(12) United States Patent
Weinstock et al.

(10) Patent No.: US 7,504,490 B1
(45) Date of Patent: Mar. 17, 2009

(54) **NUCLEIC ACID AND AMINO ACID SEQUENCES RELATING TO *APERGILLUS FUMIGATUS* FOR DIAGNOSTICS AND THERAPEUTICS**

(75) Inventors: Keith G. Weinstock, Westborough, MA (US); David Bush, Somerville, MA (US)

(73) Assignee: Oscient Pharmaceuticals Corporation, Waltham, MA (US)

( * ) Notice: Subject to any disclaimer, the term of this patent is extended or adjusted under 35 U.S.C. 154(b) by 0 days.

(21) Appl. No.: 09/417,507

(22) Filed: Oct. 14, 1999

Related U.S. Application Data

(60) Provisional application No. 60/113,476, filed on Dec. 21, 1998, provisional application No. 60/104,683, filed on Oct. 16, 1998.

(51) Int. Cl.
*C07H 21/02* (2006.01)
*C07H 21/04* (2006.01)
*C12N 1/20* (2006.01)
*C12N 15/00* (2006.01)
*C12N 15/09* (2006.01)

(52) U.S. Cl. .................... 536/23.1; 536/24.3; 435/69.3; 435/252.3; 435/320.1

(58) Field of Classification Search ............... 536/23.1, 536/24.3; 435/69.3, 252.3, 320.1; 514/44
See application file for complete search history.

(56) References Cited

U.S. PATENT DOCUMENTS 5,312,746 A * 5/1994 Longo et al. ............... 435/193

OTHER PUBLICATIONS

Plotkin et al (Vaccines W.B. Saunders Company, 1988, p. 571).*

* cited by examiner

*Primary Examiner*—Mark Navarro

(57) ABSTRACT

The invention provides isolated polypeptide and nucleic acid sequences derived from *Aspergillus fumigatus* that are useful in diagnosis and therapy of pathological conditions; antibodies against the polypeptides; and methods for the production of the polypeptides. The invention also provides methods for the detection, prevention and treatment of pathological conditions resulting from fungal infection.

9 Claims, No Drawings

NUCLEIC ACID AND AMINO ACID SEQUENCES RELATING TO *APERGILLUS FUMIGATUS* FOR DIAGNOSTICS AND THERAPEUTICS

RELATED APPLICATIONS

This application claims the benefit of U.S. Provisional Application Ser. No. 60/104,683, filed Oct. 16, 1998 and also claims the benefit of U.S. Provisional Application Ser. No. 60/113,476, filed Dec. 21, 1998, the entire teachings both of which are incorporated herein by reference.

BACKGROUND OF THE INVENTION

Significant increases in the occurrence of cases of aspergillosis have occurred since the first reported case of invasive aspergillosis in 1953 (Rankin, N E (1953) *Br. Med. J.* 183: 918-919; reviewed in Denning, D W (1998) *Clin. Infect. Dis.* 26: 781-803). This increase correlates with the increasing numbers of immunocompromised patients, including AIDS (Acquired Immune Deficiency Syndrome) and organ transplant patients taking immunosuppressant drugs to prevent organ rejection. Although *Aspergillus* is generally considered an opportunistic pathogen, invasive aspergillosis has been documented from immunocompetent patients as well (Denning D W, Stevens D A (1990) *Rev. Infect. Dis.* 12: 1147-1202; Bodey G P, Vartivarian S (1989) *Eur. J. Clin. Microbiol. Infect. Dis.* 8: 413-437). *Aspergillus* species causes a wide spectrum of disease conditions ranging from superficial cutaneous infections to life-threatening systemic mycoses. Mortality rates can approach 100% in invasive aspergillosis (Denning D W (1996) *Clin. Infect. Dis.* 23 608-615) However, only a few species of the fungal genus *Aspergillus* are found as human pathogens (Denning, D W (1998) *Clin. Infect. Dis.* 26: 781-803) and *A. fumigatus* is among the most common of these. *A. fumigatus* is a soil-borne fungus typically associated with decaying organic matter (Mullins J, Harvey R, Seaton A. (1976) *Clin. Allergy* 6: 209-217) although it is likely that is ubiquitous in the environment due to the airborne distribution of its spores. A Southern hybridization study of the genetic diversity of *A. fumigatus* isolates from both clinical specimens and from the environment suggests that most if not all strains of *A. fumigatus* are capable of becoming opportunistic pathogens (Debeaupuis J P et al (1997) *Infect. Immun.* 65: 3080-3085). Potential allergen-encoding genes in *A. fumigatus* have been isolated using M13 phage display and screening with IgE from patients allergic to *A. fumigatus* (Crameri R et al (1998) *Int. Immunol.* 10: 1211-1216; Crameri R (1998) *Int. Arch. Allergy Immunol.* 115: 99-114; Crameri R, Blaser K (1996) *Int. Arch. Allergy Immunol.* 110: 41-45).

A number of molecules have been suggested to have a role in virulence. *A. fumigatus* produces a number of extracellular toxins, such as gliotoxin (Mullbacher A, Eichner R D (1984) *Proc. Natl. Acad. Sci. U.S.A.* 81: 3835-3837; Mullbacher A, Waring P, Eichner R D (1985) *J. Gen. Microbiol.* 131: 1251-1258 and restrictocin (Lamy B, Davies J (1991) *Nucl. Acids Res.* 19: 1001-1006; Lamy B, Moutaouakil M., Latge J, and Davies J (1991) *Mol. Microbiol.* 5: 1811-1815). In a mouse model, however, deletions of the *A. fumigatus* restrictocin toxin gene had no effect on virulence relative to the wild type gene (Smith J M, Davies J E, Holden D W (1993) *Mol. Microbiol.* 9:1071-1077; Holden D W, Tang C M, Smith J M (1994) *Antonie van Leeuwenhoek* 65: 251-255). Gliotoxin is known to act as an immunosuppressant in vivo (Sutton P, Newcombe N R, Waring P, Mullbacher A (1994) *Infect. Immun.* 62: 1192-1198) possibly through the inhibition of the activation of the transcription factor NF-kappaB (Pahl H L et al (1996) *J. Exp. Med.* 183: 1829-1840), but its role in pathogenesis is still unproven (Waring P, Mullbacher A (1994) *Infect. Immun.* 62: 1192-1198). Additional toxins are known from *A. fumigatus* (Moss M O (1994) in Powell K A, Perberdy J F, and Renwick A, editors. *The genus Aspergillus*. New York. Plenum Press. pp. 29-50).

Additional potential virulence factors have been suggested, including extracellular proteases (reviewed in Denning, D W (1998) *Clin. Infect. Dis.* 26: 781-803). However, deletion of AFA1, an extracellular alkaline protease with elastase activity, had no effect on pathogenicity (Holden D W, Tang C M, and Smith J M (1994) *Antonie van Leeuwenhoek* 65: 251-255). Genes encoding ATP-binding cassette proteins (AfuMDR1 and AfuMDR2) have been isolated from *A. fumigatus* using degenerate PCR primers (Tobin M B, Peery R B, Skatrud P L (1997) *Gene* 200: 11-23). These proteins have similarities to multiple drug resistance genes from other organisms. Increased resistance to two antifungal agents was observed when the AfuMDR1 gene was expressed in *S. cerevisiae*.

Only two antifungals, itraconazole and amphotericin B, are currently used to treat invasive aspergillosis (Denning D W (1998) *Clin. Infect. Dis.* 26: 781-803). Fluconazole, which is effective against other fungal infections including those of *Candida albicans*, is ineffective against *Aspergillus* clinical isolates (Dermoumi H (1994) *Chemotherapy* 40: 92-98). Isolates of *Aspergillus fumigatus* resistant to itraconazole have been reported (Denning D W et al (1997) *Antimicrob. Agents Chemother.* 41: 1364-1368). Resistance to amphotericin B after itraconazole therapy (Schaffner A, Bohler A (1993) *Mycoses* 36: 421-424) has also been reported and this is not due to direct antagonism between the drugs as the itraconazole treatment was stopped prior to amphotericin B treatment. In vitro studies demonstrate that amphotericin B-resistant strains can be readily produced in the laboratory (Manavathu E K, Alangaden G J, Chandrasekar P H (1998) *J. Antimicrob. Chemother.* 41:615-619) and in vivo resistance of *A. fumigatus* to amphotericin B in mice has been demonstrated (Verweij P E (1998) *Antimicrob. Agents Chemother.* 42: 873-878).

The severity and difficulty in diagnosing *A. fumigatus* infections, the limited number of effective antifungals for treatment of infections, and the development of antifungal-resistant *A. fumigatus* strains provide the rationale for the identification of targets for more rapid and effective methods of identification, prevention, and treatment of aspergillosis. The elucidation of the genome of *A. fumigatus* would enhance the understanding of how *A. fumigatus*, as well as other fungi, causes invasive disease and how best to combat fungal infection.

SUMMARY OF THE INVENTION

The present invention fulfills the need for diagnostic tools and therapeutics by providing fungal-specific compositions and methods for detecting *Aspergillus* species including *A. fumigatus*, as well as compositions and methods useful for treating and preventing *Aspergillus* infection, in particular, *A. fumigatus* infection, in vertebrates including mammals.

The present invention encompasses isolated nucleic acids and polypeptides derived from *A. fumigatus* that are useful as reagents for diagnosis of fungal disease, components of effective antifungal vaccines, and/or as targets for antifungal drugs including anti-*A. fumigatus* drugs. They can also be used to detect the presence of *A. fumigatus* and other *Aspergillus* species in a sample; and in screening compounds for the ability to interfere with the *A. fumigatus* life cycle or to inhibit *A. fumigatus* infection. They also have use as biocontrol agents for plants.

In one aspect, the invention features compositions of nucleic acids corresponding to entire coding sequences of *A. fumigatus* proteins, including surface or secreted proteins or parts thereof, nucleic acids capable of binding mRNA from *A. fumigatus* proteins to block protein translation, and methods for producing *A. fumigatus* proteins or parts thereof using peptide synthesis and recombinant DNA techniques. This invention also features antibodies and nucleic acids useful as probes to detect *A. fumigatus* infection. In addition, vaccine compositions and methods for the protection or treatment of infection by *A. fumigatus* are within the scope of this invention.

The nucleotide sequences provided in SEQ ID NO: 1-SEQ ID NO: 22156, a fragment thereof, or a nucleotide sequence at least about 99.5% identical to a sequence contained within SEQ ID NO: 1-SEQ ID NO: 22156 may be "provided" in a variety of medias to facilitate use thereof. As used herein, "provided" refers to a manufacture, other than an isolated nucleic acid molecule, which contains a nucleotide sequence of the present invention, i.e., the nucleotide sequence provided in SEQ ID NO: 1-SEQ ID NO: 22156, a fragment thereof, or a nucleotide sequence at least about 99.5% identical to a sequence contained within SEQ ID NO: 1-SEQ ID NO: 22156. Uses for and methods for providing nucleotide sequences in a variety of media is well known in the art (see e.g., EPO Publication No. EP 0 756 006).

In one application of this embodiment, a nucleotide sequence of the present invention can be recorded on computer readable media. As used herein, "computer readable media" refers to any media which can be read and accessed directly by a computer. Such media include, but are not limited to: magnetic storage media, such as floppy discs, hard disc storage media, and magnetic tape; optical storage media such as CD-ROM; electrical storage media such as RAM and ROM; and hybrids of these categories such as magnetic/optical storage media. A person skilled in the art can readily appreciate how any of the presently known computer readable media can be used to create a manufacture comprising computer readable media having recorded thereon a nucleotide sequence of the present invention.

As used herein, "recorded" refers to a process for storing information on computer readable media. A person skilled in the art can readily adopt any of the presently known methods for recording information on computer readable media to generate manufactures comprising the nucleotide sequence information of the present invention.

A variety of data storage structures are available to a person skilled in the art for creating a computer readable media having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable media. The sequence information can be represented in a word processing text file, formatted in commercially-available software such as WordPerfect and Microsoft Word, or represented in the form of an ASCII file, stored in a database application, such as DB2, Sybase, Oracle, or the like. A person skilled in the art can readily adapt any number of data processor structuring formats (e.g. text file or database) in order to obtain computer readable media having recorded thereon the nucleotide sequence information of the present invention.

By providing the nucleotide sequence of SEQ ID NO: 1-SEQ ID NO: 22156, a fragment thereof, or a nucleotide sequence at least about 99.5% identical to SEQ ID NO: 1-SEQ ID NO: 22156 in computer readable form, a person skilled in the art can routinely access the coding sequence information for a variety of purposes. Computer software is publicly available which allows a person skilled in the art to access sequence information provided in a computer readable media. Examples of such computer software include programs of the "Staden Package", "DNA Star", "MacVector", GCG "Wisconsin Package" (Genetics Computer Group, Madison, Wis.) and "NCBI Toolbox" (National Center For Biotechnology Information). Suitable programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997).

Computer algorithms enable the identification of *A. fumigatus* open reading frames (ORFs) within SEQ ID NO: 1-SEQ ID NO: 22156 which contain homology to ORFs or proteins from other organisms. Examples of such similarity-search algorithms include the BLAST [Altschul et al., J. Mol. Biol. 215:403-410 (1990)] and Smith-Waterman [Smith and Waterman (1981) Advances in Applied Mathematics, 2:482-489] search algorithms. Suitable search algorithms are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997). Such algorithms are utilized on computer systems as exemplified below. The ORFs so identified represent protein encoding fragments within the *A. fumigatus* genome and are useful in producing commercially important proteins such as enzymes used in fermentation reactions and in the production of commercially useful metabolites.

The present invention further provides systems, particularly computer-based systems, which contain the sequence information described herein. Such systems are designed to identify commercially important fragments of the *A. fumigatus* genome. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A person skilled in the art can readily appreciate that any one of the currently available computer-based systems is suitable for use in the present invention. The computer-based systems of the present invention comprise a data storage means having stored therein a nucleotide sequence of the present invention and the necessary hardware means and software means for supporting and implementing a search means. As used herein, "data storage means" refers to memory which can store nucleotide sequence information of the present invention, or a memory access means which can access manufactures having recorded thereon the nucleotide sequence information of the present invention.

As used herein, "search means" refers to one or more programs which are implemented on the computer-based system to compare a target sequence or target structural motif with the sequence information stored within the data storage means. Search means are used to identify fragments or regions of the *A. fumigatus* genome which are similar to, or "match", a particular target sequence or target motif. A variety of known algorithms are known in the art and have been disclosed publicly, and a variety of commercially available software for conducting homology-based similarity searches are available and can be used in the computer-based systems of the present invention. Examples of such software includes, but is not limited to, FASTA (GCG Wisconsin Package), Bic_SW (Compugen Bioccelerator), BLASTN2, BLASTP2, BLASTX2 (NCBI) and Motifs (GCG). Suitable software programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997). A person skilled in the art can readily recognize that any one of the available algorithms or implementing software packages for conducting homology searches can be adapted for use in the present computer-based systems.

As used herein, a "target sequence" can be any DNA or amino acid sequence of six or more nucleotides or two or more amino acids. A person skilled in the art can readily recognize that the longer a target sequence is, the less likely a target sequence will be present as a random occurrence in the database. The most preferred sequence length of a target sequence is from about 10 to 100 amino acids or from about 30 to 300 nucleotide residues. However, it is well recognized that many genes are longer than 500 amino acids, or 1.5 kb in length, and that commercially important fragments of the *A. fumigatus* genome, such as sequence fragments involved in gene expression and protein processing, will often be shorter than 30 nucleotides.

As used herein, "a target structural motif," or "target motif," refers to any rationally selected sequence or combination of sequences in which the sequence(s) are chosen based on a specific functional domain or three-dimensional configuration which is formed upon the folding of the target polypeptide. There are a variety of target motifs known in the art. Protein target motifs include, but are not limited to, enzymatic active sites, membrane-spanning regions, and signal sequences. Nucleic acid target motifs include, but are not limited to, promoter sequences, hairpin structures and inducible expression elements (protein binding sequences).

A variety of structural formats for the input and output means can be used to input and output the information in the computer-based systems of the present invention. A preferred format for an output means ranks fragments of the *A. fumigatus* genome possessing varying degrees of homology to the target sequence or target motif. Such presentation provides a person skilled in the art with a ranking of sequences which contain various amounts of the target sequence or target motif and identifies the degree of homology contained in the identified fragment.

A variety of comparing means can be used to compare a target sequence or target motif with the data storage means to identify sequence fragments of the *A. fumigatus* genome. In the present examples, implementing software which implement the BLASTP2 and bic_SW algorithms (Altschul et al., J. Mol. Biol. 215:403-410 (1990); Compugen Biocellerator) was used to identify open reading frames within the *A. fumigatus* genome. A person skilled in the art can readily recognize that any one of the publicly available homology search programs can be used as the search means for the computer-based systems of the present invention. Suitable programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997).

The invention features *A. fumigatus* polypeptides, preferably a substantially pure preparation of an *A. fumigatus* polypeptide, or a recombinant *A. fumigatus* polypeptide. In preferred embodiments: the polypeptide has biological activity; the polypeptide has an amino acid sequence at least about 60%, 70%, 80%, 90%, 95%, 98%, or 99% identical to an amino acid sequence of the invention contained in the Sequence Listing, preferably it has about 65% sequence identity with an amino acid sequence of the invention contained in the Sequence Listing, and most preferably it has about 92% to about 99% sequence identity with an amino acid sequence of the invention contained in the Sequence Listing; the polypeptide has an amino acid sequence essentially the same as an amino acid sequence of the invention contained in the Sequence Listing; the polypeptide is at least about 5, 10, 20, 50, 100, or 150 amino acid residues in length; the polypeptide includes at least about 5, preferably at least about 10, more preferably at least about 20, still more preferably at least about 50, 100, or 150 contiguous amino acid residues of the invention contained in the Sequence Listing. In yet another preferred embodiment, the amino acid sequence which differs in sequence identity by about 7% to about 8% from the *A. fumigatus* amino acid sequences of the invention contained in the Sequence Listing is also encompassed by the invention.

In preferred embodiments: the *A. fumigatus* polypeptide is encoded by a nucleic acid of the invention contained in the Sequence Listing, or by a nucleic acid having at least about 60%, 70%, 80%, 90%, 95%, 98%, or 99% homology with a nucleic acid of the invention contained in the Sequence Listing.

In a preferred embodiment, the subject *A. fumigatus* polypeptide differs in amino acid sequence at about 1, 2, 3, 5, 10 or more residues from a sequence of the invention contained in the Sequence Listing. The differences, however, are such that the *A. fumigatus* polypeptide exhibits an *A. fumigatus* biological activity, e.g., the *A. fumigatus* polypeptide retains a biological activity of a naturally occurring *A. fumigatus* enzyme.

In preferred embodiments, the polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

In yet other preferred embodiments, the *A. fumigatus* polypeptide is a recombinant fusion protein having a first *A. fumigatus* polypeptide portion and a second polypeptide portion, e.g., a second polypeptide portion having an amino acid sequence unrelated to *A. fumigatus*. The second polypeptide portion can be, e.g., any of glutathione-S-transferase, a DNA binding domain, or a polymerase activating domain. In preferred embodiment the fusion protein can be used in a two-hybrid assay.

Polypeptides of the invention include those which arise as a result of alternative transcription events, alternative RNA splicing events, and alternative translational and postranslational events.

In a preferred embodiment, the encoded *A. fumigatus* polypeptide differs (e.g., by amino acid substitution, addition or deletion of at least one amino acid residue) in amino acid sequence at about 1, 2, 3, 5, 10 or more residues, from a sequence of the invention contained in the Sequence Listing.

The differences, however, are such that: the *A. fumigatus* encoded polypeptide exhibits an *A. fumigatus* biological activity, e.g., the encoded *A. fumigatus* enzyme retains a biological activity of a naturally occurring *A. fumigatus*.

In preferred embodiments, the encoded polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

The *A. fumigatus* strain, ND158, from which genomic sequences have been sequenced, has been deposited in the American Type Culture Collection and assigned the ATCC designation #201795.

Included in the invention are: allelic variations; natural mutants; induced mutants; proteins encoded by DNA that hybridize under high or low stringency conditions to a nucleic acid which encodes a polypeptide of the invention contained in the Sequence Listing (for definitions of high and low stringency see Current Protocols in Molecular Biology, John Wiley & Sons, New York, 1989, 6.3.1-6.3.6, hereby incorporated by reference); and, polypeptides specifically bound by antisera to *A. fumigatus* polypeptides, especially by antisera to an active site or binding domain of *A. fumigatus* polypeptide. The invention also includes fragments, preferably biologically active fragments. These and other polypeptides are also referred to herein as *A. fumigatus* polypeptide analogs or variants.

The invention further provides nucleic acids, e.g., RNA or DNA, encoding a polypeptide of the invention. This includes double stranded nucleic acids as well as coding and antisense single strands.

In preferred embodiments, the subject *A. fumigatus* nucleic acid will include a transcriptional regulatory sequence, e.g., at least one of a transcriptional promoter or transcriptional enhancer sequence, operably linked to the *A. fumigatus* gene sequence, e.g., to render the *A. fumigatus* gene sequence suitable for expression in a recombinant host cell.

In yet a further preferred embodiment, the nucleic acid which encodes an *A. fumigatus* polypeptide of the invention, hybridizes under stringent conditions to a nucleic acid probe corresponding to at least about 8 consecutive nucleotides of the invention contained in the Sequence Listing; more preferably to at least about 12 consecutive nucleotides of the invention contained in the Sequence Listing; still more preferably to at least about 20 consecutive nucleotides of the invention contained in the Sequence Listing; most preferably to at least about 40 consecutive nucleotides of the invention contained in the Sequence Listing.

In another aspect, the invention provides a substantially pure nucleic acid having a nucleotide sequence which encodes an *A. fumigatus* polypeptide. In preferred embodiments: the encoded polypeptide has biological activity; the encoded polypeptide has an amino acid sequence at least about 60%, 70%, 80%, 90%, 95%, 98% or 99% homologous to an amino acid sequence of the invention contained in the Sequence Listing; the encoded polypeptide has an amino acid sequence essentially the same as an amino acid sequence of the invention contained in the Sequence Listing; the encoded polypeptide is at least about 5, 10, 20, 50, 100, or 150 amino acids in length; the encoded polypeptide comprises at least about 5, preferably at least about 10, more preferably at least about 20, still more preferably at least about 50, 100, or 150 contiguous amino acids of the invention contained in the Sequence Listing.

In another aspect, the invention encompasses: a vector including a nucleic acid which encodes an *A. fumigatus* polypeptide or an *A. fumigatus* polypeptide variant as described herein; a host cell transfected with the vector; and a method of producing a recombinant *A. fumigatus* polypeptide or *A. fumigatus* polypeptide variant; including culturing the cell, e.g., in a cell culture medium, and isolating an *A. fumigatus* or *A. fumigatus* polypeptide variant, e.g., from the cell or from the cell culture medium.

One embodiment of the invention is directed to substantially isolated nucleic acids. Nucleic acids of the invention include sequences comprising at least about 8 nucleotides in length, more preferably at least about 12 nucleotides in length, even more preferably at least about 15-20 nucleotides in length, that correspond to a subsequence of any one of SEQ ID NO: 1-SEQ ID NO: 22156 or complements thereof. Alternatively, the nucleic acids comprise sequences contained within any ORF (open reading frame), including a complete protein-coding sequence, of which any of SEQ ID NO: 1-SEQ ID NO: 22156 forms a part. The invention encompasses sequence-conservative variants and function-conservative variants of these sequences. The nucleic acids may be DNA, RNA, DNA/RNA duplexes, protein-nucleic acid (PNA), or derivatives thereof.

In another aspect, the invention features a purified recombinant nucleic acid having at least about 50%, 60%, 70%, 80%, 90%, 95%, 98%, or 99% homology with a sequence of the invention contained in the Sequence Listing The invention also encompasses recombinant DNA (including DNA cloning and expression vectors) comprising these *A. fumigatus*-derived sequences; host cells comprising such DNA, including fungal, bacterial, yeast, plant, insect, and mammalian host cells; and methods for producing expression products comprising RNA and polypeptides encoded by the *A. fumigatus* sequences. These methods are carried out by incubating a host cell comprising an *A. fumigatus*-derived nucleic acid sequence under conditions in which the sequence is expressed. The host cell may be native or recombinant. The polypeptides can be obtained by (a) harvesting the incubated cells to produce a cell fraction and a medium fraction; and (b) recovering the *A. fumigatus* polypeptide from the cell fraction, the medium fraction, or both. The polypeptides can also be made by in vitro translation.

In another aspect, the invention features nucleic acids capable of binding mRNA of *A. fumigatus*. Such nucleic acid is capable of acting as antisense nucleic acid to control the translation of mRNA of *A. fumigatus*. A further aspect features a nucleic acid which is capable of binding specifically to an *A. fumigatus* nucleic acid. These nucleic acids are also referred to herein as complements and have utility as probes and as capture reagents.

In another aspect, the invention features an expression system comprising an open reading frame corresponding to *A. fumigatus* nucleic acid. The nucleic acid further comprises a control sequence compatible with an intended host. The expression system is useful for making polypeptides corresponding to *A. fumigatus* nucleic acid.

In another aspect, the invention encompasses: a vector including a nucleic acid which encodes an *A. fumigatus* polypeptide or an *A. fumigatus* polypeptide variant as described herein; a host cell transfected with the vector; and a method of producing a recombinant *A. fumigatus* polypeptide or *A. fumigatus* polypeptide variant; including culturing the cell, e.g., in a cell culture medium, and isolating the *A. fumigatus* or *A. fumigatus* polypeptide variant, e.g., from the cell or from the cell culture medium.

In yet another embodiment of the invention encompasses reagents for detecting fungal infection, including *A. fumigatus* infection, which comprise at least one *A. fumigatus*-derived nucleic acid defined by any one of SEQ ID NO: 1-SEQ ID NO: 22156, or sequence-conservative or function-conservative variants thereof. Alternatively, the diagnostic reagents comprise nucleotide sequences that are contained within any open reading frames (ORFs), including preferably complete protein-coding sequences, contained within any of SEQ ID NO: 1-SEQ ID NO: 22156, or polypeptide sequences contained within any of SEQ ID NO: 22157-SEQ ID NO: 44266, or polypeptides of which any of the above sequences forms a part, or antibodies directed against any of the above peptide sequences or function-conservative variants and/or fragments thereof.

The invention further provides antibodies, preferably monoclonal antibodies, which specifically bind to the polypeptides of the invention. Methods are also provided for producing antibodies in a host animal. The methods of the invention comprise immunizing an animal with at least one *A. fumigatus*-derived immunogenic component, wherein the immunogenic component comprises one or more of the polypeptides encoded by any one of SEQ ID NO: 1-SEQ ID NO: 22156 or sequence-conservative or function-conservative variants thereof; or polypeptides that are contained within any ORFs, including complete protein-coding sequences, of which any of SEQ ID NO: 1-SEQ ID NO: 22156 forms a part; or polypeptide sequences contained within any of SEQ ID NO: 22157-SEQ ID NO: 44266; or polypeptides of which any of SEQ ID NO: 22157-SEQ ID NO: 44266 forms a part. Host animals include any warm blooded animal, including without limitation mammals and birds. Such antibodies have utility as reagents for immunoassays to evaluate the abundance and distribution of *A. fumigatus*-specific antigens.

In yet another aspect, the invention provides diagnostic methods for detecting *A. fumigatus* antigenic components or anti-*A. fumigatus* antibodies in a sample. *A. fumigatus* antigenic components may be detected by known processes, including but not limited to detection by a process comprising: (i) contacting a sample suspected to contain a fungal antigenic component with a fungal-specific antibody, under conditions in which a stable antigen-antibody complex can form between the antibody and fungal antigenic components in the sample; and (ii) detecting any antigen-antibody complex formed in step (i), wherein detection of an antigen-antibody complex indicates the presence of at least one fungal antigenic component in the sample. In different embodiments of this method, the antibodies used are directed against a sequence encoded by any of SEQ ID NO: 1-SEQ ID NO: 22156 or sequence-conservative or function-conservative variants thereof, or against a polypeptide sequence contained in any of SEQ ID NO: 22157-SEQ ID NO: 44266 or function-conservative variants thereof.

In yet another aspect, the invention provides a method for detecting antifungal-specific antibodies in a sample, which comprises: (i) contacting a sample suspected to contain anti-fungal-specific antibodies with an *A. fumigatus* antigenic component, under conditions in which a stable antigen-antibody complex can form between the *A. fumigatus* antigenic component and antifungal antibodies in the sample; and (ii) detecting any antigen-antibody complex formed in step (i), wherein detection of an antigen-antibody complex indicates the presence of antifungal antibodies in the sample. In different embodiments of this method, the antigenic component is encoded by a sequence contained in any of SEQ ID NO: 1-SEQ ID NO: 22156 or sequence-conservative and function-conservative variants thereof, or is a polypeptide sequence contained in any of SEQ ID NO: 22157-SEQ ID NO: 44266 or function-conservative variants thereof.

In another aspect, the invention features a method of generating vaccines for immunizing an individual against *A. fumigatus*. The method includes: immunizing a subject with an *A. fumigatus* polypeptide, e.g., a surface or secreted polypeptide, or a combination of such peptides or active portion(s) thereof, and a pharmaceutically acceptable carrier. Such vaccines have therapeutic and prophylactic utilities.

In another aspect, the invention features a method of evaluating a compound, e.g., a polypeptide, e.g., a fragment of a host cell polypeptide, for the ability to bind an *A. fumigatus* polypeptide. The method includes contacting the compound to be evaluated with an *A. fumigatus* polypeptide and determining if the compound binds or otherwise interacts with the *A. fumigatus* polypeptide. Compounds which bind or otherwise interact with *A. fumigatus* polypeptides are candidates as modulators, including activators and inhibitors, of the fungal life cycle. These assays can be performed in vitro or in vivo.

In another aspect, the invention features a method of evaluating a compound, e.g., a polypeptide, e.g., a fragment of a host cell polypeptide, for the ability to bind an *A. fumigatus* nucleic acid, e.g., DNA or RNA. The method includes contacting the compound to be evaluated with an *A. fumigatus* nucleic acid and determining if the compound binds or otherwise interacts with the *A. fumigatus* nucleic acid. Compounds which bind *A. fumigatus* are candidates as modultors, including activators and inhibitors, of the fungal life cycle. These assays can be performed in vitro or in vivo.

A particularly preferred embodiment of the invention is directed to a method of screening test compounds for antifungal activity, which method comprises: selecting as a target a fungal specific sequence, which sequence is essential to the viability of a fungal species; contacting a test compound with said target sequence; and selecting those test compounds which bind to said target sequence as potential anti-fungal candidates. In one embodiment, the target sequence selected is specific to a single species, or even a single strain, such as, for example, the strain *A. fumigatus* ND128. In a second embodiment, the target sequence is common to at least two species of bacteria. In a third embodiment, the target sequence is common to a family of bacteria. The target sequence may be a nucleic acid sequence or a polypeptide sequence. Methods employing sequences common to more than one species of microorganism may be used to screen candidates for broad spectrum anti-fungal activity.

The invention also provides methods for preventing or treating disease caused by certain bacteria, including *A. fumigatus*, which are carried out by administering to an animal in need of such treatment, in particular a warm-blooded vertebrate, including but not limited to birds and mammals, a compound that specifically inhibits or interferes with the function of a fungal polypeptide or nucleic acid. In a particularly preferred embodiment, the mammal to be treated is human.

DETAILED DESCRIPTION OF THE INVENTION

The sequences of the present invention include the specific nucleic acid and amino acid sequences set forth in the Sequence Listing that forms a part of the present specification, and which are designated SEQ ID NO: 1-SEQ ID NO: 44266. Use of the terms "SEQ ID NO: 1-SEQ ID NO: 22156", "SEQ ID NO: 22157-SEQ ID NO: 44266, "the sequences depicted in Table 2", etc., is intended, for convenience, to refer to each individual SEQ ID NO individually, and is not intended to refer to the genus of these sequences unless such reference would be indicated. In other words, it is a shorthand for listing all of these sequences individually. The invention encompasses each sequence individually, as well as any combination thereof.

DEFINITIONS

"Nucleic acid" or "polynucleotide" as used herein refers to purine- and pyrimidine-containing polymers of any length, either polyribonucleotides or polydeoxyribonucleotides or mixed polyribo-polydeoxyribo nucleotides. This includes single- and double-stranded molecules, i.e., DNA-DNA, DNA-RNA and RNA-RNA hybrids, as well as "protein nucleic acids" (PNA) formed by conjugating bases to an amino acid backbone. This also includes nucleic acids containing modified bases.

A nucleic acid or polypeptide sequence that is "derived from" a designated sequence refers to a sequence that corresponds to a region of the designated sequence. For nucleic acid sequences, this encompasses sequences that are homologous or complementary to the sequence, as well as "sequence-conservative variants" and "function-conservative variants." For polypeptide sequences, this encompasses "function-conservative variants." Sequence-conservative variants are those in which a change of one or more nucleotides in a given codon position results in no alteration in the amino acid encoded at that position. Function-conservative variants are those in which a given amino acid residue in a polypeptide has been changed without altering the overall conformation and function of the native polypeptide, including, but not limited to, replacement of an amino acid with one having similar physico-chemical properties (such as, for example, acidic, basic, hydrophobic, and the like). "Function-conservative" variants also include any polypeptides that have the ability to elicit antibodies specific to a designated polypeptide.

An "A. fumigatus-derived" nucleic acid or polypeptide sequence may or may not be present in other fungal species, and may or may not be present in all A. fumigatus strains. This term is intended to refer to the source from which the sequence was originally isolated. Thus, an A. fumigatus-derived polypeptide, as used herein, may be used, e.g., as a target to screen for a broad spectrum antifungal agent, to search for homologous proteins in other species of bacteria or in eukaryotic organisms such as bacteria humans, etc.

A purified or isolated polypeptide or a substantially pure preparation of a polypeptide are used interchangeably herein and, as used herein, mean a polypeptide that has been separated from other proteins, lipids, and nucleic acids with which it naturally occurs. Preferably, the polypeptide is also separated from substances, e.g., antibodies or gel matrix, e.g., polyacrylamide, which are used to purify it. Preferably, the polypeptide constitutes at least about 10, 20, 50 70, 80 or 95% dry weight of the purified preparation. Preferably, the preparation contains sufficient polypeptide to allow protein sequencing; at least about 1, 10, or preferably 100 mg of polypeptide.

A purified preparation of cells refers to, in the case of plant or animal cells, an in vitro preparation of cells and not an entire intact plant or animal. In the case of cultured cells or microbial cells, it consists of a preparation of at least about 10%, more preferably at least about 50%, of the subject cells.

A purified or isolated or a substantially pure nucleic acid, e.g., a substantially pure DNA, (are terms used interchangeably herein) is a nucleic acid which is one or both of the following: not immediately contiguous with both of the coding sequences with which it is immediately contiguous (i.e., one at the 5' end and one at the 3' end) in the naturally-occurring genome of the organism from which the nucleic acid is derived; or which is substantially free of a nucleic acid with which it occurs in the organism from which the nucleic acid is derived. The term includes, for example, a recombinant DNA which is incorporated into a vector, e.g., into an autonomously replicating plasmid or virus, or into the genomic DNA of a prokaryote or eukaryote, or which exists as a separate molecule (e.g., a cDNA or a genomic DNA fragment produced by PCR or restriction endonuclease treatment) independent of other DNA sequences. Substantially pure DNA also includes a recombinant DNA which is part of a hybrid gene encoding additional *A. fumigatus* DNA sequence.

A "contig" as used herein is a nucleic acid representing a continuous stretch of genomic sequence of an organism.

An "open reading frame", also referred to herein as ORF, is a region of nucleic acid which encodes a polypeptide. This region may represent a portion of a coding sequence or a total sequence and can be determined from a stop to stop codon or from a start to stop codon.

As used herein, a "coding sequence" is a nucleic acid which is transcribed into messenger RNA and/or translated into a polypeptide when placed under the control of appropriate regulatory sequences. The boundaries of the coding sequence are determined by a translation start codon at the five prime terminus and a translation stop code at the three prime terminus. A coding sequence can include but is not limited to messenger RNA, synthetic DNA, and recombinant nucleic acid sequences.

A "complement" of a nucleic acid as used herein refers to an anti-parallel or antisense sequence that participates in Watson-Crick base-pairing with the original sequence.

A "gene product" is a protein or structural RNA which is specifically encoded by a gene.

As used herein, the term "probe" refers to a nucleic acid, peptide or other chemical entity which specifically binds to a molecule of interest. Probes are often associated with or capable of associating with a label. A label is a chemical moiety capable of detection. Typical labels comprise dyes, radioisotopes, luminescent and chemiluminescent moieties, fluorophores, enzymes, precipitating agents, amplification sequences, and the like. Similarly, a nucleic acid, peptide or other chemical entity which specifically binds to a molecule of interest and immobilizes such molecule is referred herein as a "capture ligand". Capture ligands are typically associated with or capable of associating with a support such as nitrocellulose, glass, nylon membranes, beads, particles and the like. The specificity of hybridization is dependent on conditions such as the base pair composition of the nucleotides, and the temperature and salt concentration of the reaction. These conditions are readily discernable to one of ordinary skill in the art using routine experimentation.

"Homologous" refers to the sequence similarity or sequence identity between two polypeptides or between two nucleic acid molecules. When a position in both of the two compared sequences is occupied by the same base or amino acid monomer subunit, e.g., if a position in each of two DNA molecules is occupied by adenine, then the molecules are homologous at that position. The percent of homology between two sequences is a function of the number of matching or homologous positions shared by the two sequences divided by the number of positions compared×100. For example, if 6 of 10 of the positions in two sequences are matched or homologous then the two sequences are 60% homologous. By way of example, the DNA sequences ATTGCC and TATGGC share 50% homology. Generally, a comparison is made when two sequences are aligned to give maximum homology.

Nucleic acids are hybridizable to each other when at least one strand of a nucleic acid can anneal to the other nucleic acid under defined stringency conditions. Stringency of hybridization is determined by: (a) the temperature at which hybridization and/or washing is performed; and (b) the ionic strength and polarity of the hybridization and washing solutions. Hybridization requires that the two nucleic acids contain complementary sequences; depending on the stringency of hybridization, however, mismatches may be tolerated. Typically, hybridization of two sequences at high stringency (such as, for example, in a solution of 0.5×SSC, at 65° C.) requires that the sequences be essentially completely homologous. Conditions of intermediate stringency (such as, for example, 2×SSC at 65° C.) and low stringency (such as, for example 2×SSC at 55° C.) require correspondingly less overall complementarity between the hybridizing sequences. (1×SSC is 0.15 M NaCl, 0.015 M Na citrate).

The terms peptides, proteins, and polypeptides are used interchangeably herein.

As used herein, the term "surface protein" refers to all surface accessible proteins, e.g. inner and outer membrane proteins, proteins adhering to the cell wall, and secreted proteins.

A polypeptide has A. fumigatus biological activity if it has one, two or preferably more of the following properties: (1) if when expressed in the course of an A. fumigatus infection, it can promote, or mediate the attachment of A. fumigatus to a cell; (2) it has an enzymatic activity, structural or regulatory function characteristic of an A. fumigatus protein; (3) the gene which encodes it can rescue a lethal mutation in an A. fumigatus gene. A polypeptide has biological activity if it is an antagonist, agonist, or super-agonist of a polypeptide having one of the above-listed properties.

A biologically active fragment or analog is one having an in vivo or in vitro activity which is characteristic of the A. fumigatus polypeptides of the invention contained in the Sequence Listing, or of other naturally occurring A. fumigatus polypeptides, e.g., one or more of the biological activities described herein. Especially preferred are fragments which exist in vivo, e.g., fragments which arise from post transcriptional processing or which arise from translation of alternatively spliced RNA's. Fragments include those expressed in native or endogenous cells as well as those made in expression systems, e.g., in CHO (Chinese Hamster Ovary) cells. Because peptides such as A. fumigatus polypeptides often exhibit a range of physiological properties and because such properties may be attributable to different portions of the molecule, a useful A. fumigatus fragment or A. fumigatus analog is one which exhibits a biological activity in any biological assay for A. fumigatus activity. The fragment or analog possesses about 10%, preferably about 40%, more preferably about 60%, 70%, 80% or 90% or greater of the activity of A. fumigatus, in any in vivo or in vitro assay.

Analogs can differ from naturally occurring A. fumigatus polypeptides in amino acid sequence or in ways that do not involve sequence, or both. Non-sequence modifications include changes in acetylation, methylation, phosphorylation, carboxylation, or glycosylation. Preferred analogs include A. fumigatus polypeptides (or biologically active fragments thereof) whose sequences differ from the wild-type sequence by one or more conservative amino acid substitutions or by one or more non-conservative amino acid substitutions, deletions, or insertions which do not substantially diminish the biological activity of the A. fumigatus polypeptide. Conservative substitutions typically include the substitution of one amino acid for another with similar characteristics, e.g., substitutions within the following groups: valine, glycine; glycine, alanine; valine, isoleucine, leucine; aspartic acid, glutamic acid; asparagine, glutamine; serine, threonine; lysine, arginine; and phenylalanine, tyrosine. Other conservative substitutions can be made in view of the table below.

TABLE 1

CONSERVATIVE AMINO ACID REPLACEMENTS

| For Amino Acid | Code | Replace with any of |
|---|---|---|
| Alanine | A | D-Ala, Gly, beta-Ala, L-Cys, D-Cys |
| Arginine | R | D-Arg, Lys, D-Lys, homo-Arg, D-homo-Arg, Met, Ile, D-Met, D-Ile, Orn, D-Orn |
| Asparagine | N | D-Asn, Asp, D-Asp, Glu, D-Glu, Gln, D-Gln |
| Aspartic Acid | D | D-Asp, D-Asn, Asn, Glu, D-Glu, Gln, D-Gln |
| Cysteine | C | D-Cys, S-Me-Cys, Met, D-Met, Thr, D-Thr |
| Glutamine | Q | D-Gln, Asn, D-Asn, Glu, D-Glu, Asp, D-Asp |
| Glutamic Acid | E | D-Glu, D-Asp, Asp, Asn, D-Asn, Gln, D-Gln |
| Glycine | G | Ala, D-Ala, Pro, D-Pro, β-Ala, Acp |
| Isoleucine | I | D-Ile, Val, D-Val, Leu, D-Leu, Met, D-Met |
| Leucine | L | D-Leu, Val, D-Val, Leu, D-Leu, Met, D-Met |
| Lysine | K | D-Lys, Arg, D-Arg, homo-Arg, D-homo-Arg, Met, D-Met, Ile, D-Ile, Orn, D-Orn |
| Methionine | M | D-Met, S-Me-Cys, Ile, D-Ile, Leu, D-Leu, Val, D-Val |
| Phenylalanine | F | D-Phe, Tyr, D-Thr, L-Dopa, His, D-His, Trp, D-Trp, Trans-3,4, or 5-phenylproline, cis-3,4, or 5-phenylproline |
| Proline | P | D-Pro, L-I-thioazolidine-4-carboxylic acid, D-or L-1-oxazolidine-4-carboxylic acid |
| Serine | S | D-Ser, Thr, D-Thr, allo-Thr, Met, D-Met, Met(O), D-Met(O), L-Cys, D-Cys |
| Threonine | T | D-Thr, Ser, D-Ser, allo-Thr, Met, D-Met, Met(O), D-Met(O), Val, D-Val |
| Tyrosine | Y | D-Tyr, Phe, D-Phe, L-Dopa, His, D-His |
| Valine | V | D-Val, Leu, D-Leu, Ile, D-Ile, Met, D-Met |

Other analogs within the invention are those with modifications which increase peptide stability; such analogs may contain, for example, one or more non-peptide bonds (which replace the peptide bonds) in the peptide sequence. Also included are: analogs that include residues other than naturally occurring L-amino acids, e.g., D-amino acids or non-naturally occurring or synthetic amino acids, e.g., β or γ amino acids; and cyclic analogs.

As used herein, the term "fragment", as applied to an A. fumigatus analog, will ordinarily be at least about 20 residues, more typically at least about 40 residues, preferably at least about 60 residues in length. Fragments of A. fumigatus polypeptides can be generated by methods known to those skilled in the art. The ability of an Aspergillus fragment to exhibit a biological activity of A. fumigatus polypeptide can be assessed by methods known to those skilled in the art as described herein. Also included are A. fumigatus polypeptides containing residues that are not required for biological activity of the peptide or that result from alternative mRNA splicing or alternative protein processing events.

An "immunogenic component" as used herein is a moiety, such as an A. fumigatus polypeptide, analog or fragment thereof, that is capable of eliciting a humoral and/or cellular immune response in a host animal.

An "antigenic component" as used herein is a moiety, such as an A. fumigatus polypeptide, analog or fragment thereof, that is capable of binding to a specific antibody with sufficiently high affinity to form a detectable antigen-antibody complex.

The term "antibody" as used herein is intended to include fragments thereof which are specifically reactive with *A. fumigatus* polypeptides.

As used herein, the term "cell-specific promoter" means a DNA sequence that serves as a promoter, i.e., regulates expression of a selected DNA sequence operably linked to the promoter, and which effects expression of the selected DNA sequence in specific cells of a tissue. The term also covers so-called "leaky" promoters, which regulate expression of a selected DNA primarily in one tissue, but cause expression in other tissues as well.

Misexpression, as used herein, refers to a non-wild type pattern of gene expression. It includes: expression at non-wild type levels, i.e., over or under expression; a pattern of expression that differs from wild type in terms of the time or stage at which the gene is expressed, e.g., increased or decreased expression (as compared with wild type) at a predetermined developmental period or stage; a pattern of expression that differs from wild type in terms of increased expression (as compared with wild type) in a predetermined cell type or tissue type; a pattern of expression that differs from wild type in terms of the splicing size, amino acid sequence, post-translational modification, or biological activity of the expressed polypeptide; a pattern of expression that differs from wild type in terms of the effect of an environmental stimulus or extracellular stimulus on expression of the gene, e.g., a pattern of increased or decreased expression (as compared with wild type) in the presence of an increase or decrease in the strength of the stimulus.

As used herein, "host cells" and other such terms denoting microorganisms or higher eukaryotic cell lines cultured as unicellular entities refers to cells which can become or have been used as recipients for a recombinant vector or other transfer DNA, and include the progeny of the original cell which has been transfected. It is understood by individuals skilled in the art that the progeny of a single parental cell may not necessarily be completely identical in genomic or total DNA compliment to the original parent, due to accident or deliberate mutation.

As used herein, the term "control sequence" refers to a nucleic acid having a base sequence which is recognized by the host organism to effect the expression of encoded sequences to which they are ligated. The nature of such control sequences differs depending upon the host organism; in prokaryotes, such control sequences generally include a promoter, ribosomal binding site, terminators, and in some cases operators; in eukaryotes, generally such control sequences include promoters, terminators and in some instances, enhancers. The term control sequence is intended to include at a minimum, all components whose presence is necessary for expression, and may also include additional components whose presence is advantageous, for example, leader sequences.

As used herein, the term "operably linked" refers to sequences joined or ligated to function in their intended manner. For example, a control sequence is operably linked to coding sequence by ligation in such a way that expression of the coding sequence is achieved under conditions compatible with the control sequence and host cell.

The "metabolism" of a substance, as used herein, means any aspect of the expression, function, action, or regulation of the substance. The metabolism of a substance includes modifications, e.g., covalent or non-covalent modifications of the substance. The metabolism of a substance includes modifications, e.g., covalent or non-covalent modification, the substance induces in other substances. The metabolism of a substance also includes changes in the distribution of the substance. The metabolism of a substance includes changes the substance induces in the distribution of other substances.

A "sample" as used herein refers to a biological sample, such as, for example, tissue or fluid isolated from an individual (including without limitation plasma, serum, cerebrospinal fluid, lymph, tears, saliva and tissue sections) or from in vitro cell culture constituents, as well as samples from the environment.

Technical and scientific terms used herein have the meanings commonly understood by one of ordinary skill in the art to which the present invention pertains, unless otherwise defined. Reference is made herein to various methodologies known to those of skill in the art. Publications and other materials setting forth such known methodologies to which reference is made are incorporated herein by reference in their entireties as though set forth in full. The practice of the invention will employ, unless otherwise indicated, conventional techniques of chemistry, molecular biology, microbiology, recombinant DNA, and immunology, which are within the skill of the art. Such techniques are explained fully in the literature. See e.g., Sambrook, Fritsch, and Maniatis, *Molecular Cloning; Laboratory Manual* 2nd ed. (1989); *DNA Cloning*, Volumes I and II (D. N Glover ed. 1985); *Oligonucleotide Synthesis* (M. J. Gait ed, 1984); *Nucleic Acid Hybridization* (B. D. Hames & S. J. Higgins eds. 1984); the series, *Methods in Enzymology* (Academic Press, Inc.), particularly Vol. 154 and Vol. 155 (Wu and Grossman, eds.); *PCR—A Practical Approach* (McPherson, Quirke, and Taylor, eds., 1991); *Immunology*, 2d Edition, 1989, Roitt et al., C. V. Mosby Company, and New York; *Advanced Immunology*, 2d Edition, 1991, Male et al., Grower Medical Publishing, New York.; *DNA Cloning: A Practical Approach*, Volumes I and II, 1985 (D. N. Glover ed.); *Oligonucleotide Synthesis*, 1984, (M. L. Gait ed); *Transcription and Translation*, 1984 (Hames and Higgins eds.); *Animal Cell Culture*, 1986 (R. I. Freshney ed.); *Immobilized Cells and Enzymes*, 1986 (IRL Press); Perbal, 1984, *A Practical Guide to Molecular Cloning; Gene Transfer Vectors for Mammalian Cells*, 1987 (J. H. Miller and M. P. Calos eds., Cold Spring Harbor Laboratory); Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997).

Any suitable materials and/or methods known to those of skill can be utilized in carrying out the present invention; however, preferred materials and/or methods are described. Materials, reagents and the like to which reference is made in the following description and examples are obtainable from commercial sources, unless otherwise noted.

*A. fumigatus* Genomic Sequence

This invention provides nucleotide sequences of the genome of *A. fumigatus* which, in a preferred embodiment, comprises a DNA sequence library of *A. fumigatus* genomic DNA. The detailed description that follows provides nucleotide sequences of *A. fumigatus*, and also describes how the sequences were obtained and how ORFs and protein-coding sequences were identified. Also described are methods of using the disclosed *A. fumigatus* sequences in methods including diagnostic and therapeutic applications. Furthermore, one or more libraries according to the present invention can be used as a database for identification and comparison of medically important sequences in this and other strains of *A. fumigatus*.

A. fumigatus DNA was isolated from cultures grown on Sabouraud Dextrose medium (Difco Manual, Tenth Edition (1984) Difco Laboratories Incorporated, Detroit, p. 768). The isolation protocol included an initial polytron homogenization, repeated freezing and boiling of the extract followed by glass bead homogenization and phenol:chloroform:iso-amyl alcohol extraction (e.g., *Methods. Enzymol.* Guide to Yeast Genetics and Molecular Biology, Volume 194, Guthrie C and Fink G R, editors, Academic Press, Inc., Boston, Cold Spring Harbor, N.Y.). The final extract was ethanol-precipitated, centrifuged, and the DNA pellet redissolved.

All subsequent steps were based on sequencing by ABI377 automated DNA sequencing methods. Only major modifications to the protocols are highlighted. Briefly, the library was transformed into DH5á competent cells (Gibco/BRL, DH5á transformation protocol). It was assessed by plating onto antibiotic plates containing ampicillin and IPTG/Xgal. The plates were incubated overnight at 37° C. Successful transformants were then used for plating of clones and picking for sequencing. The cultures were grown overnight at 37° C. DNA was purified using a silica bead DNA preparation (Engelstein, 1996) method. In this manner, 25 ug of DNA was obtained per clone.

These purified DNA samples were then sequenced using ABI dye-terminator chemistry. The ABI dye terminator sequence reads were run on ABI377 machines and the data was transferred to UNIX machines following lane tracking of the gels. All reads were assembled using PHRAP (P. Green, Abstracts of DOE Human Genome Program Contractor-Grantee Workshop V, January (1996)) with default parameters and quality scores. The initial assembly was done at 2-fold coverage and yielded 11522 contigs. Following the initial assembly, missing mates (sequences from clones that only gave one strand reads) are identified and sequenced with ABI technology to allow the identification of additional overlapping contigs. Primers for walking are selected using Pick_primer (GTC program) near the ends of the clones to facilitate gap closure. These walks are sequenced using the selected clones and primers. These data are then reassembled with PHRAP. For additional cloning and sequencing techniques please see the Exemplification.

A variety of approaches are used to order the contigs so as to obtain a continuous sequence representing the entire *A. fumigatus* genome. Synthetic oligonucleotides are designed that are complementary to sequences at the end of each contig. These oligonucleotides may be hybridized to libaries of *A. fumigatus* genomic DNA in, for example, lambda phage vectors or plasmid vectors to identify clones that contain sequences corresponding to the junctional regions between individual contigs. Such clones are then used to isolate template DNA and the same oligonucleotides are used as primers in polymerase chain reaction (PCR) to amplify junctional fragments, the nucleotide sequence of which is then determined.

The *A. fumigatus* sequences were analyzed for the presence of open reading frames (ORFs) comprising at least 180 nucleotides. As a result of the analysis of ORFs based on stop-to-stop codon reads, it should be understood that these ORFs may not correspond to the ORF of a naturally-occurring *A. fumigatus* polypeptide. These ORFs may contain start codons which indicate the initiation of protein synthesis of a naturally-occurring *A. fumigatus* polypeptide. Such start codons within the ORFs provided herein were identified by those of ordinary skill in the relevant art, and the resulting ORF and the encoded *A. fumigatus* polypeptide is within the scope of this invention. For example, within the ORFs a codon such as AUG or GUG (encoding methionine or valine) which is part of the initiation signal for protein synthesis were identified and the portion of an ORF to corresponding to a naturally-occurring *A. fumigatus* polypeptide was recognized. The predicted coding regions were defined by evaluating the coding potential of such sequences with the program GEN-EMARK™ (Borodovsky and McIninch, 1993, *Comp.* 17:123).

Each predicted ORF amino acid sequence was compared with all sequences found in current GENBANK, SWISS-PROT, and PIR databases using the BLAST algorithm. BLAST identifies local alignments occurring by chance between the ORF sequence and the sequence in the databank (Altschal et al., 1990, L Mol. Biol. 215:403-410). Homologous ORFs (probabilities less than $10^{-5}$ by chance) and ORF's that are probably non-homologous (probabilities greater than $10^{-5}$ by chance) but have good codon usage were identified. Both homologous, sequences and non-homologous sequences with good codon usage, are likely to encode proteins and are encompassed by the invention.

*A. fumigatus* Nucleic Acids

The present invention provides a library of *A. fumigatus*-derived nucleic acid sequences. The libraries provide probes, primers, and markers which are used as markers in epidemiological studies. The present invention also provides a library of *A. fumigatus*-derived nucleic acid sequences which comprise or encode targets for therapeutic drugs.

The nucleic acids of this invention may be obtained directly from the DNA of the above referenced *A. fumigatus* strain by using the polymerase chain reaction (PCR). See "PCR, A Practical Approach" (McPherson, Quirke, and Taylor, eds., IRL Press, Oxford, UK, 1991) for details about the PCR. High fidelity PCR is used to ensure a faithful DNA copy prior to expression. In addition, the authenticity of amplified products is verified by conventional sequencing methods. Clones carrying the desired sequences described in this invention may also be obtained by screening the libraries by means of the PCR or by hybridization of synthetic oligonucleotide probes to filter lifts of the library colonies or plaques as known in the art (see, e.g., Sambrook et al., *Molecular Cloning, A Laboratory Manual* 2nd edition, 1989, Cold Spring Harbor Press, NY).

It is also possible to obtain nucleic acids encoding *A. fumigatus* polypeptides from a cDNA library in accordance with protocols herein described. A cDNA encoding an *A. fumigatus* polypeptide can be obtained by isolating total mRNA from an appropriate strain. Double stranded cDNAs can then be prepared from the total mRNA. Subsequently, the cDNAs can be inserted into a suitable plasmid or viral (e.g., bacteriophage) vector using any one of a number of known techniques. Genes encoding *A. fumigatus* polypeptides can also be cloned using established polymerase chain reaction techniques in accordance with the nucleotide sequence information provided by the invention. The nucleic acids of the invention can be DNA or RNA. Preferred nucleic acids of the invention are contained in the Sequence Listing.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

In another example, DNA can be chemically synthesized using, e.g., the phosphoramidite solid support method of Matteucci et al., 1981, *J. Am. Chem. Soc.* 103:3185, the method of Yoo et al., 1989, *J. Biol. Chem.* 764:17078, or other well known methods. This can be done by sequentially linking a series of oligonucleotide cassettes comprising pairs of synthetic oligonucleotides, as described below.

Nucleic acids isolated or synthesized in accordance with features of the present invention are useful, by way of example, without limitation, as probes, primers, capture ligands, antisense genes and for developing expression systems for the synthesis of proteins and peptides corresponding to such sequences. As probes, primers, capture ligands and antisense agents, the nucleic acid normally consists of all or part (approximately twenty or more nucleotides for specificity as well as the ability to form stable hybridization products) of the nucleic acids of the invention contained in the Sequence Listing. These uses are described in further detail below.

Probes

A nucleic acid isolated or synthesized in accordance with the sequence of the invention contained in the Sequence Listing can be used as a probe to specifically detect *A. fumigatus*. With the sequence information set forth in the present application, sequences of twenty or more nucleotides are identified which provide the desired inclusivity and exclusivity with respect to *A. fumigatus*, and extraneous nucleic acids likely to be encountered during hybridization conditions. More preferably, the sequence will comprise at least about twenty to thirty nucleotides to convey stability to the hybridization product formed between the probe and the intended target molecules.

Sequences larger than 1000 nucleotides in length are difficult to synthesize but can be generated by recombinant DNA techniques. Individuals skilled in the art will readily recognize that the nucleic acids, for use as probes, can be provided with a label to facilitate detection of a hybridization product.

Nucleic acid isolated and synthesized in accordance with the sequence of the invention contained in the Sequence Listing can also be useful as probes to detect homologous regions (especially homologous genes) of other *Aspergillus* species using appropriate stringency hybridization conditions as described herein.

Capture Ligand

For use as a capture ligand, the nucleic acid selected in the manner described above with respect to probes, can be readily associated with a support. The manner in which nucleic acid is associated with supports is well known. Nucleic acid having twenty or more nucleotides in a sequence of the invention contained in the Sequence Listing have utility to separate *A. fumigatus* nucleic acid from one strain from the nucleic acid of other another strain as well as from other organisms. Nucleic acid having twenty or more nucleotides in a sequence of the invention contained in the Sequence Listing can also have utility to separate other *Aspergillus* species from each other and from other organisms. Preferably, the sequence will comprise at least about twenty nucleotides to convey stability to the hybridization product formed between the probe and the intended target molecules. Sequences larger than 1000 nucleotides in length are difficult to synthesize but can be generated by recombinant DNA techniques.

Primers

Nucleic acid isolated or synthesized in accordance with the sequences described herein have utility as primers for the amplification of *A. fumigatus* nucleic acid. These nucleic acids may also have utility as primers for the amplification of nucleic acids in other *Aspergillus* species. With respect to polymerase chain reaction (PCR) techniques, nucleic acid sequences of ≧10-15 nucleotides of the invention contained in the Sequence Listing have utility in conjunction with suitable enzymes and reagents to create copies of *A. fumigatus* nucleic acid. More preferably, the sequence will comprise twenty or more nucleotides to convey stability to the hybridization product formed between the primer and the intended target molecules. Binding conditions of primers greater than 100 nucleotides are more difficult to control to obtain specificity. High fidelity PCR can be used to ensure a faithful DNA copy prior to expression. In addition, amplified products can be checked by conventional sequencing methods.

The copies can be used in diagnostic assays to detect specific sequences, including genes from *A. fumigatus* and/or other *Aspergillus* species. The copies can also be incorporated into cloning and expression vectors to generate polypeptides corresponding to the nucleic acid synthesized by PCR, as is described in greater detail herein.

The nucleic acids of the present invention find use as templates for the recombinant production of *A. fumigatus*-derived peptides or polypeptides Antisense Nucleic acid or nucleic acid-hybridizing derivatives isolated or synthesized in accordance with the sequences described herein have utility as antisense agents to prevent the expression of *A. fumigatus* genes. These sequences also have utility as antisense agents to prevent expression of genes of other *Aspergillus* species.

In one embodiment, nucleic acid or derivatives corresponding to *A. fumigatus* nucleic acids is loaded into a suitable carrier such as a liposome or bacteriophage for introduction into bacterial cells. For example, a nucleic acid having twenty or more nucleotides is capable of binding to bacteria nucleic acid or bacteria messenger RNA. Preferably, the antisense nucleic acid is comprised of 20 or more nucleotides to provide necessary stability of a hybridization product of non-naturally occurring nucleic acid and fungal nucleic acid and/or fungal messenger RNA. Nucleic acid having a sequence greater than 1000 nucleotides in length is difficult to synthesize but can be generated by recombinant DNA techniques. Methods for loading antisense nucleic acid in liposomes is known in the art as exemplified by U.S. Pat. No. 4,241,046 issued Dec. 23, 1980 to Papahadjopoulos et al.

The present invention encompasses isolated polypeptides and nucleic acids derived from *A. fumigatus* that are useful as reagents for diagnosis of fungal infection, components of effective anti-fungal vaccines, and/or as targets for anti-fungal drugs, including anti-*A. fumigatus* drugs.

Expression of *A. fumigatus* Nucleic Acids

Table 2, which is appended herewith and which forms part of the present specification, provides a list of open reading frames (ORFs) in both strands and a putative identification of the particular function of a polypeptide which is encoded by each ORF, based on the homology match (determined by the BLAST algorithm) of the predicted polypeptide with known proteins encoded by ORFs in other organisms. An ORF is a region of nucleic acid which encodes a polypeptide. This region may represent a portion of a coding sequence or a total sequence and was determined from stop to stop codons. The first column contains a designation for the ORF ("ORF Name"). The second and third columns list the SEQ ID numbers for the nucleic acid ("NT ID") and amino acid ("AA ID") sequences corresponding to each ORF, respectively. The fourth and fifth columns list the length of the nucleic acid ORF ("NT LN") and the length of the amino acid ORF ("AA LN"), respectively. The nucleotide sequence corresponding to each ORF begins at the first nucleotide immediately following a stop codon and ends at the nucleotide immediately preceding the next downstream stop codon in the same reading frame. It will be recognized by one skilled in the art that the natural translation initiation sites will correspond to ATG, GTG, or TTG codons located within the ORFs. The natural initiation sites depend not only on the sequence of a start codon but also on the context of the DNA sequence adjacent to the start codon. Usually, a recognizable ribosome binding site is found within 20 nucleotides upstream from the initiation codon. In some cases where genes are translationally coupled and coordinately expressed together in "operons", ribosome binding sites are not present, but the initiation codon of a downstream gene may occur very close to, or overlap, the stop codon of the an upstream gene in the same operon. The correct start codons can be generally identified without undue experimentation because only a few codons need be tested. It is recognized that the translational machinery in bacteria initiates all polypeptide chains with the amino acid methionine, regardless of the sequence of the start codon. In some cases, polypeptides are post-translationally modified, resulting in an N-terminal amino acid other than methionine in vivo. Using the BLASTP2 algorithm as is in known in the art in determining gene similarity, each ORF's relative match was identified and is contained within the description frame ("Description"). These proteins in the Description were identified when the designated ORF was compared against a non-redundant comprehensive protein database. If a BLASTP2 score of less than 100 was obtained, no value is reported in the table. The Description provides, where available, the Swissprot accession number (SP), the locus name (LN), the Organism (OR), Source of variant (SR), E.C. number (EC), the gene name (GN), the product name (PN), the Function Description (FN), Left End (LE), Right End (RE), Coding Direction (DI), and the description (DE) or notes (NT) for each ORF. This information allows one of ordinary skill in the art to determine a potential use for each identified coding sequence and, as a result, allows to use the polypeptides of the present invention for commercial and industrial purposes.

Using the information provided in SEQ ID NO: 1-SEQ ID NO: 22156, SEQ ID NO: 22157-SEQ ID NO: 44266 and in Table 2 together with routine cloning and sequencing methods, one of ordinary skill in the art will be able to clone and sequence all the nucleic acid fragments of interest including open reading frames (ORFs) encoding a large variety of proteins of *A. fumigatus*.

Nucleic acid isolated or synthesized in accordance with the sequences described herein have utility to generate polypeptides. The nucleic acid of the invention exemplified in SEQ ID NO: 1-SEQ ID NO: 22156 and in Table 2 or fragments of said nucleic acid encoding active portions of *A. fumigatus* polypeptides can be cloned into suitable vectors or used to isolate nucleic acid. The isolated nucleic acid is combined with suitable DNA linkers and cloned into a suitable vector.

The function of a specific gene or operon can be ascertained by expression in a bacterial strain under conditions where the activity of the gene product(s) specified by the gene or operon in question can be specifically measured. Alternatively, a gene product may be produced in large quantities in an expressing strain for use as an antigen, an industrial reagent, for structural studies, etc. This expression can be accomplished in a mutant strain which lacks the activity of the gene to be tested, or in a strain that does not produce the same gene product(s). This includes, but is not limited to, Eucaryotic species such as the yeast *Saccharomyces cerevisiae*, *Methanobacterium* strains or other Archaea, and Eubacteria such as *E. coli*, *B. Subtilis*, *S. Aureus*, *S. Pneumonia* or *Pseudomonas putida*. In some cases the expression host will utilize the natural *A. fumigatus* promoter whereas in others, it will be necessary to drive the gene with a promoter sequence derived from the expressing organism (e.g., an *E. coli* beta-galactosidase promoter for expression in *E. coli*).

To express a gene product using the natural *A. fumigatus* promoter, a procedure such as the following can be used. A restriction fragment containing the gene of interest, together with its associated natural promoter element and regulatory sequences (identified using the DNA sequence data) is cloned into an appropriate recombinant plasmid containing an origin of replication that functions in the host organism and an appropriate selectable marker. This can be accomplished by a number of procedures known to those skilled in the art. It is most preferably done by cutting the plasmid and the fragment to be cloned with the same restriction enzyme to produce compatible ends that can be ligated to join the two pieces together. The recombinant plasmid is introduced into the host organism by, for example, electroporation and cells containing the recombinant plasmid are identified by selection for the marker on the plasmid. Expression of the desired gene product is detected using an assay specific for that gene product.

In the case of a gene that requires a different promoter, the body of the gene (coding sequence) is specifically excised and cloned into an appropriate expression plasmid. This subcloning can be done by several methods, but is most easily accomplished by PCR amplification of a specific fragment and ligation into an expression plasmid after treating the PCR product with a restriction enzyme or exonuclease to create suitable ends for cloning.

A suitable host cell for expression of a gene can be any procaryotic or eucaryotic cell. Suitable methods for transforming host cells can be found in Sambrook et al. (*Molecular Cloning: A Laboratory Manual*, 2nd Edition, Cold Spring Harbor Laboratory Press (1989)), and other laboratory textbooks.

For example, a host cell transfected with a nucleic acid vector directing expression of a nucleotide sequence encoding an *A. fumigatus* polypeptide can be cultured under appropriate conditions to allow expression of the polypeptide to occur. Suitable media for cell culture are well known in the art. Polypeptides of the invention can be isolated from cell culture medium, host cells, or both using techniques known in the art for purifying proteins including ion-exchange chromatography, gel filtration chromatography, ultrafiltration, electrophoresis, and immunoaffinity purification with antibodies specific for such polypeptides. Additionally, in many situations, polypeptides can be produced by chemical cleavage of a native protein (e.g., tryptic digestion) and the cleavage products can then be purified by standard techniques.

In the case of membrane bound proteins, these can be isolated from a host cell by contacting a membrane-associated protein fraction with a detergent forming a solubilized complex, where the membrane-associated protein is no longer entirely embedded in the membrane fraction and is solubilized at least to an extent which allows it to be chromatographically isolated from the membrane fraction. Chromatographic techniques which can be used in the final purification step are known in the art and include hydrophobic interaction, lectin affinity, ion exchange, dye affinity and immunoaffinity.

One strategy to maximize recombinant *A. fumigatus* peptide expression in *E. coli* is to express the protein in a host bacteria with an impaired capacity to proteolytically cleave the recombinant protein (Gottesman, S., *Gene Expression Technology: Methods in Enzymology* 185, Academic Press, San Diego, Calif. (1990) 119-128). Another strategy would be to alter the nucleic acid encoding an *A. fumigatus* peptide to be inserted into an expression vector so that the individual codons for each amino acid would be those preferentially utilized in highly expressed *E. coli* proteins (Wada et al., (1992) *Nuc. Acids Res.* 20:2111-2118). Such alteration of nucleic acids of the invention can be carried out by standard DNA synthesis techniques.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See, e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

The present invention provides a library of *A. fumigatus*-derived nucleic acid sequences. The libraries provide probes, primers, and markers which can be used as markers in epidemiological studies. The present invention also provides a library of *A. fumigatus*-derived nucleic acid sequences which comprise or encode targets for therapeutic drugs.

Nucleic acids comprising any of the sequences disclosed herein or sub-sequences thereof can be prepared by standard methods using the nucleic acid sequence information provided in SEQ ID NO: 1-SEQ ID NO: 22156. For example, DNA can be chemically synthesized using, e.g., the phosphoramidite solid support method of Matteucci et al., 1981, *J. Am. Chem. Soc.* 103:3185, the method of Yoo et al., 1989, *J. Biol. Chem.* 764:17078, or other well known methods. This can be done by sequentially linking a series of oligonucleotide cassettes comprising pairs of synthetic oligonucleotides, as described below.

Of course, due to the degeneracy of the genetic code, many different nucleotide sequences can encode polypeptides having the amino acid sequences defined by SEQ ID NO: 22157-SEQ ID NO: 44266 or sub-sequences thereof. The codons can be selected for optimal expression in prokaryotic or eukaryotic systems. Such degenerate variants are also encompassed by this invention.

Insertion of nucleic acids (typically DNAs) encoding the polypeptides of the invention into a vector is easily accomplished when the termini of both the DNAs and the vector comprise compatible restriction sites. If this cannot be done, it may be necessary to modify the termini of the DNAs and/or vector by digesting back single-stranded DNA overhangs generated by restriction endonuclease cleavage to produce blunt ends, or to achieve the same result by filling in the single-stranded termini with an appropriate DNA polymerase.

Alternatively, any site desired may be produced, e.g., by ligating nucleotide sequences (linkers) onto the termini. Such linkers may comprise specific oligonucleotide sequences that define desired restriction sites. Restriction sites can also be generated by the use of the polymerase chain reaction (PCR). See, e.g., Saiki et al., 1988, *Science* 239:48. The cleaved vector and the DNA fragments may also be modified if required by homopolymeric tailing.

The nucleic acids of the invention may be isolated directly from cells. Alternatively, the polymerase chain reaction (PCR) method can be used to produce the nucleic acids of the invention, using either chemically synthesized strands or genomic material as templates. Primers used for PCR can be synthesized using the sequence information provided herein and can further be designed to introduce appropriate new restriction sites, if desirable, to facilitate incorporation into a given vector for recombinant expression.

The nucleic acids of the present invention may be flanked by natural *A. fumigatus* regulatory sequences, or may be associated with heterologous sequences, including promoters, enhancers, response elements, signal sequences, polyadenylation sequences, introns, 5'- and 3'-noncoding regions, and the like. The nucleic acids may also be modified by many means known in the art. Non-limiting examples of such modifications include methylation, "caps", substitution of one or more of the naturally occurring nucleotides with an analog, internucleotide modifications such as, for example, those with uncharged linkages (e.g., methyl phosphonates, phosphotriesters, phosphoroamidates, carbamates, etc.) and with charged linkages (e.g., phosphorothioates, phosphorodithioates, etc.). Nucleic acids may contain one or more additional covalently linked moieties, such as, for example, proteins (e.g., nucleases, toxins, antibodies, signal peptides, poly-L-lysine, etc.), intercalators (e.g., acridine, psoralen, etc.), chelators (e.g., metals, radioactive metals, iron, oxidative metals, etc.), and alkylators. PNAs are also included. The nucleic acid may be derivatized by formation of a methyl or ethyl phosphotriester or an alkyl phosphoramidate linkage. Furthermore, the nucleic acid sequences of the present invention may also be modified with a label capable of providing a detectable signal, either directly or indirectly. Exemplary labels include radioisotopes, fluorescent molecules, biotin, and the like.

The invention also provides nucleic acid vectors comprising the disclosed *A. fumigatus*-derived sequences or derivatives or fragments thereof. A large number of vectors, including plasmid and bacterial vectors, have been described for replication and/or expression in a variety of eukaryotic and prokaryotic hosts, and may be used for cloning or protein expression.

The encoded *A. fumigatus* polypeptides may be expressed by using many known vectors, such as pUC plasmids, pET plasmids (Novagen, Inc., Madison, Wis.), or pRSET or pREP (Invitrogen, San Diego, Calif.), and many appropriate host cells, using methods disclosed or cited herein or otherwise known to those skilled in the relevant art. The particular choice of vector/host is not critical to the practice of the invention.

Recombinant cloning vectors will often include one or more replication systems for cloning or expression, one or more markers for selection in the host, e.g. antibiotic resistance, and one or more expression cassettes. The inserted *A. fumigatus* coding sequences may be synthesized by standard methods, isolated from natural sources, or prepared as hybrids, etc. Ligation of the *A. fumigatus* coding sequences to transcriptional regulatory elements and/or to other amino acid coding sequences may be achieved by known methods. Suitable host cells may be transformed/transfected/infected as appropriate by any suitable method including electroporation, $CaCl_2$ mediated DNA uptake, fungal infection, microinjection, microprojectile, or other established methods.

Appropriate host cells include bacteria, archebacteria, fungi, especially yeast, and plant and animal cells, especially mammalian cells. Of particular interest are *A. fumigatus, E. coli, B. Subtilis, Saccharomyces cerevisiae, Saccharomyces carlsbergensis, Schizosaccharomyces pombi*, SF9 cells, C129 cells, 293 cells, *Neurospora*, and CHO cells, COS cells, HeLa cells, and immortalized mammalian myeloid and lymphoid cell lines. Preferred replication systems include M13, ColE1, SV40, baculovirus, lambda, adenovirus, and the like. A large number of transcription initiation and termination regulatory regions have been isolated and shown to be effective in the transcription and translation of heterologous proteins in the various hosts. Examples of these regions, methods of isolation, manner of manipulation, etc. are known in the art. Under appropriate expression conditions, host cells can be used as a source of recombinantly produced *A. fumigatus*-derived peptides and polypeptides.

Advantageously, vectors may also include a transcription regulatory element (i.e., a promoter) operably linked to the *A. fumigatus* portion. The promoter may optionally contain operator portions and/or ribosome binding sites. Non-limiting examples of bacterial promoters compatible with *E. coli* include: b-lactamase (penicillinase) promoter; lactose promoter; tryptophan (trp) promoter; araBAD (arabinose) operon promoter; lambda-derived PI promoter and N gene ribosome binding site; and the hybrid tac promoter derived from sequences of the trp and lac UV5 promoters. Non-limiting examples of yeast promoters include 3-phosphoglycerate kinase promoter, glyceraldehyde-3-phosphate dehydrogenase (GAPDH) promoter, galactokinase (GAL1) promoter, galactoepimerase promoter, and alcohol dehydrogenase (ADH) promoter. Suitable promoters for mammalian cells include without limitation viral promoters such as that from Simian Virus 40 (SV40), Rous sarcoma virus (RSV), adenovirus (ADV), and bovine papilloma virus (BPV). Mammalian cells may also require terminator sequences, polyA addition sequences and enhancer sequences to increase expression. Sequences which cause amplification of the gene may also be desirable. Furthermore, sequences that facilitate secretion of the recombinant product from cells, including, but not limited to, bacteria, yeast, and animal cells, such as secretory signal sequences and/or prohormone pro region sequences, may also be included. These sequences are well described in the art.

Nucleic acids encoding wild-type or variant *A. fumigatus*-derived polypeptides may also be introduced into cells by recombination events. For example, such a sequence can be introduced into a cell, and thereby effect homologous recombination at the site of an endogenous gene or a sequence with substantial identity to the gene. Other recombination-based methods such as nonhomologous recombinations or deletion of endogenous genes by homologous recombination may also be used.

The nucleic acids of the present invention find use as templates for the recombinant production of *A. fumigatus*-derived peptides or polypeptides.

Identification and Use of *A. fumigatus* Nucleic Acid Sequences

The disclosed *A. fumigatus* polypeptide and nucleic acid sequences, or other sequences that are contained within ORFs, including complete protein-coding sequences, of which any of the disclosed *A. fumigatus*-specific sequences forms a part, are useful as target components for diagnosis and/or treatment of *A. fumigatus*-caused infection It will be understood that the sequence of an entire protein-coding sequence of which each disclosed nucleic acid sequence forms a part can be isolated and identified based on each disclosed sequence. This can be achieved, for example, by using an isolated nucleic acid encoding the disclosed sequence, or fragments thereof, to prime a sequencing reaction with genomic *A. fumigatus* DNA as template; this is followed by sequencing the amplified product. The isolated nucleic acid encoding the disclosed sequence, or fragments thereof, can also be hybridized to *A. fumigatus* genomic libraries to identify clones containing additional complete segments of the protein-coding sequence of which the shorter sequence forms a part. Then, the entire protein-coding sequence, or fragments thereof, or nucleic acids encoding all or part of the sequence, or sequence-conservative or function-conservative variants thereof, may be employed in practicing the present invention.

Preferred sequences are those that are useful in diagnostic and/or therapeutic applications. Diagnostic applications include without limitation nucleic-acid-based and antibody-based methods for detecting fungal infection. Therapeutic applications include without limitation vaccines, passive immunotherapy, and drug treatments directed against gene products that are both unique to bacteria and essential for growth and/or replication of bacteria.

Identification of Nucleic Acids Encoding Vaccine Components and Targets for Agents Effective Against *A. fumigatus*

The disclosed *A. fumigatus* genome sequence includes segments that direct the synthesis of ribonucleic acids and polypeptides, as well as origins of replication, promoters, other types of regulatory sequences, and intergenic nucleic acids. The invention encompasses nucleic acids encoding immunogenic components of vaccines and targets for agents effective against *A. fumigatus*. Identification of said immunogenic components involved in the determination of the function of the disclosed sequences, which can be achieved using a variety of approaches. Non-limiting examples of these approaches are described briefly below.

Homology to Known Sequences:

Computer-assisted comparison of the disclosed *A. fumigatus* sequences with previously reported sequences present in publicly available databases is useful for identifying functional *A. fumigatus* nucleic acid and polypeptide sequences. It will be understood that protein-coding sequences, for example, may be compared as a whole, and that a high degree of sequence homology between two proteins (such as, for example, >80-90%) at the amino acid level indicates that the two proteins also possess some degree of functional homology, such as, for example, among enzymes involved in metabolism, DNA synthesis, or cell wall synthesis, and proteins involved in transport, cell division, etc. In addition, many structural features of particular protein classes have been identified and correlate with specific consensus sequences, such as, for example, binding domains for nucleotides, DNA, metal ions, and other small molecules; sites for covalent modifications such as phosphorylation, acylation, and the like; sites of protein:protein interactions, etc. These consensus sequences may be quite short and thus may represent only a fraction of the entire protein-coding sequence. Identification of such a feature in an *A. fumigatus* sequence is therefore useful in determining the function of the encoded protein and identifying useful targets of antifungal drugs.

Of particular relevance to the present invention are structural features that are common to secretory, transmembrane, and surface proteins, including secretion signal peptides and hydrophobic transmembrane domains. *A. fumigatus* proteins identified as containing putative signal sequences and/or transmembrane domains are useful as immunogenic components of vaccines.

Targets for therapeutic drugs according to the invention include, but are not limited to, polypeptides of the invention, whether unique to *A. fumigatus* or not, that are essential for growth and/or viability of *A. fumigatus* under at least one growth condition. Polypeptides essential for growth and/or viability can be determined by examining the effect of deleting and/or disrupting the genes, i.e., by so-called gene "knockout". Alternatively, genetic footprinting can be used (Smith et al., 1995, *Proc. Natl. Acad. Sci. USA* 92:5479-6433; Published International Application WO 94/26933; U.S. Pat. No. 5,612,180). Still other methods for assessing essentiality includes the ability to isolate conditional lethal mutations in the specific gene (e.g., temperature sensitive mutations). Other useful targets for therapeutic drugs, which include polypeptides that are not essential for growth or viability per se but lead to loss of viability of the cell, can be used to target therapeutic agents to cells.

Strain-Specific Sequences:

Because of the evolutionary relationship between different *A. fumigatus* strains, it is believed that the presently disclosed *A. fumigatus* sequences are useful for identifying, and/or discriminating between, previously known and new *A. fumigatus* strains. It is believed that other *A. fumigatus* strains will exhibit at least about 70% sequence homology with the presently disclosed sequence. Systematic and routine analyses of DNA sequences derived from samples containing *A. fumigatus* strains, and comparison with the present sequence allows for the identification of sequences that can be used to discriminate between strains, as well as those that are common to all *A. fumigatus* strains. In one embodiment, the invention provides nucleic acids, including probes, and peptide and polypeptide sequences that discriminate between different strains of *A. fumigatus* Strain-specific components can also be identified functionally by their ability to elicit or react with antibodies that selectively recognize one or more *A. fumigatus* strains.

In another embodiment, the invention provides nucleic acids, including probes, and peptide and polypeptide sequences that are common to all *A. fumigatus* strains but are not found in other fungal species.

*A. fumigatus* Polypeptides

This invention encompasses isolated *A. fumigatus* polypeptides encoded by the disclosed *A. fumigatus* genomic sequences, including the polypeptides of the invention contained in the Sequence Listing. Polypeptides of the invention are preferably at least about 5 amino acid residues in length. Using the DNA sequence information provided herein, the amino acid sequences of the polypeptides encompassed by the invention can be deduced using methods well-known in the art. It will be understood that the sequence of an entire nucleic acid encoding an *A. fumigatus* polypeptide can be isolated and identified based on an ORF that encodes only a fragment of the cognate protein-coding region. This can be achieved, for example, by using the isolated nucleic acid encoding the ORF, or fragments thereof, to prime a polymerase chain reaction with genomic *A. fumigatus* DNA as template; this is followed by sequencing the amplified product.

The polypeptides of the present invention, including function-conservative variants of the disclosed ORFs, may be isolated from wild-type or mutant *A. fumigatus* cells, or from heterologous organisms or cells (including, but not limited to, bacteria, fungi, insect, plant, and mammalian cells) including *A. fumigatus* into which an *A. fumigatus*-derived protein-coding sequence has been introduced and expressed. Furthermore, the polypeptides may be part of recombinant fusion proteins.

*A. fumigatus* polypeptides of the invention can be chemically synthesized using commercially automated procedures such as those referenced herein, including, without limitation, exclusive solid phase synthesis, partial solid phase methods, fragment condensation or classical solution synthesis. The polypeptides are preferably prepared by solid phase peptide synthesis as described by Merrifield, 1963, *J. Am. Chem. Soc.* 85:2149. The synthesis is carried out with amino acids that are protected at the alpha-amino terminus. Trifunctional amino acids with labile side-chains are also protected with suitable groups to prevent undesired chemical reactions from occurring during the assembly of the polypeptides. The alpha-amino protecting group is selectively removed to allow subsequent reaction to take place at the amino-terminus. The conditions for the removal of the alpha-amino protecting group do not remove the side-chain protecting groups.

Methods for polypeptide purification are well-known in the art, including, without limitation, preparative disc-gel electrophoresis, isoelectric focusing, HPLC, reversed-phase HPLC, gel filtration, ion exchange and partition chromatography, and countercurrent distribution. For some purposes, it is preferable to produce the polypeptide in a recombinant system in which the *A. fumigatus* protein contains an additional sequence tag that facilitates purification, such as, but not limited to, a polyhistidine sequence. The polypeptide can then be purified from a crude lysate of the host cell by chromatography on an appropriate solid-phase matrix. Alternatively, antibodies produced against an *A. fumigatus* protein or against peptides derived therefrom can be used as purification reagents. Other purification methods are possible.

The present invention also encompasses derivatives and homologues of *A. fumigatus*-encoded polypeptides. For some purposes, nucleic acid sequences encoding the peptides may be altered by substitutions, additions, or deletions that provide for functionally equivalent molecules, i.e., function-conservative variants. For example, one or more amino acid residues within the sequence can be substituted by another amino acid of similar properties, such as, for example, positively charged amino acids (arginine, lysine, and histidine); negatively charged amino acids (aspartate and glutamate); polar neutral amino acids; and non-polar amino acids.

The isolated polypeptides may be modified by, for example, phosphorylation, sulfation, acylation, or other protein modifications. They may also be modified with a label capable of providing a detectable signal, either directly or indirectly, including, but not limited to, radioisotopes and fluorescent compounds.

To identify *A. fumigatus*-derived polypeptides for use in the present invention, essentially the complete genomic sequence of a virulent, methicillin-resistant isolate of *Aspergillus mirabilis* isolate was analyzed. While, in very rare instances, a nucleic acid sequencing error may be revealed, resolving a rare sequencing error is well within the art, and such an occurrence will not prevent one skilled in the art from practicing the invention.

Also encompassed are any *A. fumigatus* polypeptide sequences that are contained within the open reading frames (ORFs), including complete protein-coding sequences, of which any of SEQ ID NO: 1-SEQ ID NO: 22156 forms a part. Table 2, which is appended herewith and which forms part of the present specification, provides a putative identification of the particular function of a polypeptide which is encoded by each ORF, based on the homology match (determined by the BLAST algorithm) of the predicted polypeptide with known proteins encoded by ORFs in other organisms. As a result, one skilled in the art can use the polypeptides of the present invention for commercial and industrial purposes consistent with the type of putative identification of the polypeptide.

The present invention provides a library of *A. fumigatus*-derived polypeptide sequences, and a corresponding library of nucleic acid sequences encoding the polypeptides, wherein the polypeptides themselves, or polypeptides contained within ORFs of which they form a part, comprise sequences that are contemplated for use as components of vaccines. Non-limiting examples of such sequences are listed by SEQ ID NO in Table 2, which is appended herewith and which forms part of the present specification.

The present invention also provides a library of *A. fumigatus*-derived polypeptide sequences, and a corresponding library of nucleic acid sequences encoding the polypeptides, wherein the polypeptides themselves, or polypeptides contained within ORFs of which they form a part, comprise sequences lacking homology to any known prokaryotic or eukaryotic sequences. Such libraries provide probes, primers, and markers which can be used to diagnose *A. fumigatus* infection, including use as markers in epidemiological studies. Non-limiting examples of such sequences are listed by SEQ ID NO in Table 2, which is appended hereto and part hereof.

The present invention also provides a library of *A. fumigatus*-derived polypeptide sequences, and a corresponding library of nucleic acid sequences encoding the polypeptides, wherein the polypeptides themselves, or polypeptides contained within ORFs of which they form a part, comprise targets for therapeutic drugs.

SPECIFIC EXAMPLE

Determination of *Aspergillus* Protein Antigens for Antibody and Vaccine Development The selection of *Aspergillus* protein antigens for vaccine development can be derived from the nucleic acids encoding *A. fumigatus* polypeptides. First, the ORF's can be analyzed for homology to other known exported or membrane proteins and analyzed using the discriminant analysis described by Klein, et al. (Klein, P., Kanehsia, M., and DeLisi, C. (1985) *Biochimica et Biophysica Acta* 815, 468-476) for predicting exported and membrane proteins.

Homology searches can be performed using the BLAST algorithm contained in the Wisconsin Sequence Analysis Package (Genetics Computer Group, University Research Park, 575 Science Drive, Madison, Wis. 53711) to compare each predicted ORF amino acid sequence with all sequences found in the current GenBank, SWISS-PROT and PIR databases. BLAST searches for local alignments between the ORF and the databank sequences and reports a probability score which indicates the probability of finding this sequence by chance in the database. ORF's with significant homology (e.g. probabilities lower than $1\times10^{-6}$ that the homology is only due to random chance) to membrane or exported proteins represent protein antigens for vaccine development. Possible functions can be provided to *A. fumigatus* genes based on sequence homology to genes cloned in other organisms.

Discriminant analysis (Klein, et al. supra) can be used to examine the ORF amino acid sequences. This algorithm uses the intrinsic information contained in the ORF amino acid sequence and compares it to information derived from the properties of known membrane and exported proteins. This comparison predicts which proteins will be exported, membrane associated or cytoplasmic. ORF amino acid sequences identified as exported or membrane associated by this algorithm are likely protein antigens for vaccine development.

Production of Fragments and Analogs of *A. fumigatus* Nucleic Acids and Polypeptides Based on the discovery of the *A. fumigatus* gene products of the invention provided in the Sequence Listing, one skilled in the art can alter the disclosed structure of *A. fumigatus* genes, e.g., by producing fragments or analogs, and test the newly produced structures for activity. Examples of techniques known to those skilled in the relevant art which allow the production and testing of fragments and analogs are discussed below. These, or analogous methods can be used to make and screen libraries of polypeptides, e.g., libraries of random peptides or libraries of fragments or analogs of cellular proteins for the ability to bind *A. fumigatus* polypeptides. Such screens are useful for the identification of inhibitors of *A. fumigatus.*

Generation of Fragments

Fragments of a protein can be produced in several ways, e.g., recombinantly, by proteolytic digestion, or by chemical synthesis. Internal or terminal fragments of a polypeptide can be generated by removing one or more nucleotides from one end (for a terminal fragment) or both ends (for an internal fragment) of a nucleic acid which encodes the polypeptide. Expression of the mutagenized DNA produces polypeptide fragments. Digestion with "end-nibbling" endonucleases can thus generate DNAs which encode an array of fragments. DNAs which encode fragments of a protein can also be generated by random shearing, restriction digestion or a combination of the above-discussed methods.

Fragments can also be chemically synthesized using techniques known in the art such as conventional Merrifield solid phase f-Moc or t-Boc chemistry. For example, peptides of the present invention may be arbitrarily divided into fragments of desired length with no overlap of the fragments, or divided into overlapping fragments of a desired length.

Alteration of Nucleic Acids and Polypeptides: Random Methods

Amino acid sequence variants of a protein can be prepared by random mutagenesis of DNA which encodes a protein or a particular domain or region of a protein. Useful methods include PCR mutagenesis and saturation mutagenesis. A library of random amino acid sequence variants can also be generated by the synthesis of a set of degenerate oligonucleotide sequences. (Methods for screening proteins in a library of variants are elsewhere herein).

PCR Mutagenesis

In PCR mutagenesis, reduced Taq polymerase fidelity is used to introduce random mutations into a cloned fragment of DNA (Leung et al., 1989, *Technique* 1: 11-15). The DNA region to be mutagenized is amplified using the polymerase chain reaction (PCR) under conditions that reduce the fidelity of DNA synthesis by Taq DNA polymerase, e.g., by using a dGTP/dATP ratio of five and adding $Mn^{2+}$ to the PCR reaction. The pool of amplified DNA fragments are inserted into appropriate cloning vectors to provide random mutant libraries.

Saturation Mutagenesis

Saturation mutagenesis allows for the rapid introduction of a large number of single base substitutions into cloned DNA fragments (Mayers et al., 1985, *Science* 229:242). This technique includes generation of mutations, e.g., by chemical treatment or irradiation of single-stranded DNA in vitro, and synthesis of a complimentary DNA strand. The mutation frequency can be modulated by modulating the severity of the treatment, and essentially all possible base substitutions can be obtained. Because this procedure does not involve a genetic selection for mutant fragments both neutral substitutions, as well as those that alter function, are obtained. The distribution of point mutations is not biased toward conserved sequence elements.

Degenerate Oligonucleotides

A library of homologs can also be generated from a set of degenerate oligonucleotide sequences. Chemical synthesis of a degenerate sequences can be carried out in an automatic DNA synthesizer, and the synthetic genes then ligated into an appropriate expression vector. The synthesis of degenerate oligonucleotides is known in the art (see for example, Narang, S A (1983) *Tetrahedron* 39:3; Itakura et al. (1981) *Recombi-* nant DNA, *Proc 3rd Cleveland Sympos. Macromolecules*, ed. A G Walton, Amsterdam: Elsevier pp 273-289; Itakura et al. (1984) *Annu. Rev. Biochem.* 53:323; Itakura et al. (1984) *Science* 198:1056; Ike et al. (1983) *Nucleic Acid Res.* 11:477. Such techniques have been employed in the directed evolution of other proteins (see, for example, Scott et al. (1990) *Science* 249:386-390; Roberts et al. (1992) *PNAS* 89:2429-2433; Devlin et al. (1990) *Science* 249: 404-406; Cwirla et al. (1990) *PNAS* 87: 6378-6382; as well as U.S. Pat. Nos. 5,223,409, 5,198,346, and 5,096,815).

Alteration of Nucleic Acids and Polypeptides: Methods for Directed Mutagenesis

Non-random or directed, mutagenesis techniques can be used to provide specific sequences or mutations in specific regions. These techniques can be used to create variants which include, e.g., deletions, insertions, or substitutions, of residues of the known amino acid sequence of a protein. The sites for mutation can be modified individually or in series, e.g., by (1) substituting first with conserved amino acids and then with more radical choices depending upon results achieved, (2) deleting the target residue, or (3) inserting residues of the same or a different class adjacent to the located site, or combinations of options 1-3.

Alanine Scanning Mutagenesis

Alanine scanning mutagenesis is a useful method for identification of certain residues or regions of the desired protein that are preferred locations or domains for mutagenesis, Cunningham and Wells (*Science* 244:1081-1085, 1989). In alanine scanning, a residue or group of target residues are identified (e.g., charged residues such as Arg, Asp, His, Lys, and Glu) and replaced by a neutral or negatively charged amino acid (most preferably alanine or polyalanine). Replacement of an amino acid can affect the interaction of the amino acids with the surrounding aqueous environment in or outside the cell. Those domains demonstrating functional sensitivity to the substitutions are then refined by introducing further or other variants at or for the sites of substitution. Thus, while the site for introducing an amino acid sequence variation is predetermined, the nature of the mutation per se need not be predetermined. For example, to optimize the performance of a mutation at a given site, alanine scanning or random mutagenesis may be conducted at the target codon or region and the expressed desired protein subunit variants are screened for the optimal combination of desired activity.

Oligonucleotide-Mediated Mutagenesis

Oligonucleotide-mediated mutagenesis is a useful method for preparing substitution, deletion, and insertion variants of DNA, see, e.g., Adelman et al., (*DNA* 2:183, 1983). Briefly, the desired DNA is altered by hybridizing an oligonucleotide encoding a mutation to a DNA template, where the template is the single-stranded form of a plasmid or bacteriophage containing the unaltered or native DNA sequence of the desired protein. After hybridization, a DNA polymerase is used to synthesize an entire second complementary strand of the template that will thus incorporate the oligonucleotide primer, and will code for the selected alteration in the desired protein DNA. Generally, oligonucleotides of at least about 25 nucleotides in length are used. An optimal oligonucleotide will have 12 to 15 nucleotides that are completely complementary to the template on either side of the nucleotide(s) coding for the mutation. This ensures that the oligonucleotide will hybridize properly to the single-stranded DNA template molecule. The oligonucleotides are readily synthesized using techniques known in the art such as that described by Crea et al. (*Proc. Natl. Acad. Sci. USA,* 75: 5765[1978]).

Cassette Mutagenesis

Another method for preparing variants, cassette mutagenesis, is based on the technique described by Wells et al. (*Gene,* 34:315 [1985]). The starting material is a plasmid (or other vector) which includes the protein subunit DNA to be mutated. The codon(s) in the protein subunit DNA to be mutated are identified. There must be a unique restriction endonuclease site on each side of the identified mutation site(s). If no such restriction sites exist, they may be generated using the above-described oligonucleotide-mediated mutagenesis method to introduce them at appropriate locations in the desired protein subunit DNA. After the restriction sites have been introduced into the plasmid, the plasmid is cut at these sites to linearize it. A double-stranded oligonucleotide encoding the sequence of the DNA between the restriction sites but containing the desired mutation(s) is synthesized using standard procedures. The two strands are synthesized separately and then hybridized together using standard techniques. This double-stranded oligonucleotide is referred to as the cassette. This cassette is designed to have 3' and 5' ends that are comparable with the ends of the linearized plasmid, such that it can be directly ligated to the plasmid. This plasmid now contains the mutated desired protein subunit DNA sequence.

Combinatorial Mutagenesis

Combinatorial mutagenesis can also be used to generate mutants (Ladner et al., WO 88/06630). In this method, the amino acid sequences for a group of homologs or other related proteins are aligned, preferably to promote the highest homology possible. All of the amino acids which appear at a given position of the aligned sequences can be selected to create a degenerate set of combinatorial sequences. The variegated library of variants is generated by combinatorial mutagenesis at the nucleic acid level, and is encoded by a variegated gene library. For example, a mixture of synthetic oligonucleotides can be enzymatically ligated into gene sequences such that the degenerate set of potential sequences are expressible as individual peptides, or alternatively, as a set of larger fusion proteins containing the set of degenerate sequences.

Other Modifications of *A. fumigatus* Nucleic Acids and Polypeptides

It is possible to modify the structure of an *A. fumigatus* polypeptide for such purposes as increasing solubility, enhancing stability (e.g., shelf life ex vivo and resistance to proteolytic degradation in vivo). A modified *A. fumigatus* protein or peptide can be produced in which the amino acid sequence has been altered, such as by amino acid substitution, deletion, or addition as described herein.

An *A. fumigatus* peptide can also be modified by substitution of cysteine residues preferably with alanine, serine, threonine, leucine or glutamic acid residues to minimize dimerization via disulfide linkages. In addition, amino acid side chains of fragments of the protein of the invention can be chemically modified. Another modification is cyclization of the peptide.

In order to enhance stability and/or reactivity, an *A. fumigatus* polypeptide can be modified to incorporate one or more polymorphisms in the amino acid sequence of the protein resulting from any natural allelic variation. Additionally, D-amino acids, non-natural amino acids, or non-amino acid analogs can be substituted or added to produce a modified protein within the scope of this invention. Furthermore, an *A. fumigatus* polypeptide can be modified using polyethylene glycol (PEG) according to the method of A. Sehon and co-workers (Wie et al., supra) to produce a protein conjugated with PEG. In addition, PEG can be added during chemical synthesis of the protein. Other modifications of *A. fumigatus* proteins include reduction/alkylation (Tarr, *Methods of Protein Microcharacterization*, J. E. Silver ed., Humana Press, Clifton N.J. 155-194 (1986)); acylation (Tarr, supra); chemical coupling to an appropriate carrier (Mishell and Shiigi, eds, *Selected Methods in Cellular Immunology*, W H Freeman, San Francisco, Calif. (1980), U.S. Pat. No. 4,939,239; or mild formalin treatment (Marsh, (1971) *Int. Arch. of Allergy and Appl. Immunol.*, 41: 199-215).

To facilitate purification and potentially increase solubility of an *A. fumigatus* protein or peptide, it is possible to add an amino acid fusion moiety to the peptide backbone. For example, hexa-histidine can be added to the protein for purification by immobilized metal ion affinity chromatography (Hochuli, E. et al., (1988) *Bio/Technology*, 6: 1321-1325). In addition, to facilitate isolation of peptides free of irrelevant sequences, specific endoprotease cleavage sites can be introduced between the sequences of the fusion moiety and the peptide.

To potentially aid proper antigen processing of epitopes within an *A. fumigatus* polypeptide, canonical protease sensitive sites can be engineered between regions, each comprising at least one epitope via recombinant or synthetic methods. For example, charged amino acid pairs, such as KK or RR, can be introduced between regions within a protein or fragment during recombinant construction thereof. The resulting peptide can be rendered sensitive to cleavage by cathepsin and/or other trypsin-like enzymes which would generate portions of the protein containing one or more epitopes. In addition, such charged amino acid residues can result in an increase in the solubility of the peptide.

Primary Methods for Screening Polypeptides and Analogs

Various techniques are known in the art for screening generated mutant gene products. Techniques for screening large gene libraries often include cloning the gene library into replicable expression vectors, transforming appropriate cells with the resulting library of vectors, and expressing the genes under conditions in which detection of a desired activity, e.g., in this case, binding to *A. fumigatus* polypeptide or an interacting protein, facilitates relatively easy isolation of the vector encoding the gene whose product was detected. Each of the techniques described below is amenable to high throughput analysis for screening large numbers of sequences created, e.g., by random mutagenesis techniques.

Two Hybrid Systems

Two hybrid assays such as the system described below (as with the other screening methods described herein), can be used to identify polypeptides, e.g., fragments or analogs of a naturally-occurring *A. fumigatus* polypeptide, e.g., of cellular proteins, or of randomly generated polypeptides which bind to an *A. fumigatus* protein. (The *A. fumigatus* domain is used as the bait protein and the library of variants are expressed as prey fusion proteins.) In an analogous fashion, a two hybrid assay (as with the other screening methods described herein), can be used to find polypeptides which bind an *A. fumigatus* polypeptide.

Display Libraries

In one approach to screening assays, the *Aspergillus* peptides are displayed on the surface of a cell or viral particle, and the ability of particular cells or viral particles to bind an appropriate receptor protein via the displayed product is detected in a "panning assay". For example, the gene library can be cloned into the gene for a surface membrane protein of a bacterial cell, and the resulting fusion protein detected by panning (Ladner et al., WO 88/06630; Fuchs et al. (1991) *Bio/Technology* 9:1370-1371; and Goward et al. (1992) *TIBS* 18:136-140). In a similar fashion, a detectably labeled ligand can be used to score for potentially functional peptide homologs. Fluorescently labeled ligands, e.g., receptors, can be used to detect homologs which retain ligand-binding activity. The use of fluorescently labeled ligands, allows cells to be visually inspected and separated under a fluorescence microscope, or, where the morphology of the cell permits, to be separated by a fluorescence-activated cell sorter.

A gene library can be expressed as a fusion protein on the surface of a viral particle. For instance, in the filamentous phage system, foreign peptide sequences can be expressed on the surface of infectious phage, thereby conferring two significant benefits. First, since these phage can be applied to affinity matrices at concentrations well over $10^{13}$ phage per milliliter, a large number of phage can be screened at one time. Second, since each infectious phage displays a gene product on its surface, if a particular phage is recovered from an affinity matrix in low yield, the phage can be amplified by another round of infection. The group of almost identical *E. coli* filamentous phages, M13, fd., and fl, are most often used in phage display libraries. Either of the phage gIII or gVIII coat proteins can be used to generate fusion proteins without disrupting the ultimate packaging of the viral particle. Foreign epitopes can be expressed at the $NH_2$-terminal end of pIII and phage bearing such epitopes recovered from a large excess of phage lacking this epitope (Ladner et al. PCT publication WO 90/02909; Garrard et al., PCT publication WO 92/09690; Marks et al. (1992) *J. Biol. Chem.* 267:16007-16010; Griffiths et al. (1993) *EMBO J* 12:725-734; Clackson et al. (1991) *Nature* 352:624-628; and Barbas et al. (1992) *PNAS* 89:4457-4461).

A common approach uses the maltose receptor of *E. coli* (the outer membrane protein, LamB) as a peptide fusion partner (Charbit et al. (1986) *EMBO* 5, 3029-3037). Oligonucleotides have been inserted into plasmids encoding the LamB gene to produce peptides fused into one of the extracellular loops of the protein. These peptides are available for binding to ligands, e.g., to antibodies, and can elicit an immune response when the cells are administered to animals. Other cell surface proteins, e.g., OmpA (Schorr et al. (1991) *Vaccines* 91, pp. 387-392), PhoE (Agterberg, et al. (1990) *Gene* 88, 37-45), and PAL (Fuchs et al. (1991) *Bio/Tech* 9, 1369-1372), as well as large bacterial surface structures have served as vehicles for peptide display. Peptides can be fused to pilin, a protein which polymerizes to form the pilus-a conduit for interbacterial exchange of genetic information (Thiry et al. (1989) *Appl. Environ. Microbiol.* 55, 984-993). Because of its role in interacting with other cells, the pilus provides a useful support for the presentation of peptides to the extracellular environment. Another large surface structure used for peptide display is the bacterial motive organ, the flagellum. Fusion of peptides to the subunit protein flagellin offers a dense array of many peptide copies on the host cells (Kuwajima et al. (1988) *Bio/Tech.* 6, 1080-1083). Surface proteins of other bacterial species have also served as peptide fusion partners. Examples include the *Staphylococcus* protein A and the outer membrane IgA protease of *Neisseria* (Hansson et al. (1992) *J. Bacteriol.* 174, 4239-4245 and Klauser et al. (1990) *EMBO J.* 9, 1991-1999).

In the filamentous phage systems and the LamB system described above, the physical link between the peptide and its encoding DNA occurs by the containment of the DNA within a particle (cell or phage) that carries the peptide on its surface. Capturing the peptide captures the particle and the DNA within. An alternative scheme uses the DNA-binding protein LacI to form a link between peptide and DNA (Cull et al.

(1992) *PNAS USA* 89:1865-1869). This system uses a plasmid containing the LacI gene with an oligonucleotide cloning site at its 3'-end. Under the controlled induction by arabinose, a LacI-peptide fusion protein is produced. This fusion retains the natural ability of LacI to bind to a short DNA sequence known as LacO operator (LacO). By installing two copies of LacO on the expression plasmid, the LacI-peptide fusion binds tightly to the plasmid that encoded it. Because the plasmids in each cell contain only a single oligonucleotide sequence and each cell expresses only a single peptide sequence, the peptides become specifically and stably associated with the DNA sequence that directed its synthesis. The cells of the library are gently lysed and the peptide-DNA complexes are exposed to a matrix of immobilized receptor to recover the complexes containing active peptides. The associated plasmid DNA is then reintroduced into cells for amplification and DNA sequencing to determine the identity of the peptide ligands. As a demonstration of the practical utility of the method, a large random library of dodecapeptides was made and selected on a monoclonal antibody raised against the opioid peptide dynorphin B. A cohort of peptides was recovered, all related by a consensus sequence corresponding to a six-residue portion of dynorphin B. (Cull et al. (1992) *Proc. Natl. Acad. Sci. U.S.A.* 89-1869)

This scheme, sometimes referred to as peptides-on-plasmids, differs in two important ways from the phage display methods. First, the peptides are attached to the C-terminus of the fusion protein, resulting in the display of the library members as peptides having free carboxy termini. Both of the filamentous phage coat proteins, pIII and pVIII, are anchored to the phage through their C-termini, and the guest peptides are placed into the outward-extending N-terminal domains. In some designs, the phage-displayed peptides are presented right at the amino terminus of the fusion protein. (Cwirla, et al. (1990) *Proc. Natl. Acad. Sci. U.S.A.* 87, 6378-6382) A second difference is the set of biological biases affecting the population of peptides actually present in the libraries. The LacI fusion molecules are confined to the cytoplasm of the host cells. The phage coat fusions are exposed briefly to the cytoplasm during translation but are rapidly secreted through the inner membrane into the periplasmic compartment, remaining anchored in the membrane by their C-terminal hydrophobic domains, with the N-termini, containing the peptides, protruding into the periplasm while awaiting assembly into phage particles. The peptides in the LacI and phage libraries may differ significantly as a result of their exposure to different proteolytic activities. The phage coat proteins require transport across the inner membrane and signal peptidase processing as a prelude to incorporation into phage. Certain peptides exert a deleterious effect on these processes and are underrepresented in the libraries (Gallop et al. (1994) *J. Med. Chem.* 37(9):1233-1251). These particular biases are not a factor in the LacI display system.

The number of small peptides available in recombinant random libraries is enormous. Libraries of $10^7$-$10^9$ independent clones are routinely prepared. Libraries as large as $10^{11}$ recombinants have been created, but this size approaches the practical limit for clone libraries. This limitation in library size occurs at the step of transforming the DNA containing randomized segments into the host bacterial cells. To circumvent this limitation, an in vitro system based on the display of nascent peptides in polysome complexes has recently been developed. This display library method has the potential of producing libraries 3-6 orders of magnitude larger than the currently available phage/phagemid or plasmid libraries. Furthermore, the construction of the libraries, expression of the peptides, and screening, is done in an entirely cell-free format.

In one application of this method (Gallop et al. (1994) *J. Med. Chem.* 37(9):1233-1251), a molecular DNA library encoding $10^{12}$ decapeptides was constructed and the library expressed in an *E. coli* S30 in vitro coupled transcription/translation system. Conditions were chosen to stall the ribosomes on the mRNA, causing the accumulation of a substantial proportion of the RNA in polysomes and yielding complexes containing nascent peptides still linked to their encoding RNA. The polysomes are sufficiently robust to be affinity purified on immobilized receptors in much the same way as the more conventional recombinant peptide display libraries are screened. RNA from the bound complexes is recovered, converted to cDNA, and amplified by PCR to produce a template for the next round of synthesis and screening. The polysome display method can be coupled to the phage display system. Following several rounds of screening, cDNA from the enriched pool of polysomes was cloned into a phagemid vector. This vector serves as both a peptide expression vector, displaying peptides fused to the coat proteins, and as a DNA sequencing vector for peptide identification. By expressing the polysome-derived peptides on phage, one can either continue the affinity selection procedure in this format or assay the peptides on individual clones for binding activity in a phage ELISA, or for binding specificity in a completion phage ELISA (Barret, et al. (1992) *Anal. Biochem* 204, 357-364). To identify the sequences of the active peptides one sequences the DNA produced by the phagemid host.

Secondary Screening of Polypeptides and Analogs

The high through-put assays described above can be followed by secondary screens in order to identify further biological activities which will, e.g., allow one skilled in the art to differentiate agonists from antagonists. The type of a secondary screen used will depend on the desired activity that needs to be tested. For example, an assay can be developed in which the ability to inhibit an interaction between a protein of interest and its respective ligand can be used to identify antagonists from a group of peptide fragments isolated though one of the primary screens described above.

Therefore, methods for generating fragments and analogs and testing them for activity are known in the art. Once the core sequence of interest is identified, it is routine for one skilled in the art to obtain analogs and fragments.

Peptide Mimetics of *A. fumigatus* Polypeptides

The invention also provides for reduction of the protein binding domains of the subject *A. fumigatus* polypeptides to generate mimetics, e.g. peptide or non-peptide agents. The peptide mimetics are able to disrupt binding of a polypeptide to its counter ligand, e.g., in the case of an *A. fumigatus* polypeptide binding to a naturally occurring ligand. The critical residues of a subject *A. fumigatus* polypeptide which are involved in molecular recognition of a polypeptide can be determined and used to generate *A. fumigatus*-derived peptidomimetics which competitively or noncompetitively inhibit binding of the *A. fumigatus* polypeptide with an interacting polypeptide (see, for example, European patent applications EP-412,762A and EP-B31,080A).

For example, scanning mutagenesis can be used to map the amino acid residues of a particular *A. fumigatus* polypeptide involved in binding an interacting polypeptide, peptidomimetic compounds (e.g. diazepine or isoquinoline derivatives) can be generated which mimic those residues in binding to an interacting polypeptide, and which therefore can inhibit binding of an *A. fumigatus* polypeptide to an interacting polypeptide and thereby interfere with the function of *A. fumigatus* polypeptide. For instance, non-hydrolyzable peptide analogs of such residues can be generated using benzodiazepine (e.g., see Freidinger et al. in *Peptides: Chemistry and Biology*, G. R. Marshall ed., ESCOM Publisher: Leiden, Netherlands, 1988), azepine (e.g., see Huffman et al. in *Peptides: Chemistry and Biology*, G. R. Marshall ed., ESCOM Publisher: Leiden, Netherlands, 1988), substituted gama lactam rings (Garvey et al. in *Peptides: Chemistry and Biology*, G. R. Marshall ed., ESCOM Publisher: Leiden, Netherlands, 1988), keto-methylene pseudopeptides (Ewenson et al. (1986) *J Med Chem* 29:295; and Ewenson et al. in *Peptides: Structure and Function* (Proceedings of the 9th American Peptide Symposium) Pierce Chemical Co. Rockland, Ill., 1985), b-turn dipeptide cores (Nagai et al. (1985) *Tetrahedron Lett* 26:647; and Sato et al. (1986) *J Chem Soc Perkin Trans* 1:1231), and b-aminoalcohols (Gordon et al. (1985) *Biochem Biophys Res Common* 126:419; and et al. (1986) *Biochem Biophys Res Commun* 134:71).

Vaccine Formulations for *A. fumigatus* Nucleic Acids and Polypeptides

This invention also features vaccine compositions for protection against infection by *A. fumigatus* or for treatment of *A. fumigatus* infection. In one embodiment, the vaccine compositions contain one or more immunogenic components such as a surface protein from *A. fumigatus*, or portion thereof, and a pharmaceutically acceptable carrier. Nucleic acids within the scope of the invention are exemplified by the nucleic acids of the invention contained in the Sequence Listing which encode *A. fumigatus* surface proteins. Any nucleic acid encoding an immunogenic *A. fumigatus* protein, or portion thereof, which is capable of expression in a cell, can be used in the present invention. These vaccines have therapeutic and prophylactic utilities.

One aspect of the invention provides a vaccine composition for protection against infection by *A. fumigatus* which contains at least one immunogenic fragment of an *A. fumigatus* protein and a pharmaceutically acceptable carrier. Preferred fragments include peptides of at least about 10 amino acid residues in length, preferably about 10-20 amino acid residues in length, and more preferably about 12-16 amino acid residues in length.

Immunogenic components of the invention can be obtained, for example, by screening polypeptides recombinantly produced from the corresponding fragment of the nucleic acid encoding the full-length *A. fumigatus* protein. In addition, fragments can be chemically synthesized using techniques known in the art such as conventional Merrifield solid phase f-Moc or t-Boc chemistry.

In one embodiment, immunogenic components are identified by the ability of the peptide to stimulate T cells. Peptides which stimulate T cells, as determined by, for example, T cell proliferation or cytokine secretion are defined herein as comprising at least one T cell epitope. T cell epitopes are believed to be involved in initiation and perpetuation of the immune response to the protein allergen which is responsible for the clinical symptoms of allergy. These T cell epitopes are thought to trigger early events at the level of the T helper cell by binding to an appropriate HLA molecule on the surface of an antigen presenting cell, thereby stimulating the T cell subpopulation with the relevant T cell receptor for the epitope. These events lead to T cell proliferation, lymphokine secretion, local inflammatory reactions, recruitment of additional immune cells to the site of antigen/T cell interaction, and activation of the B cell cascade, leading to the production of antibodies. A T cell epitope is the basic element, or smallest unit of recognition by a T cell receptor, where the epitope comprises amino acids essential to receptor recognition (e.g., approximately 6 or 7 amino acid residues). Amino acid sequences which mimic those of the T cell epitopes are within the scope of this invention.

Screening immunogenic components can be accomplished using one or more of several different assays. For example, in vitro, peptide T cell stimulatory activity is assayed by contacting a peptide known or suspected of being immunogenic with an antigen presenting cell which presents appropriate MHC molecules in a T cell culture. Presentation of an immunogenic *A. fumigatus* peptide in association with appropriate MHC molecules to T cells in conjunction with the necessary co-stimulation has the effect of transmitting a signal to the T cell that induces the production of increased levels of cytokines, particularly of interleukin-2 and interleukin-4. The culture supernatant can be obtained and assayed for interleukin-2 or other known cytokines. For example, any one of several conventional assays for interleukin-2 can be employed, such as the assay described in *Proc. Natl. Acad. Sci USA*, 86: 1333 (1989) the pertinent portions of which are incorporated herein by reference. A kit for an assay for the production of interferon is also available from Genzyme Corporation (Cambridge, Mass.).

Alternatively, a common assay for T cell proliferation entails measuring tritiated thymidine incorporation. The proliferation of T cells can be measured in vitro by determining the amount of $^3$H-labeled thymidine incorporated into the replicating DNA of cultured cells. Therefore, the rate of DNA synthesis and, in turn, the rate of cell division can be quantified.

Vaccine compositions of the invention containing immunogenic components (e.g., *A. fumigatus* polypeptide or fragment thereof or nucleic acid encoding an *A. fumigatus* polypeptide or fragment thereof) preferably include a pharmaceutically acceptable carrier. The term "pharmaceutically acceptable carrier" refers to a carrier that does not cause an allergic reaction or other untoward effect in patients to whom it is administered. Suitable pharmaceutically acceptable carriers include, for example, one or more of water, saline, phosphate buffered saline, dextrose, glycerol, ethanol and the like, as well as combinations thereof. Pharmaceutically acceptable carriers may further comprise minor amounts of auxiliary substances such as wetting or emulsifying agents, preservatives or buffers, which enhance the shelf life or effectiveness of the antibody. For vaccines of the invention containing *A. fumigatus* polypeptides, the polypeptide is co-administered with a suitable adjuvant.

It will be apparent to those of skill in the art that the therapeutically effective amount of DNA or protein of this invention will depend, inter alia, upon the administration schedule, the unit dose of antibody administered, whether the protein or DNA is administered in combination with other therapeutic agents, the immune status and health of the patient, and the therapeutic activity of the particular protein or DNA.

Vaccine compositions are conventionally administered parenterally, e.g., by injection, either subcutaneously or intramuscularly. Methods for intramuscular immunization are described by Wolff et al. (1990) *Science* 247: 1465-1468 and by Sedegah et al. (1994) *Immunology* 91: 9866-9870. Other modes of administration include oral and pulmonary formulations, suppositories, and transdermal applications. Oral immunization is preferred over parenteral methods for inducing protection against infection by *A. fumigatus*. Cain et. al. (1993) *Vaccine* 11: 637-642. Oral formulations include such normally employed excipients as, for example, pharmaceutical grades of mannitol, lactose, starch, magnesium stearate, sodium saccharine, cellulose, magnesium carbonate, and the like.

The vaccine compositions of the invention can include an adjuvant, including, but not limited to aluminum hydroxide; N-acetyl-muramyl-L-threonyl-D-isoglutamine (thr-MDP); N-acetyl-nor-muramyl-L-alanyl-D-isoglutamine (CGP 11637, referred to as nor-MDP); N-acetylmuramyl-L-alanyl-D-isoglutaminyl-L-alanine-2-(1'-2'-dipalmitoyl-sn-glycero-3-hydroxyphos-phoryloxy)-ethylamine (CGP 19835A, referred to a MTP-PE); RIBI, which contains three components from bacteria; monophosphoryl lipid A; trehalose dimycoloate; cell wall skeleton (MPL+TDM+CWS) in a 2% squalene/Tween 80 emulsion; and cholera toxin. Others which may be used are non-toxic derivatives of cholera toxin, including its B subunit, and/or conjugates or genetically engineered fusions of the A. fumigatus polypeptide with cholera toxin or its B subunit, procholeragenoid, fungal polysaccharides, including schizophyllan, muramyl dipeptide, muramyl dipeptide derivatives, phorbol esters, labile toxin of E. coli, non-A. fumigatus fungal lysates, block polymers or saponins.

Other suitable delivery methods include biodegradable microcapsules or immuno-stimulating complexes (IS-COMs), cochleates, or liposomes, genetically engineered attenuated live vectors such as viruses or bacteria, and recombinant (chimeric) virus-like particles, e.g., bluetongue. The amount of adjuvant employed will depend on the type of adjuvant used. For example, when the mucosal adjuvant is cholera toxin, it is suitably used in an amount of 5 mg to 50 mg, for example 10 mg to 35 mg. When used in the form of microcapsules, the amount used will depend on the amount employed in the matrix of the microcapsule to achieve the desired dosage. The determination of this amount is within the skill of a person of ordinary skill in the art.

Carrier systems in humans may include enteric release capsules protecting the antigen from the acidic environment of the stomach, and including A. fumigatus polypeptide in an insoluble form as fusion proteins. Suitable carriers for the vaccines of the invention are enteric coated capsules and polylactide-glycolide microspheres. Suitable diluents are 0.2 N NaHCO$_3$ and/or saline.

Vaccines of the invention can be administered as a primary prophylactic agent in adults or in children, as a secondary prevention, after successful eradication of A. fumigatus in an infected host, or as a therapeutic agent in the aim to induce an immune response in a susceptible host to prevent infection by A. fumigatus. The vaccines of the invention are administered in amounts readily determined by persons of ordinary skill in the art. Thus, for adults a suitable dosage will be in the range of 10 mg to 10 g, preferably 10 mg to 100 mg. A suitable dosage for adults will also be in the range of 5 mg to 500 mg. Similar dosage ranges will be applicable for children. Those skilled in the art will recognize that the optimal dose may be more or less depending upon the patient's body weight, disease, the route of administration, and other factors. Those skilled in the art will also recognize that appropriate dosage levels can be obtained based on results with known oral vaccines such as, for example, a vaccine based on an E. coli lysate (6 mg dose daily up to total of 540 mg) and with an enterotoxigenic E. coli purified antigen (4 doses of 1 mg) (Schulman et al., J. Urol. 150:917-921 (1993); Boedecker et al., American Gastroenterological Assoc. 999:A-222 (1993)). The number of doses will depend upon the disease, the formulation, and efficacy data from clinical trials. Without intending any limitation as to the course of treatment, the treatment can be administered over 3 to 8 doses for a primary immunization schedule over 1 month (Boedeker, American Gastroenterological Assoc. 888:A-222 (1993)).

In a preferred embodiment, a vaccine composition of the invention can be based on a killed whole E. coli preparation with an immunogenic fragment of an A. fumigatus protein of the invention expressed on its surface or it can be based on an E. coli lysate, wherein the killed E. coli acts as a carrier or an adjuvant.

It will be apparent to those skilled in the art that some of the vaccine compositions of the invention are useful only for preventing A. fumigatus infection, some are useful only for treating A. fumigatus infection, and some are useful for both preventing and treating A. fumigatus infection. In a preferred embodiment, the vaccine composition of the invention provides protection against A. fumigatus infection by stimulating humoral and/or cell-mediated immunity against A. fumigatus. It should be understood that amelioration of any of the symptoms of A. fumigatus infection is a desirable clinical goal, including a lessening of the dosage of medication used to treat A. fumigatus-caused disease, or an increase in the production of antibodies in the serum or mucous of patients.

Antibodies Reactive with A. fumigatus Polypeptides

The invention also includes antibodies specifically reactive with the subject A. fumigatus polypeptide. Anti-protein/anti-peptide antisera or monoclonal antibodies can be made by standard protocols (See, for example, Antibodies: A Laboratory Manual ed. by Harlow and Lane (Cold Spring Harbor Press: 1988)). A mammal such as a mouse, a hamster or rabbit can be immunized with an immunogenic form of the peptide. Techniques for conferring immunogenicity on a protein or peptide include conjugation to carriers or other techniques well known in the art. An immunogenic portion of the subject A. fumigatus polypeptide can be administered in the presence of adjuvant. The progress of immunization can be monitored by detection of antibody titers in plasma or serum. Standard ELISA or other immunoassays can be used with the immunogen as antigen to assess the levels of antibodies.

In a preferred embodiment, the subject antibodies are immunospecific for antigenic determinants of the A. fumigatus polypeptides of the invention, e.g. antigenic determinants of a polypeptide of the invention contained in the Sequence Listing, or a closely related human or non-human mammalian homolog (e.g., 90% homologous, more preferably at least about 95% homologous). In yet a further preferred embodiment of the invention, the anti-A. fumigatus antibodies do not substantially cross react (i.e., react specifically) with a protein which is for example, less than 80% percent homologous to a sequence of the invention contained in the Sequence Listing. By "not substantially cross react", it is meant that the antibody has a binding affinity for a non-homologous protein which is less than 10 percent, more preferably less than 5 percent, and even more preferably less than 1 percent, of the binding affinity for a protein of the invention contained in the Sequence Listing. In a most preferred embodiment, there is no cross-reactivity between fungal and mammalian antigens.

The term antibody as used herein is intended to include fragments thereof which are also specifically reactive with A. fumigatus polypeptides. Antibodies can be fragmented using conventional techniques and the fragments screened for utility in the same manner as described above for whole antibodies. For example, F(ab')$_2$ fragments can be generated by treating antibody with pepsin. The resulting F(ab')$_2$ fragment can be treated to reduce disulfide bridges to produce Fab' fragments. The antibody of the invention is further intended to include bispecific and chimeric molecules having an anti-A. fumigatus portion.

Both monoclonal and polyclonal antibodies (Ab) directed against *A. fumigatus* polypeptides or *A. fumigatus* polypeptide variants, and antibody fragments such as Fab' and F(ab')$_2$, can be used to block the action of *A. fumigatus* polypeptide and allow the study of the role of a particular *A. fumigatus* polypeptide of the invention in aberrant or unwanted intracellular signaling, as well as the normal cellular function of the *A. fumigatus* and by microinjection of anti-*A. fumigatus* polypeptide antibodies of the present invention.

Antibodies which specifically bind *A. fumigatus* epitopes can also be used in immunohistochemical staining of tissue samples in order to evaluate the abundance and pattern of expression of *A. fumigatus* antigens. Anti-*A. fumigatus* polypeptide antibodies can be used diagnostically in immuno-precipitation and immuno-blotting to detect and evaluate *A. fumigatus* levels in tissue or bodily fluid as part of a clinical testing procedure. Likewise, the ability to monitor *A. fumigatus* polypeptide levels in an individual can allow determination of the efficacy of a given treatment regimen for an individual afflicted with such a disorder. The level of an *A. fumigatus* polypeptide can be measured in cells found in bodily fluid, such as in urine samples or can be measured in tissue, such as produced by gastric biopsy. Diagnostic assays using anti-*A. fumigatus* antibodies can include, for example, immunoassays designed to aid in early diagnosis of *A. fumigatus* infections. The present invention can also be used as a method of detecting antibodies contained in samples from individuals infected by this bacterium using specific *A. fumigatus* antigens.

Another application of anti-*A. fumigatus* polypeptide antibodies of the invention is in the immunological screening of cDNA libraries constructed in expression vectors such as λgt11, λgt18-23, λZAP, and λORF8. Messenger libraries of this type, having coding sequences inserted in the correct reading frame and orientation, can produce fusion proteins. For instance, λgt11 will produce fusion proteins whose amino termini consist of β-galactosidase amino acid sequences and whose carboxy termini consist of a foreign polypeptide. Antigenic epitopes of a subject *A. fumigatus* polypeptide can then be detected with antibodies, as, for example, reacting nitrocellulose filters lifted from infected plates with anti-*A. fumigatus* polypeptide antibodies. Phage, scored by this assay, can then be isolated from the infected plate. Thus, the presence of *A. fumigatus* gene homologs can be detected and cloned from other species, and alternate isoforms (including splicing variants) can be detected and cloned.

Kits Containing Nucleic Acids, Polypeptides or Antibodies of the Invention

The nucleic acid, polypeptides and antibodies of the invention can be combined with other reagents and articles to form kits. Kits for diagnostic purposes typically comprise the nucleic acid, polypeptides or antibodies in vials or other suitable vessels. Kits typically comprise other reagents for performing hybridization reactions, polymerase chain reactions (PCR), or for reconstitution of lyophilized components, such as aqueous media, salts, buffers, and the like. Kits may also comprise reagents for sample processing such as detergents, chaotropic salts and the like. Kits may also comprise immobilization means such as particles, supports, wells, dipsticks and the like. Kits may also comprise labeling means such as dyes, developing reagents, radioisotopes, fluorescent agents, luminescent or chemiluminescent agents, enzymes, intercalating agents and the like. With the nucleic acid and amino acid sequence information provided herein, individuals skilled in art can readily assemble kits to serve their particular purpose. Kits further can include instructions for use.

Bio Chip Technology

The nucleic acid sequence of the present invention may be used to detect *A. fumigatus* or other species of *Aspergillus* acid sequence using bio chip technology. Bio chips containing arrays of nucleic acid sequence can also be used to measure expression of genes of *A. fumigatus* or other species of *Aspergillus*. For example, to diagnose a patient with a *A. fumigatus* or other *Aspergillus* infection, a sample from a human or animal can be used as a probe on a bio chip containing an array of nucleic acid sequence from the present invention. In addition, a sample from a disease state can be compared to a sample from a non-disease state which would help identify a gene that is up-regulated or expressed in the disease state. This would provide valuable insight as to the mechanism by which the disease manifests. Changes in gene expression can also be used to identify critical pathways involved in drug transport or metabolism, and may enable the identification of novel targets involved in virulence or host cell interactions involved in maintenance of an infection. Procedures using such techniques have been described by Brown et al., 1995, *Science* 270: 467-470.

Bio chips can also be used to monitor the genetic changes of potential therapeutic compounds including, deletions, insertions or mismatches. Once the therapeutic is added to the patient, changes to the genetic sequence can be evaluated for its efficacy. In addition, the nucleic acid sequence of the present invention can be used to determine essential genes in cell cycling. As described in Iyer et al., 1999 (*Science,* 283 :83-87) genes essential in the cell cycle can be identified using bio chips. Furthermore, the present invention provides nucleic acid sequence which can be used with bio chip technology to understand regulatory networks in bacteria, measure the response to environmental signals or drugs as in drug screening, and study virulence induction. (Mons et al., 1998, *Nature Biotechnology,* 16: 45-48. Patents teaching this technology include U.S. Pat. Nos. 5,445,934, 5,744,305, and 5,800,992.

Drug Screening Assays Using *A. fumigatus* Polypeptides

By making available purified and recombinant *A. fumigatus* polypeptides, the present invention provides assays which can be used to screen for drugs which are either agonists or antagonists of the normal cellular function, in this case, of the subject *A. fumigatus* polypeptides, or of their role in intracellular signaling. Such inhibitors or potentiators may be useful as new therapeutic agents to combat *A. fumigatus* infections in humans. A variety of assay formats will suffice and, in light of the present inventions, will be comprehended by the person skilled in the art.

In many drug screening programs which test libraries of compounds and natural extracts, high throughput assays are desirable in order to maximize the number of compounds surveyed in a given period of time. Assays which are performed in cell-free systems, such as may be derived with purified or semi-purified proteins, are often preferred as "primary" screens in that they can be generated to permit rapid development and relatively easy detection of an alteration in a molecular target which is mediated by a test compound. Moreover, the effects of cellular toxicity and/or bioavailability of the test compound can be generally ignored in the in vitro system, the assay instead being focused primarily on the effect of the drug on the molecular target as may be manifest in an alteration of binding affinity with other proteins or change in enzymatic properties of the molecular target.

Accordingly, in an exemplary screening assay of the present invention, the compound of interest is contacted with an isolated and purified *A. fumigatus* polypeptide.

Screening assays can be constructed in vitro with a purified *A. fumigatus* polypeptide or fragment thereof, such as an *A. fumigatus* polypeptide having enzymatic activity, such that the activity of the polypeptide produces a detectable reaction product. The efficacy of the compound can be assessed by generating dose response curves from data obtained using various concentrations of the test compound. Moreover, a control assay can also be performed to provide a baseline for comparison. Suitable products include those with distinctive absorption, fluorescence, or chemiluminescence properties, for example, because detection may be easily automated. A variety of synthetic or naturally occurring compounds can be tested in the assay to identify those which inhibit or potentiate the activity of the *A. fumigatus* polypeptide. Some of these active compounds may directly, or with chemical alterations to promote membrane permeability or solubility, also inhibit or potentiate the same activity (e.g., enzymatic activity) in whole, live *A. fumigatus* cells.

Overexpression Assays

Overexpression assays are based on the premise that overproduction of a protein would lead to a higher level of resistance to compounds that selectively interfere with the function of that protein. Overexpression assays may be used to identify compounds that interfere with the function of virtually any type of protein, including without limitation enzymes, receptors, DNA- or RNA-binding proteins, or any proteins that are directly or indirectly involved in regulating cell growth.

Typically, two bacterial strains are constructed. One contains a single copy of the gene of interest, and a second contains several copies of the same gene. Identification of useful inhibitory compounds of this type of assay is based on a comparison of the activity of a test compound in inhibiting growth and/or viability of the two strains. The method involves constructing a nucleic acid vector that directs high level expression of a particular target nucleic acid. The vectors are then transformed into host cells in single or multiple copies to produce strains that express low to moderate and high levels of protein encoding by the target sequence (strain A and B, respectively). Nucleic acid comprising sequences encoding the target gene can, of course, be directly integrated into the host cell.

Large numbers of compounds (or crude substances which may contain active compounds) are screened for their effect on the growth of the two strains. Agents which interfere with an unrelated target equally inhibit the growth of both strains. Agents which interfere with the function of the target at high concentration should inhibit the growth of both strains. It should be possible, however, to titrate out the inhibitory effect of the compound in the overexpressing strain. That is, if the compound is affecting the particular target that is being tested, it should be possible to inhibit the growth of strain A at a concentration of the compound that allows strain B to grow.

Alternatively, a bacterial strain is constructed that contains the gene of interest under the control of an inducible promoter. Identification of useful inhibitory agents using this type of assay is based on a comparison of the activity of a test compound in inhibiting growth and/or viability of this strain under both inducing and non-inducing conditions. The method involves constructing a nucleic acid vector that directs high-level expression of a particular target nucleic acid. The vector is then transformed into host cells that are grown under both non-inducing and inducing conditions (conditions A and B, respectively).

Large numbers of compounds (or crude substances which may contain active compounds) are screened for their effect on growth under these two conditions. Agents that interfere with the function of the target should inhibit growth under both conditions. It should be possible, however, to titrate out the inhibitory effect of the compound in the overexpressing strain. That is, if the compound is affecting the particular target that is being tested, it should be possible to inhibit growth under condition A at a concentration that allows the strain to grow under condition B.

Ligand-Binding Assays

Many of the targets according to the invention have functions that have not yet been identified. Ligand-binding assays are useful to identify inhibitor compounds that interfere with the function of a particular target, even when that function is unknown. These assays are designed to detect binding of test compounds to particular targets. The detection may involve direct measurement of binding. Alternatively, indirect indications of binding may involve stabilization of protein structure or disruption of a biological function. Non-limiting examples of useful ligand-binding assays are detailed below.

A useful method for the detection and isolation of binding proteins is the Biomolecular Interaction Assay (BIAcore) system developed by Pharmacia Biosensor and described in the manufacturer's protocol (LKB Pharmacia, Sweden). The BIAcore system uses an affinity purified anti-GST antibody to immobilize GST-fusion proteins onto a sensor chip. The sensor utilizes surface plasmon resonance which is an optical phenomenon that detects changes in refractive indices. In accordance with the practice of the invention, a protein of interest is coated onto a chip and test compounds are passed over the chip. Binding is detected by a change in the refractive index (surface plasmon resonance).

A different type of ligand-binding assay involves scintillation proximity assays (SPA, described in U.S. Pat. No. 4,568, 649).

Another type of ligand binding assay, also undergoing development, is based on the fact that proteins containing mitochondrial targeting signals are imported into isolated mitochondria in vitro (Hurt et al., 1985, *Embo J.* 4:2061-2068; Eilers and Schatz, *Nature,* 1986, 322:228-231). In a mitochondrial import assay, expression vectors are constructed in which nucleic acids encoding particular target proteins are inserted downstream of sequences encoding mitochondrial import signals. The chimeric proteins are synthesized and tested for their ability to be imported into isolated mitochondria in the absence and presence of test compounds. A test compound that binds to the target protein should inhibit its uptake into isolated mitochondria in vitro.

Another ligand-binding assay is the yeast two-hybrid system (Fields and Song, 1989, *Nature* 340:245-246). The yeast two-hybrid system takes advantage of the properties of the GAL4 protein of the yeast *Saccharomyces cerevisiae*. The GAL4 protein is a transcriptional activator required for the expression of genes encoding enzymes of galactose utilization. This protein consists of two separable and functionally essential domains: an N-terminal domain which binds to specific DNA sequences ($UAS_G$); and a C-terminal domain containing acidic regions, which is necessary to activate transcription. The native GAL4 protein, containing both domains, is a potent activator of transcription when yeast are grown on galactose media. The N-terminal domain binds to DNA in a sequence-specific manner but is unable to activate transcription. The C-terminal domain contains the activating regions but cannot activate transcription because it fails to be localized to $UAS_G$. In the two-hybrid system, a system of two hybrid proteins containing parts of GAL4: (1) a GAL4 DNA-binding domain fused to a protein 'X' and (2) a GAL4 activation region fused to a protein 'Y'. If X and Y can form a protein-protein complex and reconstitute proximity of the GAL4 domains, transcription of a gene regulated by $UAS_G$ occurs. Creation of two hybrid proteins, each containing one of the interacting proteins X and Y, allows the activation region of $UAS_G$ to be brought to its normal site of action.

The binding assay described in Fodor et al., 1991, *Science* 251:767-773, which involves testing the binding affinity of test compounds for a plurality of defined polymers synthesized on a solid substrate, may also be useful.

Compounds which bind to the polypeptides of the invention are potentially useful as antifungal agents for use in therapeutic compositions.

Pharmaceutical formulations suitable for antifungal therapy comprise the antifungal agent in conjunction with one or more biologically acceptable carriers. Suitable biologically acceptable carriers include, but are not limited to, phosphate-buffered saline, saline, deionized water, or the like. Preferred biologically acceptable carriers are physiologically or pharmaceutically acceptable carriers.

The antifungal compositions include an antifungal effective amount of active agent. Antifungal effective amounts are those quantities of the antifungal agents of the present invention that afford prophylactic protection against fungal infections or which result in amelioration or cure of an existing fungal infection. This antifungal effective amount will depend upon the agent, the location and nature of the infection, and the particular host. The amount can be determined by experimentation known in the art, such as by establishing a matrix of dosages and frequencies and comparing a group of experimental units or subjects to each point in the matrix.

The antifungal active agents or compositions can be formed into dosage unit forms, such as for example, creams, ointments, lotions, powders, liquids, tablets, capsules, suppositories, sprays, aerosols or the like. If the antifungal composition is formulated into a dosage unit form, the dosage unit form may contain an antifungal effective amount of active agent. Alternatively, the dosage unit form may include less than such an amount if multiple dosage unit forms or multiple dosages are to be used to administer a total dosage of the active agent. Dosage unit forms can include, in addition, one or more excipient(s), diluent(s), disintegrant(s), lubricant(s), plasticizer(s), colorant(s), dosage vehicle(s), absorption enhancer(s), stabilizer(s), bactericide(s), or the like.

For general information concerning formulations, see, e.g., Gilman et al. (eds.), 1990, *Goodman and Gilman's. The Pharmacological Basis of Therapeutics*, 8th ed., Pergamon Press; and *Remington's Pharmaceutical Sciences*, 17th ed., 1990, Mack Publishing Co., Easton, Pa.; Avis et al. (eds.), 1993, *Pharmaceutical Dosage Forms: Parenteral Medications*, Dekker, New York; Lieberman et al (eds.), 1990, *Pharmaceutical Dosage Forms: Disperse Systems*, Dekker, New York.

The antifungal agents and compositions of the present invention are useful for preventing or treating *A. fumigatus* infections. Infection prevention methods incorporate a prophylactically effective amount of an antifungal agent or composition. A prophylactically effective amount is an amount effective to prevent *A. fumigatus* infection and will depend upon the specific fungal strain, the agent, and the host. These amounts can be determined experimentally by methods known in the art and as described above.

*A. fumigatus* infection treatment methods incorporate a therapeutically effective amount of an antifungal agent or composition. A therapeutically effective amount is an amount sufficient to ameliorate or eliminate the infection. The prophylactically and/or therapeutically effective amounts can be administered in one administration or over repeated administrations. Therapeutic administration can be followed by prophylactic administration, once the initial fungal infection has been resolved.

The antifungal agents and compositions can be administered topically or systemically. Topical application is typically achieved by administration of creams, ointments, lotions, or sprays as described above. Systemic administration includes both oral and parental routes. Parental routes include, without limitation, subcutaneous, intramuscular, intraperitoneal, intravenous, transdermal, inhalation and intranasal administration.

EXEMPLIFICATION

Cloning and Sequencing *A. fumigatus* Genomic Sequence

This invention provides nucleotide sequences of the genome of *A. fumigatus* which thus comprises a DNA sequence library of *A. fumigatus* genomic DNA. The detailed description that follows provides nucleotide sequences of *A. fumigatus*, and also describes how the sequences were obtained and how ORFs (Open Reading Frames) and protein-coding sequences can be identified. Also described are methods of using the disclosed *A. fumigatus* sequences in methods including diagnostic and therapeutic applications. Furthermore, the library can be used as a database for identification and comparison of medically important sequences in this and other strains of *A. fumigatus* as well as other species of *Aspergillus*.

Chromosomal DNA from strain ND 158 of *A. fumigatus* DNA was isolated from cultures grown on Sabouraud Dextrose medium (Difco Manual, Tenth Edition (1984) Difco Laboratories Incorporated, Detroit, p. 768). The isolation protocol included an initial polytron homogenization, repeated freezing and boiling of the extract followed by glass bead homogenization and phenol:chloroform:iso-amyl alcohol extraction (e.g., *Methods. Enzymol*. Guide to Yeast Genetics and Molecular Biology, Volume 194, Guthrie C and Fink G R, editors, Academic Press, Inc., Boston, Cold Spring Harbor, N.Y.). The final extract was ethanol-precipitated, centrifuged, and the DNA pellet redissolved. Genomic *A. fumigatus* DNA was hydrodynamically sheared in an HPLC and then separated on a standard 1% agarose gel. Fractions corresponding to 2500-3000 bp in length were excised from the gel and purified by the GeneClean procedure (Bio101, Inc.).

The purified DNA fragments were then blunt-ended using T4 DNA polymerase. The healed DNA was then ligated to unique BstXI-linker adapters (5'-GTCTTCACCACGGGG-3' and 5'-GTGGTGAAGAC-3' in 100-1000 fold molar excess). These linkers are complimentary to the BstXI-cut pGTC vector, while the overhang is not self-complimentary. Therefore, the linkers will not concatermerize nor will the cut-vector religate itself easily. The linker-adapted inserts were separated from the unincorporated linkers on a 1% agarose gel and purified using GeneClean. The linker-adapted inserts were then ligated to BstXI-cut vector to construct a "shotgun" subclone libraries.

Only major modifications to the protocols are highlighted. Briefly, the library was then transformed into DH5α competent cells (Gibco/BRL, DH5á transformation protocol). It was assessed by plating onto antibiotic plates containing ampicillin and IPTG/Xgal. The plates were incubated overnight at 37° C. Transformants were then used for plating of clones and picking for sequencing. The cultures were grown overnight at 37° C. DNA was purified using a silica bead DNA preparation (Engelstein, 1996) method. In this manner, 25 μg of DNA was obtained per clone.

These purified DNA samples were then sequenced using primarily ABI dye-terminator chemistry. All subsequent steps were based on sequencing by ABI377 automated DNA sequencing methods. The ABI dye terminator sequence reads were run on ABI377 machines and the data was transferred to UNIX machines following lane tracking of the gels. Base calls and quality scores were determined using the program PHRED (Ewing et al., 1998, Genome Res. 8: 175-185; Ewing and Green, 1998, Genome Res. 8: 685-734). Reads were assembled using PHRAP (P. Green, Abstracts of DOE Human Genome Program Contractor-Grantee Workshop V, January 1996, p. 157) with default program parameters and quality scores. The initial assembly was done at 2-fold coverage and yielded 11522 ordered contigs.

Finishing can follow the initial assembly. Missing mates (sequences from clones that only gave reads from one end of the *Aspergillus* DNA inserted in the plasmid) can be identified and sequenced with ABI technology to allow the identification of additional overlapping contigs.

End-sequencing of randomly picked genomic lambda was also performed. Sequencing on a both sides was done for all lambda sequences. The lambda library backbone helped to verify the integrity of the assembly and allowed closure of some of the physical gaps. Primers for walking off the ends of contigs would be selected using pick_primer (a GTC program) near the ends of the clones to facilitate gap closure. These walks can be sequenced using the selected clones and primers. These data are then reassembled with PHRAP. Additional sequencing using PCR-generated templates and screened and/or unscreened lambda templates can be done in addition.

To identify *A. fumigatus* polypeptides the complete genomic sequence of *A. fumigatus* were analyzed essentially as follows: First, all possible stop-to-stop open reading frames (ORFs) greater than 180 nucleotides in all six reading frames were translated into amino acid sequences. Second, the identified ORFs were analyzed for homology to known (archeabacter, prokaryotic and eukaryotic) protein sequences. Third, the coding potential of non-homologous sequences were evaluated with the program GENEMARK™ (Borodovsky and McIninch, 1993, Comp. Chem. 17:123).

Identification, Cloning and Expression of *A. fumigatus* Nucleic Acids

Expression and purification of the *A. fumigatus* polypeptides of the invention can be performed essentially as outlined below.

To facilitate the cloning, expression and purification of membrane and secreted proteins from *A. fumigatus*, a gene expression system, such as the pET System (Novagen), for cloning and expression of recombinant proteins in *E. coli*, is selected. Also, a DNA sequence encoding a peptide tag, the His-Tag, is fused to the 3' end of DNA sequences of interest in order to facilitate purification of the recombinant protein products. The 3' end is selected for fusion in order to avoid alteration of any 5' terminal signal sequence.

PCR Amplification and Cloning of Nucleic Acids Containing ORF's Encoding Enzymes Nucleic acids chosen (for example, from the nucleic acids set forth in SEQ ID NO: 1-SEQ ID NO: 22156 for cloning from the ND158 strain of *A. fumigatus* are prepared for amplification cloning by polymerase chain reaction (PCR). Synthetic oligonucleotide primers specific for the 5' and 3' ends of open reading frames (ORFs) are designed and purchased from GibcoBRL Life Technologies (Gaithersburg, Md., USA). All forward primers (specific for the 5' end of the sequence) are designed to include an NcoI cloning site at the extreme 5' terminus. These primers are designed to permit initiation of protein translation at a methionine residue followed by a valine residue and the coding sequence for the remainder of the native *A. fumigatus* DNA sequence. All reverse primers (specific for the 3'end of any *A. fumigatus* ORF) include a EcoRI site at the extreme 5' terminus to permit cloning of each *A. fumigatus* sequence into the reading frame of the pET-28b. The pET-28b vector provides sequence encoding an additional 20 carboxy-terminal amino acids including six histidine residues (at the extreme C-terminus), which comprise the His-Tag.

Genomic DNA prepared from the ND158 strain of *A. fumigatus* is used as the source of template DNA for PCR amplification reactions (Current Protocols in Molecular Biology, John Wiley and Sons, Inc., F. Ausubel et al., eds., 1994). To amplify a DNA sequence containing an *A. fumigatus* ORF, genomic DNA (50 nanograms) is introduced into a reaction vial containing 2 mM $MgCl_2$, 1 micromolar synthetic oligonucleotide primers (forward and reverse primers) complementary to and flanking a defined *A. fumigatus* ORF, 0.2 mM of each deoxynucleotide triphosphate; dATP, dGTP, dCTP, dTTP and 2.5 units of heat stable DNA polymerase (Amplitaq, Roche Molecular Systems, Inc., Branchburg, N.J., USA) in a final volume of 100 microliters.

Upon completion of thermal cycling reactions, each sample of amplified DNA is washed and purified using the Qiaquick Spin PCR purification kit (Qiagen, Gaithersburg, Md., USA). All amplified DNA samples are subjected to digestion with the restriction endonucleases, e.g., NcoI and EcoRI (New England BioLabs, Beverly, Mass., USA) (Current Protocols in Molecular Biology, John Wiley and Sons, Inc., F. Ausubel et al., eds., 1994). DNA samples are then subjected to electrophoresis on 1.0% NuSeive (FMC BioProducts, Rockland, Me. USA) agarose gels. DNA is visualized by exposure to ethidium bromide and long wave uv irradiation. DNA contained in slices isolated from the agarose gel is purified using the Bio 101 GeneClean Kit protocol (Bio 101 Vista, Calif., USA).

Cloning of *A. fumigatus* Nucleic Acids into an Expression Vector

The pET-28b vector is prepared for cloning by digestion with restriction endonucleases, e.g., NcoI and EcoRI (Current Protocols in Molecular Biology, John Wiley and Sons, Inc., F. Ausubel et al., eds., 1994). The pET-28a vector, which encodes a His-Tag that can be fused to the 5' end of an inserted gene, is prepared by digestion with appropriate restriction endonucleases.

Following digestion, DNA inserts are cloned (Current Protocols in Molecular Biology, John Wiley and Sons, Inc., F.

Ausubel et al., eds., 1994) into the previously digested pET-28b expression vector. Products of the ligation reaction are then used to transform the BL21 strain of E. coli (Current Protocols in Molecular Biology, John Wiley and Sons, Inc., F. Ausubel et al., eds., 1994) as described below.

Transformation of Competent Bacteria with Recombinant Plasmids

Competent bacteria, E Coli strain BL21 or E. coli strain BL21 (DE3), are transformed with recombinant pET expression plasmids carrying the cloned A. fumigatus sequences according to standard methods (Current Protocols in Molecular, John Wiley and Sons, Inc., F. Ausubel et al., eds., 1994). Briefly, 1 microliter of ligation reaction is mixed with 50 microliters of electrocompetent cells and subjected to a high voltage pulse, after which, samples are incubated in 0.45 milliliters SOC medium (0.5% yeast extract, 2.0% tryptone, 10 mM NaCl, 2.5 mM KCl, 10 mM MgCl2, 10 mM MgSO4 and 20, mM glucose) at 37°C with shaking for 1 hour. Samples are then spread on LB agar plates containing 25 microgram/ml kanamycin sulfate for growth overnight. Transformed colonies of BL21 are then picked and analyzed to evaluate cloned inserts as described below.

Identification of Recombinant Expression Vectors with A. fumigatus Nucleic Acids Individual BL21 clones transformed with recombinant pET-28b A. fumigatus ORFs are analyzed by PCR amplification of the cloned inserts using the same forward and reverse primers, specific for each A. fumigatus sequence, that were used in the original PCR amplification cloning reactions. Successful amplification verifies the integration of the A. fumigatus sequences in the expression vector (Current Protocols in Molecular Biology, John Wiley and Sons, Inc., F. Ausubel et al., eds., 1994).

Isolation and Preparation of Nucleic Acids from Transformants

Individual clones of recombinant pET-28b vectors carrying properly cloned A. fumigatus ORFs are picked and incubated in 5 mls of LB broth plus 25 microgram/ml kanamycin sulfate overnight. The following day plasmid DNA is isolated and purified using the Qiagen plasmid purification protocol (Qiagen Inc., Chatsworth, Calif., USA).

Expression of Recombinant A. fumigatus Sequences in E. coli

The pET vector can be propagated in any E. coli K-12 strain e.g. HMS174, HB01, JM109, DH5, etc. for the purpose of cloning or plasmid preparation. Hosts for expression include E. coli strains containing a chromosomal copy of the gene for T7 RNA polymerase. These hosts are lysogens of bacteriophage DE3, a lambda derivative that carries the lacI gene, the lacUV5 promoter and the gene for T7 RNA polymerase. T7 RNA polymerase is induced by addition of isopropyl-B-D-thiogalactoside (IPTG), and the T7 RNA polymerase transcribes any target plasmid, such as pET-28b, carrying its gene of interest. Strains used include: BL21(DE3) (Studier, F. W., Rosenberg, A. H., Dunn, J. J., and Dubendorff, J. W. (1990) Meth. Enzymol. 185, 60-89).

To express recombinant A. fumigatus sequences, 50 nanograms of plasmid DNA isolated as described above is used to transform competent BL21 (DE3) bacteria as described above (provided by Novagen as part of the pET expression system kit). The lacZ gene (beta-galactosidase) is expressed in the pET-System as described for the A. fumigatus recombinant constructions. Transformed cells are cultured in SOC medium for 1 hour, and the culture is then plated on LB plates containing 25 micrograms/ml kanamycin sulfate. The following day, bacterial colonies are pooled and grown in LB medium containing kanamycin sulfate (25 micrograms/ml) to an optical density at 600 nM of 0.5 to 1.0 O.D. units, at which point, 1 millimolar IPTG was added to the culture for 3 hours to induce gene expression of the A. fumigatus recombinant DNA constructions.

After induction of gene expression with IPTG, bacteria are pelleted by centrifugation in a Sorvall RC-3B centrifuge at 3500×g for 15 minutes at 4° C. Pellets are resuspended in 50 milliliters of cold 10 mM Tris-HCl, pH 8.0, 0.1 M NaCl and 0.1 mM EDTA (STE buffer). Cells are then centrifuged at 2000×g for 20 min at 4° C. Wet pellets are weighed and frozen at −80° C. until ready for protein purification.

A variety of methodologies known in the art can be utilized to purify the isolated proteins. (Current Protocols in Protein Science, John Wiley and Sons, Inc., J. E. Coligan et al., eds., 1995). For example, the frozen cells may be thawed, resuspended in buffer and ruptured by several passages through a small volume microfluidizer (Model M-110S, Microfluidics International Corporation, Newton, Mass.). The resultant homogenate may be centrifuged to yield a clear supernatant (crude extract) and following filtration the crude extract may be fractionated over columns. Fractions may be monitored by absorbance at $OD_{280}$ nm. and peak fractions may analyzed by SDS-PAGE The concentrations of purified protein preparations may be quantified spectrophotometrically using absorbance coefficients calculated from amino acid content (Perkins, S. J. 1986 Eur. J. Biochem. 157, 169-180). Protein concentrations are also measured by the method of Bradford, M. M. (1976) Anal. Biochem. 72, 248-254, and Lowry, O. H., Rosebrough, N., Farr, A. L. & Randall, R. J. (1951) J. Biol. Chem. 193, pages 265-275, using bovine serum albumin as a standard.

SDS-polyacrylamide gels of various concentrations may be purchased from BioRad (Hercules, Calif., USA), and stained with Coomassie blue. Molecular weight markers may include rabbit skeletal muscle myosin (200 kDa), E. coli (-galactosidase (116 kDa), rabbit muscle phosphorylase B (97.4 kDa), bovine serum albumin (66.2 kDa), ovalbumin (45 kDa), bovine carbonic anhydrase (31 kDa), soybean trypsin inhibitor (21.5 kDa), egg white lysozyme (14.4 kDa) and bovine aprotinin (6.5 kDa).

EQUIVALENTS

Those skilled in the art will recognize, or be able to ascertain using no more than routine experimentation, many equivalents to the specific embodiments and methods described herein. The specific embodiments described herein are offered by way of example only, and the invention is to limited only by the terms of the appended claims, along with the full scope of equivalents to which such claims are entitled.

Lengthy table referenced here

US07504490-20090317-T00001

Please refer to the end of the specification for access instructions.

LENGTHY TABLES

The patent contains a lengthy table section. A copy of the table is available in electronic form from the USPTO web site (http://seqdata.uspto.gov/?pageRequest=docDetail&DocID=US07504490B1). An electronic copy of the table will also be available from the USPTO upon request and payment of the fee set forth in 37 CFR 1.19(b)(3).

SEQUENCE LISTING (44312 sequences)

SEQ ID NO: 1 - DNA, 597 bp, A.fumigatus
ttgctcacttggctttcttcttctcttctcgggtattcagcttctcttcgatttcagcctacgaaaagaccacagctagctgctcagaaacctaaaccgaaaccagcgctgcccaagtcaaccccaggcgctgcgtctgcgccggctcctcccgtgaagaccacccttgcggactgggcagcaaccgaagaagacgacgtcaatggattctacattggcgagaagagacagcgcggcgggcgtaaaaagcgcaagaagaaccgggaagcgcaggcgttcgtccaaaattgggatgacatctacgacccttcaagaccgaacatctacgaagagtataagcatagtgacgagcagattgctgaggtgcgcgagtggaaagatcgcctctacgctcaccgaatggcacgatcgccgagcaggagctcgcacagtgccgatgaatcgagaccaatgaacagtaagcttttctttgcatggcgttcgactgttaagaatgctcacgaattttttgcagaacaatttgcgcctccgcagagttttgcgcctccgcctaatcttaacgagtcttcaccacggggctggaaggaaacgcgctac

SEQ ID NO: 2 - DNA, 645 bp, A.fumigatus
tgtcgcggctccttccagccccgtggtgaagacagcaagaactttatcgattacgaagaatatccccagtcggccgagatccagaaccggtgtgtcagcatgattgctcggctgttcaatgcccctatcaacagcgacgacgagcaccccgtcggcacctcgaccattggctcgtccgaggccatcatgctgggcacgctggccatgaagcgacggtggcagaacaagcgcaaggccgagggcaaagacaccacccgccctaacatcattatgaacagcgccgtgcaggtctgctgggagaaagccgcgcgatactttgatgtggaggagcgctacgtctactgtaccgaggaccgctatgtcattgaccccaagcaggccgctgatatggtcgacgagaacaccatcggcatctgcgccatcctgggaaccacctacaccggcgagtacgaggacgtcaaggcgattaatgatcttctggtcgagcgcggccttgacattccgatccatgtggacgccgctagcggtggctttgtcgtcccgctcatcaaccccaatctgctgtgggactttcgcctggagaaggtcgtttgcatcaacgtgtccggccacaagtacggccttgtctaccccggcgtgggctga

SEQ ID NO: 3 - DNA, 240 bp, A.fumigatus
gtcgtctggcgctcacccgaatacctacccaaggagctgatctttcacatcaactacctgcgcgccgagcaggccaatttcaccctcaatttctacaaaggcgcctcgcaggtcattggccagtactaccagatgatccggctgggcaagcgcggctaccgctcgattatggtcaacatcacgcgcattgccgactacctggcccagcaactcgaaaagctaggcttgatcatcatgagc

SEQ ID NO: 4 - DNA, 411 bp, A.fumigatus
acagcgccgtgcaggtctgctgggagaaagccgcgcgatactttgatgtggaggagcgctacgtctactgtaccgaggaccgctatgtcattgaccccaagcaggccgctgatatggtcgacgagaacaccatcggcatctgcgccatcctgggaaccacctacaccggcgagtacgaggacgtcaaggcgattaatgatcttctggtcgagcgcggccttgacattccgatccatgtggacgccgctagcggtggctttgtcgtcccgctcatcaaccccaatctgctgtgggactttcgcctggagaaggtcgtttgcatcaacgtgtccggccacaagtacggccttgtctaccccggcgtgggctgagtcgtctggcgctcacccgaatacctacccaaggagctga

SEQ ID NO: 5 - DNA, 231 bp, A.fumigatus
atgctccacgtcggatccttccagccccgtggtgaagaccggcccgtgagttgttacacactccttagcggattccgacttccatggccaccgtcgggctgtctagatgaactaacaccttttgtggtgtctgatgagcgtgcattccggcaccttaacctcgcgttcggttcatcccgcatcgccagttctgcttaccaaaaatggcccactagtaacgcttcattctaa

SEQ ID NO: 6 - DNA, 201 bp, A.fumigatus
gagactttaattactaagtataatactagtactattataatattatataataagatagaggtaataacaggctttctacctaaaaataatataaataagattatctatataattaactataacttatttaagctttatattattataaatataattataggctatctagcccctacccttaagaataagactataatataa

SEQ ID NO: 7 - DNA, 336 bp, A.fumigatus
atgtcctgcactggcacttggatgacacgcaatcgtggcctgtacagatcaacgcacatccggagatggttaaagatgcatactcggtccgggagacttactcgcacgctgacatccgccaaattattgcctatgcccgtgcccgaggtatccgtgtcatccccgaagtcgatatgcccagtcgtctggcaatatcatactgccgttcaacccaacccgggccagctggacatcatctacgacaagacgtacgacatcgttcgggatgtctacaatgagctgtcgggggtctttaccgacaattggttccatgtgggagctgatgagattcaaccc

SEQ ID NO: 8 - DNA, 402 bp, A.fumigatus
agactcagtatccaggatgcgcctctctatccttatcgtggcatcatgatcgatactggtcgcaacttcatctccgtgaaaaagatcctggagcagttggatgccatgtcattgtccaagctgaatgtcctgcactggcacttggatgacacgcaatcgtggcctgtacagatcaacgcacatccggagatggttaaagatgcatactcggtccgggagacttactcgcacgctgacatccgccaaattattgcctatgcccgtgcccgaggtatccgtgtcatccccgaagtcgatatgcccagtcgtctggcaatatcatactgccgttcaacccaacccgggccagctggacatcatctacgacaagacgtacgacatcgttcgggatgtctacaatga

SEQ ID NO: 9 - DNA, 309 bp, A.fumigatus
cgcctgcacacaaccacaatcctagctccatactgccaggtgtcaccagggttaagggcagctacggaccagtgtgataataaatcaaggggcctcaagctagccgacctggctatatgggatggccgcggggcccatgctggtgctaagctaagaatgttcctacatgacctctctgaatactacctagctaagccccagacatttaataataatataaataagatcctatacgcgacctcccaactcagtgtagatgttaagaatgcttggcaggagcggcatcctaagggatataaggctagttag

SEQ ID NO: 10 - DNA, 216 bp, A.fumigatus
aaatcgggcatcggattgccgtcacttgagaacaaacaggctgatgtaaatcagatgcaatgcgcctggctcggtgagcgtgttgctgctcccaatctcaatggcgtgacaaccaacgttatcctcggcaagaccggtggtaactggggtccgagacgctctgacaaaactggcgcagtacgcctttggcaagccatattggatagcaagaattaa

SEQ ID NO: 11 - DNA, 192 bp, A.fumigatus
acaagcagatgccctggcaaacaactactgaaggttcctggtaatgccaccacttcggaggattgcctgacggtgaatgtgtttcgtcctcatggcgcaaaaggcaaactacccgttgcggtgtacgtgcatggtggagcatataaccgtggcacaggtgaggaatctgcaaacaaacatgggcatgtctga

SEQ ID NO: 12 - DNA, 186 bp, A.fumigatus
  unsure (184),(185): Identity of nucleotide sequences at the above locations are unknown.
atcgcacaccatatcatgaactacgacctcggcacctctctcttccaccgagccgttctcgaatctggcgcagccacctcccgcgccgtgcatgcatacaacgcccaaatccacgaaacccaattccaagaattcattacagaagccggtcttcaccacggggctggaaggagcagcgccaagnng

SEQ ID NO: 13 - DNA, 261 bp, A.fumigatus
gggaatcattgtagcatcggcgcgttgggatttcttccttcgaccgtgtcagcgcaggagggaattctcaatctcggactacatgaccaaatccttgccttccaatgggttcaggaaaatatcgaagcgtttggaggggacccctcgcaagtcacgctcatcggcctgtccgcaggagcacactcggtatggcgcccaaggagatataatcaaagaccagcactgatatcaatcgtacgtagatcgcacaccatatcatga

SEQ ID NO: 14 - DNA, 435 bp, A.fumigatus
aaagctgtcctcaaatttatcgccccgtacacgcgattttcgctcagcttcatctccaagcacatcaagatatctgtcccggaagtacaggatatcctgagttacttgatccttgacaagaagttaaatgccaagattgaccaagaaaacggaacggttgttgttgaaagtgccagcgatgtggatcgattgcgtgcccttcaggactggagcgcgtcgctccgaagcctctggcaggcgacattaatcgacggcgaaggattcaagagcgacgacccggcgcaacttcatgggatgagagggggttcaatgctccaatcagcgtttggagacgaggcgcctaccgcgggtttacgtgccagcaactttcgagtacggacagggtggaagggcaagggtggccagggttccaaggccggtgtaggagccttctag

SEQ ID NO: 15 - DNA, 603 bp, A.fumigatus
ctttgtaattgcagcggctccttccagccccgtggtgaagactactcgattattgtctggctcaaccctacgctctgcatcatgccatcagtagtagcgctcgacctctgccagctttttgaccggtccgtcgctcggacaccacaccagctggcagtcgatcatgagagcggctcgctcacctataccgaactcgatgtggcctcatcgaacctggcccgaaagctaaagcaagaaggagtagtccctggggaagcggtcctcttacttactgagcacggcacccggaatgttgtcgcgctgcttgccatcctcaaggcccacgcctgctacgttcctctggaccgcagctcgtggtcatcagagcggatccaggccgtgctggacgggacagacagccggattctgatcaacacaaccgtcgagccgttcgaaagcccgcggcacaaagtcatccatctgaccagcgccgatgtgacgactctatcgacggaccgcagcaccacaaaggtcattcccgacatcgctcccgaagacctcgcttgtttgatctttaccagtgggagcacaggtgtgcccaagggagtcatgattccacatcgt

SEQ ID NO: 16 - DNA, 537 bp, A.fumigatus
cactccctacgtcaaaagactgtacactcagacatcagcaaaaggcaaaggcacaaacgatccgcccagactacggtcggcaaacaagctacagaaaaaacacgcaggaaggaaaaaacaaagaacagacagcaagagaaagtcgcagaacacacaacgacaaaagcatcaaatcaggaaatcaccgaaaccgcatcaaccaaaaaagaagaaaaagagcgggagacaacagagaaggaaggcgaaaaaaggagacagaaagcagaccagaaggaaaaacagccccagaagcggaaaaaagaaaggcaagaagagcgaaagcgaacagggaaaaagaaagccgacgcacaagggaagagacaggaagcaatccgcaaccgaaacgataaaagggaggaaaaggaggaggaaaggcagacacgagaaggacgaaggcatcgaataaaaagggaaaaagaagatcaaagagaacaggaaatcacaggtcgagtctcccaccacgaaggcgtcaaggaaccggccaaatgccgggggaag

SEQ ID NO: 17 - DNA, 444 bp, A.fumigatus
actccctacgtcaaaagactgtacactcagacatcagcaaaaggcaaaggcacaaacgatccgcccagactacggtcggcaaacaagctacagaaaaaacacgcaggaaggaaaaaacaaagaacagacagcaagagaaagtcgcagaacacacaacgacaaaagcatcaaatcaggaaatcaccgaaaccgcatcaaccaaaaaagaagaaaaagagcgggagacaacagagaaggaaggcgaaaaaaggagacagaaagcagaccagaaggaaaaacagccccagaagcggaaaaaagaaaggcaagaagagcgaaagcgaacagggaaaaagaaagccgacgcacaagggaagagacaggaagcaatccgcaaccgaaacgataaaagggaggaaaaggaggaggaaaggcagacacgagaaggacgaaggcatcgaataa

SEQ ID NO: 18 - DNA, 390 bp, A.fumigatus
tcactccctacgtcaaaagactgtacactcagacatcagcaaaaggcaaaggcacaaacgatccgcccagactacggtcggcaaacaagctacagaaaaaacacgcaggaaggaaaaaacaaagaacagacagcaagagaaagtcgcagaacacacaacgacaaaagcatcaaatcaggaaatcaccgaaaccgcatcaaccaaaaaagaagaaaaagagcgggagacaacagagaaggaaggcgaaaaaaggagacagaaagcagaccagaaggaaaaacagccccagaagcggaaaaaagaaaggcaagaagagcgaaagcgaacagggaaaaagaaagccgacgcacaagggaagagacaggaagcaatccgcaaccgaaacgataa

SEQ ID NO: 19 - DNA, 213 bp, A.fumigatus
attatgacattcactacagtgtggtggcgctcatatacatggtttaactgcaggaagccctggatccctagacatagtatcttaagctttaaagacctgattctcttgctggaattactcctggccttcctagatagaaagaccctctatagtattaagctgcctagtagatctcttatattttttaagctatttcttatgtgcagcttataa

SEQ ID NO: 20 - DNA, 507 bp, A.fumigatus
cacattgaaagattcgatgtcattgaactgtcgtctggcttcttatcgttcccagaagatgactggctcggcctggttgacaaagtccacgcatacaagttgaaggcaaaaccagagctcggcattcagtttggtgctggaggtgatacacctgcttctggccttgaggctattgggacttctgatcctgggaagctcgttaacatggggcgtaaattcctggacgtgggtgtcgaacggttaatgatcgaatctgagggtataacagaaaacgtgcagtcatggcggactgacgttgtgtccacaataatgaaggaattgccgtccgagcgggtcatgttcgaggccgcagatcccaaggtattcaactggtatataagggagttcggcatcgatgtgaacttgttcgtcgaccatagtcaaattgttcaactgtcgtgcctgcgacagggcatttggggcacagctgacacttggggcaaagtggtatcatttcggtcagaataa

SEQ ID NO: 21 - DNA, 321 bp, A.fumigatus
ggttttcgagtcaggctggctgatccgggtaggtatgcgattcgtgttgggaggtcaaccagtgtcaatgggccttttcaggataaagatggcaagaaccttactgatggtggagggacggttgtctacgcctcaaatcatggtgttgtttatgcgcctgggggggttggcgtgttgcctgcgaacgagaagcatcctgagattttgtactatcactaccgtgagtcaattccttcactttgtgtctggtttactgactcgacagtgaatacatcgatgggcttaaaagacaatgtgagtaggatcacaaccaagcaatga

SEQ ID NO: 22 - DNA, 234 bp, A.fumigatus
  unsure (233): Identity of nucleotide sequences at the above locations are unknown.
catgccaaggacgcacgcctgggatggagttacctcgagtacaaggatggatggccagtagcaaggtacgtgcactaccctaaggagacgacatcaactgacccgtgcagagctgtagagaacagcggaatggccagtcgtccgaactatatcctctgtatatctgctctgattggtacgcattctgtcaaagtcttcaccacggggctggaaggatcagcgctgatctattna

SEQ ID NO: 23 - DNA, 192 bp, A.fumigatus
accgtctctctcatcgcggaagcactaacaaatgacgcatataggttcgatggacgcaccattcgtgttgacaaggcctccgagcgccctgcccgtaacaacggtggcttccacggccgtggtggctacaaccagtccgagggtgctcccggaaatggtatatgctcccatcaaattgttcaacgaatttaa

SEQ ID NO: 24 - DNA, 294 bp, A.fumigatus
aacaaagtacccacagcggaagaagccgcagaaatagtggatactattaactatttaaggactcaactttcgagggacatcgaattcatgaacctccgcatggcaatttactataatcagaagcacgggagtgctctaaatttgaaaaggggggagaaagtctacctgctccgcagaaacatcaaaacaaaaagactaagtcagaaactagaccatcagaaaattagaccattcatcattacagaaaaattaggactagtcaactacaaactacgactaccaaaaagcatgaca

SEQ ID NO: 25 - DNA, 642 bp, A.fumigatus
  unsure (632),(633): Identity of nucleotide sequences at the above locations are unknown.
atcgatgtgaaagccgacgggtcacaggaaattgtgcggcccagtaaaagtggacttgctcgagtatccgtccttcgggggtctggagtccatgagggagtacctttcatcgatgactatatcactattaaagaacctattgtcgactatgtcactcaatattccggtattaaacctggcgacttagaccccaggaccagtcaacacaacctggtccctctcaaagttgcttacaagaaactatggctgcttctcaacctgggttgcgtctttgtcggtcatggtcttgcttccgactttcgcaaaatcaacatacaggtgcctaagagccagacggtcgacacacaatacctttacttccaccctggcaagaaccggcgacttagcctccgatatttagcttgggccgtgttcaaagaatacatccaagaagagccggctgacaataaccagggtcacgactcaattgaagatgcccgcatggctcttcgtctgtggaagaagttccaggaatacgaggatgcaggtattgtgaatcaaatcctggaagaaattttccgcgaaggatccaaacttggtttcagacgtcttcaccacggggctggaaggatcagcgatggtcatatcaaaannccccccccg

SEQ ID NO: 26 - DNA, 435 bp, A.fumigatus
ctcccatggcgcggctccttccagccccgtggtgaagactccggggaccgcatcattttccgctttttaaccggggcgtaccacgactggttgcagggtggtgaagatgaggatgatgagaccgctgagaaacgacttgtgccccatattgagtcaatggctcaagagtttgagaggggtaatgagaagtacatgcaggagatgcaagttttggaagcggagaaccgggcactacgcgatcagattgaagagttggagaagaatgcgcccgacatggccaaattggataagcatttcaggattctggaggacgataagcggaagtttgaggactacaaccaaaatgttcagggcaagattgagaagtacgagaattctaatcaggtcttggaggaagagaaccagaatgttgaggcggagctatatgcagtctaa

SEQ ID NO: 27 - DNA, 261 bp, A.fumigatus
ggactgagtagaagcattaaatcattgcttaaactttgtgacttttgcttccgcagatatcttaacctcaattccctgatccttgatatgctttatatactattgcacttgttcttctattttaagcatatatatttatgcctgttctttaatttcatttatatatttattggctgtattgcgtatctcagagttactatcattgacttgttcacaaaatttggccctgtttgttgtagaactaatcacaacattcactga

SEQ ID NO: 28 - DNA, 447 bp, A.fumigatus
  unsure (404): Identity of nucleotide sequences at the above locations are unknown.
ggacaagctgaccagatagactacgagtaccatgacatggaccagacgctcgtgctcaacctcaaccaggctgccatcaacgccatccgtgctgcaggcgccacgtcgcagtacattttcgtcgagggcaactcgtggtccggcgcgtggacctggaccaccgtcaacgacaacctcaaggccctcaccgacccgcaggataagatcgtctacgagatgcaccagtatctcgactccgacgggtccggcatgtcggccacctgcgtgagctccaccatcggccaggagcgcgtgcaggccgccacacagtggttgaagaccaatggtaagaaaggtatcattggcgagttcgctggaggcgccaacagcgggtcccagtccgctgttacaggagagccgatacnctatagttcacgccggggatgggacgtaacgcgtggcgggtat

SEQ ID NO: 29 - DNA, 189 bp, A.fumigatus
tcattgtatttgttcctcaaggtcaagtccataaacagcggcagcggagatttgaacaacgcgcggttcctgagcctggtcgcggcttactccaggctcactccttttaccgaggaggtctggctgggcgatgggcttctaggttctgggatccgtcccctctgggggctctccgggcgtggttcataa

SEQ ID NO: 30 - DNA, 393 bp, A.fumigatus
  unsure (6): Identity of nucleotide sequences at the above locations are unknown.
ttaacnaattcaatgtctcgcgcccttcacttggcgatattctctaatggcaccagaccagctcactatgctgtcttcatccctactggtgatgcaggcaagatgggaaagcttattcatgtgaccggaaccaccgccacgggattcttccttgaattcaagcgcaactacgacttcaatctcacacagagaaagcaccagctcattctacttgcccaggtcaatgcccagtatataacagatactgttggcaccggacagcaatcagctgatacaattgctcgagatcgactggagtcagttgctacaactgtgccgcctccgggacgcagcgccaatccttttgatccatcggtaagccggcctcaccgttggaacagccatgcatactga

SEQ ID NO: 31 - DNA, 408 bp, A.fumigatus
gacaccatgctcgacccgttttttgctgacaggtatctagataataagtacggcatgggaacctctgctgaaagagcgtctgcaatgactgattattataaacgtggtttatacatccctggactaagggtgaacggtatggacgtcctggcagtaatggcagcagtaaaacacggcagagagtttattcgagctggaaacgggccgttggtctatgagtatgtgacatatcggtacgccgggcactcaatgagtgatcctggagtcggatatcggactcgcggagagctaaaggcggaacgtgcaagtgatccggtttcgaactttcgggcacagctgatagactggcgtatcatcactgaggccgaagcgtcttcactcacggaggatgccaggatccgcgcataa

SEQ ID NO: 32 - DNA, 363 bp, A.fumigatus
agactcgtgagtgcaagatatatttctcaaaccgcccgtgttgcggccaatggctccaatatcctccggcggcagctcccatctccgctccacggccgctgttcggccgctggcatagctccccgattcactgctgggccatcggtgcactcccaaaatgcggtcacacggcgctatgcctcgtctactgcctcaggaccagtcaagaagactcaattgtatgatctgcacattgccaggggagcgaagatggtgccctttgcggggtactctatgcccctacagtattcagatctcagtcacgtcgagagccaccactggaccagagaaaaggctagtgtgttcgacgtgagccatatgtaa

SEQ ID NO: 33 - DNA, 483 bp, A.fumigatus
  unsure (282),(383),(386),(417),(418),(431),(471): Identity of nucleotide sequences at the above locations are unknown.
gtattgcccataccagcgatgttgatctttgaagacactctgaatctaaccctgggtagggtacaacaccatcttagtggtcctggagccatggagctgctaatgaaggtcactccctcgtctctggacaagctcaagcctaactcttccacactctcctgcctgcttgaagaaggcaccggcggcatcgtcgatgacaccgtcattacccgcctcgacggcgacgcattttatttcgtcaccaacgccggccgccgcaccgaggacctggccttcctgcangccgagatcgaggcgtacaggcagacccacggcgccgacagcatcaagtgggagaatcttgccgaccgggctctcgtcgccctgcagggccctctcgctgnctncgtcctgcagcccctgatcagctcccacggnngcgggctccccgncgacaccgaccttaacaccctctacttcggcaactggcgntcccctaactaa

SEQ ID NO: 34 - DNA, 198 bp, A.fumigatus
tgcactgagttcatcaaactttgcagagaggacggcgttgttgactttagtgtgatggctggaagagaactttgctatggatgcagctttgatcttgatgttctgccaattcccttgatctatgattcgatggtctccaaggaccacgatatgatccgcagcttggaaatactgagctatcccagagttaggctgtga

SEQ ID NO: 35 - DNA, 420 bp, A.fumigatus
agactcatccgtaacatcaccgagcacggtgtcatcgccgtcggagtcggtatgaacgtctcccagcctggcgatgtctccaacgccattttccccgccctgcgcaatgctgccatcaccatgcagatcggtacccactggaacgagaccgctccttggtcccagatgctggaggatcagtacaagatgacgaacgagtatgtgccccagttggaggcggtcacccccggcagcggctgctaccagaacgaggccaatttccgccaacccaactggaaggacaccttcttcggcgtcaactactctcccctgctcaagatcaagcagaagtgggatcccagctacttcttctacgctcttaaggctgtaggcagcgactactggaccgttgacgactcgggtcgcatgtgccatgcttga

SEQ ID NO: 36 - DNA, 339 bp, A.fumigatus
  unsure (306): Identity of nucleotide sequences at the above locations are unknown.
cgacagcaggtcctgatcatcgccatggcggtcagtttcggcattcaatcctggattgagggtggtgtcattggggctgtcattggtctaaacattgtggtaggtgtctatcaagactatgccgcagagaaaacaatggattcccttcgatcgttgagttctcccaccggaactgtcacgcgtgatggcaaaaccagtaccattcctgccaacgagattgtccccggggacatgattgaactcaaagttggagacacggttcctgcggatctttcgtgcgtaaagagttaccagaaaaatatcgtntcccgttcactaaccggccgaataggcctcgtt

SEQ ID NO: 37 - DNA, 273 bp, A.fumigatus
  unsure (15),(16),(17),(18),(19),(20),(21),(22),(23),(24),(25),(26),(27),(28),(29),(30),(31),(32),(33),(34),(35),(36),(37),(38),(39): Identity of nucleotide sequences at the above locations are unknown.
acccttgaaacttcnnnnnnnnnnnnnnnnnnnnnnnnngaagaccgctatgaggatgtccttcgtgagctggccgtcgatccagaccagggtctgaccgtgggggaggcgaagcgaagactccaacaatatggtccgaatgaactggaagggggagagggtgtttccattgtcaagattgtcattaggcagatcgcaaatgccatgatgctggttagtctctcccttttgttagacagacaacgacagacaactgacgacagcaggtcctga

SEQ ID NO: 38 - DNA, 234 bp, A.fumigatus
  unsure (193),(194),(195),(196),(197),(198),(199),(200),(201),(202),(203),(204),(205),(206),(207),(208),(209),(210),(211),(212),(213),(214),(215),(216),(217): Identity of nucleotide sequences at the above locations are unknown.
caaaagggagagactaaccagcatcatggcatttgcgatctgcctaatgacaatcttgacaatggaaacaccctctcccccttccagttcattcggaccatattgttggagtcttcgcttcgcctcccccacggtcagaccctggtctggatcgacggccagctcacgaaggacatcctcatagcggtcttcnnnnnnnnnnnnnnnnnnnnnnnnngaagtttcaagggttca

SEQ ID NO: 39 - DNA, 216 bp, A.fumigatus
agacatgcgttctcccgccacatgtcgctcttgacccccgccggcgcgatcgcattgactgtgcaccccttgcgcccaaaatcggccgccaagcagcgcgtgaacccctcgatggccgccttgctgcccgcgtacagcgcgtggcccggcacccccagccccgcggcaattgaggacatgaggatcacccgcccccccggctggatgtggtcgtag

SEQ ID NO: 40 - DNA, 648 bp, A.fumigatus
  unsure (606),(635),(636): Identity of nucleotide sequences at the above locations are unknown.
tcttcccctcaaccgcaaaggtcgcccttcgtgaccgccggcggcccgaggcatcgggccggcattggcctcgaacttggccgtcggcggggcctccgtggcaatcaattacggcccaagcgccaagtcggcccaagaggtggtcgaagcaatccaggccatcgcccgccagccggtcgccatccagccggatttgacgtgcgtgcccaacatcgagtcgttcatccagaaggtcgtcggccacttgggcgggttgaacattgtggtgtccaattccggcatggaaaagttcaagcccttggaggagaccacgctggaggacttcaacgaggtgttcaatctcaacacgcgggcgcagatgttcgtcgcgcgctacgcctacgaccacatccagccgggggggcgggtgatcctcatgtcctcaattgccgcggggctgggggtgccgggccacgcgctgtacgcgggcagcaaggcggccatcgaggggttcacgcgctgcttggcggccgattttgggcgcaaggggtgcacagtcaatgcgatcgcgccggcgggggtcaagagcgacatgtggcgggagaacgcatgtcttcaccacggggntggaagtacagcagtgtcagttttaaaannccgcccgccagg

SEQ ID NO: 41 - DNA, 615 bp, A.fumigatus
  unsure (572),(601),(602): Identity of nucleotide sequences at the above locations are unknown.
ccgccggcggcccgaggcatcgggccggcattggcctcgaacttggccgtcggcggggcctccgtggcaatcaattacggcccaagcgccaagtcggcccaagaggtggtcgaagcaatccaggccatcgcccgccagccggtcgccatccagccggatttgacgtgcgtgcccaacatcgagtcgttcatccagaaggtcgtcggccacttgggcgggttgaacattgtggtgtccaattccggcatggaaaagttcaagcccttggaggagaccacgctggaggacttcaacgaggtgttcaatctcaacacgcgggcgcagatgttcgtcgcgcgctacgcctacgaccacatccagccgggggggcgggtgatcctcatgtcctcaattgccgcggggctgggggtgccgggccacgcgctgtacgcgggcagcaaggcggccatcgaggggttcacgcgctgcttggcggccgattttgggcgcaaggggtgcacagtcaatgcgatcgcgccggcgggggtcaagagcgacatgtggcgggagaacgcatgtcttcaccacggggntggaagtacagcagtgtcagttttaaaannccgcccgccaggc

SEQ ID NO: 42 - DNA, 624 bp, A.fumigatus
  unsure (13): Identity of nucleotide sequences at the above locations are unknown.
caacttatatttnccatgcggctgttaataatcaagcgcaacacagccatccccactaagaagtctgagaccttctccacctactccgacaaccagcccggtgtgctgatccaggtctacgagggtgagcgtgctcgtaccaaggacaacaacctccttggtaagttcgagcttaccggcattcctcccgccccccgtggtgtcccccagattgaggtcacctttgatgtcgatgccaacggtatcatgaacgtttctgccgttgagaagggcaccggcaagaccaacaagatcaccatcaccaacgacaagggccgtctttctaaggaggagattgagcgcatgctggctgatgccgagaagtacaaggaggaggatgaggccgaggctgcccgtatccaggccaagaacggtctggagtcttatgcctactccctcaagaacaccatcagcgaaggcaagctcaacatcagcgatgccgataaggagaaggtctccagcaaggtcgaagagatcatcagctggctcgacaacaaccagactgccaccaaggacgagtacgagtcccagcagaaggagcttgaaaggtatgtttcatttctttccctcttaatgttcacctga

SEQ ID NO: 43 - DNA, 570 bp, A.fumigatus
aacatacctttcaagctccttctgctgggactcgtactcgtccttggtggcagtctggttgttgtcgagccagctgatgatctcttcgaccttgctggagaccttctccttatcggcatcgctgatgttgagcttgccttcgctgatggtgttcttgagggagtaggcataagactccagaccgttcttggcctggatacgggcagcctcggcctcatcctcctccttgtacttctcggcatcagccagcatgcgctcaatctcctccttagaaagacggcccttgtcgttggtgatggtgatcttgttggtcttgccggtgcccttctcaacggcagaaacgttcatgataccgttggcatcgacatcaaaggtgacctcaatctgggggacaccacggggggcgggaggaatgccggtaagctcgaacttaccaaggaggttgttgtccttggtacgagcacgctcaccctcgtagacctggatcagcacaccgggctggttgtcggagtaggtggagaaggtctcagacttcttagtggggatggctgtgttgcgcttgattattaa

SEQ ID NO: 44 - DNA, 231 bp, A.fumigatus
  unsure (165): Identity of nucleotide sequences at the above locations are unknown.
ttattatctactattactatctctaagagtactattattcttattattcttagtatattcttcacccctattaatatttatctcaagcttactctctatcttaagaaggaagttattactataaccatgcttcttattaagagccttaatcttattaattatagnctatgctttcctattattattatagcctatgatttcttattattaatattagtaagagtaatttag

SEQ ID NO: 45 - DNA, 252 bp, A.fumigatus
cactacttccttaggactccttcacagtgtgacagggccctaataaatacaaagctttccacagagcaagaggcggctcttataaagtatattaatatacttatcaagctagatattcccctatggctaaaggcaatcagtaatacagtaaattcaatactcttttatggacatactgatccaataacccccccccctttaattagcgtgcattggatgaaatgcttccttaaatactatctagaatattaa

SEQ ID NO: 46 - DNA, 273 bp, A.fumigatus
gcaccttttgcggaagatgaaaagaatggctggaaacagatactgacacacacctctatagccattgaccttctcaagaagatgctggttattgatcccgacacgagaatctccgctcaagacgctctgagacatccctacctagctccgtatcatgatcctaccgatgagcctgtagcttcagggcctttcgattggtcgttcgacagcgcagacttcccaaaggagacctggaagataatgatgtcagtatttgcgttccgtttacattga

SEQ ID NO: 47 - DNA, 222 bp, A.fumigatus
agacggcagagatacggtgttcaagtggacgtgtggagtgcgggctgtatccttgctgagatgctacgggggaagccgctttttcctgggaaggaccacgttcaccagttccacctcatcacaaacatccttggaaatcctcctgatgcggtgattgagaagatcaccagtaagaacgtaagtgcacttgactcaccaagccaagattcccctccccactga

SEQ ID NO: 48 - DNA, 567 bp, A.fumigatus
tatcgctatgcgcggtgctcggcccctggcgtaaaagaacaatatacgcgggtctatctggacgatactccatgggcacaaagcacccaagcacctaagcagtggcatggtgccccactcccaaccattcgaaaagccattggggcacttgggagccctaggatagggcgtgttcctcaggacatggtcatgaaactgaccatccttcgagacctgtattacttggacgacgaggaggaggccgaaagaagataccagttgcagcgtccgagccaggacgatgattaccattaccaggactcggacgagggggacgacgacaacgggaaggaagaggaagaggaagaagatgaggatgccgatgacgacgacgatgacgagacagaaccgggaactaagggtggaaaaagatgtcccaagtggacaaagcaagaggctcgctacccaaaacggcaacgacaacgcgagtccagattcgagtgggatctcggtcctgatgcgacagctgaagacgcgattcgcaagtttggaccggttcttttgggtcctggaaggagactcaaatga

SEQ ID NO: 49 - DNA, 456 bp, A.fumigatus
ccgatacctgccccatcatctcctctgcatgccctgtggccgataccaccgacgcacgcaggagggccacgaacgactcgagcccgcaacggtcgtcaaccctctctacaactgcccaaacgcccgcaaccccctcctccctgcaccgcgccaccggatcacccacgcccgcatgctgcacttcaccttcgtgcagctcgcgctgcgcgcccaccgcttcggccccgcctacggcatccccgtcgactccctctcccgtcgctggcgacgggacggctggtcccaccacacccggtaccacatccacaagggcaggctgctgatgcgggtggtgagctcgaccttcgcagacccagacctagctcccagctcgatgcgcctgctcctctactcgcgcgacgactactggccgtatttttctgtctgcgcgcactggcgcgacggggaactcatgga

SEQ ID NO: 50 - DNA, 555 bp, A.fumigatus
agacgcaagacacttctcctcctcctgggccgggggccctggatggccttgaacctccccgagaaccgcgaatacagaatcgacttcctaggcccacatgaccgatacctgccccatcatctcctctgcatgccctgtggccgataccaccgacgcacgcaggagggccacgaacgactcgagcccgcaacggtcgtcaaccctctctacaactgcccaaacgcccgcaaccccctcctccctgcaccgcgccaccggatcacccacgcccgcatgctgcacttcaccttcgtgcagctcgcgctgcgcgcccaccgcttcggccccgcctacggcatccccgtcgactccctctcccgtcgctggcgacgggacggctggtcccaccacacccggtaccacatccacaagggcaggctgctgatgcgggtggtgagctcgaccttcgcagacccagacctagctcccagctcgatgcgcctgctcctctactcgcgcgacgactactggccgtatttttctgtctgcgcgcactggcgcgacggggaactcatg

SEQ ID NO: 51 - DNA, 213 bp, A.fumigatus
gcttatattaacaagacaatacagggaattcttaatgagttctgtgtcgtctacctagataatattcttatctactcacagatggaagaggaatatgagtggtatattaagaaggttctccagcatcttaatagcgcgaacctgtatgctaaactattaaaatataagttttataagacagaagttaagtttctcagctttcttataggctag

SEQ ID NO: 52 - DNA, 597 bp, A.fumigatus
  unsure (41),(378),(525): Identity of nucleotide sequences at the above locations are unknown.
ggggggcgtatcttccagcctcgtggcgtgaataattccgntgagcaggggctcaagaatgtcatggtcaactataaccctgaaactgtcagtaccgattacgatgaggctgaccggttgtactttgaaaatatcaacctcgaaaccgttctcgacatctatcaactggagtcctctagtggcgtggtcatttcgatgggcggtcaaaccccgaacaacatcgccctgcccctccaccgcctcaatgtcaagattctgggtacctctcctgagatgattgacagcgcggagaatcgttacaagttctctcgcatgcttgaccgtatcggtgtggatcaacctgcctggaaggagcttaccagcatcgaagaagccaanggattctgcgacaaggtctgctacccagtgcttgtccggccctcctacgtgctttcgggagctgccatgaacaccgtctattccgagcacgatcttgctacctatctcaaccaggccgctgatgtttcacgtgagcaccccgtcgtnatcaccaaatacatcgagaacgccaaagagattgagaatgatgccgtggctcgtaaccgtgtcatggtctga

SEQ ID NO: 53 - DNA, 504 bp, A.fumigatus
  unsure (127),(464): Identity of nucleotide sequences at the above locations are unknown.
aacatcagcggcctggttgagataggtagcaagatcgtgctcggaatagacggtgttcatggcagctcccgaaagcacgtaggagggccggacaagcactgggtagcagaccttgtcgcagaatccnttggcttcttcgatgctggtaagctccttccaggcaggttgatccacaccgatacggtcaagcatgcgagagaacttgtaacgattctccgcgctgtcaatcatctcaggagaggtacccagaatcttgacattgaggcggtggaggggcagggcgatgttgttcggggtttgaccgcccatcgaaatgaccacgccactagaggactccagttgatagatgtcgagaacggtttcgaggttgatattttcaaagtacaaccggtcagcctcatcgtaatcggtactgacagtttcagggttatagttgaccatgacattcttgagcccctgctcancggaattattcacgccacgaggctggaagatacgcccccc

SEQ ID NO: 54 - DNA, 606 bp, A.fumigatus
gctcgaccaaaagccattctcgcaagccagccttctctccccagctcagatttcaccgccggcgatgttcgcagtgcgacattcgctgccaatggtcactcacctatgactttccaagggcctagccaccaatatgaggaacacaagcagcagactggtctgccaccaggagccctagcccaggcaatgaacttcaatcagatggccggcgtcactttcgggaacgcgagccctgcttaccagatgaatggcgacatgttcgctagtagccacatgaagcgggaagacacttcgtttgatttcaacaacatgtcttctcgtaacccgtcggaaatggacctggagtctgatggcatgggcgcgattccttactatctctcacccaatgtcagtaagaatcaatttattgatcccaatgcccttgggggtcatgaagtcgtttctgccggaccgtccactcaggtcggccgcatgtacccgggaatgcaccaacaacaagcagccatggcaaaggcggctcaacaacaacaaaaacaacatgagatgcttcgtcagcagcaattccagcaggtcttcaccacggggctggaaggagccgcgccataa

SEQ ID NO: 55 - DNA, 288 bp, A.fumigatus
cgcaaacataaaatgaaactcccttttgtgctcttcacagccttgtacgccagttgcgctctcgctgcggctcttccccctgatcatgtcgatgccgacaaggccatcctgctcctcgctgatgggactaccaaaaccatcgagaaaacggatctcgcctctcacctcaatggcaccttgctcgaggctcccaccgacaacttcccgcggtccatcaaatccgtcaacttcaacagcttggaggcgcggggagggcgtcttcaccacggggctggaaggagccgcacc

SEQ ID NO: 56 - DNA, 408 bp, A.fumigatus
atttcaataggtgtgagtggtgctccagaccccgtccatgttgaaattcagcagcgtgctctgccaaatgcccccgatggatacacacccagtacagttggttgtcctgccagtcgccctaccattcgcagtgccgcaagtttgtcgcccaacgagacatcatggctggagacgcgtcggggcaagactacttctgcgatgaaggacttctttaatcatgtcaagattcaagacttcgacgcggcgggctacattgaccgccattccagtaactcgtcggatcttcccaatatcggcatcgcagtctctggtggtggctatcgagcattgatgaacggcgcgggtgcaatcaaggcctttgatagccgtacgccgtcttcaccacggggctggaaggatgcgcggtga

SEQ ID NO: 57 - DNA, 201 bp, A.fumigatus
ttctatcttttcacgcctattatagggatgcttatattatttattagggttaataagtctaacctaaacttaactaatactatggtagttaatttagcagaggtatctaaatatctgtctatacagagctattatctactgaggattatagttaggcaggaccttaagagcaatcttttgcttacctacattattaactaa

SEQ ID NO: 58 - DNA, 345 bp, A.fumigatus
ttcagagagaaagtcatcaatatgctactcaaaatggtcaacatcgaacataccgccaatacggtgattggaaaccagttcatccgtggcgtctcaggaggagagagacgtcgagtgagtattgcagagatgatgatcacatcagcaacggttctggcttgggataatagtactcgtgggctggatgcttcgactgctctggactttgccaaatccctgagaatcatgacaaacatctacaagactacgacgttcgtctctctttatcaagcatctgagaatatctacaagcaattcgacaaggtcctggtgattgacagcggtcgtcaagtcttcttgaggtaa

SEQ ID NO: 59 - DNA, 837 bp, A.fumigatus
cgtaatcaaccaccgaaccgccgataccaccgaaccgccgcttcgccgcgaatatcatcgaattcttgccccccccccccccccccaccccccctcccccaccccccccccccccgccccccctccccccacgcccccccgccccccgcccccccacccccccccccgccccccccacaccccccccacccgctcctcccgcctcccccccccctcccgccaccctcccccaccccctccgcggaatcaaaccacgcgcagagacacgcgctaatcgccatcccccccacctcccccccccgccccccccccccccccccctcccacgcccccccgcccccccccccccccccaccgccccccccgcgcccccccgccccccctcccccccccccccccccaccccccccccacctcccctccccgcccccccccccccacccccccccccccccccgccacccccccctgccccccccccccccccccccccccccccccccccccccccccccgcccccccctccaccccctcccccaccccccccgcccccccccgcgcaccccccctcccccccccccccccccccccccccccccgccccccccgccccccccccctccccccccccccccccccctgcccccctcccccccccccccccccccggccccccccccgccccccccaccccccccccccccccccccccccccccccccccccccccccccccccccccccgcccccccccccccccccccgccccccccccccccccgccccccccccccccccccccccccccccccccccccccccgccccccccccccc

SEQ ID NO: 60 - DNA, 441 bp, A.fumigatus
  unsure (23),(36),(37),(38),(39),(40),(41),(42),(43),(44),(45),(46),(47),(48),(49),(50),(51),(52),(53),(54),(55),(56),(57),(58),(59),(60),(61),(62),(63),(64): Identity of nucleotide sequences at the above locations are unknown.
gcgagcgagtttttggatagganttcgaacctcgannnnnnnnnnnnnnnnnnnnnnnnnnnnnggcttgccggactatatatacccactgccctagctcttctacttttagccgttaatgcttcaacatccatagaggtaaaattaaccttgacaatgcttaataacgtaatcaaccaccgaaccgccgataccaccgaaccgccgcttcgccgcgaatatcatcgaattcttgccccccccccccccccccaccccccctcccccaccccccccccccccgccccccctccccccacgcccccccgccccccgcccccccacccccccccccgccccccccacaccccccccacccgctcctcccgcctcccccccccctcccgccaccctcccccaccccctccgcggaatcaaaccacgcgcagagacacgcgctaa

SEQ ID NO: 61 - DNA, 561 bp, A.fumigatus
tcgccatcccccccacctcccccccccgccccccccccccccccccctcccacgcccccccgcccccccccccccccccaccgccccccccgcgcccccccgccccccctcccccccccccccccccaccccccccccacctcccctccccgcccccccccccccacccccccccccccccccgccacccccccctgccccccccccccccccccccccccccccccccccccccccccccgcccccccctccaccccctcccccaccccccccgcccccccccgcgcaccccccctcccccccccccccccccccccccccccccgccccccccgccccccccccctccccccccccccccccccctgcccccctcccccccccccccccccccggccccccccccgccccccccaccccccccccccccccccccccccccccccccccccccccccccccccccccccgcccccccccccccccccccgccccccccccccccccgccccccccccccccccccccccccccccccccccccccccgccccccccccc

SEQ ID NO: 62 - DNA, 831 bp, A.fumigatus
tcaaccaccgaaccgccgataccaccgaaccgccgcttcgccgcgaatatcatcgaattcttgccccccccccccccccccaccccccctcccccaccccccccccccccgccccccctccccccacgcccccccgccccccgcccccccacccccccccccgccccccccacaccccccccacccgctcctcccgcctcccccccccctcccgccaccctcccccaccccctccgcggaatcaaaccacgcgcagagacacgcgctaatcgccatcccccccacctcccccccccgccccccccccccccccccctcccacgcccccccgcccccccccccccccccaccgccccccccgcgcccccccgccccccctcccccccccccccccccaccccccccccacctcccctccccgcccccccccccccacccccccccccccccccgccacccccccctgccccccccccccccccccccccccccccccccccccccccccccgcccccccctccaccccctcccccaccccccccgcccccccccgcgcaccccccctcccccccccccccccccccccccccccccgccccccccgccccccccccctccccccccccccccccccctgcccccctcccccccccccccccccccggccccccccccgccccccccaccccccccccccccccccccccccccccccccccccccccccccccccccccccgcccccccccccccccccccgccccccccccccccccgccccccccccccccccccccccccccccccccccccccccgcccccccccccc

SEQ ID NO: 63 - DNA, 567 bp, A.fumigatus
gggggggggggggcggggggggggggggggggggggggggggggggggggggggcggggggggggggggggcgggggggggggggggggggcggggggggggggggggggggggggggggggggggggggggggggggggggggggtggggggggcggggggggggccgggggggggggggggggggaggggggcagggggggggggggggggggagggggggggggcggggggggcgggggggggggggggggggggggggggggagggggggtgcgcgggggggggcggggggggtgggggagggggtggaggggggggcggggggggggggggggggggggggggggggggggggggggggggcaggggggggtggcgggggggggggggggggtgggggggggggggcggggaggggaggtggggggggggtgggggggggggggggggagggggggcgggggggcgcggggggggcggtgggggggggggggggggcgggggggcgtgggagggggggggggggggggggcgggggggggaggtgggggggatggcgattag

SEQ ID NO: 64 - DNA, 831 bp, A.fumigatus
ggggggggggggcggggggggggggggggggggggggggggggggggggggggcggggggggggggggggcgggggggggggggggggggcggggggggggggggggggggggggggggggggggggggggggggggggggggggtggggggggcggggggggggccgggggggggggggggggggaggggggcagggggggggggggggggggagggggggggggcggggggggcgggggggggggggggggggggggggggggagggggggtgcgcgggggggggcggggggggtgggggagggggtggaggggggggcggggggggggggggggggggggggggggggggggggggggggggcaggggggggtggcgggggggggggggggggtgggggggggggggcggggaggggaggtggggggggggtgggggggggggggggggagggggggcgggggggcgcggggggggcggtgggggggggggggggggcgggggggcgtgggagggggggggggggggggggcgggggggggaggtgggggggatggcgattagcgcgtgtctctgcgcgtggtttgattccgcggagggggtgggggagggtggcgggaggggggggggaggcgggaggagcgggtggggggggtgtggggggggcgggggggggggtgggggggcggggggcgggggggcgtggggggagggggggcggggggggggggggtgggggagggggggtggggggggggggggggggcaagaattcgatgatattcgcggcgaagcggcggttcggtggtatcggcggttcggtggttga

SEQ ID NO: 65 - DNA, 858 bp, A.fumigatus
gggggggggggcggggggggggggggggggggggggggggggggggggggggcggggggggggggggggcgggggggggggggggggggcggggggggggggggggggggggggggggggggggggggggggggggggggggggtggggggggcggggggggggccgggggggggggggggggggaggggggcagggggggggggggggggggagggggggggggcggggggggcgggggggggggggggggggggggggggggagggggggtgcgcgggggggggcggggggggtgggggagggggtggaggggggggcggggggggggggggggggggggggggggggggggggggggggggcaggggggggtggcgggggggggggggggggtgggggggggggggcggggaggggaggtggggggggggtgggggggggggggggggagggggggcgggggggcgcggggggggcggtgggggggggggggggggcgggggggcgtgggagggggggggggggggggggcgggggggggaggtgggggggatggcgattagcgcgtgtctctgcgcgtggtttgattccgcggagggggtgggggagggtggcgggaggggggggggaggcgggaggagcgggtggggggggtgtggggggggcgggggggggggtgggggggcggggggcgggggggcgtggggggagggggggcggggggggggggggtgggggagggggggtggggggggggggggggggcaagaattcgatgatattcgcggcgaagcggcggttcggtggtatcggcggttcggtggttgattacgttattaagcattgtcaaggttaa

SEQ ID NO: 66 - DNA, 543 bp, A.fumigatus
gttgtcacgcattgcgcggctccttcggcccccgtggtgaagacgttactggcgaattctacatttgccaaccatccttatgcacagaagcagattatggaggcttgcaccagcatcctgaacgaccgcttcttcagcactagtgatcaggttgaaaactgcatcaagccttataagtttgaaatcgaagttgaggacccagaatgggcaaagggcagggagaatgtcagtcgcgtattgaaggaggagctgaaagcttgcgacgctgcttaccgacgtgtcgaagaggccgttgggaagaagaaattcaaggatgtgatggcattcgttgataaagtcagaaagggcgaagtagtcctggaaggcgatggcgccgctggtgcaggtggattcagctccgccctgttgaataaaggtatgttatgcctgtcacagttgaccgttcctgctagagtactaacgaagagaacaggccgggaaggcgtcttcctgcgagaccgtgccgacctgatcaaaatgcgcctactcgccatccgttccaag

SEQ ID NO: 67 - DNA, 207 bp, A.fumigatus
  unsure (177): Identity of nucleotide sequences at the above locations are unknown.
ttccctagattaataaataatagtagttctgtgaatacattcgctaagattattatctattactatttagttaatagcctgaagcctaagctacttattagaactaatatcatctataataaaggattcatgcttaattttaaatttagcattatagtacttagttcttatattgtntccacgcaggggccgaagatacgcgcaagc

SEQ ID NO: 68 - DNA, 237 bp, A.fumigatus
gtctacgctttccccgttgattctatatcggatttgcttactgacatctctagtcgcatgggaaaaggcggctcctccggaaaggacgccttgggtatcgcggaaggaaatcggatgatcttcgaccacgtttcggtgtcgtgggggcgtgatgagacattctccatcaatggagatgctagtaacatcacgtcttcaccacggggctggaaggatgcgcaagaacgtaagcagtca

SEQ ID NO: 69 - DNA, 366 bp, A.fumigatus
gctagcattgccacctcaatctctcgatcgaacaacgaacccgaacacacgaaccatcagcaacaacaacctacccctacgaatgatttcgacgaccacctcaacaacttcccttcccctcaaacaatcagctcattcatccctgcagatctgctgcgcattgacactgactcctttcccgattttatatctccggacccgaatatctcctccgtcccggaactagatgtggactggacggacgaacttctcggaggcacagagctaagttcagagtatcccgagacgggctcggtaagccatagccatggtggtatcactggcgatctggacagggatctgggtctggctcttgattcatattaa

SEQ ID NO: 70 - DNA, 438 bp, A.fumigatus
ttgactatcattattgattatcattattgtcatatctttctgtcgtttctgtattttgtttggaatgattactcgcttttgcaggtagtaatggcttcttccgacagcgctactcgcccttcgttcaacgcggatcagccggattcccagtctcagttacttcaacccgagtcgaccttgacagttggacagtcagttaccttgactttgggtaacgatgctcttgttattgttggtgagcagtgtctgacaatccatgcttgcatgtcatggttgcacattgcgcatactaaccagcttctcgttcttctaacagacgatcgctccacccaaaaaccggaccgcggctgctgcggattactatcaaactcgagtaggtttttccagtactcctctttctacctcgtcaacattagcgtgtgtctcgggtatcaatag

SEQ ID NO: 71 - DNA, 246 bp, A.fumigatus
  unsure (236),(243): Identity of nucleotide sequences at the above locations are unknown.
gtggataatacagagaccaaggaaactcaatctatcgcattgtacaatatccttcatgcagaagtctcctctgctggtctgactattacatatgcggaccctgtaaccaagcacgatgttaccgttggtcgccttgcaatacaccattgcagacgaagacaaagcaaaggccgaaacatttgcggccagggtcttcaccaggggctggaaggagccgcgctgagcggatatcaggnttcaatntca

SEQ ID NO: 72 - DNA, 414 bp, A.fumigatus
  unsure (318),(320): Identity of nucleotide sequences at the above locations are unknown.
ctcggatccttcgacccccgtggtgaagacagagccgattatagctacctttcccagcagctggctagtgctactccctctgggaccaagaagagtgaatacaccccagcaaacagtgctcttcagtcctgcccgccggtcaacggcgattggcttgcaactgcgagtccccttccgccctcgccaaacggcgacctgtgctcgtgcatggaggaaagcttaagctgcgtattgaaggacacagtgtcgggcgaccagatcgagaagctctttgggaccgtctgtggctatgatgtctgtgaaggagttgactacccnanaccggcctacaacccccaaacccccccgggggggcccccaagtatggagcgtacagtgtctgcagccccaagcagcagttgtcttatgccatga

SEQ ID NO: 73 - DNA, 207 bp, A.fumigatus
tcaaactattctactatgctaacactatggttccctagattaataaataatagtggttctacaaatgcatttactaagattactatctattactatttagttaatagtctaaagcctaagctacttattagaactaatgtcatttatagtaaaggattcatgcttaattttaaatatagtattataataattagttcttatagttaa

SEQ ID NO: 74 - DNA, 252 bp, A.fumigatus
aggtctcttctactagtatatttagttagtaaactagcagtatatttaaagactgatttactagctaactataactttatctttaacctactagatggatcaaccttaaatagagctactatatatatatatatagttaactataagttctcctttattaaagtctgcaataaaacacctactctaattatagttacttattatgcttatatagggactatctctaatactaactttattactgcctactaa

SEQ ID NO: 75 - DNA, 831 bp, A.fumigatus
  unsure (86),(107),(204): Identity of nucleotide sequences at the above locations are unknown.
ccacagaatgcaatagaaaggcgaagccggaactgccccccaaaagtgttgatttcatccctattgctatcccctcccatcctctntaccatgacgggacccacganaatcagcatcctgggccaggagagtatagtcgctgactttggtctctggcgcaactatgtcgccaaagacctgattagcggctgtccctctacaacntacgtcctgatcaccgacacgaatatcggatcgatctacacccccggcttccagaagtccttcgaggaggccgccgcctcggtctctccgtctccccgcctattgatctacaatgctcctccaggggaagtctccaagtcgagacagacaaaggcagatatcgaggattggatgttgagtcagagcccgccatgcggccgagatactgtggtcattgcgctgggtggaggggtcattggagacctaacaggtttcgtcgctgcgacctatatgcgcggtgttcgctttgtacaggttcctactacgctgctggctatggtggactcctcgatcggtggaaagacggctattgatacccctttgggaaagaacctgatcggcgcgatctggcaaccgtcaaggatctatattgacctggaattcttggagactcttcccgtcagggagttcatcaacggtatggctgaggttatcaagacagccgccatctctagcgaagaagagttcaccgctctcgaagacaatgccgaaactattttgagcgctgttcggcgtgaggttaagccgggtcaacggcgattcggtcttcaccacggggctggaaggatccgcggtggcgctttgaac

SEQ ID NO: 76 - DNA, 465 bp, A.fumigatus
gttcctagttttgtgaaagactgcgcctccatactgcctgttcacaacgagttccagccctccgcctcacttccaaatcgccaaaggcgaacaccagcgcagggccagaactcggggggtgcaccactggctggaccttcgcaatctttcgttgacccgtcatataatctcagctccggacctgagacggtaggctcggggacagatatggatctttcgccaggtttcgacgacaatggaaatccgatatcagaaggctcaacatcgtcggctgtgaaatcctcctcaaatacatcttacgtcggcgctagtagcacatcatcgccaaaggtacgacaacattcgcccctcaatttctcgaatcgaacacccagccatacgctcggtagcagtgagtcggtgcacgcgccatcgggcaccgcgaagtcttcaccacggggctggaaggaaccgcgctccagagcg

SEQ ID NO: 77 - DNA, 411 bp, A.fumigatus
acatcccaggcccccgacctgcactaccacgatgggacatactacctctactacgcggtttcctcgctcggctcgcaaaactcggccattggagttgcaacctccaagaccatggaagcgggcagctggaccgaccacggcacgaccggcatcgagtccacgccctccagcccgtacaacaccatcgacgccaactggatcgccgtcggcggcacccagtacgtgaatttcggctcctactggaataacctgttccaggtggagatggagaacggtctcaaagtgaagagcggcgccacgccgcaccagatcgcctataatgccagcgggatccatcgccaggaggcggccttcatgttcgagcgcaacaattacttctacctgactttctccgggggcattgcgctgggt

SEQ ID NO: 78 - DNA, 345 bp, A.fumigatus
agcgcggatccttcgacccccgtggtgaagactacccagcggctctatcatcgacctagacggcaagaccaacctctgggtatgctcccttttccttttacttctgtcatgcctcctaaacatcccaggcccccgacctgcactaccacgatgggacatactacctctactacgcggtttcctcgctcggctcgcaaaactcggccattggagttgcaacctccaagaccatggaagcgggcagctggaccgaccacggcacgaccggcatcgagtccacgccctccagcccgtacaacaccatcgacgccaactggatcgccgtcggcggcacccagtacgtga

SEQ ID NO: 79 - DNA, 252 bp, A.fumigatus
  unsure (249): Identity of nucleotide sequences at the above locations are unknown.
gtgtattgcggtgctgtgattgagctgcggtgcgttattggaaaggcatatcggattcttttcttttttaaattcaaggtatcatttctggatatatacatcgtggtatccgagaagcgcgtgcaggtcccagaggcaatctaccgtatagcaacagcgacaagagcgctagatacctgccacaactcaactgtatgcgaggttctcatatgtctctgtacctcatgtcggctaaatgtaaaagatatntga

SEQ ID NO: 80 - DNA, 183 bp, A.fumigatus
tccttccagccccgtggtgaagacaccaccatcgacaaggtggtcaaggttaatgtatttctgtcggacatggataactttgccgatatgaattcggtttatatgcagtactggggggatgtgaagccctgtcggacgtatgtcacctcccgcttgtgtattcctgtgctctgggggatctga

SEQ ID NO: 81 - DNA, 396 bp, A.fumigatus
ggcatcttcacacacactacatccatgatttcagggacgctcacagaagccctagagctggacaatcactacctacggtatcatgccgacaaagcacgtcgaatcaaggagaggggaacgaaatgctgcaaaaccgcacccgaagcgatggacggtgccattgagctactggaagagctgtgcgtgccaaacaccctttacccagacagcataacacaaccttacaccttaatacaatatagtacctcctacctccccgaaagatacccctccatgttccgcaaaaccgcaacaggcattgccaacactatcactggcgaatccttcaacaccacccagcgccccctccccgaggaccccatgacgacctgcgcgcgactcatccaagacgacctg

SEQ ID NO: 82 - DNA, 204 bp, A.fumigatus
cttagcgcggatccttggcgccttgtggagaagatccatcagattgtgcgcttgacctatttcagtgaagacctcagccgtcacgtcatcgtccaggtcgcaaaagccatcgagtatctccatgagacttcaggtgttgttcaccggtacgtaccatcaaacatcagtgatttatatatatatatttgtgacaaccagtactaa

SEQ ID NO: 83 - DNA, 342 bp, A.fumigatus
caaccagtactaatcatgtcgttgtctagtgatatcaagccacaaaacctcttgttctaccccataccctttgtgccgagtaagaacccaaggcctgtccagcctggagatgaagagaaggtggatgaaggcgaattcattcctggcgttggatcgggtgggataggcacgatcaaaatcgccgactttggtttgtccaaagtcatctgggacagccagactatgaccccctgtggcaccgtcggctacacagcgcccgagatcgtcaaggacgaacggtattcgaagagcgtcgacatgtgggcccttggctgtgtgctctacactctgctatgtgggttt

SEQ ID NO: 84 - DNA, 354 bp, A.fumigatus
ataatgctgaccgctactgctatcctccaggccctggctctcatgtccctcgttggaaatatccctctgtcactctctgagctacatgctctgtcctctgatatattggatctggctggagacacctcggttgatgcatcgtggtataccaaacggctgtctgtctcggccatctacgccagtgccgaggttttcatgacccgtgactcgagtccggatctctccgctacgcaggcgtttgtggaccgtcgcatcgaggataacaagtatatcggtgataagattactggtataaagcaatgcctgggcttcatgggtttcactgctattggactgggaggagttggggtttga

SEQ ID NO: 85 - DNA, 384 bp, A.fumigatus
aggagttcgaaactccaaaggctggcaaaattactcccagataggcttatctgtaatggtaaatacagtcctactggtaaaagcaaccgaaagaaggtgtatcttatacaatgctggaactctacatcagattatgaatccaatatccactccacctatattcctcatttcagttgcagcctgtacccttcaagactagatcttcaaaccccaactcctcccagtccaatagcagtgaaacccatgaagcccaggcattgctttataccagtaatcttatcaccgatatacttgttatcctcgatgcgacggtccacaaacgcctgcgtagcggagagatccggactcgagtcacgggtcatgaaaacctcggcactggcgtag

SEQ ID NO: 86 - DNA, 198 bp, A.fumigatus
ttaatgcagagatataggcctctatctagcttctttataaagagtactagtgctactgctgggctagataattccctaatctaccccttcttaagtattttattaaggtatttacacagagcctctagctttagctataatatagtaaatagggggctatatagcagtaacttcctattaagtagctatatcttataa

SEQ ID NO: 87 - DNA, 306 bp, A.fumigatus
ttcatcatgcctctacaaacttatcatcatacctcgtcgatcaaaggcctgtcaagcatcaccaccttgattgtcggggcttcggagtctatcctcgtagacccgccattcctgattcctgatgctttatccgtcgtacgctggatcaaagaaaccaccgaaaatccccttaaagccgtctttgtcacgcatcatcaccctgatcatttcttttcggcaaatccgattctggatgcgttcccctcggccaaattctatgccgcctcgtatgtcctggagggtatcaaccgcgaatatgacgacaag

SEQ ID NO: 88 - DNA, 513 bp, A.fumigatus
  unsure (318): Identity of nucleotide sequences at the above locations are unknown.
gtaaacggatccggccaactggaaaattcgggtttgcctaaaaagccggtttccaagaagattgtcctcccggaatttggatttttcaaaaacccaagttggtttcacaaacagcgggcatattcttcatgggaaggggtctttttgttcggatcaagtataatctcttcaaaagctcaagcccacggagtctctacaaactggtcataccaaatggtagctttcctcaacgtcggctcggtcttagaagaagcgatccccggattcatcgcagattttcctggtcgcttcaatgcgctgattgtcacagtggccctntgcttcttgtgcaacgcgtgtctgtggcttcctgctgccggcaacgtccccttaatgattgtttactgcgtgatatttgggttcgccagtggcagcaatatcagtcttacgccagtctgtattggacaactctgcaaaatcgaaaattacggaagatactacgccacggcatataccatcgtaagcttcgggtga

SEQ ID NO: 89 - DNA, 423 bp, A.fumigatus
tactctcaccgggattccaattgctggcgagattctcagccgttgcaatggagaatattggggtctgattgtctttacaacttgctgttatgccctgggtctcgcatgcgtcactgcagcgaagttaattcatgttggctggcgtcaaccgtgggacgtctactgaatccgctctcatttgaatgcctttttagacgtctgccggcgtacttacatccaaaaaaacaccagaagatgcagcagcaattgcagagggaaattgatgggagttacggaaggacggctggaagccaacctaccgacaaaaaaaacacacgagaccctcagaacagaaatcttgagaataatttttcttcaaattacgcgactggccgtcgtactcgcagcttggtacaagatgatgatgagatgatccagatgtga

SEQ ID NO: 90 - DNA, 189 bp, A.fumigatus
tggctaactgacgcttggattagtactctcaccgggattccaattgctggcgagattctcagccgttgcaatggagaatattggggtctgattgtctttacaacttgctgttatgccctgggtctcgcatgcgtcactgcagcgaagttaattcatgttggctggcgtcaaccgtgggacgtctactga

SEQ ID NO: 91 - DNA, 201 bp, A.fumigatus
ctgatgggggatagtcttccgttgaatgttcccgagacgccggctttcggacgggaagctttccagcataaaatcaagttactggtcgagggcgtggcgtatgatgatacgtatactttgaacacacagagcggtacgcaatgggatgggttcagacatggtcttcaccacaggggccgaaggatccgcgcaatgcgtata

SEQ ID NO: 92 - DNA, 207 bp, A.fumigatus
cacactccccacccaaccaccacccacctgcccccccccccccccacctactccccccccccgcccccccctacccgctcccccctccccacccccccccccccacccccccacccgccccccccccgcgcctcccccccccccccccccccccccccccccccccccccccccaccccccccccacggccctatatctttgattaa

SEQ ID NO: 93 - DNA, 441 bp, A.fumigatus
  unsure (196): Identity of nucleotide sequences at the above locations are unknown.
atattaactacacccccccccccccgcgccatcctaccccctccctacggaccacaccctcccgctcaaccccgcccttaccacgccacccccccccgaccccccccttcccccacccaatccccgctgcacccccagcccctaacctacgaatacccctatagtatcacgcccaccccacccccacttttagaanaggaagctagcacccctgcccttaaaccacacccgcccctaacacactccccacccaaccaccacccacctgcccccccccccccccacctactccccccccccgcccccccctacccgctcccccctccccacccccccccccccacccccccacccgccccccccccgcgcctcccccccccccccccccccccccccccccccccccccccccaccccccccccacggccctatatctttga

SEQ ID NO: 94 - DNA, 195 bp, A.fumigatus
tattggtcttattctatatgtttattcaaatggattgagaggtgtatcatgctatccctcgtaacccttctatctgggaccgctggtcttgcattgaccgcgtcggcacagtatttccctcccactcccgagggtctcaaggtcgtgcattcgaagcaccaggagggcgtgaagatttcgtacaaagaagtatga

SEQ ID NO: 95 - DNA, 195 bp, A.fumigatus
cttactactaataaccaagatactataagtataggagttagcctattcttcctagactataaatataatattaaattattaaaagttaaactactagattataagggagctactatagatatagcctacttattaaagaagaaggctaaagtaattataactaaaataaaagaagctattaatatagcagtgtag

SEQ ID NO: 96 - DNA, 240 bp, A.fumigatus
attaatcccctagggagaatcgatttggtcttgttatattcaaggggggccatattggtgacgatcttgttcttcacagtcatgccgaggaagcacccaagcaatactgaggtttggagaagatatcacaacaacaccggcggatggtcggatggtgtttgtttcgtaataggactgatcaacccggctttctcagttggagtgcctgactgcatcactcatctttccgaagaaggttag

SEQ ID NO: 97 - DNA, 543 bp, A.fumigatus
caatgtttttacatagttatgaagccccaaattagagtccctcaaggaacgatgctccagatgttaactgccttcgtcaccacttttgtatacctgattgcgttgttgtactccattgagaacctcgatacggtcttacatagcgagttctcgtcgttcccaacagcagaaatctaccgacaagccacaggatctaggcagggtgcagtcggactggttgcggtgctcttcgtgactgcgtttccaaccctagttggagtctacatcactggaggtcgcatgtggtggagtcttgctcgagacaaggcaacgcctttcgcctcatacttcagtaatgttcatccaacacagaagaatcccgtccgggccactgtagctatggctggtatggtgagtttcctgggttgcatatacataagcagtactaccgcgttccaggcactgctatcgtcctatgtcgtgctgagcaccctgtcctatctaggggctattctgccccatgtactgacaggtcggtcttcaccacggggctggaaggatccg

SEQ ID NO: 98 - DNA, 276 bp, A.fumigatus
aatccagaatgtaagtggattcgatctcaatgcttctcgcaaggccctaattcggcttctcagaataaaatcccttcacttagggagcaatgggattgcgccaagtttgtccttcttagccacttcactgtggaacttccgcagatttggttggtgtctcaatttgaccgggctccatggtatgtttctaacagtatgtccgcaggcttttccaccccatggctcaattcttcggtctgtctacgtcggttccttttccctccgtttggaccatga

SEQ ID NO: 99 - DNA, 498 bp, A.fumigatus
  unsure (339): Identity of nucleotide sequences at the above locations are unknown.
cagtatgtccgcaggcttttccaccccatggctcaattcttcggtctgtctacgtcggttccttttccctccgtttggaccatgatgtaccagatagccattttctttgttcttgaggatacatggcattatttctctcaccgtgccctccattggggccctttgtacaaggctatccataaaattcaccaccagtattcggcaccctttggtatggccgccgaatatgcatcgcctattgaggttatgattcttggatttgggaccgttggatgccccattctttggtgtgcattgaccggcgaactgcatatcttcacgatgtatgtctggattgtnctacggcttttccaggccattgatgcgcacagcggctatgagttcccttggagtctccatcatttcttgcctttttgggctggagctgatcaccatgatcttcaccacgaagaaatttgtcggcaactattccgagtaacttccggtgggtgggaataa

SEQ ID NO: 100 - DNA, 198 bp, A.fumigatus
agacacccggaggacgagagctttcgaatcagaacgccggctgactcggtcattggccctatcgcagattccgcgaccgcgctgcgccacgttcgcttgttcgtcgacttcatggacattgagactatccccttgtggaagcgagctgccggcacgacgcagcgaaagatcgcttttgcggacctgtggatatcatga

SEQ ID NO: 101 - DNA, 732 bp, A.fumigatus
  unsure (5): Identity of nucleotide sequences at the above locations are unknown.
atganaatgaaatctgtcgagcgcgcatccttccagccccgtggtgaagactacatgaacaaccaggatgagatgtggtcgtcggatcccagtgatcagtgcctgctcgacagtagcgatcccaccgatcccctggcgtttgttaatgccacctgccggcagggtaacatgccctcgcactatctcgaggtgcacagcgccaaggacgtgatcgaggccttccgatactcgaactgctccggccagcggctggtcatcaagaacagcggtcatgactatctcactcgcagcagtggccgtggaacgctggccctgtggactcgcaacctgaggtccatccgctacgacccggcttttgttcccagcggctgcaaaaggaccggtctcaagtataaagccatcaccgtcggcgccggagtcaacttcgacgaggcgtacgcctttgcgcagcagcacaacgtcaccatcctgggcggatactcgtccaccgtcggactctcgggcggttgggtcctgaacggcggccactcgatcctcagccccgtgtacgggctcggggtcgaccgcgtcctggagttcaaggtcgtcactccagacggcgtcttccggaccgccaacgagtaccagaacgccgatctcttctgggccctgcgcggcggcggcggcggaacctttggcgtcgtgctcgaatccacccaccgcgtggagccggccgtccgctttgtgtctgcc

SEQ ID NO: 102 - DNA, 351 bp, A.fumigatus
ctggtccacgtcccaaaccacccggctcccacgcggggatcggtttgggttcgtgttttaccgcttatagccgagaaccaatggctgcatctgtccctcatcaccgacctcaagaaggcctgcaaggaggtcttccccgtcgccgaatacgcctacaccacaattcccacctacccctccggccagatcggcttcatggtctgctgcaaggacgccacccgcaatgtccgtgagcccgtccgcacttggtcccgtgaggaggaggagcgtctctgccgctactacaaccaggacattcaccgggccagcttcgttctgcccaactttgcacgcaaggctctggatgtgtga

SEQ ID NO: 103 - DNA, 315 bp, A.fumigatus
tttcatttcttagtgtcatgtttacggctcgatgaatctctgttccttttcaaatgtttttacaagtcctatctccccatggtgtggtgggagcttcttctagatttagaggatcaaaacaaaattatgtgtcataatgtagttgtcgtccattgcgcttacaagggatcgtcagtgtggaagacaggttcaaaatctaatatcataagaacatcattttcattgagtaattacatttacatgctaaccgtaagtttgattcacacatccagagccttgcgtgcaaagttgggcagaacgaagctggcccggtga

SEQ ID NO: 104 - DNA, 195 bp, A.fumigatus
  unsure (172): Identity of nucleotide sequences at the above locations are unknown.
acgttggtcaatgatcactctgacctccaaggagatgctgacacgattgagtatacgatcctccacaccgagttctaccggggacgagcgcaacctggcatgttgatcatttggctccgactcacatacgtgcttctctggcgccttgggatgtctggcatttgggctcggngcaacaaatgtgactttggccct

SEQ ID NO: 105 - DNA, 522 bp, A.fumigatus
tggctcggctccttccagccccgtggtgaagacgtcctcgcctgccgagtccttgggccagtatgtgggtcgctgctgttcgcgttctttgatgacctcaactgtgtcgacagtctcgtcgctgttggcgaactgctgaaagtacttgcgtcgcttaggattgcggactgtctcggtccactcacaaaagtagctgttcaccagttcttccatctgctgttccatctcagcgccaatccccaacttgtcgtcgatgatcacctctcgcagatagttgataccgccggggaggttctcgatccaccgggcagtccgctgaagtttgtctgccgttctaatatagaatatgagatatcgatcaatgataggaatgactttctcaggaggcacatctttcgcaagcaattccgaatgccggggtttggcacctccattgccaccaacgaaaatgttatatcccttctcggttgcaatcaatccgaaactgatcggaaattagctgcttgttcattcatagtctaa

SEQ ID NO: 106 - DNA, 186 bp, A.fumigatus
  unsure (47): Identity of nucleotide sequences at the above locations are unknown.
ttggtcaagtggcgaaaaaaatccaccttttactgcaggattacagnaggtcagcgtattgacttgtttggtgccaagaagcaagattttttcgacatctggacgaagctcgtggacgcggaaatggagagtggtcatgcttatgccaagtcgctccgaacaatcaaggtactgccgcccgtttaa

SEQ ID NO: 107 - DNA, 318 bp, A.fumigatus
cttgtttggtgccaagaagcaagattttttcgacatctggacgaagctcgtggacgcggaaatggagagtggtcatgcttatgccaagtcgctccgaacaatcaaggtactgccgcccgtttaagattgagtttcctagctgacgtattctatcagagctgcgtcggaactacatggtgccgctttggtatcggcgacagtgttggaatggcgatccgactggaggagcgctacaagagtattcggtcaccccataagctcaagggtgcggtatctggttgtgtcagagagtgcgccgaagctcagaacaaggagtaa

SEQ ID NO: 108 - DNA, 495 bp, A.fumigatus
tttccgatcagtttcggattgattgcaaccgagaagggatataacattttcgttggtggcaatggaggtgccaaaccccggcattcggaattgcttgcgaaagatgtgcctcctgagaaagtcattcctatcattgatcgatatctcatattctatattagaacggcagacaaacttcagcggactgcccggtggatcgagaacctccccggcggtatcaactatctgcgagaggtgatcatcgacgacaagttggggattggcgctgagatggaacagcagatggaagaactggtgaacagctacttttgtgagtggaccgagacagtccgcaatcctaagcgacgcaagtactttcagcagttcgccaacagcgacgagactgtcgacacagttgaggtcatcaaagaacgcgaacagcagcgacccacatactggcccaaggactcggcaggcgaggacgtcttcaccacggggctggaaggagccgagcca

SEQ ID NO: 109 - DNA, 279 bp, A.fumigatus
gcactcatatgttatcttcgagcccggcgtgaagacatccagctgaactcttcgggattccaacagcccaatggccaaggcgtagtctccagggccataccggaaactccccttgaatacaacctctttatcacaaacctggcccacgggaaacatcaaagtcgggtttccgagacccacctggacgaatgtgcctcccgagcgaagaatatcgagaccgcaattcaagcatggctcggcccctgtggcgtcgagaataatatcggccccatcttctag

SEQ ID NO: 110 - DNA, 555 bp, A.fumigatus
tccctgagagatggtgcgctggtggagccccttagtgtcgcggttcatgcctgccgcttggctggggacatgcagaacaagagcgttgtggtcttcggtgccggtccagttgggttgctttgttgctctgttgcgtctgcgtttggagcagcaaaggtggtggcggtcgatgttgtgaaaactcgactggccactgcaaccaaatacggtgccactcaccggtacgagatggacgctgagaagaaaaatgccgaggaactatcggcaaccgcagccctagaagatggggccgatattattctcgacgccacaggggccgagccatgcttgaattgcggtctcgatattcttcgctcgggaggcacattcgtccaggtgggtctcggaaacccgactttgatgtttcccgtgggccaggtttgtgataaagaggttgtattcaaggggagtttccggtatggccctggagactacgccttggccattgggctgttggaatcccgaagagttcagctggatgtcttcacgccgggctcgaagataacatatgagtgc

SEQ ID NO: 111 - DNA, 366 bp, A.fumigatus
aataaagaggatgcgggtgtcttgatggaacagaaggccgctctagaaaaacggaaaaaagaggctgaagagcatgcctctgaacaggaaagcaggagagatcgtaagattcggacaattggaaactatgttcatgagtcagtgcctgtgagcaataatgaggtgggttatctttcgagatcttgttactggcatcggaaactcatatgcttaaaggatgacaatgtggtggtcagaacgtgggctccggaaaacgtgtttgtagagaagcgcaactgtctttctcatcacgaagtccttacccgccttgatgggtacgattcggagcgtggtgtaaaaatcgttgccatcgtggattttgtttga

SEQ ID NO: 112 - DNA, 789 bp, A.fumigatus
agacatttccgagacggaaactacttctaccagatctcgagtgaataccgggtcgccagacctgaatctcgggggagctggtttcctcagaaaaagccggacaaacaagtaccttccacaggagcgagtgagaacccaagagactcggccgtgaatggtcattccaggtctgagagcgtcgagacacctgcgaccccatccaagtcaaagaacaaagctacaatcatgttatccaagatgatgaagtatgatgttgaccctcgcaagcggtcgaacagacccgaagtcatcgatctccattacgacaggctacataatccggacaactgcttccacattgagctcagctggatgaataccactccgaagctgatcgaagatgctgtgctatcctgggctgcaaccgccgagaagttggactcaagctcggccaggtggcaaattgcgaaagcttgtcgatcagcaagacgcaaccttttaggaagccatattgaggcttactcgcagtttcaacttcttcgggccccggtcccacaagtttcaataccggtacctttttgcaactgggcttatcggaccgacattactaccaacaagctctgcttgcgaaatttgattttggtctggacttccaagcaaagatccgcgttcccggccgatgtggaagtggcctactcctggggcactgcggactaccagtacccggagtacattcaccggtctggcagttttctggttcaaatcaccgaccaaggagactctctggtttttggccaaccgaacttgtga

SEQ ID NO: 113 - DNA, 330 bp, A.fumigatus
cctccccttaagcggctctgccacttcgtggtgaagactcagtttgattaccttatcaggttagactggaggtactccctagcttatctgctttcgtctttgtttctccgtctggatagcctctccctctttgcgatgctgacttttctccttctgctgttcttttttcctgctgctctttgctctttcttcttcctctcttcttttcttctttttgtgttgcctttcctctcttgctctcttttcttttgctcccttccttcctcccgcggtttgtccgcttcccccctcctcgacttcctccgcctttgcctctcccttgctgattga

SEQ ID NO: 114 - DNA, 312 bp, A.fumigatus
  unsure (288),(299): Identity of nucleotide sequences at the above locations are unknown.
tcgcctcctcgcccttccttcttccgcgtcggcgcgttcctcgtctcccgctttgatggcgacctcgatttctttgatgttcgcttcctttcttcgggcttctctttggatcttgccggcttctccctcgccgatctgtgttgtctctccttcttcgccgctgtcctctccgtccccgatgattttgtcgcttatgtcctcccggccgatcccggtcggattcttatcttgtatgtgacgatggagccttgcgggtatcgactgtcggggattgtgccgtgtgtgctncggatcttctnctctatggcttga

SEQ ID NO: 115 - DNA, 498 bp, A.fumigatus
gaatccgaccgggatcggccgggaggacataagcgacaaaatcatcggggacggagaggacagcggcgaagaaggagagacaacacagatcggcgagggagaagccggcaagatccaaagagaagcccgaagaaaggaagcgaacatcaaagaaatcgaggtcgccatcaaagcgggagacgaggaacgcgccgacgcggaagaaggaagggcgaggaggcgatcaatcagcaagggagaggcaaaggcggaggaagtcgaggaggggggaagcggacaaaccgcgggaggaaggaagggagcaaaagaaaagagagcaagagaggaaaggcaacacaaaaagaagaaaagaagagaggaagaagaaagagcaaagagcagcaggaaaaaagaacagcagaaggagaaaagtcagcatcgcaaagagggagaggctatccagacggagaaacaaagacgaaagcagataagctagggagtacctccagtctaacctga

SEQ ID NO: 116 - DNA, 627 bp, A.fumigatus
  unsure (77),(88): Identity of nucleotide sequences at the above locations are unknown.
gtaagaccaacgtcaccgggctcttttacaacctttaaaaacgttttggatccccgcagcccatcaagccatagagnagaagatccgnagcacacacggcacaatccccgacagtcgatacccgcaaggctccatcgtcacatacaagataagaatccgaccgggatcggccgggaggacataagcgacaaaatcatcggggacggagaggacagcggcgaagaaggagagacaacacagatcggcgagggagaagccggcaagatccaaagagaagcccgaagaaaggaagcgaacatcaaagaaatcgaggtcgccatcaaagcgggagacgaggaacgcgccgacgcggaagaaggaagggcgaggaggcgatcaatcagcaagggagaggcaaaggcggaggaagtcgaggaggggggaagcggacaaaccgcgggaggaaggaagggagcaaaagaaaagagagcaagagaggaaaggcaacacaaaaagaagaaaagaagagaggaagaagaaagagcaaagagcagcaggaaaaaagaacagcagaaggagaaaagtcagcatcgcaaagagggagaggctatccagacggagaaacaaagacgaaagcagataagctag

SEQ ID NO: 117 - DNA, 438 bp, A.fumigatus
gcgacaaaatcatcggggacggagaggacagcggcgaagaaggagagacaacacagatcggcgagggagaagccggcaagatccaaagagaagcccgaagaaaggaagcgaacatcaaagaaatcgaggtcgccatcaaagcgggagacgaggaacgcgccgacgcggaagaaggaagggcgaggaggcgatcaatcagcaagggagaggcaaaggcggaggaagtcgaggaggggggaagcggacaaaccgcgggaggaaggaagggagcaaaagaaaagagagcaagagaggaaaggcaacacaaaaagaagaaaagaagagaggaagaagaaagagcaaagagcagcaggaaaaaagaacagcagaaggagaaaagtcagcatcgcaaagagggagaggctatccagacggagaaacaaagacgaaagcagataa

SEQ ID NO: 118 - DNA, 210 bp, A.fumigatus
ggatgtttcatcacgcattatcttaggtacttactaataccccttcacaccggtattatcgacacgatgatgggcagattgaagcaattcactcctgaattgaccatataccgatacaacacctatattctagtgggctgccacggtgatgtacggagtacgtcatcctcagcggggcagcgtttcgcatccctacaccccagttcctag

SEQ ID NO: 119 - DNA, 183 bp, A.fumigatus
  unsure (15),(18),(19),(27): Identity of nucleotide sequences at the above locations are unknown.
cagacggccttttgnagnncccgcggngatggcagcgctccttccagccccgtggtgaagactgcagacgatgctgcctcctgtggaggagatggggatggtgaacaaggacatgatggctttgtagtggagagtgctttattgatctttgctggtatgagagcaaaggatttcacagcatga

SEQ ID NO: 120 - DNA, 432 bp, A.fumigatus
agacatggaacggtacatgagtacaacatcaccatcaaggtgtggaccgacatcagccctacgcccatggcaagcacatactatggctatggcggtttatctgttgacctgcaagtccctgggacattgatggtagcggcactgaattgctggtggccagatgagctgattttcacaagtgtggattctggagctacgtggtcccccatctgggcctggaacggatatcctaacttggactactactatagctatgatatatcaaatgccccttggctgcaggatgacacctcaacaaatcagttccccgttcgtgtcgggtggatggtcgaggctctcgcaattgacccgttcgactcaaaccactggttgtacggcactggcgcgaccatttatggtggccatgacctcgagaaatgggacaccgtgcat

SEQ ID NO: 121 - DNA, 201 bp, A.fumigatus
gtacaatactatctaagtcttactagatgcttctgccactatattaataagtatgcctatattattaagcctttacaggaacacaagacgcacatgcttaagggtagccctctaaaaggacctgagcgctgtatatttactattagtaaggtaattaatactcctactaattataagactaaagcattctgtcagttataa

SEQ ID NO: 122 - DNA, 480 bp, A.fumigatus
atcctcttaataatatatccaccttattcaactcattcgctgcagctgcttgatgttgggatctttagtcctcttgccactgcttatagcaagcaactggaggagtttttgcacagattaatgggcctaagctatattactaaacaagactttttccgcctcttttggccagcctgggagcaagcctcgtcattgagaaatatcctttcttcatggaaaactgtcggtatatcgcctctggatcccgagattattctgcagcgattcactaagaagaaggactcaaggccctctactagtgagtcttctcactcgatactacaagcggaagattggaggaagattgaaaggcttctaaaccacatagtggctgatatatatgacaaaaacactaagaagttaagtttaataatgcaccacctctctacagagaatattcttctaaaactacattgccaaggccttgaatcagccctctag

SEQ ID NO: 123 - DNA, 222 bp, A.fumigatus
  unsure (204),(205),(206),(212),(221),(222): Identity of nucleotide sequences at the above locations are unknown.
atacatctgcccctagctcatgaattattatcctcggatgacttccgaaaatacatcgtcagcatccgaaatgcaagttatgccattgcagttctagcgaagatcagctcgattgaacaaggcacggttacagcagggatgcgcttcgatatcgaggtagggtcttcaccacggggctggaaggtcgacgagtgctcatttggnnntcaatncgggccctnn

SEQ ID NO: 124 - DNA, 576 bp, A.fumigatus
  unsure (38): Identity of nucleotide sequences at the above locations are unknown.
gcgatacattctgaattttatgactggagggtatctanaagaagagggcttcttctcttcctctttctcttcctcttcctcctcctcctcttcttcttcctcctcttcttcttcctcctcctcttcttcctcctcctcttcttcctcctcttcgcctgtcgttgcttctcttccttcttcttctcttggcgcttcctccttcttctcttcctcttcggccttcttctccgccgcgcgtcgtttctcctcctcgcgccgtccctgttcctgttttgctgccttctcctccctcttcttccgctgcgtcttgtttttcgctccctttggtgtcgtctccctttcctcttctttctggttcgactcgttctcggcgcgtatttagcggagttttcgtgtttttctgcctcttctcctcgttccttcgcgcgttggcctcctccttctgctcttgctgctttttttcctggttgttctttgatttcttgttgccggtcgtgcgggttccgttctgcttcttcctgcgcttcttggagatcactatggggatggattaaaagggggattgctatttgttag

SEQ ID NO: 125 - DNA, 456 bp, A.fumigatus
  unsure (6),(21),(30),(112): Identity of nucleotide sequences at the above locations are unknown.
agttgnggccgcttgctccgnatggtgaanaggtatgcacgaattgtcccaagctacaggactagatggaataagcgatacattctgaattttatgactggagggtatctanaagaagagggcttcttctcttcctctttctcttcctcttcctcctcctcctcttcttcttcctcctcttcttcttcctcctcctcttcttcctcctcctcttcttcctcctcttcgcctgtcgttgcttctcttccttcttcttctcttggcgcttcctccttcttctcttcctcttcggccttcttctccgccgcgcgtcgtttctcctcctcgcgccgtccctgttcctgttttgctgccttctcctccctcttcttccgctgcgtcttgtttttcgctccctttggtgtcgtctccctttcctcttctttctggttcgactcgttctcggcgcgtatttag

SEQ ID NO: 126 - DNA, 531 bp, A.fumigatus
  unsure (15): Identity of nucleotide sequences at the above locations are unknown.
ctggagggtatctanaagaagagggcttcttctcttcctctttctcttcctcttcctcctcctcctcttcttcttcctcctcttcttcttcctcctcctcttcttcctcctcctcttcttcctcctcttcgcctgtcgttgcttctcttccttcttcttctcttggcgcttcctccttcttctcttcctcttcggccttcttctccgccgcgcgtcgtttctcctcctcgcgccgtccctgttcctgttttgctgccttctcctccctcttcttccgctgcgtcttgtttttcgctccctttggtgtcgtctccctttcctcttctttctggttcgactcgttctcggcgcgtatttagcggagttttcgtgtttttctgcctcttctcctcgttccttcgcgcgttggcctcctccttctgctcttgctgctttttttcctggttgttctttgatttcttgttgccggtcgtgcgggttccgttctgcttcttcctgcgcttcttggagatcactatggggatggattaa

SEQ ID NO: 127 - DNA, 555 bp, A.fumigatus
  unsure (535): Identity of nucleotide sequences at the above locations are unknown.
caaatagcaatcccccttttaatccatccccatagtgatctccaagaagcgcaggaagaagcagaacggaacccgcacgaccggcaacaagaaatcaaagaacaaccaggaaaaaaagcagcaagagcagaaggaggaggccaacgcgcgaaggaacgaggagaagaggcagaaaaacacgaaaactccgctaaatacgcgccgagaacgagtcgaaccagaaagaagaggaaagggagacgacaccaaagggagcgaaaaacaagacgcagcggaagaagagggaggagaaggcagcaaaacaggaacagggacggcgcgaggaggagaaacgacgcgcggcggagaagaaggccgaagaggaagagaagaaggaggaagcgccaagagaagaagaaggaagagaagcaacgacaggcgaagaggaggaagaagaggaggaggaagaagaggaggaggaagaagaagaggaggaagaagaagaggaggaggaggaagaggaagagaaagaggaagagaagaagccctcttcttntagataccctccagtcataa

SEQ ID NO: 128 - DNA, 516 bp, A.fumigatus
  unsure (513): Identity of nucleotide sequences at the above locations are unknown.
tccatccccatagtgatctccaagaagcgcaggaagaagcagaacggaacccgcacgaccggcaacaagaaatcaaagaacaaccaggaaaaaaagcagcaagagcagaaggaggaggccaacgcgcgaaggaacgaggagaagaggcagaaaaacacgaaaactccgctaaatacgcgccgagaacgagtcgaaccagaaagaagaggaaagggagacgacaccaaagggagcgaaaaacaagacgcagcggaagaagagggaggagaaggcagcaaaacaggaacagggacggcgcgaggaggagaaacgacgcgcggcggagaagaaggccgaagaggaagagaagaaggaggaagcgccaagagaagaagaaggaagagaagcaacgacaggcgaagaggaggaagaagaggaggaggaagaagaggaggaggaagaagaagaggaggaagaagaagaggaggaggaggaagaggaagagaaagaggaagagaagaagccctcttcttntag

SEQ ID NO: 129 - DNA, 360 bp, A.fumigatus
tgcacgcccttcagccccgtggtgaagacccagattaactacgtcacttctaataatatgaatgtgtccttgaccgatgacgtgacccccaaggtcgaggagattgatggtgcggaggacttgcggagcatcaaaaccctcgaggcggagaacacgatcgccagtgcgagcaatcatcccaatactacgacaaccaccacggccgctcccgccaacgtcccacggaaacgtggtcgcccacgcaaacatccactgccagtacccgggagccagatcaagatcaccaagggaagatctaagacgggctgtattacttgtcgacgacggaagaagaaatgcgacgagacaaagccatcgtaa

SEQ ID NO: 130 - DNA, 309 bp, A.fumigatus
ctactctttctgtttattctcttcttttatctacctcttttcgtctccccgttcattttctctcccctctctctcccttcccctcccccccctcggcgagattgtcttccaccgcctggtgaaaaccagttccgttccctgaccggaaccaagcgaattgtgtcatttggtggctgggcattttccacacaaccttccactttcaacatcttgaggacggcggtaaccgcggacaatcgagcacagtttgccagtaatgttgcgcaggcatgtcttccctattgccgcggggtttcagggcacggctaa

SEQ ID NO: 131 - DNA, 381 bp, A.fumigatus
tgttgcgcaggcatgtcttccctattgccgcggggtttcagggcacggctaaccctgctgcagtttgtggtcaataacaatctcgatggtgttgacttcgactgggaatatcccggcgcaccggatatccctggaatcccagccggcagcccggacgatggaccaaactatctggcattcctgcaagagcttcggtccattttgcccaccggcaagacgatttctattgctgcgccggcatccttctggtacttgaaagccttccccatcgccgagatcagtcaggtcgtggactacatcgtcttcatgacatatgatctccacgggcagtgggattataacaatgccttctccgagtccagtatacaccgcttactctga

SEQ ID NO: 132 - DNA, 189 bp, A.fumigatus
tgtggtggtaggggtaggtttgggaatgtcatgctacagatatgccttaaggcaggtctaaactattataatctggttgaatatattattaacttgggcagcacaggtatgatgaataatatcttatacaaaggcgcgaggggtcctgtcattcctaatattattatatctataagaaagggattataa

SEQ ID NO: 133 - DNA, 336 bp, A.fumigatus
actttcaatagcaccgaagctgcatctatggtggaacatattgagcttctacggcaagaacttcgcaggctcttctgttttcataatcatcgcgaacggtggtccacatacgtttggcatctgctgtttcatccaagctacgtcttccgtctgaagactggcgtgtctaattccgtcgacaacaacctgtatcgactgagcgtcatggtttcttcagaattcgcggccaagagctgtgacagccagcagaacatttcgtctgcatttttcgtctgcagctcaacacaaatactcagaatccgtaagcttacaacggcaagccaggcctccatttga

SEQ ID NO: 134 - DNA, 417 bp, A.fumigatus
ttccaggggaagttccaagatatttatcttccactccatgttttctcaaattatagatatccgagaaaggccaaagactttgtgtcattatgggaactgaaatattcagctgagttcagtctatataccaaattcttagatgaaccaatccgttgtttggtggttgtactgatcgtattttgcgattaccaacactgcagaaatcttgtgcgattcggctatgatgagagagcgttctggcttttcccctggagggcagatatcatgttgcactctggtagcaagtatctgggtggtcacagcgatattatttatggtgtgctagcagtccgaggcgaggaatggtacagacaactgtggaacggattcacttgggttccattatcggtcaaatggaggcctggcttgccgttgtaa

SEQ ID NO: 135 - DNA, 798 bp, A.fumigatus
ctaatggattacctgcctatatcaagtcacaggtcgcaccctgagtggggtatatgcgaagaccccattggtcgtaatgacccgcagagaccatgccattcaggcgttgttcggagggtcgagtgcttgaggggtgaaatgaagatggattttgagatctttcctgcgttcaactatgcaagagaccgacacactggtcattggattgctccagagagctccagtggtgcgctcaggaaatattcttttgagagtgagacgcaaaaactggacttgactatccattctggtatcgacacttcacttgagccagctgatgctatttctccggtggatctaaatctccaggagaaggaaggaccgaaagggcctggactacatgccagagtgagaatgatagaagggcaatcaatctcatttgtgcttcacaacccggaaacaagtcttcctgaggagggcgccttacaacactacctggacagactggaaaaagagacgctggacttctgggttggctggatcgcccattgtatgttccgcggtcactaccgagaacaggttgagcgtagcctgttggtgctgaagctcctcacctacaaacctaccggagcaatcgttgcagctcctacgttctcccttcccgagtacgtcggggggtcccgcaactgggactatcggtactcctggcttcgtgatgctgcctttgtcgtgtacgtgttcctcaagaacggctatcccttggaagccgaagcatacacgtcttcactcacggagctgccaggagccgcgcaagagtta

SEQ ID NO: 136 - DNA, 489 bp, A.fumigatus
ctccagaacatcgaattctccggtggtacctgctctggcggccacggtctctccattggctcggttggcggtcgcgacgacaacaccgtcaagaacgtcaccatcaccgactccaccgtgaccgattcggccaacggcgtgcgtatcaagacggtctacgacgccaccggctctgttagccaggtcacctactccaacatcaagctgtcaggtatcacggactatggtatcgtcatcgagcaggactacgagaacggcagcccgaccggtacccctaccactggcgttccgatcaccgacctgactatcgacggtgtgactggtaccgtcgagtccgacgccgtcgaggtgtacattctttgcggagacggtagctgcagtgactggacctgggagggcgtggatatcactggcggggagaagagctccaagtgcgagaatgttccctcaggtggtcttcaccgggggctgaaaagcgctccatgggaa

SEQ ID NO: 137 - DNA, 594 bp, A.fumigatus
agaccattcttcacctattatagtgaatatttcttacttacctgttctgcctgcctgactgccattcacccgactaaaatatctgaccacctgaatgctgagcaccctggaactcatgtgacccagcaggccctagattctattagggttgctgccctgactactagtcataatcagattatgactgaacagcctattcacccgattccaaccctggctagccctagggaggggtttcaatgcaaactgtgcaaactagttcggcttggtcaccgaaccatgcgcaatcatatccatgatattcaccagatcaatggatatggccctcaggatgctgagatggcatcatgcctcatccaggccctagaagggactagctatctctttagggtaaaccctccagccacgatgcctaatcaggcatccactagcacccgagctagccgaaaacgaactagggaaccctccctgattggttcaacccctggaccttctatccagcggtctagggtccattcaccagatcagcctgggacatcaaccattcaccaatcatacctggcctcgttccaggctcaccgccagaatcttaag

SEQ ID NO: 138 - DNA, 270 bp, A.fumigatus
gacgcttactctgtctatttgctttgtcgctggttggatcttccagaagttccaaccttccagtaccgtcgatgcaacctccttatcgaactagtttacaggatcgcagacttccccgcaatgcagatactttcccctcacggtttgagctgtaagctaattcgcaagctcgagctctctcttattaaagccagcgagtaccctggtcttaccatggtctccatgagctatactgcgtcttcaccacggggctggaaggatcagcggtag

SEQ ID NO: 139 - DNA, 231 bp, A.fumigatus
gacctgttgactgatcgacactaccattggtggagacgctcaaatcgcgccataaccgatgctcagcttgtggtcttggaggtgcttcgttcccatctagacctatcagcacctagaatacgagacattgccgataagacgcttactctgtctatttgctttgtcgctggttggatcttccagaagttccaaccttccagtaccgtcgatgcaacctccttatcgaactag

SEQ ID NO: 140 - DNA, 588 bp, A.fumigatus
  unsure (282),(500),(574),(575),(577): Identity of nucleotide sequences at the above locations are unknown.
gaagcgggccattgtttccagaaatccatcgagattgaccccaggtgtgccatgtcatactggggcctcgcttacgccgtcggtccaaactacaacaaaccatgggaggtcttcgataagcaggagctcgaatcgacagtccagcgcactcgcagggccgcagaagatgccaaagcaaatgcaaaactagcgtcgccggtagaggccgctctgatcgacgccatgcagtatcggtatccgcaagaccggccggcgggggactgctcatcatggaaccagggntacgccgacgccatggaagcggtgtataaacagcacccggatgatctagacgtcgcggtgctgtatgcagacgccttgatgaaccttacgccgtgggcgctctgggacataaagactgggcaacccgcgccggacgcgcgcacgttagacataaaagcagttctcgatcgtgcgcggcacagaagggaggactctctcatccgggtctgcgcatttgntatccatttgaggagagtcagatccccggatgcgcaggaggccgccaccactcctgggaaaggcccacaagccnnanacacttgggga

SEQ ID NO: 141 - DNA, 954 bp, A.fumigatus
gggaatttcttttgcggggcgtatgaaggcttaagttgggtttcaaagaagggccagggtttggggtccaagtggcccagggtattgtcggcccggtcaaaggcgcaagcgcggcccgacgggcgttgggttggggtgccgttcgcaagaaaccgaaaacaagctcgaaaggaagagaaccgacaaacagctgcccgaggtgaagttgtcgaagacagttcagatgaagaacggatgagaagaaggaaaaagaaggaagaacgtcaacgggagagcaggagtgggacggggacacctgtctctcgagcgaaacctcgtttcagagccgcccgcgaaattgaggcggatatggatggtctggaggtgccaaatgtgctaaagtcgctgattgacgccactggcaaggaacagcgagttctgacctccacagccggcctgatgactcctttggagtttgtcaatcaaggtgaaggggaggcgttgaaaatcgcacgaagagcgcgtcacgaccttgaagcgtttgcggatgaatggaaaggattgacggaacgaaagaagtttgctgagttggaggaagctcagatcgtggaacaactggacaccaatcagctcaagacggatgaactcacgaatcttatcacggccattgggcagctggagattttcgaagaagacagtacgcttgcaaggtttgatgaattaaccagcaagctcgagtcgatagagatgaagtaccgaagcgagatcgatgagtatcgactatcagagacggcggtcgctgctattcacccgctcttccgccaagcgatggaggattgggatcctcttcaagagccgacattccttgtatccaatcttcgtcgtcttcagccccttctgagcaggaagaaaaatgacgaagccgtgtcaagacagtcttcaccacggggctggaaggagccgtgccatgaccaa

SEQ ID NO: 142 - DNA, 183 bp, A.fumigatus
tctaagacatccttagatttttctcatactattattctttctattcttcctttatacctagacaagccatctattcccctccatattcgtgaaatttcctttgtcattcatatactatttagtatatactatttattttcatttcacaatacgagaatctgccccacgggtggaaatccgcgt

SEQ ID NO: 143 - DNA, 327 bp, A.fumigatus
tgtcttgtctcatctcctctccgccagtccacgtataaattcctcctcctcctcatccctcaccatgacttcttcctttcaaaccatcaagggatgctcattgacggtgaaaagtgggcctgtgaagcttgcgtccgcggccaccgtgtgacaacctgtaaacacaatggtacctattcctccattctctcactctccttctccaagttcagtcagactcatattgaatgttacagatcgaccattgatccgcatcgccagaaagggtcgccccttttcgacctgctctgtatgcaattgcaccccatgccaagctccagaggatca

SEQ ID NO: 144 - DNA, 267 bp, A.fumigatus
tcaacatcgcgagtcatcagggttaacaacacgaagtccgctcacacaccttcatatataggctccaaccagattgaagctgctctgtgcttctacaaggctctcaaggtctaccctcagcccaaggacctgatctcgatatatgacaagaccgtccctaaggatgtgttggagatcttggccgaaatggtcgccatggacgccggtctcaaactgggatcttttactggcgagggtggcagtgctgacaatcacggcgtcgaataa

SEQ ID NO: 145 - DNA, 243 bp, A.fumigatus
ttgatctgcaatggcagcggcaccttccagccccgtggtgaagacacctctggcccaaggcaaatgcttacttgcccaggactagtaagaaaggcagccaggccattggactttgtgcctgtggtcttccctaaggcccagttatacctcctgccttctcagcagcccacacaagccagcagcgaaacacttactgacccaactggggctgccgcagaagctaaccatagccaccatcactga

SEQ ID NO: 146 - DNA, 261 bp, A.fumigatus
gatgtgcttgtgagtatagaatacaacaggattggccaggcgtggtggctcacgcctatgatcccagcattttgggaggctgaggcgggtggattacctgaggtcaggagtttgagaccagcctggccaacatggcaaaaccctgtctttactaaaaatacaaaaattagccgggcatggtggtgtgcacctgtgatcccagctactcgggaggctgaggcaggagaaccatttgaacctgggaggcagaggttgcagtga

SEQ ID NO: 147 - DNA, 306 bp, A.fumigatus
  unsure (74),(76),(77),(79),(83): Identity of nucleotide sequences at the above locations are unknown.
ttatctcaacatgtaatcaataaagatgttttatgctgtcttcaaagtccgggttttttttttttttttttttntnntntgtntgagacagagtctcactctgttgcccaggctggagtgcaatggcatgatcttggctcactgcaacctctgcctcccaggttcaaatggttctcctgcctcagcctcccgagtagctgggatcacaggtgcacaccaccatgcccggctaatttttgtatttttagtaaagacagggttttgccatgttggccaggctggtctcaaactcctgacctcaggtaa

SEQ ID NO: 148 - DNA, 219 bp, A.fumigatus
tccacccgcctcagcctcccaaaatgctgggatcataggcgtgagccaccacgcctggccaatcctgttgtattctatactcacaagcacatctcaatttggactcgccacatttttaagtgctgtatagtcaaatggggtgagtggcctgtgctgctccagagatgtccaacaagggcagaccccaggtcctcaagaaagtggaaattctacctttga

SEQ ID NO: 149 - DNA, 420 bp, A.fumigatus
  unsure (58),(60),(61),(63),(67): Identity of nucleotide sequences at the above locations are unknown.
tcaataaagatgttttatgctgtcttcaaagtccgggttttttttttttttttttttntnntntgtntgagacagagtctcactctgttgcccaggctggagtgcaatggcatgatcttggctcactgcaacctctgcctcccaggttcaaatggttctcctgcctcagcctcccgagtagctgggatcacaggtgcacaccaccatgcccggctaatttttgtatttttagtaaagacagggttttgccatgttggccaggctggtctcaaactcctgacctcaggtaatccacccgcctcagcctcccaaaatgctgggatcataggcgtgagccaccacgcctggccaatcctgttgtattctatactcacaagcacatctcaatttggactcgccacatttttaagtgctgtatag

SEQ ID NO: 150 - DNA, 318 bp, A.fumigatus
  unsure (307): Identity of nucleotide sequences at the above locations are unknown.
ttacagaatgctggaccattccgcgtattagaatgtgttagaagactcgcctactatattaaactaccctctacatggaagatctatctggttttatctgtcgcctaccttgaacctgcgctggccacccctaatctattctactgtgagttaccgaagcctcctgcagtcattaatgctgaggtctatcctagtgaggatgatatatacaaagttaaatgcttactaaacaagcataccgttcaccgtggacataaatataccccttatatagaataccttgttgcatggaaaggataccgactanaagatgactaa

SEQ ID NO: 151 - DNA, 246 bp, A.fumigatus
aaaaaacttgctgttatttataccttggaattcctatgcaatcttaagcaactggaacactatctaggtcttactatatgcttccaccactatgggagtaagtatgcccacatcattaagcctttgcaggaatgtaagacgcgcatgcttaacagtagccctctaaaaggacctgagcgctgtgcattcactactggcaaggcaattaatgctcctactgattatgagactgaatcattctgttag

SEQ ID NO: 152 - DNA, 534 bp, A.fumigatus
tatacgcatagttcggatccttcggccgccgtggtgaagatcatcggcgacgatgaccaaaaagttaggtcgggacgtcatcttcaaggacaatcagacttggaagccgcgagctgtgaatataggcacaagttcgactttttagaaaagtcattgtcgaacgacgaaggaaacagtatatatacacctctattgtcgccagatagttgggtcgcgaagcccgtcgggaacacgccagcgatatcctggaacatgtcaatgcgaaaatccaatcggatcgaagaaactcaaccagtctcatcccacaatcaagcccagccattgcaccatcgtagattaaaatggctaatcgcaacccagcatgctataccttgcttccatgctgtaccggctgtgttatggggaagtctggaagactgccacaggagtcagcaggagtcagcaaattgccattttgcaagtcaccttgtccatgtcactcagtgcgaatcgcctcgattgcatgttagacgctggaaacaagcaatcaaatga

SEQ ID NO: 153 - DNA, 237 bp, A.fumigatus
cgcgggtccttcgccccccgtggtgaagacatgcttggctacaccctctggaacttctgcgaactggtcttcgtctatttcttctacgtcgagaccaagggcaacacccttgaggaggtggcgcgcatcttcgacggcgacgacgccattgcgcatattgacctgcagcacgtcgagaaagagatcgaggccgaggcgacgtaccacgagactgttcctaacaagtcggctgcttga

SEQ ID NO: 154 - DNA, 873 bp, A.fumigatus
  unsure (59): Identity of nucleotide sequences at the above locations are unknown.
ctttggtcggcgcgccttttcttcaagattcgacccaatgaaggacctgaatgtttgcngaaagttggaatccgttccgcaatcgaaagtgtacagaactcggaaaagaaaaagtacggtcgctcataccagggtgatcgcttgtttcgcctcgaacgcatctatatccgctacctgagcgaaagcggcagttgggacagtgcacgcgaaaccttcaaggggctggtcggtcgccgtggcaatagttacgaattctggctcacctactatcactgggagctgatctcatggagcaaatttgtacagggagaagggacggcagatgcggctcggcggactcccaaccccagctttgcaactgccgtgttgaaacaggccatcaagcggacagacctagattggccggagaagatcatgcaggtctacatcgcgcactgtgaagactacgaggactcggatgaactccaacaggctatactggagacccggaaagccatgaaggccatcaccgcacggcgagaaaaggaagctgcggccgcgttgcagcaacagcagcaggcggcggccaattatgcatctcaagccgagaagcgtaagcgccaggatgacactggagtaaacggctatcccagcagtaaaaaggcccgtgccgaggagccaacgccagcgccagcaccggctgcgccgcaacccgagcctgtggcactccggcgcgaccgcgaaaatgccacagtagttgtcaagaatttgcctcaccatattacggaacaccgtgtccgacagttcttccgtcatgtaagttttctcccctggtttcctgttgtcttcactacctcatctaacttggacagtgcgggacaatcaaaggcttga

SEQ ID NO: 155 - DNA, 552 bp, A.fumigatus
acctgtggtccttctcgggtggcggggtatgtagaccctgcctccacccagcagggctccctggcctgggctgagatgctgttctctgacacctgcataattctctctccagacaaggaagtcctggcgagcctggagcagaagctgaaggaaattgacgaggagtgccggggcgaggagagcaggcgcgtggacctggagctcagcatcatggaggtgaaggacaacctgaagaaggctgaggcagggcctgtgacgttaggcaccaccgtggacaccacccacctggagaatgtgagcccccgcgtgagtgctggaactgcggcctctgggctgcttgcagggctccctggacatgggttggggtgggtgggtcacatctccctccccttgactcagcccttgctctcctcctataaccacagcccaaagctgtcacacctgcctctgccccagactgtaccccagtcaactctgcaaccacactcaagaacaggcctctctcggtcgtggtcacaggcaaaggcactgtactccagaaagccaaggtaa

SEQ ID NO: 156 - DNA, 273 bp, A.fumigatus
ctggtgagggaaggtcttgagggtgcaaagtcacccactggctttctttttttgagacagtcttgctctgttgcccaggctggagtgcagtggcgtgatcttgggtcactgcaacctctgcctcctgggttcaagcgattctcctgtctcagcctcctgagtagctgggattacaggcatccgccaccatgtccagctaatttttgtatttttagtagagatgggatttcaccatgttggccaggatggtctcgaactcctggccttaagtga

SEQ ID NO: 157 - DNA, 216 bp, A.fumigatus
gtagctgggattacaggcatccgccaccatgtccagctaatttttgtatttttagtagagatgggatttcaccatgttggccaggatggtctcgaactcctggccttaagtgatctgcctgcctcagcctcccaaagtactgggattacaggcgtgaaccaccgcacccagcttgaactgtatttttttaaactccaatcttcaaaacattattag

SEQ ID NO: 158 - DNA, 258 bp, A.fumigatus
tcccagctactcaggaggctgagacaggagaatcgcttgaacccaggaggcagaggttgcagtgacccaagatcacgccactgcactccagcctgggcaacagagcaagactgtctcaaaaaaagaaagccagtgggtgactttgcaccctcaagaccttccctcaccagtcagctgagtttgtcctcaaacctgcaccgctgctcttgcttattcatacacctctacaatttaaataagcacaaagttactccatga

SEQ ID NO: 159 - DNA, 516 bp, A.fumigatus
acggaaattccaggagacacaaacagccccatccgtcctacacaatgccccacgacaaaaaggaactacacagtgcaggatccctgtaccaactgccattatctcccagccacagcaaccctcttctactggccagtgagcactaccggcggtgatctctgtcaccagaacggaaccaccgtacctgccaccgctactggaaatggccccaacactgcagttgtgaatggccatacattcatatcccccagtatatatgtatccttcaccagtatctacgcgcgtagcaaccagcgcgcgcacccaggtggctcctgtggcggcgagtacgaagatgtgattatctccgtcaacccagaagccgtaacatcctaccgtaaccacctcaatgcgaagtatccacgaatcggcacagcctacccgttcaactttgccgagttccaaccgcatgtcgttgggaactattccgtgccgctgatcccgtgttttaaacgacgcgactggaaggtagtcgtc

SEQ ID NO: 160 - DNA, 183 bp, A.fumigatus
agactaaccaggtatcctagtgactctgaccatcccacaattacaacattgtttaaccatattcacttctgggaagatatcacaatcctcttccactttacaattcccactttccctagacttcatctgtatatcacctcaccatcttcatactctgaacaatcaacatcagagccacaatga

SEQ ID NO: 161 - DNA, 321 bp, A.fumigatus
  unsure (130),(228),(229): Identity of nucleotide sequences at the above locations are unknown.
acaatcaacatcagagccacaatgaagttctctcctgcttacctgcttgcgttcgcgccaattgtcgccgcccactttagactccaatatcccacgagtcgtggcttcaatgcggacacaatggctaatnttccctgcggggaattggcccaatcctccaacaggactcaggtctctctttcgtcgggctccttccctgtcgccttaaggatgggccacgatgaaacnngctgtgaagtcctcttggctcttggaaacgaatccggcagcaatttcaaaatcactctccatcccactttccgtattgagggattgggcgaa

SEQ ID NO: 162 - DNA, 189 bp, A.fumigatus
aagaacaaatttttcggggatactgttcactacgtcagcgtgcaaaccgcccagataggcaaagatgtccccctacctatgtgctcggctacagcgcagaagaatgccgagttgaatatcaataaggcaatctttgcatgcttgcatctcacaagaatcgagagatacaataaatacgaacactattga

SEQ ID NO: 163 - DNA, 192 bp, A.fumigatus
cctcttaatgttagctgttttgtagttctaaagtatatatatagttaccttataaaaagtaatatgcagcttggaattaattatattaataagctagatttccttaaagcatacctaaaagcttatatagaagcctttaaattagagaatattaaaaatagctttacagtaactagattagtgctattttaa

SEQ ID NO: 164 - DNA, 699 bp, A.fumigatus
  unsure (602): Identity of nucleotide sequences at the above locations are unknown.
ggcggccactctctttccctggcggaattggggtcattattctcgcgggagtttggtttccgcgttcccatcgcgcgtctggccaagaactcgaccctgaccggtcacctacagaccgtgcgtgccatccgagacggccacaccgctgcggtgcaggctgatctgccggccgtgctacgcgcagacgcaacgttggatgaggacatccgaccttctggtgatgtgaagatccgatccgtgacggatgcgcaaacggtgctgttgaccggcgtgactggattcctgggcgctttcctccttcacgacctgctggaaaccacatctgcgcacatcatctgcttggtgcgtttcaacgaacccgccgacgatgatcagccgggcggtgtggcccgtatccgccgtaatctgctggatttgggtctttggcgcgactccatcatggaacgcgtggaaatccttcctggtaacctgtcccgctcgcgctttggtctgtctcccgaggcctttgacgagctggccgctcgggtggatgtcatcgtccatgccgctgctaccgtcttcaccacggggctggaagagggcgtgcaacacaaatcaaaccntccccgccatgagtccgcccaactaatatataccagccacatcccacaccaatttatcctacacaaacctatagacaacaacactaccaaactttag

SEQ ID NO: 165 - DNA, 267 bp, A.fumigatus
atttgtacctgcttcactggcatattaacctctcttctattgacgctctttcctttcactcctacctacctcctcatactctgtagttcttacactactcttcacactaccactccgttactccactctatccatatacgtatctttctctcctctattacttaccggtacgtgtacacactacccgttatgtatattgactcgtctcctcctccgttcacgtactatacctctccctctgtcgtacgaatgtctactcgtgtgtag

SEQ ID NO: 166 - DNA, 201 bp, A.fumigatus
aatatgatgagtcatatgccatctgctacatccctttcgcttgatgccacgtctctcccatcctacactacttctcgctacactctcgctctgctcctgtttgtcacacgtcgtcttatccctccctatcatcactctttaccttctgctgcctctacgccatgtttctatctccttctcgttatcttcatccctctatga

SEQ ID NO: 167 - DNA, 480 bp, A.fumigatus
  unsure (1): Identity of nucleotide sequences at the above locations are unknown.
nggacgcggtatctactagccccgtggggcagatccttctggatcctggggagctccatccgatcagggactgggtggcctcagtgcggagagcttgatatccttgagaatatcaatggcaatctagtaggctacggcactgcccactgtgatgttaatccaggcggcatctgcaatgagccaaacggcctgggaggaagcattaccattccagatcagtcatggcacacatggcgtgtgacttgggaccggacgccatctaactggcaatccgagaaaatcacctggtatatggatggccagcagttccaccagatcaccgggtcccagatcggcaactcgggtgtgtgggccacgctgtgtcacgacccgctgttctttatcctcaacgttgctgtcggcggctattgggtaagtccagtgaacctttttcttttgatttcccccctttccgaacatttccatcccaaatattcatag

SEQ ID NO: 168 - DNA, 645 bp, A.fumigatus
  unsure (509): Identity of nucleotide sequences at the above locations are unknown.
ttgacccatagagcgccccttcagcccccggtgaagactttcctcattccctcatcgaagctcgcgtttcacgacccgtcgaccaatacatacagaagtgacaaatcgacatccgcaatgggtcggataagctatcccgcgggtttggatagcccgtcgaggcagcttctgcaggatctcaccagagaccttgaacaattacaaatccacagtaccgagttgaaacaggtcaaggcgtgggaacgaaaatcgttttacgaacgactcgatcgcattgatagcgaacgtgaggccatacactatacagcactcgacaaagttgctgcccgtcatgatcaggtgcgggaagaagcgcaggagatgctcagagctcaccagcgcgccgttgaggaagaaaggcgtcggaaagaggaagaggctcgtcgagaagctgagcgtctagaacgggaacgagcagagaaattacgccgtgagcaagaggaggctgcgcgacgagatgcagagcgcanagcggccgaggaggcaaagaggaaagctgaagaggaggccgagaagaagcgcaaagccgagcaagaagagaaagaacgcaaggaaaaggaacgattggaggaggaaaatagacagcgacaagcagaggcgcaaaag

SEQ ID NO: 169 - DNA, 504 bp, A.fumigatus
cacctatgtcttgccagccggcggcgtcgtaatcacaagaaacagggacggcgggacctgagtgcagaattgcataagcggggcatgttcctcatggtggacacggtcatcaacaacatggcgtacatcaccaacggcagcgatccggctacgcatatcaaatactcgacgctcacaccgttcgacagttccagctactaccacccctactgtaagatcgaagactggaacaatttcacccaggcgcaatggtgtcaaactggtgataacgtggtggcactgcccgatctttacaccgaacatcccgacgtccaaagcattctagagaaatgggcgcaagacatgatctcaacctactcgattgacgggctgcggattgatgcggccaaacacgtcaacacgggcttcctggccaatttcggcaaggcgctcagcgacaccttcatgaccggggaggtgtatcagcaagaagtagacatcatctgcgactacaagaacaactac

SEQ ID NO: 170 - DNA, 492 bp, A.fumigatus
actcttacttccacgccgcgtgaagactactgctcgccgaagtgtgtatcttcctcgcgggtattctatctctcctcgaatctcatcgcaaagcactatgagccttcagacgtcgaaggtgcgttgaaggctactgaagtcgccagccagcgtgggatccgctgtccctccgtacgaaagatcagcaagaaccacgagaatgtttatgtgggtatgaaccgggtggagggcaccacattagacgttatctggaaggaactgggctggttcatgacagtcaagcttggtctgcagcttcgccgctgtgtgaagattgacagaagtattacctcaccgactgccggatcgctcgtgacaggcgaatgcaggtctttctggcgagacgatcgctacggtcttcctgcgaattcgggtcccgcggagattgcccacttctgtcaagttctgggcgagctttacctccatgcgtcgagcaatgcatatctagcgtga

SEQ ID NO: 171 - DNA, 225 bp, A.fumigatus
  unsure (141),(156): Identity of nucleotide sequences at the above locations are unknown.
cctctgtccatctcatttcctctccattctccctgcacctgtcaccaatgtttcggacgtctcaacactgagtctgagcctcggtacgactggcattgttctttgtccatcggagatggagagtctaagcccagccacacncaggacacgtggatnttcgcttatttgccaggatttgtcagtctgaatttcttcgtctacactttgccaaacgacagtttgtga

SEQ ID NO: 172 - DNA, 717 bp, A.fumigatus
  unsure (2): Identity of nucleotide sequences at the above locations are unknown.
anactgattgggctgggtcgaccaggctcagggtgcagcactttcctcaagactctcagtggggaactacatggcttgaacgttgacgagaagaccgtccttcactacagcggaattccgcaatctacgatgatcaaagagttcaaaggcgaagtcgtctacaaccaggaagtcgacaagcatttccctcacttaactgttggccagactctggaattcgcggcggcggtgcgcaccccgtccaagagactgggcggtatgtccaggaatgagtacgctcagatgatgaccaaagtcgtcatggctgtcttcggccttagccacacctacaacaccaaggtcggaaacgacacggttcgaggagtgtcgggtggtgagcgaaagcgagtgagtattgcggaaatggctctggcaggcgctccgttggcagcctgggataattccactcgaggcttggattcggcaaccgcgttgaagttcgtcgaatccttgcgattagccgcagacttgaactcatctgcacacgctgtagcaatataccaagccagccaggccatttatgatctatttgacaaagctgtggtgttgtacgagggacgccagatttatttcggccccgccagcaatgccaaggctttcttcgagcggcaaggatggttctgtcccccccgttcgacgaccggagatttcctcacatcggtggaccaccccatttga

SEQ ID NO: 173 - DNA, 255 bp, A.fumigatus
caaccacaggtgaaagaaaagctcaagaaattccaaaacttggacccctccaacgccgacttcatccccaccatcaaatccctgatggctgatctggcagagcacatcaaggaagaagaaacaaacgacctggtcaagctggaccaggcgctgtcccacgacgacagcgtcagtctctccaagagcttcgaccggaccaagattgtgcgccgacgcgctccctattacaccgcccggcaggaaggaaaccggggt

SEQ ID NO: 174 - DNA, 333 bp, A.fumigatus
caattctcccccatcgcagcaagaagcgtttctacctctcccatccaaatgatcggacgaatcaccgacacggtcaagcaggatcaccgcgagatcgaagcctgctaccagaggatcatcaacgcaaaggaccgtgatgagcagactcggtatcagaatctgtttacctgggagctagcccggcactccatcggcgaggaactagtcgtctatcctgcgtttgagaaacatctcccagatggaatttccatagcagagaaggacaggagggagcaccaaactgtattctgtcgcctggaaccaccagtgatcgaaactgacaaccacaggtga

SEQ ID NO: 175 - DNA, 207 bp, A.fumigatus
aaaattttccgggccttgatcccttccagttttaggtccctcttttccctcaagggaccggttcaaaagtctcttgtgaagccgaaccaaggctttgggcaaatcatcccctttacgcccacggctgttggtaagctttctcaaagattttctgggttgtcgggggtcgaaaaacctcctgttccctttgaaggaaggacctattga

SEQ ID NO: 176 - DNA, 216 bp, A.fumigatus
tccaccttatgtacgcctggtgagcaaaccactcatgcagccatgccaaagttcctaacctctcagttgaccttcctgattgcgtctagcatcttctcctatgcaggccttcgctatggcgaaaaaatcgaggccaactggagccacaaaattttcgccaataggagacttcccgctaatgagcgactcttcggaaacctccacttgaccatttag

SEQ ID NO: 177 - DNA, 240 bp, A.fumigatus
  unsure (127): Identity of nucleotide sequences at the above locations are unknown.
cgatatacgatgcatatgcagcccagatgggcgatctgcattcttaacatgtcataccctcatttaacggttaattctcaattcaattcccctttcaacatgtttgataaaggttgtctgtatgtanggcaacggtggcgtttggttctgacgagaatcgaagctgcctttcgcatcattgaatggctaggcaaaaaatacccgtatgcaaacactggcaacattctgtctgaaacctga

SEQ ID NO: 178 - DNA, 642 bp, A.fumigatus
gtacaccatgctcctgttcatctggatgcttgttgtctgattatgatctggagttttttccacaatatggcgcctttgtcgcctatcctgacagacttcttcgcctctcatcgtacacattattggctcatcacgcaagaaccagtcctgtgctgcacaatcctgatgatctcctcgaggtaccataccctaccagggccgtccggtgccacgcgcggattctttatccacaacaggttatggcagcactgccagcacctcattctacggatcatgcttggacaggagaagttttccaaagcaaagacaaggcatttgggaacggtcgaggctcttctacttctatcagagtggtacccgcgggcgttgcattttccacccgagaatgacggatgggattcagatttgatgttgacggcacccagcgagagagacccgccccccgtgacagaagagagccccatgcaagacccgtggagagaagacgttgtcgagccgacgagacgatcggatcgcatgggctggatgttggtaagctcttgcttggctcttgcacatgagccttgtgtgttttctaccagcaatcgatcggatttgggagaccatcgaattgtaaagccggatgttaaagcgtatgtctaa

SEQ ID NO: 179 - DNA, 561 bp, A.fumigatus
gcggctccgttgccggatgtgattgtcatgcagggagagatccccgttgacacggtggtgggcattctgcgggatattagggtgtggaaggcgaataatcgagcgcaggggaagaagggaatcgaggctggtccggatgtcatatataaccctgcgccggcgccgccgggtggtttgcctgaggatgtgtacactgccgttgaccatatcattatgaacgagacggaggcggagctaatgagcccgtctgaggagcacttgctccaggttgttcccggtgtggagaaggagagcagaaacgagaaggttgcgcggtatttccaccagctgggcgtgacgtatgtgctcatcacgctggggtccaagggtgtttggtatagtgcgacggacgcggggacgtctggtcctgcggatggagtcaatcggtttacgaagcagattccggccgcgaaagtcagcaaggtgctggataccacggcggccggggatacttttgttggtgcatatgccgtggaagtggcacgctgtcttcaccacggggctggcaggatccgcgcttag

SEQ ID NO: 180 - DNA, 342 bp, A.fumigatus
atttgcacttcactccttatctacttggcactagttattaccatgcgcaaaacattttctctgtttaagaagcaaagacggatgccgtcttatacttctaataaaccaacagtcgagcccaactggacattccagatggctctcaatgcaaacgaagagtggtttcgctatacaagaagccggtttctatccaaccaaactcacgagatggcgatccgttatgtcaaattcaatatggacgaattggtaaaacatgctgctgaatctgtcggcctttcttctgcgcaatgcgtgccggttgagaaaattcccgaagggaatttcaacaaaaacctccctctt

SEQ ID NO: 181 - DNA, 246 bp, A.fumigatus
  unsure (159),(160),(171),(172),(188): Identity of nucleotide sequences at the above locations are unknown.
gacattataccgctgatgtcctttagaaaccgcggccgctggcagtttatcgtcttccatagaagccatattttcttcgatttacggtactacagccacaccctcaacctcgagcactcccagttcctctccaacatccgactgttgggggcgagacgnnctctgcagtannccaccaaccgtcccanttttgggggggggggaagaggggtttttccaaatataaaaaccggcggcgggaaataa

SEQ ID NO: 182 - DNA, 213 bp, A.fumigatus
  unsure (99),(185): Identity of nucleotide sequences at the above locations are unknown.
atattactatcttctgtacacttcctgtgtattaggccttacttaaatccctgggactccctgctcaccaacgcactcttagacagggaagctactatnaaggatatagctatgaataattctgatatctactttaactatgctctaaacatggtacattggctgcacaccaacaggttactaanggaaaacaattgtgtaaaacacagggca

SEQ ID NO: 183 - DNA, 618 bp, A.fumigatus
  unsure (1): Identity of nucleotide sequences at the above locations are unknown.
ngcgccttccaggagatggatgccatctctttcctcacgccacacaccaagttcgcagtgcgaccgccgtctctcgcgttcgtcgccggcgccgtcaaaaacgcataccggacatgctggtacggacgtcctggtccgaccttcgtcgacctccctgccgatctaatccagggcaaatcagcacctggcttccacttaccgcagccagaggaaatcctcgtcccgtcgcctcccaaggcaagcggggaccccgcaatgattttgaaggcggcgcaattgctcaaggcagctcgtgcgccgttactgattatcggcaagggggccgcgtatgcaagggccgagggcgggatccgcaagctagtcgagcagactcagattccgttcctcccgaccccgatggggaaaggggtagtacccgactcacatcctctcaatgtgtcgagcgcgcggagcgcggcgttgaagcacgcggacgtggtgctggtgcttggggcgcggctgaactggatcctgcattttggcgagccgcccaagtggtcttcccgggcgaagatcatccaggttgatatctgcgccgagggtcttcaccacggggctggaaggatccgcggtggcgct

SEQ ID NO: 184 - DNA, 222 bp, A.fumigatus
gtctataacttccttctatttattagttttaaatatatacatactaattattctgtctttattaaatatagtattattatactactctatatagataatatccttatacttttaaattctaataatcttattaacaacttccttaagcagctaggaaaattatttaaatatactaataatagcaaggtttctgtctacctagggattaatatactatattaa

SEQ ID NO: 185 - DNA, 273 bp, A.fumigatus
  unsure (212): Identity of nucleotide sequences at the above locations are unknown.
agtaaacacctcttcggagtctttacgcaggccaagaatgcgtatcgtgaacgcaaggctcagattcaatcggagcgcaacgccaagattgccgaaagggaagctctgagggctttgcaaaactatcacatcgatgatgcaccgccatcagtcgctccctctcgcagaagcaggagcacacattcgcgacaccatcgacaccggcgcgcccnctcgcactatgaacaggacctgcacttggtggcctcgcagacggagtcctactacgccagt

SEQ ID NO: 186 - DNA, 315 bp, A.fumigatus
actactatcgctgtggtgaaagattatcctcgtccacttgttctccgacgtttggctggttccaagcaacccaacatccgacctccacactccgaggcagttgacaacgctatcggtgctgtttctatggggccacgctgtgcctcaggagaccctacatatttgtccgcgctttcaggcaccgcttcatacgctagttgtcggtcgaaaattaacaactcaacgccgtacaggacgactctgtcgcctggcgacccccttgccccttctcgtctgtacctcgttggtggatccctgcatgtgtttttcctttag

SEQ ID NO: 187 - DNA, 267 bp, A.fumigatus
  unsure (92): Identity of nucleotide sequences at the above locations are unknown.
gcctacacccacttcaatgcctacatcagcggcgtgcctttgaataatgccctcctccaccttacctctgcccctgcccctgcccatggccntgcttccttccccctcttatctcctccttcttgtcccccctctggtcttgcccagtctatatacacaactattactagaagtcccccagctaggaataatgctgctacaaagaaaatatatagtaatactaagactaataggttagctacaaagctgtcacctcctgataactaa

SEQ ID NO: 188 - DNA, 183 bp, A.fumigatus
  unsure (183): Identity of nucleotide sequences at the above locations are unknown.
ggagttgatgatcggccagatgcaaggtttgttttaggcttctcgctggctgttggccgcgttctacagctgacagtatgttctgcagggaaatatcaactccaggtcctccccgaagcgggccatttcattcaagaggatatgccagcgaagacggcccagatcttggtggacttctataan

SEQ ID NO: 189 - DNA, 285 bp, A.fumigatus
aagctaacatatcgctgtagcacacgctcccgaacaatccgaaacagagcctctgccagagtctccgtcccatccctcctatacaaagaagaaacgccgtcagaccccgcaaaaccatgggtctggcgaaccgacctctccgccacgaagcccttctgggaagactggttcatcggcctcagtcggaagttcctggaggcgcgcggcggtaaactcctcctgctggccggcacagatcgactggataaggagttgatgatcggccagatgcaaggtttgttttag

SEQ ID NO: 190 - DNA, 873 bp, A.fumigatus
  unsure (56),(57),(58),(75),(246),(347),(864),(865),(866),(867),(868),(869),(870),(872),(873): Identity of nucleotide sequences at the above locations are unknown.
agtgtttccaagggtgtacccatccatcaaccatactgccatgctgtttcggcgcnnngatcgtctcttcttccnttcaagctggggttcgtactgtctaattttggagaaatcggtcagaactcgcaaatattgattgattacttcgtcggcaccggtgcccttccatgtcttccggatgcgaatcctgccgaatggatgctggatgtgatcggtgccgctcccggatcacacaccagcatccantggttcgagacctggcgtcgatcccccgaatatgcacgagtccaagagcaccttgctgaactgaaacacgaacgtcgccaccaaacaaacctgttccgcantacatccggccaaaagcgcgaagacaaagacagctaccgcgagttcgctgctcctttctgggcccagctttaccaagtccaagtacgagtcttccagcaaatctggcggtcacccacctacatcaactccaagaccgctctctgcgtgttatccgctctcttcgtcggcttctcccttttccatacacccaacaccatccaaggcctccagaatcaaatgttcggcatcttcatgctacttaccctgttcggccagcttatccaacaaatcatgccgcatttcgtcgcccagcgcgcgctgtatgaagtccgcgaccgacctgcaaaaacctactcttggaaagccttcctcatcgccaacatcgttgttgaactcccctggaactcgctcatgtccgtccttatgttcctgtgctggtactacccgattggtctttaccgcaatgccgaaccaactgatgcggtgcacttgcgggtcttccccaaggggccgaagatccgcgcaagcgttaaaaannnnnnntnn

SEQ ID NO: 191 - DNA, 570 bp, A.fumigatus
  unsure (37),(554),(555),(556),(557),(558),(559),(560),(562),(563),(565),(566),(569),(570): Identity of nucleotide sequences at the above locations are unknown.
aacacgaacgtcgccaccaaacaaacctgttccgcantacatccggccaaaagcgcgaagacaaagacagctaccgcgagttcgctgctcctttctgggcccagctttaccaagtccaagtacgagtcttccagcaaatctggcggtcacccacctacatcaactccaagaccgctctctgcgtgttatccgctctcttcgtcggcttctcccttttccatacacccaacaccatccaaggcctccagaatcaaatgttcggcatcttcatgctacttaccctgttcggccagcttatccaacaaatcatgccgcatttcgtcgcccagcgcgcgctgtatgaagtccgcgaccgacctgcaaaaacctactcttggaaagccttcctcatcgccaacatcgttgttgaactcccctggaactcgctcatgtccgtccttatgttcctgtgctggtactacccgattggtctttaccgcaatgccgaaccaactgatgcggtgcacttgcgggtcttccccaaggggccgaagatccgcgcaagcgttaaaaannnnnnntnntnnttnn

SEQ ID NO: 192 - DNA, 201 bp, A.fumigatus
  unsure (190): Identity of nucleotide sequences at the above locations are unknown.
gctgacccacttcaaaccatcaggtccggcacatcggtcgaacacaacgtcctctacgagtaccagttcgtctcaacccagaatgtgtacatgggccagatccaaacagagaccgcgtgcgtcttccaccacttcctcgaacacaatgtcttcaccacggggctggaaggatccgcggggcgtcaatccncggtggtcaat

SEQ ID NO: 193 - DNA, 225 bp, A.fumigatus
aaccttgcgtcgccgtccgatccgtctggaatgtgggaggtgcatgcgcgcgttggagggttcgcagggtcccagcagacgaccagggagtgcgccaaaacacccgagactgtaatcacagaggccgatgagaagtgcattgtcgcttacatgcttatgcatgtcaccccgtctgcttcaaacctctacctggagaacacctggctctgggtttcggatcagtaa

SEQ ID NO: 194 - DNA, 555 bp, A.fumigatus
  unsure (552): Identity of nucleotide sequences at the above locations are unknown.
gccccgaagccctgggatgacgaccagcggctcaaggcggacgtggagctgcagcagtcgctgctcaaaaccgatgcgaacctacagcgcatgtttatggaatcgctgcacaccaaaccagataccctgtctgcctcgcagttcatgtcgcagttctggtcgacgcggctgcacctgctgcgggcccacgcgatcgagcggtcgcagacgcgcggctcgtacaatgtgctgtcctcgctgaagccgcgggtcgaggacaacgtgaccaagctcaatatcagcaaggagcagatccagctcattttcagccagcatccgcttgtgaagagggtatacgatgagaatgtgccgaagctgagcgagcagcagttctggtcgcgattctttcagagtcggctgttcaaaaaactgcgtggcgagcgcatctccgagaacgatgcgacagatgccattctcgacaaatatctgcgcgaggacgagcaggcgaatctcgagcgggaggcgcctgctcggtcttacaccgacggggctcgaaggacacgcgctaaaggngaa

SEQ ID NO: 195 - DNA, 309 bp, A.fumigatus
atcctatcaagaaatagcacgagtggccaagtggctaaggcgtcgcacttgtatctgcccgcttgggttaagatcgctatgcgaagatcgggggttcaattcccctcttgtgcatttcttttttcaactaaagttcttatttccaaggctgccttttcatcaatctcaaattatttttgctacctcttggacttttgtcgtttaagtctcgttgaggactttctaaaatattttattattttctttctgttctgtggtaatgtgtatatttgtgccggtcttacctcttatatattgttgaacttctga

SEQ ID NO: 196 - DNA, 228 bp, A.fumigatus
tctattgtatttgtgcaagcggtagagtcattcatacacttgccagatccaccccctttgtcaaacaccgccaccaccgcaaaatatttcttctacctctttaaccaaggctcatctaagtttcaacataagtacatccagaatgaccagcaagtatttatttatgtgacaagactgataattaatgttggtcttcaccacggggatggaaggatccgcggtggcgta

SEQ ID NO: 197 - DNA, 189 bp, A.fumigatus
aagggcgacgttatcatgaagtacactgccgacgaggccagaagtctcaaggcctacggcgagttgcccgagcacgccaagatcaacgaaaccgatacctatggccacgaaggctttgaggacaacgtcgagttcgacgaggaccgcgagtctgaagacgagaaggagatcgatgtcgacgagctctaa

SEQ ID NO: 198 - DNA, 882 bp, A.fumigatus
  unsure (228): Identity of nucleotide sequences at the above locations are unknown.
gtacggccatggccgggatctaaaccatttgtgttttaccgtcgggcaaaaatgggggccttttggttcccgcttaaaagggaggggttggtccggattcccacattgctttttgggtcggaacccggcggttggccctttgcaaaagggcttgaaaccgggtctatttggtcccttattctcgatcccccggggaggttctccgggacggccgtcatcgtcgagttntgggtgacggtcaccaatgcgatctggattacggtgttcgggttgctgatgctgccgaccgcactgctgtttgtacgcgtgtacggggagctcgagttcgggttctcattgatcaagatcatgctcgtcatcggcatcaatatcatggcgctggtgatcacctgcggaggcgggccggacgggcagcgcatcggattcagatactggcgggatcccggcccgttcgtgcagtacctggacgtcccgggctcgtggggccagttcctggggttctggacgacgctcaataacgcgctgtatgcgtattcggggatggagaacatcactgtcgcggcggcggagacccggtatccgcggcagtcgatccccaaagcggcgcgacggatctttgcccgtgtgtttctgttttatatcctgtccatcttcatggttggcatggtggtcccctcgaatgaccccaccctgcttcggtctaccggcaatgcgtcgcagtcgccttttgtcattgccgcgcggcgcgcaggcattcaggccgtcccatctattatcaacgcggcggtgttgacgtcggcctggtccgcggggaattccaacatgctgggaggctcacgcattctcttcgggctggccatgcacgtcttcacgcggggctaa

SEQ ID NO: 199 - DNA, 306 bp, A.fumigatus
  unsure (96),(185): Identity of nucleotide sequences at the above locations are unknown.
tctccatgtgattcctttagccctcagaaaccatatctgtttagggttgatgtccaatacctcggcgttttgtccgaatgttcctccttggctaanagggtgttttatgaaaagaagtatataactctacccatctatttgtctcttagatacctgactcttgtcaaattttcagaacaagctgntatagattgtccaaagtacgcggagaacctaccctcctggtctagaaccccagtttcttgtagatactccccgaaaatgaatgccaagactcatctccgatcctctgccttgaagcgttaa

SEQ ID NO: 200 - DNA, 225 bp, A.fumigatus
tccccagcagtgctgatcgtatggtgggcatggaccatgctgaagtacgttacttcaccaggtatgagactaattattatccctgatcagtatgatattttgtgtctgaccttgttcacagttatgatcatcatggtaaattctacctgttatccgcaaaacgttgaagggtatgtgaagctaacacaaacccgtgctaaggcattcatgaggagatgcttgtaa

SEQ ID NO: 201 - DNA, 207 bp, A.fumigatus
  unsure (11),(12),(13),(14),(15),(16),(17),(18),(19),(20),(21),(22),(23),(24),(25),(26),(27),(28),(29),(30),(31),(32),(33),(34),(35),(36),(37): Identity of nucleotide sequences at the above locations are unknown.
gagcctttgannnnnnnnnnnnnnnnnnnnnnnnnnngaagacagtatcagaagtattacgtggatcgagtattagtcatggacgatcatacaattaactatcatgaggctgtgagctactccacttttctagagacactattattattatacataagcatgacgtcggtcagagctatgccacaatctcccttgagaccacactaa

SEQ ID NO: 202 - DNA, 456 bp, A.fumigatus
aaggaaaacaaaaggaaaataaatggaaaaataaatggaaaaataaatggaaaaataaatggaaaaataaatggaaaaataaatggaaaaataaatggaaaaataactggaaaaataaatggaaaaataaatggaaaaataaatggaaaaataaatggaaaaataaatggaaaaataaatggaaaaataaatggaaaaataaatggaaaaataaatggaaaaataaatggaaaaataaatggaaaaataaatggaaaaataaatggaaaaataaatggaaaaataaatggaaaaataaatggaaaaacgaaaacagggaataaaggagagaaaccctaccaagccttcctgcgaacggaaccatctgttatccgagttgaatatgtaaatctgaccgttctctttcaaccgaaccatgagcgagacatccacattacactcctggcacaattcaaa

SEQ ID NO: 203 - DNA, 573 bp, A.fumigatus
  unsure (546),(551),(563),(572): Identity of nucleotide sequences at the above locations are unknown.
tttgaattgtgccaggagtgtaatgtggatgtctcgctcatggttcggttgaaagagaacggtcagatttacatattcaactcggataacagatggttccgttcgcaggaaggcttggtagggtttctctcctttattccctgttttcgtttttccatttatttttccatttatttttccatttatttttccatttatttttccatttatttttccatttatttttccatttatttttccatttatttttccatttatttttccatttatttttccatttatttttccatttatttttccatttatttttccatttatttttccatttatttttccatttatttttccagttatttttccatttatttttccatttatttttccatttatttttccatttatttttccatttatttttccatttatttttccatttattttccttttgttttccttttattttccttttaccccacaccccgtcctttttattctttccttttccttttgctcaatttcggggctatactaatggccgcaagtatntgcantatcctgtacgncgggcgatna

SEQ ID NO: 204 - DNA, 411 bp, A.fumigatus
ggtttctctcctttattccctgttttcgtttttccatttatttttccatttatttttccatttatttttccatttatttttccatttatttttccatttatttttccatttatttttccatttatttttccatttatttttccatttatttttccatttatttttccatttatttttccatttatttttccatttatttttccatttatttttccatttatttttccagttatttttccatttatttttccatttatttttccatttatttttccatttatttttccatttatttttccatttatttttccatttattttccttttgttttccttttattttccttttaccccacaccccgtcctttttattctttccttttccttttgctcaatttcggggctatactaa

SEQ ID NO: 205 - DNA, 528 bp, A.fumigatus
  unsure (457),(462),(474),(483),(491),(492),(496),(506): Identity of nucleotide sequences at the above locations are unknown.
cagatggttccgttcgcaggaaggcttggtagggtttctctcctttattccctgttttcgtttttccatttatttttccatttatttttccatttatttttccatttatttttccatttatttttccatttatttttccatttatttttccatttatttttccatttatttttccatttatttttccatttatttttccatttatttttccatttatttttccatttatttttccatttatttttccatttatttttccagttatttttccatttatttttccatttatttttccatttatttttccatttatttttccatttatttttccatttatttttccatttattttccttttgttttccttttattttccttttaccccacaccccgtcctttttattctttccttttccttttgctcaatttcggggctatactaatggccgcaagtatntgcantatcctgtacgncgggcgatnatgtgtcnngtantagccggccngagcaatatatacggccgaaga

SEQ ID NO: 206 - DNA, 486 bp, A.fumigatus
cacctcgtgtttgatcagttagctgatgagttttcgtttcaggatctgtttaatcggatcggacctgtctcaaatctatctctcgtctatgaccgggctggacgctccgaaggcgttgcctatgttacctacaaccgtgcgaacgatgcgagaacggcgatagcagaattcgatggcgcaaatgccaaaggacagcctatccgtttgacactagtcgcctctggccccggaagacggggccgcaacccatttgataatgtcgaacggcccaagggaagtcttttcgatcgcatcgagcggcctcgcgatgcccgaagcttaagccctggaagtgagaatggtgatgtggaaggcggagcacgtcgtcgccggggccgtcgctctggaggaggcgcaggccatcgccgtagcgatgtctcgaaacctgcccccgagcacattgaccggtacgtgcctggacagcgatcaccagtcagacgaagcacc

SEQ ID NO: 207 - DNA, 462 bp, A.fumigatus
gttcaactcaagcggggatccgtccagccccgtggtgaagactgtttgtctccagcgcatgttccagcaatattggcgaagtccgtcgtacatatactcaaaggctgcaacgagtatcattccggtgagtggcattcctccccgagacacgatggagtcggcacgtctgactatccagcaccccagcctctgttcattggcttcacattttggcgggagccgaccagtttgcaaggcctgcagaaccaaatgttcgccatcttcatgctgctggtcatcttccccaacctggttcaacagatgatgccgtactttgtaactcagcgagccttgtatgaagtgcgcgaacgaccatccaaggcgtactcgtggaaagcgtttatgcttgcgagcatcctggtcgaattgccctggaacattctaatggccgtgccagcatatttctgctggtattacccaatc

SEQ ID NO: 208 - DNA, 303 bp, A.fumigatus
cttcgatcacatcactgtctcagacccccacaagattgcgggaagttcgagaaccaagtcattgaagctcataatgtcgctattcacattgcaaacatcaagcaactgcattggcgcttaacctgcgatactccgtacttatcgttgctatttcgggttaccgatacagtgttttctgatctgttctccgcgactacgacctatatttatggcatcgagtacggaatgcgcctctacctgcatcagatagcgagcgtcttcaccacgggggtcgaaggctccgcgctaagcgttatggccatc

SEQ ID NO: 209 - DNA, 450 bp, A.fumigatus
agacttgcgtctcccttccttcaagggttcgactccttccgctcatggcgcagagatgttcaccggcgattgatggagtggcaggaaagcgcgcccactcgtagagaaacaggcgtgcagttttcggtggaatttcttgaacttaattactggcaggccgtcatcatgctctaccagcagagcttgacagttccggcggaattagccgcagagctgacaccggcagaggatgtatccagcccgtcattctcgaatgtggacgaaaccgaagatgaagatgaaatatactacaaggttgcagaggcagggcagaaagttatccgtatatatcgccagatgcaccgtgtccgactagtgaactatacttatcttgcaacacatcatatattcatggcgggtatgacaaagtccctcactcgataccatgacgctgcttacactctcctaggt

SEQ ID NO: 210 - DNA, 384 bp, A.fumigatus
tgggatctagattctattctctggcccatcctgcattatcagtctggtgccgacttcaacgaggattactggaaggcctaccagtgcgtcaatgagatcttcgcagatacggtcgccaaccaagcgcaagacggcgatctgatctgggtgcacgactaccatctcctgcttctccctgcgctcctccgtgagcgtctcaagagccaggggaagacgtgtcggattgggtttactctgcacactcccttcccggcaggggacttctggcgctccctgccggtcgagaaggaactgctcaagggtgttcttgcgtgcgacgtgattggcttccatacggaagagtacaagcggaattttaccgaggcgtgcgaacagtgtgtgtag

SEQ ID NO: 211 - DNA, 252 bp, A.fumigatus
  unsure (4),(23): Identity of nucleotide sequences at the above locations are unknown.
agtnaagctctccaacggcggantggtgattgccctgtccggcttgaaccactcgacgacctcaaatggttcggctggccgggaatcaacatcccggatcccgaagagcagaagaaggccgcagacgcgctggaagaaaagggcgcgaaggggatctttctggaggagaagctgggccatgcgcattacaatgggttctcgagtccgttacccaaacccgactttggcagaccccgagctgatgggatctag

SEQ ID NO: 212 - DNA, 465 bp, A.fumigatus
  unsure (459),(460): Identity of nucleotide sequences at the above locations are unknown.
gcgtctcaagagccaggggaagacgtgtcggattgggtttactctgcacactcccttcccggcaggggacttctggcgctccctgccggtcgagaaggaactgctcaagggtgttcttgcgtgcgacgtgattggcttccatacggaagagtacaagcggaattttaccgaggcgtgcgaacagtgtgtgtaggtaccaacgcttgcaatccggattgggttgcgctgacagtgaacaggggcgcccaagcgacagacagcaatgggatcacattcgacgatcactgtgctcatgtcggtgtctttgtcgtgggcattgatccccagaagtttgacgatgcgttgagagacgacgcggtcatcaaacggattcaggaattggatgagcagtacagggacaagattgtcattgccggcgtggacagactgtcaacagcctccaatgaaagacttcaaatnngacgc

SEQ ID NO: 213 - DNA, 333 bp, A.fumigatus
tggcgcggctccttccagccccgtggtgaagacggacctgcgtatttcttcgcaatggtggaacacctagttgccagtgccactgccctgggcctatccaaggagcaggccacaagactggcagctcagacctgcctcggtgcgggcaagatgctggtcgagtcgtcggaggaaccggctcagttgcgcaagaatgtgacgagtccaaacgggacaacacacgccgccctccagacatttgagtctctgaatttcaaggaaattgttgacaaggcagtacaggccgccacgtctcgtgcggcggagctcggagagacgcttggaaagctctag

SEQ ID NO: 214 - DNA, 204 bp, A.fumigatus
cggagaccgcggactctacagagtatacagagtatacagacgtcaatccacagtaaacactgctccttatcaccggtactcactaatacaaacattgaattaggtactactgcaagcaaaacaactagaacaagcattaccatatccctccccctcaccactcccccgtcccatttcatctccatagaacaagtttctccatga

SEQ ID NO: 215 - DNA, 519 bp, A.fumigatus
  unsure (281): Identity of nucleotide sequences at the above locations are unknown.
gatagaaccagccgcggatccttccagccccgtggtgaagactttgatggataccatcacacctctgctggtgaccccatagttttgccgaatgtagtttgctgccatgagattgatgatggaatactgtggaagcacaccaactatcggacacagaatgccgtcgtgacaaggtcgcgcatccttgtgttgcagacgatcatcacagtcgggaactacgagtacatctttgcatttcagttcactcaagatgcgtcggtcacctacgaggtccgcgcaanaggcattctatccacagcacccattaacttgggccagacagtgccatatggaaccatcgtggcccccggggtcatggccccttaccatcaacacctcttttctctgcgaatagacccagctatcgatgggcacatgaactctctgatggtggaggaatcccacgcaatgccccttaacgaccccagcgttcataaccctttttggagtgggatacacaactgggaaccacatcgttga

SEQ ID NO: 216 - DNA, 408 bp, A.fumigatus
  unsure (2): Identity of nucleotide sequences at the above locations are unknown.
tnaagtgaggtggtgggcctcgacccctcttgtcttgcgggttctttctttttccctttcggttgtattgtccgttttctgttcgcctcctgcttgttttgttgttttcgaggtcgtcttctcttttttttccttttggttgtcttcctctttctttttttctctttctggttttgtcttcctgtcgttcttttcgttgctttgttgctcccctgtctccctgcctggttgttcccgttctccgtctctgctcgttttttcgccggttcctgcctttgcttttcccctttttgttcttcttcctgcctttttgttttcttcttcttgtcctctcttggtcttgtcttttttcttctcggcttcctttgtttccttcttgtcttagtgtttgggatattggggccgtag

SEQ ID NO: 217 - DNA, 498 bp, A.fumigatus
  unsure (493): Identity of nucleotide sequences at the above locations are unknown.
acgaaaaagataatcaaaaagacaaccagaggaaacaaagagcaaaggaaaaaaaggggcagacaaacgcaacaaaggaaacaccactacggccccaatatcccaaacactaagacaagaaggaaacaaaggaagccgagaagaaaaaagacaagaccaagagaggacaagaagaagaaaacaaaaaggcaggaagaagaacaaaaaggggaaaagcaaaggcaggaaccggcgaaaaaacgagcagagacggagaacgggaacaaccaggcagggagacaggggagcaacaaagcaacgaaaagaacgacaggaagacaaaaccagaaagagaaaaaaagaaagaggaagacaaccaaaaggaaaaaaaagagaagacgacctcgaaaacaacaaaacaagcaggaggcgaacagaaaacggacaatacaaccgaaagggaaaaagaaagaacccgcaagacaagaggggtcgaggcccaccacctcacttnactaa

SEQ ID NO: 218 - DNA, 489 bp, A.fumigatus
  unsure (480): Identity of nucleotide sequences at the above locations are unknown.
tcaaaaagacaaccagaggaaacaaagagcaaaggaaaaaaaggggcagacaaacgcaacaaaggaaacaccactacggccccaatatcccaaacactaagacaagaaggaaacaaaggaagccgagaagaaaaaagacaagaccaagagaggacaagaagaagaaaacaaaaaggcaggaagaagaacaaaaaggggaaaagcaaaggcaggaaccggcgaaaaaacgagcagagacggagaacgggaacaaccaggcagggagacaggggagcaacaaagcaacgaaaagaacgacaggaagacaaaaccagaaagagaaaaaaagaaagaggaagacaaccaaaaggaaaaaaaagagaagacgacctcgaaaacaacaaaacaagcaggaggcgaacagaaaacggacaatacaaccgaaagggaaaaagaaagaacccgcaagacaagaggggtcgaggcccaccacctcacttnactaagtga

SEQ ID NO: 219 - DNA, 654 bp, A.fumigatus
  unsure (568),(569),(574),(575),(581),(583),(584): Identity of nucleotide sequences at the above locations are unknown.
aatgatattttgatggagtatactgagttttggaacgaaccagcgacgtatgacctcggtgctatccattcaatcatcaactcaagtcaagtgctccatgtgtcgtttagtcctgggcccccagatccttttcccgccatactgcccatgattggtacgatggggtcatttgactatccatcagctggactcgatgagcctctagactgctatctacatggatacgtcagttcacgaatcatgaatctagcgagaaaagcggaaggagacggattgcctgtctgcatcgctgcgagtagggtagacggattaatcctgtctcttacacccaactcccatagctacaactaccgctccgctatccttcatggctatgctagaccagtcacggacgaagcagataaactctgggcgatgaaactcattactaattcagtgctgccggatcgctgggaccatacccgtgttaccccagacaatgccgaaatgtcttctactgttattcttaaagtcaaagttgtcgacggcagtggcaagattagagatggtggtgtctccgacgagagannggacnngaaccncnncgatgtgaccactagggtctggaacggtgttgtgcctgttctagagttaattgggagaccctgttcctag

SEQ ID NO: 220 - DNA, 192 bp, A.fumigatus
  unsure (41),(42),(44),(50),(51),(56),(57): Identity of nucleotide sequences at the above locations are unknown.
aacaggcacaacaccgttccagaccctagtggtcacatcgnngnggttcnngtccnntctctcgtcggagacaccaccatctctaatcttgccactgccgtcgacaactttgactttaagaataacagtagaagacatttcggcattgtctggggtaacacgggtatggtcccagcgatccggcagcactga

SEQ ID NO: 221 - DNA, 612 bp, A.fumigatus
ggcccccctacccctgcgggctcagctggcccagaccgcccaggcctgcaagcgcgcagttcagcggtgccgacgcagagcctttcgacaacagatcaccgagatcacagacatggaagacgtctggcgcgccgtccggtggacaaagaatcggggcccataccaggcctacacccccctcttcgggatccccgtactggcttagtagtgtacggggttagggagaaagctgacctctttgcctgccaattcttcccaccgcccccgcaggccagcctggatgacctccggggatatgactatcccgagccacttagcgtaccagaattcaaggagcatgaggtgctctgcgcccttcgctccgtcaaacctgataaggcacccggccctgacagaatcactaaccgggtgctgcaagctgcgggccacgtgctggtgcaatgcctgacaggcctgtataaccaatgtatccggttggaatactgcccgaacaattccgggaatgccgcactaaccccctccgcaagccccgaaagccggatttactccgtggccagagggttccgaaccattgccctgctgaacccccaaaccaacttcttgaaggcctga

SEQ ID NO: 222 - DNA, 318 bp, A.fumigatus
  unsure (316): Identity of nucleotide sequences at the above locations are unknown.
ctagatagagtctcatcgcgtctgttaacaagcacacaacagctgtaccaaaccttctatggcctgttcgtctgcccctggtacagctactcccagatcatgatctcggaggtcacgccgcgtggccacgagtttctgtttttcagcttgttcagcatcatcggcaagacgtcctcgttcattgggccgctggtctccagtgcgatcatcgatgcctcgccttcggggaatgtctcgacgccgttttatttcctgttcgctttgagcgtgggtcttcacgcgggttgccgagggtcgctctatgggccatcaaagnca

SEQ ID NO: 223 - DNA, 201 bp, A.fumigatus
cctctccaggcacttggcatttacgccttttggttcatccagaggcgctacaacctcggcacgaaggccatgttcaacgctatcgcagtgggaatcatcctgcttgacggctgggggatgatcggcatctgggcgcagcgattcggtttccaccatgcttgggagatttgggtgagtgttcagcccaacgtagctagctag

SEQ ID NO: 224 - DNA, 753 bp, A.fumigatus
atcagatatctgttgcttatttttctgtcctcaggatgggtttcttatgcggcctcgtccatatgttctgcgctcggtgagtacaggatgatgccagatgcagacacagcctgctgtcttatcaacggcaaaaatgggtacgtccggggaaataattcctgggttctcggacgcatcatgcgagattatgagtactggatgggggagcccgtccgtgagaaaacagagtccctcatccaggctcgttgggactttgaccggcagcgccaggagagagaagtccccgggtcggggagccgagtccctcgtccttcgcaagccggattagtcgtcagtctgtggcagccaagtacaacgaagccatctggagagcccggccacgatctgctccattggtcgggtatcattgtcactgtgattcaactaggaatagccgccgtaccactgggcttgtccggagattggggcattctgatgatcactgcggcagccaccattctgtgctacgtcaccggggcgctggggcagtggaaggtcgagaagtgggcctgtcgccgtctggacacgcgagagaagaagaactttgtcttgacgcgcggaaacggggctcagcatgccattgcgatcatcagtaatgcccgcggcctggatctggaagaccttgccacagggttttccaagatcgactctccgtccatcactctcttcgcgcagctggcaaccattattcaccccgggctggaaggaccgcga

SEQ ID NO: 225 - DNA, 222 bp, A.fumigatus
gttggtgagatagaggcgatcccagagaatatcgaacagggctgggatcgcgccgaggaccgcatcgagcagaagtgggacggtgcagttgacgacatcgaggagttcccggagaatgcggcggaatggactggacgaaaagtcggcgaggtggaacaattcggcgactatataggcaatgcgtatgatgagggaagggccgagggtcgcgatgattggtga

SEQ ID NO: 226 - DNA, 204 bp, A.fumigatus
gctggcgggcctggctccaggttggtactatgcctgcattcaaacaaattgactatctctaacgatataggcccgttcgctggacttctactcgcagactatggcgcgtcagtgctgcgagttgatcgaccgaaatccatctccacagaccagttgactcgccggaaaacgtccatcacgctggacctgcgagacatcttcacc

SEQ ID NO: 227 - DNA, 204 bp, A.fumigatus
gcaaccgtttctccgcagccgatgcccggggccacgtgcggggaccaacaatgctgccagggaagctccagagcatatatacagttatgcagtgtgaatgtgatgattgctatacaacatttactgtttatcaacaagtacatcatgacttgcaatactgctatgcccgagatgtataaatcaccttgtcaaaacgcggtatga

SEQ ID NO: 228 - DNA, 390 bp, A.fumigatus
ttctcatctggatcctgcgccatgtcttccccgcgtcttcccactcctacaactacaacaactactactactacgacgacgaccgcctctacgtcctcctcttctttttcttctttctcatcatcatcatcatcctccgtcgctcgaaatcgtctcgcctccatctcctcacaaatcatgggttcctcaagcccatcagtcttctccacggccgtcgtgcccgccgctccagaagatcctctctttggtctggctcaagcttttcgtcaggatccctcagataaaaaggtcgatcttgtcattggcgcctacagagacaacaacgcaaagccttggattcttcctgtagtgaaaaaggtcattccccgtccgcatagtacagcatcatga

SEQ ID NO: 229 - DNA, 375 bp, A.fumigatus
gagagcgaaaacagaagatccagaacaggaaaaattcccgcattttgtgtttctattactcataccattcattgtcttacccgtcttttaattctcatctggatcctgcgccatgtcttccccgcgtcttcccactcctacaactacaacaactactactactacgacgacgaccgcctctacgtcctcctcttctttttcttctttctcatcatcatcatcatcctccgtcgctcgaaatcgtctcgcctccatctcctcacaaatcatgggttcctcaagcccatcagtcttctccacggccgtcgtgcccgccgctccagaagatcctctctttggtctggctcaagcttttcgtcaggatccctcagataa

SEQ ID NO: 230 - DNA, 420 bp, A.fumigatus
ggacgcggtacttccagcctcgtggtgaagaactgtatgttcggctgtggaaactacccaacctggcccaacctgctcgagtccatccgaaaggaatctgtctacaacgttcgtaggctgcgtcatcacccatccattgtcatctgggttggcaacaatgaagattaccaggttcaagagcaagcgggtctcacttacaactatgaggacaaggacccagaaaactggctcaagaccgatttccctgcccgttacatctatgagaagctcctcccagaggtggttcaagaatactctcctggtactttctatcaccctggtagcccttggggtgatgggaagaccacgtccgaccctaccgttggtgacatgcatcaatggaacggtatgttcattgcgtcccacttcactaatcattga

SEQ ID NO: 231 - DNA, 381 bp, A.fumigatus
ctcaaaatgcagacgcacatctacctcacacaggtcgttcaagcagagacaatgatgttcggataccggggatggcgccgccaatggggtgacgagagacactgtggtggtgctctcctctggcagttgaacgattgttggcctacgatctcctgggctatcgtagactatttcctacggcccaagcctgcgttctacgctgtggcacgagtgctgaaccctattgcggttggtgttcgtaaaaagcatcatgactggagcgtgacccacgcacagcctcccaagacgagcaagtttgacctctgggttgccaacagccgtccaccagagatcccaaggtacgtggagctccggttcctttccgtcaacactgggacttga

SEQ ID NO: 232 - DNA, 1137 bp, A.fumigatus
  unsure (701),(855),(856),(872),(879): Identity of nucleotide sequences at the above locations are unknown.
cttattataacaggttacgccgccgacgggtatgcccgggtgaacggaatcagtgcattgataacgacttttggcgttggtgagctgtcggcgatcaatgccattgctggtgcatactccgagttcgtacccattgtccatatcgttggccagccacacaccaggtctcagagggacggaatgctgcttcaccacactctgggcaatggggactacaatgtctttgcaagaatgaatgccggtgtctctacgactgtcggacgcctgaatgatacccacgaagtagcgacactcattgacaatgctatccgagaatgctggatccgaagccgaccagtctatatcactctgccgaccgatatggtcactaagaagattgagggagaacgactgaataccccgattgacctttctttgccagctaatgaccctgaaaaggaagactacgtggtggatgttgttctcaagtatcttcacgcagcccaaagaccggttatcttggtcgatgcttgcgccatccgtcacaaagtgctacaagaagttcatgatcttatggaggcctccggcctgccaactttcgttgcgccaatgggcaaaggagcagtcgacgaaacgcacaaaaactacggcggtgtttacgctggagacggctccaacactggtgtgcgagaacaggtggagtcttccgatctgattcttancataggcgcgatcaagtcggacttcaacacggctggtttcacctaccgcattggtcagttgaataccatcgatttccacagtacatacgtgcgagtgcgatactccgagtatccagacatcaacatgaaaggggtcttgagaaaggtcattcannaattggggcgtgtcanatgccancccggtgcacacctcaacaacaatttgcccgacgatgaaccgaattcgggggatcatccaatcacccacaaatggttctggcccaaaattggccaatggctgaaggaaaacgaactcgtcatcccagaaactgggcctggcaacttttggcatcctgggaaaacaaggtgccctgcaggttttcccgccaatcaatccaatttctctgggggtaccttgggtttctcccttgggagcttggccaggaagccgccactg

SEQ ID NO: 233 - DNA, 606 bp, A.fumigatus
  unsure (259),(266),(282),(283),(437): Identity of nucleotide sequences at the above locations are unknown.
cagtggcggcttcctggccaagctcccaagggagaaacccaaggtacccccagagaaattggattgattggcgggaaaacctgcagggcaccttgttttcccaggatgccaaaagttgccaggcccagtttctgggatgacgagttcgttttccttcagccattggccaattttgggccagaaccatttgtgggtgattggatgatcccccgaattcggttcatcgtcgggcaaattgttgttgaggtgtgcaccgggntggcatntgacacgccccaattnntgaatgacctttctcaagacccctttcatgttgatgtctggatactcggagtatcgcactcgcacgtatgtactgtggaaatcgatggtattcaactgaccaatgcggtaggtgaaaccagccgtgttgaagtccgacttgatcgcgcctatgntaagaatcagatcggaagactccacctgttctcgcacaccagtgttggagccgtctccagcgtaaacaccgccgtagtttttgtgcgtttcgtcgactgctcctttgcccattggcgcaacgaaagttggcaggccggaggcctccataagatcatgaacttcttgtag

SEQ ID NO: 234 - DNA, 783 bp, A.fumigatus
cattttgcaggtgtcttcggcctgcttcagcttgtggccttcgccgagtttgtccgcagcttcgttccaagcaagcagttccagagacttctgaccgccatgatcttcatcaccttcggtctcggtttgcttgggctagttgttctgactgtgacgggagtgatcgctccttggagcggccgattatactccttgtgggacactggctatgccaaaatccacattcccatcattgcgtcagtctcggaacaccagcccaccgcttggccagcgttcttcttcgatctgaacttcctgatctggcttttcccggcaggtgtctacatgtgcttccgtgacctcaaggacgagcatgttttcgtcattatctactcggtccttgcgagatacttcgccggtgttatggtccgactaatgctgaccttgacccctattgtgtgtgttgccgctgctctggcgctgtcgtccattctcgacacctatatggcgactaccctcccgacaccagcgtctgaagcgaaaacgaatgaagactcgtcttcaccacctcttcgctcagttcggaagcccaatgttggaatcacctctcatgtttctaagattatagtgacggcgtctgttgtcgtctacctgctcctgtttgttgcgcactgcacctgggttacatcgaatgcatattcttctccttccgttgtcttggctagtcggatgcctgacggaagccaatacatcattgacgattatcgtgattttcaccacgggctggacggtccgcgattgcat

SEQ ID NO: 235 - DNA, 288 bp, A.fumigatus
  unsure (67),(78): Identity of nucleotide sequences at the above locations are unknown.
ttcacattctttctatggatcaaggctgtcaaaaatgggtctatcatgtggggagcgctgaccgcantattttacggntacatggtgtcggcatggggtgggtatgttttcattacgaacctgatccccctgcacgttttgttccttctgtgcatgggtagatacagcactcgcatttacattagctataccacatggtatgcgctggggactttggttagcatgcagattccctttgttggaattttggcctatccgaaacagcgaccacatgtccgccttgggtag

SEQ ID NO: 236 - DNA, 243 bp, A.fumigatus
tattggaggaactccggcggttatccagcagtatgcgagatactcgtctacgttggagccaggattacagagtggctcttcgtcagggagcgcccgcagtcggttaggggcgtcaaagtctcctcccctacatcgcaaagcgacccctcgcagtctgcaatcttcccctactggtttacgaccagttgcgcctgccacgtcagctacgcgctctggaccatcgatgtctcctccagtttatga

SEQ ID NO: 237 - DNA, 429 bp, A.fumigatus
ctcagtccagctcctatccagtggcgaccagtcatgcctcgcgcgttggctgtccgcttaacctgccaggcctgcacgcgccgcaaagtaaaatgtgacaagaagagcccttgcaccaactgtctaaagcatgagattacatgtgtggtggttgagaggccgcggtggccacgcggccggtccggaaaccaggcaataagccgagagcaagatctgagcgatcgtgtagcgaagctagagcagttgatagagggccttagccactccaagagaggaacgggaaatgggtccagcagcggtggcgagaatacgatacctagcagcggacgatcgccaaaatcaccgtcagaaagggcgcagacaaccgaagacttgtttcatttgcagccggtgagcggtatgcccttgatagtagtgacaattctctga

SEQ ID NO: 238 - DNA, 732 bp, A.fumigatus
  unsure (468): Identity of nucleotide sequences at the above locations are unknown.
tgtaactggggatataaggatgagagtgggaatggtagatttcagtttgtttttgacttcaagatgcaggttcaaactactattgcagcttatgggatctacggttcacgaaattactgttacgctttatgtctcaattctcacgagttagttatcaatccactgcacactctggccaaagtctcatccctagatctcttaacttcgcacattgctatcatttatcgagagattgtgatgctatacttcagggactttgactttttttcggggacccaaacttgcaatatcaagtacggcccacgatatatgttccaacagagagtaaggcaactgagatctatgagagttagttccatgtataagacatccccgttagtcgaagaccaagtgcaacccagctgcgcaatcactgctccttcaattctgggtgttactgtgtttagacctccaaactggcgggacagntactccaacggaggcgtcaacagccctcctccttctatcatgttcacctccttatcatcaacaccatcgggaggagctctcacatcctcgccagcaaagaaccaaaccaccatttccgccgcaacctgtgcatcatcctgcccatcacccgcctcaatcgccttcaaatacctttgtaccatttgcccatcccacccccaccttctcccaaactcgaggcatgtctctctattcacaaacacatcgaactcaaagtgcccctga

SEQ ID NO: 239 - DNA, 513 bp, A.fumigatus
gttggtgaatcggtcccttccagccccgcggtgaagacagcatctctaaactcaatggcttcgtcctggatgcaagaaaactcgtcccctaagagcagccgccgtaggggaattgacctgcaaaagaaggtcgatgagctagtgcacaaatacttcaagatcaaatgtcccagtcccgccctccgcgatatcctcagaagcactgagaaatccgatctcctcgtcagcgctgtccggcttcaggtttcactggccagatgccgctctcagaactttaatgacggtcagatcaccatctacgataaagctctgttgacgttgtcaaaaaatggaaacgagcctgcggaactgagcgtccttgagctctacctgactgagtatctggggattgtgcctattgccaacacttcgtacagcctgaatgtggccactaagcgtcttgggctgcatcaggctttggccaagggtttgtccacagtaaatgttatctatttcttcactcaatcatgctaa

SEQ ID NO: 240 - DNA, 219 bp, A.fumigatus
  unsure (10),(89): Identity of nucleotide sequences at the above locations are unknown.
tcattaactntggaattggccaactccacaaacttagattcggcacagggcatcgaaacctccataaagacgggcatcgcggtgattcngaccctctcacgggcgaaggctctcaggaaggaccaccagttcgacacctttttcatcccgggcggggtcggcaatgctgccgctgatctgggacccaatcctgctacaacgcatcggaaagctggttga

SEQ ID NO: 241 - DNA, 327 bp, A.fumigatus
tcaatccatctgctagtccccggcgtccaatggcagaagcgggcccgctgggtgcaggacggaaaattcctgacttcctccggtgttacggcggggatcgacgcaggccttgtgttcatggctagtacgtatgaggctcaaaaggcttctgcccagggagaggaggcttcaattccaggcttcagcagagaaaaagctctgcatcatgctcattttgttgcgtttggcttggaatatcgttgggactccctgctaaagatgtcacataaaagtgctcttatacctttaaatgaatcttccacctgggacaatgcagtcagatattaa

SEQ ID NO: 242 - DNA, 264 bp, A.fumigatus
  unsure (4): Identity of nucleotide sequences at the above locations are unknown.
ttcngaccctctcacgggcgaaggctctcaggaaggaccaccagttcgacacctttttcatcccgggcggggtcggcaatgctgccgctgatctgggacccaatcctgctacaacgcatcggaaagctggttgaccgcgccgcgaatattttgactgtgtgtaccgggtccatcctgctggctgcgactggtcggctggatggacggaaggcaacgacgaataagcggctgtacgatgagttgactccaaagtgtatgatataa

SEQ ID NO: 243 - DNA, 336 bp, A.fumigatus
  unsure (329),(330),(331): Identity of nucleotide sequences at the above locations are unknown.
gagattgtccaaaagctgcaggacctgcacaacgtgttgaaaggttatactcctccgaccgttgtgcacccaagcgttgagtcgctggatccgaaacccaagtcgtcgttcttcggctcgctgtttgggcgccagagcgcaaaggcggagactgagatccccgagaatctccccaagggattgtatatgtatggtgatgtggggtgcgggacgacgccgctcatggatctgttctacgagacattgcaggccaaaatcaagtcgcacgtcgcgcatagtccttcaccaagggcaggaacatgccgcgcatgcgataccaatcgcggggnnngtccg

SEQ ID NO: 244 - DNA, 390 bp, A.fumigatus
gttcgcatatcatgcgcccatcctgcctgccatgaatacgacctctgtgtcccctgcttcgcggctggcgagaaatcgaaaaatcacgatccatccacgcatccgtaccaggtcatcgaacagaattcggttcccatatttgaagaagactggggcgccgacgaggaactactgttattggagggtgccgagatctacggattgggatcatgggcggacattgcagatcacatcggcggatatcgcacaaaagacgaagtgcgcgatcactacatcaggacgtacatcgaaagctctaatttccccctacccgaacgcgcggatcccgatgatacgagcctacaagatgtcttcaccacggggctggaaggtcccgcgattagcgtaaaa

SEQ ID NO: 245 - DNA, 615 bp, A.fumigatus
cttagcgatgattccgcgcaaaaattcattccccgctatactcggcaagccatctcccgtctctcccgacacttgcccaaggactttaacctgacggctttggacgtgctggcgatgcagaacatctgtgtctacgagcacatcagccttggcggttcctctttctgttcactctttaccgaacaggagtggagggattttgcgtataatgtcgacgtgcagtactatggggactatgcgtacgggtctcccacgggccgtgcgcagggcatcggctatgtccttgaattggcggctcgactgcagggcacgttgatctactccagcgacaccagcattaacttcacctacgacaataatctggcacaattcccgctcgaccagcccttctacctcgacatgtcgcatgacgatatccttctgtccgtcatcaccgcgttgggactgcgctatttcagatatggaccgcacggcttgcccgggaatgttgaccatgcactcaaccggacatttgccatgagccagatgacaccattcggagcgcgcctcatgtcggaggtttggacctgtcatcgtaatgcgtcgctggttttcaccacggggctggaaggatcc

SEQ ID NO: 246 - DNA, 549 bp, A.fumigatus
cccgtggtagtggataatgagggagaccaccagatgagtgatattatgaaggaccgtgccgtgtcgggagcctcgagatattcgccgctgtctcccagtaagagacgtgattcccgggctgtcgatttacccgagtcggacggtcaaccgctatccacttccccaaagtcccaaatcatgatccgaatgcctaatggcgccgtgcgaattaactggccacacctctacaaacaacgaagacgcttggaagaaaactgggcgaaaggccgattcactaacttccaactcccgcatccggcccacccagaagagtctcatctggagtgcgtgtatgcaattcagtttatagggaggtggctcgtcagcggtagccgggatcggactctgcgcgtttgggatctggagaccaagaggcttcggtatcgtccccttgtcggtcacacaaagtcggtcctatgcctgcagtttgacccgcggccatcggaagatgtcataatatcgggcagtatcgacagaaatgtcataatttggggattctctacgcggtga

SEQ ID NO: 247 - DNA, 201 bp, A.fumigatus
tacgaggaagagcgcggggggtatctgccatgcgaggaggtcgccagggccattattcagggaatagggtatcaggggttcgtatctatggagctgttttccagaacgatgtcgttggagggaagccatgttcctgttgagcatgcgcggcgggggatcaaggcttgggagatgctcaaggagagattgcagttacagtag

SEQ ID NO: 248 - DNA, 330 bp, A.fumigatus
tccctaactcaatcgcggtttgtcccttccccgacggttgaagacgagcgcgtcaactttctggctgtcactcagagaatcattgactctgtgatcgcctctccgctggatcattcgctggctacggccgcatattggattgtcattcggcaagagatctattatgccttgacaagggagacggtcccgcatttacggtttgattctgaccgttggcccaatgcttccatcgccaacaatatgatcatgttcgtcggtaaagtcgctcagtggcgctgggggcaaaagagccttgatgagtggagtaagtatgctttatcttccaaatag

SEQ ID NO: 249 - DNA, 669 bp, A.fumigatus
tgcaccagccctggatccttccagccccgtggtgaagacagtctctggaaggtcatcaagcactcccaggtcggagtgcggaatgcgctggccgctgctgagcgccagggtactactctcttcgacaccatggtcaatatccttgtcaatggcaaggttaacgatgatatttccaaggaggtgttccagctctatggtcggcgaccagtatggagaaccgagtacacaacactgaacgtcgaggagggcgctacgggtatcgacgtcacgctcacatcgcccatggaagagcatcgtttggagttcattctggagcagttctgcatggcactgaatctcattgcatccaatcctcgacagactgtcaaggctactaacctggtcagcgagacagaactacagttcatgcttcaatcacataagaacttgcctgatgccactcgcacgttaaatggccaattcgaagccacggtccgcacataccccaatcggacggccattaactaccagaacgagcagttccttacatacgctgagctggattccgaggcaaaccgcatgacacactatctctccgagcttggtgtagtgccgggtgacatcgtccctcttctcctagagaagtcgccattgatgatcaaggcgattctcgccttattcaagctcggc

SEQ ID NO: 250 - DNA, 531 bp, A.fumigatus
tactttctgtggcaagcctatttcgatgtctccccccgagtcccacttggcaaaatctctcaacaagcatgggctcagctgcattttccgtttcacgtggccctcatcctacttcttgaaggatcgcaaatccttgctctcaccttggatgtcactttaaaattgacgtatctgactgaaacaatccagttcgcatgcgaagagccgcggcttgaggcggaggttgccatcaggctactgcgaagtacaattgctgatttggatatcgaacacggccggggtgcgatgaaagaaaaggctatcatctcggacatattggaagagctacttacccttcctctgtgcccgaccaatgtgacgagtaatggctactttgtaacccatgaccgcatggacgatttggtgggacacgttacagccgctttattctccagcatgggaattactccgtcagagggccgagacatcagccaactgaacaatagtcagttgttcatgatgtatattgaccaccggtggcatgtcacgtaa

SEQ ID NO: 251 - DNA, 879 bp, A.fumigatus
  unsure (79): Identity of nucleotide sequences at the above locations are unknown.
cgggccatgtcacagaatgagagttcatgtctccgcagcgaacgtgagacagccaggagtcgtaaagcaccacctcatntacgcctcgatcctctgagaatccatcctcctgatcctcgaccttccactgccggcgcatctcgatctccctcccccctcttaccgccggcgccgcatcctccccgaaaagcatctgcatatcctcatcctgaggacccttttctccgtggcacctcttctcaagccaggggacctgatgaaaacgcgctgaggaaaccaacctaccgctctccgaccttccctcgttcaccctccccaaacttggcccgaccagaagatgattttcagcgtccgtcttaccgaagaggtcctcctccgggccgaccaggattacgaatctcgatgtcgacttcgaggatgtatagcagccgcccgcggggaccgccgccacgcgaacgctaccccaatgaatctccgtcccgaggccttgcattacctcggtatacgcctaatggaccctccgacgtctattcagacgaagcgctccgttccagcgtcaattcggcaatgacgtcgcgatcaagcattgagcaagccagcggaacagaacgcagcagtgtcttgacgaagagcagctccataaccgacctgtcgccggacactccggatggcccttacgaaaaggatggcgggatgagcgttgaagacgcgatttccatgtacttggatgggttcagcgatgtgacggaggagccagcttcaccgggctttggtgacgacagcaaaatgcgacctatcagtccacgcccgccgacggaactcacgtacgactatggacaccgctccgacgagtttttaccagcgacggaaggacgtatt

SEQ ID NO: 252 - DNA, 267 bp, A.fumigatus
agtaatacgtacctcaataagattcttgcatatgggcgcgtggggtgctacctggccccatccagacacagcgaccggattctatcacgcacaagcaagaaggagagtgaggaccctgcgagcaagcacctattctttaatgaggaccctgggggaaaaagcgtcatgcccactccccgccggcgaatcgtatcgcctgaattgtcaggcctgccgattattatcctccgatccgcttaccgtcgcaacttgagaatcgtgaggtag

SEQ ID NO: 253 - DNA, 942 bp, A.fumigatus
  unsure (498): Identity of nucleotide sequences at the above locations are unknown.
acctccatattagcgatcctgtctgcccgaatgggtcattcttcggacaccttttcgtactctcctctcaatcccgaggctgcggagattcgccttctcactatcctacccgacagagatggaaacaacccagtgagatgcaccttgcagaccgtgtctctgaacagcgcgccccaattcgaggcgctctcatatgtctggggaactgttgctgaaatggtggaaatcttggtggacgacatcccatttcaggtcacaacgaacctcaacgcagcgctgcaatgccttcgacattctcggaagaagcgcgtcatctgggttgactttatctgcatcgatcaaaacaacggcaaagaaaagaatacccagctccctctcatgggccgtatctacaaggacgcgacatctgtagttgcatggctcggaccagtcaatcccaacatggaacagacaatgtcgatgatcaagcgacgagaaagcagcctggcggcgatcctncaggacgtacggcagatgacgcggccgctgagccggaagaaccggcgcgacaccataggatcgatcctagacgccattcagggctttctggacatcgtttcggccccatactggggacgcatatggaccttccaggagtactatctccccgagaagctccccgtgtgcatggtcggcaatatcccctttaccctccccgcgctagtcgatctgggtcggcactttccggagatcctggccccgtttgtggaaaacctcgacaaaatggctccgcgggcgggcgatgcagccgacatcgaaagccaccagacactcctgagccgtgtgaaggaggcgcggcagcgcctcgcgcagtcaaatcctatgcaggactttgcgcacgacatcgcagccaggtcttcaccggggtggaaatacacatgtataggggaggggcggcgagcg

SEQ ID NO: 254 - DNA, 780 bp, A.fumigatus
atccatagtgagaggagcattgatattgccgttgcgcactcgcaagttctcttctcggatcctctcaagtacgtcgggacgatcagccacgagttggaacaaccaagtgcaagccgcactggtggcgtcttgcgaggcgaacaacaaagtgaaaacagtctgggcgatctcgtagtcggtaaactcacggagcaagtgagaaggcttctcggagtcttccacagggagtcccttggcaatcttctcgttgtacttggcagaatcctgttgagccttgacccatgcgtccatgatacaggtgatctctccaccagcagccatatgagccttgctcttggcagcacagttggagaattcttcaagaaccatatccgacgccttctttccgtaccaagccttggtgaaagggaggatgaaagggaagttgaccagctccaaagcggctgtgatcatgtagtagtcatccgcaatcttcttgatggccgcatcagtcatatagtggccgacgaaagtcccgcaagagacggcacacatcagctcacggaactcgggcttccaaggctcgggcttgtaatcggtggccttggacttttccaggaaatacttggagtacttggtattaacatctttccttaccgggaagaatggaagacagagcccagcgggtggaaagaaccggtcaaatcccttttcggaattcaacgggcttcttgccaatgcaaaaacaaccaattggcccggcccaagaacttgggcgccaggtctaacacccaagccttg

SEQ ID NO: 255 - DNA, 465 bp, A.fumigatus
tcacagccgctttggagctggtcaacttccctttcatcctccctttcaccaaggcttggtacggaaagaaggcgtcggatatggttcttgaagaattctccaactgtgctgccaagagcaaggctcatatggctgctggtggagagatcacctgtatcatggacgcatgggtcaaggctcaacaggattctgccaagtacaacgagaagattgccaagggactccctgtggaagactccgagaagccttctcacttgctccgtgagtttaccgactacgagatcgcccagactgttttcactttgttgttcgcctcgcaagacgccaccagtgcggcttgcacttggttgttccaactcgtggctgatcgtcccgacgtacttgagaggatccgagaagagaacttgcgagtgcgcaacggcaatatcaatgctcctctcactatggatctacttgacgagatga

SEQ ID NO: 256 - DNA, 1137 bp, A.fumigatus
caaggcttgggtgttagacctggcgcccaagttcttgggccgggccaattggttgtttttgcattggcaagaagcccgttgaattccgaaaagggatttgaccggttctttccacccgctgggctctgtcttccattcttcccggtaaggaaagatgttaataccaagtactccaagtatttcctggaaaagtccaaggccaccgattacaagcccgagccttggaagcccgagttccgtgagctgatgtgtgccgtctcttgcgggactttcgtcggccactatatgactgatgcggccatcaagaagattgcggatgactactacatgatcacagccgctttggagctggtcaacttccctttcatcctccctttcaccaaggcttggtacggaaagaaggcgtcggatatggttcttgaagaattctccaactgtgctgccaagagcaaggctcatatggctgctggtggagagatcacctgtatcatggacgcatgggtcaaggctcaacaggattctgccaagtacaacgagaagattgccaagggactccctgtggaagactccgagaagccttctcacttgctccgtgagtttaccgactacgagatcgcccagactgttttcactttgttgttcgcctcgcaagacgccaccagtgcggcttgcacttggttgttccaactcgtggctgatcgtcccgacgtacttgagaggatccgagaagagaacttgcgagtgcgcaacggcaatatcaatgctcctctcactatggatctacttgacgagatgaagtacacacgtgctgttgtcagggagactctgcgttaccgcccgcccgttatcatggttccctacttggtcaagaaggatttcccaattacggactctatcaccgtctcgaagggttccatgatcataccatcggtgtggcctgcaacccatgaccctgaggcataccctaatcccgactctttcgacccggaccgctggatcaccggcgatgccgagaagcaagccaagaactttttggttttcggcaccggcccccactactgcctgggtcaaacatatgctcagctgaacctgtcttcaccgcggggctggaagggtccgtgcattcacaaaagcgcc

SEQ ID NO: 257 - DNA, 618 bp, A.fumigatus
aatgagcaccgtcgtacttccagccccgtggtgaagacccttggccctaagactccgccgaagtctcgcgcgccacttaagccccctaaaggaggtatattcgggcatatgctggatgagtcgcgaaagatattcgcgcgaccggagcctcccaggacagcacctgctaggggctccaaaattgaggcctggctctctggtactcctgacccgttcctagaagacatggatcccgatgtggaagttcctgcacccttgaacactaggacgaaccgagcgaaatcgcatagacgtgaagacaaacacgaccgcaacgccgagtctgagccgtcacccgagagtgagagtcggaggaggagtacgtccaaacgacacgggcgtagtagagaaggctcagtgaccagtgagagaaagaaatctgaggagaggaaagtttcctcgaaacagctgagagacgactcttctcctccccaccggaagaagtccagcgaacacaggcatagcagatcatcatcaggcgcaaaggaggctaccacccgtgatgcagatctaaaggcagacgatcatgacacagatactcagcctttctccgacggttcagaggtattccgggaataa

SEQ ID NO: 258 - DNA, 609 bp, A.fumigatus
  unsure (50): Identity of nucleotide sequences at the above locations are unknown.
tctgccactgaccgccctctcctagaacaaggtcttgtgcgcatcaccangatcaatcatgtcaattaccagattctagtttccaagctccaaaagggcgatccgctgccacaggacttgaatcccgatgagactacgggtacactggcggatgaatctagttattctgacattggccagaagaagatggttgtgaatcagcaacatctgaagaatgcttgggatgcctctcaaaagtcgacgcgtgaagactggcaggaatggatacgaagattcagcgtggagctattaaaagagtcaccctcaccagcacttcgagcatgcgccagtttggctggtatctaccagccattagcaagggacctctttaacgcagcatttgtatcctgctggacagagctgtacgatcagtatcaagaagagctcgtacgctcaattgagaaggctcttacttcacccaatatccctcccgagatactccagatacttctcaatcttgctgagttcatggagcatgatgataaggctcttcccattgatattcgtacacttggcaagtacgccgcaaagtgtgtcttcacaacaagcgcgaggatccgaataggtact

SEQ ID NO: 259 - DNA, 459 bp, A.fumigatus
ctcttgctacgtccgtacatcagttcgaacaattcggtatatgagatgacgaccatttgcacgacgcccaattcccctcccgaactgtcgggatccaagtcctctaaatcttcgtccttccggtcctcttcgcagctgtccggtcccgacggtattctcgctgacatttccaatttcgaagaaatcggtctggaggatgacccggagatgccttacatggatggtgttactgctgtttatggaaagtcgggggtcatggttcgctcgacgacggccagattgcagcccaaaactccgacaactacgactcgcgacttgacgtccaatgtcaaacccaccaggactccgcatccatcgctcaagggccatgccaatggcgcgttgacgaaaccgaagcacagcagcaccaagatcgggtcgggcaagtcttcacgccgcggctggaaggatacgagtacg

SEQ ID NO: 260 - DNA, 975 bp, A.fumigatus
tcgcgctcctgccagcccgtcgtgaagaccgaggatgacctgaccgacgatgaagagacagatgaacaagaagctcccgatgttgaggctgcggcgaccgagaaagcggatatcgaaggtctcgaggctgaggaacagatggtcatcgacggtggactagatcgcgatgaccaacggcggaacaagaacttgatagttcctgcccggcaaatcgacgcttactggctacaacgccaagttggttctgtgtataccgatgctcacatacaacaggagaaggccacacaggctttggaaatacttggtggcaaagccgaggatggcacagagaaatcgctgcgagatgtggaaaacgacctgatggaactcttcgattatgagcacccagaccttgtcgccaaattcgttatgaaccgtgataagattgtgtgggtaacgcgttggcgcatggttgctgaagacgccgacgctcgccatctcgtcgaaagtgagatggttgaggctggccaccgagctattttggatgaaattcgaggcaagacggttcgcgatgaagcggcaggtcgtcccgagaagaagatcaagctcgatctgatggatgtcgatgtccctagcgcgccggctcccgaagagaagcctacagagggtggcttggtcggcggtctgcagcccaagaggctgattaacctggagaaccttgtcttccaccaaggcaaccatctgatgaccaacccgaatgtcaagctgcctcaaggttctaccaagcgaacatttaaaggatatgaggagattcatgtaccaccgcccaaacccaagcgagatcctggggagaagaacatccccgccactgaactgcctgaatgggcccgtatcggctttggcagtgccaaggagctcaaccgagttcagaccaaatgctacccagctgccttccacgatgatggcaatatgcttgtctgtgctcctacgggatct

SEQ ID NO: 261 - DNA, 327 bp, A.fumigatus
aagatgaagtcgccagcttcgagaagcttgccgaaggaggattcaatcgaagtttcaagatcaccatgcgagacgggttccaatttgttgcacgaattccttacccagtcactgaaccaaaatctctactggttgcaagtgaagtcgcaacaatacatttttctccgttctcatggcattccagttcctaaaatatatggttactctgccgttgcagataaccctgcaggtacagaatacatctttatggaacttgttcaaggacaaaacctaggtgatatctggtttactttgtctgaacaggagaggataacgctggtcacttaa

SEQ ID NO: 262 - DNA, 396 bp, A.fumigatus
agaccccctgtccttccctttgcagaagaaaaaaatcatgtgttaaacatgaaacaggtcaaagaacacctctataaattccagagcctctcctctgaggacgccgagttcgagccgacgctcaagtccctctggagcaatctaggccagcacatcaaagaggaagagagtgacgatctgccttcgctggagaagacgcttgaccaggacgactcggagaagcacacgaagaagttcatgcggacgaagaagtttatccccacgaggagccaccccagtgcgcctgacaagccgccgttcgagaccgttgccgggttgatggctgcgccgattgatcatctggcggatttgttcaggaagttccctgaggagtcgaagagtcagttgcctccttga

SEQ ID NO: 263 - DNA, 414 bp, A.fumigatus
  unsure (80),(144): Identity of nucleotide sequences at the above locations are unknown.
ccaggtatgtcacaacaaaccagcatctcaaccatcggaaagactaccaccctcaaggctccgacgaccatagtgactgntactttgctcgcaaccaagacatcaactattaccattgtcggcgtaactcagacggtcaccagnttgaagacgacaacgatcgaatcgaccgtttcgctccgtcgacgcacactcaccgtaaccaaatcgaccgtctcgacgatacattcaacggtcacgctcgccacccccaccagcacggtcgtgaaaacgacaacatatagacttaagctctcggcgacgtttacttcccgggccacgagcaccaagacaacaacggtaaagaagacagttacacagacgcaaacggtgactaaaacgtccaagggggctgggacctgtcctaccaactaa

SEQ ID NO: 264 - DNA, 198 bp, A.fumigatus
tccctgcggcgatgcaggccacatcacatcacatcgtgtcatttcacatggctggcgcatgaaccggcttgtccttcttgggtcggtctgtcagatgacatcagatttaacgactacatggacaacgttagtatgtggatatggaggggtaatactgagcctacggctactttggtttattttcttatttccggatga

SEQ ID NO: 265 - DNA, 672 bp, A.fumigatus
gcgcggatcgtgccagctcccgtggttgaagacccaatgtccctcgtgatctcttccttcgcgcccgtcggtgatttccgtaagacctggacaccagccctccgcagcgttgaggatgtcggtgacaccgttctgatgttcgttgacctctcgtttggccgcaagaccctgggcggctcggccctcgctcaggtcttcaaccaggttggagatgaatgccctgatctccgcgatgtggagatcttccgggacttcttcgacgctactcagcagctccaggaggcaggcatcgttttggcctaccacgacagatctgatggtggtctcttcactactcttgcggagatgatgtttgccggacgctgcggcgtggaaatcatgttggacaacatctgccccaccaacagcacacaagatctcgtatcgaccctcttcacggaagagctgggtgcggtcttccaggtgcgcaaggagcatgagatccaattccgctcttgctttgccacctgtggcccccctgctggcctgatccacaagatcggtcgcgtctccgaaaggccaaagcagaacttggccatctactacaaggccagcctggtataccgcaacaatcgcgcgagcctccagcagacctgggctaccacctcgtatcacatgcagaagatccgtgac

SEQ ID NO: 266 - DNA, 678 bp, A.fumigatus
gtcacggatcttctgcatgtgatacgaggtggtagcccaggtctgctggaggctcgcgcgattgttgcggtataccaggctggccttgtagtagatggccaagttctgctttggcctttcggagacgcgaccgatcttgtggatcaggccagcaggggggccacaggtggcaaagcaagagcggaattggatctcatgctccttgcgcacctggaagaccgcacccagctcttccgtgaagagggtcgatacgagatcttgtgtgctgttggtggggcagatgttgtccaacatgatttccacgccgcagcgtccggcaaacatcatctccgcaagagtagtgaagagaccaccatcagatctgtcgtggtaggccaaaacgatgcctgcctcctggagctgctgagtagcgtcgaagaagtcccggaagatctccacatcgcggagatcagggcattcatctccaacctggttgaagacctgagcgagggccgagccgcccagggtcttgcggccaaacgagaggtcaacgaacatcagaacggtgtcaccgacatcctcaacgctgcggagggctggtgtccaggtcttacggaaatcaccgacgggcgcgaaggaagagatcacgagggacattgggtcttcaaccacgggagctggcacgatccgcgcttagat

SEQ ID NO: 267 - DNA, 987 bp, A.fumigatus
agacagaaaaaggcagcaagttcgaaggcaggtgtctcgcaggtactgtctcgttacacctatgcctccaccttgtcacatcttcggcgtaccaacacgccaattggtcgtgacggtaagatcgcaaagcctcgtcagcttcacaacacccattggggcttggtctgtcctgcagaaactcctgaaggtcaggcttgtggtctggtgaagaacctggctctcatgtgttatatcactgtcggcacacccagcgagcccatcatcgatttcatgattcagcgcaacatggaagtgcttgaggagtttgagcctcaggtgacacccaatgcaacgaaagtgtttgtgaacggtgtttgggtcggtgtccaccgagatcccgcgcacttggtcaacaccatgctctctctgcgtcggcgcaacatgatctctcacgaggtcagcttgattcgggacattcgtgagcgtgaattcaagatcttcacggacgctgggcgtgtgtgtcgaccacttttcgtcgttgacaatgaccctaagagcgagaactgcggctcgctggtgctcaacaaggatcatatccgcaagctagagcaagataaagaactacccgcggaccttgatcccgaagatcgcagggaacgttatttcggttgggatggtttggtcaagtcaggagttgtcgagtatgtcgatgccgaggaagaagagacgattatgatcgttatgacccccgaagaccttgaaatttccaaacagtttcaggcgggttacgcttcttccggaagaagacaatcccaacaaagcttgttcgtttcaatcctaattcaaaaagggccacactttgaacgcaatggcaaaattaacccccattttgattcttggggggttggggccaatattcatttcctttcccgggactccaacccagttcggctttggaattacctttccaattctggtaatggggcaaacaagccattgggttttgtt

SEQ ID NO: 268 - DNA, 375 bp, A.fumigatus
gtaataaccatctgcgatgggattgcacgagatcaacgaaggctgatggtctgcataggtaaatacgtcgctgcggtgttgaagaatccttctgagtcccttggtgctcagatcctcgccgccgaagattactacacccctacaagaatcctccaggagttcgaggaggttactggacagaaagctcgatttgtgcaggtggatcccgatacgtttaagagctttatgcctggtctaattggtgaggagatgctgcagaaccacctcttcattgagaatcctggttacttcaacggcagggatcttaaagagagcaatgactggcttgagaaggctgggtatcagctaatgagctggagagagttcctggagtga

SEQ ID NO: 269 - DNA, 201 bp, A.fumigatus
  unsure (2): Identity of nucleotide sequences at the above locations are unknown.
antggaaagcccagggtggagcagaatatccggtccactggtgtgcgtgttacatttgtgctgccagggtatttcatgagcaattatcccgaagtgggtatgctgcgcaagggcgaggacggcgtatacaacctggcgtaccctgtgggtcagaacgccaagtttccactggtcgatatcgaggccgatatgggtaggtaa

SEQ ID NO: 270 - DNA, 552 bp, A.fumigatus
gtgtgggacgatctggcttccatcccggcggtgttagaacccgccgacggcgaggcagtcgtctccctcctctcagatgcgtccttcgaccccgagtttccctccaccgccgaggagccctttgaacctgtcgagacggagctcctccccccacaacttaccccgtcggagatccaaatgatcgagtccttccgccgccacgccgcgctcgagacctcgacgccgacgccggctacagaaccgttgtcactgacacatagactcacgtccctcagtctcgtcccggacatccagtcggtcctcgacagcgtgccagctgcgcaggctacggacgccacggcgctgcgggatgccgttctgaagggtctgccgggtgtagcggagtggatcgctgtcgaggagcgataccatgatgaagtctgggggtacctgcgcccgacactcgaggcggcggcgaaggaaatggaggagcgtaaggagcagggcgctcccgtggaggacgggcctgctgttagacgattgaagatgattttgaggcatatgcagacctga

SEQ ID NO: 271 - DNA, 621 bp, A.fumigatus
aaatccaagcctaatagcaaggcaagcgtccccagtgaacaaggtgagactctgacctctgacatatatcaggtctgcatatgcctcaaaatcatcttcaatcgtctaacagcaggcccgtcctccacgggagcgccctgctccttacgctcctccatttccttcgccgccgcctcgagtgtcgggcgcaggtacccccagacttcatcatggtatcgctcctcgacagcgatccactccgctacacccggcagacccttcagaacggcatcccgcagcgccgtggcgtccgtagcctgcgcagctggcacgctgtcgaggaccgactggatgtccgggacgagactgagggacgtgagtctatgtgtcagtgacaacggttctgtagccggcgtcggcgtcgaggtctcgagcgcggcgtggcggcggaaggactcgatcatttggatctccgacggggtaagttgtggggggaggagctccgtctcgacaggttcaaagggctcctcggcggtggagggaaactcggggtcgaaggacgcatctgagaggagggagacgactgcctcgccgtcggcgggttctaacaccgccgggatggaagccagatcgtcccacacc

SEQ ID NO: 272 - DNA, 303 bp, A.fumigatus
acgagttcttcgatctttgaaacgaccctgagtgacacagtcaccgataatacatacattatgcctccttccgaacaacagagcggcaactccacgccgcgctttacgagccagactacctccgcagaagatcttctcaagtcgcagaccgtcggtctggtccatctttcggactttcgcaagcgtcgagcagaggttctagagcaaaaggaacgagaggcacatgacaagtcgctgggaagatttacatccggtaactccagaagtgctactccttcaacaggggacgtgactgacaggtga

SEQ ID NO: 273 - DNA, 429 bp, A.fumigatus
ggtgactggatcctcttcactcacgagggtggtgtggacgttggcgatgttgatgccaaggccgagaagcttcttatccccgtgaacctgagaaactacccctccaacgaggagattgctgctgctctgttgagcaaggtgcccaagggcgtccacaatgtcctagttgacttcatctcccgtctctacgccgtctatgttgattgccagttcacctaccttgagatcaaccctctagttgtcattcccaacgctgagggtacctccgcggaggtgcacttccttgaccttgccgctaagcttgaccagactgctgagtttgagtgcggtaccaagtgggctattgcccgcagcccggccaaccttggcctggccaccgttccccagactggtcttcaccacgggactggaagaatcggcgtcagttga

SEQ ID NO: 274 - DNA, 606 bp, A.fumigatus
tcttacatttctatcgtcatgtccgccaagtcgattctcgaggctgatggcaaggacatcctcaactaccacctcaaccgggctcctgtcatcaagccgactcctctccctccttcgtccacccacaagcctcatcccagacttgcctcaatctacttccccgaggacgccgctgtcaaggatgtcttggaccagacgaggttgttctacccttggctgctgactcctggcgccaagtttgtcgctaagccagatcaattgattaagagacggggtaagagcggtttgctcgctctaaacaagacttggcctgaggccagagagtggattgaggcccgtgccggcaaggagatcaaggttgagactgtcaccggtgttcttcgtcagttcctggttgagcctttcgttccccaccctcaggagactgagtattacatcaacatcaattccgtgcgagaggtaagtgactctggcgattctcaaaatggggcccgatttggaagactaatgaacttttctagggtgactggatcctcttcactcacgagggtggtgtggacgttggcgatgttgatgccaaggccgagaagcttcttatccccgtga

SEQ ID NO: 275 - DNA, 717 bp, A.fumigatus
caagcagatgtggtggtgtacgcaggcggtatcgacaataccatcgaggcggaaggccgcgaccgcaccaccatcgcctggcccggcaaccaggtaaatctgatcgaccagctctcaaagatcggcaagcctctcgtcgtggtccagttcggaggcggacaggtcgacgactcgtccctactctcgaatccgcgcgtcaacgctctcctctgggccggatatcccagccaagaaggcggatccgccatcttcgacatcctcactgggaagactgcgcctgcgggccgcctaccagtaacacagtacccggcagactatgtcaaccaggttccaatgacagatatggctctgcgtccggggtcgaacaccccaggacgtacgtaccggtggtacgacaaggcggtcctgccatttggctttggtctgcactatacgactttcaagatctcttggccgcgtagagccctgggaccgtataacacagcagcgctggtgagccggtcacccaagaatgtgccaatcgatcgggcggcgttcgacaccttccacatccaagtgaccaataccggaaaaaccacgtcggattatgtggcgttgctgttcttgaagactactgatgctgggcccaagccatatcctctgaagactttggttggctacactcgtgcgaagcagatcaagcctggcgagaagaggtcggtggatatcgaagtctct

SEQ ID NO: 276 - DNA, 600 bp, A.fumigatus
tgcagtacaaccggagtggtagtacggatgttggagcgtcccgacgacttccaagacatcactcatgttgttcttgacgaggttcatgaacggtccatcgacagcgattttcttctgattgtgcttcggcgactaatgcagaaacgaccagacttgaagttgatactaatgtccgctactctcgaggctcaacgtttctcttcatacctcggtggcgttcctgtgctgaatatacctggacggaccttccctgtcgaaatgaagttcttggaggatgcgattgagctgaccaactaccgcctactggaaaacgaggcgaactctgtgattgatgaagatttggacgatacgccgtcggacaacggggaaggcgacactgctggcggcctgctagccactcttgaaggatattccaagcaaactcgcgaaacggtactcactttcgacgagtaccggctcgactaccagctcatcaaaaagttactagtgaaactcgcgtcagcaccggagatggcatcctacagcagagccatcctggtgttcatgcctggcatggcggaaattcgtcgtctgaatgatgagattctctcagatccaatt

SEQ ID NO: 277 - DNA, 264 bp, A.fumigatus
  unsure (206): Identity of nucleotide sequences at the above locations are unknown.
ttccaggggagggatgaaccttccggatttgggaatttaaagagaagaattctcaaacacgttgaacaaggattggggccctattcatctgcagggagacaggaagtggaaaaaagaaggcaggtactttccttcatccttgagcatgagtggaaaccagctcgtctttgcaagatttatgggacggagcctaggagaatctttgntatatccctggcgcgcagagtcaatgaggagcttggagagagtaaggcagacgtttga

SEQ ID NO: 278 - DNA, 228 bp, A.fumigatus
  unsure (107): Identity of nucleotide sequences at the above locations are unknown.
ctttactttccagccgaacagcaaaaccaatcagaggacggggccgtctcaaacgtctgccttactctctccaagctcctcattgactctgcgcgccagggatatancaaagattctcctaggctccgtcccataaatcttgcaaagacgagctggtttccactcatgctcaaggatgaaggaaagtacctgccttcttttttccacttcctgtctccctgcagatga

SEQ ID NO: 279 - DNA, 735 bp, A.fumigatus
agaggcctgatcgggctgtatgatccgccccgccccgaaaccgcgggggccatccgcgcctgcgcccaggccggcatcgccgtgcacatggtgacgggcgatcacccggggacggccacggccattgcgcagcaggtggggatcctcccgtcggatctgggaagcgtcgccgcggacgtggccgacgcgatggtcatgacggcgggccagttcgacaagctgaccgaccgcgaggtggacgcgttgccgacgctcccgctggtcattgcgcggtgcgccccgcagaccaaggtgcggatgattgacgcgctgcatcgccggggccagttcgccgcgatgacgggcgacggggtgaatgactcgccctcgctgaagcacgcggacgtcggcatcgcgatgggccaggcgggctccgacgtcgccaaggacgcgtcggacatcatcctgacggacgacaactttgcgtcgatcctcaacgccgtcgaggaaggccggcgcatcttcgacaacatccagaaattcgtgctgcatctgctgtcggagaacatcgcgcaggcctgcacgctgctcatcggcctggccttcaaggacctggacggccagtccgtcttcccgctcgcccccgtcgagatcctctggatcatcatgatcacctccggcatgccggacatggggctggccatggaagtcgtcttcaccaacggccgccaggaaggacaaacggtccccccccgc

SEQ ID NO: 280 - DNA, 765 bp, A.fumigatus
gcggggggggaccgtttgtccttcctggcggccgttggtgaagacgacttccatggccagccccatgtccggcatgccggaggtgatcatgatgatccagaggatctcgacgggggcgagcgggaagacggactggccgtccaggtccttgaaggccaggccgatgagcagcgtgcaggcctgcgcgatgttctccgacagcagatgcagcacgaatttctggatgttgtcgaagatgcgccggccttcctcgacggcgttgaggatcgacgcaaagttgtcgtccgtcaggatgatgtccgacgcgtccttggcgacgtcggagcccgcctggcccatcgcgatgccgacgtccgcgtgcttcagcgagggcgagtcattcaccccgtcgcccgtcatcgcggcgaactggccccggcgatgcagcgcgtcaatcatccgcaccttggtctgcggggcgcaccgcgcaatgaccagcgggagcgtcggcaacgcgtccacctcgcggtcggtcagcttgtcgaactggcccgccgtcatgaccatcgcgtcggccacgtccgcggcgacgcttcccagatccgacgggaggatccccacctgctgcgcaatggccgtggccgtccccgggtgatcgcccgtcaccatgtgcacggcgatgccggcctgggcgcaggcgcggatggcccccgcggtttcggggcggggcggatcatacagcccgatcaggcctcttcaccacgggggcggaaggatccgagctag

SEQ ID NO: 281 - DNA, 636 bp, A.fumigatus
cggcggggggggaccgtttgtccttcctggcggccgttggtgaagacgacttccatggccagccccatgtccggcatgccggaggtgatcatgatgatccagaggatctcgacgggggcgagcgggaagacggactggccgtccaggtccttgaaggccaggccgatgagcagcgtgcaggcctgcgcgatgttctccgacagcagatgcagcacgaatttctggatgttgtcgaagatgcgccggccttcctcgacggcgttgaggatcgacgcaaagttgtcgtccgtcaggatgatgtccgacgcgtccttggcgacgtcggagcccgcctggcccatcgcgatgccgacgtccgcgtgcttcagcgagggcgagtcattcaccccgtcgcccgtcatcgcggcgaactggccccggcgatgcagcgcgtcaatcatccgcaccttggtctgcggggcgcaccgcgcaatgaccagcgggagcgtcggcaacgcgtccacctcgcggtcggtcagcttgtcgaactggcccgccgtcatgaccatcgcgtcggccacgtccgcggcgacgcttcccagatccgacgggaggatccccacctgctgcgcaatggccgtggccgtccccgggtga

SEQ ID NO: 282 - DNA, 225 bp, A.fumigatus
aaatgtgtagctaccgtcttttcctgctctgattaccaaatgaccttcggattcaggcccgatgcccgacgtgaggatcctagtaacgacatcgcgaccgaactcgctatcctcggtccacccgggctggccgaacatcatgcccagctccaactcgtttgggctaaccacatcaactactcgagctgcttccaagaatctatcttgttcttctggtgtgcatag

SEQ ID NO: 283 - DNA, 969 bp, A.fumigatus
ccactagagcatggaatggatatgggccgaatgaaaagcgaggttagcatattctctcgttctgcaaccgtggaatgcaaaataagagatgtattaattgggatagatttcaaatatctgacgcctaaattgagacttgagccctcaatgctctctgactcgcaggttttctcaaagacattccacatggtctgctcttcttcccgttgcataaccatcgttgaagatattctacgaagacgtgacgatttgtggaaagagggcaaggccccttccgccactggcgccacgaaaagaccaatcttcatctgggagcccgtgccggatctatgcacaccagaagaacaagatagattcttggaagcagctcgagtagttgatgtggttagcccaaacgagttggagctgggcatgatgttcggccagcccgggtggaccgaggatagcgagttcggtcgcgatgtcgttactaggatcctcacgtcgggcatcgggcctgaatccgaaggtcatttggtaatcagagcaggaaaagacggtagctacacattttcaaggaaagagagaatttggcttcccgcttaccatcagcctggcacttctggggttacagctgtcgtggatcctacgggagctggcaattcgtttctgggggctctggcacaaggcctcattagttcagaaagagacccaggcatgatcattagctccgtgcttgcgaagtgtggagattggcagactatcacgaaggcatcggcaaagcagagagatatgctggtggccttgatatgcgccactgtcgctgcaggctttgtggttgaacagattggcgtgccccgtctaacactatcaagcgaggggaaagaactgtggaatggaactgaattcacggaacgagtccgtctgtacacgcagagattgtatcgaacattcgaagagtctccccgaaagcattttcgaaacaactga

SEQ ID NO: 284 - DNA, 189 bp, A.fumigatus
aggcatgatcgcgctggcggtccagatgcctcgaccggctcaggtttccccttgactctcttgttggatggtgccgtcccttcactgtatctggagtcgccgacagcctttctttggcaattcgactctgatccatacttaagcttcgtgtcctacccctccggctgccgtcttcagaaatgttcctag

SEQ ID NO: 285 - DNA, 732 bp, A.fumigatus
gttattgggagtggaattctagctgacgccggttgtaggagaggtgtcgccgatgagatattagcaagacgaggagaggaacgaggtcgcaagagggagctaggagattcagatccgtttaatgacagtcatcatgcagcgaagcggagtagatcagagtcatctcattcaatgtcgtccgtttcaacgatatcgaccagtcgatcgcattcagtttcaccgccacgacatgaactttatactgaaagtatggggcgagaccgagcacaatcaatgtcgtcgcctcaaccacaatcaagaaagaggcgatacagtgtctcattatcctatcatactgactcttcattctcttccggtgggcgacagcgctctcggtcgagggaatgggagacagacagaaacacaagacgaagacgtcgggaatctagccctgaagagcgtggtcgacctaggaacatttctgaagacggcagccggaggggtaggacacgaagcttaagtatggatcagagtcgaattgccaaagaaaggctgtcggcgactccagatacagtgaagggacggcaccatccaacaagagagtcaaggggaaacctgagccggtcgaggcatctggaccgccagcgcgatcatgccttcagcagacctacatccggttcagcgcgaaaggaaaggagcctcagtccttacagtaagcgtctagcgcggactggtcttcaccatctggggtag

SEQ ID NO: 286 - DNA, 204 bp, A.fumigatus
ctcgacttcatcgttgcaaaaactaataccatctaccttccccaaattcaataccaaagggcacagttgctgagtttctacactactatcgtaatctggttaacagggactgaaacgtgcgtcttattactctgctcgaacatttccatatatgctgggcacaccatatctgccaagtacgcgtacaatcacctcgaagtctaa

SEQ ID NO: 287 - DNA, 339 bp, A.fumigatus
ttttctaacaccagccaagatgaaccttggttcgcggatggcaaaaatttggatttccaacacggcaatagtcgggaaaagtgccctttcgcggcgcatatccgaaagtgcagacccaggggagatgtcaaggatacgagtactagttccatgatgcgtcggggcattccctatggggatgaagtcactaaagaagagaacgatgaacagataacaaagaaggagcgcggaatgttctttctgtgctaccaaagcaacattgcaaatggattcaggcgagttcaagagcgtaagcaatccaaccactgcatcaataccacatactatcttgccccttaa

SEQ ID NO: 288 - DNA, 669 bp, A.fumigatus
aaatacagtagggaagaatacggagaaggacaagaacaagaagtgggaggtagcatacacggctcgaatgaggcagattgtgcctggtctcttccttggaaatgtcgaggcatcatacaaatgggaaatgcttcaaaaagtcgaatcaacgcatttgtctctcttactgatgcccggtgggtgtggtggaacactactacaagagaggcaggcatcccagcacatcgtcacaaatgggttcagggtgcagattcgtcgacgcaagacctccttgctcatatgagcgatatctgctactttatcaaccagatggcatctcccgttctttcgtcgttgtcctccttggtcatcgagcacaaacacgacacgaatgatgagccatgcagagcacctccggaggccatattaatccactgtgattttggaatatcacgctcgccaacgattattgttgcctatatcatgcgcaaactctgcatgccgcaagcggacgtattacaatttgttcaatcaaagcaaagaatcaaaccgagcccgaatttcactcgtctattaaagtttgagaggaggttggatatcaagtatgggaggacgaagacaaggcagtcccgaaggcaccttagaagccatatggtcttcatccacggaggctggccaatcgggcgctaa

SEQ ID NO: 289 - DNA, 381 bp, A.fumigatus
cgacaaccatttgtcatcggtactctcctcgagctcagcgccgctcgtgctgtgaacgaactgggaggcaatgacgagtccggcgatgtgtatgcctatgctcagcgcctcatggcgaactgggatgcaggcaacttttcccgcgatgtcacgaactggtttacagtcgatcgcatgcttcaagagaacgtgcctatctacaacggaattacgctcgcccttcaggttgagggcgtcgcaagtgacaaaactgtgtcgggtcctctgaggagacgtctgaataacttgcgtctattgattgccaaccataatgaaatggcccccgagaatgtccatcaaaagccgacactgggctatcatcaaagccagctcctgcattag

SEQ ID NO: 290 - DNA, 411 bp, A.fumigatus
gtgacttgcccgcgctcgcttccgaaattgagatatgtccccccgcctcccctccgccccgcccccccccgccgcacctctccactgggattgaccacaccgaacaatacatcagcaatgccattgccgagctcgttccccccgaaccatgcgtggagatgcgtcttcacaaggtcggcccacggaagcatgctgaacggcgtgccgctctgggttaggagaatggcgtccggcaccacgtccaggacagcggtgaccagggaggcaacggccggaggaagatccatgtgggaccgatcgaatccctctgattcatggtctcgcgtcagcccaacccccaggatcgtgatgtcggcacgcttcgcggcctcaacggcccgggcgatcgcccgctccggatcgacaacctga

SEQ ID NO: 291 - DNA, 840 bp, A.fumigatus
cagtctctttctcgacgaccagcttatcatcgacaacacgactgtgcaacgaggtggcagttcttcttcggcaaaggcaccctggaggaaacggccacggtggatcttgttcagggtcagtcgtaccagatcaaggtgcaattcgcgagtgggctttcctccaagctcgtcaaacctggagtggtgaatttcggcggcggcgccggtcgcctgggaatggttcaggttgtcgatccggagcgggcgatcgcccgggccgttgaggccgcgaagcgtgccgacatcacgatcctgggggttgggctgacgcgagaccatgaatcagagggattcgatcggtcccacatggatcttcctccggccgttgcctccctggtcaccgctgtcctggacgtggtgccggacgccattctcctaacccagagcggcacgccgttcagcatgcttccgtgggccgaccttgtgaagacgcatctccacgcatggttcggggggaacgagctcggcaatggcattgctgatgtattgttcggtgtggtcaatcccagtggagaggtgcggcgggggggggcggggcggaggggaggcggggggacatatctcaatttcggaagcgagcgcgggcaagtcacttatggcgagggcatttacgtgggttacaaattactacgaaaaagtccgacgagctgtgctctatccattcgggtacggtccgctcccgtccatccatgttgttttcggtcgaactccctgctgactcgcttcgtccctcaggcacggtttgtcgtacacctcctttgcgtactccgatttgacggtcgacaccgcgtccggtacact

SEQ ID NO: 292 - DNA, 219 bp, A.fumigatus
actaacgctaaggatagattcttgatcgtactctggactctgtacctacgttacacctacctgaagagagatccggtgtcgttactggacgctgagacgcacttggggctgctgcccggagctgccgccaacgctgtggcctaccattgggtggcgaccgcccatccgagaatggaaatgtcacgtgataacacattttcgtcccttcagccaccatga

SEQ ID NO: 293 - DNA, 600 bp, A.fumigatus
ctcttcgagctccgtcgttatgatcaccgatctgctagtgcctcttcttccgccaacgactctttcaactcacccttttcttcgtctacttcgggcaagagcggtatcgccatcaaagcctctacatccaaaccgaatcgcttcacccagctcttctcaacgtcccctaagtccaaatccgaacctcaatccgcacagtccgctctccaggcagctagtgggactttccaacccagtcctgtcgctccgccgatcagttcggcatcactgtccctaccgaccatttctttatcgacagctactgcgggtaatccaaatatggacgagcctccgaccacacttttccaacctccgtcacccgaagaggcccgtcggcaagccaagcaacatgcccaattcggccccattggccatccaagccaccgctactcgagtagacaccctggcggtgtcttcccagagccagtgatggacgaaccaccctattattatcttctcactacctatatcagctacttgattttgatagctttcggacacgtccgcgatttcttcgggaagcgctttcgcgaggagaattatcggcaccctgaaactcgc

SEQ ID NO: 294 - DNA, 267 bp, A.fumigatus
ctgcttatcacggaatttattccgagctcagctttgcaccatcgcagatccaccactgccacttggacaatgatcaatcaccccatctcctgggtccatacttacagcatgcatcttggctaccagtctcgtggccgtttcgactcttttatcactacttgggttctgaccatgcggggtgcaagctgttcccgacattaccagccgaaactatgccgtccgagcattttaggcctcggtctgtgtctgtgtccacctggtaaatag

SEQ ID NO: 295 - DNA, 429 bp, A.fumigatus
cgtctctggtcagacagctcattaatttcccccaggatccctcccaactgccgctttgagatcgacgatttcgaatcaccctggtcatacagccaaccgttcgattacatccacggccgtgaactcgaaggagctatccgcgaccatgacactctttttagacaagcatatgagaacctgcggccaggtggctggctagaaatggcctccatggacgtcaactcgtattccgacgacgggacccatctcaaggcggttaatatggttgagggggtcaagaacatgcatgcagcatcgaagaagcacgggaaagacatgacaacagcgccaacatggaaagcaaagatggagaaggcaggctttattaacgtccgcgaggacatctacaaggtactactctgtcatacgttcctagtcaaaccatactga

SEQ ID NO: 296 - DNA, 399 bp, A.fumigatus
catacgcaaggtcacaccatgtcaggtattggctggggtgcgtacggcacacgagttggacagagccagggtgtcgatgtatacagcctgggccataatctcttgctcaaagcgtccgagtacgcagccaagtacaatctgaacgagacagtcgagtacgatcccaagtggtcccgttgtgaagcggtcattgtccatggtccctgggcgactatctctgaacagaggcgcggcgagacgaaccagaaccctatgtgggacattttgtactaccagtacgtggtcaagagaaaggcaaaagcaccgtggactaccaaagccagggaattcgagggcttcgagggtgctgtctcgtccaacgatcatcccagctggggtggtctgatatgggcatactag

SEQ ID NO: 297 - DNA, 366 bp, A.fumigatus
agcttcctaacgcccatggctgctgggacgcaagccacgcgtgaaggatggcgggcatcctatcgtgcactaggcatcgctgatgctgtcctactcggtctttttatattcttctatgaggagaccaagtatacccaagtagttatgggtgtgagcagcagtgtgcaagttggcgacgctccaaatatctcagtcaaggacatcaaaaccgaccgacaaccagatatcgagtgcactacaagccggcaggaatcagataccgctcctgcgcagcaccgcgagctagactacaatatcccattaaagacctggcgacagagactagcgctggtgtcatacaccgctgagccaatctggccgtgtctt

SEQ ID NO: 298 - DNA, 246 bp, A.fumigatus
  unsure (246): Identity of nucleotide sequences at the above locations are unknown.
acttcggcaaaaagaacattgacagatgctcttccgggagacgattcatggttagacttagacacttggctatggacaggatctcggctgccaaactgctcccgctcccagactgatacttatccacggtcctacaacgcactgtttcgactcttccccttctattttggtgataacctcgtgtatctagcattccctcagcacaacatgcggtggtctcttgcaggtctgctgccgtcgctctgn

SEQ ID NO: 299 - DNA, 249 bp, A.fumigatus
aacgttcttcatgcggcgctcctaggtggccaccttgcagttgttgagtttcttgtcatcatctggcctgagctcaaatatggactaatggatattcccccgtgtgacatatggctcattgtcacagcaggccacgcacctattgtagagtaccagctttttactggcgttggcttcaagttatggtgcgccttattatggtttttcccaaagcgcctctgctcgcctcagctgttgtatatggcatga

SEQ ID NO: 300 - DNA, 228 bp, A.fumigatus
gtagatagcaattacgcattcttgttaccgtcttggttgcaaccaggcaacggccgttttagtttatttcttttgcttgatttccctatagtggagtcgatctacgtctcagacacacccactctttcggtcaatccagtaaacccctcctctatctggctgttgtctgcctccaccgccttcgaccgttttccaggcatatcaaggccaacgataagcctcagctaa

SEQ ID NO: 301 - DNA, 261 bp, A.fumigatus
ctttctgccacagctgccaaagccgccctgcgaaggaagaaggtccacgagaagaatctcgaacagactactgcgcagatcgcccagctcgaacagcagatctactcgatcgaagcggcgaatatcaaccaggagactttgaacgcaatgaaggccgccggcgctgccatgacacagatccatggctcgatgacgatcgacaaggttgatgagacgatgtatgtatttatttgcaatagttatcgcgaaggcagatactga

SEQ ID NO: 302 - DNA, 426 bp, A.fumigatus
aagagattccgcccccacactcctagtttgatgcaacgacagcttcgcggcagacgttgcatcatccttctctgtagtttcctcgtccgagtcagtctgctcttgagccttgccatcggccttctccagatcctgcgcccggacaagccgggcataagcaccgtccctggcaatgagttcctggtgcgtcccctgctcgatgattctcccagcggacatcacagcgatgttatccgccttctgcaccgtagacagtttgtgcgcaatggtgatagtcgtgcggccgacagagatattatccagcgcgctctggacaatcttctcagccttgggatcaagagcagacgtggcttcgtccagcagcagaaccgacggccgagaaacgatactccgagcaatggcaatccgttgtttctgccctcctga

SEQ ID NO: 303 - DNA, 843 bp, A.fumigatus
agacacctgcccagacagtatgagacccagattggagaacgtgcgcgcatgttgtcaggagggcagaaacaacggattgccattgctcggagtatcgtttctcggccgtcggttctgctgctggacgaagccacgtctgctcttgatcccaaggctgagaagattgtccagagcgcgctggataatatctctgtcggccgcacgactatcaccattgcgcacaaactgtctacggtgcagaaggcggataacatcgctgtgatgtccgctgggagaatcatcgagcaggggacgcaccaggaactcattgccagggacggtgcttatgcccggcttgtccgggcgcaggatctggagaaggccgatggcaaggctcaagagcagactgactcggacgaggaaactacagagaaggatgatgcaacgtctgccgcgaagctgtcgttgcatcaaactaggagtgtgggggcggaatctctttcagcggatgacaaggcgaaaacagctgccaaagagactatgggatacagtctcattcgatgcctgtggcttttgataaaggagcagccgcagctgtggggactgtactcccttgtggcgattgcgtgtattcttggaggtcagtgtgcccaaaatatctcccagacccttcctctaaccaatggcagggggcacattcccagcacaagccatcattctggcgcggacattgcaagtctttcaactaagcggcagcgaggctgttcggcggggagatttctgggcgctgatgttcttcgttgtcgcccttgccaacctcttcatctacttcctcctgggatggctgtcaacacgacggggctg

SEQ ID NO: 304 - DNA, 204 bp, A.fumigatus
atggagacccctcagttgcccatcttccgtatttgccctgtgccaccaactgcttgctctggccgctggtgctcccacatccaaccccactatggtaaacgtgctcataacatccccgctccggaactgaacacgggccgttgccacttctccaatttcaaaactccgtttaccttgtttatgcagtctacccgggccctctaa

SEQ ID NO: 305 - DNA, 1038 bp, A.fumigatus
  unsure (758),(779): Identity of nucleotide sequences at the above locations are unknown.
gaccacccacacattactacacgcttccacatttcttctcatcctacccaacaaataatgttcgctcgtgtattcaaggctatgcccgccagggcttcagccttgacttccgtgaatgcttccattccggctcgcttcatggctactgttcgtcagcagcgtcctgctcatgagcgtgccactttcacgattcgagatggtccgattttccacggcaagtccttcggagctcgcaccaacatctccggtgaagccgtcttcaccacctctctggttgggtatcccgagtctctgaccgatccttcctaccgtggtcagatcttggtcttcactcagcccttgattggcaactacggcgtgccttctgctgagcgggacgagcacggtcttctcaagtatttcgagtcccccaacctgcaggccgctggcgtggttgtggccgatgtggctgagcagtacagccactggactgctgtcgagtctctcggcgagtggtgtgctcgtgaaggcgttcctgccatctccggtgtcgatactcgggctatcgtcacctatctgcgtgagcggggttcttccctcgctcgtatcaccgtcggcgaggagtacgacgctgaccaagacgaggctttcaccgatcctgaacagatccacctggtccgccaggtcagcaccaaggctcctttccacgtgagcgccgccgatcctcagtgccacgtcgccgtcatcgactgtggtgtcaaagagaacattctgcgtantctggtcagccgtggtgccancatcaccgtgtgctccttcgactaccccatccaacaagtggcccaccatttcgacggtgtcttcatctccaacggccccggtgaaccaattcactgccaggagaccacctaccaacttccgtcgcttgaatggagacccctcagttgcccatcttccgtatttgccctgtgccaccaactgcttgctctggccgctggtgctcccacatccaaccccactatggtaaacgtgctcataacatccccgctccggaactga

SEQ ID NO: 306 - DNA, 234 bp, A.fumigatus
tttactgcaatgtattcgagtaccccatctcctattaccctcgattataccctccacgatctctacatagccagtcaggaagatggcctgaataccgtcctgatctactaccctttacagtttggacacaaccatgagggtaaatcggccaagtttgcctacgggtacaaagtggaagaagaggatgaatttgcaacgtccttgactatggccgccaacctggtaccacagcga

SEQ ID NO: 307 - DNA, 756 bp, A.fumigatus
  unsure (738): Identity of nucleotide sequences at the above locations are unknown.
ctagaagatgttcgacagggcttgtaccttgctgttgatcttggaggcaccaacttccgggtgtgctcgatcgatcttcacggagataccacattcaacctcacacagtcgaagatcatgatcccccgcgaactgatggcttctggtacttccaaggatcttttcctgttcctagctcgccagatcgaggcgtttctgcgaatccaccataacgaacactttgaggctcatctgagacgccgtcgtgaaccaaacagtgaagaggaactcttcgacctgggcttcacattcagtttccctgtgcgccagttggggatcaacaaaggtaccctcattcgctggacgaagggcttcaacatccccgatgccgtcggtcacgatgtctgcgctctcttgcaaaacgccattgatgagctggaccttcccgttcgcgtggccgctctggtcaacgataccgtgggaactctgatggctcgttcctacacctctcccggtgatacctcaactttcattggcgccatcttcggcactggcaccaacggtgcctatgtcgagaagctcgaccggatcaccaagctgcagacgattgaacacgcggattacgaaaaatcgactggagagatgatcatcaacgccgagtggggcagctttgataaccacctcagtgttttgcccaacacgaaatgggacaaggagttggatgaagacagcaacaacccaggcatccagatgtttganaagcgtgtctcgggtatg

SEQ ID NO: 308 - DNA, 192 bp, A.fumigatus
cgacctgcagatgtaagcggcgaattgatccgcagcgacatcaccgagaaccaggcgggtgttcctctctacgtggacgtccagatggttgacagctccacctgcgagcctgtcaccggtgtctatctggacttctggcactgcaatgctactgtaagtcttccgtgcataggcgcaaatggatgcaactaa

SEQ ID NO: 309 - DNA, 426 bp, A.fumigatus
ctctgcccagtcctaacccactccctcaacgaaaccaccgtcaacgccaacaacaccctccaggccctctacaccgcgcactccgctcatgtcggccagattttcttcgatcaggacctcatctctaccgtcgaaaagctctcgccctactctaccaacacgcaggagctcactactaatgacgaagacagcatccttgccgaggaggccgacaccatcgatccctttgtcgaatacggttttctgggtgactctggttctgacggtttctttgcttggatctcccttgccatggacttcctccaaagcagctttgggactcctgctgcttactatactgaggatgggggggccagaacagcaacttcggggggtcccgtggtccccgtgggctccggttttggtggcccctggcggggcttctcg

SEQ ID NO: 310 - DNA, 408 bp, A.fumigatus
cccactccctcaacgaaaccaccgtcaacgccaacaacaccctccaggccctctacaccgcgcactccgctcatgtcggccagattttcttcgatcaggacctcatctctaccgtcgaaaagctctcgccctactctaccaacacgcaggagctcactactaatgacgaagacagcatccttgccgaggaggccgacaccatcgatccctttgtcgaatacggttttctgggtgactctggttctgacggtttctttgcttggatctcccttgccatggacttcctccaaagcagctttgggactcctgctgcttactatactgaggatgggggggccagaacagcaacttcggggggtcccgtggtccccgtgggctccggttttggtggcccctggcggggcttct

SEQ ID NO: 311 - DNA, 543 bp, A.fumigatus
gggggagaagttttcagattattaaggggggatgtttgtgttgcggttgataggaggagtcaagacacaaccagcggtttcaatacggagagagaggggagcaacgtcgagcagcaggatttcgttggtgaatttggaagaggtgtcaccagacaggatagccgcctgaacggcggcaccgtaggcaacggcttcgtcggggttgatggacttgttggcttccttgttgaagaagtcggcgacgagacgctggatcttggggatacgggtggaaccgccgacgaggacgatctcgtggacggaggacttgtcgagcttggcgtcacgcaggacacgctcaacaggctccatggtagagcggaagaggtcctggcagagctcctcgaaacgggcacgggtgatggaagtgtagaaatcgataccctcgaagagagagtcgatctcaatggaggtctgagcagcggaagagagggtacgcttggcacgctcgcaagcagtgcgcagacggcggagagcacgtgcgttggtggtgagatcctgtga

SEQ ID NO: 312 - DNA, 468 bp, A.fumigatus
  unsure (380): Identity of nucleotide sequences at the above locations are unknown.
acagggttagccactgtcaatagagataccataggaaagggatctacataccttcttgtgctttctcttgaattcattaacaaagtggttaacaagacggttgtcgaagtcctcaccacccaggtgagtgtcaccagcggtagccttgacctcgaagataccctcctcaatggtcaggagggaaacatcgaaagtaccaccaccaagatcgaagatcaggacgttacgctcgccctcggccttcttgtcaagaccgtaggcaatggcagcggcagtaggctcgttgatgatacggaggacgttcaagccggcgatgagaccagcatccttagtggcctgacgctgagaatctttgaattaggcggggaacgtgattacanccttgttgacagtgccaccgaagtaagcttctacggtctcacccctcctggtccaggaccatgggaagagatctcttccaggggttga

SEQ ID NO: 313 - DNA, 657 bp, A.fumigatus
ccattgaggagggtatcttcgaggtcaaggctaccgctggtgacactcacctgggtggtgaggacttcgacaaccgtcttgttaaccactttgttaatgaattcaagagaaagcacaagaaggtatgtagatccctttcctatggtatctctattgacagtggctaaccctgttcacaggatctcaccaccaacgcacgtgctctccgccgtctgcgcactgcttgcgagcgtgccaagcgtaccctctcttccgctgctcagacctccattgagatcgactctctcttcgagggtatcgatttctacacttccatcacccgtgcccgtttcgaggagctctgccaggacctcttccgctctaccatggagcctgttgagcgtgtcctgcgtgacgccaagctcgacaagtcctccgtccacgagatcgtcctcgtcggcggttccacccgtatccccaagatccagcgtctcgtcgccgacttcttcaacaaggaagccaacaagtccatcaaccccgacgaagccgttgcctacggtgccgccgttcaggcggctatcctgtctggtgacacctcttccaaattcaccaacgaaatcctgctgctcgacgttgctcccctctctctccgtattgaaaccgctggttgtgtcttga

SEQ ID NO: 314 - DNA, 351 bp, A.fumigatus
ttcaaagattctcagcgtcaggccactaaggatgctggtctcatcgccggcttgaacgtcctccgtatcatcaacgagcctactgccgctgccattgcctacggtcttgacaagaaggccgagggcgagcgtaacgtcctgatcttcgatcttggtggtggtactttcgatgtttccctcctgaccattgaggagggtatcttcgaggtcaaggctaccgctggtgacactcacctgggtggtgaggacttcgacaaccgtcttgttaaccactttgttaatgaattcaagagaaagcacaagaaggtatgtagatccctttcctatggtatctctattgacagtggctaa

SEQ ID NO: 315 - DNA, 528 bp, A.fumigatus
ccctgttcacaggatctcaccaccaacgcacgtgctctccgccgtctgcgcactgcttgcgagcgtgccaagcgtaccctctcttccgctgctcagacctccattgagatcgactctctcttcgagggtatcgatttctacacttccatcacccgtgcccgtttcgaggagctctgccaggacctcttccgctctaccatggagcctgttgagcgtgtcctgcgtgacgccaagctcgacaagtcctccgtccacgagatcgtcctcgtcggcggttccacccgtatccccaagatccagcgtctcgtcgccgacttcttcaacaaggaagccaacaagtccatcaaccccgacgaagccgttgcctacggtgccgccgttcaggcggctatcctgtctggtgacacctcttccaaattcaccaacgaaatcctgctgctcgacgttgctcccctctctctccgtattgaaaccgctggttgtgtcttgactcctcctatcaaccgcaacacaaacatccccccttaa

SEQ ID NO: 316 - DNA, 666 bp, A.fumigatus
  unsure (656),(657): Identity of nucleotide sequences at the above locations are unknown.
ccaaaacagatggccgaggaggtgcgcaatgcatctgtggcaatcccgagggctattctcctgtcggttctcattaatggagcgctcggatttggcatgttgattgctgtattgttctgtctgggtgatctcgacgcggccctcgcaactcccaccggatatccatatatggagattttccgccaggcaaccgattccctggcgggtgccctgggaatgacctcgattttattgatcattggcgtctgctcggtgattggaatgctcgccgctacatctcgtcagttctggtcttttgcgcgtgaccgggctgtgcctggatggcgcatctggagcaaggtatcatatcctcacccccatgcgctttcaaggaccatcactgacatgctgcctcgtcaggtctcccctaccaactgcctccccacgtactccatcatgctcacaatgaccgtatgctgtctactcggccttatcaacatcggctccagcgtcgccctcaacgccgtcgtctccatggccgtgtctggtctctatctctcctacctcatggtcggaagtcttcttctctaccggcgatgcacgggcgccatctcgcaatacgaccatggagaagacggggtcatcagtcttcaccgggggtggaaggcgttccaggnnacaatcact

SEQ ID NO: 317 - DNA, 507 bp, A.fumigatus
ggagaagacatgacaggtaggcatacaatcgaatcccccattggcactactaacctcatcgtcataggatgggttaccgtcatcggctggcaggccgcattcgcctcgtcctcgtttctcgcaggaactcagatccaaggcgccatccgcctcggtcacgaactttaccaggcgaagccctggcatggaacccttctcatgtgggcggcagtcctgctggcgttgggcatcaacgtggtcggaggcaagctgctcccccggcttgagacggtcatcctggtggttcatctgctgggcttctttgccattctcatcccgatgacctacatggccgaccacaagtccacccacgaggtattcctcgaatttgtcaacagtggcggatttcccactcagggtctctcgtggttcgtgggaatgacaggctgcgttttcgcctttgctggtggcgatgctgctgtgcatgtatggaactctcttcggaccccccttcagaagattggatga

SEQ ID NO: 318 - DNA, 798 bp, A.fumigatus
agacgcattgacaaaacttccattcactgtttcctgttacgaaatcctcgtcttcaatacatcaatgtctctggattatcgactgtgaccaactccgccatgaagattatcgcccagaaatgcccgcatttagagattcttaatatctcgtggtgcactggagtcaacacgaccggcttgaggaaagttatccaggcctgcccgagattgaaagatttgcgggctagtgaaatcagtggttttcacgatgaagaatttacccttgagttattcaggaggaacaccttggaaaggttaatcatcagccgtaccgatctgacggacgacagcctcaaggttctcatgcatggtattgacccggaaattgatgtgcttacggaccggccaatcgtcccaccccggcgtctcaaacatctggacgtgcaccagtgcccagaattgacagatgttggagtaaagagtctggcccacaacgttcctgagctcgaaggccttcagctttctcaatgcccgcagttgagcgacgattcagtcatcgatgtcatccgcacgactcctttgttaactcatcttgagcttgaagacttggaacagctcaccaacaacactctagttgaacttgccaggtgtccgggtgccgaacgtcttgaacacctcaatatcatctattgcgagagcctaggtgacgttggaatgcttcacgtgatgaagagctgccccaacattccgttcgtggagatgggatatactcggatccctgatctcactttgaaggaagccattttccgcgtccgttaa

SEQ ID NO: 319 - DNA, 225 bp, A.fumigatus
tatataaggagtttctataaagataaaaccagttccctaaagttcttcttgtttgcatggtctataagaatcatatcttcttctctaaaacataatattaccctgattggtgctggtactataggaatatccctggcagctctttatctagcccacctttattctctagaaagcctcactattatagatatatggcctgacctggccgcagttgttgaagattag

SEQ ID NO: 320 - DNA, 255 bp, A.fumigatus
cgcggatgtcgccctcgtgtgaagacagatgattcggttgctgcacagatatacaaattcaacgctgtggacatgtgcgagctcgcaaaacattcagtcgagcaaagcggttttgaactgtcattgaagaagagatggcttggtgcgaactgttctctccgtggggtcgcaggaaataatgtcgcaaaaagcaatgtgccagacatccgggagcaattcagacatgaaactttacttggggaacttgccttgtaa

SEQ ID NO: 321 - DNA, 192 bp, A.fumigatus
gggcgtgtgctgatattagtcaattctaaacagtatgctattcggcctacaataaggggcaacaataaattcaacagggatagtgtgatcaaaacaattgcagatgtcgtaggccccgaacatccagttgatctcaagaattacgatttgatcatccttgtccatcttatccaggtgagttgccttatatga

SEQ ID NO: 322 - DNA, 213 bp, A.fumigatus
tggaatgatacacagcatcatctatcgggccagccttcatataaggcaactcacctggataagatggacaaggatgatcaaatcgtaattcttgagatcaactggatgttcggggcctacgacatctgcaattgttttgatcacactatccctgttgaatttattgttgccccttattgtaggccgaatagcatactgtttagaattgactaa

SEQ ID NO: 323 - DNA, 954 bp, A.fumigatus
ggtgagactgtcatttctgctcagtcccttgagaatgctaaacaagacaaggtcgatgtgtgggcatatggctgcactctcttcgaattcgcaacgggaaaccccccaaactccaatttacgggagcggatgcaaattggaaggcaactcaaccgtaccacaccgcgtcttgcaaatgaagattacagtgaaggccttaaagacctagtatcattcgctctcgagtcggaccccatattgcgcccgacaatggcagacatcatgtcacattcgtatattgctgaaacagacgagcagtatccgacttcttcacttagcgagttggtgcgcatctactatcaatggtctcagcggggagggcagagaatttcgttattccatccgggaggtgctgccgccgcggaatttcccgattatgagccagattttgaagaagactggaacttcagtacaacagatggctttgaacggagattttccgtcattgatctggatcggatagcggcctcgttggccgagctagaagaggagatgagtccagcgacaacaaatcagcaggaccgcgattccttcgatgagcctgcgggacccgaaatgtccatggaagacaaggccaatttcgacgagcgtgtccgccgaggcgctgcggcaatggaggggctattcaacgaggacatgccgagttacaagtacgaaacgaagaacgattttgtgcccatcgagcccaagcccccagcgtctgatctgcctcttcgcacggagacagatcggtcttccgtgacgtctacatttattgacattgacatcggctcattcgactcgtcgcattatgctgctggagctgcatcggcacagccgttccaacttgcagacgcggatacgattagggccaatagatccgctggtcgacagcaacacaagtcttcaccacggggctggaaggagcagcgacat

SEQ ID NO: 324 - DNA, 540 bp, A.fumigatus
gagcaactggtgataagcttgaggaaaggttcatcatccccatcgcacgagagttggctgctggcttgcgtgcgattcacgaggctggtatcatccatcgggacattaagggtatgtagcttcggctgccggaatttaactcaacttctgacgccattggtagctgcaaacattttgattcacgaggaaggccggcttcagatctgcgatttcggtgttgcgggagtactccagtcgcacgtagacaagcgatcaacctggattgggacgccgcactggatgccaccagagatgttctcaactcgaggcgaagctcacaaatatggaagtgaggtgagactgtcatttctgctcagtcccttgagaatgctaaacaagacaaggtcgatgtgtgggcatatggctgcactctcttcgaattcgcaacgggaaaccccccaaactccaatttacgggagcggatgcaaattggaaggcaactcaaccgtaccacaccgcgtcttgcaaatgaagattacagtgaaggccttaaagacctag

SEQ ID NO: 325 - DNA, 777 bp, A.fumigatus
ataaccccgcgggaatctttcgaaatgcgcgtcaggttgccacgaacccgatatggggtgtctttagtgttcaggtgtgttgtttgcattgggtcttcagcatctcacgttgaccagactcagcaggtagcgattggaaacggcgccctggaggagtcacagggtaaagccatggtcgacgaggccttgaaacggaacgtcaagttctttgtgtacacctccgtcgaccggggcggggagtcatcgaccacgaacccaacacgcatcccgcacttcatccacaagcacaacatcgagcagcacctgatggaaaaggccaggaacaccgagatgaggtggtttatactgcgtccaaccgcgttcttcgacaaccttgtccccggattcttcggcaaggtctttgcgacttgtttcaagatggcgcttaaggggaaaccgttgcagatggtggccaccagcgacattgggtactttggcgcggaaggattcctccgcccggacacatacgcgggcagaggtctctcactggcgggcgatgagttgacctatgaccagatggtggagattttcgagcagaagaccgggcagcagattccgtccacttttcggccgctttgttcgttcttcatggcgtccatgaaggatatgggatatctgttcaagtggttccatgatgcaagatacaatgcggacatccctgagctgaaaaggattaaccccaacctgaaagactttggggcgtggttggacgaggagagtgagttcaggaagcgctaa

SEQ ID NO: 326 - DNA, 192 bp, A.fumigatus
gccgtccccaaaactgccgaagtaattaagggcaatggaccatacctaacccaattggcttgtcaccccgaattctatcctgaaatactgtcctgggtggaccccccccctagctgcatcgatggtgcctttagacatcagccctgttcaaggccgggtatactatcggaacccatcgcctccaaaagctga

SEQ ID NO: 327 - DNA, 531 bp, A.fumigatus
aaattgggtatccttggtttctcccgcgctctggccattgaaggtgccaagtacaacatcaaggtcaacaccattgcgcctaacgcgggcaccaacatgacccgtaccatcatgcccgaggagatggttcaggccttcaagcccgattatgttgctccgatggttgcccttctctgctctgacatgtgcccggagcccagcagcaagggtctctacgagtgcggcagcggatggttctccagcactcgctggcagcgctctggcggccatggattccctgtggatgtgaagctgactcctgaaactgttctcaagaactggaagcagatcactgacttcgatgatggtcgtgctgaccacccccaggacagccaggctggtactgagaaggtgatggccaacatgtccaaccgcagtggtggtgaaggtggcaacaacatcctcgccaacattgagaaggccaagcaggccaccactgagggcaccgctttcgactgtcttcaccacggggctggaaggagccgcgccaca

SEQ ID NO: 328 - DNA, 291 bp, A.fumigatus
caaggccttcaccaacatgaacgaatgatctctggaacggctgttatcaacgttcatctgcgtggtacctataaggtgaccaaggctgcctggccccacatgctcaaacagaagtacggtcgtattgtcaacaccactagcaccagcggtatctacggcaacttcggacaggccaactatgctgccgcggtaagacctcgaattcgatcatgctcactggaaccgtatgggtttgctaatcgtggtctagaaattgggtatccttggtttctcccgcgctctggccattga

SEQ ID NO: 329 - DNA, 303 bp, A.fumigatus
cgctcccatcaactgaccgctcgaggcaaagatgacctcttaatcgacgcagttgccgagaatatgcagcagtggacccgacttcaagggacactagaggaacagctcagccaggcgcgtcactttgtctcacaataccaacgctacagcgaaactcgtcggttcagtgagcaaatgcatcaaaccatcgacgccgcggagcgagacatccaaaatcaagtggataaactagaacagaccatgcgagatctcttacagatagcaagttatatcaccccctttcacgtccagcatcagaactga

SEQ ID NO: 330 - DNA, 534 bp, A.fumigatus
atccgtctgtgtcacagggcatcgatggggacggtggcggtcgcacatactgtgtggctgttcgtacttgcgcggttgctccagggcggtgcgacagccatggtggccgtcgcgggtcttgcactcatgaccgactcggtctcgttcgataacctgggccagacgatcgggtatctgggatcgtcgatcgcgctgggcttcctccttggtccattgcttggcggactagtctacaatgcagccgggtacaatgcggtgtttgccatggcgtttgcgattatcggcgtcgacttcgtgatgagagtggccgtgatcgagaagaaggtagctcgcgcgtatttgtcggattcgcctgaggagaatccacgtgaggaatacccgcagcgcccaccacaaatttcggaaactgcaacggggtggaggaacattgctctgttgcgcatagccagccagccacgggtagtgatctcgtcgttcgccctactcgtccagggcatcttatattccgcctttgactcggtacgctcttcatag

SEQ ID NO: 331 - DNA, 432 bp, A.fumigatus
  unsure (336): Identity of nucleotide sequences at the above locations are unknown.
ttcttagcatgcaggacgatcaacaacctagcctacctcgttcccatcctcaccaacgtccttgtggggcgccggacaatgcaccacggtccgttttacctgggtcatgcgcccggtatggctgtgaacatcattaccgttgcatggctggtgttcgccattgtgtttttctcctttccgtattatatgccagtcactggtgagtgcaaacttgtggataagaagctggtggcgtcggcgaaggctgacaggctggacagcggcgaatatgaattacacttgtgtctgtgttggtggattcctgctcatcgcgttgctctggtgggttgttgcggnggacaagtactcgaagaatatgcagaaggcgcgcgaggaggagcaaaatgctgctcgtgctatgatggttactcacgagggaaaagagtaggatga

SEQ ID NO: 332 - DNA, 255 bp, A.fumigatus
gtaccggtcgagttttctgggctttcgctcgagacggcggcctccctttttcgagaatgtaagcagctttccaacgctagtcatttcgtactacgaaacccacctaacatgcagtctagctgggcaaaagtcaacccccacttcgaaaccccatttaacgcccagctatgcgtgggcattatcactgccctgctgggctgtatctatctcggttctagcaccgccttcaacgccatgatgagctccgcagtgtaa

SEQ ID NO: 333 - DNA, 606 bp, A.fumigatus
tccagcctcgtaggcatatacgaaaagcaaagcactcccgggccggcctactctagtttagatatccaagattctgtccatcagtcatcctcgacacacaagaggcattcaagcctcaagccgtcggaatggtcgcaccagcgactgagcgaaaacaaagcagtcgattcggaaagcgatgatgaaagcgacggcgaatggaaagacatgcccgccctaggcgaattcgacgtctacgacgattatgggcgattgattgctcgtggcgccaaagaagagggcgacgacgcagtttatcagggcctgggtggcgctggaaagggatatactcgagtacaactcgacgaagacgcgcagtccgcgacaagtttggatcaggacaccagctatctcttcaaggaaactgccggcaactctgtaggagtagaaggagaagagctgcgcgacccgctcagtcaactacaggctacaaaagatcttctgaccgagagtcaaaggatcgcttatgtcggagtgacgcggctgatgatctaccagatgacccaggacttggaaaagctaccaacgactaaggcttctcgcaaggcgaaacagaaagcggccgac

SEQ ID NO: 334 - DNA, 627 bp, A.fumigatus
aatctgggcaatatgcatatccttccaggatcccaacatgcggcagagttggacaacagtggaactctaatacactctgtccattgcgatccagaacagaaagccaagaatatcccgcaatcgacgggtatagctcaagcgagctctgaatggcgaccgtcataccatcttgctgcgccccgggggtggatgaatgacccctgtgggcttgggtatgacccgacgactggactgtaccacctgtccttccaatggaacccgcatgggaatgactggggcaacatctcctggggccatgccacctccagcgatctagtgtcctggcaaatatcccccgaaccatgtctcacgccgtctgcggagtatgatcgatgcggcgtgttcactggctgcttccgttctcatggtccagatggcaagccaggtgtactaacgtatgtatacacatccgtaaatcaccttccactccactatactctgccgtatgtcaagggcagtgaatcgctcagtatagctgtctcccgtgaccatggcaagacctggcaacgaatcgacagtaatccgattcaccccggcgcccctgcaggactcgaggtgacaggctggagagacccttatctgaactga

SEQ ID NO: 335 - DNA, 231 bp, A.fumigatus
ccgggttcgaaagcccttggcgacatcacggcaggcgagaataatggtatggcatccaaggcccatgagctggcggcatgtttcgaggccgagccctgctgttggtccggtgacgataacagtctgaccggtgagtctgaaatgcaatggggttggcgtcacgggggggttggaagaatcgcattttgtcaggtttgtggatctttcacagatgaactgataatggcttaa

SEQ ID NO: 336 - DNA, 708 bp, A.fumigatus
ataggcgcacttcccgactcagtctgtatggatccttccttaagccattatcagttcatctgtgaaagatccacaaacctgacaaaatgcgattcttccaacccccccgtgacgccaaccccattgcatttcagactcaccggtcagactgttatcgtcaccggaccaacagcagggctcggcctcgaaacatgccgccagctcatgggccttggatgccataccattattctcgcctgccgtgatgtcgccaagggctttcgaacccggtcaaccctcctctcggagtatgtgacccgggcagccatgcatggtagcccgtccgtgaaggtactgaagcttgacctgggcagtttcgacagtgttttattatttgcatcccaggtgaagagcgagatcccagttgtggatatcttgatattaaacgcgggggttggatttctgaaggacttccgctctaccccggacggccacgaattgactctgcagactaattatctctccaatgtgctgctcctcctggaactcctcccctatctgcagcagtccgcacggggccgccagcccgccagggtcacctggctcgggagtcgatctgcgtacgactccaacctcgttcgcatggtcgctccgcactcggaccttttcggggtatctggacgagtgtcttcaccacgggctggagatccgcgactgggtgatccgcaa

SEQ ID NO: 337 - DNA, 366 bp, A.fumigatus
tatttatttcatactaccacagtatccatcttgattctttctccagttatccacgaccagatcttggggatgccgtctgggcccaggaagcgcatgccaagtgtaagtgatgactgcaacaacagtgaaagcttccagcagaagaaagcaaaaaaagaagcatcaataagttcatcacctcacaacatgcataacgcagtgaactggaaaattgatgcaaatggagacaaattctgggagctttctaaaatgcgtcgggtcactatctcctcctttcgagggaagacactcgtcaatattagagagtattacgagaaggatgggcaagagctccccgggaaaaaggtaattatgagatcgacatga

SEQ ID NO: 338 - DNA, 696 bp, A.fumigatus
gacgaggttatacccgaagaacagtggcttatggccgtggatgccgatgatgacacgatcgagaatgctatcgcccgaaaggaagcgagagtcgagcgtcgccgcttgaataaggagaagcgtcagaaaagagccatgggcattgagtcatcgccagagccatcgcgcgaaagttcggagaccccgcagcccaagaagcgtggtcgtaggggtcctgcgcctaaacgcaaggcggaggagcccgttgaggaaaccccgcaaccgaagcgcaagagaggcagacaaccgaaacctgtggaaaccttgagtagcgaggaccgcgccacgctccagcggatcctcaacaccgcataccaggcgctgatggatatggagcaagagctgccagcggattcatccgacagcgaggacgggccggttacgcgctcgatcatcgagccattcatgaagccacctcctaaatcacaatatcccgactattacctgattattcaaaacccgatcgccatggagatgatcaggaagaagataaaccgcgaggaatatcagaatctaaaagacttccgaaatgacatccacctcctgtgtcagaacgccaggacctacaatgaagatggaagcatcctgttccaggatgccaacgatattgaagtaagtttttcctctgtcactttacttgtttttttgctttcatag

SEQ ID NO: 339 - DNA, 615 bp, A.fumigatus
tacttcagagctacagtcgcatccttccagccccgtggtgaagactcgtcggcgggcaattcggacttcttaacagcggcaacaggttcttcaatttctccctttacctcagatacttcctcaggaactgcttcctcggtagcagtagcttcggtgggctcgttgatggccacctctcccttagcttgctctccggtggtcgtgatgggttcttgggtcgattcaaccgtggccggctctttagctacagcttcagtttcgggagattcgctcacaggttcaggaacgaccgtctcaggagccggtgcctctagcgtctcgggagcagcaggagcttcgcccttggacttagcagcctttttgtcgcttgcctcaacctcagactcctttgcgagttcccgggtaacggggtgttcctcaaaccctggctctttagtctcggtcactaccgcaggcttttcgctcgactcagcctcatcaaccgcagaagttttagcagtaccttctgagactactggttcgctcacttccgatggtttgggggccgcttcagcaacagactcctgggtgaccggcttgtcctcagtcagagtttcagtcgccagatcatcctga

SEQ ID NO: 340 - DNA, 852 bp, A.fumigatus
gaaaacttcctgttgaggaggacttcttccgcaatatccggaaggcaccaacggaaagagtcccattatgccagaggaaggcgggtaaggaaccgaggcagcgaggaaacgccgtgtcaaactcttccttgccgtggagccttcccaagaaagccacagttgaagagcttgcaaaagaagagtccccaatttaacaagtgtcagaacctttcgaagcagacgttaagggaacatgctcaggatgatctggcgactgaaactctgactgaggacaagccggtcacccaggagtctgttgctgaagcggcccccaaaccatcggaagtgagcgaaccagtagtctcagaaggtactgctaaaacttctgcggttgatgaggctgagtcgagcgaaaagcctgcggtagtgaccgagactaaagagccagggtttgaggaacaccccgttacccgggaactcgcaaaggagtctgaggttgaggcaagcgacaaaaaggctgctaagtccaagggcgaagctcctgctgctcccgagacgctagaggcaccggctcctgagacggtcgttcctgaacctgtgagcgaatctcccgaaactgaagctgtagctaaagagccggccacggttgaatcgacccaagaacccatcacgaccaccggagagcaagctaagggagaggtggccatcaacgagcccaccgaagctactgctaccgaggaagcagttcctgaggaagtatctgaggtaaagggagaaattgaagaacctgttgccgctgttaagaagtccgaattgcccgccgacgagtcttcaccacggggctggaaggatgcgactgtagctctgaagtaa

SEQ ID NO: 341 - DNA, 738 bp, A.fumigatus
agcggtcaagcggtgcgcatggctatttccatgaatctaggcacactcgcaggcatgagtcactctgacgagctgcggcaagggaaagctgttatcctcggctgcttcgtcgtcgattctttactttcctttcgaatagcacggagaccttgcatgcaccctcgagatctgactggtgtcgggttgctggaagaagacgggctggaagaatggaattcgtgggctgacgttctgccctccacaggaacagctcggggaaggacacctcgacgcggaccccttcttactcttagctgcttcaaccggttggtggagctggctagtgttttgaacagaattgctcgtgacgcagtcggtctgcctaatgttcatacgtttgcgcaacaattggtgctcgaactgaaacaatgggacgatcgcctgccccttggatgccgtctcattgggcctgagagtatctatcctgagcgccactcgtctgtactccctcatcagagctatcttgggttgacgtatgttgctacactattatggttgtatttgcgtatcgttccccaggagctcgatctgcatcgctcgcagcggcctgccatcgagggcgcgaagaagctattattccgcgccctgcctatgattacccaacatctggaaaatttccctacgtgcacccttccccctatctttgattttcttcacgcacaatcggtcttcaccaacggggcctggaaggatccgcga

SEQ ID NO: 342 - DNA, 321 bp, A.fumigatus
cctcacatctacaacatgtccggttacaacggccgccgtgcgcccaacttctctcaatacctcgaggatttgaatgccattccctcgccgtacgaccaggccttgcagcagcaacagagacaagatactttcaacctcgatgctgaactctcattgttcacaaataccgagttcttcgatttcgacaatctcggagacctcaacctgccttcgtttgatgccgtgaatgaagacagtgcaaagacaacggaccagcagcatggaggacctgctgcccacaatcccgatatggagtttctggatcttctagggggtgagtga

SEQ ID NO: 343 - DNA, 747 bp, A.fumigatus
cgtcggcctcagcaagaacctctcgctcattatcggaggctgcgtacaaatcatgttcgtcatcggcagcttcttccctaccttcttcgtggaccgtgtcggccgtcgggtccccatgatgtggggctcctttggcttagggctctgtatgatgatggtatccattctcctgagcttcaagggaaaggcaaacgagcatgcaacgtcctcagcctccgttgcgttcttctttctctacatgctcatcttcggcgcatctgtcaactgcatcccttgggtctacgtgccggagatcctgcctcttcacgccagagcgaaaggaaccgccgtggggatttcttcgaactggatctgggtgagttgagtgtcttgccttttgagcgtcggttgctgatcatctgcgtgcagaatttcttcgttgtcatgatcacacccatcatcatcaaccggctgcagtggaaggcttacttgatattcatgtgcacgaactttgccttcgtgccgttggtatatttctgctatcctgaaacagccaatttgacgctggaggagatcgattatctcttcaccaatccacagaaaacagccgtcaaaatttcgaatgaacttcacaaggagggaaagaggcatgggcatacaagccttgctcacatcaatgcacggggacgcgatagatcagtgattgaagacactcaggagaaggctcctgccattcaagctcctggcgaacatcttgagaatgtttag

SEQ ID NO: 344 - DNA, 468 bp, A.fumigatus
gacggcatcaatcttgtagtgtatggagtgcttgcgaaactgttatctcgtcccgtcactgacaaagaccgtagctacttcatacccacagttctcaacagtaacgtcggcctcagcaagaacctctcgctcattatcggaggctgcgtacaaatcatgttcgtcatcggcagcttcttccctaccttcttcgtggaccgtgtcggccgtcgggtccccatgatgtggggctcctttggcttagggctctgtatgatgatggtatccattctcctgagcttcaagggaaaggcaaacgagcatgcaacgtcctcagcctccgttgcgttcttctttctctacatgctcatcttcggcgcatctgtcaactgcatcccttgggtctacgtgccggagatcctgcctcttcacgccagagcgaaaggaaccgccgtggggatttcttcgaactggatctgggtgagttga

SEQ ID NO: 345 - DNA, 201 bp, A.fumigatus
cgaacgcgtgacctttcagctcccgtggtggacacccaaaatatgcacattgcaaaccaagactggtttgtcggaattgtcgctattgcatatgactctgtaaatggacttggagagtgctcagcgctgcccctggtaattgaagataacactggttccagttacgtacaaagtgccagatggggttacgaactacgctaa

SEQ ID NO: 346 - DNA, 1080 bp, A.fumigatus
  unsure (1029): Identity of nucleotide sequences at the above locations are unknown.
ttgggcttcctgtccgtaatcgaagttctgctccagcagaatgggcagccgacacgcaccattgttctcgccttcgggtttgacgagaagtctcatggcttcctcggcgctggttcgctttcctctgctctaaaaaagaagtacggccccgacagcttcgagtttatcctagacgagggcggcatgggtctcgaatctctgggcgatgacgtggtatacgcgcttcctggcgtaggagagaaaggcagcatcgatattgtgctctcgctcgacgtcgcgggcggacacagctccatcccaccccctcacacagggatcggcatcatggccgagatcatctacgagctcgagcgacaggccctcttcgtccctgtactgacagatgaccacccctcccgccgcatgctcgaatgccaggctcgctactcccctaaccacgtcgaaccctggcttgcctccggccttcagtcatccgaccacgtcgcgctagccgagaaactggcatcctcccgcggcgacgccttccgatacatcctgcaaacctcgcaggccgctgacatcttcaacggcggcatcaaggcaaacgctctacccgagaagatctccgcgctcgtcaactaccgcatcgccctccatcaaaccccagaactcatcaagcagcgcgccattgacatcatcgcccccatcgctgacaagcacaatttgttatggaccgcctttccagaaacgaccgccgccactgcccataagccagctgtcaataatcaactcactttgacgaccctcagcacgcctcttgtccctgctcccgtgagtcctaccaatatcgacaccgacgccgtctgggctcgcttcgctggtgtcgcgcgcacctccttcgagtccgtgcccagcttgaagggcaagacagtggtggtcagcggcgacatcatgacgggaaataccgacactaggttttactgggccctgtcgcgaaacatctaccgctggagtccgtctcgcaggggccgtagcctgaacatccatacngtggacgagcgagtagctattgatgtacatctcgaggcaatggttctataa

SEQ ID NO: 347 - DNA, 183 bp, A.fumigatus
caggaccaaagctggctcacggccttcatctttgccgcgcaagactacaacgagcagaactgctacttcaactctcccccgttcgtcggctgcagcaagaaaaaggctaatgaggcattcattttctgggctttgtatgttcctcgcctcttggttgcctcatggtttttcccacagtggtag

SEQ ID NO: 348 - DNA, 213 bp, A.fumigatus
gactgctcctatttatccatcgatataaaacccatatcacaactccccgttctctataccggaaaagatacaactacagccgtcacaatgagcgatttcccaaccgcattccgcgcagcccaaatcctaggcttgacaggcgccgcctggctctcaggtctttccatcgccccactctcaaacatcacctaccaaacactgacactgatatga

SEQ ID NO: 349 - DNA, 297 bp, A.fumigatus
gatcaaggcatcgcagcgacagccgcaaccaccgccccaaccaaggggaacgcgcccctcacagcattcaacacgccccatctctccataagcgactcgacctccgtcctcgtcgcctcactgtcatccttagaccccactttcgcctccagcgaccgattcgtccccatcataaacgcaaacgtatacggaacaatccccacggtcaacaaccccgacacagcatacaggaaactactgttcggcgctgcaaccagcgacaacgccgttccatcacggacagaccaggacaggtag

SEQ ID NO: 350 - DNA, 1275 bp, A.fumigatus
  unsure (120),(241),(330),(1013): Identity of nucleotide sequences at the above locations are unknown.
tggtggtgggccaagttcaccacaagcaaaagcccaagctttttggttggaagcactggtaccggaagctctttgttcggggcccaactccaactgttcaacccaagggttcttggctcnttcggcaacaatcagggccaccaacacaagattggcctcggcacgagtagcttttccggtacaacccagcaggcacagccactgcacagcaagcaggcacagcagcctgttcctgaagccntgcaggcttctttgctcgatggcaatccgtatggcaaccagtccatcttctctggcttgccagctcctagtgctccaagccctggcccnctggccacaccactctcttcgtcgatcaagcaaaagcagcgcactccactgcccgtctacaagattactccaactgcggcgaatcgtcttatcacacccccaaagcgccagggatacggattttcctactccacttacggatcaccctccagcactactagcacccctactggcctgggcagcagtctcttgggcggcagccttcgcggaagtgttggtggcagccttggacggggtagctttagcaagagcttttcaacaagcaacctgcgcaagaccttcgacccggagaccgacagtgtcttgtcccccggtgcactttctggtacttctcgcttgtccagtggaagcctgaagcgcttgaccatcgatcggtccttgcgcaacgacctgtttgcacgtcccgcaagcacccccgcagctcctatcactaatggcgaggatgctactcagacgaccgacaaactgaagaagcgagtgagcttcgatgcttcatcttcaaaggctcctgaagcaaccactggtggagaaatcgttcctgttgcatccgagagcccggaacctaccccggaggagcttggattcttgcgctcgattcgcaagcctggaagcgtcaacggaattaacggcgtaaaggcgtctactgacatggttgcccgtccggagatggaatctgttcgtancaaagatctgcccgttgttccagaagactctgagcatgctgccaccgaccgctccaacaaaattcccttcgttcctggcagtgaccccaaacctggcgagtattggatgaaaccatcccgtgccgagctcagtaagatgagccctgaagacctcaagcatgttgttggcttcactgttggccgtcaacgttgtggtcaggtaacttttgatgagcctgtcgatctgacgaccatcgaactggaccagattttccgtgggctt

SEQ ID NO: 351 - DNA, 465 bp, A.fumigatus
cttcagaacctcgacgccctctcgaaccttcgcatcatctccatccagtcgaatcgtctgaccagcattactggcctctcctcgctcaagaacctcgaagagctctacctatctcataacgccatcaccgacctcagtggactcgagtccaatacctcgttgcgcgtcctggatttctccaacaataaaatttcgaagctggaacacatctcccatctgaagaacctggaagagctgtgggcatccaacaacgaattgtcgagtttcgaggaggtggagcgcgagttgagggataaagagaagctgcagacggtgtattttgaagggaacccattgcaaaccaaggggccggcggtgtatcgaaacaaggtgcggttggcactgccgcaaatcatgcagattgatgcgagtaagttcagtttcttcgctggtcgggctctcggatgggttgctgacgatatctag

SEQ ID NO: 352 - DNA, 198 bp, A.fumigatus
atgtccctctgggagcggatccacacgctgggcggcctcaccgccgaactcagggaaacagactggtccacgggtgagcagcagttacactgtctgaggcaggtgctgctccgcaaaagccggaccctgttgctggacgaggccaccagcaggtttggtgcccatcccatctctggtcgttttagacttgactgctga

SEQ ID NO: 353 - DNA, 285 bp, A.fumigatus
gttccttgtctctacattttttttgtcgtcagtgtatgcctgacacttgccatagtcaacacattctggtgttatttgatgcctattctgggtgcttacattgccgacgagttctggggacggctgaagacgattcaggtttccatcgccttcgcgatggttggacacataattctgattatttccgccttgccatctgttatcgctcatccacatggcgctctgggatgcttcgccgtcggtttggtcatctttggaattggtgtcggaggtttcaagtactga

SEQ ID NO: 354 - DNA, 480 bp, A.fumigatus
cacgtatgcaacaggtcaaacattgcccctctgatagctgaacagcacaaggaaacaaggtccttcatcaaggtgatacccaagacaggcgagcgtgtcattgtggaccctgctcagacgatcactcggattttcctgtacttctatttcatgattaacgtcggcgccttggtaggctcaatcgccatggtgtatgccgagaaatacgtgggattctggcttgcatttcttctcccaaccatcatgtttgcgttctgccctgctgtgatctttgcatgccgcaacaagtacgaggtcacacccgctaccggctcggtttccgcgaaagcattcaagctctgggcttttgctctccaaggccgctggtcgtggaatccagtgcgattgttagtgctcctcactccatgtcgagttttcttcgtactgactccccttgtagcgtgcggaattgccagtctcctgacttctgggagagagtga

SEQ ID NO: 355 - DNA, 201 bp, A.fumigatus
catttgatgaccaatgggtcgatgaagtacgcagagctgtcaaagcgtgtgctgtctttctctggtatcctgtctactgtatgtgtccatatcacaaacgtcgtgaacaaaacttaccgagatgatagggttggcctatgggcagatgaccaacaatctgacctcgcaggcagccacaatgcagctgaacggtgtccctaa

SEQ ID NO: 356 - DNA, 483 bp, A.fumigatus
cgtcggcgccttggtaggctcaatcgccatggtgtatgccgagaaatacgtgggattctggcttgcatttcttctcccaaccatcatgtttgcgttctgccctgctgtgatctttgcatgccgcaacaagtacgaggtcacacccgctaccggctcggtttccgcgaaagcattcaagctctgggcttttgctctccaaggccgctggtcgtggaatccagtgcgattgttagtgctcctcactccatgtcgagttttcttcgtactgactccccttgtagcgtgcggaattgccagtctcctgacttctgggagagagtgaagcccagcagggttcaaaataagccagagtggatgacatttgatgaccaatgggtcgatgaagtacgcagagctgtcaaagcgtgtgctgtctttctctggtatcctgtctactgtatgtgtccatatcacaaacgtcgtgaacaaaacttaccgagatga

SEQ ID NO: 357 - DNA, 282 bp, A.fumigatus
cgtcacgcagatttcccatgggcgtccctgggggatgccctggtagttgatgtcgggggaggcgttggcggatttcccctgcaactgagcaaggtatacccccagctgcggttcattgtgcaggaccgtggtccggtcgtcaagcaggggctggagaaggtctggccccgggagaaccctgaggccttgcatcagggacgagtgcagttcgtcgagcatagcttcttcgatacaaaccccactgagggcgccgacatttactttctgcgatatgtcctgtaa

SEQ ID NO: 358 - DNA, 183 bp, A.fumigatus
caagtcctttcatgctcatgcaagttgatcaatgtaacgcaatcactcctccttcactcctccatgcagatcactccgcatcctgtggcggatctagaccagtcctatccagctcctaccaagaaggaaatgcacttttgcttcctggttcggtcgccgtctcgccgtccaacaggggtctga

SEQ ID NO: 359 - DNA, 849 bp, A.fumigatus
gagcgtggtaccttccagccgcggggtgaagaccctcctctactcgattatcctagctctcgttctcggctggcagaattggggcatgacggaatacgctgccatcattgggggcccagtcctgtacgaaaatgtcccaagatcacctcgagtccttgtatcacgtctgactggaacaggatctacgttgtccgagccgtagctagcaagttcttcgactaccgtatcaacaagacccagcgacacctcgaagatctacagaaacagcgggacgagaccatcgagaagctcaaggtcgcaacaaaatataactcgactcaacagctgctggaaaagtatggcgcggagtcacccaagccctcgcgtcccaagggtggtgacgagaaacgcaagacggacgccaaacgcaagcagccttctaccccgcaacaacccgtcatgagaaccgggcttcctcccccaccgaccgccaacatccgacgaccaactccggctcaatcgccagtgtcttcgcccggccagcctcagtctccgccatcatacctcatccaagaacagccacaactgcagaactcacacccaccagtccctcctgcacttgacgagcccggatttgcacccaacgcgtttccaagcgccccgcagtatgtcgagcactcctcactggtacgaccgtttgctagacatcctactcggcgaggacgagaccccccccatgaaccggatggcgttgatatgcgccacctgccgactcgtcaacggggaagccccgccgggggtcaagaccctgggattacctgggccgctggcggtgttggcacctgccggggcatgggaagggggaaatag

SEQ ID NO: 360 - DNA, 201 bp, A.fumigatus
agcgtggtaccttccagccgcggggtgaagaccctcctctactcgattatcctagctctcgttctcggctggcagaattggggcatgacggaatacgctgccatcattgggggcccagtcctgtacgaaaatgtcccaagatcacctcgagtccttgtatcacgtctgactggaacaggatctacgttgtccgagccgtag

SEQ ID NO: 361 - DNA, 741 bp, A.fumigatus
atagcgcgtgattttcgactcctgtcggacacttatgaaagagacccaaggaggtcacaggaggaattgaagctggattacatcgtcacgggttcatggtcgttgaaggcagcacaggaggctacccgtctggtgggtgccaaacatgtgaacattgcgctggatgccagaaccgcgagcaacgggaagtttggcaagatccctgcagaggatacctggactctctcgcccagtaagaactcggcgtttgtttacttctgtgacaatgagacggtggacggtgtagaattccccaacttccccaagatcctggagtcggacgaccgaatcgtcgtcgcagacatgagctccaacttcctcagccgaaatgttgatgttaaaaagtattctgtgatcttcgtacgtattcttccctgtgacgaagtttggttttcaagtctccgagctaatggacagcagggtggtgcccaaaagaacattggtatcgctggtatttccatcgtcatcatcagaaaatcgctcttgcctccccagacccctacaccggcaccggctcttctacatcggttgaacattggcggattaccggggagcgtcgtactcgactacgcgaccatcgcgaagaataactccctgtacaacacactccccatcttcaacctgtggattgccggccaggtcatggccgaactcgtccagacttatggtgtgcagaagatcagcggtcaccaacagatctcc

SEQ ID NO: 362 - DNA, 456 bp, A.fumigatus
gtctcggcgttggtgggccaccaggagaccaacagtgtctacttaggtggatacttcaaatacgagaacacatcgaacgcggtcgcttggattggaggtgaaggctggaagacactgcccttcgatgggctcaatgggccggtggaatccatcctgaagaatgacgatggccatgtaattttcgctggatcattcgatggcgtcggcaactccacgtcgtccaagaagaaggagcagattgtcaacctccaggatgccacaattacctccgatgccgtctcatcgagatcaggctacagtgacccgaggaatgttatctgccaaaccagtggcgcggatggcgaaggcaagacatggttgcttgctgatacctcgccaggcttctggcgagcagatatgggttttcaatacagaccaactaaactccgtctgtacaatacccatttcgagggctga

SEQ ID NO: 363 - DNA, 261 bp, A.fumigatus
ggcaccaaaaccttcctgttcagaaggcttccggacaatggcatcatgaatttcacatacacagatcctgacactggctacgacgttcattgcgactctacttgccccctgtccgaccgcgcagacgagaaatatcgtgacttcgaatttgtgaatgtcgtgggcatgagcgggtttcatattgaaatctccgactggtatggatctggtgccggattgaatggaattgagctttttcaggaaagtgagataaatccataa

SEQ ID NO: 364 - DNA, 735 bp, A.fumigatus
  unsure (500),(554): Identity of nucleotide sequences at the above locations are unknown.
ccgttccgtggcttactgaaaccgaacatgacagacttcttcgcctatgccgtggatgcctttaacgagccgacatgtgcaagcatcaaatatccttccaaagcaactcggacgggctcttggtcgacaacagagtccgggcagagttcatccaagtacctaacggctcatgtcaccgattccactgcagacagcgcttccgtggtctttgagcccgacatcaatcagtccggaaactatagtattcttctgtacactcctgggtgcattcaagatggaacctgtggctcacgcggtgtcgtcaacgtgacagccactgttacaacggattccgaccagcatattcagactgttatccaccaaaccaatctctacgaaaagtacgataacatctacactggccatgtcgatgccagcgatagttcttttcgtccgcaggtgaagctgactacggtggccggccaaggagacatcactgtggtagcctcgagggtcgagtntaagctcacgaatgcagcaagcaattcgacaagtggagacttgaacggactctntgaatatgatcccgcttccaaggatacaagcgagaatctgacacaatctgtcgtgaatgcagcggggctacaacttgactctcgtgcatctgtgaagactttggccaagcatgacaatagaatctatgctggaagaaaattctcaaaattcctcaattcacaatatcaggtttttccgtga

SEQ ID NO: 365 - DNA, 624 bp, A.fumigatus
gaaggccttgcccatcttactgcgattcctggattactcctccacgtcaactcttggaatattggtgcgcctaacttctttgtgagtctcagaatcatgcctcggaatataatccaaggcggaggcagcatcctccgataccttcatcgcagcaatgccttgattcgtccctctcgcgtggcaattgccaatggctttatccggcgcatttgtgtctctatgaactctcagctcgtgagcccaaccatgaaaacatttcggccttcagtcattctatcgcggcctttgatcaattcctttgcgacgacaatcactcccgatgacgagaccgagacaacaaagtcgacaggatccaagactggcaagaagaacaccaaaaagcggagctcgaaagccgcgactaaagctaagccgaagccccgcaagaagttgacagacaagcagaaagaagccaagaaagctgagaagatgaaggaactggtcaagcagctcaagaagacagcgctggaacctcccaagaaactgatagagaatccctggaatctcaccatcgcgacggtggccaaagggcttcaggctcgcggcgtcaacggaacagacttcatcatgcaatgttcccaactt

SEQ ID NO: 366 - DNA, 546 bp, A.fumigatus
tcacacattaaaacgctgataactctagcttcgaataatttggttgcttctctcaaggcagagctggaagcacagaagaagcttggccaacaaagccgagcgctccagaaacaattgaaggagcgggatgcggaggtcgctgaattgaaatcccaagtctcggaggcgaagaaacaactgacttcggctcaatcggaagtcaaagccttacagaccaagctggcagctgcccgtaatactactgcgagtctcgaaaacgctgccgcgaaagttccgggaagcgcaatcaaaaacaacagggcgaaccgcgcagctgatgctgaggcagctcaagctgctcatctctcgcagttgaaggaggagctgtacagtgacctcactggtcttgtcattctcgatgtgaagaagagggaatcggatcacctgtatgactgcctccagactggcgtcaatggaagtaagttctatttcgaaaagggaggcttgcaagatgtgtttctgacacctcggcagctcttcacttcaaattggctgtcccaacaataa

SEQ ID NO: 367 - DNA, 765 bp, A.fumigatus
  unsure (5): Identity of nucleotide sequences at the above locations are unknown.
atagnagggctctcactaggcggctacttccgtggggttgaagaccccggtgcccctggcggattgttagaaattcggtcccttcagtcaagcgtcgtccggaccaattgcatggactgccttgaccggacgaatgtggtgcagagtatgcttgggcgatgggctgtgtcgcggcagctcatggacgcaggagtccttcgtccaggagaagcagctaacgatgatcgggagtttgagaacctgtttcgtaacatttgggctgataatgccgatgttgtctcgaaagcctattccggcacaggagccctcaagacggacttcacgcgcactggtcaaagaacccgggctggaatggtgcaggatctgtgtaattctattacccgctatatccgcaacaacttcctggacggccccagacaagatgggtttgatgtgttcttgggcacctatctgcctcctgattctgctcttggcaacatccagctcttcgttgaccgcaggccgctaatcattcagtcaatcccttacattcttgctgcaggcctgttcatgatctttgtttccattttcacgaagcggttgccggactctgccgtctggcctatccgcatattcatttttttctgggtagttgtttcggcctggtgtgcacgcttcatcttcgcacatggcatgctctatgtaagtttcacctttacaccattgtttgcatggtcgttcgtccctaacattccgggtctcttaggtccacctggcccaaactga

SEQ ID NO: 368 - DNA, 189 bp, A.fumigatus
tggtccacgctcaacacagagaacggagaattcataatcgtccttgattcgcaagatcgtgagaatgaaggcgacctgatcattgccgcagagtcgatcacagactcgcagatggcgttcctagtccgctttacgaggttggtacaccctttcctgcactcaatcccggactctcagagcgcttcttga

SEQ ID NO: 369 - DNA, 690 bp, A.fumigatus
gaaactggtgcggccgcaggacaaggtgctgtgaatccagacactctcaaatcacccacgtcgccctccgttcataaagtcaccaaatatcctcattcaccggtacctcctcggccgctgattccagctcgtctaccttcgtacactgccgctccccgaaactcacgcgcccctcaaaagacactggtcctggacttagatgagactcttattcactccctagccaaaggcggtcgcatgtccagcggccacatggttgaagtcaagcttgctactcccatgactactgctctaactccgggtgggccaccgactacattagggccgcaacatcccattctctactacgttcataaacggccgaattgcgacgactttttacgaaaagtatgcaaatggtataagctggttattttcaccgccagcgtccaggaatatgcggatcctgtcatcgactggctcgagcaggaacgcaagtacttccacgcacggtattaccgccagcattgcacgttccgcaatggcgcgtatatcaaggacctcagttctgtggagcctgacctgagcaaagttatgattctggacaatagtcccatgagctacctttttcacgaaggtacgtcggaggaatccatatttaacgtctgtcttttgtttgtttcatattctgacttaactgtgtctagataa

SEQ ID NO: 370 - DNA, 210 bp, A.fumigatus
ccaggatggtctcgatctcttgcccttgtgaaacgcccgcctcggccttccaaagtggtgggccttccacagtgctgggattacaggcgtgagccaccgcgcccggccaagcggagggatttcttctcacttctcagaggtcaagccatggggaatctcaccttaccttggtcgcaagccagcagacagttttcttgtggtaacccttaa

SEQ ID NO: 371 - DNA, 192 bp, A.fumigatus
ggagtgcagtggcgcgatcttggctcactgcaagctccgcctcacaggttcacgccattgtcctgcctcagcctcccgagtagctgggacgacaggcacccgccaccatgcctggctaatttttttgtatttttagtagcaacagggttttaccatgttagccaggatggtctcgatctcttgcccttgtga

SEQ ID NO: 372 - DNA, 246 bp, A.fumigatus
  unsure (81): Identity of nucleotide sequences at the above locations are unknown.
ctaccaccttcaggggaaggcttgggttccagccagattttgttttcttatttttttgagacagagtctcactctgtcacncaggctggagtgttgtggcatactctcagctcactgcaacctccaccacctgggcttaagcgattctcctgcctcagcctcccgagtagctgggactacaggcactcaccaccatgccctgctaatttttgtatttttagtagagacagggtttcaccatgttga

SEQ ID NO: 373 - DNA, 354 bp, A.fumigatus
  unsure (80): Identity of nucleotide sequences at the above locations are unknown.
taccaccttcaggggaaggcttgggttccagccagattttgttttcttatttttttgagacagagtctcactctgtcacncaggctggagtgttgtggcatactctcagctcactgcaacctccaccacctgggcttaagcgattctcctgcctcagcctcccgagtagctgggactacaggcactcaccaccatgccctgctaatttttgtatttttagtagagacagggtttcaccatgttgaccaggctggtctcaaactcctgacctcaggtgatctgcccgccctggcctcccaaagcgctgggattacaggcgtgggccaccacgcctggcccatccagattttctaa

SEQ ID NO: 374 - DNA, 288 bp, A.fumigatus
gctctctgccaccatggggcaggtgtggctcctgcatgggtggtgaagtttttttttaaaaaaacttctcaaaaaataatttttctcagccaagtgtggtggcatgtacctgtagtcccagctactcgggaggctgaggcacaaaaatcacttgaaccccgggaggcggaggttgcagtgagccaagatcgtgccactgcattccagcctgggctacagaataagactccatctcaaaaaaaaaaaaaaaagtcctcttccttcagccggattacgatttataaataa

SEQ ID NO: 375 - DNA, 231 bp, A.fumigatus
acccaggggccctcatcctcatcctggtgccctgtgaccttgggagaggctgtggttcctcccttacaaagtgaagagaagggccctgatgtggctaagctgttttatggttttaaaagtcccattggactcctgcctccatcatggacctatgatgtttggacctcaagatacatccagctccgttttgtttttttttttgacatagttatttgcatatttaaagtttag

SEQ ID NO: 376 - DNA, 192 bp, A.fumigatus
tttttgtgcctcagcctcccgagtagctgggactacaggtacatgccaccacacttggctgagaaaaattattttttgagaagtttttttaaaaaaaaacttcaccacccatgcaggagccacacctgccccatggtggcagagagcctacatgaacccaggggccctcatcctcatcctggtgccctgtga

SEQ ID NO: 377 - DNA, 249 bp, A.fumigatus
ttgaccgacccatcagcacaatgtcctcatccagattaccacatatccctgctctacgtagacaacaactcctgcttgaattgtgagtacgactgcctctccttgaacggtggtggcaatgttacgtttgctaagtgcgtcatgcagtgccagcttgaaacatgcaaccccctcgggaatctacatgtccatcacgccaggcgatcctaccctttgtcttcaccaccgggctggaaagacaagcgctgg

SEQ ID NO: 378 - DNA, 642 bp, A.fumigatus
tcgctcaaactggcgactacggcgacctacaccatgccggcgaccgtgctgccggccatcgacgatccagatactagaccgccagcagatatggtggacagtgatcaggatgcagaaggggaagacgaaaccgatctctatgagatggaccagcagctacagaatgcagttcatcgggcatactctggggagaacaccgacggggatcaggatgccgattacgacgaagacgaagatgcagagggtgaaccggatacggagctgaacatcaacgggggtaatgacgatgcagaaccggttggtgccgtcaagatgcctgacacagccggctctcttgacaacgatgatgtcgcttctgcggctgccgatgcagaagatgatccagcctttgagaatttaagtgacaccgatacacccgctgcctctccaagcagttcagaatcggaggccgatgaggagtgggaggctgagagtaataaccgggaggacgcagaggtggataccactgtccgcagcaattgcatgtgggttcattattctccatatgcccaccctgttgtgatcttgtctgatgctgagattggagaggtcgcttgtcttcacctcgaagagccgatccggattattaacccccccccaaaa

SEQ ID NO: 379 - DNA, 195 bp, A.fumigatus
aactatgcaaagattttccaagcgacactggatcttacacaactctataacaacgttcacgatgtactctactccgggatgcggaccagcaatcaaatgatgctcatgggcgactacgtgaaatacgtggacgatttccgcctggcgattctccgctggaagtcccgctggggctcgctttcctgtagggcatga

SEQ ID NO: 380 - DNA, 396 bp, A.fumigatus
ccccatatgcttacgctgtcagccacttacgcatttgcaggttccacaccgatgcgagccaccatgcagttgtcgtacgagtatctgagactctatacgaacgcatttgcatttcaagctgccatctcccagtcacttgtctcaaaacataaaaacaacaatcagtctcaaagggagcatttgcgcgcaaccttcaacaatgtggcatcaatgcaggatgcgcgcttcatttacgagtctgtcgatgcggcgaaggcgtacctgaccattcttgttgacgaagtgcatccggaaaagcacttgcattttatgcctttgaggttttatctgtatggaatctatgcagcggtcttcttatataaggtgagtcggtcgtttaaaatgattcgagtatga

SEQ ID NO: 381 - DNA, 228 bp, A.fumigatus
caaatgaaacctttccagcgggccgtcttgtataaaaatattaagttcgctggcgtttgctatacagatctacacactatgaaatgtgactggccgctcaagcccaaatggcctcttgttggcggccatgaaggggcagggatggttattacagttataatcctcagtgtggttaggctacatctaatctgcatactaaataaagaacagtctgcctctgcccaatga

SEQ ID NO: 382 - DNA, 654 bp, A.fumigatus
tccttcgaccggcgttgtgaagaccaccagacccgcgccgagactcgcgcgcgaggacccctagccgccatgtgctgggtcaacgtgctcaacgcgatcgacctgttgttgtcgagccgggtctcgttcgacgagcagatcgcgtggatgacgaaatgcggtcaaagcaagactgcagacagtagctactggagaagactcgtctggtccatcgaaatggccttcaactaccgtcgcatcaacaccccgtggcagatccgcgctgtccccgcgttcgacaggcacgacccgggctttgtcccggacaaggtgaagttcctgcgtcagtgtgcgctcagagtatgcgggtcgctgtttgtggtgcatttctgcaccctcgatctgagggatgctcacctggcgggaattctgtctgagatctccgactccaagaaggtgttactccctacgtggggggaatggactgcgcgccgcgcgatcctccagatgctattcaccatttcttttgggctcctcacgcgagcggctatactgggaacgtatagcctcctcgcgatgttcttcgtcgcggtgggcgcgtacgagcccgtcgactggccgccggttttcggcaacgtgagcgatatgtactcgttgacgcgggtttgggggtga

SEQ ID NO: 383 - DNA, 363 bp, A.fumigatus
  unsure (39),(67),(89),(90),(102),(132),(201),(211): Identity of nucleotide sequences at the above locations are unknown.
catctcggaacaataatgagcgcccaacttacatgtgcngccagtgaaccgcaacaaaaggtccatncgccttttctttgccataagtnncgagtcgagatnttacacaagctgggccaagagtgcgacgtnctagtcgagaactacctttccagcaccctgaagaagtacggtcttgattacgaaacgctacgatctatncatccaaaangatatatgcaagtattacagggtacggccaaaacagggcatacaacaaccgggctgggtacgatgtcttggcccaaacttaaaataactcatgcccatcactggaagcaaaaaccgcgaatctttcaagttcgggtaactgtaacggattga

SEQ ID NO: 384 - DNA, 855 bp, A.fumigatus
ccgagatcaatagcttataattcccagcgaccaatcgtcgagaaacatgcatcgtttgccttctatcatcccgccaccgaggccattgcaggggttgtcagtgatatcccggtcaagttcctcatggcaatagcgttcaacatcattctctatttcctgagtggcctacgtcgcgaaccgtctcaattcttcatttatttccttattacgttcatcattatgttcgtcatgagtgctgttttccggaccatggccgcaatcaccagaactgtttcccaggccatgacactggctggtgtcctgattctgatgctagtaatttacaccggattcgttgttccagtaaattatatgcacccatggttcaagtggatccactatctgaatcctatattttatgcttttgagatcctgatagccaatgagtttcatgggcgggagtttacctgttcacagtttatccctgcctatcccaatctgcccggcgactccttcgtctgctcgtcaagaggtgctgttgctggtcgtcggactgttagtggggatgcatacatcgaagcgtcatacagctacagctattcacatgtctggagaaactttggtattctgatagcattcttgattggcttcatggtcatctacttcgtcgcaaccgaactgaattccgccacgaccagctcagcggaggttcttgtcttccgtcgaggccatgagcctgcccacttgaaaaatggacatgagcctggtgcggatgaagaggccggcgctggcaagacggtggtttcttcctccgctgaagaaaacaagcaagaccaaggtattgtcttcaccacggggctggaaagtgcgcgccat

SEQ ID NO: 385 - DNA, 687 bp, A.fumigatus
  unsure (162),(191): Identity of nucleotide sequences at the above locations are unknown.
gtagccggggtacttcgcacccagtccagaatattttctgtatatttccatacataccaacttgattctccatctacctcctcaattggcattctcaaggttctatcttacatttctcagactattgatccaattgaatcactttttcaaccacaatggccnccatcgccgtccaagaagcgacccccacnaccctgtacaacaactaccaccccacaaccaacccatcccggcttgattcaagttaaccgctccccaaaagccttcggcagcagcgcctcctcgcttgtctcgctcccagcaggcgccgtatttgccaaaatcaccaccgccaccccctcgaagaaggcttacacatccgtccagacgggccgggacagccacatcgagctgaactcggacctggtgttttgcaaccactcatgcgacccgagtttgaactttgatatggataagatggaggtgcgggttgtggacgaccggccgctgaaggtcggggatgcattgacgttcttttatcccagttcggagtgggagatggatcaggcgttcaactgtaactgcgggagtaccaagtgtaaggggtggatctctggggcgaagacgatggggagagaggagttggagggttactggttgaatccgcacatcgaggagatgttgagggagagggacgggcagttgtga

SEQ ID NO: 386 - DNA, 192 bp, A.fumigatus
  unsure (75): Identity of nucleotide sequences at the above locations are unknown.
tatgaatggggaaaaaatacacttatggcattcatcacccttttcccacttgcatttggacgtgggatggttcanggcattacagttagcgcacctggcaacgctcaacaatttgcccgtgtttgtgtctgcaccattattatgtttagcgtcttcttgattaaaagggaccgtagctcacatcttacctga

SEQ ID NO: 387 - DNA, 204 bp, A.fumigatus
agtcaggttggactcatcttccctcgtttacaatatagtccttcgacgaagaacagtggcagctcggagccgagcggtattgcccatctccgtcagtccgaccgcccttcctttgcacggccatcaacatccaccgatcttgcctccgaccccatgaacatcgacgacttcatagttcctatcgagtcgcccgccgagtcttca

SEQ ID NO: 388 - DNA, 324 bp, A.fumigatus
ccctgccacgacgggataatgtcggggatgagccatggaggagcgcctaaagcagcgcgaccgactccaaccgctgtctctgcctcctctggttacgacatcgccgatgctgaccgatcatcgtcttctcatttccaccacacctcccaattatccgacgatttctcccgtggttctcccatcagtccacctgactccgctcatgtccaggacggtctgctccaggactctctttttcccgagtggaggaacgccgctccccgagctggggtagaaagtccagatgagatgcatcggaaagatcctctggctactcatatatga

SEQ ID NO: 389 - DNA, 324 bp, A.fumigatus
aagctctattctagaacgaaagctcagttacccaatcaggagcgcatggaaaatctcacgtggcgcatgatggctatgagcttgaaacgcaaggaacgcgaaaggcttcagcagaataagcggtatgtctatgataattcaggtgcttggacaatcgctttttttgaagtcaggttggactcatcttccctcgtttacaatatagtccttcgacgaagaacagtggcagctcggagccgagcggtattgcccatctccgtcagtccgaccgcccttcctttgcacggccatcaacatccaccgatcttgcctccgaccccatga

SEQ ID NO: 390 - DNA, 507 bp, A.fumigatus
gaacctagggattcatttatgatcggtgtacctcgctttcagcttcggaggctaaacttctctggaagctatatctacggtccaagagcgacttttatctctgacattcaaaccaggtgggctgtacagttttctcacagccaaagacacaacatgacgaccgttgtcaacctccctagggatccaaataccctgagcaattacaataattgggtgtctactcatattactgcaaatttcgacatcctttttgatcagagaaagcttgctggaaatgtgatccatcggttccgttctaccactgatggcgagtctaatcatatcatcctggacaccaaccatctcgatattggtagtgtgaaagtcaacggacagccatccgagtgggagtatcttccccgactggaaccgtacggcacccctctcaagatcaagctcgatcaaggtgtgaaactcaacgaaactattgagtcttcaccacggggctggaaggagccgcgccatcat

SEQ ID NO: 391 - DNA, 777 bp, A.fumigatus
aatgctccccatcggcgattcccacaccagcgttcttcggtggccgaaatcatctccttcgaggcatcttgggtcaggaactttactctccacgtgcctggtaatttctactacaaccacggtgctcagtcggtgcagaatgtggatttctgcaacgtgacggtgacctacagccatccaggctacgacgaccgaattacggtcgaaacctggctgccacgccactggaaccaacgcctgcaagccaccggtggagggggatggcgtgcgggtcgcttcgtcctgtcccagtttttcatgggaggtgccattggagagggatacgcgacgacaaccactgatgccggcctcggggatacaatgccagacgcatgggctctgaagagcactgggaatgtcaacctcgaatacctgcataatctgggctatagatccctcaacgacgaagcgatcatcgccaaggacctggtgcgcagcttctacggcatcccgccggcgtattcttactggagtggctgttcgcagggcggacgccagggtctcatgcttgcgcagcggtacccgcacgcctatgatggtattgtggcctctgcaccggcgcagtcgtggcccgagtttgtgactgcggtttactatccgctcctggcgccgctgtgggccggggagccgtctcccctcagctgtgaactggatttccggactgcggaagctgttaaaccctgcgaatccccagaagggattgtggatgggatcatttccggacccgaacaactgtga

SEQ ID NO: 392 - DNA, 204 bp, A.fumigatus
cccatttgcgcgttcctggggctgggtcattcggaactgtcacgatttgttccaatctaccaatcactggagggaaaagcgcaacgaaagaccgctattttgtataacatgaccagaatggctcatcatggtattccgcctacggggatcttgtgctatgacctgtcactgtcagatgctgacatcattagctcacagcattag

SEQ ID NO: 393 - DNA, 222 bp, A.fumigatus
ttggcgcatgggtggaagtcgcctggtgggcggttacatgatgcggagcatgcgttggagaaggggcaggtggttgcgttcatggctgaagggaaggagcatgcgtgtatggttgggccgttgaaggtcggaacggaggagatgaaggagaagaagaagggtgtggttatggacgaggggcattatctgggcgacggcttgtggaagatgcattgggattga

SEQ ID NO: 394 - DNA, 318 bp, A.fumigatus
  unsure (183),(255): Identity of nucleotide sequences at the above locations are unknown.
aagtgcggtgatgctgttgaccgcatacccacggctatcgctggcaatcatactcccccttcagccaatctatcaaattcattgataatgacaagctgcccatgtctcccttcgcaatccatgcccaattatattgctgatcctgagatggctgttccacacgactgtgtgtttaccgtgggnctgattggctggctgcctgaatcccccgctgagtcgccgttcgccaagcttaattcgcgattgggcctgatnaggaggaacaatattttcgctcaatatctgattgggttatggtaccagccaaaccaagtcttc

SEQ ID NO: 395 - DNA, 1032 bp, A.fumigatus
  unsure (1026),(1027): Identity of nucleotide sequences at the above locations are unknown.
ttcaaaaaaattgggtggggggaacgcgcttcttccgaagaacgaatgcgacaagaagccattttctcgaaaaaatatcgggcgcgaaggacgacccaggcgaatttctcgaagcggaaaggcgcaatggcccgccactttttggatcctgccggggaacgaaggtcaaatacagccacgggcgcgggaatcggcccggatctggatatgcggccgtccggtgtggacaaggtacccatcattcggacgttgaatatgctgagcgagaagattatggcgaatgtggcgccggtggatcgcgacccgtcggcgcctgtcggcattgatgacgagacgtacaaagagctgcagttgcgggacttgcgtggggacgatgaacagaacaggattctactgaatatccgggatcagagtcggtttttctcgcaggccaaagtaaccgaagatgagcagagtcggttgtttgccaagcaggaccctgaccagatcctccgtgatctacgtggccagatcgaccgggacctgccgaccgatgggacagcgccattggggaagctggtggaaccagaggaactcgaagatgaagacgagcagaaacatgatcagcgggtcggatcgcaggccaacttgcagcgcgcatcgaagcagatccttgacgccatccgggaccggcgcaaccagacggaggcgacatctactgggggaacgtacggattgtcggccaatctctatgataggttgaccctaacacatgcgacaaccacggagttccttcaccaattctggcaggcttttctgtccggaaatcccgaccgtgcggctgaggtcgcgtcgcttgtggaatcgctgaaccgggccatggaacgcatccagtctgtcgcaccccacgcagaggctcagcgccaggtggaagtaaaccgacttaagcagcatgcacgagaggtgctagaggctacgggcaagaagatcgtcttcaccacggggctgtatgcaccgagggtggtcatttcgacgtgtgctcaatcnncattc

SEQ ID NO: 396 - DNA, 444 bp, A.fumigatus
  unsure (383),(384),(385),(386),(389),(390): Identity of nucleotide sequences at the above locations are unknown.
ttctctaggactctatccatgcacaacccgaaagaagcagccgaggagcttcgccgctgcgtagaaaaatacggcttcctcggtgcccttgtaaatgacacgcagcgagccgggcccgacggcgacgacatgatcttctatgaccagcccgaatgggacatcttctggcagacctgcacagacctcgacgtccccctttacctacacccgcgcaaccccacgggcacaatctacgacaagctctgggccgaccgcaagtggcttgtaggcccgccgctgagcttcgcgcatggcgtcagcctgcacgtcctaggcatggtgaccaacggtgtcttcgaccggcagtcttcaccaggggtggaaagagggtataaatcttcttnnnngannaaaaatgtaattaatagaaataaaggtagaaattggtattatattaaaatttaa

SEQ ID NO: 397 - DNA, 378 bp, A.fumigatus
atccccaccagcatcagtcagggtgaagcaccagtttctcacagggatggtttggaaaggttgcccttcgaggaaggctttggggctttccgcgtttcgaagaaaaagactcgttggtgggttagtctgttctctaccgaccccgagactcacgtcaaggaaataaccgacatcaccaagatccgtatccaatacgccgacaagcatggcgtcggctaccagattctctcctacacagcacctggtgtgcaggatatctgggatgcgaaagaggcacaagcgttagcggttgagatcaacgattatattgcggagcagatcaaagagtacccagatcgatttggagcttttgcgtacgtccactcctgctttctatag

SEQ ID NO: 398 - DNA, 339 bp, A.fumigatus
  unsure (181): Identity of nucleotide sequences at the above locations are unknown.
ttatcatttcaaatcgcccaggataatgccagaccgtctttattccacaacacccagcataaggtaatttacttcatcgttaaacttggcatttccaatgtgttggaagaatgccatgaggcctttcacgaagatagccctattgtatttataaactgccaacttgatcttcccgaggagnggtgtgagacctataaaaataaagagcattcatgcccaaccggtacctgggctgatgaagcggggatatctgtgaaggatcacatcaaggacgagcgcgactcgaacctatatcttttgtcattctccgagcgcccttgtctttggtgttctctctag

SEQ ID NO: 399 - DNA, 219 bp, A.fumigatus
  unsure (6),(19),(23),(46),(75),(92),(111),(119),(127),(170),(188),(193),(202),(211),(218),(219): Identity of nucleotide sequences at the above locations are unknown.
cctttnccccgccccaaanaatntataaacttttgtaaaaatatanattctttccccggtcccacacactttttnaacgccattcttctcanatatcccgccatttccttngcccaccnagcccttnttgcggggtggttaaaagtgtggcgcctttttaccgcggccgnggtgggggccgggatatnttccnccgtttccnaaaccaaanccgaatnn

SEQ ID NO: 400 - DNA, 207 bp, A.fumigatus
ggatgcgacgagtctactcagattcatcgcctctggaaatctcagcggaattcctcactctgcagatggatagaacccgaaaatagttacagtgtttatgatgccatgaagaccaacaacgcaagtatggtggagagccatctgaaccgacctaccacaccctctgtgattattggcactggtgttaaagtacctgtagaagtatga

SEQ ID NO: 401 - DNA, 204 bp, A.fumigatus
attaccctgacagggttcttatttgtggtaatcaacttcatcaccatcttatggtacaacccagcgttagatcacgattgccctccatgggtctatgccagttgcgccattgggttgttcctgtatcagacattcgatgcagtagacggcatgcaagcgtatggactcccgtcctccttcccatctgctagtagactagattga

SEQ ID NO: 402 - DNA, 474 bp, A.fumigatus
atatccgtcgtttacagtaaccgaccactgccatcagagctaacatcaacttcacaacaacctgctcactttctcatctcaacagccaccatgcattcgacttcgagttccgagggaaccagctcacgccaatcccccctgcaaatccacatcgacgaactctcctccctgcccctccacgacaccatccaaagcttggtacacctcctccccgaactaaccacttctatcacgccaacaggcgaacgcctcgtgacgcaccctacctacgaaggaacaggcaagctcgacgatctgggtgcactctacctccgcgcggcagatcgctgtacccgcgaacgcgcatccttcaaaacccgtctcctgcatatatcccttgattccatgatcgaagcactctacgcatcgagtcaagagcagctcgataaggggttggaagatggaactgtgcatctacctcctgtcttcaccagg

SEQ ID NO: 403 - DNA, 870 bp, A.fumigatus
agacatacgacagctgcagccgaagaagcctgcgctctactggatggcaagccaaactcgcagaatgatgccaacatgatcgttgagctctaccatggaccggttccgtcagcgttgaacccccagaggcgcaatacgattgatcacaccgcgactcgaaatatgttgggtaatggccacctcgcgcggtcttctcgttttaacggcacatttcaaagccttgaaaagctagcagcgccaaattcgtccctgcagtcgaacggcgacgcactgacctcgaactcagagtcagggtctcgccttcaaagcatattttctccccagtccccgatcggcaatggcgttcatgaccttccgcgcgttagtggtaagtcgatgatcgaccaggatccggacgaagatacgggtgagctactcaaggatcccgttggctacgccgagaacggtcattcttcttcggccaccctgcctcgacgttcgacgaatcctcagtatcccaccaaccgattcggcaacctctctctgtccaccaacatgacctcgccgcctctgcacaactatgcgcctggcggctcagggcgcatgggggtcccgacgccttcctccgcctttcctcaggcaatcaacggtaacactatgatgggaggtcatggatacccttatggtagtcagcatactcctcgtcatagtcttcccgcggcgaatccgaacgacttgaacccaccctgcaataccctctatgtgggtaaccttcctccagacacctccgaagaggagctgaaggctctcttctccaaacaacgcggatacaagcgcctgtgcttccggaacaagcataacggccccatgtgtttcgttgaattcgacgaa

SEQ ID NO: 404 - DNA, 372 bp, A.fumigatus
  unsure (202),(283): Identity of nucleotide sequences at the above locations are unknown.
ttcccgagaacaacaaccaagatggccacgacgccgaaccggccagctcagcgcagcagctcccagaagaagcgaacaagtttcaacgtgccattgcggcgtggagaagttcgtcaccattttagaatcttttctattttgaagctcaaagttgctgatatctctactttattaggcattgacttgacaacgactgtcgcanaactagacgctacggcttcggatattgtcgctcaacagcgagatgcacttatacagagaaaggagctagcccagaagacanaggattttcgaaaattagacgatgcttccaagcttgcggaatacaagggtctcctgaaatggttgggtccctggcctttccggccgggg

SEQ ID NO: 405 - DNA, 783 bp, A.fumigatus
aagatcccaaagttcaagtcctcccaaacgtgcctgagaatcttcttggataccaagttttccgagaaggtgcggaccccaagcgtcatggaggcctacgccaaagaaaattgggtacagcacctccattcagtccagcccgaagagacctcactcgaggacaaaaagacaatcgccagcatgctggcccggatgttcggtacggaagagaacatggccagatggttgggaatgagaagttgggtctcgacaagcgacaatctgaaggctgttcagcgctggtggaatgatgccgagattgtcgagtcgcttgctgtcaaggaggccgaatttgtcctttccgtcaaggagaagcctgtagagaccttccgacccatcgcggagctttgcaccaagaaatggttagccgaagacgactgggtccccacagccccggcggctatgattatcagctatctcaaatgtcagagagggatcgacgaggattttatggaacattttgcactgactgccgccgaggtcgtcgaggctgccgaatggggccagatcgagaagacatctcgctggtaccaaagggtcgccgtggtgctgcgctacaccggccacatagacgaggctctggactactttacgaaggcactcgccctagatccagacaactggattgccaaagcgggcatggccatagcacacctgagcaggaaagaatgggcaacggcccttgtgctcgacgaggaaatagaggcgattctgtcttcaccacgggggctggaaggaccacgc

SEQ ID NO: 406 - DNA, 255 bp, A.fumigatus
ctgtctgggattgtacattgtgccagcagcacaggagaatgcacagggccaaaatgccacaaggtctcctgcactggtcccaactgtcaaaacggagtgtgcacgggcgagggctgtgaatcagaagacgacgactgcgaggctaaagaggctgaagtctgcactgaaactgtctactcgagtattatcacgcccgcgtcaacatatacaaccgagatttacgtcttcaccacgaggctggaaggacacgcgctc

SEQ ID NO: 407 - DNA, 210 bp, A.fumigatus
aactcggccggtcagtattacactctcctccactttcagtatacctgcaagttgttaaccgcggagcagtcatgcctacgatgccaaaagtcaaaccgcacctgcgcaggctaccaagaacaagccagcaagaccctaatcttccagcggaactacacccaaagcgcaagtgccaatgtcttcaccacggggctggaaggggccgttcga

SEQ ID NO: 408 - DNA, 624 bp, A.fumigatus
acgcgtgtccttctagccccggcgttaagacccggtatctcccacgtcattctcttgaataaatttactcagagcccggtgctgcctctgggtccgacaatcaactacttgagcacgattcgactcaggacactggacgggcgttacgtcgccgtggacagcaacccccccgggaacacaaatctcatcctgctgaccctggtgaacgcgccaacggacaatactcgtttcctgatccggcactatcggagggactcgtcttgggaatggccgttcagtggcaatctagacgccgactcctgcaacgccaatggaaatgtccgccttgttcatgtcgacagcagagttggtgacgatactgtggtgtcctgtgcgaagaactccggaggcttcatgtactggggtgtgggctggggcccggcaaacgactgggagacgttccttccatacgatcctgctaacccccgaagcagcgctaagattcttgacggtagtgtcattgtccttcgcacactttggcatatgtactggaaggcaggcaacgatgagaacctctatactaggcttaatgcgagcaccggagcgatcgaagatgccacacggtttgtggtaaaaaaggcctga

SEQ ID NO: 409 - DNA, 630 bp, A.fumigatus
cgtgagtccaacctaggtcactacatgaagctcccgcctcgcgtgaccttcgcgggacagttggttgcctgtttgtggtcctcgattgtccaaatctgcactatgaactgggcacttggagcaattaataacgtctgcgacccagaacaggccaaccactacacctgtcccaacggccgcgtattctttaatgcttccatcatttggggtgtcatcggcccctcccgcatgttttcacctggtcagatatattccggcctcatgtggttctggctcgcaggtgccattttgcccgttgtcatctacctcggtgctcgctactggcctaagagtcccatccggttcctcagcgcgcccgtcattttcggtggcgcgggactgattccccctgcgacgccactgaactacctcagctggggtattgtaggtcttgtgtttaacagacacatccgcaaccgtttccgcggatggtggatgcactacacctacgttttgtcagcaggattggacgtcggcctggcgctgtgcaccatcctgatcttcctcacactccaattgacgaacacggatttcccaagctgctgggtcttcacctcgggactggccggtaccgcgccaatttctacccca

SEQ ID NO: 410 - DNA, 522 bp, A.fumigatus
  unsure (139),(259),(276): Identity of nucleotide sequences at the above locations are unknown.
tttcttcctgtcccaccaggttggcttttgacctatggtttgagttttgctaccatcatcggtggtgctcattcatactggggttctcccatggaaaagaagctgtgggccggttttcgcaagttcggtaagaggaagnaaaacgtccacgcgcgtctcatgtcccggttcaagaccgtcccattgtggtggtatgccgtgctttcactggtcatgatcggaatgggtctgggtgttgtcctgggctatccaactcatntgagctggtgggccttnttcgtctcgttgattattgccgctgtgtggtttgtgcccattggtcttgtacaggcgacgaccaacattcagatcggactgaacgtcattacggaattcatcatcggttacatgcaaccgggacgccctatggccatgatgctgttcaagaccttcgggtacatcaccatgtcgcagggcctgtatttctgccaggacatgaaactgggtatgtcacttatcaacacagaagagtcgtcgaattag

SEQ ID NO: 411 - DNA, 693 bp, A.fumigatus
agacaagaaacggtgtctgggaagccggacataatatcttctcaacagcccaagtcgacactgacgcccaaggaaagcatcttcacatacactaacccctttgagcaactggctgctgcatcgccacgcaaggcctctcctcagatcaagtctcggagtgctagccccgctgtcgagctcacccagcgccagaagatcaacgtaactgcaaccgcggatgttgctcctgtgtctcagccagcagcttcgtctgccgtgcaacgcccgtcatcgccaatccttgacgcagagcagcgcgaggctgttaaccaggtagttggcaagctggtggatcagatagttggccgcgacgttgctgaagtacgtgacaagacagccaaggaagaggagtcattgcctgtacggacggataaggatgagggcactaaagcggccatttcctctgtcactagccatcttcgtgatacaactgctgaggccaagcaggctgcaaagattgaagcagcggccgcccaagaccccgcggcagggagtcctgcagctattaacgaaactactaatggcgaaagtggcgaggcccttgcagacagttgggagagcgccgaggacagcgctgcgaaggaagaagagcgcgttgttcccgtgtacaactttcctctgaagccgttcatttccatctccctcaagggcaac

SEQ ID NO: 412 - DNA, 555 bp, A.fumigatus
tttctgatcccgaataacgcctgtaaagttggcgtgcgggagaacgtgagcaagatcgacttttacggcatcattgcctcatccattgggatcatctttttgcttatacccatatcaggtggtggctcctacttccagtggaattctgcaatggtgatcagtatgcttgttattggagcgtgctcattggtcgcgtttgtcttcatcgagtggaaagtggcctccctgccgatgcttccaggtgcgttacaactcgtgccgtttgttaattcaagaggagctgacctgtggacagtggtattcttcaagaacaaagtcttatgtgctttattcttacagagctttctccttggcgctgtgtatcaatcgtatctctattatctgccattgtactatcaaaacgcacgagggtggtctcccatagtttctgccgctatgactgctcccatggtcggttgccaggcacttgcttccattgcatctgggcaatatatttctcgaaccaaacggtacggagaggtgatatgggctggtttcggcctgtggactctgtga

SEQ ID NO: 413 - DNA, 720 bp, A.fumigatus
agaaccttcgaggagattatctacgacaaggccatctttaagacacaacttgccgttcgggttgtggacaaaaagaaccctattcgctgggcgtctaagaagctcaacgagtacctcttccccgctaaaccggtaaaacagcatgacatctccgaatttgtggggaaagatcctcatgtgcttgacaaaataatcaaagaagacaacggcgaggaacgggcaatccggaagatcgctctcaccgagaccttccagagagaagacaatgacaagctcacagaagaggaaaggaaggatgtccagcaagagctcgacgaagaacggcttaggcgtactgatcccgaggcataccagcgactgatatttgagagacagaggaaggaagagttcgtgagagatgggggaagacgcagagaggcggagagactagcaataatggtgcccatgtctcagcctcaagggcaaagctggcctggcagacccgtcctgcccattcactacgcggccgcgcagcaagcccgtgtgccatcttctcaagtgcctccaccgtctacagctccctctaggcctcgtgactgggggcaccgtgttcatacttatgacgatggcccattcactcatgcacgtaacaggcccacctcgccacgctctcagtccacgtcgaatgcagagctggccgtgtctcaaaatggggcggttgatggcactcagcctggtctt

SEQ ID NO: 414 - DNA, 309 bp, A.fumigatus
  unsure (116): Identity of nucleotide sequences at the above locations are unknown.
gaaagtgtactcattctcaacccgtgcagttgcttgggctttgatattccgggtgcgaatcgcgtcgtgatattcgacctctcattcaatcctatctggaaagacaaggttgttgngcgtgcatatcgtctaggtcagcaaaagccggtatttgtttaccgcttcatggttgaagaaccttcgaggagattatctacgacaaggccatctttaagacacaacttgccgttcgggttgtggacaaaaagaaccctattcgctgggcgtctaagaagctcaacgagtacctcttccccgctaaaccggtaa

SEQ ID NO: 415 - DNA, 609 bp, A.fumigatus
agacgcctgatgtttggcggcaaagccatcttgtatgatggaagtcccttcctaccagacgccaagttcctcatcgagctactgagcaagtataaagttacccatttcggcacatcgccgcgctatctccatgagctccggaagaacaacataagaccgaaagacattgcagatctcagggcacttcgcatcgtcacgagcaccggcatggtcctttcggaatccttgtttgaatggttctacgacgagggtttcccatctcagacccaattggcgaatatctccggcggcaccgatctcgccgcctgctttggcttggagaatccgcttactcctctatatgtgggcgggtgccaaggtccagctctgggtattcctatcgcagtattcgatcaagcggatgagggtgctaccgccgtcaaaggcactgccgtgccagatggtgtgccaggagagttggtagccaccgcagcatttccaaccatgccagtcaaattcttgggcgacgacggcccgcaaaagtactttgactcatactttgcccggtttgacagtaagtctcctactctccccaccctcccaatgcatctaccatctactaacctatga

SEQ ID NO: 416 - DNA, 951 bp, A.fumigatus
ttcccatgccgagagacgctttggccggatccttcgccccctgtggagaagaccactacgccggcacctgcgcctgcgcctgtcccagctcccgctcccgcccccgccgaagaacaacagcctgccgctgagccagcagcaggacataaagcagctgaatctgtccctactcctgcctccgtacccacttctgctccagctcccgctgctgctaacgcccctgctcctgtcccggtccctgttcctgtaccgattcccgtcgaaaaaggacccgaacctgtccttcctaagcagcctgctgaagtcccggttactccttccacttctcacatcactcctcccaaggatggtctgaccaagacaaacctcgaacaaatacccgatgtttcacctcccgctcccacagccactgcggctagcacagtgggcagcacacttgatgccaacagcatcgcagctgcctctacccccgctcgtcaacctgctcaagctgccttcccttcgagtgcattcaagtccggcgctcgggctcctggatcacagcgtcgtgtcatggaacagcaagaagctgtagtcatgcctggaaaccacgccgttgatcgtgctgctgtccagtttggcagcatgggtctgaacggcgatgctgccgatgttgatattgacgagaacagagaaaacgctgaaacacgcgctcagccccctcaacactctcccgtcgcccctcgtgcctctctacctccttccactcaggcccagccgtccaccgaggctcctcctgtttcccgtccagctcccggacttcctcctgtcccacaagtctccgctgccgattcctctttcaccgattttgcccgctacacagaggcccagaagccttacgacccgttctctcagcaggtcagccagccccagccccaagtgcaggagccatttgcaaaccaggcccccgtt

SEQ ID NO: 417 - DNA, 750 bp, A.fumigatus
aaacgctacgtgcgttacttctctggtcataccgacaaagtcacctgcttggcactatctcctggcagcgacgcctttatctcatgctcgaaagatgacaccgttgccctctgggatcttagctcgaggaatgcgcaggggaagttgaaattggccacgccttatctggttgctttcgatccctctgcttccgtgatcgctattgcttcacaatctacctcgtcagtccttctatacgattttcgcaactatgacaaggctccgttttccaccttcgatctcgcgccgtacgaagaaagatacactccttctacacgtggaagagcgtggactcgccttgaattctcaaatgatggaaaacacttgatggttgggacggattttcatgggcatttcattctcgacgcctttgaaggcaatatcaaggcgttcctgctcggcaagaacggatcacctggcagagcagctcctgtctcaacaactggaaaaccacttggtcagggggatgcatgctttaccccggacggacgatatgttctgggcggctccggcgaccagtcagatgttcttgtatgggatatgcagcagacaccggatgccaattccctcctgcagccaatgaccaaactaccaaaccgtggtcgcaccgccgtactagaatacaacccacggtacaacatgcttgctacggccgataaggaggtggtcttttggcttccaaaaaaaaattcgcggtccggtgaaaaataa

SEQ ID NO: 418 - DNA, 180 bp, A.fumigatus
aacaattcatggcacccctgggggcaacggggcccgtattcggtaccccaattaacacaagtgggtaaaaccattatcttgggaacagactgccaggcctggaacaaatgggagacacagccaccagttattattgttaagggccccacagccaaaacagatccgcaatgcatagactaa

SEQ ID NO: 419 - DNA, 798 bp, A.fumigatus
  unsure (774),(775): Identity of nucleotide sequences at the above locations are unknown.
aaccttaagcgcggatccggctattcccgtggtcaatacgtggagcctagttcggggaaagtccttgtctggtcctcatatcggaagaaccagtatggagggacatccggcggcttgacccagacagctatgtgggatccgaacactggcgaggtcacgcagcgtgaggtttccgatactgagcacgatatgttttgttctggcatttcaatggatatgaacgggcgggttattgttaccggtggaaacgatgactctataaccagtatttacgattctttttccgacacgtggcatgggggagcaatgatgaatatcgagcgtgggtatcaggcgtcaaccattctttcggatggaaatatgtttgtcattgggggttcctggaatggtccgcagctcaggaataagaacagcgaagtctataatgtagttgcagacacctggaccgaacttcccaacgccggctcaagttatatgctgaccaatgataacctcggcccttaccaccaggacaaccatggctggatatttggctggaagaatctctcgatctttcaagcaggtccaagtcgtcagatgcactggtattctgcccacggccaaggaagtgtggcagatgcagggaaacgaaacagcgacaatgaccagatgtgtggcaatgcggttatgtttgatgcagccaagggaaagatcctcacatttggagggtccccgaattacgaggattccacggctacaaacaatgcatctctcattatattcgtcttcaccacnnggggctcgaagctctcgcgctaa

SEQ ID NO: 420 - DNA, 717 bp, A.fumigatus
agtgcatgcgtattcgttggtcacagacagacactcggtcatttcaaatgggcggcggccaacgtcaccagactgacgtgtcccctgtccctccacgctgaaattttcaacgacaacgccaaaaaaaaaggtcatcgactgagaccgagccatcgcgttgaactttgtctcctccgtacacatactggcaagtggcaagtgacaactgtcgacaatctcgacatgggtgtaattccccccgaagagccaatcgatctcttcagaggctggccaaacccggccctgttgcccacctccgccttggcccaggcatccgccactgtcctgtccacgccgtccattcggaccccagccctgctgtatgggcctgatgatggctatctgcccttgcgaaagagtgttgctgaatggctgacccacttttacaaaccccgcgatccggttgggttcgatcggatctgcattactggcggtgccagccagaatctggcatgtattttccaagtcttcaccgatccaagttataccagacatgtctggatggtagcgcctgcatatcacctggcgtcccggatggtagacgatgccggcttcgcaggtcgtgtcagagccgttccgcaggatgacgcggggcttgatcttgactatctccgtcgggagatggaggcggccgagcggaaagctaatgaagagcagagattcgaaccggtacggtag

SEQ ID NO: 421 - DNA, 612 bp, A.fumigatus
  unsure (48): Identity of nucleotide sequences at the above locations are unknown.
cccccaaggaaagcgaactttgaacttgtttttcgaaccgaggggcgnttgtccgccgtccgggttctcctaatgaacttcagccgcaattacgtcggactccaaagtataacggtgacggtcgagaatatcagcacgcggtatccgcagctcgcggcgctgattgggcgagggggtttttcgtcgcttgggctgcggaatggggtgatgacgcaacggggaccgcgggattcagcgcgtgtgtatgtctttttcaccgcggcggatgggttcactggcgaggggaagcgagcggctagcgtaacgaaggagcagctactcagtgacgaggccctcctggggaggtttggtgactctgtgaaggagttggtggctgttggtgttgcgtgcgacaaaaccgcggacctgcctgagggggtcgttgaggtcaaaccgctgtatatgttgcctgttggcgctgcgtgggcgcataagccgggtgtgactatcgtcggggacgccgcgcatctgatgtgtccgtgggctggggagggagttaatctcgccatgtgtgatgcgctgatgcttgcgaaggttattgtcaaggtatgggagaaatggaccggatgttag

SEQ ID NO: 422 - DNA, 621 bp, A.fumigatus
accaacgacggaaacacgatgctgaaagacatgagcgtgatgcaccctgcggccagaatgcttgtcgatctgagtgctgctcaggatgtcgaagctggtgatggaacaacgtccgtggtcgtgatcgctggtagcttgctcggtgccgccgagcgcctgttgggcaagggtattcatcccaccatcatctcggaatctttccagcgagccgctgctgctgcggtggaaattctccagaatatgtctcgcccgatcaacctgatggaccgtgctactctcctgcaagccgcttctacatcgctatcctccaagatcgtatcgcaacactctggccttcttggccctatggcggtggattcggtgctcaaggttatcaatcctaaaacggcagagaacgtggatctgagaaatatccgaattgtgaagaaggtcggcggtacaattgaggacagtgaaatggttgacggcctcgtgttgaaccagcccgtcatcaagagcagcggcggccccacaagaatcgagaaggcccggatagggctgattcaattccagctcagtcctcccaagcctgatgtacgtgtctctacctcaaaagcacgatacaggtatacaggttgctaa

SEQ ID NO: 423 - DNA, 207 bp, A.fumigatus
gtttcgggcggaaatgacaaccaattcatggttggggaccagctgaatgggacaccgtttattcgtttctcggaccataccgcagccgtgaaggccatcgcctggtcaccccatcaacaccttctcctcgcctcaggtggaggcacggcggaccggaccatcaaattttggaacactgctattggttcactgatcaagggaagttga

SEQ ID NO: 424 - DNA, 312 bp, A.fumigatus
tcaagggaagttgatacgggtagccaggtgtgtaacctggcatggtcgaagaactcggacgaaatcatcagtacacacgggtacagtcagaaccagattgtaatctggaaatacccgcgcatggagcagattgtatcgctgaccggccacactttccgtgttctctaccttgcgatgagccccgatggacagaccgtcgttactggagctggtgacgaaacgttgagattctggaagattttcaataagaggtcaggaagagaacatggacgagagagcggcaagcttgcggaatggggtacgattcggtag

SEQ ID NO: 425 - DNA, 213 bp, A.fumigatus
ccagggtcttcaggtcgtgctattattggagctggtgtcggtatagtgaaagttgcggctcctgtattgatccaagagatttcccatcctcggcttcgacctattcttggctcctgctaccaaacgttcgcatacatcggaatcttcttcgccgctattatgacttgtgactcacccagaccaacccgaagtacgttctcagctaacccatga

SEQ ID NO: 426 - DNA, 450 bp, A.fumigatus
agacggccaaagatctgggcggagacgctgaatgggaccatcgtagggggggagaaaggcgggtggtaccatgacgacgtgtggaacaggaagtacctgaggggcttcaagtgggcggatcggatggagcaggtgcagcgggagagttcggagagggaggcgaagaggcggattgagaacacaaggccccggaaggaagataaggtgttcttgcaaggtgtggagcagggtaagtttctgcaggggatccagaagaagaatgaggagaagaaaaagaagaaaggggagacggggaccggtgaggggtctgctgatgcagctgcgaatgcgtctgaactcaaggtccgcaggttgttcaaacagaacgaggtcaagatgggacgggataaggtcaaggatatttctgcgttggaagatgatgcgaagcgtgtgctgagcaaaatcttctaa

SEQ ID NO: 427 - DNA, 501 bp, A.fumigatus
ggaattctgcatgttagcgactctgtactcggtaatcatctcaccggcacaaacttcaacgatcccaactttgaagccatcgaagccagcagtcaatatagctgtactattccggacgttgtactggtcaagaagcactatgctcgcaagaagaacaagaagactcgcaactggcgacttaagcgcatggctcgcgagtatgaggaggaggctctgcagcagcagggagcgtcaatcagtcgcaaacaagagcaggagcgtgaacgcatggaggccgactttgaaatgttcctgcgggatgtcgaagaagaccaagaattgcgtagtaccctgcaactatacaagaacaagaatgctcggccgaataatcgtatgcaagtcgaaggcggtgctggtggcatggagatggatgaggatgagagcgatgacgatgcgcctaagattagcatggaagagttgctcgacgactttgacgagctgaacatggatgacgaggaatga

SEQ ID NO: 428 - DNA, 930 bp, A.fumigatus
  unsure (61),(66),(67),(69),(70),(74),(75),(77),(81),(84),(85),(87),(88),(92),(97),(100),(101),(104),(105),(106),(109),(111),(113),(114),(115),(121),(124),(127),(129),(130),(131),(140),(141),(144),(150: Identity of nucleotide sequences at the above locations are unknown.
accaaaaggcagaagaataaggcaaagaggaatcaaaaagtaatgctcacaagcggatttnaaccnntnncctnntnattnctnntnntgcnctctnccnnctnnnctntncnnnctctcnctnctntnnnctttttttnnttnctttcnnttcccntttcnntntnnaattncccttcctttcccccttnttctcccttttctttctttcttttttttttccctcttttcccctttcttctttcccctctttnttttcttttcccctttctctttttttccctccttcntttccttttcccnccctttctctctctccctcctttctttttctctctctctctcttccctctccttttttttcttcctnttccttctttttctccctttctcctcttccctttttttcttctttttcttctccttctttttccctcccccccctctttttccctctttccttccctttcccctcctctcttcctcttttctctctnttctttttttttccttctttccttttctcttcccctcttttctcccctttttctctcccccttttttccttttccccttttcttttctccctttccttccccttcctttttctttcntttctnccccctcnctcttcttctttcttcttcttcttttcttttttctcctctttttcttttctcttccccttnctcctttctctttttcttcttccttttttttctcttctccctttttttttttttttttccctcttcncnctctttttctcccttttttcctnttctttctttctctttcttctcttctttcctccctttttttcttcttttcttctcttnncttccttcctcttttncnttctctctccttttcctctcttcctcctctcctttcctccctttttctttttcctcctctttttctctcccc

SEQ ID NO: 429 - DNA, 888 bp, A.fumigatus
  unsure (18),(23),(24),(26),(27),(31),(32),(34),(38),(41),(42),(44),(45),(49),(54),(57),(58),(61),(62),(63),(66),(68),(70),(71),(72),(78),(81),(84),(86),(87),(88),(97),(98),(101),(107),(108),(114),(119: Identity of nucleotide sequences at the above locations are unknown.
tgctcacaagcggatttnaaccnntnncctnntnattnctnntnntgcnctctnccnnctnnnctntncnnnctctcnctnctntnnnctttttttnnttnctttcnnttcccntttcnntntnnaattncccttcctttcccccttnttctcccttttctttctttcttttttttttccctcttttcccctttcttctttcccctctttnttttcttttcccctttctctttttttccctccttcntttccttttcccnccctttctctctctccctcctttctttttctctctctctctcttccctctccttttttttcttcctnttccttctttttctccctttctcctcttccctttttttcttctttttcttctccttctttttccctcccccccctctttttccctctttccttccctttcccctcctctcttcctcttttctctctnttctttttttttccttctttccttttctcttcccctcttttctcccctttttctctcccccttttttccttttccccttttcttttctccctttccttccccttcctttttctttcntttctnccccctcnctcttcttctttcttcttcttcttttcttttttctcctctttttcttttctcttccccttnctcctttctctttttcttcttccttttttttctcttctccctttttttttttttttttccctcttcncnctctttttctcccttttttcctnttctttctttctctttcttctcttctttcctccctttttttcttcttttcttctcttnncttccttcctcttttncnttctctctccttttcctctcttcctcctctcctttcctccctttttctttttcctcctctttttctctccccc

SEQ ID NO: 430 - DNA, 909 bp, A.fumigatus
  unsure (41),(46),(47),(49),(50),(54),(55),(57),(61),(64),(65),(67),(68),(72),(77),(80),(81),(84),(85),(86),(89),(91),(93),(94),(95),(101),(104),(107),(109),(110),(111),(120),(121),(124),(130),(131),(1: Identity of nucleotide sequences at the above locations are unknown.
ggcaaagaggaatcaaaaagtaatgctcacaagcggatttnaaccnntnncctnntnattnctnntnntgcnctctnccnnctnnnctntncnnnctctcnctnctntnnnctttttttnnttnctttcnnttcccntttcnntntnnaattncccttcctttcccccttnttctcccttttctttctttcttttttttttccctcttttcccctttcttctttcccctctttnttttcttttcccctttctctttttttccctccttcntttccttttcccnccctttctctctctccctcctttctttttctctctctctctcttccctctccttttttttcttcctnttccttctttttctccctttctcctcttccctttttttcttctttttcttctccttctttttccctcccccccctctttttccctctttccttccctttcccctcctctcttcctcttttctctctnttctttttttttccttctttccttttctcttcccctcttttctcccctttttctctcccccttttttccttttccccttttcttttctccctttccttccccttcctttttctttcntttctnccccctcnctcttcttctttcttcttcttcttttcttttttctcctctttttcttttctcttccccttnctcctttctctttttcttcttccttttttttctcttctccctttttttttttttttttccctcttcncnctctttttctcccttttttcctnttctttctttctctttcttctcttctttcctccctttttttcttcttttcttctcttnncttccttcctcttttncnttctctctccttttcctctcttcctcctctcctttcctccctttttctttttcctcctctttttctctccc

SEQ ID NO: 431 - DNA, 855 bp, A.fumigatus
  unsure (73),(75),(91),(92),(150),(173),(175),(242),(303),(311),(317),(434),(561),(628),(641),(677),(740),(758),(763),(764),(766),(768),(769),(774),(780),(781),(787),(790),(791),(800),(801),(802),(804): Identity of nucleotide sequences at the above locations are unknown.
ggggagagaaaaagaggaggaaaaagaaaaagggaggaaaggagaggaggaagagaggaaaaggagagagaangnaaaagaggaaggaagnnaagagaagaaaagaagaaaaaaagggaggaaagaagagaagaaagagaaagaaagaanaggaaaaaagggagaaaaagagngngaagagggaaaaaaaaaaaaaaaaagggagaagagaaaaaaaaggaagaagaaaaagagaaaggagnaaggggaagagaaaagaaaaagaggagaaaaaagaaaagaagaagaagaaagaagaagagngagggggnagaaangaaagaaaaaggaaggggaaggaaagggagaaaagaaaaggggaaaaggaaaaaagggggagagaaaaaggggagaaaagaggggaagagaaaaggaaagaaggaaaaaaaaagaanagagagaaaagaggaagagaggaggggaaagggaaggaaagagggaaaaagaggggggggagggaaaaagaaggagaagaaaaagaagaaaaaaagggaagaggagaaagggagaaaaagaaggaanaggaagaaaaaaaaggagagggaagagagagagagagaaaaagaaaggagggagagagagaaagggngggaaaaggaaangaaggagggaaaaaaagagaaaggggaaaagaaaanaaagaggggaaagaagaaaggggaaaagagggaaaaaaaaaagaaagaaagaaaagggagaanaagggggaaaggaagggnaattnnananngaaangggaanngaaagnaannaaaaaaagnnnanagnagngagagnnngnanagnnnagnnggnagagngcannannagnaatna

SEQ ID NO: 432 - DNA, 870 bp, A.fumigatus
  unsure (72),(74),(90),(91),(149),(172),(174),(241),(302),(310),(316),(433),(560),(627),(640),(676),(739),(757),(762),(763),(765),(767),(768),(773),(779),(780),(786),(789),(790),(799),(800),(801),(803): Identity of nucleotide sequences at the above locations are unknown.
gggagagaaaaagaggaggaaaaagaaaaagggaggaaaggagaggaggaagagaggaaaaggagagagaangnaaaagaggaaggaagnnaagagaagaaaagaagaaaaaaagggaggaaagaagagaagaaagagaaagaaagaanaggaaaaaagggagaaaaagagngngaagagggaaaaaaaaaaaaaaaaagggagaagagaaaaaaaaggaagaagaaaaagagaaaggagnaaggggaagagaaaagaaaaagaggagaaaaaagaaaagaagaagaagaaagaagaagagngagggggnagaaangaaagaaaaaggaaggggaaggaaagggagaaaagaaaaggggaaaaggaaaaaagggggagagaaaaaggggagaaaagaggggaagagaaaaggaaagaaggaaaaaaaaagaanagagagaaaagaggaagagaggaggggaaagggaaggaaagagggaaaaagaggggggggagggaaaaagaaggagaagaaaaagaagaaaaaaagggaagaggagaaagggagaaaaagaaggaanaggaagaaaaaaaaggagagggaagagagagagagagaaaaagaaaggagggagagagagaaagggngggaaaaggaaangaaggagggaaaaaaagagaaaggggaaaagaaaanaaagaggggaaagaagaaaggggaaaagagggaaaaaaaaaagaaagaaagaaaagggagaanaagggggaaaggaagggnaattnnananngaaangggaanngaaagnaannaaaaaaagnnnanagnagngagagnnngnanagnnnagnnggnagagngcannannagnaatnannaggnnannggttna

SEQ ID NO: 433 - DNA, 765 bp, A.fumigatus
  unsure (74),(76),(92),(93),(151),(174),(176),(243),(304),(312),(318),(435),(562),(629),(642),(678),(741),(759),(764),(765): Identity of nucleotide sequences at the above locations are unknown.
gggggagagaaaaagaggaggaaaaagaaaaagggaggaaaggagaggaggaagagaggaaaaggagagagaangnaaaagaggaaggaagnnaagagaagaaaagaagaaaaaaagggaggaaagaagagaagaaagagaaagaaagaanaggaaaaaagggagaaaaagagngngaagagggaaaaaaaaaaaaaaaaagggagaagagaaaaaaaaggaagaagaaaaagagaaaggagnaaggggaagagaaaagaaaaagaggagaaaaaagaaaagaagaagaagaaagaagaagagngagggggnagaaangaaagaaaaaggaaggggaaggaaagggagaaaagaaaaggggaaaaggaaaaaagggggagagaaaaaggggagaaaagaggggaagagaaaaggaaagaaggaaaaaaaaagaanagagagaaaagaggaagagaggaggggaaagggaaggaaagagggaaaaagaggggggggagggaaaaagaaggagaagaaaaagaagaaaaaaagggaagaggagaaagggagaaaaagaaggaanaggaagaaaaaaaaggagagggaagagagagagagagaaaaagaaaggagggagagagagaaagggngggaaaaggaaangaaggagggaaaaaaagagaaaggggaaaagaaaanaaagaggggaaagaagaaaggggaaaagagggaaaaaaaaaagaaagaaagaaaagggagaanaagggggaaaggaagggnaattnn

SEQ ID NO: 434 - DNA, 1248 bp, A.fumigatus
  unsure (622): Identity of nucleotide sequences at the above locations are unknown.
agacctgtgtggtgtgctttgtctccaaattaccccagtttggtgattgctcggattttccaagggatcgctgtcagtactgtcgagtgtcttccctctgccactattgccgaaatctacttcctgcatgagcgagcatatcgtgttggcatctacacacttctccttcttggtggcaaaaacctcgtgcctctggtcagcgctgctattatcggccgcatgggatggcgttgggtgttttggatcgtcgcaattattgttggtgcttgtctcgtcctcctcttctttttcgttcccgagacgttctgggatcgcacaccgcgtcctcgtcgctctcacaagcgtcctcatccgatgcggagcgtatcggaccttctccggggtcgacaacttcaccaccgtctggagaacccagcctcgaatggagaccacacatcacctgctcccagaaagtccaacaagggtcacgttggctttgtggaggatcaagatcaggatggaaaccccatagatgagaagaaaagaaatcttgaagataacgaccagatattaccatccgagacgccagccgagcacaacgatcagtcggtcttggcgaatcccgagcagcacgatgcacccntacaaatacctgctccagcggtcactcgtgagtcagactctcagcgcgatctcgaatttgctaggcgacctgccgtgtcacccgcgcgtagtgaatccgtgggttcagccgtaccactgcttccgtcccaggtgtataccaaccgactacgagagaaacctcgaatcccctttacgcattacctgcgagtctggaacgggcgaatttcgcatgacaaatggttacgagtcgccatacgaccgttcattctgttcgcctacccagctgtcctctggtcatcagtagtgtatgcactgtctgtcggatggcttatcgtgctgtctgagtctgtggctcatctgtaccagggcccgcatggttacaacttcacacctctacagaccggcctgatttatatctccccgttcgtcggcggtcttttaggaaccgcggttgccggtaaagtatccgatgtgattgtgcgattcatgtcccggcgcaatggaggcgtctacgagcccgaattccgccttgtcatggccatccctattgctctatcaacttcggcgggattgatggcattcggatggagcacggcggtgaaagatctttaccaaggggaccgaggcatcccgcgctatggtcat

SEQ ID NO: 435 - DNA, 318 bp, A.fumigatus
aattggaggcacacccctaaggttggcaagcaatcccgaaaccagaattttcggaatgccgtggacaaggacggtacccgccttcccacgaggatttatcccgcacctgccgtatcaacgatccgtgctgatctagtagatttgactggacgtccgatgttctcgatgacgggtaacgttatcagttgcggtcgacttgtcgcactagctcattgcttgggcctcaaccgagaccctagcaactggaagctgtctccccaggagaaggacaatcgtattcgtttatggtggggcgttgtcatccatgaccgttggtaa

SEQ ID NO: 436 - DNA, 570 bp, A.fumigatus
agcatcgaattactccatacaaccatacaagccgtggatatcctgagtgcgacccactcagtcgacgattataacgtcagcactgccggatttatcggattttatcattcaatcggccgttatccccttccagaacgatcaacatatttctataagaccctctttgcttctgtacttagagtcctacctcacacgaatccatccgtaaactcaggcgcagtcagacaaaaccataaaatggacttcatcagtacccaacaccacgatacctaccccttcatcgcccaggccacccaccacaaccacagagtcctcatcaccggcgcctcccgaggcatcggcctcgcaacagcgcactccttcgcgcgagccggcgccccatccatcgccatcgctgcccgaggccccctcgataccgtggagactgccctcctctccaccgccaaagaagcaggccacccgccgccaacaatcctcaaactgaccctcgacgtcgcagacgatgccagcgtggcagctgctgcagaggaagtggccgctactcggacacctcgacatcctgatcaataa

SEQ ID NO: 437 - DNA, 198 bp, A.fumigatus
aataagccaactcgctcatgctacagattgaatgatatcgaggatggttccacccttcgccggggtaagcccgctgcacatctcaaattcggactcggacagaccgtcaacgccgccacgtttctgcatgcggaggccgtgaggtatactcttgagcatcttgggcccgattgttcgatgctcatgttgaaactatag

SEQ ID NO: 438 - DNA, 891 bp, A.fumigatus
tcctcttcttgtagcgcgggtccttccagccccgtggtgaagactgacgttacggatgctattatcgagttggacaaggctttccgctgtgcaaaggctcctctgtcgcccatcagccgtccagacaataattcagttgaattcgcccgtacgcaagaaaatgggaattccctcagcctacctgaattacctcctattctggacagttcactggaattggcggtctttacacatcctggcttgagcaaggattcgaagttgacttatgatcgccttgagatacttggagatgcttatatagagctgatcgctacgaggttcatttggggcaggtatgagggtttttcttctggtcagatttcgcaaataagggagctactggttaagaatgagactttgtcggagtttgcgacattatacgggctcgacaacagagcgtcagtgccacgggacttgcttagccagcccaggcgatggaccaagactaaaggtgacatcttcgagtcttatgtggctgcagttattttgtctcgtccgagtgatggttaccacgttgctgaacgatggttgacacagctatggcttccaaggctcacagatgctgtgataccgcggactgctttggatgcaaaggagaaccttgccaagagaattatgggtaaaggagttaagctcaaatatgttgatgagcgttcacctgcacagtcgagaggtgggatgcagactttctatgtgggtgtttaccttactggttggggctggcaaaacaagcatttgggttctggtcatggacctagtaaagcagttgcaggggatgcagcagcacggcaagccctgtttgaatggagctctttaaaatttataattcccaccaaaaaagaaaacccttga

SEQ ID NO: 439 - DNA, 309 bp, A.fumigatus
tcaccgcattacgtgccagccccgtcgtgtcagaataactcatcaggccatgcgggctggctcggatggcccgccaacttgggccccgccgcaacactcttcgccaaagtctacaccgacgcgggttcccccgcggctgttcgtggcctggccaccaacgtcgccaactacaacgcctggtcgctcagtacctgcccctcctacacccagggagacccccaactgcgacgagaagaagtacatcaacgccatggcgcctcttctcaaggaagccggcttcgatgcccacttcatcatggatacctgtaa

SEQ ID NO: 440 - DNA, 312 bp, A.fumigatus
gtgcttattccaatcgccgatgtgtgccgactaatcaatgtttcagcccggaatggcgtccagcccacgaagcaaaacgcctggggtgactggtgcaacgtcatcggcaccggcttcggtgttcgcccctcgactaacaccggcgatccgctccaggatgcctttgtatggatcaagcccggtggagagagtgatggcacgtccaactcgacttccccccggtatgacgcgcactgcggatatagtgatgctctgcagcctgctcctgaggctggtacttggttccaggtatgtcatccattagccagatga

SEQ ID NO: 441 - DNA, 342 bp, A.fumigatus
caccgcattacgtgccagccccgtcgtgtcagaataactcatcaggccatgcgggctggctcggatggcccgccaacttgggccccgccgcaacactcttcgccaaagtctacaccgacgcgggttcccccgcggctgttcgtggcctggccaccaacgtcgccaactacaacgcctggtcgctcagtacctgcccctcctacacccagggagacccccaactgcgacgagaagaagtacatcaacgccatggcgcctcttctcaaggaagccggcttcgatgcccacttcatcatggatacctgtaagtgcttattccaatcgccgatgtgtgccgactaa

SEQ ID NO: 442 - DNA, 510 bp, A.fumigatus
  unsure (165): Identity of nucleotide sequences at the above locations are unknown.
tggagattttgttccgtgagtgcgagggagggcatgattatcacggactttgcgagtatgccgtttgcccgacaactagagaagacagctgctaatgattgtaggtccaagaatcgatggactatggttgcatccctagtgattgctacgatcttacgagtcctntgggtcatcatttcttacggttgtaaagttccggtcggcattttcgtcccgtcaatggccattggagcgtcctttggtcgcttggtagggattcttgtccaggccttgcacgaggctttccctaattccgcctactatgcctcttgcaaaccagatgttccatgtatcactcccggaacatatgcgttccttggcgctggggccgctctgagtgggattatgcatctcagaatatctgtggttgtcatcatgtttgaaccttacgggggccttacttactttctacccacaatggtgagtcaatcaggattggttggcatcatcacaaaacactacattgggtaa

SEQ ID NO: 443 - DNA, 288 bp, A.fumigatus
ttaggtggttggacactattgatcaagtccatcgcgcttccattggccattgcgtctggtctttcagtgggaaaagaaggtcccagtgtacattttgccgtctgtacagggaatgtcatctcgcgcctttttagcaagtataagctgaacgcatcgaaaacgagagaagtcctgacggcaactgctgctgctggtgtggcagtggcatttggcagtccaattgggggggtactattctctctagaggttggtgattttgaggcgcatgtgttcggagggttatgctga

SEQ ID NO: 444 - DNA, 219 bp, A.fumigatus
tccaggccacagatgatgaatcccttcaggaccggacaactcgtcatgtttcaggtgcagtatgatcgcacgtggcattttttcgaactaatatttttcgtacttcttgggatatttggtggtttgtacggcgtctttgtgatcaagtggaatctgcgagtccaggcgttcaggaagaaatatctttcgcaataccccattgtcgaatcagtcatctga

SEQ ID NO: 445 - DNA, 957 bp, A.fumigatus
tgtacgcatttcctgccgtcccggcggttaagaatcgacagctgcgacgttcgtggatccctggaaggattgaaggagatgttgagcgagcttaagtcggcaaaagagattgctattgatttggagcatcacgatgtgcactcgtatcatggcttggtgtctctgatgcagatcagcacccgggacaaggattgggttgttgacacgctgaaaccttggagagaagagctccagattctcaatgaggtatttgcggatcctggaattctcaaagttctccatggctcgtccatggatattatctggctgcagcgagatctcggcctctacgttgtgggcatgttcgacacctaccacgccgcctgtgccttaaactacccgaagcggagcttgaagttcctccttcacaagtttgtcaacttcgaagccgacaagagatatcagatggccgactggagaatccgtcctctcccgtcaggaatgtttgactatgcccgctccgatactcactacctcctctatatttacgaccacctacgcaacgagctgttggaaaactcgacgccggaccacaatctcgtcgattatgtactggaacagtcaaagaacgaagctttacaacgttacgagcgtcccgtttacgacgctgccacgggacaagggcaaggcggatggtatgactatctgtaccgcaaccctgctgttctgagcaaggaacagtttgccgtcttcaaagcagtgcaccaatggcgcgacgaggtggcaagggaagaagacgagggcgttcaatgcgtgtttccaaagcacattcttttcaagattgcccaagtcatgccccttgaccagggtactctgttccggacgttatctcccgtgacgccgattgccaaggaccgagcagcggatctcctggaagttatcaagaaagcgaagattgaaggagctacaggacccgaa

SEQ ID NO: 446 - DNA, 615 bp, A.fumigatus
tctctggggatacatctttccttcgtgcggcttggtgaaaacaccgtcgcgatgtctcgtgcgcggtcccacacgcgcagtgccagccgtagtccctctgcttactcgcggtctgccacgcccagcgatgacgaggaagcggcccgggagcgggagcgcattcgtcgcgagcgccgccaggacgccgagcgacagctgcgccagtctcgcatgggcacggaacgacggatccagatgatggcccgtgagcagaatcgtgatatctccgagaaggtcgcgctcgggttggccaagcccacccagacatccgagtccatgtgggactctcggctctttaaccagacaagtggcctgcagtccgggttcaacgaggataatccctacgataagccgttgtttgccgcgcaggacgcgatcaacagcatttaccggcctcgggctcagctggatgtggatgacgaagagggagctgaaggggagatgagcaaaattcagaaaaccaatcgcttcgaagttctgggcaaagccaaagatagtttccgtggcgcagctgaggctgaggtgagatttgattccccttctgctccccccccctctaggatgcctctatcctga

SEQ ID NO: 447 - DNA, 894 bp, A.fumigatus
agtcctctccttgcacccatattcaatctgccaaatcctgtctcattgagacaaaggaacgcaatatttcagtcatactgtgattttatctccgagagatcaaaggctattaagctcatcaagatgagcgcgcacactttgaaaaagaagtcctgggagtccctctcgtcgactttctccaacctcgaaatatctgtctcccaggacagttgctacgcctcggacgagctctccatcagtccaaccaatcctgtcactgctggcacgtcgctagcctcctttacgccagcccgccagaattcattacactcgctattgaagcctattttgaagaggccgtactctgatattgaggaagatgaggaacctgagtctggctacggaacagacgattctgaatacgattacgcttctgtgtctgatgagcatgacgacgaaatgtatgcggtttccacctgggacgaggcctcggatgcctctgatgccatcttggaaaactgcaatgatgatgttgaatcagtggacggttcattcatttcgttcgaatcaatggtgcgtttcgacaccaatgtgcgttatatcgaggcgccagagcctcaggaagaagagaccgagacgccgagaaccgaattaacctgccatgaattaatggaaatggcgagggcgtctggcactcttcgcctgcagggcgaacaagtcgctgagtctgattcgagtgacaaaatgcccgaacatgatgaactcgatgattcaatcaaacaatggccagaggagcacccgagtgacattgtggacctggataagagactattcatcggctacatcaaccgcatcaacggaaatgccgatcctggatacaaagtgcgtcttccggaaagatttgatgatatttag

SEQ ID NO: 448 - DNA, 204 bp, A.fumigatus
  unsure (64),(67): Identity of nucleotide sequences at the above locations are unknown.
cccggcccactattcgccgatgaccgcatccatgttggtgccttcgcatcctggtgcaccccgntcntagtccttactacccccctccaccacagcatgatcggcgtccctcgccgcaatctgcctacccgtacgatagccgtcactcctcttccccgcacagctccccatatcctcctctgcacaccgctacaagtacgatga

SEQ ID NO: 449 - DNA, 198 bp, A.fumigatus
acttcaatcgcggatccttccagccccgtggtgaagacaagtatcgaaggtatccctttagcgactttcaaccatgtggattatggtgtcttcggcttttgcaaggggggcgaatgcaccaacatcggtaggggctacactactggtatgtggtttcgcctgtacagcagcaagcaggttgccggctaccatagctga

SEQ ID NO: 450 - DNA, 798 bp, A.fumigatus
catccttcagacgaaatttcaaacaccgacaatagcgagttcgatctaccatcgagtactcgaagggccctatcctccatcctgatcgggcacccggtcgccgcctttctcaccctcgtttgcctttgcctcgccgcggccgctcacctacacgctccgtcgcattcaccccgatatcttctagcgctcttgatcctcctacttacgacacttctagattccctccttgccttcttggtggacattcttctttttggaccgcatctaggatggggaggctggattgtcttgggtgccacaattctgctggtgatcagcggcgtggtcacttgcgcgatgcgccggactctggttagtcgcaaagcgagaaagagacgaatcgcagagaatgcagaaatgagtggggagaattactacaaccgacagaatgcggcggcgccggttgtcgccagcggattcaccggtccaagatcagcggccttgaacgctgaaacgaaagaggccattctcacaacctccccaaattcggagtccggccccatgttcgctaccttccgcacgacgacacattctagcgatgacgatcaaacgcctctcaatactcagggagctccgactgatattcctgcgccagatagtcagtatgctgcacgcggccacggcgatagaatgccctcgggtgcacttttcgacgagtcaagaaaccatccatatgcaagttcttaccgcccagggcctcggatgcgacctgaacctggtgatcctcgcttacgtcctcagtattcggacggcagtatg

SEQ ID NO: 451 - DNA, 348 bp, A.fumigatus
gcgcgtttccttccaggcccgtggcgtgaagaccagactttcctgagtgtgtgcctggccacgtccgtcctagcagttaccaatcacgctgagaatctagcgcatcaggcctctctgcctcatcatagattcaccctcgactgtctctcgtcttcaaagcgacttttcattggccaatgtacccgtggagatagcctgagacgacccgctgaccaacagatgcagcggtcttatgctcatcgagagtaccctcaagatcgacacctggtgaacctgtgccctcggaaaggttggtgtaatgggacgattggggtggagcgtctgtctttgttcgatgctggattatga

SEQ ID NO: 452 - DNA, 297 bp, A.fumigatus
ggggggggaaaaaaaagcaagaaaaaaaagactggcaactatcaacagacaatcggcatcatcttccctcaaaataatactcaaggtgaagaatatcgcccgagagttctccaaggtcagttcggcatggcaactctgacatcggtagggattgaaggtatcggcctacgcggcaccacgggaatcggcacgttgagaaaggtcaattgcggcgggaaaaatgattggtttggcactacgcaactgaatccctgggtgaggcgaaccgttcttccgttggcttctatggagatttga

SEQ ID NO: 453 - DNA, 288 bp, A.fumigatus
tcctgcaccccccgacttctccattttgtaacgtccaaaagcgaatcaactcgcaacttagtcctaagcgctgaacacgagccctactttgtgatattgcaatatctcttggctttttcttacaagaaggtagtcctggctcgagatacatttggcgagtgttcaacacaatgctacacctacctgtcactctacctttgcacagtgcaatctagatcagcattccagtcatcgactctggttcttaggtatcggttgtgctttagccgcaatccatgtcccacatag

SEQ ID NO: 454 - DNA, 1014 bp, A.fumigatus
ggtgggggtaccttatgccgttgtttattatcgggcattttcgcaaggacccttgttcatttgtggggatcaagaaattcaaagtcaatatggagaacaaggacgttcttccctatggatgccattcgcgaagtgaaatatctacaggaattttcgcatcccaatataatagctctgcacgatgtattctcttttaaagaccagaatctcaatctggttttggaatatttaccacgtggtgatctggagatgctcattaaggacgaaaacattcactacggtgttgcagatgtcaaggcttggatgggaatgcttgctagaggtgtttggttctgccacgaaaactttgtgctacatcgagacatcaaacccaacaacctcctcattgccagtgatggtgaggtcaagctggccgatttcggcttggctagatcatttgcagatccttatttaaatatgacacatcaggtcataactcgttggtatcgcccgcccgaactgctttatggtgcccggcagtactctggggctgttgatgtatggtccatggggatggtatttgctgaactcctcctgagagtcccatttgttgccggaaattcggacattgatcaaatatcgaaaatatgtgaagcattcggcacgccttccgaagagaattggccgggagtcagtacgttgcccaattatatcccctcggataggcaaagcactgttccactacagggtcgtgatttcttcttacggcagtttcccacggcaggtccagcgggtgcagatttacttatgtcgatgtgcacgttggatccaaggaagcggagcacggcttatcaaatactacagcatggctggtggtcgactgaaccaaggccgacagctaaggaggatcttcctcgtaaatcaggtgggactaagaaaatgggtgacgatctctcaaggcgcggtggcgacgtggacgacggtccattcaagagtgccgctcgacagctagatttcatggcagttaagcgttaa

SEQ ID NO: 455 - DNA, 825 bp, A.fumigatus
atggtggcccaagcccttaacgggtttgggcatccagattcccaagttccattcgaagagccatcacccgcaccatacccagcaacctattcaccacacacaccacaatcaagcttcacacaacatcaaccaccaacacacttctcgagcggggcattggcttccgcgactccccactttaccccaagccacatccaaaatggggctcacactaatgttgacgaggatattgacgaatcgatgaatgagcactggcagcaacaacttcagttggccgcggagtcacggcaggccagctcaccccactatcatgcccgatctgtcgcgcgacaagccaagggcatccagattgcccctagccaaccggagacacaagaacaagttcctgatgggcagaacggagtggtcaaggccaaggcatcttcacggcaaggttggcacgccttggatttcggcggacagggactgcgcgcgctgtccacgtctctgttcaactatatcttcttggagaaattgtacctgaatcataacaagctgaaggccctcccaccggccatcgggcagcttcggaaattaaatcacttggacctgtcaggcaacgacctcaccgagcttccagaggagatcggcatgctcacgaatctgaagaagctctacctgttcgacaacaatatccgcactcttccttacgagatgggttacctctacaggctggaaacactgggcgttgagggcaacccactgaatgatgtcttgaagtctcacatcatgaaagagggtaccaaggctttaatcaaatatctcaaggaagagatgccaggttag

SEQ ID NO: 456 - DNA, 195 bp, A.fumigatus
cgggtttgggcatccagattcccaagttccattcgaagagccatcacccgcaccatacccagcaacctattcaccacacacaccacaatcaagcttcacacaacatcaaccaccaacacacttctcgagcggggcattggcttccgcgactccccactttaccccaagccacatccaaaatggggctcacactaa

SEQ ID NO: 457 - DNA, 378 bp, A.fumigatus
agacccagtgcgccgaatgctagctgtacgccggaaacctacgaccacatactaggaatgattgacaagtacgtccgccgcgaacgctcccagcgccgctggcgtctggcccatttcgtggcgtcggttgttgtctcaatcggttgctttgttggagtctggtggaccggcgaccatctcccatatgtggccttcatcttgtgcttggtgagcacgctgagcttcggggcgggaatcttggatgggctgattggcgggttattcgtttcgagtgagctgcgggcgctgaaggagtttgagtgggaggtgcgcaatgcgaagcgcatcgttgagcgggcgggcgcccagggaacgatcaaaatcgaggagagccaatga

SEQ ID NO: 458 - DNA, 723 bp, A.fumigatus
cgcaccagcccacgaacacacaagtggtgttttattccacgtgaccggcaacccagattcacttcccccaaggctggagtacactcgaccaatcgtttccaccccttcgttaagcaagagacttcgaaacatgctttaactggatccgcgcctctggagcgcaaatctcgcgcgcgtcctgaagcagacgatgactggtctgctgcagggtctgagttcgattcgtctgacgatgacgacgacgagcggccaggaggtggtagtgctaaacaacttgcaagtattctatttggtactatggcaccaccacgacctttgagtgctatggatgacaaatcgccctccaagtcgtcgactccagtgcaggacagcccagttgcctctctccctgtgcctgagtcgaacggcagcctctctgcacctgctgcccctcctccgccccctcctcccccaccagcggcagtgcccagctatgatccatccgtcgcaccgcccccacctcctgcaccacctatggcaccacctgcgccacctccaggccctccaccgcccccaggccctccaccaccgccagctcctccggctgccagtggcccgcctacgcctgcaggagcacccgatcgtagcgcgctcttggcctcaattcaaaagggcaaagggcttcggaaggtccaaaccaacgatcggagcacgagctcaattgctggtcgtgtgcttgactag

SEQ ID NO: 459 - DNA, 279 bp, A.fumigatus
atctgtactgactgctatcgtgatatagcgaaagccttagaactcttcatgatttctctggtcaccaaggcggccaaagaagctagagatcgcaactcgaaacgcgtgaccgcgacgcatctgaaacaagcggttgtcaaggatgaagttttggatttcttggccgacataatcgccaaggttcccgatcaacctgccggcggaacgaagcatgtcttcatccacgaaggcggcaagaatccgcgaaagggcatacataaccccccaatcgcccccgcc

SEQ ID NO: 460 - DNA, 564 bp, A.fumigatus
agcattttcctagcaatgacagatcaggacagcacctacagaccccgttcacccgatctttccaccttccagtcctctgttcctcccgccgttaactcccccatctatcctctcgcgagtcctctggcacaccgggcttcctacgacgcctcacctttctttgccccgcaatatcagcaaccaccggccccgcttggtcgggtccctcagcagtacataccaccattcgtagacccgaactctcctctttctccagacatggctcgtcgatcctcccgtctggcacgcgcgaccgaggtcgcgcccatgccagaggtctcatacgcgcagccagtactctcggaagagccgcagcagctcccaccaccgccgccgcaacccaacccagtggctagcattgaggtgaagacgaagtttcctgtcgcgcgtatcaagcgtatcatgcaagcagacgaggatgtcggaaaggtggcacaggtcactcccattgctgtctgtacgtgtatcccacttcatttcgtccctgcgtctcttgaatctgtactgactgctatcgtgatatag

SEQ ID NO: 461 - DNA, 606 bp, A.fumigatus
ctttctgaacaagctttttccttgagcgacaccccaattgagtgcaacatgaccaaatccgccttcctcttcctagacatccagaacgggatcgtcgagcgcctagacgacccagatacttaccttgcaagccttgctcctgtcatcaaggcggctcgcaaatccgtcgtcaaagtcatctacgtcaagacagctttccgggaaggataccccgacacacatccgcgcagcaccatgggtactcgagtccgagaatcacaatccttccacgaaggtgatatctccgtggagatcccttccatcgtgtcaccggatgccaacgagccgatcatcaccaagcgccgcgtgtcggctttcaccgcgacggatctagacctagtgcttcgctgtctgggagcggagcatttggtcgtcgtcgggctgatcaccagcggtgcggtgctgtcaactgttcggcaggctgctgatctggactaccagttgactgtgttggaggatctgtgcatggacagagaccaagaggttcatgatgttttgatgaaaaaggtgttgtcaagacaggcgcgggttgtttcctctgcagagtggttggcagaactggattga

SEQ ID NO: 462 - DNA, 303 bp, A.fumigatus
ttccttctcgtttgctgtattcttatattacgtggatcggcctacaatctttcgcagatggcatctcgaagccccagcgaagaagcacctaaaccggcgccgtttagcaacttcccgcaggacccggctgaattcgacagcgaccccagaatttccttctcgaagctggacaacaagtttatactagagactgaagacggacaggaatttgaatacgatacggttttaaaacgatggattccgacggtgtgtgcgcgcttcctctgcagctggtcgattccctttgtatcttgcgatcgttga

SEQ ID NO: 463 - DNA, 249 bp, A.fumigatus
aacgatggattccgacggtgtgtgcgcgcttcctctgcagctggtcgattccctttgtatcttgcgatcgttgaactcttacctttcctgtctccctcttgttatgagctccctttctaccacactgtgtttttcccacttgccaagtatcatatctggagcacagcgtttgactgcagatacactgccatcgccgttgctacatggtctgtcttcaccacggggctggcaggttccgcgcttagcgta

SEQ ID NO: 464 - DNA, 687 bp, A.fumigatus
ttgccaccactgttagttgaaatggggatgatggaaaataataaccgattccgttcttattctgtcaatgctaaggagaaatacgcagacgatgagattcttgagtatgccactcgctattctcaaattccttctggcaccgtcaccctttctgccgcagcgacagccgctcaactcgctgccacgcaggcccagattcatcaacataatcttgccgtgcaagcattcgccaaccatgcttcggtaaaccgaccgcgagcacgaacagctggtgtgttagaagctcctccgcagagatcttcaattcgtaactatctggccactccgtctcgcctcgaaaacagcttcagtgccgcggatcttcatatcgccgaaaccggtgaatacgatgagctatccgaagctgtgcagatgatgaacctcggaggtaatggtggtcaaaacctgggtcttcgcgcgagcggagaggctgctgacgaaagcaaccaagatgggcccacacgagccttatggattggcagtattccagtctccacgactgtcacctcgctcgaggcgatctttggcatatatggcaagattgagtctacccgtgttttgacgcacaagaactgcggttttgtcaactttgagcgcctggagagtgccgtgcaagccaaatcattgcttaatggcaaagagatcttc

SEQ ID NO: 465 - DNA, 375 bp, A.fumigatus
  unsure (338): Identity of nucleotide sequences at the above locations are unknown.
aggagtcaaacggattcgtctggcggcggcggcgatctaaccactatgacgcgcacttctacacctcccaccctactccaactccaaagcgcagactcagtatcatctcaagctgcagtacttcgcagtctgaagaacgaaacaattggtcatgatcagcgcaaagagatttatatcaagcggggaatcattccggtgctcactaaggtcctcacgtcacggaaactgagcggggggagcgttacggcgccggttaaagaatcatctggcatcaagtcggaggaagacgatgcttgtctacaggcgatcatcatcctcggtagtttggctcaaggtanatttccagtgatttgtcccaacaacgccagtggtcac

SEQ ID NO: 466 - DNA, 261 bp, A.fumigatus
  unsure (8),(35),(54),(64),(68),(93),(118),(121),(122),(123),(233): Identity of nucleotide sequences at the above locations are unknown.
cataattntacaaaccttggcgtgaatgatcttgntgggatggagaaaattaanagggacaagnccanactccggatttggattacttccgantacctgtttgagattcgtaccttanatnnngtaatagctcttcataagcgctctatatcaacacaactgattcttagaaacctgctttccatgatattacatggaaaatggaccggagccttgacatggggaaactgtanacttttctcaacttcttggtgctcatga

SEQ ID NO: 467 - DNA, 237 bp, A.fumigatus
cccgttgcaatgaaccgaagcattacgtccatcaattcccgggcgtgcatccaaaccctctactggtccctcaacccctcaatcccccctcaaaggagctgtttctcctggaccgcgctgcacctaccgtattggtccaacggcgctcttcaaggagagaattcgccggactatcctaggtcctcccaaagcacctttattcaccgccacagacagaagcccattcaatcatgctaa

SEQ ID NO: 468 - DNA, 225 bp, A.fumigatus
tggtacgtcactgagaaatcggttgtcatttctcttctgacaattataggttctgagcgggcgagaactgcaaagacggcgggatctaccctagccgaagccggtaaaatcaatgagagtctcatgtatctgggacaatgtttacagatgcagagtgaaatccaagaagggaaggtgcgtttcatgatgccgacgattctctttccttgtcttcaccacgggtag

SEQ ID NO: 469 - DNA, 795 bp, A.fumigatus
accgaagcattacgtccatcaattcccgggcgtgcatccaaaccctctactggtccctcaacccctcaatcccccctcaaaggagctgtttctcctggaccgcgctgcacctaccgtattggtccaacggcgctcttcaaggagagaattcgccggactatcctaggtcctcccaaagcacctttattcaccgccacagacagaagcccattcaatcatgctaaacaatcttctcacatacttcaggaaccgactcctgccctcatctttcctcgtcgcaatatgcctcaaaagcccaacgttctgcctcgcttgccggatgttagccacttgaccgtcgaactaaaccataactccgaatacatcgtcctcgtctcaatgtatgaggtgtacaacgatcgaatcttcgatctactgtcgcctgccgtcgtacccggccaaggaagtgccatgtcgcgccaaggagcaaatgcccagaaagaccgtcgcagaccccttctgtacaagtcgaccgaaggatcccctgacagaaaggtcgtggctggcctccgcaagattgcttgtagcacatacgaagaagccctggcagtcctcgaagtcgggatgactgagcgtagagtgacagggaccagtgctaacagcgttagttcccggagccacggattcttctgccttgaagttaagaggaggatgagaaataagagaacaggagaagagacgtggattggtaacacgctcactgttgcagatcttgatggtacgtcactgagaaatcggttgtcatttctcttctga

SEQ ID NO: 470 - DNA, 693 bp, A.fumigatus
  unsure (6),(9): Identity of nucleotide sequences at the above locations are unknown.
agtccnganctacaaaagagctcaagtttcaccgaacttatcggtcatgcagtttctctgaacaaaaagtcaagttcggtcggagaaacagagtgtggtattggcaacacctgtgcctggaaaatgtgcggcattgatccatcctcaagttacggcgtgtacttcgagatcgccaaccagggcggtcctgcagccgtgcaaccaggccttcagcggggtatgatgcaattcttgacctactaccagcatgcttctggtcattatcatctccgagtcacaactgttgcacgccccttgagtggtccggctggggacccgactctcgcacagtcctttgatcaggaggctgctgctgtgctgatggcacgtattgctgtctacaaggcagatgtcgatgacggaccagacgttatcagatgggttgatcgtatgctcatcagactctgctctcgcttcgcagactaccggaaggatgaccctacctcgttccgtctggaaaagaactttacgctttatccccaattcatgttccacctccgtcgcagccagttcttgcaggtgttcaacaactcgcctgacgagacagctttttacagacacgtcctcaaccatgaagatgttggcgacgcccttgtaatgattcagcccacgctggattcgtattttctggaacatgagggaagccagcatggt

SEQ ID NO: 471 - DNA, 237 bp, A.fumigatus
  unsure (45),(124),(126),(182),(185): Identity of nucleotide sequences at the above locations are unknown.
attttgccgggtgcctggaccagttgttttttagaaaggagaacnggccaactccatgggggtcataggttcctaacagatagctcaacatcgtcacagttcaagcgttgtttggttcgggttntngataaaaacgccaacgataacttttggatgggtttcaacgcttcccttgaagtccnganctacaaaagagctcaagtttcaccgaacttatcggtcatgcagtttctctga

SEQ ID NO: 472 - DNA, 417 bp, A.fumigatus
cttcccgcgaaccttgagcaattggaatccgcccctccgccctcttcggccgttttcgtcatggccgccaaccaggacacccccaccaaagtgcctgacggccagccaaaccccgtcatggtcggtcccggcatgaagtctttgggcgaagaggcttataccaatgcctcaaatgccactcctagtctggagactgacaaaaaacatcccctggtcaatgacgccccatcgtacttctctcaggttcctggcaccaaacaatcgtcgaccgtctccgataccgctctacccggctcaccagctgatgcagccagggatgcaaagtcgcctattgaactcctccgccgtctgagtctcggccgctccccaatgattcctgacgttgacccgcgcgaacaatatcccggtctgaacctg

SEQ ID NO: 473 - DNA, 420 bp, A.fumigatus
tatcaacgaggccatcgagcggctgtcctccaagtgaccgataaaggggacatagcttcttcctccgtcctcggtttcggtttcagtctcgttcgcgagtttcacctcgtggatggctacagcgcagtcggcacgaagcttttcatcgttgtcctccccatctccatcttcatcagctccgccgtcatcttcttcaatctcctcgcttccctcctcgtcaccagcaacctcgccctcagactgattctcatcccactccccaactaccgtgtccggcgtctcaatccatggccgccgatgccaaagcgtccaccgattcatcctctccccttccccaaactcgatctctccatcttcgcagcttaccaacactttctcgtgccttgggaccccccgcagaaacacccctccggatattga

SEQ ID NO: 474 - DNA, 498 bp, A.fumigatus
cggcgaggaactaccgccggtggttcaatatccggaggggtgtttctgcggggggtcccaaggcacgagaaagtgttggtaagctgcgaagatggagagatcgagtttggggaaggggagaggatgaatcggtggacgctttggcatcggcggccatggattgagacgccggacacggtagttggggagtgggatgagaatcagtctgagggcgaggttgctggtgacgaggagggaagcgaggagattgaagaagatgacggcggagctgatgaagatggagatggggaggacaacgatgaaaagcttcgtgccgactgcgctgtagccatccacgaggtgaaactcgcgaacgagactgaaaccgaaaccgaggacggaggaagaagctatgtcccctttatcggtcacttggaggacagccgctcgatggcctcgttgatactagggatatgcggtgtcttcaccacggggctgggaggagcgacgtgtagtcaa

SEQ ID NO: 475 - DNA, 732 bp, A.fumigatus
gacggacagacgaagaaagcactgaacctgattctatccgacttgaaggatgtctcgctggcaatatcatttgccaagtcgcaagatgatcctgatctttgggaagaccttctcaactactccatggacaagccacgcttcatccacgggctccttgttgaggctggcacgtccatcgacccgatcaaacttgtcagacgcatcccaagcggacttgaaatcgaagggctgcgggaaggcctcacccgcatgattcgtgaacacgacttgcaggcgagtatcagccagggtgccgccaaggtccttcaaagcgaagtcgctgttggcatggccaccttaagaaaaggacagcaacgaggcatcaaatttaatatcattgaagagaaggccgtctccgacaccggcgacagaaacgaagcgagcagcaacactgatacagagaaggccttgtcgccatcgaggccgcctacgtttcaaccagggaggtgcgcaggatgccatctccctttctatcccaacggtaagctaccttgcttagactatacaaaaatgtcctcagtgttgatccattatgttcgcgtaaagaaaaggaaatcctcgttggcttcgcatgtggacatgtcttccacctatcgcacgttcactcggatgatacctcaacaacctcggacggaaaccagtccggaatgcagaccccacgcccgctgccagaaattggcatatccaccctga

SEQ ID NO: 476 - DNA, 345 bp, A.fumigatus
  unsure (339),(342): Identity of nucleotide sequences at the above locations are unknown.
gctaccttgcttagactatacaaaaatgtcctcagtgttgatccattatgttcgcgtaaagaaaaggaaatcctcgttggcttcgcatgtggacatgtcttccacctatcgcacgttcactcggatgatacctcaacaacctcggacggaaaccagtccggaatgcagaccccacgcccgctgccagaaattggcatatccaccctgaatgagctcccgctgtccatgtctagcaccgtcggcgccaaggtaaccaccgcgcggctcttgagagatcggattggaaatggctgccgcatctgttccctggctaaagaaattgaggcgttgggtgagtcnganacg

SEQ ID NO: 477 - DNA, 270 bp, A.fumigatus
ggtggccatgccaacagcgacttcgctttgaaggaccttggcggcaccctggctgatactcgcctgcaagtcgtgttcacgaatcatgcgggtgaggccttcccgcagcccttcgatttcaagtccgcttgggatgcgtctgacaagtttgatcgggtcgatggacgtgccagcctcaacaaggagcccgtggatgaagcgtggcttgtccatggagtagttgagaaggtcttcccaaagatcaggatcatcttgcgacttggcaaatga

SEQ ID NO: 478 - DNA, 882 bp, A.fumigatus
cgctcaaagtttcttgttcaaaaagtcacccaagtgccggaacttcccaacatgttatttggacccattctattctggcatgatgacgagtcgatgattacagatgagacagccaaagtgtttttgcgccacctactcagcaagggcaagacgcaagtccgggatttgcgagtcgagtcagatcagaagcgacgggaagttgacaacgccaagcgtgtacgagaaaatgttcggcaagggaaggacaatcggaacgaagtggaggttgtccggtccatatttttcttacaggaggcgctccatgaggtagagcggaaacgactggctgccgaggttgaaacgtcgaccatcatatcggtggtcggcgatttgtctctaggggccaagaatcacaatttcaagtcacagacgttcaagatcccaaccaactgcgatctttgcggggagcgcatttggggactgtcggccaaaggctttgattgtcgggactgcgggtacacatgccacagcaaatgtcagatgaaggtacccgcggagtgtcctggcgaacagaccaaggaggagaagaagaagctgaaggcagagagacaagaacaagccggcgccatgccagcgctcgatatcacaccatcgaacggtacgtcagccgcgccatcactcactcgacaaaatacgatgaactctttgagctccggatatgcggcgagcgccaaccgatccttgtcaaatgttaccagccaaccagccagtgcaacagagcctgctgcacccgctacacccgctgcacctgctgagactaagcccgccgtggccgctccgaagaggaatcggattgttgcaccactttcgggcacagtatgttaccgctccagccccaagtga

SEQ ID NO: 479 - DNA, 408 bp, A.fumigatus
ctgaggtctctagatggctccggatggatgcgcgttcgcgccgggtcgcgacaaggcctcgttccagcttcgtacgtggaagtattaccgacagcatcgcatgcgcccacggccagtcctggaatcacggatcgaccgggctccacgtactcgaactcgtctgcctcgttatctggcagtatggcggccaagcgggttgggcctgcagtcgcccctcgacgaggggcaaagaaactgcagtacgtcgaagcgctgtatgactacgaagcgcgcagtgacatggaatggagcatggtggaaggcgaccggttcgtgctggtcaaccgggacagcggggatgggtgggccgacgtcgaacggggaggggtcaccaaaagcgtacctgcgaactatatacaggaagtttag

SEQ ID NO: 480 - DNA, 237 bp, A.fumigatus
cagctgttcactattctccctcaagtggtcgctcggatatgccatccccatgccacggtttacgagcttttaaccaggattgtggcgaaagtagccaatgcttttcctcagcaaggactctggacagtccttgcagttgtcaagtcctcctcgaaggatcgagcttctagaggcatcaattgtcttcataaaatcactgtaagtgcgcaaaatcaccgcattgaggtcacatattaa

SEQ ID NO: 481 - DNA, 186 bp, A.fumigatus
ctaaagaatagttctagcttaagcggtgaagcctcaaaacttgtcattgataactaccttcgttcgttggcgcacgggaacaaatacgttttccagtcactgcccagaattttgactctttggttagagcatgctgccacagttgataaacctttcgaccctaaaaggggcgataatgagtattga

SEQ ID NO: 482 - DNA, 237 bp, A.fumigatus
  unsure (119): Identity of nucleotide sequences at the above locations are unknown.
ataaagacgctctctatccccatcttcattattttttcatttcctcgccgctttggtcaattgctgatttgtcaccttgtttacctagggatctactgcgccttcggtcggagcggtcnccgccaaaaaagaacacagcctcccccgatgaaccctctagaaaaaaaggtactggacatgggcccgattatgtatgaatggagcgacaagttttatggcatgggagaatgtaagatg

SEQ ID NO: 483 - DNA, 546 bp, A.fumigatus
gtcaacggtttgcagcccacaccagccccgtttgaaccagtgatggagattagcaacccctttacatgcaatgagtcctctattctatcggaaatcaacagcagtagcgaacccacaacatgcaatcctgttagcaacaactttggcgggtctcgggccagtccgctccacagggccgtccaaatgggtcacagcaagatcgtccgacttttgcttgagcataatgcaaactgcaatgaaaaagatagcgatggtctgacaccattaatacacgccataatcggaggatatgaagacatggtagatatgctgctgtcgcacggtgccagcattgggctcgtcgacgatgagcatcgatcggctcttcactgggccgtaatacgtcgccgggaccgcttgctaacaagggttttgaagcactgtgtagggaatagcaccttggtgaatcaatgtaccaaagatggaaggactccgctgctcattgctattgatataggctttgaagcagctgtagaggtattgctggaatcgggggcagttgtgtaa

SEQ ID NO: 484 - DNA, 582 bp, A.fumigatus
atgttgctgcgggtcagaaactcgtcgtgtgcgggcgcacaggcaggtgagtcactgcatagggtacggcttgtatatccgaaggctcggctcactctacatactagcggtaaaagcacgctactcctctcgcttctacggcttctggagctacaatccggccagatcgagctcgatggcgttgatatcagccaggtgagactagatatcctacgacgacggtgctttgttgcagtgtctcaagaccctttgttgttgccgaacgagaccttgcgcttcaacttagacccggatgcctcaatatcagacgacgccctcgttgttgcattgaacaaagtgggattgtggtcccatttctttgaaggccacacgtactttgggggagaaccagctaccgtcatcaatatcccaggctctaatgaacatccaatcctcgaccagaaagtctcaatatttcaggagctctctgtaaggcagcgtcaactgtttgcgctctgtcaagcacttgtgaaagtcagctcttttagaacattctggagtgaaaccccgtggttctcttggacgagtttacatccttcctag

SEQ ID NO: 485 - DNA, 285 bp, A.fumigatus
gaccgccaagcaagacgtcgactttacgtcccatggctatgttggtcccatgttcctctacatgttctatggcttctacgacgcagctttccagacgtgcgcatactggtgagtctccacaatggtctcttggggatctttgttacctccaccgagtttgtgtcggaaactctgacaacttttaggtttatgggatccctcaccaacaacggtcgtaaactagcgaactttgccggtttctacaagggaatccaatcggctggtgctgcaggaatgtggcggtaa

SEQ ID NO: 486 - DNA, 249 bp, A.fumigatus
ctggtattgccatcgaagaccgcagggactcaactaagggagagtcagtcacaaagcatgtgtccgcgtcctaagtcgccccttgagaacttcgattcccttcaaccgaacatattgacgtgttgtgttggcgcacagtatgacaacatgatccttcttcatatttgtattggtcaggacttttattattgcatcactgcgtttttggtcatgttccggctccttcggaggggttggatgtttgaataa

SEQ ID NO: 487 - DNA, 315 bp, A.fumigatus
agactcaacattcgtacccggtctctcaacagtttactctattggctcatgcagatggttggtgcttttgtctttggtaagcttctggatctgcaatttctttctcggtccatgcgagccaagctcaactggctcattctccttgtcatcaccatgggtgtctggggtggtggttatgcttttcagaagcagtatacccttgagaccgccaagcaagacgtcgactttacgtcccatggctatgttggtcccatgttcctctacatgttctatggcttctacgacgcagctttccagacgtgcgcatactggtga

SEQ ID NO: 488 - DNA, 279 bp, A.fumigatus
acttgcaagggcatcctcgttgacatgtccgatatttgcagcatggatgcagaaaagaccccctttatgacccagttcgcctcctgctggggattgctcgttggcagtctattgattgcttctcccatcatcttcttcaagatcaaggatcacgtggatgtcgaggaggacctcaagttttccgacgaaaccaccgaagatgtgactggtattgccatcgaagaccgcagggactcaactaagggagagtcagtcacaaagcatgtgtccgcgtcctaa

SEQ ID NO: 489 - DNA, 348 bp, A.fumigatus
gttgttcccctccccaccctcatccacaacttctcactctttactggctgggaagcgatacgcgagtggcctgcactgactgctacatttcagactgcctgtaatgtttatttgattttctccgccaacaagtccggggagtactatggatatgctcgcatgatgtcgcctatcaaggaagatgaaaccctagccctggagatgcctgtgcgacctgaccatggtcctcctgagccggtggaattgcacgtggttccaactcaggctacagccacggcgccaacgggacgaattatagatgactctgcgtcttcaccacggcggctggaaggacgaacgatacaagcg

SEQ ID NO: 490 - DNA, 213 bp, A.fumigatus
gtcacttctgtctgtgccttgtcttgctattgtgcactggaagacgtgtttgagattgattatttgcctgtttggaagtacatgagccgctttctggacggccttattccttcccaatccggccgagcgagacccaatatttatctccgcactttgaactttctcgagaccattgagcagcatagagattggattatcagtcggtctgcctag

SEQ ID NO: 491 - DNA, 669 bp, A.fumigatus
ggatcgtgccttgtgaggatgagagaaactgaacagaactcgctgaataggcggcattcgaccacgcagcactatcaaaccttcgacactcctcctccaaaatcgcgtggaagaccgaactcaggccaatccgaattgtcaggcggcaactcgaatctgcaacaacatggatccggaagcgacgacgaatcgcgatctcccttgccgaagaagcagatggcagtgttggcgatgatcgcgctttgtgaacagacggcactcaattcgatcagcccttatctgcctgatatggcggcgtcgttccccggagtcgaatcgcagtcggtgggtatctatgtcggaacgatcgcctcggcgtttgcgttagcgcagttcataaccaactacttctggggttggctgtctgatcgtgtaggacggaagccggtcattttgcttgggaccatcctcactgcagtttgcatgctagcatttggattctgtaagacgttatggcaggccatcctggtgcaggcgttgatgggcgctgtcaatggcaaccagggattggtgtcaacgtgcctgggagagattaccgacagaagcaaccagtcgaaagctttcacttatctccctgtcctctacggtattggaggtatcaccggaccccttattggcggcttactattc

SEQ ID NO: 492 - DNA, 387 bp, A.fumigatus
cacttggagaattccccctggttcgacggcggcgtcaaaatggcctccgtgcacccctgccgccacgcatccgtcatgaagaccctcctcgaccgcgccgacgctgccctcaagatacgccgcgataagctcaagcaggctcattcggcggatcaggcgaacaggatcaactccgagcgtgggctggagggcttggtggacgagacgcggggcttatcgctgaatgagcagcaggggcattcccccggtggagatgaatgggaggtgctgcagcatgatgaggaagaccaggttgctatccgggttgatcagtacctggttgtgtttttgaaatttatcgctagtgtaacgcccgggattgagcatgactttaccatgggtgtataa

SEQ ID NO: 493 - DNA, 441 bp, A.fumigatus
gaatactacataccggcagagtcatcgtccatccatttcctccgctcgactctttgtgtaggatgcgctcgtgggtttgaggtagtaagtcttgagactactgagacgcagtcccttctggatcaggcggatacttcgcttgattttgtcgcacgcaaggagaatgtgaagccgattcacattgagcgaatgaacggagaattcttgctcaactacagcgacttctcgttcttcgtcaaccgaaacgggtggcgagctcgcccggattggaagatctcatgggagggcaaccccaatgcatttgctctatcatacccttatatccttgcctttgagccaaattttatcgaaattcggcacattgagacgagcgagctgatacatatcatgactggaaagaacattcggatgttgcattcttccacaagagaggtgtgttga

SEQ ID NO: 494 - DNA, 765 bp, A.fumigatus
cgcaagatcgcccggaatgaaggcactctggcactttggcgtggtcttagtcccacattgatgatgagcattcctgccaatgtcatctactttgccggatacgattggttacgcgccgatgaaaaaagtcccatcaaacggttctttcccgctgcctacgctcccttagttgctggctctgtcgcgcgaattgccgctgcatcagcgatcagcccgattgagatgtttcggacgcgtctgcaggccactcccggtacgggtgcagggcatttcaaggccacgttggaggatctgcatcaaatgacccaggtgcatggctatagggctctttggcgcggattgaccctcacaatgtggcgcgatgttccattttctggattatactggtggggatacgaggaatgcaaacgctatcttctcgatctacgcagggaagcctacaaccatcatctcctgcgtcatgtttcgtcctctgctcttcagcatgatttagataccccgacttttctcgaaagctttctatctggcgcgttgtcaggttctctggcggcatttgttaccactccttttgacgttggcaaaacgcgccagcaggtgttccgacacatgggtgatggcggtccaagcagtttgcgaggcagcgtagcgccggaaacacttcgacctgagcagctgtctctgcctaaatttcttatgcacatcttccgtgaagaaggcatggcaagccttttccgcggttgggttgcgcgttgcttgaaagtggcg

SEQ ID NO: 495 - DNA, 270 bp, A.fumigatus
cacacacagcccgaattggcccacccatgggaagtcctccacgagaaggccgagctggtcattgcctcccccaagggaggcgaggcaccgcttgatcccgcctccgtcaagatgttcgagaacgaccccgtggcctccaagttcctcaacgagcaaaaatcactgtggacaaacacagtcaagctgtccgatgtgctacccaaggtgtctgagttcgacgcaattttctacgttggtggacatggccgtacgttccctgattccacttga

SEQ ID NO: 496 - DNA, 252 bp, A.fumigatus
cgaaaagtagcaatgttcgacctcgtcaacgacgagacctctatcgctctgatcgaagccctctccgccgcccggaagcccattgcggctgtctgccacggtccgaccgtcctgctcaaggccaaggcgccgtccggtgtccctctgctctcggcctgcactgtgaacggtttctccaataccgaagaagaacaaggcgcaaatgtcgtccgcgaatgcatttatgctggaagaagaagttgcaaaaagtga

SEQ ID NO: 497 - DNA, 543 bp, A.fumigatus
  unsure (110): Identity of nucleotide sequences at the above locations are unknown.
tcagcatccacaacgacggggtatattactttacagcttgccaaactagcaggattaaaggtcatttgcgtggccgatgtagcacggcacggtgccaaactcctcgatgntggagcagacttcttcgttgaccgacacgataccgcaagagccgcggagatcatccgcggcgtaaccaaggaaaggctgcggtatgctattgatattgtgggcaaggacacggccacgctcttgcagcagacccttgattctgctgtgcacgaggatggctcgcatgcgcatctgctggggctgactgggctgccgaaagagagggacagcaggatcgtctaccatactgttccaatcaaactgttccatacctctcctgcagtgggggaggctatggtgacttggctcgaggagctgctacaaaccgagacgattcgattgccggagattatactggcagacggaggactagagggtatcaacgcttccctggaggccttgagacaaggaaaggcatctgggaagagaattgtcatgaatttacgacgatag

SEQ ID NO: 498 - DNA, 762 bp, A.fumigatus
gaaaccggtgcgctgtcggattcagagcagcagatcgagccgggtccacctgcagcagcacagacatacaacgctgatctggaaggcgggcctgaactgcacgcgctgatgcgcgccgtggaaatgattgcccggaaacgtcgcgaagaagaccgcgaagcttctgataccaaaccgtacctcagtcccttggaatcgtactttctttcgcagtcagacgtatcaacctccgcatccagtttaaattcacaggacccgtcaccaataccggaaaagcttctaaagacaaactccgcctcgccggctgttcccacgacgtcgaaaacccctccggttgctccggttgctccggttgctgctccgcgtatccgctcgcgtgcacagggcggctacctctgcacagacctagacgtatacctcacccatgagccctgcttatgttgctccatgggaatgctcctctcgcgcttccgagcggtgatatttccccggaagggacggatggtcacggggggactagcctcggagcctgttatctcaccggcgtctgacactgtccctgaaggcgagcctgaagagtctgaatcgaaggcgccaatggacgagtcgtccgatccggcaacaaaaaggaaatactacggtctgcactggcgcaaggagctgaactggcgggcgttgggcttcgagtttgtcgagcatgatgatgctgatgaacttgctcggcgtacagaggatcagaccggagttgcttttcatgcatga

SEQ ID NO: 499 - DNA, 231 bp, A.fumigatus
  unsure (67),(119): Identity of nucleotide sequences at the above locations are unknown.
acaagcatctcaacgacctgcgaattcgcgtcagcagtcgtgtttgcgcatgaatatggtattctgnttgcgtcccttcaggatcggccattcattccaacagcccttgtctccatcgnaggtatccccgagtcggctcgcagcgcatttcgcaaatgggagaaaccgtctggacaaatgcgtcctcaagtgtttcctctaaacgcggcaattgagtctattcgctcttga

SEQ ID NO: 500 - DNA, 519 bp, A.fumigatus
  unsure (518): Identity of nucleotide sequences at the above locations are unknown.
atggaattccaacaagtctattatagtcaaacgatgaacccatctatctctcgcgagctcaaccccctcgaccccgcggtactccgcgcgacgtccgaccatctgcatcacacttgggctaagaccttctactcacgccccgaattgtatatccgaccgcgatctattgctgaaatccagaaggtggtgacgctggctcgtcggtgccgtcgtcgcctggtcaccgtcggcagcggtcattcgccgtccgatttaacctgcacttcttcgtggttggtcaacctcgacgatttcaatcgcattctacatattgatcgggagacacatgttgtgactgtcgaggccggtatacggttgagagatctcggtcggcagtttgaggaacatggtttgacgttgtcgaatttgggcagcattgacagccagtctattgcgggtgtcatttcaactgggacccatggcagcttccttgcgcatggtctgatctcaaaatgtattatttcgctgactctgatgtng

SEQ ID NO: 501 - DNA, 207 bp, A.fumigatus
atatgtactcgaaattctggcccaaaggcggtctcccaggcattctacaccactacgtacgtttcctcccctcgtacagtgcaacagacagagtacctaaccgatctgcaatttagacagaaaccctcgtcacatttgaatacaccacaaccaccacccgcaaaccacacagtctcttcttcgttggcggtctcggcgatggcctag

SEQ ID NO: 502 - DNA, 258 bp, A.fumigatus
  unsure (7),(9),(10),(15),(18),(19),(20),(21),(24),(25),(26),(27),(28),(31),(32),(33),(34),(35),(36),(37),(38),(39),(40),(41),(42),(43),(44),(45),(46),(47),(49),(50),(52),(56),(76),(79),(124),(125),(12: Identity of nucleotide sequences at the above locations are unknown.
ttccctncnnttttnttnnnnaannnnnttnnnnnnnnnnnnnnnnntnncntccnttttttcccactttttttantanttctcttctcccccccacaagtttataataacttccctttttttnnntcananaattcnnnntctttnntntcagntatcntcttcntcngtctcggttttttcttttccctttttccccgtttcttccccggattcggcggcccttgtgcccgtggttttggtgctgtcctctcgtga

SEQ ID NO: 503 - DNA, 546 bp, A.fumigatus
gggtgcagctgtgatcatttccactacccagtgacctctttttacccgttcaggtcagccacattttgtcgtccccaccgtcgacgtcggaaattccttcaatctcctcttttattatttaattgctccgttttggagatacatcaacaactaccagaagatatgtctgaagttcaaacacggccttctgcctctcgaggcagggtatccgctcgtggtggtcgaggtggctatagctccagaggtggtcgcggaggcagcagatcggccaaggcagacacctcagaccagaccacatttgaagatgaaggagaaattggtcagatgaagaagaaatactcgaacgatctgccgacactgaaggaattgttccctgactggaccgatgaggatcttgtctttgctctggaagatgccgacggtgtactcgaggatgctgttgagcgcattactgaaggtatgatcatggattccgtgagttgtatctcgtacccctacatatgctgctcactggaattcgctctaactttgatcgtcccatcataa

SEQ ID NO: 504 - DNA, 312 bp, A.fumigatus
aggtatgatcatggattccgtgagttgtatctcgtacccctacatatgctgctcactggaattcgctctaactttgatcgtcccatcataacaggcaacgtctcacagtggggtgaggtgaaaaagaagacggccgaccggaatcgctccaaggccaaggaggctcagagcaccccgaccgaggcaaccacaagttccgttcgcacaggccgtggtcgtggcggattcgagggtcgtggacgcgctcgtggagatcgtggtcgtggtggccgtggcgccgtcttcaccacggggctggaaggagccgcgcca

SEQ ID NO: 505 - DNA, 192 bp, A.fumigatus
aagactccgtattttactgcgaccctgattaaatatttaattattcgaattttaatttccctttttcaatttgaatttccattttttggggcccctttttctgtgcccggactttttccacttaagtattacttgccttctttcaaatccctccttaattccatcttccttctccatcttccatctacctaa

SEQ ID NO: 506 - DNA, 195 bp, A.fumigatus
atgtctctgggtttcattcattttgaattgctgggtgtgacaaacttacgtggtttcatcaaccagtgggacgtcttagcgagattgagcaataataatgatgactggcacggagtacagtggaagtggtactccatagaggcagccaagtccgtcttcacccacggggctccagaaggatccagcgctaaggcg

SEQ ID NO: 507 - DNA, 864 bp, A.fumigatus
ggggagggggttttggagagcgcaagagagcagcttgaagagagaagtgggccgagccaaaggaaaaacccgaaaagggaggcgagggaccgggttgaaaaggagcggcaggaagctagagcaaagatcgagcgggcgaattgccggaagcgaaagctaaggctgagcgtgaagcagccgaggtcagagaaagggccgagcgagaggccgcggaagccaagacaaaggcagagcgcgaagcagctgaggctcgagctcaaagacttgctgctttggccaaggaaagagaggctagagccaaagccaaagccgaaaaagaggccgcagaagcaaaagccaaggccgagaaggaggccgctgagaaagaggctgccgcaaaggccgctgctaaaaaggaagccgatgccaaattcgccgcgctcaaggaagctgctgcgaagaagtatgcggaaaagaaggccaaagatgcccaggaagccgcagctagagagcaggcagcggcggaagcagcaagcagcaaatccgcaacagggtcaacggctcccaggaccccgtctccaaaaaagccagcgtatacgggcagtgctcggacaccaacaactgcggacgaggatgatgcctattcgttccggccatacgaccgaccccgccgaccctatgcgggtacatcaggttcctcggtctattctgaatcttcctatgccccttcgcagtcgacggcccggacgaccccgccaccttcaaccagaggcgcctactcgaccaaagatccggacaagattgtcatccgaggcgtttatgccttcaataacgccttcctgcgaagtcctgtggcgcagttggtctctggccaaggggtggtga

SEQ ID NO: 508 - DNA, 792 bp, A.fumigatus
agcaaagatcgagcgggcgaattgccggaagcgaaagctaaggctgagcgtgaagcagccgaggtcagagaaagggccgagcgagaggccgcggaagccaagacaaaggcagagcgcgaagcagctgaggctcgagctcaaagacttgctgctttggccaaggaaagagaggctagagccaaagccaaagccgaaaaagaggccgcagaagcaaaagccaaggccgagaaggaggccgctgagaaagaggctgccgcaaaggccgctgctaaaaaggaagccgatgccaaattcgccgcgctcaaggaagctgctgcgaagaagtatgcggaaaagaaggccaaagatgcccaggaagccgcagctagagagcaggcagcggcggaagcagcaagcagcaaatccgcaacagggtcaacggctcccaggaccccgtctccaaaaaagccagcgtatacgggcagtgctcggacaccaacaactgcggacgaggatgatgcctattcgttccggccatacgaccgaccccgccgaccctatgcgggtacatcaggttcctcggtctattctgaatcttcctatgccccttcgcagtcgacggcccggacgaccccgccaccttcaaccagaggcgcctactcgaccaaagatccggacaagattgtcatccgaggcgtttatgccttcaataacgccttcctgcgaagtcctgtggcgcagttggtctctggccaaggggtggtgacagatgggttggtgttgcgcagtcttcacccacagggcgccgaagga

SEQ ID NO: 509 - DNA, 711 bp, A.fumigatus
acgcatagttcggttccttcggccgctgtgtgtgaagacaagactgcgttatactttgctgtcgagtcaggggatctcggcaaagttacagctcttctagagcatcctgatgtagacgtcaatctgcgaacggacgaacttggtgacggccaatcactgctccactgcgcagttaatcaacagtgcgtggatccagagattatgaaggctttactagctcgcccagacatcaatgtcagcgctagagattatagtggccggactcccctcgctttcgcggctttcaatggggaagctgaactagtgaagctcctcctgcagcgccatgatgtggatgtattcccgcaggatagatttggagacacaccgttgcttctcgccgccaaagaaggagaaattcacattgtgaatatgctatcgaaggtaccaggtacggacacttggcacagaaataactgggacaaaacagcgctggggttggcgggggagtcgggtcacacagaggttatgagacgattgctcgatccagacctcaaggcaacacgggaaatcatatgcgatgccatggaaaacacaaaagaggctttggatgctattcgaaggacaccgagaagtgttcttggttccgaaaatgaaagtcttgcgcaggaaagaaagatagaggaagcatacaagctgctttcggccggtctaaatagaacaggttcatga

SEQ ID NO: 510 - DNA, 378 bp, A.fumigatus
  unsure (334): Identity of nucleotide sequences at the above locations are unknown.
ccatatctacacaacaccggcacccaacatgggtgcctcatcccgatggcatccccgccgccagtctcaaccgcaaccgcaaccgcaactggatcctcgcatcactttcccaatgactccgtccttaagtatagccacatcggacagaccgagaagtatgtcttctcggcttttgccggcgtggtctggtacaacgcgatcgagctcattgtcctctgcctgaccaccttcaaacgctaccgtggttgctacttctggtcccttcttctcgcttccatcagcctcaccacatacatcctcggttctttttcttcttctttctctccatgtccgntaccccctatggtcgcgtcggcttcatcggtccgagctggtgcg

SEQ ID NO: 511 - DNA, 609 bp, A.fumigatus
aacattctttcctctcaccagcctccatcaaacagcccagctcaggccaagcacgccgcaatcacgataaagaaaagcaagatgccctccaaaatcaccgtggcagtcgcccaagcccgcactcacatagcaacacaagccactctctccgccctctcccgcatcgcccaccacgcccgcatccgcggcgtgcacctcctcctcttccccgaggcctatctgggcggatacccacgtacctgctccttcgtatgtgcggtgggctcgcgcgccccacacggccgcgaccagttcctggcctatttccgctcggcgattgatctcggcgatacccctgcgggcgccggggatgattgggttcaacgacggttgcctgtagccgaggggcggagcgagcgcggcgatgggacgagggaggagatggagcgggtggcgagagagacgggcgtgtttcttgttgtgggggtgattgagcgcgcggggggcagtttgtattgcgctgttgtctatgtggatcccctgcgtgggtgtatcgggaagaggaggaaggttatgcctgtatccctcccttgttctttttctttttccttctcttcacggttccattga

SEQ ID NO: 512 - DNA, 183 bp, A.fumigatus
acaggaacagaacgcctcatctgggcccaaggctccccctccaccctcaaagccgtcaccactcacctcaacggtgtccccgtcaccctcgccgcagcgatctgctgggagaactacatgcccctcctgagacagagcctgtacgcccaaaacgtcaatatctatcttgcccccacggctgac

SEQ ID NO: 513 - DNA, 456 bp, A.fumigatus
ccttcctcctcttcccgatacacccacgcaggggatccacatagacaacagcgcaatacaaactgccccccgcgcgctcaatcacccccacaacaagaaacacgcccgtctctctcgccacccgctccatctcctccctcgtcccatcgccgcgctcgctccgcccctcggctacaggcaaccgtcgttgaacccaatcatccccggcgcccgcaggggtatcgccgagatcaatcgccgagcggaaataggccaggaactggtcgcggccgtgtggggcgcgcgagcccaccgcacatacgaaggagcaggtacgtgggtatccgcccagataggcctcggggaagaggaggaggtgcacgccgcggatgcgggcgtggtgggcgatgcgggagagggcggagagagtggcttgtgttgctatgtgagtgcgggcttgggcgactgccacggtga

SEQ ID NO: 514 - DNA, 921 bp, A.fumigatus
ggagatgttgtcgtggccaatgaccaccagaacccagacatcttctgggctttacggggagggggtggaggcactttcggcatcgttacacgtgctacaatgagggtgcatctcaatagcccggtctgcgtctcggaggtggcagtatcaggctcccggaataactcgttgctctggacaaaagggatcacgggtctattttccattcttcgctcgttcaaccagcaggggataccgggccagtttattcttcgaccgctatccaaggatcaggtcaacgcaagtctcacactgtattccctaaacacagatgacactcgacgatcggccgagaacatgctctccattcgaaatatcctcgaatctaccacccttcccttcactctggcctccaggtgcctaccaaagatcagtgacgcgctccgaaaaggacctgatatgcttcccgtaaattacggaatcatcaccggctccgttttggtgtcagaggatctcttcaattcggaggaaggaccactgcatctggccaagcagttggaacatttcccgatgggaccgatggatctcctgttcaccagcaacctcggcggaaacgtttcggcaaacaccggaaagaagcacagggatacctcgatgcatccgggctggcggcaagcggcccacctcatcaacttcgtgcgcagtgtgagcacacccacagcgcatgagaaggccagaagcttagaagagcttcatagcgtccagatgcggcaactgtacgacattgaacccgacttcagagtgtcgtacaggaatttgggcgaccctctggaaagtgatgctgcacaggtctactggggcccaaattacaagcggctgctggaaatcaagcgtcttcacacggggctggaaggtccgacggtgctcagacaatcaatgggg

SEQ ID NO: 515 - DNA, 405 bp, A.fumigatus
agcccagaagatgtctgggttctggtggtcattggccacgacaacatctccctacacagccatagtgaacttcagtacaaagacaccatattgcaagttatcaaggatgtatctaccaaccttcgccgtcacgacctcaaattcgaggacattatctacagccagaccgtcgatgaagctgtggaaactggacactccgcctccctggagaaaaccgcccgcagcgcccacggtaggacactcccccccgacgaccacccatccatcacgggcacctcttgcatacatctcccccagagtcactccagcgcctacgctcacggctgggccacggtctatatcggagccgagggcccggaagttgtcatgtcttcaccacggggggctggcaggatccgcgctcag

SEQ ID NO: 516 - DNA, 621 bp, A.fumigatus
tccttggatagcggtcgaagaataaactggcccggtatcccctgctggttgaacgagcgaagaatggaaaatagacccgtgatcccttttgtccagagcaacgagttattccgggagcctgatactgccacctccgagacgcagaccgggctattgagatgcaccctcattgtagcacgtgtaacgatgccgaaagtgcctccaccccctccccgtaaagcccagaagatgtctgggttctggtggtcattggccacgacaacatctccctacacagccatagtgaacttcagtacaaagacaccatattgcaagttatcaaggatgtatctaccaaccttcgccgtcacgacctcaaattcgaggacattatctacagccagaccgtcgatgaagctgtggaaactggacactccgcctccctggagaaaaccgcccgcagcgcccacggtaggacactcccccccgacgaccacccatccatcacgggcacctcttgcatacatctcccccagagtcactccagcgcctacgctcacggctgggccacggtctatatcggagccgagggcccggaagttgtcatgtcttcaccacggggggctggcaggatccgcgctc

SEQ ID NO: 517 - DNA, 522 bp, A.fumigatus
  unsure (17): Identity of nucleotide sequences at the above locations are unknown.
agagtctcaaggtcaanaagaagaaagggcgatgcgaaggggccgtgggcggagaaggctggtctgactgctagccctgccgaaacgaagcccgccggtcccgcagctccagccaaggaagcggccaagaaggatgactctcgcatggagatgacccgcgtggtcaccgcctccacccctgtagacaaggtcaaggagtacctcaagcgtccttctcaaaagtccaacgacgccatcgtgggcctcgttcgccccatcatccaggatgtacgggacggcggtgatgctgctgtgctcaagtatactcacaagtttgaaaaggcgacttctctgacgtctcccgtaatccgcgctcccttcccccccgagctgatgaagttgtcgcctgagacccaggaagccatcgatgtcagcattgccaatatcaagaagtttcactccgcccagaaggacagcaatgacgtcctccaggtggagacgatgcctggagtcgtttgctcgcgcttttctcgcccctattga

SEQ ID NO: 518 - DNA, 222 bp, A.fumigatus
  unsure (95): Identity of nucleotide sequences at the above locations are unknown.
acgtgtgggtctgttactcccccggtggcccaccctggtgccgtcccaccccgccccatgaagctcggtgttcccccatggttggcggctgccanaaaaatgtcctggggttcccctcccccgggccaatgggcgcatccccccccgagaattgttctccttcccccaccaaatttggaaacccaaaaaacttgtcctccccccggggtttcccaagccctg

SEQ ID NO: 519 - DNA, 336 bp, A.fumigatus
  unsure (279): Identity of nucleotide sequences at the above locations are unknown.
acgtggtccttccagccgcgtggtgaagacaaagaccttcaggcccgcaaagccgatgcaccggccggttcctacaccgctagattgttcaacgagcccaagctgacccaggcaaagatcatggaggaggccgacgagctgtgccgtgccaccaccaaggaggagatcgcgtttgaggctgccgatctactctactttgccctgactcgctgcgtggccgcaggagtcagcttggaagatattgaacgtaacttggatctgaagagtctcaaggtcaanaagaagaaagggcgatgcgaaggggccgtgggcggagaaggctggtctgactgctag

SEQ ID NO: 520 - DNA, 420 bp, A.fumigatus
tcttgcattggtccaggtttgataccggcgctggtcaaacaagcaaaagcaaagcgtattgtacatgtacataatgaaatgacttgtcttcccaaccaatcacgcaatggtaatgatgtaaatcaatcaacgccaccctatgtacgccagaccgactgtctcgagtctcgagtcgagagtctcaagatgatctcttcttcctccgcgcctcatcctccctcatcatccgaatcacctcctcccttctcttctcaacccgagccaactcctcctctctcgcccgtcgcctctcctcatgcgtcgcaaaccattcctcccgcgcccggtcctcctcttccggcttcgcatgcgcaaccatacacgagttcatcgccagccgctgagcccgacatacccaggtggccgttaccgttcgattaa

SEQ ID NO: 521 - DNA, 198 bp, A.fumigatus
tgtgaaggatgccacggcggccagcagttaaatcttccagttgtagacttcttttggagttggtcgatcttcgaccagagcaaggatggacattgtgctacctatgatttcgggtacgagaactgtcgacgcaatggtactaagggtgactggaaggtgagaagaaagctgatggaggcatcaactgtatctaaatag

SEQ ID NO: 522 - DNA, 231 bp, A.fumigatus
  unsure (76),(191),(200): Identity of nucleotide sequences at the above locations are unknown.
acgttaaaaagagggtaccatactgtatttgccggatatctcatccataatattgcagtgtctttctacgtaaatngattgactgtctatgattcctatttccataacgctacagatattctagttgaagtatgttttcattatcattatgccacaaggtcaggcagaaggcgaagtaggcaaagtgccanttccactanggccgagaccattccaaaatttttttgggga

SEQ ID NO: 523 - DNA, 810 bp, A.fumigatus
  unsure (711): Identity of nucleotide sequences at the above locations are unknown.
cgttgtattgcccactgcgagttgaagacgggaatgcgtttggaatttatgaaatttttgccgaatgacgacgatgacgacgagggtgaagtgactgtcgtctggacggcccaccacagcctgatcgatggttactccctgggactcattctggctcgggtgcagcaggcaagccagggtgtcgcatcctcccgggtctcttcctttgtagacgcagcgtggaatctgctgagcgtgcagaagcagagagacaccgaggcacggcggttctgggagcagtatctgcagccggtacggtcactcacgaaagcagaggcaaccacaacgcctgtagcacggccgtacctcgctcaggaggtgctgttcaagcatgtgggcggcgtggacgagttacaccgactcgcatccagctgcagtgtcaccctagcggccgtctactacacggcgtgggccatgacgattgctcggacgaccaagtccaccctggtaactctgggagttgtcttctctggccgcgagatcctcccagacgatgcgcaggccgtcggcccattgatggccactctgcccctggtatgccgcattgacggagaagcctcgattgagcgccagctgcagaccacgttcgaaggtttggcaaccattagcacctacgcatggtctgccccagatcaaatcgggtaccgggtcgactctctgctggcgacgcantatgatttcccaacctacgaccaacccatccccgccgcaaaagagcagttcttcgagaacaccaactttgcgctgagtctcctggtcgaagctgatgct

SEQ ID NO: 524 - DNA, 270 bp, A.fumigatus
ggaatagatccagtcctctataagttctgcattgttaatcttgtctatatctctattcttaaacttaaggtctataagagcctttctctctggcacaatataggagatgtctggcttaaaacttatcaggttaccctggtaattttacttaataatataattactaatattcttaaaaaactctatatactcctagttcttagcagccctatacagtttctttctttccaatctaactttattactagctctttaaaactccctgtatag

SEQ ID NO: 525 - DNA, 501 bp, A.fumigatus
  unsure (181): Identity of nucleotide sequences at the above locations are unknown.
ctcggacaatgggccgcatcacgaaccgatatctttcccccagaaatgtgcaacattatgtcttcgctgcactctcatgctcctgcgcattcgttgcatcagactaaaaagacgataagcaaggctttcaatggtctaccattcgaggagatttttgaggagttctacgaggaaccactangagttggggccattgctcaagtatacagagcaaagctcaagccgagtttggctgtgatggacgatcaggctctgacacttgaggacagaagcttccgtggaaaggtaaggaaagaatgtcgaacgtggttggtaaagaattcgcccgggacggggttccgtcttcgtacgtggccattaaagtactccatccaaaaggttgagcgcgtgatccggaagggacttgggattcatgtctttcttccgcatcatggattaatgccatccccacaatgcactggttgtcttggccggatgaggtacagcagtttggtgagatga

SEQ ID NO: 526 - DNA, 735 bp, A.fumigatus
gcgcgtgatccggaagggacttgggattcatgtctttcttccgcatcatggattaatgccatccccacaatgcactggttgtcttggccggatgaggtacagcagtttggtgagatgatgaaactacaactggatctcagaattgaggcatccaacgttgtgatctttcgccagaaattcaaatcacgaaccaccgcttggtttccctacccatacttggagtataccacgcgtgaagtgctggtcgaagaattcgctcaagggatccccttggagactttcttggatgttggaggaggtgtctaccagcaagagatcgcaaatgagggtctggacgcgttccttcatatgcttctgatcgacaatttcgttcacgctgatttgcacccgggaaatataatggttagattttaccaaccagccgagttggacttatccctcggcaagcgcagtcgggtttcagatgcaccaaccgccgccgaagctgatgtgactgagactgtactggcccggttgaggccgcacgcccataatcgggaggcctggcacgctgctctttcccagctgaatgctgagggttatcgcccccagctcattttcatcgacactggcctagtgacccagctcaacgagaccaaccggagaaacttcctcgatctgtttcgagcggtggccgagtttgacgggttcagagcgggccagtcgtacaccgaccgggctggaaggacacgcgat

SEQ ID NO: 527 - DNA, 303 bp, A.fumigatus
cttcctacgcttagcgcggcaccttcgacccccgtggtgaagaccatgctgaacaagcgcaaccacgttcaccacttggacacgaacacagatgaagacatgatccccatcttcacgcacgacgtgaacaacaagtcgcgtaacaacaagcgcttgctaccgcgccgaaattggtgcgcgatccgagagtatcaacccggtgagtcgatgtttcgtccttacgagatatcaatctctctgactgaagataggctccacacctccgggttcgccagaatccgaagaggtccctccaccggctga

SEQ ID NO: 528 - DNA, 279 bp, A.fumigatus
  unsure (190),(227),(230): Identity of nucleotide sequences at the above locations are unknown.
ttcctgcctcctaagactctcgctcctacggttgggtttccacattccagtcgccagctgagactaatcctggctcggaaaatcttctgcatggccacagatgcggccaagaaggacattaaccatggccggtccatgctagataacgaatcctctttaacgcgccaactgcagtgtgcctacggactanggtggttgcctaaaagcattccactagggtgccttantanctggtgttcaaagtcccgccaccatctatctacagtccagagtagatag

SEQ ID NO: 529 - DNA, 198 bp, A.fumigatus
  unsure (182),(184),(185),(186): Identity of nucleotide sequences at the above locations are unknown.
agtgcttatcggctgaactttacatgtttgcaatcgagactcagcctcataaagcagctgctcgatatcgtgatcattcaaggcaccttcttcaatagaatgcagtgcaactttgccacatgcttctacttgcatattgtcatcacgccccggggctggaaggagacgcgtcccccaaaacncnnnaaaatggggggc

SEQ ID NO: 530 - DNA, 225 bp, A.fumigatus
gagcatccagccaaaatgcctggaattctccctatgaaagtgatcaaagtcggcaacggctctcaaagtcgtatagcacaggcctgcgatcggtgccgaagcaaaaagattcgttgcgatggaattcgaccgtgttgtacacagtgcgcaaatgtcggcttcgagtgcaagacaagtgacaagcttagccgtcgagcggtcttcaccacggggctggaaggaacc

SEQ ID NO: 531 - DNA, 336 bp, A.fumigatus
  unsure (36),(45),(52),(184): Identity of nucleotide sequences at the above locations are unknown.
ttcaatcagagtggacttggcgctaaatatccactntcagtcccnatcgtgncacctcccgttttggtcctcacgaagatcaagagatggtcgaccttggctgaatctaccgttcctcagagcatcaagaaggcagatagcgatattgacgacattgaggtgcttttgaaatggcttgctaganaccaatttcacatagatttcgagggttacctggcaaaaccaaaggaggagctgctctcgggggttcgcaagttgtaccaaatgcatgccgcatttcggcctttgcttgagactacgttggacgaggagagctttgcactcattaacaattag

SEQ ID NO: 532 - DNA, 717 bp, A.fumigatus
cctcccagaacgaaaagactactctcctgggcaagaccaagcaggactacgctgccatcctccgctggctctcgttcgtcaacgctgaggtcctccccaagctcggtgcctggtaccgccctctgctgggccttgacccctacaacaagaagaacgttgaagatgccgtcaaggctgccaacaaggccctcgccgtccttgagaagcacctcactgccaatacctacctggttggtgagcgcatcaccctcgccgattacttcggtgcctctctcctcacccgcgctttcgctaccgttttggacaaggcttggcgctccgagaacgttgccgtcaccagatggtacaacaccatcatcaaccaggctcctttcaaggccgtcgtccccagccctgtcttcgctgaggaggctatcaagtacactcctcccaagaaggaggagaagcccaaggctgctcctgctcctgccaaggctgctgctcctgctgctgagcccgaggcccagcctgagaagaagcccaagcaccctcttgaggctcttggtaagcccgagtttgtccttgatgagtggaagcgtcagtactccaacgaggacacccgccccgttgctctgccctggttctggcagaactacaagccggaagagtactctctctatgctgttgactacaagtacaacaacgagctcaagctcaccttcatggctaacaacctga

SEQ ID NO: 533 - DNA, 264 bp, A.fumigatus
ggtggtttccacgcccgtcttgaggcttcccgcaagtacctcttcggtgctcagtccgtttacggcgagaactacaactgcgttatccgcggtgtcttccttgtccgtggtcaggattggaagcccgcctttgaggtcgcccctgactgggagagctacgacttccgcaagctcgacccctccaaccccgaggacaagaagctcgtcgaggacatgtgggcctgggacacctccgtcactgtcttcaccacggggctggaaaat

SEQ ID NO: 534 - DNA, 1158 bp, A.fumigatus
atctctttggctaccccgcctttcggcagaaaatttcccaaaatggaattgacattgtttgatcgttgcaaaccaccactggttccgaatattttgagactgactggaacaaaagtgacctcccagaacgaaaagactactctcctgggcaagaccaagcaggactacgctgccatcctccgctggctctcgttcgtcaacgctgaggtcctccccaagctcggtgcctggtaccgccctctgctgggccttgacccctacaacaagaagaacgttgaagatgccgtcaaggctgccaacaaggccctcgccgtccttgagaagcacctcactgccaatacctacctggttggtgagcgcatcaccctcgccgattacttcggtgcctctctcctcacccgcgctttcgctaccgttttggacaaggcttggcgctccgagaacgttgccgtcaccagatggtacaacaccatcatcaaccaggctcctttcaaggccgtcgtccccagccctgtcttcgctgaggaggctatcaagtacactcctcccaagaaggaggagaagcccaaggctgctcctgctcctgccaaggctgctgctcctgctgctgagcccgaggcccagcctgagaagaagcccaagcaccctcttgaggctcttggtaagcccgagtttgtccttgatgagtggaagcgtcagtactccaacgaggacacccgccccgttgctctgccctggttctggcagaactacaagccggaagagtactctctctatgctgttgactacaagtacaacaacgagctcaagctcaccttcatggctaacaacctgatcggtaagattctacttctttggcttggtcttactccaccctctgacttttctcctaaggtggtttccacgcccgtcttgaggcttcccgcaagtacctcttcggtgctcagtccgtttacggcgagaactacaactgcgttatccgcggtgtcttccttgtccgtggtcaggattggaagcccgcctttgaggtcgcccctgactgggagagctacgacttccgcaagctcgacccctccaaccccgaggacaagaagctcgtcgaggacatgtgggcctgggacacctccgtcactgtcttcaccacggggctggaaaatc

SEQ ID NO: 535 - DNA, 231 bp, A.fumigatus
aagttcataagctcacccagtcgcagagaatgcaaaatcaagcacattggcgtgtcgtccgtgacttccgcaaccctccggcgcgcatgcaagatcgccaatgtcgtggctgtccaaaccgagtattgcgtcttttcacgcgatatcgaaggcccatctggcacgaacctcctggctccctgtctagaactgggggtggcgcttgtggcttcctgtccccttggacgcggg

SEQ ID NO: 536 - DNA, 252 bp, A.fumigatus
cctctgattgctgatcaactctacctatctagtctctatggcgacaatgaggagctgttgggcaagtggttccgacggactggaaagcgtgaccagatctttcttgcgaccaaattcggctttgttcagggaggaaaaccccacgagatcaacagctctgccgaatattgcaagaaagcttgtgaagcgagcctcaaaagattgggggtcgattcgattgacctttgttcgcaccttaaccccgcctactga

SEQ ID NO: 537 - DNA, 267 bp, A.fumigatus
gaccaaagttcttgtgggcaggaggggaaaggggaacttccccatcaaaatcttcggagggaggtgggggccataccccgttcttccatcccgttggtgtggacgtacatgaacactaccgtggatcaaacgcccaatctggatccggatttcgataagaacgacttcaaggctcccatggctggctttgggtacggattgccaatcagtcgcttgtatgctcggtactttggtggtgatctcaagttgatcagtatggaagggtaa

SEQ ID NO: 538 - DNA, 207 bp, A.fumigatus
cgagaacctcgttatgatgggaaatctagcctgcctcaattatcttattataatgagtttttactactcccactcgatataagactaataaatgagggttggttattagaaacctatcaagtctctcagaacgggctgtggagggtttcggttctaaatgaccgaaccgctgattcgatctcccaggaaacaattagattgtactag

SEQ ID NO: 539 - DNA, 189 bp, A.fumigatus
tattctaaatgcgcgttgtgcacccgtcagggtcgtttatgtaaaaaggatttccataccaaaaaggagtgggatttacttaaaagggctgaaaagaaaattgcttctgaactttctgtgactaataataaattagaactcttatatcctgaacttcaacagctgcaagagcacttagagaagatttag

SEQ ID NO: 540 - DNA, 921 bp, A.fumigatus
  unsure (907): Identity of nucleotide sequences at the above locations are unknown.
agcgcggatcagtcgctcaacgtcattgaatcacagctcatgccgtacaagcatcaccgggttctcttcattgacaagggccagaacggtcttcaggcggagaacatcatcaagatgctgaagcagctcgagctggagcctatagtagtgagggacgaagatcatgttccaccaccagaaattcaggatccgtcaggcaaagagtcgggtcacgcgtacgatgttataatcgtggattcagtggacacggctcgcttattgcggacctatgatgatttcaaatacgtccccattgtcttagtctgtccccttgtttgtgtgagcttgaagtcagcactggatcttggtatcagttcctacatgaccacaccgtgtcaaccaatagacctcggaaatggtatgctcccagctctggaaggacgatctacgccaatcaccaccgatcattcccgctcatttgatattctgcttgcggaggacaatgacgtgaaccagaaattagcagtcaagatcttagagaagcacaaccataacgtctcggtcgtgggcaacggattagaagcggtggaggccgttaagaagcgtcgctacgatgttatcttgatggatgtacagatgcctgtcatgggcggcttcgaagccactggtaagattcgtgaatatgagcgagaggccgggctttctcgcacacctatcattgcactcactgcgcatgccatgctgggcgatcgcgaaaagtgtatacaggctcagatggatgagtacttgtcaaaacctctgaaacagaatcagatgatgcagacaatcctcaaatgcgcaaccctaggcggttccctactagagaagagtaaggaatcccgactttccagcagtggcgaaattcaccaccactctgaaggcaagcgtnctggtatggagaca

SEQ ID NO: 541 - DNA, 300 bp, A.fumigatus
cttcatccaaaaacagcaacaatggtgagaaaggtggtcgttgtgactgggagtgcgtcagggatgggcctcgcaacagccaccagtcttgctagtagtggagcccatcttgctctctgggatatcaacagcagcaagcttaaagaaatcgcgaagtccttcaaagcccaatattcggggaagatactggctcaaactgtcgacgtgtcggaccgctctgctgtcaaggccgccttgatagaggcacagcatcacctcggccccattaatgcaattgcaaactttgaggggctcgtctaa

SEQ ID NO: 542 - DNA, 339 bp, A.fumigatus
  unsure (256): Identity of nucleotide sequences at the above locations are unknown.
gcctcgccagtttgtcccgcttttgacgatgcgaatgtctccggccacttggtcgactacgccattggacacaatgtcctcgttcctcgtaccctgttggattatctcagagtcctcttcggtgtccccgtggaagcgatgcaggacctcgtgatcgtgacccccgagaatcagatcgactttggcaatcccgtgtgcggcattatttgctattctgatatcctccgcaagccgcgagtgagagatcgcgatcacnaagtcacaaccttcattaagacgcaagtgtctcgcaagctcctgagcgaccatggcgggatccttgatgtacaacgggggtaa

SEQ ID NO: 543 - DNA, 513 bp, A.fumigatus
gcattttcccttcaatgcgttttgcgtttccattggctgactagagccaaggtgtccacctggaatcttatcttcgaaatgttgtgcggttcacaccctttctgggacagtggctcgcccgtcaagatctacgagaacattctccgcggccgtgtcaagtacccgccctatcttcacccagacgccgtcgacttgctctcgcagctcatcacagcggatttgacaaagcgactgggcaaccttcatggaggttccgaagatgtgaagaaccacccttggtttgcggaagtcacctgggatcgtcttgcaagaaaggacattgatgctccttatgttcctcctatccgtggaggtcagggtgatgccagccaatacgatcggtatcccgaggagactgaacaatacggtcagcagggcgaagatgtgtatgtgttccagttgcgaatcattctcgatcagagtactaaccgaaactcttgctacaggcatggccatcttttcccagacttctag

SEQ ID NO: 544 - DNA, 366 bp, A.fumigatus
ctccaccgcggatccttccagccccgtggtgaagacattttgattatggagctttcaagtggagagcatgctgtaagtactagcggcattttgtacgatgagggattcaaaggatacactccaccctctcactactcactggaggtatacatctcctctgatgcagacatgctgatgcactgtacatggtcattggaggatagcaaagttgtcaggggtccagaagcacattctcatacgactgtacaacctgtacgaccggtccgaataaccacagggcgacagacaagccttgacaagagatcttggcggtctcaccactttactcggctattcggcaaatcgatgctagcaatcactagctga

SEQ ID NO: 545 - DNA, 414 bp, A.fumigatus
ctgagaatgttgatgttcccaccacaaacaaggccttcgtgcctcttggtaagtaccatatctccaagctcatcaatggtccgaagtatgaatactaatacttccgtagaaaacaacccagaagtcatgtcccaccttgtccaccaactgggcctcccacccacactcggcttcacagacgtctactcaatcgacgagcccgacctcctcgccctcgtcccccggccctcacacgctctcctcctcgttttccctattactccatcctacgaagcctcccgagtcgctgaagacgggcccttacccgaatacaacggctccggccccggagagccagtaatgtggtttaagcagacgatccgcaacgcctgcgggctgatcggactcctgcacgccgttgcaaacggcgaaacg

SEQ ID NO: 546 - DNA, 582 bp, A.fumigatus
ccctcgatagatatatatcagcccctagactgtgaggaattattctccgttcactttctcctcaagctcaagtgcaaatacaaggatacgatcatgggatccccgcgactcctctctcgtacaccattgacctcaatccttcgtctccccatccagactaccaacggagcaaacctcatccctcgcaccctgtcaagagtacatagatcttttatttcctcccagactaaagcggcaccactcaagatgtccaacaccgacacgctcattgagctagccaaagcccgccgcacaatctacaaactcggaaagaacagccccgtccccgactccaagatcgaagaggtcgtcaacgcagctatccagcacgtccccagctctttcaacacccagtctacgcggctcgtggtcctcctgcacgccgagcacgagcgcctctgggagattgtcattgacaccttcatgcagctcgttcaaagcggcgccgtgcccgagacgacatggaagatccagacgctgcctaaactacaggggatgaacaatggtgtcgggacggtatgtctctgtgtcgagagtctttga

SEQ ID NO: 547 - DNA, 192 bp, A.fumigatus
atccttgaagctaacccatcgctacagatccttttctacgaagacccagcacacatcaagcccttctccgagaaattcgcaacctacaaggattacttccagccttggggcggagcactcgaacgccctgcaccagtacttccgtacgttcctcctcccccggtatcagctgcaatccgtgctcgggcataa

SEQ ID NO: 548 - DNA, 261 bp, A.fumigatus
acaccagtcaaccttgagtgggtagggcgatgcaaggaacgaaagggcggcgacttccacatgatctatcaacccatgagtctgccgcatacaactgatatctgctgtgacgctgctgacctagggcttgaatatttgggactgacatattcctacccacaacgtagatttgacactcagccaggttgctcgcaggcaacggaaattgatgcaaacacaatagatctacattggttcttacgcgcgagaccggggagatag

SEQ ID NO: 549 - DNA, 381 bp, A.fumigatus
cttcatcgtcagacaccccatgaaatccttcccaaactatttgggacactccgcgagcgctacgccgaacgtcggggtggctacacacgagttctgcggatcgagcctaagaaagatgatcaagcccctagcgccattctcgagcttgtcgatggaccgaaggatatgcgatttgccatgacagcccggaccgttgcgagacagcgagcacagggcctcgagactctcaacgagctaacaaccctgaatgtccacaaagtgacaaggttccggaaaggcggtgtcgaagacctcgaaaaggcgatcaagcggttagaaatcgaacagaagaaagcccctacgacgcataaaggcgaaaaagaggtggagtctaagcaatag

SEQ ID NO: 550 - DNA, 876 bp, A.fumigatus
  unsure (848): Identity of nucleotide sequences at the above locations are unknown.
gggcgaggggaatcgttggaaggagaatgggagaacgttggaagccggtcggagggaattcgcaacaagaataatggtgcccctggaagaaatgtggaatgtgttagacgtatctcccggaaaggaaccccagctgtggatcccgggaggagattgccttacaatgaagcgcaccttttggtgtggagaactcgatcaatggctcgctggcgcgatcgtctggctaccgctaagaatgccaacgaaatgtgccgtgtattttcaaagttcaatgctctccttgttcgtccaaagatacgaggtgcgattggcgaatatcaaactcaacttatcgagaatgtcaaacaggatatttccgccttgcacgagcgcttcaaacagcagtatggccactcagaggcacatgctatggcacagttacatgacctgccccctgtgtcaggtgcgattgtctgggcccgccagatcgagcggcaactcgacggttatatgcgaaaggtcgaggacgttcttggagaagattggcatcttcactccgaaggtcagaaactccaagcagagagcaatctcttccggaagaagctggatacgcggcccgtttttgaatcgtggctgcatgatgtgcaaaggcgtcacatcaccattgctggccgactgtttaatgtgacgcgcaaccgcgccgcagggaacagccttgagctctccgtcaacttcgatgcccaaattatcgccttgttcaaggaagtcagaaatctcatctggcttaatttccaagttccacatgcagtcagcagtatctcaaaagaggctaaacgtgtttatccatacgccatcagtcctgatggatnttcaccgacgggccagatcagcgtagcg

SEQ ID NO: 551 - DNA, 201 bp, A.fumigatus
ctaacgactacatttagttccatgtgtctggaagatgtcaatggcaccgatctaatgcacgtgctctcctgtcgccatgtgtatcacgcacactgcctggagcagtggttccttgggcgtcacttttcgtgtcctctatgtaaccgatccttcttcgaagaggtggagccggggcccgagccggggcccgataacgtctag

SEQ ID NO: 552 - DNA, 204 bp, A.fumigatus
agagggattttcgtacaagtgcgccgaaatgcagctcgtacgtcggcctcaactgttgtaaaagaaaccaagcagcactccgacacggaaatgctgcagaagctcgagagtatctgccccaccaaaccgtatgacgaatgggtcgaacacactcagactgagcaggacttgtctgatcggtcttcggcgcatttcacatggtag

SEQ ID NO: 553 - DNA, 306 bp, A.fumigatus
aagtgttggctcagtatccccggcctgatttacctggtcgcagtgcctatgtggccacgcgcacgacggttcggcaacgtctatgccttcgctacggtcgactgtttatacgccattctgtggttctcggcgtggatctgcgtcgcaagctatgtcgcacagggaaaggccgagggcaagagcaacagtgacaacgataagaataaagatgacaagaagagtggctgcgacgcatggaagtacggaaacgccagcaaatgcaagattagtacggcaactgtgattctgggggttgtgatcttgtag

SEQ ID NO: 554 - DNA, 483 bp, A.fumigatus
gtttcctcccccattttggtatttcgcacgaaatttttgttaatgagccttgtttgcagccttctgtttgttgcgaccgcttggatgtccttccgcaacgtcatgcatttccgccgaactggtacccttcccgatgctgtttccgatcctacgttcgcggcccagagcaaggcggctttctcctcgaaccctgcgcacgactttgacgaagaggaggatgatttccgctccggacgtgctggaatgggcgcttctgttcgtaatgatcaggacgaggattacgctttacttcaccaaagcgaggtagacgatctcggaaatggcaacggacgtactgcaatgcatggtgcctatgatcccactgctactaccggatcagggagtgtgctacatgactataacaccagttatggcggcgcgcacgggcaacactatgcacaaccgtctgaattcggttctaccctgagtggttatggacgttaa

SEQ ID NO: 555 - DNA, 273 bp, A.fumigatus
acctggagacttcttcaaagccggcatgggtttccccactggcttatgcctgaatcacattgccgctcattggaccccaaatccacgcgagaaggacgtcattttagacaagggggatgtcctcaaggtagactttggtgtgcatgtgaatggtcgcatgttgattcggcatttaccgtcgcttttgacgaccagtatgataatcttcttactgcagtgagggaggcaaccaataccggcatcaaggtatgtctgtccatgcaagaactttga

SEQ ID NO: 556 - DNA, 882 bp, A.fumigatus
  unsure (406): Identity of nucleotide sequences at the above locations are unknown.
cttttatactctcccaaacaacaaccgacagcaacgctaattcatccttcccttacagcctccaactgcaatgagctcaagccagccaatcccgaccctcagatctctcaaaatggctcgggatcagccgatttggatcgcggagtcattggtgatgatgatgacgacgaggatgccgaagaaaatggggtgaacaccgagactcccaatgttggtaagctcaaccaaccacccttcccaaatttggatcaagtgcatgtaaccaccactgacggtctatgcataacagaaaaaaagaagaaacgtaaaaagtccaacaagaagaagaagaagaagaccaagtcgggagcccttccggcgacggagctcaagcaaactagcccaccgcgtgtgctggtctcgactntgttcccttcggagtatccagtaggagaactcgtcccatacgactgtacggcgcgcacgaccgatgaagagttgcgctacaactcgcgtctttgggacgacgacttcctccccgattaccgccaggctgccgaaatccatcgccaggtccgccaatatgcgcagaaagagcttatcaagccgggagccactctcctatcaatcgccgagggtatcgaagccggtgttcgtgcgctttccggccatcagggacttgaacctggagacttcttcaaagccggcatgggtttccccactggcttatgcctgaatcacattgccgctcattggaccccaaatccacgcgagaaggacgtcattttagacaagggggatgtcctcaaggtagactttggtgtgcatgtgaatggtcgcatgttgattcggcatttaccgtcgcttttgacgaccagtatgataatcttcttactgcagtga

SEQ ID NO: 557 - DNA, 243 bp, A.fumigatus
atcccttcattagcggtcgtccgctatttactgacaaccatctacgcttgggatgttgcacaccctgcatccttcatggactcttgtatgacaagccgctattacggtaccattgccctaactatctttctaaaggaggagcttagttgcctccgagtcggccaaattatgcagcacatttgccagcggataaataagcgcaccattcacaggctgctcacttttgtcatccttgttatttaa

SEQ ID NO: 558 - DNA, 534 bp, A.fumigatus
tctgccctggcttgctacccccgtatcaaaaattttcacggtcggtcgcagggatcaggctgcttgggcttcttgccttctcttgtcctggattcctcatctaggatccccatgtctgattgcgcctcatcagcgtcattccgagcagggcctccttcaccatcatctcccgcttccgggtcattgaaagagaaccatccaccatatatatcctctgaacactttccacagactccgacatctcctccgttgatgtcggtaagcgcttctaactatgccaccaatatcgcatcctcccaacctcccagccaggcgacgtcacaacctgcgaacctttcatcccctccgtcctcagctccaatgtctacacagacctcacagcagccgacgctagggcccacgaattcttttcctacaccggccagcagtgtgagcggccacttcatgggaccaacttccgtcgaagattcagagcacgtgggaacatcattggggtcttcaccacggggctggaaggatccgcggggatgctat

SEQ ID NO: 559 - DNA, 675 bp, A.fumigatus
gaaatcaacggtcagaatggggtcccacgagataccagcatgaacttcatgcaggatcactccggtgctggcatttctatgagccatcccggccatatgtcgcagatgtattccaacactcctgaaggggctccgatgcacagccccttcatccacagtttcaattatgatcatttccgcggtctgaaccagcaacaacacaatccctcccatctccagggttcccatttcgagcagagctacgtcaactccaaggcacgcccgagtctacaggcgatcgaccgcacatcttccgatggacgcagccccatgacccctaaaactccagctttgggtgccctgactcttggaactccggaatctggtagtttccctacacaaccgatccgtactggattgcaaccacggcatcagaagactctgtccaaccagtgggatggcacccccggaagcgcccactccttcggtatggagtcccccatttcgtcgccgggccatccctctcatcatgccgctatctcggagatcctcaagtctggcaagcatgcctctttgccagccaaggttgatacacacattccgggaagcgcccaggatttagaatcacaagaagcaaagcgtcggcgccgaagagtcttcacgcggttgcgagaggcgtctggatgcaaatcgaag

SEQ ID NO: 560 - DNA, 381 bp, A.fumigatus
cttcggcagatcataaaaacaatgtccaccccgcgaattgagcactacacgacggatgttcacgcccactgggaagggatccatccgcaggattgggctgaggtcgatctaatcggatacgagaatgccatggataagatgtatcggacgttgtgtgaaaatccggatgctgctctagtccaagttggccataggtcgaaactgctcaatgatcatggctctgactatcggttcaatggaaaatttacaagcgagcagactaaaccagagcgcagtcaccatgactataaccattttggcaagttgatgaaatgggaaggcgatcgttggtacaagtatgatttcgaagtggaagtgacagatcacaccagatctgaatga

SEQ ID NO: 561 - DNA, 228 bp, A.fumigatus
gaatcatatgattcacactctaacaccagacatgacatcatgatattattacatccagaagaacaatttgcccaacagtttaataatttggaaactccatatctaagtcgcctccccttctcaaggctgaaaaatcctttgtacttttaccctatacaaaacagcaattatatctcctcacaggcaaccgcctacctagttggaaatagtgacttcggcagatcataa

SEQ ID NO: 562 - DNA, 537 bp, A.fumigatus
cgcggatccttcgacccccagtgggtgaagacgacgttgctcaacatctggaatcaatgggtggattcggacttcagctacatctgggcgcgcgagaatttcctccagcagcgaagcctgacacgtgcgcgagacgtgcgcgatcagctggcgaagctttgcgaccgcgtcgaggtcaccatcagcacatgcggatcgaacaactacgttcccatccagaaggcgattacggccggcttcttcccgaacgcggcacgactgcagcgcggcggcgacagctaccggacggtcaagaacggccagacggtctatctccacccatcgagcaccctgttcgaggtcaacccccgctgggtgatctactacgaactcgtcctgacgagcaaggagtacatgcgcagcaacatgcctctgcagccagagtggctggtcgaggttgcgccgcattactacaagaagaaggacctggagacgctggggctggaccgcaaagtccccaagggacagggtgcagccggcgagaagagcaaggattaa

SEQ ID NO: 563 - DNA, 897 bp, A.fumigatus
  unsure (18),(190): Identity of nucleotide sequences at the above locations are unknown.
gcattttctttttgcagntcaccaacccgaggaggtgaacttgaccaagtagcattccacagcataatggcagcattcttaggggggaatcaacacagacatccttcatcaggcgccaagttgtatcattcgccctcagatctcgaatccgactcagacagtgaggacgacacggcaggcacgcgatttnttgagcatcaccgcggacgaagcagtacacagatgaagaacaagagtcgcacggtttccaaacgtcgctttaaaccgagtttgaccctcgcgaccggcacgcagaacggctctgctggcggcgagatgaactctaatatcgagatgcgcaagagggatacctccctcgaatcatcgggtgggcgggcctcacgcttgatggcccggcagagcttctccttgaacgatgaccccccgatcactccacagactccagctatggcaacgactagtttcgccaacctgccttcctccgaccgaaggaattttttgctattgtgtgttctatatttcctgcagggagtccctatgggattagctacaggatctgtcccgttcctgctcaaaccatacctttcctacggtcagatcggcgttttctcgttagcgtcttacccttattccttgaagcttctctggagtccgattgtcgatgcagtatggagtcagaggttcgggagacggaagagctggatcacacctgtccaagtcattgcgggcctggcgatgatctatctgggtggacacattgaggagatgatggtaaaggccggtgccaatggtggtgctggcgtctggaattttacgtattggtggttcctgctcgtctttttctgcgccacccaggatattgcggtggacggctgggcgtcttcaccgcggggttgc

SEQ ID NO: 564 - DNA, 426 bp, A.fumigatus
aatataaatgagcatatagttaccaatgctatctacgcgtttgatttgggtaatattatggagccgctggtttcattctggcagcgactcttgcttaacagtgaccgatatgtttatgacaaaattggcgcgggtgacgaccctgatgatgatgaaagtgatttcaaggccgtggagtttagtgaccttgaggacgccttactctttgagccagatcctgaagagaagtatgcgtgctgggatgtcaagtatattagaaggctttttggatttgaaacaatccagcatgctccggcctggcaggagctaggaaaagtgagaatgcctcccggtcgcttgatttctttccccaatgcctttcagtaccgcatgggtccgttagagcttcaggataagactaagccgggacactgtcgtttcctgaat

SEQ ID NO: 565 - DNA, 270 bp, A.fumigatus
gactgtttatggggtaatagtccgttagacgcgttccaagtaagactgtggcagaccttcttcattggtaaaattggagctgagatcatcaccttattcagcctcacaataactcatctcaacaacatccactctttctcagttttcgacatagccacaaatattgactcaagagcgccgtgccccgaaggatgcaaggcacaagtgcacttcgactgtctgctgaaggtactgtggatgttcctttttactccttccaacaatgagtga

SEQ ID NO: 566 - DNA, 249 bp, A.fumigatus
  unsure (95): Identity of nucleotide sequences at the above locations are unknown.
agaaggtctgccacagtcttacttggaacgcgtctaacggactattaccccataaacagtctcactgactgggttccgattgtccctgtacattntataatcctcgctcaaaccacgctttctttcagtgtttttcgacccattgtcaatactttctctgacgcacacagctctgaaatcgatagcctaactgctgttccccttgttaaggcttccctcattgccgcgcggactccaaaaccactgtga

SEQ ID NO: 567 - DNA, 1137 bp, A.fumigatus
  unsure (614): Identity of nucleotide sequences at the above locations are unknown.
acgccatgcccggattcttccaggctcgtttgtgaagacgccaaggccctatgcgtcaagccttctcttctgttgctggacgaccccaccgctcacttggatctcgaggcctgtgtgtggctggaagattacctgaagaagtgggagcgcactctggtgcttgtttctcactctcaggatttcttgaatggtgtctgcaccaacatgatcgacatgcgcatgaagcagctcctctactacggtggtaactacgattcgtaccacaagactcgcagcgaacaggagaccaaccagatgaaggcctaccacaagcagcaggaggaaatcgctcacatcaagaagttcattgcttctgccggtacctacgccaacttggtccgacaggctaagtctcgccagaagattctggacaagatggaggctgaaggcttcattcaacctgttatccccgacagagtcttctccttccgtttcgctgatgtcgagaagctccctcctcccgtcctgtccttcgatgatgtttcgttctcttactctggcagctgggacgacaccctgtacgagcaccttgactttggtgttgacatggactcgcgaactgccctggtcggccncaatggtgtcggcaagtctactctcctccgtctgatgaccggaaaactccagcccattgccggtcgtgtcagccgtcacactcacttgaagctcggtatgtacagtcagcactctgctgaacagctcgacttgaccaagtcggcactcgactttgttcgtgacaagttccccgagaagagtcaggactaccagtactggcgtcagcagctcggtcgctatggtctgagcggtgaatcccagactgccctcatgggtactctgtccgaagggcagaagagtcgtatcgtcttcgctctgctggccatcgagtgcccgaacatgattctgctggacgaacctaccaacggtctcgatattcccaccatcgacagtttggcggatgccatcaacgccttcagcggtggtgtcgtcgtcgtgtcccacgacttccgtctcctcgacaagatcgccaaggacatcatggtgtgcgagaacaagaccatgtcttcaccacggggctggaaggtgccgacagtagtctga

SEQ ID NO: 568 - DNA, 1053 bp, A.fumigatus
  unsure (488): Identity of nucleotide sequences at the above locations are unknown.
agacatggtcttgttctcgcacaccatgatgtccttggcgatcttgtcgaggagacggaagtcgtgggacacgacgacgacaccaccgctgaaggcgttgatggcatccgccaaactgtcgatggtgggaatatcgagaccgttggtaggttcgtccagcagaatcatgttcgggcactcgatggccagcagagcgaagacgatacgactcttctgcccttcggacagagtacccatgagggcagtctgggattcaccgctcagaccatagcgaccgagctgctgacgccagtactggtagtcctgactcttctcggggaacttgtcacgaacaaagtcgagtgccgacttggtcaagtcgagctgttcagcagagtgctgactgtacataccgagcttcaagtgagtgtgacggctgacacgaccggcaatgggctggagttttccggtcatcagacggaggagagtagacttgccgacaccattgnggccgaccagggcagttcgcgagtccatgtcaacaccaaagtcaaggtgctcgtacagggtgtcgtcccagctgccagagtaagagaacgaaacatcatcgaaggacaggacgggaggagggagcttctcgacatcagcgaaacggaaggagaagactctgtcggggataacaggttgaatgaagccttcagcctccatcttgtccagaatcttctggcgagacttagcctgtcggaccaagttggcgtaggtaccggcagaagcaatgaacttcttgatgtgagcgatttcctcctgctgcttgtggtaggccttcatctggttggtctcctgttcgctgcgagtcttgtggtacgaatcgtagttaccaccgtagtagaggagctgcttcatgcgcatgtcgatcatgttggtgcagacaccattcaagaaatcctgagagtgagaaacaagcaccagagtgcgctcccacttcttcaggtaatcttccagccacacacaggcctcgagatccaagtgagcggtggggtcgtccagcaacagaagagaaggcttgacgcatag

SEQ ID NO: 569 - DNA, 327 bp, A.fumigatus
  unsure (165),(286),(299): Identity of nucleotide sequences at the above locations are unknown.
gaaccaattctacccatcccccacgatcctacagtcccaggcatgaaccgccgaaactcctgggttcaacggcgaagaacggtggatcagtggaagcagcgcttctcccagcttcgcgaggaatctacccggtatgtctatcgcccagacaccggttgttgtctntacgggtacccttttacctacaatggcgcccgggaaatcctgggcttcgttgtccgtggaacacctgggatgttcccgtggaataacgccctgggccaacttgtgtggaggcacggaatcncccccaaattcangtgttatgcgccccaacccgaatcttaa

SEQ ID NO: 570 - DNA, 456 bp, A.fumigatus
tgtgtatgtgccattgcttacggacaccctctcgtccttgctgataggaagatatggcacaatcctgtccatgaacgtgatgagtccaacgagtcagaaacagcgaagacatgcttcaagttcctggatttgacaagccggagcttcagcgcggtgatcaaggagcttcaccctgagctggtgcttcccatgtgcattttctacctgacactccgtgggctggacaccatcgaagatgacaccctaattcctttgaagactaaaggaccccctcttcggggattcaaagaccttcttgaacaggaatgctggaacttcacgggtaacccgcccggaagaaaaaggcccgtgaactgctggttcaatttccccaatgtccataaccccagtcaaaaaaatggaacccttgcctcaaggcccgtattcaaggatttccccggaaaaaaagggccaatg

SEQ ID NO: 571 - DNA, 228 bp, A.fumigatus
ttctttcgcattgccgagcatggtccatggcgaaagagcgacactgtgtcgctagggattgcttatgataacttcgcattggaagatgctgccgagattgagcagatcacttccttggcattgtacgaggcttcctcgattgagatacgcagggctgactttatttcaggtcgcaaaacgtttctgcattcacaatacactaccttggcggtccttggagttgtatga

SEQ ID NO: 572 - DNA, 399 bp, A.fumigatus
acagacgcaaatagccctgaactggtcaatcagtacaactttctcaacacatctatcccaattgtcttttcccacgcctcttacctgacagtgaaggacgccgagctgcttcgctcaacaaaccaatatatttccatcactggggaatcagagcgacactatggacacgaccacccaagcagcccgtacattatggaccaatcctctctgggaatcgacacccacttcacctacagcgccgatatcgtcggacaagcgcgcatgtggctgcaggaggtgaggcttcgcctgtacgctcaggtcctcgactgttgggacattcctcccaataaccccatgtctgtcgaacacgcatcttattggcaatctcacccagccgtgcaaggaccgcgattaagt

SEQ ID NO: 573 - DNA, 300 bp, A.fumigatus
actgttataaatgatgggcaagctctagatcagttgagtgattcaatcaggattccactgcatagacgaacggaggagcagagaatcgctgagcaggctttcttaaatgatgagaagcattctgggctgaaagtgctggagagtactatgtttaagcgtactttaatttgcattgacttcataactcatttgcttagattactgctattctaccagatgcagcgtgccataatagctagatttagcagagaaaacaggttatttgatttgataacttcaatatatcatggttcaatttga

SEQ ID NO: 574 - DNA, 198 bp, A.fumigatus
tccatctgcggtctgatcctggttgcgacggacatattgaacaattggcccttactctcacaaccacaatatagcgttttctggaacatggcaggccgggaattgctctacactgttatagagcaaacatgcatagtcctaatttatatgagttattgcattgtttatcttaaggggattatatgttcgccctgctag

SEQ ID NO: 575 - DNA, 183 bp, A.fumigatus
ggcccagtgtttgttgccacaaattgcattgccacaatgggcggaggctcaaaggtggccattgtcggagctggcttcgctggcttacggtgcgcagacatattagtccagaatggcgctcaagttaccatctttgaggcaagagatcgactcggagggcgggtgcgttcacaggcacgttga

SEQ ID NO: 576 - DNA, 438 bp, A.fumigatus
tttgtcgcaaggggccctaactggattcatggcacggagaagaatcccatcaccggcgtggcagaggtgaccggaacgactatcgaggattttgaaggcgagcagatcattttctccagagctggaaagctcgtcgatgaggccacctcggccaggatctctgagttcgtatggagcacgatagacgaagcgtttgagtatagcaatgccctcaaagactctattcctcccgatcaaagtctgcttgacttctttaaggagagagtcagcaaaacgggcttaaaccctgaggaaaaggagctctgtatagagacatgtaagctgtggggagcgtatgttggtgactctattgagagacagagtctcaagttcttctgtctggaagaatgtatagacgggagtacgtgccacattttctctatggctgctatctgctga

SEQ ID NO: 577 - DNA, 555 bp, A.fumigatus
cgcacgcgtatcttccagcttcgtcggtgtaatatggaacctctcgacgcacacagcagccgatcccccaatatagtcatgagcctaatccgacatcacctcctcgggcgccaggatgtttcaacggtcgagtcctcgcgcagctactttgtccaccaacagctccgctcccagctcagccatgacgtctggtggatcgccctcgcagtcttgttcattaccattgccgagtcgccgcactattccgataatccaatcgcctactcgacctttaacatcatcttcgaggttgtctccgcgtacggctgcgtcggcatcagcgtcggctttccgggcagaaattactcattctgcgggtcgtggcataccatcagcaagctgattctggcggctgttacactgcggggccggcacagaggtcttccagttgcgattgatcaggcagtaatgctgccgaatgagtcgctcgcttgggcagaagaggaagatgcggttctgaggcgtgagcagacacgtacgtatggaagtgacaagatgcccgttgggacggtttag

SEQ ID NO: 578 - DNA, 270 bp, A.fumigatus
cgcggtgctggcgctagtgatgaagacagccgggaggagatgctgacacacagtgttgttgatttgacagatgacaagatcctcgtccagatgggttcacttcgagagggcaaaacgcctgaagaaaaggaccaatatattgccgggctgaaacaaatcattaatgatatgcggcgcgacaaggtgaaagatttcaataccgtggccacggaaattgctgcataccgtagacgcttcctccaagatccatcacgtgtcttgcccttgtag

SEQ ID NO: 579 - DNA, 705 bp, A.fumigatus
  unsure (4): Identity of nucleotide sequences at the above locations are unknown.
tggntgccagcatgcccacggaagaggaaacttctcgctgcctttgtaccttcggatgagttgtcgaaggaggtcgaggagtacattcgcaatcaccctgtgacacttgctttgcgccaaaacccggcctataccgaatcgcgaccacatatgaagatcccgcaagagttgcgcgcgcgtcatctaacggccggcatccttgcgactccgggcggaattgtggtgccgccttatgttttctgcgaggagggcggaaagagcctgactgccatcttttaccttggctccgatgtctccggtcatcctggcattgtccacgggggtcttttggccacgctgctggatgagtctatggccaggtgctgcttccccgcgctgccaaacaaagtgggtgtgacagccaatctgaacattgactaccggcgcccggcgatggccaacaactatgctgtcttgaaggcgaaaacggtcaaggtggagggccggaaggcttgggttgaggcgcatattgaaactcttcctgaggatggtaaagagccagtgatactggtggaagcaaaggctctgtttgttgagcccaagcaagctgcggtaagtccatttccgggggccgttggaataaggaataatgtgctgactatgatttcaggccatggcgagtctgtacaaaattaccaactagtatgttcaggaacaagcggctag

SEQ ID NO: 580 - DNA, 804 bp, A.fumigatus
  unsure (10): Identity of nucleotide sequences at the above locations are unknown.
actcctaccncttgcggcgccgtttgcacacttttggaaagcatcgtttgcggacggaaccggttggagaatggcagtatggaagcgtgggcacgtgcctacaaggtacacgccgcaggcatccgctccgtcaagatgacacagaacggtattcgtcaggagggtatctcgttgctcttgaaagagggccttcgtcacgcgagcgccctggaggttttggacttgcaggacaatacgttcacaatcatgggatcgactgctctcgccggtgttgtggctggctggccctctctgcgtgaactcggtgtcggcgactgcctcctatctgcacgcggcggtgtcaaggttgctcaggccctggcagagggtaaaaatcaaaacatccagactctgcgtctgcagtacaacgagattacggctgagggtgtgaagctgttcttgcacgctacgaaaaccgcccttccttcccttcgccgcatcgagttgaacggcaacaaattcctcgaagaggacccgaatgtgacagagttgcaggaggtcttggaggcgcgcaaggaggagcacggcaccgatgatgatccagacgacatgtggggtgtggatgagctagatgagctggaggaggagagtgaagaggaagaagaggccgaagaagaggaggaggaagaggagcaggaggaagaggagcgcaaggccgacaagttcctcaaggacaatgtgaaggcggaagacgagaaggtcgctcaaagacaggacaaggatgtcgatgctcttgcagaggccctgggcaagactgctctatag

SEQ ID NO: 581 - DNA, 684 bp, A.fumigatus
atcgcaccccttgctctgaagggtgagagtctgactcaatggcgcaatgccgttgtgggtgcgccaagccccataacgcacaaatacaataacgaccttcgcctgtctggcatcgacttcagcgaccaggaggccctcactgaaagactagcggccgttatggactacgacaagcattgcaatttgcagatggttctttacgaagacggccgcgaggaaatccgaaaaccaggtcgcaagatcatcggcgagatgaagaaggacgctattatggctcgcttgcacgcttggacgcctgagctgcgctctggttcattttccgcgcacgacttggttgagccgaggactctaaggataatgtgcgatgcaatgtccgcactggcaaaacacttagctcaaaatcttgatactggagcggaaggcaaaacctcgaactgtgtggccggccaaaaaaaaatattcatgtctctaagccgccttatggtggatctgggagaagccattgttaggtgcgacggcgtggaggctttcgttgtgaccagcttattccttttcttgacgtcggaagagatccactcgaacctatgtgagtcggaccaagctgctatccactccatattggtggtgttcctaagaaattatgtggctaccattctgctcgtggaggcaacggtatcttcttaa

SEQ ID NO: 582 - DNA, 573 bp, A.fumigatus
ggattagagttctaccacccgacgtcttacagcattagtcgatactccaatgctctgaccaccacgatggtctttgggtggcgcacgccgacctacgaggacgcgaaaatgaaacagctttttgacggcttctcggagttcgccgagatcaaccagacgggaacagcagccctcattgatttcttcccgtggctaagaatgctgccggactttctgctcccgacgcagaagcgggccaaggaacttcacgagcgcgaaaaggctctgtacctgggccactatctgcgagccaaacaggatatccgtgacggacagattaagccttgcttttgcgtcggtctggccgaggcccaaaagtcggacggattcagtgacgaccaggctgcgtacatctccgggacgttgttggaggccgggtccgacaccacgtcgaatactctgtatgcgttcgtgcaggcgatgctacttttccctgacgtgcaacgcaagcttcaagaggagattgaccgcgttgtgggaccccgcatgccgaccatggacgatgagcaggacctgcagtacgttcgtgcctga

SEQ ID NO: 583 - DNA, 219 bp, A.fumigatus
tgtactgccgctgtctcgaagttgaaggggctcattgcgaggaaggcgtctgaggtgtcggggctgaaagcacagctatgcgtggaagcaagaaaagataagagcaaatcagtcagtcttaaatctcatgaatatctgaagatctatctgaatagaaagaaacatcaacctcttatggcctctcaggacctcacaaaggatctcctagaaggaaaataa

SEQ ID NO: 584 - DNA, 546 bp, A.fumigatus
gagcctgatagtcagacttctccggagtttgggtacagccctcagtcatcatctcaagccagccagcagtcaggctataaacctcagtcctcgtctcaagcaagcgcgcagttagggtatcagccccagtcttcatctcttgcaactccgcagactgggtatcagcctgagagccagtctaaccttgagtctggttacaacccgcagtctgaatcccaatttatcccacagtctggatatattcctcagtctgcgtcccaatcacccccggagtttgggtacagccctcaatcatcctcatcccaaggcacttcgcagactgggtatcagcctgagagccaattcaatcaggactctgggtacagccctcagtctgcatctcaaaaagccccagagtttggatacaagccccagtcttctcagcccgctgcccagtctggataccagcctcagtcatcatcgcagtcatcccagtttagccaatctgccccacactctggataccagccccagtcttctcagtccgcggctgagtctgggtacaaa

SEQ ID NO: 585 - DNA, 249 bp, A.fumigatus
cgctcatctctgacaataaggcttctggttttttcatcctcatttagttggcattcaaccttcggctactaccgcggacttgtctcttatctcttttcatcccttttaattttcctccctatcacaattctttcgcgccgactcagcattattgccaagattattcacagcttgtcctttctccagtcggtgtcgatcgcgtctcacggacacctgcgtcagtgtgggtgctctcgggaagctgactag

SEQ ID NO: 586 - DNA, 234 bp, A.fumigatus
  unsure (136),(169): Identity of nucleotide sequences at the above locations are unknown.
attattctctttcacctcaggtacatgccaaatgtagctcaaattgaaaaaaaccctcttatgaatctaatttgcacagtttctcttagtggcagcaagttcggcaccggcttatcaaatttactcacatgtgatntagccaagagaacaaacatgaccgtggcaccantaactcgctggcttcatattaacggaggttaccaactaaccaccacatgtggcaccgggctctaa

SEQ ID NO: 587 - DNA, 348 bp, A.fumigatus
cttgatttgcagcgaccttaccagtgcttgttcatggcagcttgtgcccatgtatggcattacaagtgcatcagccgtctcatccatactcctgagtacccgatgttccaatgtcccaattgtcgtgcatacacagacttgagcgccgaggtggacgattccaacgacgcgaacgatgtggataccagcaaggagaatgatgatagccaggagcctgcgcagacatcagcagcagagacttcaaatgggatccaagaaccctcagcggaatctgatacggcagcagctcgtacgcaagagcgcacggaaagcagtcgtcaaacaagggacgtgcccgctgttgtgtga

SEQ ID NO: 588 - DNA, 225 bp, A.fumigatus
aacttgatactgcccgaaaatgagaatgtttgggagcgcaaagtcagtcatcacaccacagcaactctaccatgtcaacgacgtaatggctatgacacttcattcctccaatctccatacactattgattatcccgtcttttcatcccacgctagtcctgaacggggcgacagtctctgtctacagacgagcccggaagaagatagtattggttacgaccgcacc

SEQ ID NO: 589 - DNA, 405 bp, A.fumigatus
aacgcgggcaaccttgctaatggagaaaccagggttggattcctcaccatgatcgttcctctgtaccaagccgaaatttgccatcccaagattcgaggccgtgtaacagccttgcagcagttcatgctgggtgttggtgcactgtgcgccgcgtggatttcatatggtacctacgtcggatttgatccaacgaacaacgcccagtggcaggtcccacttggtctgcagattgctcctgcagtcatcctgggacttctgattatgttttttcctgaggtaataagatggaatattttccttacagaatgcgatgctgacacaagaacagtcacctcgttggctcatcgaccatggctacaacgaaaagggcttggcgacccttgcaaaactccatgctcatggtaa

SEQ ID NO: 590 - DNA, 207 bp, A.fumigatus
cgcctgtgtagtggattggtagtgtccttgttcacggctggagcgttctttggcgcaggatttgccggtcccgccggtgactatctgggaagacgatggaccatcgcgatcggttgcctcgtcttctgcctcggaggaggtcttcaaactggtgctcagaacatttcgtacttgtactccggacgattcttcgccgggcttgggtaa

SEQ ID NO: 591 - DNA, 270 bp, A.fumigatus
gatggaatattttccttacagaatgcgatgctgacacaagaacagtcacctcgttggctcatcgaccatggctacaacgaaaagggcttggcgacccttgcaaaactccatgctcatggtaacgaggatgacgcatgggtgcgtgcagagtacaatcagattcaggagagcattgtgtatgagcatgagcacgaggccaagtcctacagtgagttattcactaatcggtcgtccttccgtctccttttgcccaggcccgtgccttacttg

SEQ ID NO: 592 - DNA, 891 bp, A.fumigatus
tcccccagggcggattgcctgtcaacatcaccaggagcgcgggcccgaatttcacccaatttccccccaatagcgctctatcccccaaagtatccgcaaagcgcaggtgtccgtcgctcaagatccggtaatcgcggttattcatttcggcgtacaattttcgcgaagaacatccagacgcaagatgtaacatcaccgggggcttttgaattgagcccaggggttagcccacagccactgccggagacatcgacagtgaatggccagccacaggcaacaggagatgaaaaacactcggacgttgtgcgtccaacggtcacgtcggaatcttcccccaaagatgacggctcaacgacgtattactctggtcctaaggtcggcaggcacctttccatgagtgtttcatatgagagatggttgaagaggaaagctgcttgtactattatcaaggtgcgactagagaacgcggttgaaactgtgcgcaaggccatccttcaaatcaaggacattcctcccaccaaagacggccgtcatattgatctcgatgtcactcgcactgaggacttgattgacgaaaggactggtaagccatacgttggaaactggatccgatccagtcgttatagcttctggagtttctttcccaggcaattgttcgcgcagttcaccaaattggccaacttctatttcttggttgtggctatcctgcagatgatcccgggtttgagtaccacaggtacttttacaacactgatccctcttttgattttcgttggtatctcaatgggcaaagaagggtttgacgattggcgtcgttattgcttggacaaggaggagaataatcgtctcgcatcggttcttcgtcctggtgccagtcttaccgtttcttga

SEQ ID NO: 593 - DNA, 411 bp, A.fumigatus
agagcactagatgctgctttccctcgcgaccctgctatcccagtgaaccatctccgacgatttgccaaacattcccaattgccagaatccttgcgctcagccatcagccacaatgactccgctccgcagacaatctttgtcctaatatcgcctcctctcccggaagctgatgctctccaaaaagtgcttgctccatttgcccctgcctcctcgacctctgccgacgatcaggccgaagccgctcctgccatttccctgcatacaatcaagatccctactcaaccgcccttgaatgctaagcaagccgagaaatggacatcgacttactggcccgttgtctacaacccagctgccccgcgagccacaatagcaccgccgccgcaaatcctaaaccgtgcgctcgagtccatc

SEQ ID NO: 594 - DNA, 495 bp, A.fumigatus
tggaagctacggtttgtgtttgcgctgtttgcaatactgttgagcttccccgctattgtccgggccatctctacagtcccactttatcgttcgaaagtgttccggcagcttgagaagcggttagaatactctgttacttcggataagatgcctgtcccatcatcgtacgacgaagtcaaagctcatctgcagcatgttctggatgatcattcgactcccttggacatttctcttatcgacaagttaaaactagagcttaccgagactacagatcgcagggttcctagcacccttctaactctcatttcacagctccttccggtccttcaggaagatcccacgccgattacaactcttggtatcaaggctacagtctatttctcctttactgatattcgctccgttgagccccccattgactttatcgccgggttcaaagcgccctcgccacctgtcaacctgtattcgccacgggggtcgaagaaaccgcgctgc

SEQ ID NO: 595 - DNA, 195 bp, A.fumigatus
aacactcctctacgatatctgctttcgcacagtggcctagtgtctatgcccgctatcctctttgtctctcagcatatctgcctcatcttcacatatgacacttcatcgggggcatcatgggacgaaatggtcactgcctatggggaaatgcgcatctgctgcaaagatagtactctccctttcttgaaaccatga

SEQ ID NO: 596 - DNA, 189 bp, A.fumigatus
cttcaggcccatggccacgagtacatggccgacctagattacccacaccacctaatgagaacttgcaaggcgtcttcaaacagcgtattgacaaggcaaggagtctatagacttcaatggtatgtgaacatgctgggactcaccgcaatcttcgggtatgtcttcgctgcttttatggccatgcactga

SEQ ID NO: 597 - DNA, 186 bp, A.fumigatus
gaagccaggattctcaaggtgaagaaagaaattgaggagaagttcgagcaggagaaatggcataagatcgccgacagtgttgctgcggatggaggaaacaaatatcctgcaagtgcaatccagaaaaagttcaaagagctgaacaagaggactcaagctgcagcagcaggtgaggctgaggactag

SEQ ID NO: 598 - DNA, 390 bp, A.fumigatus
  unsure (131),(170): Identity of nucleotide sequences at the above locations are unknown.
aagatgcaacaccctaaccttacgcaggaatcacagtcaacttgtgccccagtaaacgggactcctcgcaagcgaggccggaagaaggccgcggacggtgacgcagacgcagatagtacggagaccccagntaagaagggaaagacttcgcccaagaaaggcttgggtcntattccagcctctccagaatcagccgggttggccgacaagatggttctgcggatgagagacgaggaagggcgtagctggtctgagatcaccaatgtctggacgaggatgaccggcatcaaggttgaagggagcacgctgcgaaagcgctacacagccatgaaggcgaacttcatctccatcagtgcagaagatgtaagtgatcgtccggtttcagcttga

SEQ ID NO: 599 - DNA, 231 bp, A.fumigatus
gaagactgcgcacctaatatcaaaagattcttctcaggcaagcgctttccatttgcgacactgtccagcatggacgaccagatgtttttctttgggccatctttacttgacggtcgactattgtttccagacattatgtccaagatcgaccctgctcaacctgtgctgaccattccaaaactaattaaagtctttatcagagctctgacctgcttaacgcgtcgatcttga

SEQ ID NO: 600 - DNA, 237 bp, A.fumigatus
ttcaagatgacggtcaagatcccatggccggcagtttaccttgccattgcagcctccgtctatatgagacctcaatatgcgatccttgactcgctaacggcgacattcgtcgtgctgtctctggctgttacttcgttcaggatcatctatgccttcgtcctgtaccctaaatttttcacacctataaagcacattcccacaccttcggtaagaacctttattgcacggcctgaatag

SEQ ID NO: 601 - DNA, 726 bp, A.fumigatus
  unsure (308): Identity of nucleotide sequences at the above locations are unknown.
actcactgcgcggatccgtcgacccctgtggtgaagacctgccaagcaaaacgtcctcgatacgggcaggtcttgaaaaacatgattcgccttgcatcgcccgcaaagccatttaaattgacgccgaagggcactactcagcgacatgccgtttatgcggactacgcagaggagattgacgcaatgtatgccacgcacgagaagcagctggggcctaagctgccatcgacgatcgactctgagagtgtacattgctatgtgcatgaagtcattacctccctaactgggcgatctgatataaggcctancgatgatcttttcggcttagggctcgactcactgcaggcgactcagctcagcaatattttgcgaagtgcagtcttgtcttacaacccggcgttgagtacggacaacattactgtacagaatatctatactcgacccaccacggacaagctcgctggtctgctcctgggcgtccttcaagaaaaaaaggaacaagcagcgatagccccgacggaatcgcgctctgaaagaattgccggcctagtttccaagtacacagctgatctcccagctcgatacgtcaactccccaactcaattgcctcggctctcgactgttaaaactaacgggatctaccggttcgctgggcacttatatcctttccggcctattaaacgatcctcacgtggcaaaagtatattgtttcaatcgcgccgctga

SEQ ID NO: 602 - DNA, 783 bp, A.fumigatus
  unsure (444): Identity of nucleotide sequences at the above locations are unknown.
tttccaagtacacagctgatctcccagctcgatacgtcaactccccaactcaattgcctcggctctcgactgttaaaactaacgggatctaccggttcgctgggcacttatatcctttccggcctattaaacgatcctcacgtggcaaaagtatattgtttcaatcgcgccgctgatgcagccactcgccaacgtcaggggtttgccgaaaagggactggacgcctcgctcttggaagacccaagcaaggtcgaattcttacacgtgtctttcggagacaaacactttggtctggatgattccatgtacagcaaactgctggataccgttgacctgattgtccacaatgcgtggaaagttaacttcaatcaccctgtgtcgtcgttcgaagaccctcatatcaaaggggtgcgcgaattcgtcaatttcagcctcgaggcccgntacaatacccaccttgcctttgtctcttctgtgagcacaatcgccggatggacgccctcttctgacgagtcagctgtccctgaattgccaatggacactgtggacgccgtgctgaagcaaggatacggtgaatcaaagcatgtaggggagaggatttgtttggaggcgtctcggacatcaggggtgccgacgagcgtcctacgtgtgggacagatcgctgggccggatagtcggttggggctgtggaatccacacgagtggctgccctccgtggtaaagacgtctaagagcatgggaagtcttcaccacaagggtcgaaggacgcccgcagggttacca

SEQ ID NO: 603 - DNA, 438 bp, A.fumigatus
agaccgcacaaagtactccaggttctggcagataatgtgctgcggcggggggacaacgggctccaggtgtatgtgatgtgcgagattcctagcaacgtaattctggccgcagagttcgcggactgttttgacgggttctcaatcggctccaacgacttgacacagcttacccttggggtcgaccgcgactccgccgagctggcggacatcttcagcgaacaagatgaggctgtcaagtggatgattgcacgggtgatcacggtagcacgccagaagggctgcaagattgggatctgtggccaggcaccgagtgaccatccccagttcgctcagttcctatccgatttaggaatcgattcgatttccgttagtccggacagcttcgtgaccgtcaagcggcatctaatcagaagcgagcggggtgtgcccgtttgttga

SEQ ID NO: 604 - DNA, 219 bp, A.fumigatus
aaaatttcaagcgatttctgcagccgtccacatccatccttcaaacgcctttcattcataatgggagacgtcgccgtggagagctcggcgaccaacgtcacacctagcaagtcggcgccattcgataccatccctaatatagactctctcgaaggcacagatgcagatggaggtgatgagtatgcgactctgaagagactccagagacacttagagtaa

SEQ ID NO: 605 - DNA, 363 bp, A.fumigatus
ggactcatctacatacccgagtgtatgagaactaagatcatcacgaagtaccataacaacccaatgcatagatatatgggaaccgaaaaaacagccgaagccatctcaagaaattattatttcctaaacatgaggaggaaggtacaaggatacattcaccagtgtgaaacttacattagagacaaacctgctagacaccaaccttacagcaaaatacaatcaccagaagcaccgaaacaatcatgggaatggatcaccattaactttgttggaccactactagagttaaaagggtataattacctaataacagtcaccaacagactcattcttcaccccggggctggcaggtaccgcgatgct

SEQ ID NO: 606 - DNA, 639 bp, A.fumigatus
gacttgtccgctcaatgccccgggctccatatctcgtttcaagttggaaaactaacccctggtctcttctccgtcggccttttgcagctgaactgtctcacttcggccctgggttccgacggctgctctgagctgacggatttcgcctgccattgccaaaagtcaggccttgtggaacaggtggtgccctgcgtcaaacaagcttgcgatgtcgcggaccaacaaggtacgaatatgaaaaagacacattcgaccctccgtctgatcctctctaatccacgccgtgtagccgtttccaaagtcgtcgtgtctttgtgctctggcgttggccatccggtctcggtgccccccgtggacgcatcggctcccacatcgactgctgcagccagttttccaaccacagcaagcagctccaattccaccacggtcagcggtttgggcggaagctcgcggacttcgtttgcggcctctccaacttcgactttgggttctacgactttggccacggtcaacactgcttcgccttcgccttcgttttcgagccccgccctgtctaacggggcctcggggattcaatccggagttgctcaggtggctggtgctgccatcctgctagccagtgttctgtttctggtctga

SEQ ID NO: 607 - DNA, 249 bp, A.fumigatus
cgacaactgaccggccagggcgcacactgggactgtctcggcgacaagatcgaggtcgcaaccaacccgaacccggacaagtcgcccgtcgcctacgtccacccggacaaatacatcaactacaagttgaaccccgacctcgagacggcccaccgatgcattgacatgctcaccaaggcaggcttcaacgccagcggcaacccgaccttcgactggattcacgatgtctacctgatcctcatccacatg

SEQ ID NO: 608 - DNA, 570 bp, A.fumigatus
tttccccgacgttgtccttccagcccgccggtgaagacgagacagacgcgacgagcgctgtccagcgtgctggccgagtggtcctccggtctgtggacttcgcatgagtttgtgcgtgtctggtggatgccgtatgagaagagtgcggttgtgtggcatgcggacaagactgatctgccactgcggaaaccccccaagacgttctatggggagtggattggttatcatatctaccataacctgttagcgctctccaactatttcccccgtatccttccctgggtcgaatgtttcgtctttggcttgcaatatgggttcaaggcggagaagactgtgacggaagccgtagagcctgcccgtgaggggcttctgatgaactgtctgtactcacagtttgtcaacgaatgggcactccctctcgcgaagggccctgaagcgatcacacgcctgtcggcctggcttcatggtgacatggagaccgctcgtatcccgttctcggccaatgggctgtgggtacattgccccattgaagtcagagtcgcagattccacctatttgggaaaacctcgc

SEQ ID NO: 609 - DNA, 318 bp, A.fumigatus
aaagttggattgggttttgttggtgcaccgatctcggtcgccattaccgattggctaatgccattcttcctgtttctctacgtgtacttcgttgcgggctcagaatgctggaatggcttgacaaatcgtgcatttcgaaactggggtccgatgatccagcttgcacttcccggattggtcatggtggaggccgaatgccttgcctttgaagtcttaactctggcatcgtcatggcttggcacaactcccctcgctgcgcagtcgatcttgtctacgatcgcaagcattacgttccaaattccgttcccagtgtctatc

SEQ ID NO: 610 - DNA, 201 bp, A.fumigatus
ggtgaagaacggaggaaagatgttgccaagttggcaggtttatatctgaaggtggttgctctaggcgcaccagggtatgcttgctttgagagcgggaaacggtacatgcaggcacagggattgttctcggcatccctcttcgttctgttgatttgcgccccgtttaacgcattcatgaattggttcctcgtctgggtatga

SEQ ID NO: 611 - DNA, 315 bp, A.fumigatus
aacccatcatcttccagcccgggcgttatgaaaacattgtcaagcgcagcacgatcgacatggttcccaaggccatcatgtacaccctcgttcagtaagtggcatcgacagcttcgactaatgtttgtgctaacttttggtcccaggttcaccaaggatgagatgcaacgtgaactgctcgagcagatgtaccgtaataacgagctggacgaattgctcaaggagagcgattacaccattcgccgacggaaggagtgccagcagatggtggagagcctgagccgcgcaagcgagatcgtcagccaagtccagtga

SEQ ID NO: 612 - DNA, 486 bp, A.fumigatus
tgcggatgttgcagccccgtggtgaaaattcgctcattctcactcatgccttctatcgcctcgacggcgattgcccctcatttttcgtcttcgctacgtcgtcgcttggattgccctcagttcctgctgtcacgctgttggcctcgtcacacccttccccggtctactgtcgctcctttctcaactgcggccgtcaccatgggctccatccaacgcattacggagcatttggaaaagccagagctcgatgaccgctcctatcgagttattcggttgtcaaacaaactggaagcgctcttagttcatgatcctgaaacggacaaggctagcgcatccgtcaatgtcaatgtgggaaacttttcagatgcagatgatatgccaggaatggctcatgctgtagagcatttactcttcatggggacaaaaaaggtaggttgcacatacacgtgtcgaacatcagggtttcttttgaggaagttcaagtga

SEQ ID NO: 613 - DNA, 285 bp, A.fumigatus
  unsure (213): Identity of nucleotide sequences at the above locations are unknown.
ttcccgaaagaaaacgcgtacaatcaatatctcgcctcacattctggctcgtcgaatgcatacacagcagccacggagacgaattatttttttgaagtgtctgctacggacgactcgggggatggacagcccaatggccaatccttgactaacggcacgaccaacggaaaaaccaatggaacaaccaacggcgactatgcgttcgcaaagtcngacacttcggaaaccctcgtccctctgtatggagctctcgatcgcttcgcacaattctttgtgtcccccctt

SEQ ID NO: 614 - DNA, 894 bp, A.fumigatus
  unsure (763): Identity of nucleotide sequences at the above locations are unknown.
ctctcgacaactgacctccgattgtattatgctaggaatgatgagcgcaacgaggacggcaaggacaagcaggaggagtcgccaggtgatggcacggatagcaaggatgctttcgggtatcgcaagaaccggatggccgtcgatgggatgccagtgaccaccctcaccgagcaacaggaagctcagcaagcgtcccacaacactgcttacgcacaatttatgaagcccaagttcgctcgggcaccgataaaggaagcaggcagagtcgcctatctcggagagtcatcaaatctgtcgctcctggttcaggatcgtcatggaacaacggatgtggtgcactaccctcttccgccgaacatcagaggatcgcgtgctcggttgacggacctcgacaacctcgaactcgacattctccatcagcgtggcgctttcttactccctcccaaacccctctgtgacgagcttgtcgaagcttatttcagatgggtcgcacctatcgtccccatcgtcaatcgcagccgttttatgcgacaatatcgcgatccgaagaacccgccttctttgcttctactgcaggccatccttctcgctggctctagagtttgcacgaatccccaacttatggatgcgaacggctccaccactctcgctgcaatgacattctatgaacgggcgaaagcactttatgatgctaattatgaagatgaccgcgtcacgattgtccaggcccttgttctcctaggctggtactgggaaagtcccnaaggtttgttcatctgctttgtccgaaaatcggcctgttctaactcctacagacctgacgaagaacgtcttctattggaccagagtggccatggtcgtccccacagggctcccgcatgcacccaaaggtag

SEQ ID NO: 615 - DNA, 915 bp, A.fumigatus
attctcgttctactgtggtcactcgctcttttggccgtcgcgtggcccatcgccatcgccattgtctccatgttcattggcaacgccagtgctgctggccaggcgtctgaaccgttatgctggagagttggatttaaatgggataaagacgctcttgcatgctctcggaactatgtgacgctgtctatatcgccatatgcgaatgaccacaatcctggttccgcagccttctcgtacggtgccgaggctgtactttgtgttctcttcgtctgtcttatccaggctaatcagaccatctcattgcactgtttagagctgctcgtcaacctgtccagagatgaaggcatatggcgacaagcgtatagtgaaacaggggaggccccagggacacagttgaccgtgaatccgttccgtgcagctgtatcgagttgggagaacgctgttctattcattgccaaaacagtgctgcattggataattggtcagagcctgatcccttccgttgccatggaagaatccaaagacaccgacttcgccaaagacatcgaatcatgggcctccatccctgtccaagacctgtccgctcatgtccagaagctgccgttcaaacgcggattccagtttgatatggtatactcgcggttgattatatacgccatactagccgtcctcgtggctacgttcgcaacatacctggctctaaggcgacggaaaggctgtcagcctgccgcgctgggacatctgccgactctcgtagatctcatcgatgattggaagacagaccaggaaggccggatgtggtggggggataaggctcccgaactaaaggccggtcaggtgcggcacgccggaacatgctgggataagatgcttcttggcccgatatgtactactgctagatatgccggtggttaa

SEQ ID NO: 616 - DNA, 747 bp, A.fumigatus
aattcacacagcagactggcagacaaactgaccaactctcgcagaatcggcgtcacaacccgcgatcgaccggccgcagccccccaaaccgggcccttcgatctcggctttcgcgccattggcaatcccaccttcgcagtaggcatcaccgcctccgcaacaatcttctgctctagcgccgcaacctccgccttcctccccgtcatctccgaaatgcgcaaaccaagagactaccccaaagccgtgtacctgagcatgagcttcgtgacgacctcctacctcgccttcagcctggtcatctacgcctggtgcggcaagtggattgcctcgccctcgctcggcagcgcgggcgagactgtcaagcgcgtcgcgtacggcatcgccctccccggcctcatcgtcagcggcgcgctgtacgtgcacgttggcgcaaagtacctctttgtgcggatcctgcgccactcgaagcatctccaggcgaacaccctcgtccactggggcacctggctgggttgcactataaccctgtccgccatctcattcctcctggccagcgccattcccatcttcacgtatgtccttgcgttggtggggagtctctgctattcgccgctggcgatctgcttgcctgggtggctgtggctttatagtcaccagcactaccggcggggaagcgtgggccggctcgtcatctacggtctgcatgtgggtatgattctcctggggatctttatgactctcggaggc

SEQ ID NO: 617 - DNA, 198 bp, A.fumigatus
attatctgttttaggagagcaacttctatttatcagatcacagcctatcagagtgtatttcaaagaaagtatcactccgcatggggctctgttgatacagcttccagagttgggccatctggtcccaatcctgcggtctttatcctccaccacttgattcacactaacagcaaaatcatggccgatacctggtgctga

SEQ ID NO: 618 - DNA, 327 bp, A.fumigatus
ggaaccaccacctctggcattccacctggagatttcactaataatgaatctggagctacacagcctagtatgcctcccaggatctcttatagcataactgttagggctacggcttctagtatttctccagacatccctgccagcaacgactccgaagctgcacaggctggtgttcttcccaatgtccctggtgccgtgactgttggagctacagcttctgatgttcctccagtaatgactccgagagctgcagtctggtgtacctcccagtgtttcaggtggcatggctattggagcacttgctgttggtcccataaacctttttga

SEQ ID NO: 619 - DNA, 720 bp, A.fumigatus
  unsure (644): Identity of nucleotide sequences at the above locations are unknown.
tccccttgcaatgggcggtgtcctggcccttgtggtgaagatttttcaggcgcgcagaattctaagacagatggacatgctggaaaccatcaagaggatgaggtgggaaacaaggctgtcaaaaaaccccaagcttcggatctcaagacagaatgcaagaatcttgaattaccgctagattactctgcttctcgtcaccatgcaggcattgagcagatcttgcaggctctggaggatttccatcctcaacttgacactccttgcaagctttggacctttttcgccctggcaaagctgtatgatatcgccacgacaccgaagatatgcgacctcattctttcctggttctacgagtccaccaacgtccgatttattgagatccacccagagatcagctatcggatctcttgtggaatccagtgcgcctccctttgccgtgacaccttctctatccttgtaggggaggaggccctacttctgctggctaatcgggatgagccggcgcgcctggggaggcctcaagagacatggcatggacgcctccgtgagtcgctagatgacacagagctccagcgtattgagtacgcaagtaagagctttctggactatgttatagatcgttttgttcacttgatgggggctancatggcatggctccatgatttatccgagtatcagaaagtttatcatttccaaccgagatcctcaccaggaagatga

SEQ ID NO: 620 - DNA, 183 bp, A.fumigatus
aggaaaggcatcatcaggctgttaatgtctgcaaagactgatagctattacatagcacgcaccaaaaatcctatgattagcagcaaatatggcctcagaaacccatgtcgtcaaagaactgcggttgtttcctttgacctactaaacattaataccgaatctgcctcgaaaggggtggtataa

SEQ ID NO: 621 - DNA, 312 bp, A.fumigatus
aatcatcgtcttcatacgttaattgctatttttgagcacactctacaggaatcacagttttcaaatctagcatttaaatcctttcaaatcatcaccatggaccccaacatgaacaatctcctcaaatggagtatcgagaactcgacctcagctcggcaggctggcaattccaatggcactggtcccgcccctgcctctcgcagcaatttgaaccctgagatgctctccgctctattcggaggcccttcggatgccgacctcatgaaagctgccatggaagcggtgcactcggacgtcttcaccgacggccgg

SEQ ID NO: 622 - DNA, 246 bp, A.fumigatus
  unsure (136),(185): Identity of nucleotide sequences at the above locations are unknown.
agagtgcaactgccactccccgtcctagtgccactcccgcagttgaaaaaagagcacaattaccagctgctactgatgatggacaggaaggattacctcaacctcgggctgaagagcatatacgggacgcctcttnagaagatgaacgagcccctgtgtctaccgcagaaaattagggggcgacnggaagtctccaaaaccgttgggtacccgaattaccttctgagctttaactctcctggctga

SEQ ID NO: 623 - DNA, 234 bp, A.fumigatus
tgcaatagtgacccttggtggatcttcaccacctgctccctcttctacaccatcaaacgcgaatacaactttggcatcgtcgagctggtcagcgtctccccgcggtttgggatcatgctggcgtccatgtgcctgtcgattgccttcatgatcgtcgatacctgcagcgtcctcaacgtgtttagccactcgtccctgccgacggggatcgaaccattctggaaggtatgttag

SEQ ID NO: 624 - DNA, 237 bp, A.fumigatus
ctagcgctgtccttccagccccgtggtgaagacaagaaccgcccgttcatgtcacgaaaggtgtcgctgttctatatcgggaccgtgatcctggcgcaaccctactgggtgctggagatttatgccaactttgcctatttcaacaactacaacaagatctttctgaccacgcggccgctcgagcctattttccggttcgtctcccgccattgggccctccaggcggacatcggatga

SEQ ID NO: 625 - DNA, 195 bp, A.fumigatus
agaaggaggtatataagtaggataattataatttatagtaggtatacttcttctatagtagttagggcagtctattcctcttatatatcttatggcttctacttagttagctacttactatatctagtaataataatctataaaggtctcttcctttttaatactagtaagtactccctctactttatagcttag

SEQ ID NO: 626 - DNA, 213 bp, A.fumigatus
gctcacacatttaataattataactcatttataattcccttaaataactatatagggtctctcactgtaatctactacagtaataaccttagatgttatatagagtcctattataaagccagtttcattaaagttctagatattatctttatagatgctatgttcctgaatagctctatgtacagttttaaactactattttataacctttag

SEQ ID NO: 627 - DNA, 801 bp, A.fumigatus
  unsure (793): Identity of nucleotide sequences at the above locations are unknown.
atcacaaatggtctaatgagatgtttattaggggatttctcatttgctcgctctctagcagtgcagcaccgatgcagggatatcctggccacatgctacgactctgaagagatgctgtacagcaagtatccacaagctaagcagcatgtccaggatcttcttggctcgttctctaataagagaaagcagtgtgatcctgatggatctgagacggagaaggaaagcaaccaggaaataaagaaaggcggagagcagtctaataagaaacaagactgcaagcgtcggggtccgaacgtactcttcgcagttgatgcgcgaaaactcggatctccctctggaggtgggaaggatgtccgcacaggctttgcacgacgcgagcgcaaacgccctgcttggcaggacaataggcagaagatcgagctagcaaccaacacaggtggtccttgggatatcatatgtttcaacttcccacacgtcggtggcttatcaacggacgtgaatcgacaggttcgttcaaaccaggaattacttgtcgcctttttcaagtcatgcgtgccactgttgtcggcccgtccgcaagtttggaacggcgatgatgaagacgaagaggatgaccactggagctcaagtgaagacagtatatcagactcgagcgagcaggatgatcaagatatccccacccatggacgacgaggcagatacaggaccgagccaggacaaattttagtgaccatgtttgaaggcgagccttataccctatggaatatggtctcacacaagccgaaggaaggancatgctcc

SEQ ID NO: 628 - DNA, 861 bp, A.fumigatus
gacatgtgcctgggtggtggaatcgccggcctcacggccagcatcgctctggcgaaagagctcacaaaggttgagccggacctggacatggccatctacgaaagtcgagatgaacattcgatgggggaaggaggagctatcagtctcactccggtcgctcagcaccatctggatcagctaggcgtcctgcctgaactctctcggatgggagacggcgcgggaattgaggtagatgaaatcaacctttactctctccgctccgggcgatcgttgggtcccttgcgatttgccgacgagaccggccgcggttacggaggctataagagccgccgagtgcggcggagtgccctgtttcgcgccatgctggccgtggctcgccggtacgcacagatctcggtagagtttgacaagaagttgtccagcaccaccatggacggaaacacagtgaccctcgcattcgacgatggaacaacgaccacgggcgatctactgctgggatgcgatggcgtccactcggccgtccgcacgcagctggtggatcccgggaatcattccgaatataccggcatcgcctttattcagagtctggctccggccgagcgagtatcgctaccatctcatttgaaccaatcggccattcaccttacaaagcaaggatcgctgctggccagctactgtgaccccagtcatcagaccctgtttgtcgccgcgatcatgcgtgtgaatgaacacattatcgagcggtaccgcgcgctggcctccacaggcaccaataccgcggcactcacgtccgcacagatggcccttcgctacccggtgcgttcttcactcacgggagctgacgagacccgcgcttatgta

SEQ ID NO: 629 - DNA, 195 bp, A.fumigatus
atcataattaagaaagcgctcatccaaccgactaccttcagtccactagttcactctttgactaccaactctatcactactgtgaacccatccgtccaaagcatcatcaatcaacatttatctaataagaaagcaagttcgcaatatcatgtcacccctatcaacactacggccccgagcaaggccaacgactga

SEQ ID NO: 630 - DNA, 675 bp, A.fumigatus
cagcgcgggttcttcgagccccgtggtgaagaccaattattttcctacatcaagatggcgatttgggactcaatcagcggccgcaagcaggcccaaggatccgaggctttcgacccttcgaccgcgcaagatgccacatccttcctctccgaagctctcattcccgatcctactcagcttcatcctcttgctggcttgaaccaagatactcttgactacctgaccctcgaagactccgcgcttgacgaaattccggggtcgcgatcggtattgccatcccgcggatggtcggacgacctatgttacggaactggaactacctaccttactgcgctgacgataggaggtgcttggggtcttgctgaaggtctaaagcgtacaccagttacagcgcctcccaagattcggctgaacggcgttctcaactcgattaccaggagaggaccgttcctcgggaactccgcaggtgtggtggccatggtatacaacggatttaactcaggactgggctacgcacggggaaagcacgacgcagccaacagcattgttgcaggtgctttgagcggaatgctcttcaagagtactaagggtctcaagcccatgatgatctctgggggtaatggggctagtatcgctggtactgggctgtacgtacattctcatttcttcttctag

SEQ ID NO: 631 - DNA, 366 bp, A.fumigatus
gggtttacggcagttcatatcgctgcgatcaccgcgacatgctggatcctcttcttgaacgctcttgtcgggtttcagttccttgacgacggtacacctgtttcggtcggtctctgtgttgcttctgccctggtgttcttcatcggtaccggttatatcgccctagatactgctttcgactggaccggagagtttgcgatgaccccatctgatcactatcgaaatatcgcactctacgtactgtatcagctcttccccttcgtcctcctcgtggcattcttcgttctggaatctgtcttggtgatccgggtcctgggcgagttccgaccaatgtgtatgctcaacccacaaggtcttttgagctaa

SEQ ID NO: 632 - DNA, 234 bp, A.fumigatus
ctgacgggatatgcagtgtatctgtctgccgcgggtctgttgttcgccattggccaaatcttcaactacgtgatcagcacccatctctgccaggcgtcgcatggaaaaatcaacggcgccttattcgagacattgttcaccctcttgtcggtcgttatggtctggatcttctggagcagtataacggaagatgactggccgatgccgatggctgtaggcaccggctacaactaa

SEQ ID NO: 633 - DNA, 186 bp, A.fumigatus
aacggaacggcggccgttgtccctgggcgagcacactgcgatccgttatccgatggatgtacgccacgttgcgattctgaacaaccaccacctggaggacattatacaggtcctgcgcatgcacttccaacacaatctcgttgcttggcgctgttctcggctgctccgccgcgttccggaacgtga

SEQ ID NO: 634 - DNA, 453 bp, A.fumigatus
atccaccccctgtgcaactcgaaccgtccacttgggtctgaaacggaacggcggccgttgtccctgggcgagcacactgcgatccgttatccgatggatgtacgccacgttgcgattctgaacaaccaccacctggaggacattatacaggtcctgcgcatgcacttccaacacaatctcgttgcttggcgctgttctcggctgctccgccgcgttccggaacgtgacaaccgccctgggcgcgttcatcgcaacccgcagcttggcttcgaggatacactggtccccgccggggagacggaggcaaagcgacgaggagtcgtaccattggcaccggagctcgaagagggggagccccgagcggtcgtggaacatgcgtgcctggctgaccttccagggctggccgaggacggtgaagagttcggttccggcatattcgatcgagtagtctag

SEQ ID NO: 635 - DNA, 273 bp, A.fumigatus
tgtcctccaggtggtggttgttcagaatcgcaacgtggcgtacatccatcggataacggatcgcagtgtgctcgcccagggacaacggccgccgttccgtttcagacccaagtggacggttcgagttgcacagggggtggatctatcactggtcagttgatcttcgggttagcttggacttcactttggctgacggccgtagatagctgttgttgtggtcattgttggccaacgagccgggttggatgtagaggacggctgatcggcatatga

SEQ ID NO: 636 - DNA, 594 bp, A.fumigatus
ttaaatgaggcccttgaactgcgcggtgaatacccaccatttccgatcgcaatcagacccgagagcatcacccgccatgaagtgatagtgaccgtgaccaaccgcccggaaccatggcactccctagactactcgatcgaatatgccggaaccgaactcttcaccgtcctcggccagccctggaaggtcagccaggcacgcatgttccacgaccgctcggggctccccctcttcgagctccggtgccaatggtacgactcctcgtcgctttgcctccgtctccccggcggggaccagtgtatcctcgaagccaagctgcgggttgcgatgaacgcgcccagggcggttgtcacgttccggaacgcggcggagcagccgagaacagcgccaagcaacgagattgtgttggaagtgcatgcgcaggacctgtataatgtcctccaggtggtggttgttcagaatcgcaacgtggcgtacatccatcggataacggatcgcagtgtgctcgcccagggacaacggccgccgttccgtttcagacccaagtggacggttcgagttgcacagggggtggatctatcactggtcagttga

SEQ ID NO: 637 - DNA, 279 bp, A.fumigatus
cagaggagcctctcaagtgagcgttacccacaaatgggagttgccgagtcccagtaccgtttcggaatgcagtgctttcagcagtttctaacaaagttcgtccaaggcgcagcccgtgagattgagtcgaccgtgaccatcaccatcaaaatctctggtgagatgttttatgtcattggatatgtttcactgaggtataaccttcttgtcatccgggttgcaaacgcacacatgacacagcacaacaggttgcttagcattatttcatctggaaattga

SEQ ID NO: 638 - DNA, 513 bp, A.fumigatus
cctgacgcagggggcgcggggaaaacacagacagctttgcactatgccgtccaaaatctgtcaaaatacccgtcagggattgcctttataaacgcaacatcagtgatctcactttcggcagactttgaccgcttacatgaccttcttaggcttggagattctaaggacaagattggcgctgttaaaggctggctctcccggcctgaaaacaacaagtggcttctggtgttcgataatgcagacgacctggacaacgttccacttcataagttttacccggccgtgaactggggccacattatcatcaccagtcgtgaccaggcggtgattggcagcatagccgagaacggccacgttctgagtcccctgacggaaaatgatgcggtgcaactactactcgaaaagtcagggatccagaaccctaccgaaggggatattgaagatgcaaggaccgtcacaggccttcttgggtctcttcctctcgccttagttacagccggggcattcgttcgc

SEQ ID NO: 639 - DNA, 537 bp, A.fumigatus
agaccagcaatgttgaaggctgtggaggcaaagttcaaggaagccgctctcaaggcgaaagatgcggaaattctgctcgagcatgaggcgggattcctggagccagaaggggagctggaacggacatacaaggtgcgacaggatgagatccgcgacaatgttgctatcgagacggcgaagaagggattcgagttgaagttggaagatctcggtccataccgggcagactacacaaggaatggtcgggagctgcttctggctggtcggaaagggcacgttgcgacgatggactggcggaaaggcaaattgggctgtgagctgcaattgggagaaacagttcgcgatgctcggtggttgcataacaatcagtactttgcagttgcacagaggaagcacgtctacatctacgaccacgccggtgttgagctccactgtctcaacaagtatatcgaaccgctctttctcgactttctcccataccattttcttctcgttggcgctgtaagattgacccttttttttggatctgatacctaa

SEQ ID NO: 640 - DNA, 525 bp, A.fumigatus
  unsure (42),(43): Identity of nucleotide sequences at the above locations are unknown.
cccttcaacacccccaagattggtaagccttcatcatctttnntggaccaaatccccggcgacatttaccgcggcgaatcatcccgcatcttctttgaattcttgaatccattcgcgagaactatcgccttcaaagccgcggacgcggggttcccaagtgggaccagtcccttccgctaccgccagggtcagcgcatatggttttacatgccgttcatccatgccgaggatctcgacatgcaggagcttgcgcggatcaagtatgcggagatggcggaggatttcacccggctgctggacggggatgcaacggggttatcggatgacgaggcgcagtgccggcagattcttctggagaatcgggcgaggctcgaggagcaactgacgacgcatttccgggtacagagggagcattatgagcccattgcgcggttcgggcggtttccgcatcggaatgtggcgttggggagggagacgagtgacgaggagaggaggtttctggaggagggaaagatatttgggtag

SEQ ID NO: 641 - DNA, 279 bp, A.fumigatus
gcgtgcgacagcttccccaaggatgaccccaagaagcccgtccacctgacggcctccatgggttacaaggccggtatgaccaccgtcgtccgtgatcttgacagacccggtgccaagatgcacaagaaggagattgttgaggctgttaccatcatcgagactcctcctgtatgttcattgacccaaggatttggttggttacgaaaaaggggcggtcacttacacttattatctatagcttgttgctgtcggtgctgtcggttacatcgtcttcaccgc

SEQ ID NO: 642 - DNA, 783 bp, A.fumigatus
cccaaaggccagaatgctataacgcgccaggaactcgatgcgaagccgttgctgcagctgctggccacgagcatccggcggccgctcacgatgctggtcaccgagtacgtggtcttcttctcgacgctgtggtcggcctttaccgtcggcacgctgtacctcttcacccagtccgtcgagcaggtgtttgtgggtctgtacgactggggtcctgtcacagccggatacgtccaggccgccattgtgattggcgaagtcgccgggtggttctgctccatcccctcggcccagctgtacttcgcatcggccagtcgcaacaccgagatgcctggtctccccatccccgaagcccggctgtacctgtccgtggccggcagcgtggttgggatcgccgggggcatgttcgtgtacgcgtggacctcgtacccgacgctcccgtgggttgcccccgcggtgggcctgttcatggtcggcgccggcagcgtcgtggtggtctctggactcgcggactacatcgtcgatgcgtacagccagtacgccggcagtgtcatggcctgtttcgtgctgggggagaataccttttcggcgtttctgccgttggcggccatgcgcatgtataatacgctggggttccagtgggccagtacgctgctggcgttgatcagtctgtctctggtggtggccccagtcgcgtttatcgtttgggggcggaaagtgcgcgagaagagtccgtatatgagagaggtgatcaaggagaagaggatgcaggctggcttgcagtag

SEQ ID NO: 643 - DNA, 825 bp, A.fumigatus
gagcgcgtgtccttccagcccccgtgggtgaagaccgacagactactgcaagccagcctgcatcctcttctccttgatcacctctctcatatacggactcttctcgcgcactttccgcccccaaacgataaacgcgactggggccaccaccagagacagactgatcaacgccagcagcgtactggcccactggaaccccagcgtattatacatgcgcatggccgccaacggcagaaacgccgaaaaggtattctcccccagcacgaaacaggccatgacactgccggcgtactggctgtacgcatcgacgatgtagtccgcgagtccagagaccaccacgacgctgccggcgccgaccatgaacaggcccaccgcgggggcaacccacgggagcgtcgggtacgaggtccacgcgtacacgaacatgcccccggcgatcccaaccacgctgccggccacggacaggtacagccgggcttcggggatggggagaccaggcatctcggtgttgcgactggccgatgcgaagtacagctgggccgaggggatggagcagaaccacccggcgacttcgccaatcacaatggcggcctggacgtatccggctgtgacaggaccccagtcgtacagacccacaaacacctgctcgacggactgggtgaagaggtacagcgtgccgacggtaaaggccgaccacagcgtcgagaagaagaccacgtactcggtgaccagcatcgtgagcggccgccggatgctcgtggccagcagctgcagcaacggcttcgcatcgagttcctggcgcgttatagcattctggcctttggg

SEQ ID NO: 644 - DNA, 219 bp, A.fumigatus
cgcatgaagatccctgcaggtattgtaatcccagtaccgagcgccattgttgtcatttattctgtacctcataacaatactcttgccccccctgtagcacgatcaataccccataatactaatttcggatcttatttacgagggacttggttgtttacggttgcttattacaacaatattgctgacaggatgctgtttctgacgtgcgtatttgcttga

SEQ ID NO: 645 - DNA, 642 bp, A.fumigatus
  unsure (605): Identity of nucleotide sequences at the above locations are unknown.
attttacaaatacattgttcccatcgcagcctccaccatttacagtctcttgagcacatcgtccagaacctcctgcgtagtggccttgccacccatgtcaggagaaaggaacttgccctcgtcgagattggcgtcaacggcaccataaatcttggcagcggcctgctcctcacccagaaactcgagcatcagagcgacgctgcgcagagtagcgatggggttggcgatgcccttgccctcgatgtcgggggcactgccgtggcagggctcgccaatagcgaaaccatcaccgacgttggcgctgggcacgagacccaagctgccaaccagagcagcagcaccgtcggacagaatgtcgccgtacaggttaggggcaacaatcacatcgtagtactcgggctgacggaagagcttgtagaccatggagtcgacaatctgctcctccacctcaacagaggaaaagcgctccgcggcgagagccttgcgggcggtttcccggaagagaccgtctgtctgcgacaggacgttcgacttgtgggtgatggtcaccatgggcttggcgcggagagcagagctgccagcggcatcacggatcgtccgacgtnttcaccatcggaacctagaaggatccgagctagagtg

SEQ ID NO: 646 - DNA, 567 bp, A.fumigatus
  unsure (2): Identity of nucleotide sequences at the above locations are unknown.
anacgtcggacgatccgtgatgccgctggcagctctgctctccgcgccaagcccatggtgaccatcacccacaagtcgaacgtcctgtcgcagacagacggtctcttccgggaaaccgcccgcaaggctctcgccgcggagcgcttttcctctgttgaggtggaggagcagattgtcgactccatggtctacaagctcttccgtcagcccgagtactacgatgtgattgttgcccctaacctgtacggcgacattctgtccgacggtgctgctgctctggttggcagcttgggtctcgtgcccagcgccaacgtcggtgatggtttcgctattggcgagccctgccacggcagtgcccccgacatcgagggcaagggcatcgccaaccccatcgctactctgcgcagcgtcgctctgatgctcgagtttctgggtgaggagcaggccgctgccaagatttatggtgccgttgacgccaatctcgacgagggcaagttcctttctcctgacatgggtggcaaggccactacgcaggaggttctggacgatgtgctcaagagactgtaa

SEQ ID NO: 647 - DNA, 618 bp, A.fumigatus
agaagacgttctatttcccgtcatcgctatgatcctgatttcagcagcacgacctatctgagtcctgtcgtgcatgaagatgtccgtattcatcgctccgcttcaacgggcgctcggcgccgccgtgaattgcagccgcccccccctcctcctgcagtcattgttgatattaacaatgtttcccgcaacaaaagcacaaacaggagtgccaacaagaaccgcaagcatcgccaggaggatacaaccatagtcgacatcgagtcggaggatgaaactgttctccgaaagcaccgtcgaccccgtgccagcaccagcgtgtctcgcgaggcttctcctcgccatgaggcgtctcctcgtcaccaacgtgattttgaattggtgattgatcaacggatgctcgagaagaacgatgtacgccaagacctcgagctcatgaagcagcagatggagatcgaacgtcttgagcgggagcttgctcgccggcgcggtgaacatgagaacaaccagactcaacttattagagaagaagagacctggtacgaagatgagatcagtgatcgtctaagacgacttggtcttccccacggggctggaaggatcgacgggggtcaatcataa

SEQ ID NO: 648 - DNA, 186 bp, A.fumigatus
atacatggaagaaggtcagtcgagagtgtcaacgttatcgtctattctgactcactggagtatcttaacagcctctgcatcattcatgcggcacttctacgctcttcagcgagccattcaacgcaggccgagtcgctcgactattgtacaatcttccgcggatctatgcgaagtagctgtgcatga

SEQ ID NO: 649 - DNA, 294 bp, A.fumigatus
gcccacttcagcggtcagccacatcagcccctgggctgctgtaccttggcctatgcgtacgatttgtggcgcaacgaaacactgctgtcttacctctcgttcgtaccttacgcaatagatacattatcttacgaggagagatacagtcctgacgctcttattccttgtcgaattatcaatcaatcgtctaacccaatcgaaaaggacgctattgattcttggagaggtaggaagacattgaaatcaatacgccggatgctcttcaccacgagcgccaggagcgccaataggtca

SEQ ID NO: 650 - DNA, 189 bp, A.fumigatus
actatcagttacgtattttatatctgctactttgcaattgcaattcgtatcaccatggacggattcctcggtaaaatgatcgaaaagttcgctgaaaaggctactggtggcagcagcaacagcggcggcgacggctactcctctttacaacagaagcaaccccaactacggtggacaggggcaatggtt

SEQ ID NO: 651 - DNA, 207 bp, A.fumigatus
ctcattattttcctacttattcctcttatttttacttcccgacttgccctcgctcgcaacggcgctctcaattttacaaattcccccggatttttaaccttcttcatcttctcccgggcctcacttgttgaaccttccgttacgctttccatcgtcccccttcccctcccccctttgactcgctctcccatcttccacaactactga

SEQ ID NO: 652 - DNA, 324 bp, A.fumigatus
cttgccagacttcctatctccaagatcctcaacaaaatccccacggcacacgagaacctcgcatccacgcacgacgcctggctcaccaccgcccgcgccatctgtacaacagacacctttcccaagctgctctcgcgaaccttcgccctcccctcgtcccccggccgcacctacagcctcgccggcatgaccaaaggcgccggcatgatccacccgaacatggccaccctcctcggcatcctctgcaccgacgcccccatcgacccctcggccctgcagtccctcctcagtcttcaccacgggagctgccgcatccgcgcttag

SEQ ID NO: 653 - DNA, 690 bp, A.fumigatus
acactggacatggccatgcccgcctccaagcagaaatacatcccgtcctctggatcctatccaaagggattcctcgtctccggtacccatgttggtgtcaaggcctccaacaccaagttcccggacctggcattgatctcctccgaaaccccatgctctgctgctgctgttttcaccaccaacaagttccaagcggcacctgttcaagtcagcaagaagacccttgagagccgccagggacaaggcatccgatcggtggtcatcaactctggctgcgccaatgcagtcaccggtaagggaggtctggaggatgcactgaacatgggcaagaaggtggacgagtgcaacggactcagcgagcccagcacaatcgtcatgagcactggcgttattggacaacggtacattcctcttcctcttccacagcccccccccccccccccggcgcccgcacacacacacacacacacacaaagctatgaaagcctgactagtcatgacttgccagacttcctatctccaagatcctcaacaaaatccccacggcacacgagaacctcgcatccacgcacgacgcctggctcaccaccgcccgcgccatctgtacaacagacacctttcccaagctgctctcgcgaaccttcgccctcccctcgtcccccggccgcacctacagcctcgccggcatga

SEQ ID NO: 654 - DNA, 219 bp, A.fumigatus
cgacatgaaactcggcaccaaaggagctcgagcaagttaaaaggcatgcctgaacaggcaggcaagtatcttgcttcctggtcgtccgaatgtattcctagctctttcgtcattgcccttggcccctccatcacagtgcagggtctctcagcaatcgacaaccggagtacgcaccgcgaatcagacatctggtacttgagagtatttgtaaagaactag

SEQ ID NO: 655 - DNA, 408 bp, A.fumigatus
tgtgtccagggctctgttacactgcttggagatgcgtgtcatccgactctgccgtatcaagcgcagggggccgccatggcggtggaagatggcgcagtgctgggactgctactccaccacgtagcatcctcaccggactacagatcaaaaatcccacaggcactaaagctctacgaagatcttcgcaagccacggaccgcccggaacgtccaaggcgccatccgcaaccgacgcgggtttcaccttgaagacggcctcttacaacgactgcgtgacctggttctgagctggtcgggcctgactcgggagacagactggattggactgatgtcttcgcgacaacgagctgttcttggatttgatgtactgcaggaggtagagcaaaggatgccagagctatccacctga

SEQ ID NO: 656 - DNA, 219 bp, A.fumigatus
atatgcagaaacggccagaccatcatgcgattgccagacgtaaactcccacccagaaacatccagctccggctgccgaaggagcgccctcaactcctccggggtcctacaccgcaacgtcgacaccaacccatcgaacgaacagaccaccgagaacagcggcaccacatatgtgaagaacagatgcaagggcgaatgccagtactgctgcagcgtatga

SEQ ID NO: 657 - DNA, 1125 bp, A.fumigatus
ggtagtccttccggccgctggttaagactctcgacggatgtcgaggtcgaatcgcgtacgagtgaggcccccgcatctcttttgtggagcctttctggatcagtagaagccgccaaagagggcgagtcggggctcaggcgagtctctttgggcaaaccatcctcaatcgctcgttattttgccctagtacgggtatggattccatggcttgggcctagacatgggaagaagaatttcagcttgacagaggatgccgtattatgttccttcctgcggactgacggttctcatttggttcttctggcggtctcggggattagcgatgtcctgactgtgcttgcttcgaacgaaaaaggggaagtcgtgattaaagccaagtctgatcacactgaagcaagcaagttccaagttcttgcttccgccgctgatgatttcgaggtagcaatgagcgctgttatatacgaagctcggaaaatggtcaggccgtacgctacggagggattgtctgatcgatcaccgactccagtctcgcccatggacaacgatattgtggtggtcgaaaaggaccctcaggcgcaatggatgtcagagtggtatgatgggttgggttactgtacttggaacgggctgggacagaacctgaccgaagaaaacatccttttcgctcttaactccttgaaggagaagggaatcgaaattcaaaatctgtttatagatgacaattggcaggctctcgacaacgaaggcgagtcacagttcaacagggcgtggacacggtttgaggcagattccaaagccttcccacagggatttaaacgaggcatagagaccatccgccagaagcatcggaatattcagcatatcgcagtctggcatgccctctttggatactggggtggaatctcgcccaacggggatcttgcccgagcgtacaagaccaaagaggtgcagattacagatccggccacaggagggaccgttgcgcacgcctctgagaaggggtcattgctggctattgatcctgaagatatacagcgcttttatgatgatttctacagctttctatcatctgttggtgttgattcggtcaaaacagagtcttgcccacgggtagacaatccgcgt

SEQ ID NO: 658 - DNA, 411 bp, A.fumigatus
gactgggatcgacttcgaagcatcatcgccccgacccttaccgtggactacaggcagatcggactgcgaaagtgggatgacatgcctgcggaagactacatggccatgatttctgacatggacttcttgggtgaccccaccgtcaagacccagcatctgctgggcgagtcctggtgggaaaagatctccgataccgaggtcattggccaccatcagctgcgcgccgcccatcaggtctacacggacagcaccttgcaaactgtcaagctcaaggggcacgggcatgccaccaatgagcactactaccgcaaggtcgacggcgtgtggaagtttgccggcctgaaacctaccgtgcggtggaatgagtatcaattcgaggatgtcttccgggccgcgaagccatcagtctga

SEQ ID NO: 659 - DNA, 597 bp, A.fumigatus
ctcatccggctgatactctacgctgaaaccaagatcttgtctagcatcatggcttcctctcaggacaatttcgtgtccaaaaccaatcccgatccctatgatcagatcatcgtgctctcgcagaaggtgataaatgcagggttcaagaacatgtggaagcttgcccagggagatgacgatagtccgttgacacactttaagaagagcattcacggggagtatattgaagctgatgtcgggatcccttccgtgaagctccatgtcgaaagtcgggagcccatgttatattttctattggccttgaagaatggtgaaatggctgtgtacgagagtgatgattccgacacactcttcaaatgggatatcaaggactgggtcctcgcgttcaacgtggttcttagtaagtgcaatgggtgtccttcaaccggcagaagcatggaaccggcccctaaccacccttctctccctctactagaccagaagaagatcaccaaggactcggaggaatatagaaagtttaaggagcgtgcagggcttcccgagtcgaacttctctctcgcgcagctctttattgatgcgtcatgtgggtgcccttga

SEQ ID NO: 660 - DNA, 201 bp, A.fumigatus
ggagttctgggacgtgtggtgcaggcaaccaacgctaaagttcgtgcagtcaacgaatacgcaccgtctttccctcccaccagcatcgattacttctgttacccatggcgtggagtggatggaagtggggcgaataaggatgaccaggacagcaatgctctggcctatctcttgatgtccgattttaagaacccccgtctt

SEQ ID NO: 661 - DNA, 219 bp, A.fumigatus
  unsure (102): Identity of nucleotide sequences at the above locations are unknown.
ccaagtttgttaggcgttgcctggttaatattttcaaaggattttgaagaatttgccgattcgccattggggtgctccaacctcttggttgccatatgtttnaaaaagcctgtcaataaattctgttttaccttcagccagttctgcggaaatacggcgcgtttcaagttccgttttcagatcggccactttccaattggaattaatcagtcattgtaa

SEQ ID NO: 662 - DNA, 318 bp, A.fumigatus
tccttccatggccgtggtgaagaatttgatgcctcagtacagatgaacgttacgaccctctcggtgcgatacatgctgaagcccttcaaacctggtgacaaactaagtgaccacgccgtccctattggtgtggtgatgcaacaactacaaacccaacttgccgaatacagagcgctcaaggaacaactggctgtcggtggtgcgggcatcactggtgtgtcatccagctctccaggagctgaaggtcaggatactggcgagagcgatcccagctccgcgtcttcgtccttcctccaacttgctacatcctcagagtag

SEQ ID NO: 663 - DNA, 240 bp, A.fumigatus
gatgaaacccaggaggagaaaactcccagatatactccctacgttagcccactgagatggttcaaggcttaccgctaccaccctagattcactgagaatgtctcgggcggctttcgatccctaacatacagccacaacatcgattctgaaaaatatctctgttcctacaaagctactggcggtgtctgcaatgaccggtcatgcgaactccagcactttcgtgacataactcttagccgt

SEQ ID NO: 664 - DNA, 978 bp, A.fumigatus
atgtgttcggctgctcctacaagtgaaacgccgcctcctttgctgaaccaactgattcctgcgggccattgtgcttgccggtctgctaccatcttcagctgtgatagctgcctccagtgctctgcttccaccttgcctccgagcccttcgcctcctcatatcacctttgatccgaatgaatactcctacaatgagacacaatgccattccttcttccctggcttgttcgaagatcccacacgcgctcaaacattctggcaggccaagaatgggatccgcagggctgacctcgacaatgtccaaatgatgaacggcatggtcagagcggccgtctacaaaggccgtctgtatgtccttaccgctctcgcgaggggggaagatcaccgccgcaaaatcatcggagtgttaagctcgatccaccgcgccctgatctcagcctcggaccttgctgtgatcccagacacagagtttatcttctccgttgaggacaaaatggaagatatcgcgggacccggtcatcctctctgggttcttgcgagaaagccccacgaagagtccgtctggctcatgccggactttggcttctggtcctggggccatcttgatagccagatcagaccgtatgaccaagtggtggagcatgtccgacagcgggaggtgccctgggaccagaaacgggataagctggtgtggcgggggaagcttagctttgcaccaaaactgcggcggacgctgctcgaggttgcacggggctatccgtggggtgatgtgcgagaggtggagtggaggaacaaggccaacttcctcagcatggaggagcattgtgactacaagttcatcgcgcatgtggaagggcgttcctattccgcgtcgctcaagtatcgccaggcgtgtcagtcggtggtagtgattcataaactgcagtacatccagcatcaccactatctcctcgtctcctccgggccacagcagcctttt

SEQ ID NO: 665 - DNA, 219 bp, A.fumigatus
ttacaaatactaagacatattggtattatagtcgatcacggaaagtcgactctgaccgactccatgatccagcgtgccggtatcatctcggctgctaaggccggtgaaggtcgttacatggacactcgtcccgatgagcaggaccgtggtatcaccatcaagtcgactgccatctctctctatgccaagttcccagatccggaggatcttaaggaaatc

SEQ ID NO: 666 - DNA, 216 bp, A.fumigatus
aatctgggatgtgcgttttttttcccgtactgttgccctgccatgattattacctactattgcccctcagatttttcctctcgtctaacagcctacaaagctctggaggttgataccaggtacctacgtgcccctcatgactgccttgtctccgtaccatgtatttcgttcctcaacctagccatgcaaattcgtactcatttattgaccgactag

SEQ ID NO: 667 - DNA, 660 bp, A.fumigatus
ttgaagtttaataatacaggatccattgttcgtcatttctgtggagatcatcctggctggccgcacacttgtccacacgccttcgccatgggtcgcaaaccaaatcaactcatcgtcgagttctttattcgaggccaaaagctcgaggacgccagtaaccgctaccaacacacgtgcagagcctgcggagagaagttccccaaaggtcgcatcgacagcctgaccaaccatttggtgaagaagtgtcaagcgatcccgctgcgtgacagacaacgcgttctgctgcgactccacgaactccctgaccttgccgacggcgatcagaacaaggatcccaacctggcgggccagggaaaaggcaaatcggttaatctaccatacacgacaggacagaattttgatggcctgaacgtcctggcagaagcctcgagacaagtcggcgcctccgaccagaccaaacggggcggcccagcatatgctcagtccgtcactgttggtggtaagactgtggttgttgacccggcgctggaggccgaaggttttcaaggtcatcctactcaacccgagcatattgaggaggacatcaaaccgcctggtaagattcttttctttcctttatgtcctcatcacgagggccaggaccgccttattttcgcccat

SEQ ID NO: 668 - DNA, 807 bp, A.fumigatus
tcgaggagttgctcgatagccagaccattgatggttgtcgcaaggtattcgattatttggagtcccgccgagaacggaatacaaaggtcgatatttccttctgtcactacaactcatgcagtacatccgctgatactgttccagaaacacttcaagcaaaagagcttgattatccttagatcctgcaatgagctgcttcggaggctgtcccgggcagaggacacggtattttgcggccgtgtcttcatatttttatttcagagtttcccgcttggggataaaagtgctgttaatctccgcggcgaatatcacaccgaaaatgttaccacctttgacgagattactaaatcaggagccaaggagagcgatgatatggatgtggaaatgcccgatgcgaaggaaacattaacagcaactgaagccctgggacatgatcatgatggccaaccaccaccttcggccagcgcttctcagacgcttgtacaagaacaagcaaaaatccccaaacttatcgtctcgaaaactgaagacaaggattcggagaaggcagttgatttgaacgctctgtaccctgttttctgggggctgcagacatacttctctgccccgacaaaagtgtttgattctcatcacttctcgtccttcatgactggtttggaaaacacattgatcgcgttcaagaatatcagaacagaccttgagaatcaaagtgccagtaagacagccgaggaaatacggaagtctacaaagcggaaacggagcgtggatggccaaaaaattgcgagcagtttcaacccaagtatctga

SEQ ID NO: 669 - DNA, 288 bp, A.fumigatus
gttgtagtgacagaaggaaatatcgacctttgtattccgttctcggcgggactccaaataatcgaataccttgcgacaaccatcaatggtctggctatcgagcaactcctcgatcaaccaaaatatcaaaccgggctcgcactgttctatgcacagtcagctagctgttcggtcacaagactagacgactggggccaaccattatcagaaaaaattgagattatgtcaagcaaattccacatgcgaatgaacgagggctcgtcaattgtcgtgttcgcctacagatag

SEQ ID NO: 670 - DNA, 342 bp, A.fumigatus
gcttttgatgatatgttaaaagagatctgtgccgcattgctatctgcagacgtctacgttcgcctcgtccagaccctccggaaatccatcaaatccagcgtgaacttctcctcgttgccacctgccgtcaacaagaagcgcttgattcaaaaggccgttttcgatgaattggtagcgctggttgatccgcatgcagagccattccgcccgaagaaaggacgatccaatgtgatcatgtttgtggggttgcagggtgcgggaaaaacgacaacgtgtactaagctggcccgacattatcagatgcgcggttgtcttcaccacggggctggaaggacccgcgct

SEQ ID NO: 671 - DNA, 813 bp, A.fumigatus
cttaaatatagcgcgctccttgcgcttcgtgatgaagacctcaagaacgtctaccacaactaccgcgcctcgcttcccctccgccgttctctaggtctacccgtctacctccccatctcgcctcccccggcaccctccacctcctccaccaacaacaagaccacacctttccgcgaagccgtgaaatcccaaaacctcagccgcgccaacttccagcttgtccgccgcgccgcctacgacgtccgccgcatgatccctttcaccctaatcctgatcgtctgcggcgagatgaccccactcgccgtcctggccctcggcaacgccgtcacccctttcacctgccgcgtcccgcagcagatcaagaaggcccgcctgcagcacgcggcccggaaacgcgcggccctcgccgcccaccaggcgcaggcgcgaggctccgttactggccccgcggccggctccgacgccgagcgcgagctgctggcccgcgaatttgcacatcccggttgggtcgagaaggcctcagcgcaggagatcctgcaggcgtgtgcggcgttggggcttgtgcggacgcatacccggcccgcggcactggtgccctggttgtatcggccgcggctacggcggtatgtggagtacctggcgctggatgatgagttgattcggcaggggggaggcgtcccggccatggaggcggcggaggtcagcattgcggtcgaggagcgagggggcgtgggcgtcgcggacggcaaggagtattgggaggcagagagggaggagagacggtggttggagcgatggctcggaagagcttaa

SEQ ID NO: 672 - DNA, 615 bp, A.fumigatus
agacctcaagaacgtctaccacaactaccgcgcctcgcttcccctccgccgttctctaggtctacccgtctacctccccatctcgcctcccccggcaccctccacctcctccaccaacaacaagaccacacctttccgcgaagccgtgaaatcccaaaacctcagccgcgccaacttccagcttgtccgccgcgccgcctacgacgtccgccgcatgatccctttcaccctaatcctgatcgtctgcggcgagatgaccccactcgccgtcctggccctcggcaacgccgtcacccctttcacctgccgcgtcccgcagcagatcaagaaggcccgcctgcagcacgcggcccggaaacgcgcggccctcgccgcccaccaggcgcaggcgcgaggctccgttactggccccgcggccggctccgacgccgagcgcgagctgctggcccgcgaatttgcacatcccggttgggtcgagaaggcctcagcgcaggagatcctgcaggcgtgtgcggcgttggggcttgtgcggacgcatacccggcccgcggcactggtgccctggttgtatcggccgcggctacggcggtatgtggagtacctggcgctggatga

SEQ ID NO: 673 - DNA, 576 bp, A.fumigatus
gctcttccgagccatcgctccaaccaccgtctctcctccctctctgcctcccaatactccttgccgtccgcgacgcccacgccccctcgctcctcgaccgcaatgctgacctccgccgcctccatggccgggacgcctcccccctgccgaatcaactcatcatccagcgccaggtactccacataccgccgtagccgcggccgatacaaccagggcaccagtgccgcgggccgggtatgcgtccgcacaagccccaacgccgcacacgcctgcaggatctcctgcgctgaggccttctcgacccaaccgggatgtgcaaattcgcgggccagcagctcgcgctcggcgtcggagccggccgcggggccagtaacggagcctcgcgcctgcgcctggtgggcggcgagggccgcgcgtttccgggccgcgtgctgcaggcgggccttcttgatctgctgcgggacgcggcaggtgaaaggggtgacggcgttgccgagggccaggacggcgagtggggtcatctcgccgcagacgatcaggattagggtgaaagggatcatgcggcggacgtcgtag

SEQ ID NO: 674 - DNA, 264 bp, A.fumigatus
cctccgccgcctccatggccgggacgcctcccccctgccgaatcaactcatcatccagcgccaggtactccacataccgccgtagccgcggccgatacaaccagggcaccagtgccgcgggccgggtatgcgtccgcacaagccccaacgccgcacacgcctgcaggatctcctgcgctgaggccttctcgacccaaccgggatgtgcaaattcgcgggccagcagctcgcgctcggcgtcggagccggccgcggggccagtaa

SEQ ID NO: 675 - DNA, 732 bp, A.fumigatus
cctggttgttgctccagcctcggcgctttcgaatacttgacgatcggacacaccgtctttgcgatcgggcggttcctgactgccttcatgcaatggttcttgaaaccacgatgggttctgatgctttcgtacattggcatgattgtgtttgcagtgctatgcatgaagacgaccggctccactgcggtcgccatgagtctgatggtctacctctttgagagcggcgcattcagcacgattttcgccctgtccctccgtggcaccgcccgtcatacgaagacggctgcttcgctactggccacggccatcagcggtggagcttttttccccttcgcgcagtacgccgccgagctctcgggtggtgtttcctactcgtacagcgttcttgttgcgcttttctgcgccggcgctatctttcccttgtacttgaattttgtgccggccgccaagaagcaggtcgaccccgtccccgacgagtatctccgccgtcaccgccgtcgtcgtagctgtgtggccgcgaacaaaaccctcgctcccgttccccgcgagaaggataacccctcagttggcggcgttctatcccgccgtcgcagcgtattgagcgatccacttcctaccatcaacctccccgaaacaacctacaatccgatgtcaagtcccagcagaacgaatcttccagaagaagcagtcatcgtcatcatctgccaggagcggcggcgggctcatgcatga

SEQ ID NO: 676 - DNA, 222 bp, A.fumigatus
tatggtgaattatctggatgtatgggcttctcaggagagggataccaggcctacttaacagagattgacagtctgaaaaaggccatttatatgatgtgtatatttaactcacaatatagtggtatattcatccatcgcgggtttatttttggttataccttcacattgacgcctgaaagttttatgtacatgtctgctagatgtaccgctcaatacttttaa

SEQ ID NO: 677 - DNA, 387 bp, A.fumigatus
acagccggcttctcggtcgcaccactcggagacattcatcctgccattgaagtatctttcctcgcgatgatgtacatttcttctgacttcccaaccgccatcaccatgcgcaaaaccaatgtatacgaagaaaggagtgttggagtctacgagcatgactccgtttcagaagcagaatctaggaacggaaaacatgttggactggccgtgcacatccagcgacaactgggattcgatctctggtacgtcatgctcgaaatcttcctcattgcaatcacggaagggggccgtctccagaaagctgccgacgagacgaccttctcgctcttttctgttccctttgagattgtatcctacgggactgccgggctctccgggatatcttga

SEQ ID NO: 678 - DNA, 219 bp, A.fumigatus
ctgagcacctcatccttgtgtgatgcaactgcaacaatggctcaaacactggcagccgcctcgctggttctcgtcccccttgtgactgcgcagcagatcgggtccatcgctgagaaccacccggagctcaaaacatacaggtgcggttctcaggctggctgcgttgcacaaagcacctcagtggttcttgacatcaacgcacactggatcttcaccacg

SEQ ID NO: 679 - DNA, 234 bp, A.fumigatus
gtccggcacgagttttgcaaccttgagactcctttcgaagccaaggctcatgatcaggcagagtccgcttctcacagaacacgttataagactttcagacaaactcaatcggtactccgcttgtcctcggattcttccccaatgattgtgggagccaaggataacaggggacgacagcctattcaacaaatcttcctctacttgctgagcatgatccctcttgcattgttataa

SEQ ID NO: 680 - DNA, 384 bp, A.fumigatus
ccggcaaggcctatccgggtatctgcctccacgaccagaattgctggggaaacccccgtggtcaggtacgccagggcctccattgtcgtcttcccaactgaccaccaggcctaccaatggtaccgcacctctgacacgtcctggcgggcacacgagatctacggcgacaatccacccaagtggaacttcgcagctcagcgcccagctgatctggtggtcatcaacatcggcacaaacgacaacaacccggcgaacaatgtatcgagcacagactactacaacgactacatcactcttgtgggcaatattcacaagatctggcccaaggccgatatcgttctgatggtgagtctcctcggcaaattggatatggtaggatgctaa

SEQ ID NO: 681 - DNA, 486 bp, A.fumigatus
tctggtggtcatcaacatcggcacaaacgacaacaacccggcgaacaatgtatcgagcacagactactacaacgactacatcactcttgtgggcaatattcacaagatctggcccaaggccgatatcgttctgatggtgagtctcctcggcaaattggatatggtaggatgctaatgacgcagtcgctgtggggtggcttcggtgcttcgggggatacatacgtgcagggtcctttatgggtggatgagatcaagcgggtctaccagcactacgagaagcaggggttcatccattatttcgacacggcggggatcctgcagcacaacgacatcgcgccgcagtggcatcccacggatgttggacatctgaagattgccgcgcatctgatgcagtgggtgaagttgaagtttgggtgggaatttggggctaccggccccgaggtgtatcacggaactttgtactggaatgatcaggcaaattactag

SEQ ID NO: 682 - DNA, 192 bp, A.fumigatus
gacgcgtttccttccagtccccgtcgtgaagagtggaagaccaggtggttcgtgctagatggttggctgaaccttgtgtacttgttcgatattggattcgtcgcctatctttggcggcctactgcgaacaacaggcggttcgcaatgagtgacgaggtatgtcttggacaacgcttccatggcgcccgatga

SEQ ID NO: 683 - DNA, 612 bp, A.fumigatus
agactacttgttctcagaggatccgcaggaagcggcaaaacaactacgttgtcgctattgtcggacaagctaggtttcgatgttctcgaatggagaaatccgtcgggatctgaatttgcggcgaaaggattcacgtccacaacagcgcaattcgaagaattcttaacaagaggaaatcgattccgtgggctcgagtttcacggcgcgaccggttcatcagcaagcaagttcaacagcagcgatcatatgacgccacgggtgattctcattgaggagttcccaacagtctttgatggagattcccccggtttagccgctttccgactgtctctgcagcggtatctctcagtgtcatcctcaccgagaagcaatatccggaacgatatcgagagacacgggagctcacctgttgttattatcgtttccgagaccatgttgaataccgagggatcctattcggacaacttcacagctcacaagttgctggggccagatattctaagccacccgtgcacaacgattgttgatttcaatgccattgctccaacgttcatgttcaaggccctgaacctggttctagagaagcatatccgccgatatagatcagcttaa

SEQ ID NO: 684 - DNA, 858 bp, A.fumigatus
  unsure (552): Identity of nucleotide sequences at the above locations are unknown.
gttggcaaagttgctgctgccggctcagtggctggtctgctcagcttgctatactacgtgcctccccgtcatggatcattgcaactcccacacgccttttaccaactgcaggcatatctccctagtctgcaccgcctgctgccgtcctccatgaccggcatgcgcctgccacaggggggcttcgccaatggattcgcagccgcagccctactctccgcgatcatcaccggcatcgtggggatgcaagtgtcgaaactgaccaagatcgactccggctttactcgatacccccctcgtatcaagagcaagccgagtcccaaggcggatcctcacagcattcccggcttcctcaaccccaaggactacaagacgctccctctggtgcagaaagccctcctcgcgcccaacgtctaccgattcgtcttccaactgccatcagccacagatatcgtcggcctcccggtcggccagcacgtcgccataaaagccaccgtcgatggccaaaccgtcacacgatcgtacacgccaacctccaacaacctcgaccgcggntacctcgagctcgtcatcaaatgctacccggacggccttctgaccggccagtacctcgccaacctgcaagtcggcgacaaagtgcacttccgcggccccaaaggcgcaatgaagtaccagcgcaacctgtgcaagaaaatcggcatgatcgccggcggcacaggcatcacccccatgtatcagctgatccgggcaatctgcgaggacgacaaagataccaccgagatcagcctggtgtatgccaaccgcagcgagggggatattctgttgcgcgaggagctggccgctgctcaacgccagggctga

SEQ ID NO: 685 - DNA, 744 bp, A.fumigatus
  unsure (427): Identity of nucleotide sequences at the above locations are unknown.
tctgcaccgcctgctgccgtcctccatgaccggcatgcgcctgccacaggggggcttcgccaatggattcgcagccgcagccctactctccgcgatcatcaccggcatcgtggggatgcaagtgtcgaaactgaccaagatcgactccggctttactcgatacccccctcgtatcaagagcaagccgagtcccaaggcggatcctcacagcattcccggcttcctcaaccccaaggactacaagacgctccctctggtgcagaaagccctcctcgcgcccaacgtctaccgattcgtcttccaactgccatcagccacagatatcgtcggcctcccggtcggccagcacgtcgccataaaagccaccgtcgatggccaaaccgtcacacgatcgtacacgccaacctccaacaacctcgaccgcggntacctcgagctcgtcatcaaatgctacccggacggccttctgaccggccagtacctcgccaacctgcaagtcggcgacaaagtgcacttccgcggccccaaaggcgcaatgaagtaccagcgcaacctgtgcaagaaaatcggcatgatcgccggcggcacaggcatcacccccatgtatcagctgatccgggcaatctgcgaggacgacaaagataccaccgagatcagcctggtgtatgccaaccgcagcgagggggatattctgttgcgcgaggagctggccgctgctcaacgccagggctgaaggtaatgcgc

SEQ ID NO: 686 - DNA, 216 bp, A.fumigatus
gcctcggtccaaatgggggtgtcttccctgaaagcttgccttttaggatgtaaaatctccgtgaactccaactcatatccagaggatgttgacgatgtcatcctccgactgttccccggggaggttgccacctatacattggcaggaggcaaccctgaagctgcttctcgcagcggatgtcaacctactcgatcctttgcgtctggcagtcaataa

SEQ ID NO: 687 - DNA, 378 bp, A.fumigatus
  unsure (231): Identity of nucleotide sequences at the above locations are unknown.
aactcttttcgactggataatgtttcaaaagattcgacagactggattggccccaagccaggagggagtcctgggcttgattgcctccctatcggcgccgcctctgaagcaaaatatcgacggtttaccgagaggttccgccccgaggaacagcttctcttgaaagatattgtgtaccagattatgcgcagttatctcaacatccccttaggctccctggaagacacctgntcaggactccttttctttactgccctagctggaaacctggcgcgggtcgaggatctcgtgaaggtcgctcatgcagcgagcagtgaaagtgcacactggttgtgcaaatatgttttcaccacacgggggtggaagaatcagcgctag

SEQ ID NO: 688 - DNA, 477 bp, A.fumigatus
aaagttcgtcagggccaactctggataccagaggcttggaatacagattccaaaggctctttcagatcagattgttttgctcgtttctccatatccttgtcaagcatgttgttcacagcagtgactcttgctcttctgggccaagctttggctggcccggttgagcttgaagaacggcagagcagctgtcccaatatccatgtctttggtgctcgtgaaaccaccgcacccactggctatggttcgtcgtcgaccgctgtcaatctgatcctcaacgcctacccaggctccacctccgaggcaatcaactaccctgcttgtggaggtcagtcctcctgcggcggagtcagctatgccaactcggtggttgccggaatcaacgctgtcgtgagcgccgtgaactcttttaatcagagatgtccaaacactcaactcgtccttgtcggatactctcaggtatttgtttccccagattga

SEQ ID NO: 689 - DNA, 201 bp, A.fumigatus
  unsure (170): Identity of nucleotide sequences at the above locations are unknown.
aatattcagtcacgtctgatcctgctacagggtggccaaatcatggataacgctctctgcggaggcggagatcccaaccagggctacaccaacacggccgttccgttgtcctcatcggcggtcaacatgatcaaagcggctatctttatgggcgaccctcgcctatgtcncgggtcttcccgtacaagttcggcacctgca

SEQ ID NO: 690 - DNA, 612 bp, A.fumigatus
cgcattttcgtcggccatgaccaggacgtggactgcgtctgctttcacccgaattccgcctacgtcttcactggcagctccgaccatacggtccgcatgtgggcggtcaccacaggtaacgctgtacgaatgttcactggtcacaccggcaatatcacagccttggcttgcagcagagacggcaaacttctcgcatccgcagacgatcaaggatccatcctcttgtgggatctggcaccagggagactgttgaagcgcatgcgcggtcatggaaaaggaggcatctggtccctaagctggagcgttgagtcgactgtcctggtctctggcggcgccgacggcactgtccgtgtgtgggacgtcaccggcccagcccaagatccatcccagggtcgtgtcgtcggagacggcggagccggcacaaaggtcgatggtggcaatccctcggccgcttcaacccaaccctcgacctcggttgctccgggaatgggcaagaagaaaggaaaggatgtcgtcgtgactcctgaccagatcagcgccttcccaacgaagaagagcccggtctacaaagtcaagttcaccaacatgaatctgatcattgccggcgtcttc

SEQ ID NO: 691 - DNA, 267 bp, A.fumigatus
ctgagaaactatttgtgctgccgcaaacttagaatcccacttattcctctattttcctattattacctagcagggttattcatgactatcattaccatcattaatgcctgcattataacaatgcaaagtagtgtcaacttgtgcaatggtaagcacagtaggacacagacccccatggatctcatgatgctgctcattgctaaccgaggcaggcgattggactttaactatcagatggagcagcgcgaagtttcccacacattatga

SEQ ID NO: 692 - DNA, 198 bp, A.fumigatus
aatcttgttattcaaataagccaattgatcaacatcattattatcaaaattattaatttccaatattttccccaatttattcagtttgtttacattatcatcattattgttaaatttatttttgatttgtcgataaaaattctcttgttcaatcaatttttgtctatctatatctttttgcttttcatcattagttaa

SEQ ID NO: 693 - DNA, 792 bp, A.fumigatus
atttggaagaattcattaattatctttgatattaaaccgaaaaagaataaacgaaaactaatacataataaaatatcggataatttcttagaagaatatggactttcaagttatcaagaattgaatcgaaatgttgatgattataatagtatatatgaaaagaaacaaaaggaattactaactagaaacaatcttaataatatccctattgagaaattagatggatttatcattggtgaatcttcacttattgataaaatcaatactactgataaatccaaaaatatcaagaaatcaaatattcaaatattaactaatgatgaaaagcaaaaagatatagatagacaaaaattgattgaacaagagaatttttatcgacaaatcaaaaataaatttaacaataatgatgataatgtaaacaaactgaataaattggggaaaatattggaaattaataattttgataataatgatgttgatcaattggcttatttgaataacaagattttacagaatgataatagtaaagccacgacaactttagataatgatcttgatttattattggggatatcatcggatgggaaagatgatgtcgataaagttgaatcaaatgtaaaacaacaagatgacaattttgatacatttataaataaattaaccatcaatgataaagacgaaacttttaaaaatgaacaacatcaatccaaattgagttttgataaggttaataaaaaacaaaatcaaaatgatgctaaagatttagattttctagatgatttgttaggttaa

SEQ ID NO: 694 - DNA, 660 bp, A.fumigatus
  unsure (47),(49): Identity of nucleotide sequences at the above locations are unknown.
ggggccaaagccgccattgggggcctttcccccttgcaaacccaacnanttccaccctcccttccgggggttgtagtcgcctggtccgccctcaaacagaaatatcgagaagtcatgcgcgttgccgcctacgggtccccctcggttcagatccacttcatttatctcaaggtggacaaggacatcctgatcgagcgcgtcaagcaccgtgatccctcccaatatatgaagagcggcatggtccaattgcaattgcaggctttcgaggaacccccgggcgaatgggatgcgctgcccttcaacggtgatggtccccgcgaggaggttcagaagaccgtttttcagttggtgtcggagaagctggcggaataccagggactggggtattctgggtttgcttgccttatgaccatttttttttttatatttttttttttttttttttttttttttttttttttctcgggggaactgggttcagttgcacggattgcatggatctcttgcgccgtccggtgtctttggagttttagagctgcccactcatgcttttgggagcatcatgatctgtccttgtctatggagtccgcatcatatcctggagttcccatcggttgtgaatctttatgtcttgtcatggtgatctgtctgctattttga

SEQ ID NO: 695 - DNA, 306 bp, A.fumigatus
  unsure (37): Identity of nucleotide sequences at the above locations are unknown.
agacccgatgcctcgcccatgggtgcgggtgccgaanaacccgtcatcattgaccagagccggatctacgccccgccggatcccttcgagacgccttccgtcggcgtcgagatccctgccgcggtgaaccggccccgcaccattacggcgaaggtgccgctgaaggagatggtgggatacctgaagcatctccgcagtctgagcgcgggtcggggcacgtttgtgatgtctgtcgatcggtttgagcttatgagcgcgcaaaggcagaacgccgtgctggcggagttacgcggaggcttttattga

SEQ ID NO: 696 - DNA, 645 bp, A.fumigatus
gtagcgcgtgttcttccatccccgtgggtgaagaatgagcatcgccagcgaatctacgaggaacgctccgcgctgatccggagccgctcggaacagttcgcaatcgataccttcggcagcagtatctgggatcagtctctctacaaggcatgggcagggatcgtccataagctcatcccgaaccttaccgttatcgaacggtttctcaccgcgttcgcgaagagaatcgatgcagaggaggtcatcctcttcgagcgctcgaccttcctcaccgtgacctctgtctcatccgagatcggtgacatgaatcccatctatgatcggcacgagcgcctctcaaatatcatgaaggctttcaagcactgcgctgcccgtaatacgcacacaacacctgccacagccggttttctggtcatgcacaccaagaccccgcagttcaacgtcttcctcggccgcttcacggacaatacatatatcttcatggttgtcccgccaggcgaagcagcgtacaactgcgccgtcctgaacaccatgttggcccgggaaggcttctccaaagccgcggcggcaggctacggggatgggttcccgctcccagcatcggaccctccagaagcgaatatggctaatggtgtcactgcttga

SEQ ID NO: 697 - DNA, 1026 bp, A.fumigatus
  unsure (185),(846): Identity of nucleotide sequences at the above locations are unknown.
ggaactttcaattatgggcttggagccaggtgcaccatttgcttgggaggcgccggcccaattcatggcggcacgggatgcagaaatggtaatttccacttcgcgtttactcttgactcgggcggtctcctaactacttttttttggcagattcccgagcaagattggctgcgtgccgtcattcntcatctccttgtcgatcccaagatggcccttgcatgtccgccgcagttgttttacaatacccctccgtctgaccctctcgcacagagtctggacttcttcgtgcatgtgattgagccaatcaaggatgcgatgggtgttgcttggtgcactgggtccggttatgtcgttcgacgcgaggccctagacgagatcggcaacttccctcttggttcgttggccgaagacgtcgcaacctccacactgatgctcgggaagggatggaagaccgcgtacatccatgaacctctccagttcggtaccgtgccggaagactttggcggacatcttaagcagcgtacccgatgggcaatcggaaccgtcgacactgccgtgaagctcaaattctgtctgtggggtgacgccgttcgacagatgactgttgctcagcgcttttcgggattcctgtacgcaacactcagcttgtacaccctccttctcactgcctcgattttcgccatccccattattcttctgtggggcaagcagcttgttgcctacgcgactcaagagcaactgcgttggcttatctgggcatgctttgcctcgaccatttccaaccgaatctgcgagttcgccctcttcatccccgctggctaccacaccggacagagaggctcgcgntaccagctttggatggcaccctacattgccctttgtattgtccggtcattcatcctccccagatggcttggtggccaggcccaggccttcaagccgaccggctcactcagctccgcactcgaagagcgtgatccgcaacggaggaagaatcttaccaggcggctggaaattaatacgctg

SEQ ID NO: 698 - DNA, 312 bp, A.fumigatus
caaagaatgccccgtggattccggaatacctaccaggctggtcttatttccgatgccgcagggtggctcgacaatacgattaccgagcctctgtatggcaaagctaccagtaaaacctccgccaccttccacaccttcggcccatacactgcagctatatgtctctgttgtgtgctggagcaaaattcaggacaaagagcaattgatgaaggcctttgtaagggcacagcgcttgcaagaggccgaggctttagacgggggaaaagtaaaaatttgcccaagatgcctacgtcgagaagagaagcgttataa

SEQ ID NO: 699 - DNA, 741 bp, A.fumigatus
cttccacccgtggcgaatactggtgccgagtacattatggagttgaccgacaagaccaaggccgacgtcaagggtggtaccatcattgactacgagggtaaggcccgtctgctcgaaatcgcccaggtgcccaaggagcacgtcaacgagttcaagtccatcaagaagttcaagtacttcaacaccaacaacatctggatgagcctccgcgccatcaagcgtgttgttgaggagaacgagttggagatggagatcattgccaatgagaagtccatccccgccgacaagaagggcgaggccgaccaggccatctaccagctggagaccgccgtcggtgcggccatccgccacttcaagaacgctcacggtgtgaacgttccccgtcgccgtttcctgcccgtcaagacttgctccgatctcttgctggtcaagtcggatctctaccgtctcgagcacggtcagctcgtcatggaccccaaccgtttcggcggtgtccccgtcatcaagcttggatcggacttcaagaaggtgtcggacttccaaaagcgcatccccagcattcctcgcatcgtcgagctggaccacctcacaatcaccggtgctgtcaacctcgaccgcaatgtcaccctgaagggtaccgtcatcatcgtcgccaccgagggcagcacgatcgacattccccctggttcggtcctggagaactgtgtggtccagggcagcttgaggatcctggagcactaa

SEQ ID NO: 700 - DNA, 816 bp, A.fumigatus
tcgcacatagtgtcgaccgccctatcgttgtcgcaacgacaccaagactgccaaataaccctgctagaacaatctcctataatccctaacccgtatggttcctccgttgacagttcgcgaatcgttcgcgctgactactcgcatcccgtttatgcgaaactcgctgctgccgccattgaccgctggcgcaacaccgaatggggaagggaaggtcgctacacgcagaacggactgatgctcgtctggacgcctggcaatgagaaggcgaaaaactatgcgaccaagagctaccacaatgtcaagcagttggagggcgacaaggtcgaactactcccgtcggcagatgatgtgatgcggatcgtgccagaatatgggaaggagttgaatgtagccgggggctacatcaactggggctcacgctgggcagatgccgcagcaggcgtgcgattcgcaaagaagctactggacgaacagggaaaggtggttttcaaaaccggcgaggtcgacaggctccttcttgccgatggccagagcgccacctcccagcgcagagtcaccggtgttgtcttgacggacggcacgacactcacggccgatcttgtcatccttgcgacaggcgcctggacaggtaagcttgtcgacctccgcggcagggccatttcaaccggccaagcaatatcatacatgcacatctcagacgaagagcatcgccgactagagaacatccccaccgtcctcaacttcgccaacggcatcttcattatcccgcctcgaaataacctcctcaaaatcgcccgccacgcctacggctaccat

SEQ ID NO: 701 - DNA, 201 bp, A.fumigatus
aatggccctgccgcggaggtcgacaagcttacctgtccaggcgcctgtcgcaaggatgacaagatcggccgtgagtgtcgtgccgtccgtcaagacaacaccggtgactctgcgctgggaggtggcgctctggccatcggcaagaaggagcctgtcgacctcgccggttttgaaaaccacctttccctgttcgtccagtag

SEQ ID NO: 702 - DNA, 378 bp, A.fumigatus
ccccagcgattatcattatcggcggtgagcaccgacatttacgatgtctcgctagaagagcttaccgaagctgagactgccttggctgaacgggaaacagaagaccaatactcattgcgcgctcttcgcaccctctttggaaggctatataacgtgagaaagagcatcctttgctgtctcctagctctgggtgccgatggtggcggatccgacatcgtacgatggagcacggctgttgagcagatgcgggatcttactcaagtcacgggagcgaatacccgcaagatgaccaacattctcaatgaagatgaccgtgagttttcacctcaatgtagagtgttttccgatgatccgcctctgactctgttcgtaaggtga

SEQ ID NO: 703 - DNA, 300 bp, A.fumigatus
accccttttattgcgggacgggagaactacagattcgaatatctcctcatcttcgtcgacactctgtataatgctcgggtctggcttaatatcgccattcagcgcccggagcgcatctgctgggcttccctcaaccgcggtggcaccaccaaggctgggtgtcggcgacaatggcagcttcaacccgctgggcgggcgcgacatatgatctaccgacgatcgcttgtcgatgctgctcaccagagcagctttgccagcctcccattcctgaaggaggcctctgatatccgttccaattga

SEQ ID NO: 704 - DNA, 183 bp, A.fumigatus
  unsure (45),(46),(55),(88),(116),(133): Identity of nucleotide sequences at the above locations are unknown.
actattaccttccgtctggaaccggcacggcccgaaggttattcnncggaagaanatggacactcaagacagaacttttctgggtcanaaactgtgaagctcaggttccccattangcgcgcgactgtccaanagttacgatttattccacaccggaaatatgatttgctgttggcatgctaa

SEQ ID NO: 705 - DNA, 267 bp, A.fumigatus
tctcaaggcttcgtatatacatcgtctactgacaggattttaggcacccctcataacggcagcagcctcgcagccatgggaaaggtcctggcaaatattgtctcagcattttcgccaataaggactccccgagcgcttatagggacgctgcagaaggactcagaggtcctgttagaaattactgaagacttcctcaagaggaggcggaaagttcaactcgtatccttctatgagctcgagttcacttccatcggcccctttttatga

SEQ ID NO: 706 - DNA, 603 bp, A.fumigatus
cctgcgcaatcgggccatcgggtatctttggtgttggcgacctggttttgctccccggttatgctggatgcgtatttcagagggcagaccaaggtgcagattggcaacaacaaaaacttattcgacttcactgagaacacaaatgtggcatacagtcactaccttgcggccgccgcgctggttacatgccaaaatagcctgccgggggatgatgccaaggtggatggcgaagcctttttcatcactaatgacgaacctatatacttctgggactttacacggctggtttgggggtatgcgggggacaccacgcggccagaacaagtacaggtgatgagtcgaacatgggcattgctgctggctgcattgttggagtggatcttctgggcttttcgcctaggcgaagcacctctgacaaggactaaagtgcggctcagctgcatgacaaggtatttctgcattgacaaggcgaagcaacgacttgggtataagcccctggtagggcttaaggacgggttaagaactgcagttgaagattgccttcggcggcggacggcagcacaaagcactcatacaagtaatgtaaaggaaaaggggcaatga

SEQ ID NO: 707 - DNA, 387 bp, A.fumigatus
  unsure (313): Identity of nucleotide sequences at the above locations are unknown.
aacactgactgcgttgccatcatcatgcctctaacaccagaacaagttcaaatcatcaaggccactgtgcctgtgctggcagagcatggcacaaccatcaccactgtgttctacaagaacatgctcactgcccatcccgagctcaacaatgtcttcaataccacgcaccaggttaccggccaccaagctcgtgctctcgccggggcgctcttcgcctatgcctccaacatcgacaacctgggtgctcttggacccgccgtcgagctcatgtgccaacaaaccccctcgctgtacatcaagccggaagactacnaatattgtccgggaattcctggctcgaaacaatggggccaggtcctccggggatcccctccccccccgagatcc

SEQ ID NO: 708 - DNA, 624 bp, A.fumigatus
gagcgctgttccttccagccccgtggtgaagattcgcaatccatcaagaccacgagggacgtccaattcctgcagtgggcgggtgataaaaccagagacttctcagcaaatgcagtctctgcagccactgagttgagccgtctactgcaggagggtgacaactgtgatcaaggcattttcctctcgcagtccaaggatgtcatcgttggtgtctacatcggctccgatattcagcgagcaagtgctgtggatatccttcagaattttggaaattcggcaccctcaggcccggtgaaggcgtctcagctcgctgcccaggcgtgtgagaatgggaacaagaccgcccaaacgctgggagtctttgcagatgccaccggaaatctggcatccgttctcaatgcgctccaagtatgggataaagggcagtgcctgactggcgcggacaatcagcaagtgtggtccaacacgcccatcaacgtcttgaacagacatactactgtcaggagcgacaatacgaccatcgcagctcgattgaagaccaaggttcttcctcgggatacatgcacatatgtccaagccatcgcaaacgatggagttttcaccaggcggggcaggaccaagcta

SEQ ID NO: 709 - DNA, 1194 bp, A.fumigatus
gtgaccttcgcactcaagagacaggcgcttttcatggggctcaacatgggtatggggcagttgggcctggcgacgggccccatcatcggaggggcttttaccacaaaggtgtcctggcggtggtgcttttacatcaatctgcccctgggcgttgtcgtcggcggatttcttctcttcaacacgatccccgaaccgaaacccaagagtccgcccctggagattctcggcaccgccatcaagtctctggatctccccggtttcatgctcgtctgtcccgcggtggtcatgttcctcttggggcttcagtttggcgggaaccaacacccttggaacagttccgtggtaatcggcttgctagtcggcgctgccgtcaccttcggcctctttctggtctgggagcatcgtcgaggagacaaggccatggtgccgtttgccatggtcaaacaccgcgtcatctggtcgaccgccatgaccatgttcttcaccctgtcgagcgtcctcgtggcggatttctacattgccatttacttccaggcaatccgcgacgactcgcccttgatgagcggcgtgcacatgcttccgatcacgctcggcctggttctcttcaccgtggtctctggcgccctcatctccattttgggctactatcttccctttctccttgccggcggtgccatctccgcggtgggctacgggctcctgtcgaccctcagccctacgacctcggttgccaaatggatcggctaccagattctctacggtgttgcaagtggctgcacgacggcagctccctacatcgctatccagaacctcgtgtccccagcgcagatccctcaggccatggcgattatcattttctggcaaaacatcggggcggcgacctctctcatcgcggcaaacgccattttcagcaacagccttcgtcatcagcttcaggagcgcgtggcagatatcggcctcgcgccagacgccatcgtcgctgcgggagtccgctccatccgggacttggtgtctggctcgccgctggctgctgtgcttgaaggctacgctaaaagcatcgaccgcgtcatgttactcggtctggcggtcagcctcgccgtcttggtctttgctccgggactcggatggaaggacattcgcaaagtcaaggattttcaagttattggcatccattcccctgacggtggtgaataa

SEQ ID NO: 710 - DNA, 201 bp, A.fumigatus
attgttcgttcccggtggcatgtccctcttcagatcgtcggcacggttatcgcagtcgttgcatacttcctaggccacgctcacaagggccgtcagttcggaaagaacgtgcatgcctcgttcgcgaacctgttgatgcttatgcttgtggtgcaagtcgttatcggtctttatctcaagctgtcttcaccaggggtctag

SEQ ID NO: 711 - DNA, 552 bp, A.fumigatus
  unsure (524): Identity of nucleotide sequences at the above locations are unknown.
ctaaccatctccagccatgggattgactctctcaactgcactctggctagtctgctggagacagcagcaatgggctttggctcttcccagttaggagcctacacggctcttgttccctgtctcgcaatgtacttttcgacctgggagacttaccacacacatactctctacctgggatacatcaatgggcctaccgaaggcttgctcgttgcaatcggaatcatgatcgcttcaggatactatggtcctcagatatggagtcggccgatcgttgaattcctgaattttccccagatatttgggaattattcggttaaagatgtctgggttccattcctgcttctatcgttctttgtcggtcatctgccgggatgcgtcttcaatgtcatcgaagctcgcaaaaagcaaggtctgccagtgtcaaccatcttcaaggaatgcggttccaatgattgtcttccacatttgcaacattgctgggctcttctctccttactcgactctgctggctcaaaatcgactantcttgtattggttggacaatctcgtttg

SEQ ID NO: 712 - DNA, 1035 bp, A.fumigatus
  unsure (53),(67): Identity of nucleotide sequences at the above locations are unknown.
gtgggcgactgcgttggaattgttacggaagtactccatacaggtacagcagnttccggtctgtcgntgcacgccggacaggtcctggacgtctttctcgtcctttatgtcccttactgtgggggtttcctcacccagtacttgtccaccatcgggctggctatttactttagtgctgggatcacattcatttacagaggagcgttcgtttcatccttcatcatcctagcattggtctattttcggcgatataaacacggaggattctcagttacgaacttcacctcacctgtcgatactgtattgaattcatatttggatttgggagaccgcaactacctgattgtttatttctgtcctgttacgaagcataccatatctttattcagcagatcgcacatcatggctgataaacccgccatccttcaacctcgtccgcggcgagtgttcgaccttacgcctgcttcgaacgaatcgtccgaatctcctactcccgcggagcccgccaattctgatctgctcaatcccaaggaggccgcttcgagcagcgtaagccgcactgcttctatcatgaatctgacatcgtctaccctttatggcatttattctccgaccgcattcgaaggcgagggacaaacacctatctcggagagtccaccaatcattaaaccgtctcctgacacgccggttcgccagtcacttcagagaactcggtcgcgcctcagtcatgggctattccgtggagttattctgcctcaggtgttccgaagcgtgcttctctttggtttcggagtggcctatggggttatcacagttcatttacatgagaatcactggattacgccggtgaaattggagaatattcgctactacgactcttggcaatacctgggtttgtggggtctggctggagtggctctgggacatgttcttccctggctggattcttttgctggagagtggaatacggatcgttcccagaccgtcaaagggcaggagaacaatcgtctccgcgagtcttcaccacggggctgg

SEQ ID NO: 713 - DNA, 186 bp, A.fumigatus
atacatttgccagtacaagtgagcgatttgtattctcagtggggtatctctactttactaaacaatcgcaggggctggtataagactggaaacaattggtgggtgaaggggagcgacaaacccagggactgcggtatgtatatctccccgaaaggatctgtggttgcgacattgacaatgcaatag

SEQ ID NO: 714 - DNA, 216 bp, A.fumigatus
ggaaaaaaagggggtggggttaattttgggcaagaagtaaaattttcttggggaacgggaagggaaaagtttggaaaaaattacccccacctaaaacgcccaatagttaaccccctttttggttacccatattttatcaatatcaagcaatccccggggtttttggcattcctcccggccgagtcgactcgtaaatccgaggttcgtcgaagatga

SEQ ID NO: 715 - DNA, 228 bp, A.fumigatus
  unsure (134): Identity of nucleotide sequences at the above locations are unknown.
tgcccactgtcccgccacaatgcttatccgaatgcaggactagtcctcctttcgctgcctagagtgaccccccgtcagctgatatgcttgccaatacatggggggcctgtcccaacattcgggatatcatatcnctggatggagcccccggcccccgaaattttacctcagaatattctccagcaggcgaccccttttggatacctccgtaattttatgtacatgtaa

SEQ ID NO: 716 - DNA, 390 bp, A.fumigatus
tcacccaattcttttcaaggaacggaacgttcaattcccatactcccccaattaacggacccggaagccaccagtccaactgacaaacgcctgatggaaacaacagacgccttcccctcctccgccgccttcgacgtgatcaactccgccctccagtccgacgaagccgagcgcaaagacgccatcaagaacgccaaggccatcgtcgcgttcaacctcaagaacgcctccggccaggaggagagctggtacctcgatctcaaggacaagggcgtcgtcggcaagggtgctgcccccgccggtggaaaggctgatggttcgtttatatccctcactttcgaaaatcagtggagtgggttggactggtttcaggctgaccatgtgacttga

SEQ ID NO: 717 - DNA, 318 bp, A.fumigatus
agactgtgtgctttgatcaacgcactggagttcaaaccgaagcatttactggcagttgactctgtcccgtccagactcgaacttgccaggtcgctcggtgccgagccttggaacttcaaaacagacggagaaggattgcgcaaacgcgtcgaagagttgaccaatgggcgaggagcggatgctgtcattgaggtggttgggcttagcccagcgctgaggactggatttgatctgctgcggccatggggcattctcagcagtgtgggtgttcacaacggggaggtgagtcttcatcagccgtcaggaatccaagcatga

SEQ ID NO: 718 - DNA, 255 bp, A.fumigatus
cggctgatgaagactcacctccccgttgtgaacacccacactgctgagaatgccccatggccgcagcagatcaaatccagtcctcagcgctgggctaagcccaaccacctcaatgacagcatccgctcctcgcccattggtcaactcttcgacgcgtttgcgcaatccttctccgtctgttttgaagttccaaggctcggcaccgagcgacctggcaagttcgagtctggacgggacagagtcaactgccagtaa

SEQ ID NO: 719 - DNA, 342 bp, A.fumigatus
gagagaatagtacgttacccttgcagtcaggagtctggacctctaagactgaacacaaaggctctaggcgcccttgcgccccatttccctgagccggactggtcggctgtgctgcgggctgctggcctggcctgggagccttcctcccttctgcctccccaacccaagcccttcccttcccttcagtctctcatttttcttcccttgtattattgttttcatcctcccataccaacccctctgtcattcttcctccttctcaccccatcacgttctctctctaacgtcttcaccacggggctggaaggatcagcggtggctcattgcccgacagcggtccat

SEQ ID NO: 720 - DNA, 192 bp, A.fumigatus
cgatttgcttcgcgtcgttcagttgtgcgatcggagagcgtaagaaacattattcgggaacgacgaatgctcgaacatttaaaccatccctgtctttgcaacttgagatacagtttccaagacattgagtacatgtgcgttctgcagcaggtttcctggatggccatgagattggttgctaatatctcgtga

SEQ ID NO: 721 - DNA, 258 bp, A.fumigatus
agttatattgtggttgatttgatgaacggcggtgatttgcgattccatatctcaagaaagtgctttacggaagaggcagtacgattttggatggcagaactcggttgtgctttgagatacatccactcacaaggaatcatacatcgagatgtgaagccggacaatgtgctgctagattcggaagggcatgtgcatttggcggatttcgtatgtggcgccctctttgagcagtgcgaccccattcattttatccgctga

SEQ ID NO: 722 - DNA, 225 bp, A.fumigatus
cttttcttcctattgcagaatgtggcatccgattttcgaccgggcaagcccctcacaagcaagtcaggaaccttggcttatctggctccggaggtgtacgaaggcggaggttattactgtgaagtggattggtggtctcttggtgttacattttacgaatgcatttacaacaaggtatggacttgcttaggccgcaattccggtttctcgcactactctaactag

SEQ ID NO: 723 - DNA, 303 bp, A.fumigatus
cgaccttttgaaggtcgaagccaggacgtccttagcgagaacatcaaaaaggctcaaccgaaatactacgtcaccaaccctgctgtttcagttccgtgcctgcgggcaatggctgcgctgttggaaaaggaccgaagcaaacgaataggggccactggatttgacactttcacttcgcatatgttcttcgcagaaatcgactttgttgctctggaacgcaaggaagttccgcctgttttccgaccttctagcgataagaccaactttgacgccacgtatgatttggaagagcttctcctctaa

SEQ ID NO: 724 - DNA, 459 bp, A.fumigatus
ccttcttcctggacattgctgcctccgatggccattcaatcgatgcggctgacgacggggccactgtcacggccgctctgcaggaatggggctacctggcgacagaaatcgaggacttggaggccgaaagcgaagaggcggtccagattttcatggatcaacttaatagcaacgatccggcccggcagattgccgctggcgagaatatcgccctgctgtacgagaagagctacacaccgcaagaggacgacgacgacgaagacgaggaagtcgaatccgacgaggaggagtttatgggggccagggaccgggacgggccaaaactcgtcaaacgctacaatgcgtaccacaacacccatgagttggaacagcaactccaatccttggccaccgtgcacaaaaagcacatcagcaagcgagacaagaagaacctgcacagcaatttcgcctccatcttga

SEQ ID NO: 725 - DNA, 225 bp, A.fumigatus
  unsure (56): Identity of nucleotide sequences at the above locations are unknown.
gcattgaccgttggtggaagtggtatccgactgactctctcccacgagttctccangggagattcgccgtaccctactttgagggcaaccgcccctcccggaacatctgcccgtgaatgttccggccccgccttccgaacctacagccgcagaatatcaacagggccccccataatccccgaagggctgtttcctaatcagccccacaagaacgaatttctttga

SEQ ID NO: 726 - DNA, 822 bp, A.fumigatus
  unsure (762): Identity of nucleotide sequences at the above locations are unknown.
aatgtaaaaccgctgctgacccgcacgatccgcgactcgacttctcctgtgatcaaagctgccgcaatccattgcctgggggtatgtaccagctttggtggtgctggcgaagacagcattgtcgatcagatgaccttcttcctggacattgctgcctccgatggccattcaatcgatgcggctgacgacggggccactgtcacggccgctctgcaggaatggggctacctggcgacagaaatcgaggacttggaggccgaaagcgaagaggcggtccagattttcatggatcaacttaatagcaacgatccggcccggcagattgccgctggcgagaatatcgccctgctgtacgagaagagctacacaccgcaagaggacgacgacgacgaagacgaggaagtcgaatccgacgaggaggagtttatgggggccagggaccgggacgggccaaaactcgtcaaacgctacaatgcgtaccacaacacccatgagttggaacagcaactccaatccttggccaccgtgcacaaaaagcacatcagcaagcgagacaagaagaacctgcacagcaatttcgcctccatcttgacgactgtggagaatccccgacgcggccccatgtacaacaaggcgatcgatcaagattcgaatcggcagtacgggagcaaagtccgcgtgaagatcggaagagaaggggtcatgagcattgaccgttggtggaagtggtatccgactgactctctcccacgagttctccangggagattcgccgtaccctactttgagggcaaccgcccctcccggaacatctgcccgtga

SEQ ID NO: 727 - DNA, 645 bp, A.fumigatus
ttcctaaccatacgcggatccttcggcccccttggtgaagacagatctcaccgtggcatgacttctgccgcttaccagaagaaattcgacgaatatctcagccagggataccgtgtcgtccaggtcaatggctacacggtcggcgacaaagtgtactatgctgcgatttgggacaagtccccctcggccggctgggtcacccgtcatggaatgacggtcgagtcgatgcagaaatacttcgacgagtacctgaaacagggctacaagctcactcatatcagtggctacgagctcaggggcgaggagcgctttgctgccatctgggagaagcagaacgataaggtcgcctggctctcctatgcgaacatgacctctgccgaataccagtcgcgctttgacaaatatgtcaaggatggatatcgcctgatcgatgtcgatggatatcaggtaaacgaccatgtttactatgcggccatctgggacaagttggcttctggtgcctgggttgccagacatggattggattcaccaagcttccaggcggcatttgacaaatataaggaggagggttatgttcttcgcgctttcagtgggtacaactctggaaaggaggatcgctatgctggtctttggataaagccatag

SEQ ID NO: 728 - DNA, 375 bp, A.fumigatus
  unsure (34): Identity of nucleotide sequences at the above locations are unknown.
catccaagatggataactgtgtctccacagttgnagatcgtcattatcctatactgctcgcaccaccatcactgtcatcacatcatcacagcgtattttaactacagcattgttaccttccattgctttgttattcgatatattgtccatgctctgctggagctatcatctcttcctctcagtttggacatgaccgacatgagcaagaacctggactccatcccatatgatgtgttctaccagatcgcttccgggttggattgccatgactttatccatctcagtcgagtcaatcaggctctcaacaagttgatgcgaaatgagtccattgcaagaaagacaatcgaggtgtgtattttcctcacgagtgcataa

SEQ ID NO: 729 - DNA, 537 bp, A.fumigatus
cctggaacccctccacgaccccgctgctgcatcgaacagttaactttccctgaccaagctctacttcaattaacttgtgggaagtctctgttccatatatgcatgtatgagatggatgctctggtaacgttcggcgctgtcttcaccagtacaggcagcttcagtctgtccagtctactcacgatcatctacagcctgttcttgaagccttatttggcgccgctgacagtgaacatcaccctcatcagtcaatccactgatttcgccccgactgctgcagaaattgatgcttttctaagagaacagttcggagaggaatctaacaagtggaggtgtactcttacggtgaagcttaaccgctataacggccccgccaggaatgctttccacgttagtcaagttcaatatacgattgattgtactcgggtggaagttgacgcttacggacgagtctctaggcaaccctccagcacactagtactccccatgagagcccactacgggagcttgctgtccgatcactttgcgggaaactag

SEQ ID NO: 730 - DNA, 252 bp, A.fumigatus
aaaccctctatatttaagtgctctattcttacagttaggctctacaatactcaattcgcccacctcttcttcgtgagcaccgaatcagatccttcgtctggctgtcacaagagctatagaattgaaactggtagctgtatttatagctacagatttgatgacacagagtttatgcatcccaaattagcctcccctggtcatcttaaccggatagggatcttaatacctcatgtagtacactcacacaggtaa

SEQ ID NO: 731 - DNA, 258 bp, A.fumigatus
tccggccgcacactcacagacatccatgacaccacttccttcgaatacacgaacaacattcacttccgtaagtcaatcggcacattggcagagtgccattctaacataatactccagagagcatcctcattcctcagcgatggcatcttctccgttagcgcaaactccaataaaatttctacctcgaggttgtggtggttctggatggcactcacctttccgctaacagtgattgcgatggctgcttggtgggcatag

SEQ ID NO: 732 - DNA, 285 bp, A.fumigatus
  unsure (157),(206): Identity of nucleotide sequences at the above locations are unknown.
acctttttagcccgcaactacggtggagacattcccatgtccgcagtcgagaagttccccatactctttagcgaagccgaagaagaaagatcccccgtccttccatgtttctcccatgaaggaatcaatgtatgtgagacccatgcgaaacctgcantgcatggccttcggagctttcgccgctccccgcaacgcacctcctcccntattcgaaccagctactttggctcgagggcacacagggagtgtcggatatggctgtgttacttttctgtgattgtctag

SEQ ID NO: 733 - DNA, 477 bp, A.fumigatus
ttatgtgctgttcctcaccccagatatataacacaagagtcacacaagcttgagattcaagcccgaccgcctattgccgtcacaaatgccgtctcctggcgaagcgagggcattcgctatcgcaagaacgaagttttccttgatgttgttgaatctctcaatctcctggtatcggcgtccggaaacgtattgcgctcggagatcctgggtgctatcaaaatgaagtgttacctgagcggtatgccagagctgcggttaggtctcaacgacaaggttatgttcgaaacgactggccgcgctacacgaggaaaggcggtcgaaatggaggatgtcaaattccatcagtgtgtccgactttccagatttgagaacgaccggactattaactttattccgccggatggggagttcgagcttatgagctaccgtctcaacacgcatgtcaagcctctaatctgggtaaagtgcctggtttga

SEQ ID NO: 734 - DNA, 234 bp, A.fumigatus
  unsure (27): Identity of nucleotide sequences at the above locations are unknown.
tatctctacatccgtcacagcaatctntacatcctcgccctaaccaagagaaataccaatgccaccgagatcctcctctttctccacaagattgtggaagtctttacagaatattttaaggtcctggaggaagagagtattcgcgacaacttcgtcatcatttacgagctgctggacgagatgatggactttggctacccgcagacaacagagagcaagatcctgcaagagtga

SEQ ID NO: 735 - DNA, 183 bp, A.fumigatus
ttgcgggctaaaaaggtctactccagcttggttattttgcgtgtcctagacctgtggaaaaataacgatactaaggcgcattggtcaccttggccctttaaggtcaagaaaaataccggggacgcccttgttgaaggcaaagagaatggtgggaataggcgaaaatgttccgggaatccattg

SEQ ID NO: 736 - DNA, 729 bp, A.fumigatus
catgctcaccccccagaccggttgaaattgatcgtccagcagactggggcaaaatttgtcatcagtgagcctgttgtcatggattccttgatccttgatggaactgcgaacatattgtcgttgaccgactgtggcgggagcatcaatgagcccggcctaactccttgtcaactgccatcagtgaaacccaccgacatagcttttatcatgtttacctcaggaagtaccgggacgccgaagggagttttgattcaacacgagtcaatatgtacgagcattcagtacaatggcgaagccgaaatggtaacgtcaagcactcgcggcttgcaattttcatcttatgcgtttgacacgtctgttgatgaaatattcactgttctctcaaggggcggttgtgtctgcgttccaacagaggccgagagaatgaatcatctagctgcatttatcagccgttttgacgtgaattggcttagtatcacgcccacggttgcgcggctgatcgccccgggcgaggtgccgtccgtgcggaccatcgtccttgggggggaagaaatagacccaggggtcgtaaatcattggaaaggatcatgcagaattggttgcatcctacggcccggcggaggcatccattgcctgcgctgcgtcgcccgtgacgagtgtcgttggcgatgccctgcttggccgacctgtggcctcgtctttgtgggtagtcgatccctccgaccatga

SEQ ID NO: 737 - DNA, 765 bp, A.fumigatus
atcattggaaaggatcatgcagaattggttgcatcctacggcccggcggaggcatccattgcctgcgctgcgtcgcccgtgacgagtgtcgttggcgatgccctgcttggccgacctgtggcctcgtctttgtgggtagtcgatccctccgaccatgatgccctcatgccaatcggcacggcaggagaactggttatcggtggccctcttgtagccaggggttacttgaatgacccagatcgcacctcccttgccttcgtctgtcccaagtggtcaacggaactcaatctgccgttcaacaggttctaccgaacaggcgacatggcgcgctggaatgtggacggcactctatcttatgtaggacgcctcgacactcaggtcaaactaaatggtcagcgcgtcgagttaggagaggtggaacggcacttactggcccaaccctgccttcaatgctccacgtgcgctgtgcctcagtccggtctcctcgccaatagactggttggtgtgattgggctacaaactccgcagatatctgctgcggatgaattccattgcctcgagatatcccaggctaggaccttggttccctatgcttctgatgcagaggaatctcttagggccaaattgccaccttacatggtgcctaccgtctggataggcgtccaatcgcttcccttgaacgcatccggaaagctggacagacgcaaggtgaataaatggctggaggtcttcaccacggggctggaagggtcgacggatgctcta

SEQ ID NO: 738 - DNA, 342 bp, A.fumigatus
ccatctgtacaggttgacaatttcggcttcggggccgaaaaacgccggatgcttgagctcaaagtcctaaatggaactttggcattcaggtacgtgatagccctgggtagaaattccaagatctacaataatagtgggccgaagaatgaccccgctagggatgcttttcaggctatgcttgacagcgtgcgactacccttcaatgagtgccttcgtatcgttcaggaaaatatccagctcgaccccagttttgtcaacttctatctctgggcaaaagagaaaagtattccaattgtgattctgtcatccggaatgacgcctgtgatagaggcattgctggtt

SEQ ID NO: 739 - DNA, 219 bp, A.fumigatus
aatatgcctcaaagttcctcacaaatggagggcaggcaccagtacttgaatggtaacccgaaagcaatattcttcactgatttcgacggaactgttactttgcaggactgtaagcaatatatactcgcccttttcacttcttcatattttgcgaagccattactaagaagtttatcaggcaatgactacctagtaataacctcccacactgattgttga

SEQ ID NO: 740 - DNA, 510 bp, A.fumigatus
ggtcggctggtaaaaaatcgccgggttcgccctctactggatcctccaagtctgcgatcaccaccgccacttcggcgacagcgcctacgcccgctccttccttccccgcatcgacggcgtcctcgagttcttccacgcccacatcgactccctcgggctcgtcagcaacctcccagacgacgtctggcaatacgtcgactgggtgaccacctggggcgccacagagacccatcccgacaaaggcgtccccacatcgggccgccagtcaaacagacacaccttcttcagcctcctctacgcctacgtcctcaaccaagccgcgcagctcctccacgatgtcggccgacccggccacgcagccgagtataccgcgcgcgcggaagctgtcctcgcatccgtgcgcacgcactgctacgacgggcgcttcttcacggattccacggcggcgatcgccggcgagggcgcctactcgcagcactgccaggtattcgctgtgttagctggtgcggt

SEQ ID NO: 741 - DNA, 495 bp, A.fumigatus
aaaatcgccgggttcgccctctactggatcctccaagtctgcgatcaccaccgccacttcggcgacagcgcctacgcccgctccttccttccccgcatcgacggcgtcctcgagttcttccacgcccacatcgactccctcgggctcgtcagcaacctcccagacgacgtctggcaatacgtcgactgggtgaccacctggggcgccacagagacccatcccgacaaaggcgtccccacatcgggccgccagtcaaacagacacaccttcttcagcctcctctacgcctacgtcctcaaccaagccgcgcagctcctccacgatgtcggccgacccggccacgcagccgagtataccgcgcgcgcggaagctgtcctcgcatccgtgcgcacgcactgctacgacgggcgcttcttcacggattccacggcggcgatcgccggcgagggcgcctactcgcagcactgccaggtattcgctgtgttagctggtgcg

SEQ ID NO: 742 - DNA, 612 bp, A.fumigatus
gttcttgataacgtgcggcgaatgaaacaggttgagtttgagatggattctcagagcgtgatgcgccactgctgcaagcttctcacgcttgattcggttcaagaagggccagaagggcgaaatttctacattcttcccaaattactcaaaatgggtgttcggccagatcgggatatgatgaacgtcgttttgtccaacgccttcaaaacaggtgacgagcagttggggctcgatatgctggagtatatgaaaaataatggccttgaaccagactcttacacccatttaatcctcctcaatgatgctgttgcgcgagggaatcgagaccgcgttagttcattgattcgggagatcgaatctaacgaggagctactgaagaatccttggatctcgagtaagatctttcatgctcatttcgttttcactgcgaagcatataaatccagatgacgacccggatgccgtgttctactccatgctggagatgtataacaagttacatgatattactcctttgaaggagctttctatcttaccacctgaatatacgcccccaccaggaggtgacaatacgccaccgaccacgatcgctttatttttcttcacctcgtga

SEQ ID NO: 743 - DNA, 195 bp, A.fumigatus
gctgcagcaatgatcaattacaactgggcgcaaaatccggcgctgctggcggagccgatcaacaaggggattgcggcgttgatgacggcgattgtctgggtgagtgctgcgtggtatctgaagaagggagtcaagaccaatggagtggctgttgcggctatgggggcgttgcacgcttgggctgcttttcggtag

SEQ ID NO: 744 - DNA, 477 bp, A.fumigatus
tttctaggtgatggtgtaacggatgatactgctgcgatcaacgcagctatgagcgatggtggtcgtttctccccagcaagtcgcgactcttcgacgaccaccccagcgattgtctacttcccagccgggacatatataatttcttcgtcgatcattgattactattttacccagataattggcaatccaaactcgcttcctgtcatcaaggcgacgccaggattcacaggccttggtctgatagatggcgatcagtatcagggcgacggtaaccagggttggatatcaacgaatgtcttcttcaggcaaatccgcaacttgatcctcgacctgactgctatacctccgggcactgctgccaccggtattcattggcctaccgggcaagccacaagcattcaaaatgtgcagatcaagatgagttctggcgccgggacgcagcatcagggtcttttcattgagaacggtaagccataa

SEQ ID NO: 745 - DNA, 492 bp, A.fumigatus
cggttttccggctcttatcgggtggtggaagatacggtcaaggagacgcagctcatgttgtcctattcgccgcctgttgcgccggctttgagatccctaagcatcatttttccgcgtgggtccttcacggactttgtgcgcggaagcaacccaaacagcgagctgactcaccagaagcattctgtcttatcaggcctatccacgtacctagagaagcacttggcgatgaagctgaatctgggagatctggacagcggtcaccatcctgtcaaccaacccgtgcgtctgactaaaatcgcatgtggcagcttcgtcctcgccggcgacggtaaaatgaagctggtcgctccgtcgggacaagctggttccagctctgaggatggtgctactgcagctcgtgagagcagagaccgtctgctatctcgggcgaacgaggctttgcttcaagctgttatacgtcgagctgctatgaccggcgacgagcagacataa

SEQ ID NO: 746 - DNA, 549 bp, A.fumigatus
acaatgagtcaaatgagatcatctccatacagcacacatgcgaacaaagaaaaacagaaggctcctctgcggaaaaaggcatgtcagaattgcaccaaatccaaagtacgatgtggactagaaaagcctatctgttcgcgatgcaggtcgaaaggccacagctgccaatatcccccggggcgcgtcgctgcacctcagattggggtcactggtaccgctaacgacatcggagaagactatacagcgcttcttggcatacaaggatatgtagactccgccatagttccggcaccagcgtctttgataccggaatccggccgagctgcggcttccaggtctcctcgtcctcgtgctgtaaccagcggacagaccagacgcctcgatctcgattttacggatatcgacttgacacccagtctaaacgcagtagatattcgagaccgatggctgagaccgtatctcctcccacctctaggacgagacgagattctcaaggcctaccatctatttacgctgcaggtcctcactacggagtgccgatcgccctag

SEQ ID NO: 747 - DNA, 495 bp, A.fumigatus
  unsure (468): Identity of nucleotide sequences at the above locations are unknown.
ctgatgcaatctctaaaggccaccaccgtgcaaggtatcgagcgattgatcaaaaccgcgattgtcgacaagaccccttctgtctcctccgccgctctggtttcttcataccacctccttccaattgcgcgcgatgtcgttcgtagatggcagagtgagacgcaggaagctgcatccgcatcgaagtcgtcgaccggtttccttggcttcggcggcagctcctcgagtcacgctatctcacaatcaaacttcatgactcaatatcatgccattggtcttctgttccagatgcgctcgcacgataagatggcgttggtgaagatggttctgcagtatggagcagctggcgttgtgatgagccccgccgcgctggtattgttggtgcgattaacaaccaacttggcggaggaggatccgggcctgacgaaaccgatgatgcaaatgcttgatggctggctccggcataancatgaaatggtcaacttcgatgcggcg

SEQ ID NO: 748 - DNA, 306 bp, A.fumigatus
tatgtgcggatctggctgtccgtggtgaagacgagcaatgtccctacgaatgaggcgaccactctgttcttcggcatttcgaagctgtttcagaataaggatccttccctgcggcaaatggtctatctgattctgaaggaactcgcgaacacggccgaggatgttatcatgtcaacaagcattatcatgaaggataccgctgtcggtagcgacatcctctacagagcaaacgccattcgggctctgtgccgcatcattgatgtgagcatccttcgttatactacattccttaagcttagtagctga

SEQ ID NO: 749 - DNA, 339 bp, A.fumigatus
caggccaatttctccccagccaagattggcatcacagagtacgccgccaagtcccttggtgatgtcgtgtttgtagagcttcccgacgccgaccttgaggttagcgctggtgaggccgtgggtgccgttgagtcagtcaagtcggcttcagacgtcctgtcgcccgtctctggaaaggttgtgcaggggaacagcgttctcgaggacaatgccaagttcatcaaccagagcccggagggtgacgcctggatcgccaagatcgaggtcagtgacgttgcggagttggatggtctactcgatgaggccgcctacaaggcgagcattgacgcggaccactaa

SEQ ID NO: 750 - DNA, 225 bp, A.fumigatus
ttctttaggaaatttatcctccgtacctttgatcaatcaatccactactggcaatcagatgttgaacacttcaactctatatcagatagtcatatttcgttcggtctagacatttcttctagggaccagactatttttatgagtgatgctgttctcttctattccagaaacgagattgaatacctccggcttatccccgagtacctgacagccaaggccatttag

SEQ ID NO: 751 - DNA, 285 bp, A.fumigatus
ttgtacaccattcccatcatggtgtacaattaccccggtgtggcggcggggctggacgtcgactctgatatgctggtgaagctaagcgcgcatccgaatatctcgggcgccaagttgacatgtggaggtattgggaaggttccccgtgtgacggccagtgcggtgagaccattcagcgtgcttggtgggcagattgactggatgggccctgcgatggccgttggtgctgttggggcaattacggggatggcgaatctgtacccgagggtgagtatctttttttga

SEQ ID NO: 752 - DNA, 249 bp, A.fumigatus
  unsure (38),(40),(49): Identity of nucleotide sequences at the above locations are unknown.
tcattgaaccgaaaggggaagcttgaagacatcgtgtntngagtatccncaccagacacttcccccgggttagacggatgtacgagtacatacggaatactcagcctaagcatctccttcctgcaacaactgaaccagcttaatggtggcttagtatattcaggagtgcaaaactgcaagacttcgccatctcaaggtttcaaggtacgaaacaccttggcggagaatacttccgaaggcagtctatag

SEQ ID NO: 753 - DNA, 408 bp, A.fumigatus
  unsure (18),(56),(143),(337): Identity of nucleotide sequences at the above locations are unknown.
tccgtggcggttcagtcnctgcctcgacgcctgacttgtcggcggagaataccganactcaggacagctgtgaatacgcccaatttatcgaggagcgctttcggccggaacttgagcgttttactggctgatcaagcgaaacnagctgtgcgcagacgaatcgcgggagttctcactgctaatgttgatttaagtgaggccctcaatgaagcatcaggaaagggtaaaattacagggttgaccaattccgatgtttttctcttccccagttggtatgaagttcaatcttcaaatacgccaccagaattcttctgggcactaaaagttcccctgaaanaacatatgcctttggaatccccccacatagaaatccctccagaagccttgaaaaaatggggtcctgggttg

SEQ ID NO: 754 - DNA, 633 bp, A.fumigatus
  unsure (520),(558): Identity of nucleotide sequences at the above locations are unknown.
tacgaagaaagagaaccgtggattgtgagaaagatgaaatgtggctaccctcgcttcttcattcatcccgtcattcaagatcttgcgacggaagttgtaaaacttcatggaaatcccaaaacagaaacggcctcgttgttcccgtcactcaagactgcaagcgtatgccggtcattcattctttcgaggatttcctcccaagaatcgcccagaatccgtattgtcaacttcgttcctgcccctcacacagagtcccggccacagacaataaggtcgcccctgtcgtgtgtgatttatccaacagaatatgcttctatcgccaagcaagtatggcaacacagtggaaatggaatatcaagtcgccggggcgaattttgtctaagcgcgctacgagatggattccttgtggaggataaggaacctgcacaggttgaccaatcatctcagaaattttctaagggtccacggcgatatcagggaagaggatctgcgaatgaaatagtccgtggcggttcagtcnctgcctcgacgcctgacttgtcggcggagaataccganactcaggacagctgtgaatacgcccaatttatcgaggagcgctttcggccggaacttgagcgttttactggctga

SEQ ID NO: 755 - DNA, 342 bp, A.fumigatus
  unsure (96): Identity of nucleotide sequences at the above locations are unknown.
gtcatgtttggagcgctgaacagatttatcgggcgactggacgcggagcccgtccagcacccgcggactcccagcggagacaacgcatttggcttncaggtcctccgtaacaaagaccccgagctacctctagaaccctggtttgattttattgttggaatcaacgggcattctatcgtacgtgcattgacatttgccattgtaaccgaactaaccggacggctgcaggaggaccccgacccaaacctcttcgcaaccgaagtgcgcaactgcgcagggacaagcgtcacattcgagatttggagtgcaaaggttcgcatggattggacttgtcaccaatag

SEQ ID NO: 756 - DNA, 786 bp, A.fumigatus
  unsure (579),(601),(742),(751): Identity of nucleotide sequences at the above locations are unknown.
cggacacagggccaaaaaacacacagcgtctctataccagtacccgcctcgaatcccacactcggtctcgccttacaactagcccccctttcctcgacacaacatatctggcatgtgctgtccattccatccccgctgagcccggcctatcgcgccgggctcctcccgcactcagactacattatcgggacgcctagcgggacgttacgaggcgatgcggcgctaggagagttggtggaagaccatctgaaccggaccttggtactctgggtatacaacagcgaattcgacgtggtaagggaggtggagctggtcccgacccggggctggggcggtgaaggcgcactcggcgcagaactaggttatggggcgctgcaccgcttacctgtcgggctaggcgaggaggtcgagggtcccggcgaggtcgttttcgagacgagagaggacggcacctctgcgccgatggcacatgcgacggatgctggccagacagcggacaccggtgcgggaagcttcttagttccagcaaacatggtctcgcctccgccattatctgctccgaacagggccttgtcgtcngcgtcgccgtcgaataaccggntccctgcaacgccgcgaggtggccgaacccgtcatatgggcgtctcgcccaaccttgcgttcgaagagtactttggcccaggggagcagaagagcaagggagcaggattatatcccgttcccggaaaggggactcccttgncttcggcgncccaagccccgaatcgcgttggcttctgttggtaa

SEQ ID NO: 757 - DNA, 186 bp, A.fumigatus
cctagttctgcgccgagtgcgccttcaccgccccagccccgggtcgggaccagctccacctcccttaccacgtcgaattcgctgttgtatacccagagtaccaaggtccggttcagatggtcttccaccaactctcctagcgccgcatcgcctcgtaacgtcccgctaggcgtcccgataatgtag

SEQ ID NO: 758 - DNA, 183 bp, A.fumigatus
cgtgcggtgggtattaattacatcactttctcttgtttcaccattcgaaccaaacactatcccacctctgaagaattcaggttcccatcctcgaatggacatcatcaatacatcatgagcagtattatccaaacagcagttacactgaaatctcattctgctgaggctcaattcgagtgctga

SEQ ID NO: 759 - DNA, 294 bp, A.fumigatus
ctgaccctatcagcgatgtctcaaattgagctgttcggtgacaatgagcatttcacaacgttactagcggacggagtctgcatagcgacgcctaccggctcgacagcatacaatctcgcagcgggaggttcactgtgtcatccagagaaccccgtcattcttgtcaccgcaatctgcgcccacactctgtctttccgaccgattatattgccagacaccattgttctacgtatgggagtaccttacgatgctcggacaagctcatgggcaagctttgatgggcgagagaggtga

SEQ ID NO: 760 - DNA, 423 bp, A.fumigatus
gcgggttataggttgtgctcagcgcctgtgaagattctctacacaagttggctgtttcagcatgtcgtaccacccgtactctcgttttcactggggtctctgggattcctgactagattcgatttcaaccagtaccagagcacactagagactgcgttcaaggacggtgtcgtggtaagcctcagactgaggttcgagtgcacaatcatgaggagcaatcggcggtcggaggacgacgcaacaaacataacgaagcgagatctcgtcgaagagctgataggagaggagatggaaggaacattgacccatcgaccggacaaggttttccagatcctcaacgatgttgtgcttgacagaggaccgaaccccagtaagagcatccctgaagcactcggccttgcctggaaatgggctcctgactga

SEQ ID NO: 761 - DNA, 570 bp, A.fumigatus
ttccgaattacctgccagcgggtagaccaactcatggtcaacccaggcgacggctcagctgagaatgccaccgaagtctgtttcgcttttgtggagtgggtcaatcgactcgagcaatgggagcaaatggtggagcgcgaagaagggggcacatacgagaaatcgtccgaaggagaacaagcagcacagctgattgatccgggcatcacaggccacactctctggtttccaagcgttaccatagcgaatgtgttgacccacctctgggctattcatatcgtttgtctcaaggagattgacaagctcagggcgactttcagcagtaatgtggagccttgtatacccgcaaagttctgcagtgtggaataccagcaaacccaagttctcactctctcgaagcggatctgccacagtatggagtacctgctgcaggatgaactgaaacttttcggaccggcttccactgctttccctctcaaggtggctcatgactcattcagagagtgtgggacgactcaggagggctatatcaagttcgttaactccagactccgtccacttgactcgtaa

SEQ ID NO: 762 - DNA, 564 bp, A.fumigatus
  unsure (13): Identity of nucleotide sequences at the above locations are unknown.
aaaaccgcctgtntacagccgccattttcgccgaccgaagccccgaaggccattgaaccccgcaaaggcgaattctccgaaaagaacaaccgcatctccatccagtccgtctccgcgtcaagctcaagtggacaagatcccgcgagctcaagcggctgccttgccggcggaggctgctgctgcacagctgcggtagaagacgaggatgaaatcaccgaacacaaatgtacttgttccggaaacgctccggcatcagaatcctcaaaaccaatcccaacggctgcagctgaaaccgaggaaacacgccaactcaaagcatcggcgcagccagaacctgcgcaatcccaccacctcaacctcctatctggccgaccgcagccacgcatcatcatccgcaaggtccttgagaaagcagaaggcgaaagcgccgtcgttgtatgcggaccagagggactctcagacgacgtccgccgcagcgtggtgtatctcagcgacgaacgggcggtccacaaggggaccggcgcccaggggatctacctccacgtcgaagcattcggctggtag

SEQ ID NO: 763 - DNA, 597 bp, A.fumigatus
  unsure (2): Identity of nucleotide sequences at the above locations are unknown.
anaccggaccgtctggagcgttctgcagcgatcaaatgccccaccgttctgaaccagttggcaggatctaagattatacaacaagtactggcagagactgcagggcccgatcaccttgcgagtttcatggcagacaccgatccggccactattgctcgcttacgagaaacatttgcgcctcaatacgacctttcttcaagtggacgcggccgagaattggctctgaaccccgaaacagctgtcaatcacgtcctcaaaccgcagcgggaaggaggcggcaacaacgtttataagtcagccattccggactttttacggtcaattccagaaagtgaatggaagcgatggatcctgatggaactgatccgtccacctgctgaggccaagaatgtggctttgaggagtgatggcgaggttctcagcggcaaagtcattggggagttaggtatctatggcaccattctctgggatcaatccaatggaaatgtcctgcagaacgagcaaggcgggtggttgatgaggaccaaggcgaaggatgttaacgaagggggggtggccacgggattctccagtatagatagcattcttctttactaa

SEQ ID NO: 764 - DNA, 216 bp, A.fumigatus
tattcatcaatcaatcaatcaatcatagccctggacccccagacaacgccccccattctagccatcgccgtccgcgaaggcgactcccccttttcgtcaaacaacaagaccagcatctgcatcataatcgagctcctaaggccctgcacctccttccgcgacgaagacgaccatgagtctacaccacggggctggaaggatacgcggggtgtctat

SEQ ID NO: 765 - DNA, 396 bp, A.fumigatus
caggtggaacctattcttcagtgttgccgaaattggagggcagtgcataccgcggcgggtttggccgagctcatgaacaaccagcaggcccacaagacggagcagaagcagggtgatatcgaagagggtctcaagaacgactcgcacgcaaaggagcgcgaaacgcacggcattgaaaccccgtccgacagcagcagtactgatgacgataaactgcagcgcgatctgacggaaagcaaggcgtaccggaaccgccgtaaagtggcgctcgtccagggtctgaaccggccgttcttccatatcgacctgaccagtgcactgcagagtgcattggccaactcggcgccggaccttcatgtcgatcctgctgaggtgaatgccacgactgatgcttaa

SEQ ID NO: 766 - DNA, 810 bp, A.fumigatus
  unsure (522),(534),(543),(548),(557): Identity of nucleotide sequences at the above locations are unknown.
tacttatctgttcctcttcattatctggagcacacaaagctaacaaaaagcagaatgtggattgaacttggccaagtcttcgaccgcctctcgcaggacccctccgtccgtgccatcgtcctcagcggcgcaggcgagaaagccttcaccgcaggcctagacgtcaccgccgcatcgcaaggtctcctgtccgcagacggcgaccaggcagtcgatcctgcgcgcaaagcggcccatctgcgccgtcacatcgtctccttccaggactgcattacggccgtcgagcgctgcgagaagcccgtcatcgtcgcgatgcacggcttctcgcttggtctggcggttgatctgtccacggcggcggatgtgcgcgtctgcacgcgggacaccaagttcgccgtcaaggaggtggatatcgggcttgcggcggatattgggacgttgagccggttgcctaaggttgtcgggagctttgggtgggcgaaggaagtggcactgacggcgaggatatttggggcgggagangcgctccccctngggtctgtnactcnggtgtttgncattttcgccgccgtctttgtccgtcgccccgttctttgcttcccctggcttgtccccctctccctttccttccgcccttttttttcccgtttctcctcctttcctcctcctcttcttcctcctgttctcttcgtcccccctcttcctgttgtttctccccttcttccttcttgcttccctctcgtgttctcttcccttcggtttgtcctccctccccgtcttttcccgctttcctgcccggtttctttcctg

SEQ ID NO: 767 - DNA, 189 bp, A.fumigatus
  unsure (75): Identity of nucleotide sequences at the above locations are unknown.
gcacttatcaacagaacggagaagcttcaaacatcactagtcgaagcaaggcagaatcataacaccatggcaganaacaactacaattcattcaagtacttcattatccggtttccagccgaacatcaatatgtcgcccacgtggagatcaaccgcccagacaagatgaatgccttcttcgaggcgtaa

SEQ ID NO: 768 - DNA, 654 bp, A.fumigatus
  unsure (254),(263),(268),(277),(289): Identity of nucleotide sequences at the above locations are unknown.
caggaaagaaaccgggcaggaaagcgggaaaagacggggagggaggacaaaccgaagggaagagaacacgagagggaagcaagaaggaagaaggggagaaacaacaggaagaggggggacgaagagaacaggaggaagaagaggaggaggaaaggaggagaaacgggaaaaaaaagggcggaaggaaagggagagggggacaagccaggggaagcaaagaacggggcgacggacaaagacggcggcgaaaatgncaaacaccngagtnacagacccnagggggagcgcntctcccgccccaaatatcctcgccgtcagtgccacttccttcgcccacccaaagctcccgacaaccttaggcaaccggctcaacgtcccaatatccgccgcaagcccgatatccacctccttgacggcgaacttggtgtcccgcgtgcagacgcgcacatccgccgccgtggacagatcaaccgccagaccaagcgagaagccgtgcatcgcgacgatgacgggcttctcgcagcgctcgacggccgtaatgcagtcctggaaggagacgatgtgacggcgcagatgggccgctttgcgcgcaggatcgactgcctggtcgccgtctgcggacaggagaccttgcgatgcggcggtgacgtctag

SEQ ID NO: 769 - DNA, 564 bp, A.fumigatus
  unsure (253),(262),(267),(276),(288): Identity of nucleotide sequences at the above locations are unknown.
aggaaagaaaccgggcaggaaagcgggaaaagacggggagggaggacaaaccgaagggaagagaacacgagagggaagcaagaaggaagaaggggagaaacaacaggaagaggggggacgaagagaacaggaggaagaagaggaggaggaaaggaggagaaacgggaaaaaaaagggcggaaggaaagggagagggggacaagccaggggaagcaaagaacggggcgacggacaaagacggcggcgaaaatgncaaacaccngagtnacagacccnagggggagcgcntctcccgccccaaatatcctcgccgtcagtgccacttccttcgcccacccaaagctcccgacaaccttaggcaaccggctcaacgtcccaatatccgccgcaagcccgatatccacctccttgacggcgaacttggtgtcccgcgtgcagacgcgcacatccgccgccgtggacagatcaaccgccagaccaagcgagaagccgtgcatcgcgacgatgacgggcttctcgcagcgctcgacggccgtaatgcagtcctggaaggagacgatgtga

SEQ ID NO: 770 - DNA, 645 bp, A.fumigatus
ttccccaactttgctgttttcttttcttcgttcgcccactttggaacaatgcgacctttccgtcttgttttgctcgtatggcccccactgtacatgctcgtcccatatctcgttcttctgccttcaattctgcagacagcagcagtttacgtgacgttcatcagcaaaattacgttgcacgtcattgccttcccttcaactgctattctgcttgccaatgctgctccatcttccaaggttctcggttcgatcaacggtgctgccgcctcgactgcgagccttagccgcgccttggggccaacaatcacgggtctgttgcactccaagggtctcgaaagcggctactcgattatcgcatggtgggcatgtggcctcgtttgcgtcaccggtaccatccaaagcttctggatggaggagagcgagccacgcagagacagcgagaaggctggcaacagtgattcgactgcaggaatccctatgcggagctccttccctgcgggcaaagagtatgccacgcccgaagaggaacgcagactgctctcttctacgcggaccagcgtcgatgatttggacatttccaatttagatttgacgcaaatcgaaccagcaccccggtcgaatccacttgcatttgccgaggactga

SEQ ID NO: 771 - DNA, 651 bp, A.fumigatus
aaaggaaccgccccaccgttggagggatttgcaatttccattaacggttggaaccgttgcaaaatatggggcccaaagagccaaagtctatggccaataatgtattcaagtgccaccaacggtagatcgcatgagcttgtggatcagttcccaagcccttggagttatagcgggcaacaactctctgtcataggacgcagcagtttagcagcgcttccgcttgcacctaagcttcccattccgcgatcgggctcgaccccaaccagccgccaacgcacaccgcgcgcctgtgaactatgtcgtgagcgcaaaaccaagtgtgacggcgcaaaaccgatctgcaaacagtgtcggctactgaagaccgcctgtacttattctggttcgaaacgcgaaagacagcagcttgcgatcgaatgtgcccgagcgaaggtcaaggtttacgaatcagtgctgcgacagatctacgaggaaagccgtgaaaacggtcgcacctccattgaggagatattccatgttagtctctccacttgcccctatcgcgcgctttcttattatcctgtgtctggccgtgctaaagtcgtgacagaaacactttcgcgcttcaccagaattattctcttcgctcctcggctcgaagtcgctgtttga

SEQ ID NO: 772 - DNA, 606 bp, A.fumigatus
gtggtgacgacgtttgaggcaatggcagtgatcttcacagccattttctttgatgcggaaccggtcaaatctttcgaactacgccacaaggctcgcgaagcagcgaataaactgggtaggctggtcgagctcaacgtcaaagctatcaagtcgtctggtcttattgccactctgcttggcaatatgcctgccaacaggaatgcactcttcgagtatggagtgcacatggtggagcgtctgctgcagagtggcctggatcctgaacaggtgacatggtctcaagttctgccgactgccgtcgccatggtgccgaatcaggcccaagtcttcactcaaatcatcgattattacctatctgataagggccggaagcatctgccggacatcaagcgctttgccaaggaagactctcccgcttcggacgaagttctcctccgctactgcatggaagcgatccgcctgaacggcatctttggctcgtaccggaaatcccagaccaacctgaccctcgacgacaagcgcggtaaggttcacatcaaggcaggtgacaatgtattcgtgagctttgtatgtcttctgtgcagaattgctatcgttcggtgctga

SEQ ID NO: 773 - DNA, 489 bp, A.fumigatus
  unsure (277): Identity of nucleotide sequences at the above locations are unknown.
aacgttcccaggttctcagcgaccttgaacggagcggcagtcttgctgcggatctcgtcgacggtcacgccctcggcggtctcggctagggtcagaccttcggttgggctgacatcaaagaccgccaggtcggtgatgatcttccagacacagcgaggaccggtgagggggaaggtgcactcgggcaagatcttagggttgcccttcttatcggtgtgttccatggtgacaaccaccttggtcttctcgggattggcgacgaggtccatggcgccgncgacacccttgaccttaccagggagcataaagttcgctagatcaccgtatcgggtaacgtgcagggcaccgagcatggtgagatcgaatcggccagcgcggatcataccgaaactttcgtgggagccgaagacggaggcgccggagctcaggatgacggtttccttgcccgacttgatcaggtcgggatcctcctcgccgggcttgggttag

SEQ ID NO: 774 - DNA, 192 bp, A.fumigatus
  unsure (33): Identity of nucleotide sequences at the above locations are unknown.
acactatcgcggtcctggcgcctcgggctgttnacaaggcgctacgtcgacaaggttattcagagcacggaaaagatcatgatcgaaaagctcaccttcgccaaggatcccagcgagatgctccaggctggtatgcaggcttctatcattctgatactatatctccgtgctaactgctccaggatctggtga

SEQ ID NO: 775 - DNA, 336 bp, A.fumigatus
ggctaccgctcgccgcgaacacatcgtcaagcgcgccgccaacgaactccaggactgcatgttcgtcaacctcggtgtcggtatccccctgatcaaccccgcctacctccccgaaggcgtcaaaattgtccttcaggccgacaatgggatcctcggtctgggtccctaacccaagcccggcgaggaggatcccgacctgatcaagtcgggcaaggaaaccgtcatcctgagctccggcgcctccgtcttcggctcccacgaaagtttcggtatgatccgcgctggccgattcgatctcaccatgctcggtgccctgcacgttacccgatacggtga

SEQ ID NO: 776 - DNA, 207 bp, A.fumigatus
tactatatctccgtgctaactgctccaggatctggtgaggctaccgctcgccgcgaacacatcgtcaagcgcgccgccaacgaactccaggactgcatgttcgtcaacctcggtgtcggtatccccctgatcaaccccgcctacctccccgaaggcgtcaaaattgtccttcaggccgacaatgggatcctcggtctgggtccctaa

SEQ ID NO: 777 - DNA, 489 bp, A.fumigatus
  unsure (209): Identity of nucleotide sequences at the above locations are unknown.
cccaagcccggcgaggaggatcccgacctgatcaagtcgggcaaggaaaccgtcatcctgagctccggcgcctccgtcttcggctcccacgaaagtttcggtatgatccgcgctggccgattcgatctcaccatgctcggtgccctgcacgttacccgatacggtgatctagcgaactttatgctccctggtaaggtcaagggtgtcgncggcgccatggacctcgtcgccaatcccgagaagaccaaggtggttgtcaccatggaacacaccgataagaagggcaaccctaagatcttgcccgagtgcaccttccccctcaccggtcctcgctgtgtctggaagatcatcaccgacctggcggtctttgatgtcagcccaaccgaaggtctgaccctagccgagaccgccgagggcgtgaccgtcgacgagatccgcagcaagactgccgctccgttcaaggtcgctgagaacctgggaacgttttaa

SEQ ID NO: 778 - DNA, 186 bp, A.fumigatus
attaggttgacccaagggcccataatgctttggtccaatgttccccattattttaaagtcatctggttaccccacgcaatccatgttatgcctataaccgagtattatgttatctttatacaaactttccttttttacttagtctacagccagaatgtgtttctgggtctaaagacggaaagttga

SEQ ID NO: 779 - DNA, 297 bp, A.fumigatus
agatatggaccactccttgacagcacatccctggataagcatacaacgctttcctttagctatgagtcatatttacctcatatcatattctgtgagcatgactttctgcatactagtttagacatgagccagcctacaactgatctaattatccagctgcaactgcaacatgccgatcattattttgaagcctccaagggaaatcgcgcaaccccaaggaccaagagctatagttcagttaacagaaggaattgcaaggtattcatcagtcacttgtggatagatgaatggccatga

SEQ ID NO: 780 - DNA, 696 bp, A.fumigatus
gaacacatcatggctgataaagacgcctccagcacccccaacaccaataccatctacgcccaatcgcaccgcaaccaaacctactccatcaccaacaaccctccttcagaagaacacccccgccgagccctcaaaccaggcgtctacatcccgctcctcgccttcttcgcccccgaaaccgaagagctcgatgagtctacagttgcccagcacgccatacgcatggccaaagccggcgccatgggcctcatcacccaaggcacctacggggaagccgctcacctctcccacacagaacgggcccgcatcaaccgcacaacacgccacgccgtcgcagcagcgggatacccgcagctcccgctgatcgccggctgcggcgcgccgtccacaagcgagacgatcgagctgtgccacgatgcgttcgagtcaggcgcggactacgcgctcgtcctccctccgtctacttacaaggcgcagtacacgcttccgagccttaaggcctatttcgaggatgtagctggtgcgtcgcccatcccagtgctggtgtacaactaccccgccgtgatgggcgtggacctcgacgcggagacgcttgtgtcgctggcggaacaaccgaatctcgtggggtgcaagcttacctgtaacgatatcggaaagctgtcttctacgcccagcggccgaaggaacgagcatggt

SEQ ID NO: 781 - DNA, 828 bp, A.fumigatus
ttcggaatcagggcaaccctaaatgtgttttggcgctttgtttgggacatcctccaggacaatgcgaatctccagatgggaatcatagagttacgggagatgttcgaaagctcgaaccaggaggtgcagaatttgcgagatcagatcctgtcgcatcagcccttgacttcaaccggtgaaatcgatgagcgagagccccggccgtcatcgataacattgaataacgaactggaatcgaaagaatcgcgccgcgtctcgcaagaattccacattcatcatcattaccatacccctgccatctccgtcggctccaagaaggagaaaagcaccatctttcgtcggtcaaaaaagagacggtctctgggagccaccacagtcatgcactcggcgtcgacctcccaggcgtcccggaagttctcgcaccagcaccagtcatccatctcttcgacctcaactattttgtctcagacgtctgtgtcaattccgccggccgcagcttcccgccgttggtcactgcaatcacccgctgccgattcctcgctagcgagctcgccgcagtcagggtatcgagcatcatccatcttcgaccgggtggaacgcggttgcgaatcgtcacaaccgactagtcctgaaagcacggctgtctcgtctccggtaatggcctcgcgccacaagaacgtcccttttgatgtacctttccggcccctggatggacttgaaagaacagagagagtcggtgatgattcaatgcacttggcatacgatgattctggggaccacccgaataatgtgccccacgagggccaaggatccgcgcaaagttacggc

SEQ ID NO: 782 - DNA, 327 bp, A.fumigatus
atggagctactccgaaggcgcgccaacccggatgtggaagactcttacggattcgccctcacgcaagccataagaggcggtaatgttgagctcgcaatggagctactccgaagaggcgccaacccgaatgcggaggactcttacggattcgccctcacgcaagccataagaggcggtaatgttgagctcgcagtggagctactccgaagaggcgccaacccgaatgtggaagactcttacggatccgccatcacgcaggctagaggaagcggttcaaagaggttagaggaggcgtttctgggctgtttttcagacttctgtggatag

SEQ ID NO: 783 - DNA, 756 bp, A.fumigatus
  unsure (82): Identity of nucleotide sequences at the above locations are unknown.
ttcggcaccctccgctttcgcacattcgtcgcatcatcacccatggaaaactacaccattcccctagaaaaggctgtcgacntgatgcctgtgtcttcgcaactggtacgcctcttctctccagttgttttcccttgctctggtactcggtcattccctatccaatatactgaacttcgtcctcaggacaccttcaccaacgctcaagcactgtggagctttgtgggcggatatggagtctacggcggatcgactgtcgcccactgtcttgtggccgcccaaaagaccatccccagtgattatgttgcccattccctctactgtagcttcgtgccccccgccaatccaaagcaacggattgagtatcgtgttgaacgaacacgcgatgggaaaagcttcctcacgaggaccgtccacgccacccagaaggccaaggtgatctcagcatcaatcgtcaactttgtacgggcgggaacatacagtaagagcagcgacactgacagggcaggaaggctcgaacacgggccaaaaaggcccgaggggttgacagtacccgatgaagccgagatggatgggaaggggatcgatgggccatttgagatgcgctggggggaagttgtgtaccgtgggtcgttccctggctctagccgtgcttggggcttgctcgctctttggacttgcttagatctaagatggataaacagaaaggtccgacgacttggtccacactcggatccgatactggatgcgagctaa

SEQ ID NO: 784 - DNA, 240 bp, A.fumigatus
acagaaaggtccgacgacttggtccacactcggatccgatactggatgcgagctaaggaacccatgcaacagacggatcctcaggtccaacttgcggcgctgtcatacatgtccgacgcgtatttcattggtgctgcagtacaggtatatgatgtgcccggtcagacgttcgggaccaaaatggccatggcagctagtttgaatcatgcaatttacttccaccaccctgacgcgggtttt

SEQ ID NO: 785 - DNA, 420 bp, A.fumigatus
aacactgtcggatccttccagccccgtggtgaagacccgttgcatgtacagctcacactcagtcacttcgccatgtccagcgccgatctgggcgtcgatgagtcgttcgcgcagaagatggtgcgcacgaccatggacgttgattgcccgccgtggctggactttctacatggtggcctcaatttccaggtggtgcaccatcttttccctcgcctcccgaggcataacttgcgccgggcgcagccgtatgtcaaggaattctgccgcgacgttggaattccctatgtcatattcggttttacgcgggggaacaaggaagtcattagtagactgggtgaggttgccgaccaattgagggtattggaggaatgcagaaaggttgctgcgaaggatttgatcgggggtcgccatggccgttga

SEQ ID NO: 786 - DNA, 267 bp, A.fumigatus
catttgtctagatcacgagcgaacctgaccattctgggctcctttaccggacttttctgcaccgtgggcttcttgaactcgtttggtgcctttggagaatactatgcgaagaatcagcttgcgaataagtctgaatccacaatcgcatggcttggagctctcagcatcttctttgtattgtccgtgtccgtagtgtctggccctatactggacgcctttggaccaagggtgcgtcccccatacattcttgaaatgttgtgtagctga

SEQ ID NO: 787 - DNA, 582 bp, A.fumigatus
ctttggtcctcctctgattgccgacatggacacggggtacggaggtatgtattccccactcctcttcaagcgcctaggctaaccacaccaggcccccttatggtcgccaaatccgtccagcaatacatccaagccggcgtagccgggttccacatcgaggaccaaatccaaaacaagcgatgcggccatctcgcaggcaagaaagtcgtgtccatggacgagtacctgacccggatccgcgccgcaaagcaaaccaaggaccgcctccgctcggatatcgtgctgattgcgcgcactgacgccctccagcagcacggctacgacgagtgcatccggcgtctgaaggcggcgcgggaccttggtgcggatgtgggtctattggagggattcacctccaaggagatggcgcgccaggcggtccaggacctggcgccatggccgttgctgctcaacatggttgagaacggggccggcccggtgattacgaccaaggaggctaaggagatggggttccggatcatgatcttctcgtttgcgtcgttggctcctgcttatctcggcatcaaatctgccctagagcgg

SEQ ID NO: 788 - DNA, 327 bp, A.fumigatus
gggactactgacaccattagcaacggcaaaatgttctatgggattctcggagactccaacggtgacagccctcaggtgaccggcgaggcgtcctggttgatggcccggacctgcttccccaacgagggcctgaacggcaataacggccacaccggtgtcgatgtaacctgtatgttcttttcggccattgctcttcccgcgctaatgcaagcagacatcgtcttcaccggcaagaatgcagtgctccccagcagtgccttgacgaaaaactacatcaccaacttgtcttcaccacggggctggaaggatccgacagtgtgcgaggat

SEQ ID NO: 789 - DNA, 492 bp, A.fumigatus
ccaacctacagcccggttctatcctcatctcctactctttcgtcggtttcatcgtctatctggtcatgtgtggtctgggagaaatggccacttggttgcccatgccctccggcttcactggctatgccgtccgtttctgtgaccctgctcttggattcgccattggttggacgtatgtcaatctatcatggtttaccgtcaagactgcgtcgcgtcgctgacacctttggccactacaggtactggtttaaatatattatcgtcacaccgaaccagttaacggccggcgcgctggtcatatcattctggatcgatgcctcgcgagtcaatgcaggcgtgtggatcacagtcttcctggtgttgattatctccatcaactactttggtatccggttcttcggtgaatttgagttctggctgtcctccttcaaagtgatcgtcattgtcggtctgattctgctctccttcattctgatgctgggcggcggcccc

SEQ ID NO: 790 - DNA, 228 bp, A.fumigatus
caactaaccaacctacagcccggttctatcctcatctcctactctttcgtcggtttcatcgtctatctggtcatgtgtggtctgggagaaatggccacttggttgcccatgccctccggcttcactggctatgccgtccgtttctgtgaccctgctcttggattcgccattggttggacgtatgtcaatctatcatggtttaccgtcaagactgcgtcgcgtcgctga

SEQ ID NO: 791 - DNA, 396 bp, A.fumigatus
acctcaatcataatggctgaagtcgcagagaacggtcctgtgccggtgaacaatgagaacaccgctcctggcgccgctactgaagaaaaggagcagaccgagaagaccgagcagacgaatggcgatgctgttacagtattccatgaccccgagaatttcaacgtgaagcatccgctcatgcacgaatggactctctggttcacgaagccacccagtggcaaggtacgtgccatagccatcgatatacgggtagactcgttaacactgtttgatttgcagggcgacaactggaacgatctgttgaaggaggtcgtgactttcaactcggtcgaagaattctggggtatctatgtacgtcatttcatttatcgatgcctgtctggtgagctatactga

SEQ ID NO: 792 - DNA, 399 bp, A.fumigatus
aacaatatcacaccaacttctgaactgggtctcaaggcggactatcatctcttcaaaaagggcatcaggccagagtgggaagacccccagaacaagcacggtggcaagtggtcatactcgttcaaagacaagcgctccgtaccgatcgacgatctttggcttcacgctcaactggcagctatcggcgagactcttgagaacgatggtgacaacgaagttatgggtgtggttgtgaacgtgcgcaagggattttaccgtgttggtctgtggacacggaccgtgggcaagagcattcccggcgacaagaacggccggacacccgctcaagggaaggagattctcgaaaacatcggtcggcgcttcaaggaagtgctacgcctgaaggaaactgatgtcgtt

SEQ ID NO: 793 - DNA, 510 bp, A.fumigatus
gacgctggagtctcaacagtgcttgggttgtgtgttttcattctcagcattctttcgctctactgggccgtccaattccggtcggaagacaggctgcacactttgaccgtctgggtggtcgatttcgataaccaggtggacccatacaggaatgagagcatcacgcccattgttggaccagccgtgacagatgtcgcgaatcggcttatcaagtcggagagagaacacgtgggatatgaaatcagatcgccagcagacttcaactttgatccttgggcggtccggcaaggggtctatgatgaacatgcgtatgccgcaatcattgtcaaccctaatgctactactctcctatacgaagccgtgaccaacggccactcgtcgtatgatcccactggcgctgctcaatttataatcatcagcgcgcgtgaccaggccacatattccaactacatcgaaccggccttgtcctggttccagttggaagttttcgccgaatttggccccaggtga

SEQ ID NO: 794 - DNA, 297 bp, A.fumigatus
ccttgccttcagaagtcccggaaagccatggccgactcaagtgactatccggatttccgattcgtgaagttggcaatcggtgtcccggacatgacaaaggccatggagtatatcaggagtcacaatgttagaatactcaaagaagctggcgtgactcagggttcagaggtcgtggctactttcctgggttgcgatatgcccgacaagggatttgacaggcctttgtgggaagccgccgtggctgtcccttttgtggaagacccagatggatacctcattgaaataatcccatattga

SEQ ID NO: 795 - DNA, 285 bp, A.fumigatus
  unsure (4),(10),(12),(13),(14),(15),(23),(32),(33),(57),(147),(151),(179),(196),(223),(224),(262): Identity of nucleotide sequences at the above locations are unknown.
gaanagaatntnnnngagcgtcncgaatatgnncgaatccccgaaagaaagaaaatngaaaaagaaaaactgtcggcagtcagcgaataccccttgagatttgaatgggcaagttgggagctcggtaacctgccgaagaacgcgttnaacnacttgccacaaaaaggccccaattcccnaaatggaaaggcggtcnaacccccccagtttatcggaaatatcnnaattgggaagccaacaacttttttttggcctgcattgnaggaactccgcaaaatttattga

SEQ ID NO: 796 - DNA, 402 bp, A.fumigatus
  unsure (32),(130): Identity of nucleotide sequences at the above locations are unknown.
gctgatacgaacccaaataattccaggcgatntactaagcaatgtcagatcaatggtaaatgggtgtcatggacacatacagcggttgcctatacggcgttcctgagcgctcttgtagtgggaatgtccntacatttccacaagatcgtgcagaacgaacactatggatacccggatgaatggttcccttctgtgtcagctacaattggtgatcggtatccggaacggtcattctttcaagtcttcatcgccattacctcaggtcctcgattcgctctcgttttcctttggtatcttcttactgcacggccccaactcgactcttcccaagatcgttgctggtgttgggctgttccggacttttatgtgtggtggttggacatatgtcacgtcgaccgatga

SEQ ID NO: 797 - DNA, 615 bp, A.fumigatus
  unsure (12): Identity of nucleotide sequences at the above locations are unknown.
tgggaatgtccntacatttccacaagatcgtgcagaacgaacactatggatacccggatgaatggttcccttctgtgtcagctacaattggtgatcggtatccggaacggtcattctttcaagtcttcatcgccattacctcaggtcctcgattcgctctcgttttcctttggtatcttcttactgcacggccccaactcgactcttcccaagatcgttgctggtgttgggctgttccggacttttatgtgtggtggttggacatatgtcacgtcgaccgatgaccatgactggcatgatatcttcatgatctcttacctcgtcgcgacattgccttggacccttggttgcctggcactcagtcccaacaaccgccgcgccgtgaagtacagaaagatcatggcaggcctgttctttggcaccctagtaccactgatctactacttcatccaacacaaggtgcacaaggtcgctggtggtgagtttactctttttctttatttggcataccgttctctaacaactctccgaagcctatacgaaatatgccttcttcgagtggtctcttatcttgttcgacgtgggattcgatgcggtcacggcattggactttga

SEQ ID NO: 798 - DNA, 495 bp, A.fumigatus
agaaaagagaagggaccttaccaagttgtcggtgccgtagaccttggtgttggtatccacgacggaggtgccgtcatcggggcccatcttggctgtgccgacgaagtggtcgccgctggtcactttggcgaggatgtcggccggcgagctggacccctggacggtgtaagaggccttcttgaggtcgtcgaggagctcctgcaggaacgaagtaagggcctccttgtcctcgggggtctgcagcaaggggtcggattcgatggtagtggagccggcggcgttgatgcccagcacgccggaggatgtggcgccgtgggtgaggtacagtttcatggtgatgatgccgtcgccgccggggctgcaggaggcctggaagaagcgggtgacgccgtcggaggcgacgttcgaggtccagaattgaaggcgatggccgccctgggtgaggatgccggaaccgctggcgtacaagcgctgcgcgaagggattggtggcggg

SEQ ID NO: 799 - DNA, 540 bp, A.fumigatus
cccgccaccaatcccttcgcgcagcgcttgtacgccagcggttccggcatcctcacccagggcggccatcgccttcaattctggacctcgaacgtcgcctccgacggcgtcacccgcttcttccaggcctcctgcagccccggcggcgacggcatcatcaccatgaaactgtacctcacccacggcgccacatcctccggcgtgctgggcatcaacgccgccggctccactaccatcgaatccgaccccttgctgcagacccccgaggacaaggaggcccttacttcgttcctgcaggagctcctcgacgacctcaagaaggcctcttacaccgtccaggggtccagctcgccggccgacatcctcgccaaagtgaccagcggcgaccacttcgtcggcacagccaagatgggccccgatgacggcacctccgtcgtggataccaacaccaaggtctacggcaccgacaacttggtaaggtcccttctcttttctttacaccccttgcatcttgccaaaagttctaccgcagtatactga

SEQ ID NO: 800 - DNA, 279 bp, A.fumigatus
tacatcgtcgacgcgagtatccaccccgacctgccaaccggcaatacgcaggccatcgtcatgatcgccgctgaggctgccgtcgcgcgcatccttgcgcagggcagcggccccagctcttcttctagtatcgctgtttccgcgcctagccagaacactgccattgctgccgtgtccagcaccccgagtgctactgcggttcctgttccggtgcctattcctaccggtggtcaggagacccctggcggggactcccgctgcagcgcctaccgaaactga

SEQ ID NO: 801 - DNA, 189 bp, A.fumigatus
agatataggcctctatctagcttctttataaagagtactagtactgctactaggctagatgattccctaatctaccctttcttaagtattttattaaagtatttatatagagcctctagctttagctataatatagtaaataaggggctatatagcagtaacttcctgttaagtagctatatcttataa

SEQ ID NO: 802 - DNA, 492 bp, A.fumigatus
actcaaccgattgcggctgtgttgacaagggctaaaatacgagttgagcacaggctagataacttcaaaatattatctggtgagggtgagggggatataaggctggcgtgtgctccctttgttaagtctcgattgttgttacctttcccctatcacatttctgtcatgtcgcacccccagtatacctacggcggacccccgcaacccccttataacagcgctgggtatggtcagccgggcgcccatcaacagcagccggccccgttttatccaccacaacagcctggtggatatccgccccaaggggctcccccgcagcaatttcccccctctggtcagtaccaacagccatatggtgcgccgccgccgcaacaacaatggccgggccaaccaccgcaacatattcctcaggtaggcaatccaccaccgcagcatttatccgcctccagggagcttacccccaaaatcaataccctccacaggggccaataa

SEQ ID NO: 803 - DNA, 204 bp, A.fumigatus
  unsure (204): Identity of nucleotide sequences at the above locations are unknown.
tcctattctgcggaggctgtcgtcagacggcgttgtcgcgatacccaggaacggtgggagaacttttttattggtgttcccgattgggtatatgaggaggaagtgatctcggggacagccgtcacatggtggtcgaatgacgccaagtatatcgctttcttcagaacgaatgagacgagtgtgcccgagtttccggtacagtan

SEQ ID NO: 804 - DNA, 744 bp, A.fumigatus
tacatctcgcgaccatttgggaagaagcttctcccggggttggagaattaccccgacgtgagggagatcaaataccccaagcctggtgccccgaacccagtggtcgatcttcagttttacgacgttgagaagaatgaggtcttctccgtccaagtagcagacgactttgccgatgacgaccgcatcatcattgaggttttgtgggcctccgagggcaaaatccttgtgagatcgactaaccgcgaaagcgacattctcaaggtgtatctgattgacacccagtccaggacgggcaaactggtgaggtccgaggacgttgccggtcttgacggtggctgggtcgagccttcgcagtccacacgcttcgtcccggcggaccccaacaatggacgaccgcacgacgggtacatcgacactgtgccatacaacggatacgaccaccttgcgtacttctcgccgcttgacaaccccaacgccctgatgctcacatcgggcgagtgggaagtggtggacgcaccggctgccgtaaatctgcaacgcggcctggtgtactttgtcggcactaaggaagcacccacccagcgccatgtctatcgcgtgcagctggacgggtcgaatctcaatcctttgaccgacacttccaaacccggctactatgatgtctccttttcacacggcacaggctacgcgctgctcacatacaaagggccctctattccttggcaggcgattatcaacacgcat

SEQ ID NO: 805 - DNA, 528 bp, A.fumigatus
actctgcgcggatctgcatctcgtgtgaagaccgcggtggagtccagcatgaccgccctgtccaagtctcccaacaagcacaaccgtctctacgtcactgctcagcccctcggcgaggaggtctccctcgccatcgagtccggcaagatcaacccccgtgacgacttcaaggcccgtgcccgtctcctcgctgatgactacggctgggatgttaccgatgcccgtaagatttggtgcttcggtcccgacaccaccggtgccaacttgctggttgaccagaccaaggccgtccagtacctcaacgaaatcaaggactctttcgtctctggtttccagtgggccacccgtgagggtcccattgctgaggagcctatgcgctctatccgcttcaacatccttgatgtgactctgcacgctgatgccatccaccgtggtggtggtcagatcatccccactgctcgtcgtgtcctgtacgccgctaccctgctcgccgagcccagtctcctggagcccatcttcaacgtctaa

SEQ ID NO: 806 - DNA, 291 bp, A.fumigatus
atccaggttcccgagcaggccatgggtggtatctacggtgtccttacccgccgtcgtggtcacgtctacagcgaggagcagcgtcctggtactcctctgttcaacgtcaaggcttacctgcctgtcaacgagtccttcggtttcaacggcgatctccgccaggccaccggtggtcaagccttccctcagtccgtcttcgaccgctgggtctatgctcccggggtgggttctgcgctgggagccgcggggggggggcgggggtggggagcgggtggtgaagattgcgtgtag

SEQ ID NO: 807 - DNA, 864 bp, A.fumigatus
gtaagcccagggaaccatgattccgttggagaccccttggcgctacacgcaatcttcaccacccgctccccacccccgccccccccccgcggctcccagcgcagaacccaccccgggagcatagacccagcggtcgaagacggactgagggaaggcttgaccaccggtggcctggcggagatcgccgttgaaaccgaaggactcgttgacaggcaggtaagccttgacgttgaacagaggagtaccaggacgctgctcctcgctgtagacgtgaccacgacggcgggtaaggacaccgtagataccacccatggcctgctcgggaacctggatttagacgttgaagatgggctccaggagactgggctcggcgagcagggtagcggcgtacaggacacgacgagcagtggggatgatctgaccaccaccacggtggatggcatcagcgtgcagagtcacatcaaggatgttgaagcggatagagcgcataggctcctcagcaatgggaccctcacgggtggcccactggaaaccagagacgaaagagtccttgatttcgttgaggtactggacggccttggtctggtcaaccagcaagttggcaccggtggtgtcgggaccgaagcaccaaatcttacgggcatcggtaacatcccagccgtagtcatcagcgaggagacgggcacgggccttgaagtcgtcacgggggttgatcttgccggactcgatggcgagggagacctcctcgccgaggggctgagcagtgacgtagagacggttgtgcttgttgggagacttggacagggcggtcatgctggactccaccgcggtcttcacacgagatgcagatccgcgcagagtcta

SEQ ID NO: 808 - DNA, 510 bp, A.fumigatus
aactcaaatgcatcccaatctgacaaattttacatcagagccccagtcgagtatccggtgtatctaggggcccagtacgatgcttcgacaaccaatctgacctaccgcattgattctcattcgactgtctcttctgcggctggtccagttgcacttacggtttctttcttgtctcccatcaccccgacatcgaccctgcggcagtcgattcctgcgtcctatattacggtctatgtccacggcgatgtgcctgtcaatgtctacatggacctcaatgggcgttgggtgagcggagatgcaggcagtcaaattgtctggcagcatgatactttcggttctaaagggaagaagccgacccttcagaaatggcaatttcgcagacagaacgagctcctcctctcagagattcgggatcgagccgaatggggcaccctccactttactggacctgctgtcagtaatcttttcatcccactcgtcattgacaggagcattaattggctgtactag

SEQ ID NO: 809 - DNA, 273 bp, A.fumigatus
catccaatgctgcgtgaaatacaccaatatgacgaaccgcacatccacatcctcgactcgcgcgtcgactgggacagctacgctccccatctcgagtacacccacgagtacgccccctcacacaagcgcatgcagcgattcgactcagccccccagtccactctatcggggcaatcacagtccgggaacggcctatccggctcgcagattgggggcatcgtccgggggcttcttcgccgcccggtgctaagccggctcatcctcctggttccc

SEQ ID NO: 810 - DNA, 339 bp, A.fumigatus
gccggcttagcaccgggcggcgaagaagcccccggacgatgcccccaatctgcgagccggataggccgttcccggactgtgattgccccgatagagtggactggggggctgagtcgaatcgctgcatgcgcttgtgtgagggggcgtactcgtgggtgtactcgagatggggagcgtagctgtcccagtcgacgcgcgagtcgaggatgtggatgtgcggttcgtcatattggtgtatttcacgcagcattggatgttattcggccccggacagggccaggggtactagagatgtttctgtcagctgacaatggagggttgctttttgtgtgcgtgtga

SEQ ID NO: 811 - DNA, 324 bp, A.fumigatus
caaagtatcacagagaacaaagcgaaggatgtacaattctccggcgcatcaacgcccctgcaaaccctcaacaccaaccaggcaagcagaccagatagcaagagcaagagcgagagcgccaatccaccgccccacagcagtacaaccctcgacgagatgacctccacgccgaagcgtctataccgtgagcatctggagaccctgcagacttccctggcgtcgcctccaacgggcggtccggcgggcaactaccatacgtttgagttcttgcgggttacgcagaatgagaaggggccgacgctggcgtgggaggagcaccagtag

SEQ ID NO: 812 - DNA, 324 bp, A.fumigatus
tctgctctccagacctatggttactgtgcttccatcatcagtagtacaatcgggcagccgggatggtatagctatttcaagctccctgccgagggggaaccgggatatgcctcgatcacaacgccggctatctcgacagctaatggtgtcttcagcgccggaggtgctgtcggcacgttgttcattatgtggtcatgcgattactttggtcgtaaggtgaacatccagttcggtgcctttttctccctcttcggtggcgcgcttcaggctggcgcaaactcgctcgagtatgttctaatccgcatattcttggtcaaggcatag

SEQ ID NO: 813 - DNA, 210 bp, A.fumigatus
gatacccatatcgagaaaatgaccatcgatgattatctctccgtgttgcggccaaaatacttcggaacctggaacctgcaccgccatctcccagcggacctcgacttcttcgtcatgctctcttctataagcggaatcatcggaaacgccacccaggccgcgtacgccgccggttccacccttcctcgacacattcgccatgtatcgtaa

SEQ ID NO: 814 - DNA, 366 bp, A.fumigatus
gtcatgacaccgaagccacaagctgccctacttcgtgcagatgcatcttatatacttgttggcggtctaggaggtcttggacgagccacagccctctggatggctgataacggggctcgaaccttgatctttgtcaatagaagtgggctgtcgagccaggcagcccaggaaacagcacgagatttgaagcaaaagggagttcgcgtcatcattcatgcttgcgatatatctgatagcaagaaagtcaagaagatggtgatcgagcttgaacggaacgcccctccaattcgaggggttattcaggctgccatggtcctccgggtacgttcgttcaatcgacgaagactgcacccctgtggaagctga

SEQ ID NO: 815 - DNA, 672 bp, A.fumigatus
gaagacatagcggacatcatcaagacatcttaccctaataagtccggcattatctactgtctatcgcgcaaaacttgtgaaactgtcgccgaagctcttacgtcgcaacacaacatcagggccgaatattatcatgctggtatggattcctccaagagggcggaggtacaggaatggtggcagtccggccgtgttcatgtgatagttgcgaccattgcctttggaatgggtatcgataaacctgacgtacgcttcgttattcaccacagcatcccaaaaagcttggaaggatactatcaagagactgggcgggcaggtcgagatggaaagcgctctggctgctatctttattattcttatcgggatgcgacctctatcatgagcatgattgacaaaggcgaggggggcaaacaacagaaaaatcgacagcgccaaatgttacggaacgtcatgcagtactgtcttaatcttgcggattgcagaagagtgcagattcttgcatacttcaatgagtattttcgcccaattgactgcaacaagtcttgcgataattgcagatctgacggtatttttgagcaccgtgacttctctcagcaggccgcttctgttttgaagatcgtgcgatactgtcttcaccacggggctggatggatcccgcagcgggtatacgag

SEQ ID NO: 816 - DNA, 534 bp, A.fumigatus
ctcgtggtgaagagacagtgcccaaatgttctacttcagatgaacctcaacctgctctctacaactacccttcaaagaatccgccatctcaagtccttcatcaaacgctgtcacggttgttttttcaccacaaaagacatgaccaagcagttttgcccacgctgcggtaaagataccctcactcgtgtatcttgcaccacagatgcaaacggacaattcaagatgcatctgaagaagaatatgcaatggaacaatagaggcaaccgatacagcattcccaagcccacccacggcagcgcgagtggaaagtggaagggcggcggcggaaaggatggatggggaatagagctcattcttgctgaagatcagaaggagtacatcagagcatcagtggaggagagtcgaaggctccgtaaggaacgagacttgatggatgaggattacttgccgggaatcctgactggcgaacggaccaagcatggtgggagacctaaagtcggcgccggaagaaacgtcaacgcaaggcggcgataa

SEQ ID NO: 817 - DNA, 480 bp, A.fumigatus
acgaatcccgcaccggacgagaacacgcttcagaccttaatcgagacgaacgatgagctgtcggtcgcgttgtccaagtaccagcatgcgttcctcagcgcccgcaaagcaactggcaactcggggagtcagtcacccactccgtcgaacggagccgctgacactgggaccaatcgtccactccctgtggccccagtgccgcagcgacaagggcaaagcgcctcgccctcggtcttctcgccaccatcgccgccgccgcggcagcaacagcaacagcagcagcagagcactgcaacggtggctcccttgtcagcgacgtcttcggccgcagctccggtgggtaataatgcggctcggtacgagtaccggtcggaggatttccaagtaccgaatccatttgcggatgactacagcacaaccaccacagagaatcaacaacaggcaggatcataccagcgccctacgcagcacactctttga

SEQ ID NO: 818 - DNA, 246 bp, A.fumigatus
tgtatttgtcgagtgtcacacgaccgtgcaactgtagcgccatgtacttgctcggctccaacatttgcacctgttgagggtagcctgttcaacaattctcaccacaacggcgacagcgtcccgatgaagtacgatcctcctccatcctacatcctactccttcaaatcagcgcgtccatccctgcagtgcttcaaccgtcactcatcaagttgatctttacctatttgcccgtaaattcgggctag

SEQ ID NO: 819 - DNA, 186 bp, A.fumigatus
tacatgggcatgcgaggcatgaactgggggatacgaacttttatagctgcttggacgccgcagggtcgcaaggctaaccaggttagggcagtaaaactctatctctatcgtctacggcgtactgcagagtatctgttgcctattgatattggttattggtgttgctatgtactgtgtagtatatag

SEQ ID NO: 820 - DNA, 201 bp, A.fumigatus
aagttcgtatcccccagttcatgcctcgcatgcccatgtactactagagtactctacccatgtgaaggaatatggacccggcgagtaatatctactgatcggtaccaggctaaccatgaaaccactatcaagctcaagcgtaaggccaagggaagagcttacttgctgatcaacaataagaagctaaaacggcagccttaa

SEQ ID NO: 821 - DNA, 237 bp, A.fumigatus
acccctatgacaactccagatgcctttcgagatgcggagtacatcgctgacgtgtccggcatatcttatggaaacgtcgcgaatctcaccgagcaagatgctaatgtggtgcctcgagagaatgagcgcatgagaaagctgcagctggctgccaaggtcgcgttcattgatcgtttacttcgcgatcttgatatcctcatttactgcgagctatctgcgctctattacatggagtga

SEQ ID NO: 822 - DNA, 867 bp, A.fumigatus
  unsure (796),(861): Identity of nucleotide sequences at the above locations are unknown.
tatgtgtctccctccccacttacattgtcattacaggtcattgattttgggcccttcctgaaaggaacaccgtctgacaaacatgctgttgctgtttccatcacaaatgcattcaagacatctggttttctctacctaaaaaaccatggaatcccattttccacagtatcccaggtatttgagacatcagcccgcttcttcgctcgcccccaggatcagaaagacagtttgtgctggacttctccgcagtcgaaccgtggttacgtgaagacgggacgagagaagctgagcttacctgaagataatgtcgacaaagatgccgctagactggcgacaccagatcttaaggagacaatggatattggtcgcgatgatgttgaaggtcatcctaatcgatggccagaccatatcgatgacgaggggaaggagttcaagaaagtgattcagttattcttcggaatgtgcaaatccctgcatacagaggtcatgcgggccatcgctcttggattgaacttaccagagcactactttgatgaattcgtggatgcgggagataataatctccgtctgctgcattacccatctgtgcccaaagatgtcttcaagaaaagctcaggacaggttcgtgctgcaaagcacagtgattatggatctatcacgctcctgttccaagatcgtcgtggaaggctgcaggtacggagtctcaaggggcactttgtcgatgctacgcccatcgcaaacacagtcgtcgtcaatgctggtgacctactagctcggtgggtcaacgatatcatcnagagtactcgtcatcgcgttgtcgagccccaagtattgcatgtgttcgacggagatgactcctcntatact

SEQ ID NO: 823 - DNA, 591 bp, A.fumigatus
cgtggctcaacacaatatataaacatcaaccctacaatactacagccaaaaaaccaagatagagacatggcaaacgtcccgcacacctacggcaacgaagtctacgccaacggcctccagaacatcaaaccggccatcagcttcaacccgcccgactgggaaacccaggcccgagacctcctctccgccgacagctacaactacatctggggctccgccggcctccgcaaaaccgacaccgacaaccgcgatgccttccgcaaatgggccctcatcccgtcacgcctcgtctgcgccgacttcccctccctgaaaaccaccgtgctcggccatgaatacgactaccccatcgccgtcgcgcccatcggcgtccagcgcattttccaccgcgacggggaggtcgcggccgcgcaggctgcaagcgcgcagcgagtcccgtatattctgagcacggcctcgtcgacgagcatcgaggatgtcgcggcggcgagcggcgacagagcgcgctggtaccagctctactgggcgccgcgcgagcacgatgagattacggtgagtttgcttcaaagggccaagtgcgcgggggtatag

SEQ ID NO: 824 - DNA, 426 bp, A.fumigatus
ccagtggatatccttgtttcctcaccattcctagcaaaatatagtcagccccgaagagtggcaacgagactgttacaggaactcgccgcgttgcgccgtcagttgcccatggtgcgcatccacgacccagctcggttccaattcgatacacctgacggagggaagagcctgttggatctgttcgaagggcgcaaacaactaaccctctaccatttcatgctgggaccccatgagactcagggctgcgtgggttgctcattctgcgtgaaccatattcccgatctccgccacccctggagcagggatacttctttcgtcgcctggctcccgcgcccttgtctagaatcactgccgataggaatcagatgggctggaagtttccgttcgatagttctgcaaaaacgtacaaacgtgggccgaagttga

SEQ ID NO: 825 - DNA, 210 bp, A.fumigatus
ggtattatggtctacaagctcgttttcgggatccctagagatctaacaggatctagtataagtaaattatcttgtcatggaagattggagcgtcctaggattcccagttctcttgctccttatctgtttagtgatgctgtagagaggtacatcatcccaggtacggagtaccttatccagagactacctgcctccaagtgtgtttcctaa

SEQ ID NO: 826 - DNA, 213 bp, A.fumigatus
  unsure (42): Identity of nucleotide sequences at the above locations are unknown.
ctccggagagccgaagatagcggatatgaggacgagtatcangtcgaggacttggaacttactggcagcgactatgtcattcccacgtttgccggcagctttgaccacgtctgggagcagaccggcgcgaacggggaggaagtcagcgagactctgcaactcaataacatgaagaacatctcaggtgcgtctcgaattcgacgtttaatgtga

SEQ ID NO: 827 - DNA, 807 bp, A.fumigatus
  unsure (677): Identity of nucleotide sequences at the above locations are unknown.
ctagattctatgttttcactttctacgttcgagcaccagcttgtcatgtacgtgacatcgacagacaaggagacatttgccgcggctttcgacatttccactgttcctgttgtcacacaagaacaggcattggctgaagagaggaccaagaagctcacaactgcaacacccaccctcaaggctccttctgcaggtcctcccaaaggcaaggccaatggcgtcgccgaggcggcaaccgcagcggcaactcagaaatatgccgagcagctcatgcagattcccgagctcaaggcctacggaactttgctcaagtcctctgtgcctgttgagcttactgagagtgagaccgaatacgtggtaacagccgtcaaacatgttttcaaggagcacattgtggtgcaatacgacattaagaacactctgcccgatacggtactggaggatgtaacggtagtcgccactccttctgaggaagaggtcctggaagaagagttcatcgtgccagctcccaagctagctgcaaacgagcctggtatcgtatacgtcaccttcaagaaactctccggcgaacacagcttccctgtcacatcatttacaaacatcttaaaatttaccagcaaagagattgaccctagctccggagagccgaagatagcggatatgaggacgagtatcangtcgaggacttggaacttactggcagcgactatgtcattcccacgtttgccggcagctttgaccacgtctgggagcagaccggcgcgaacggggaggaagtcagcgagactctgcaactcaataacatga

SEQ ID NO: 828 - DNA, 402 bp, A.fumigatus
actcatcgggcgactatcgacacacgcgtccggcgcattatcagacgcatcaaaatacagcagcaattgcacctaaaatcctcatcattcttccatccatccatccattcatcagccatcgttgtgctcagcaaacgatcatgtacggcgaactcggaaacaaactggtccgccgcgtcttacaacacccaaattccatcccacactattgctaataccagtgacaggtccaacacgccaagcgcacgcaatccctcgtccacctccccccctaccaaaccgaactggtacgtaccgtcgcccgcgaagtccgcgatctcgaccgcgacgtcgcccgcctcctcgagcccttcagcggcagcttcaatccttctgcggacccggcgccggcctgcgccctat

SEQ ID NO: 829 - DNA, 210 bp, A.fumigatus
ttagcgccacccgcggatccttccagccccgtggtgaagactagtcctgatttggtcatgattaagagagttcctaaattttctctatttagatctgtgattggttcaggtactacctttatttttcctagaatccctagcttccttataaaggctaggtttataaagttgcctgttgctcctaagtcaatcattacttcagctgattaa

SEQ ID NO: 830 - DNA, 213 bp, A.fumigatus
tatattactaacactacaggcagtaaaacaaagagtatcaccacaaactcaagagggtattggaaaaaagactaccaggaccatttcataggaaatgtgattacgactggtgtctatacaaatacttctaaggacacccgcgatataaacaagtactatggattacttgttacagtaataattgcagtatccaccataataataaatatatag

SEQ ID NO: 831 - DNA, 855 bp, A.fumigatus
gaaccttggaagaaatttcccggtaaattaaaccgggagaatttcagcccaacacaggggaagagaaagcacggttccaggaggagtaaacaccggagcagatggccggcgattgaagccgtggaggcgcaattcgatcccaaggatctggccgaacagtttgccattcgtcgggacccgatgaaacttcactatctggatgatttctcgaccatcgaacctggggtagacaagcacgtccgggcgcccgtgaccaataccgattacaatgccgaactgaaaagcgagagcgactttgcagaggattttggccgtttccttgcagaacttcccagagatccgaccgcggccgactgggtacggtttgcggagactgtccgtatgacccatggcaaggaggagaacgagttgaatccccacagtgctttggttcccgatttgcttgctcctggagagtccatcagtggggagcggaaggagatcaatttcttcaaggagacagacccgagggccagagagtcagaggaggttacagatgcattgaagcagctccttttgactaccggatattcacagaaggagattcaggatctgaggacaaagacgctcgtttcccacgcggttgtcaaccagacccgcttgggtaaggtccgtcgtcagtactgcttgtcgattgctggtaatggtaacggtttgctcggaattggcgaagccaaatcagaagaaccggccgatgctcagacgcagtccagatacagagctattagaaacatgcagcccattcttcgttacgaggaccggaccatcttcggggatgtcgagggtcttccccacggggctggaaagaaccgcgct

SEQ ID NO: 832 - DNA, 921 bp, A.fumigatus
agactctaccgaaaggtagctccatggtttggaagcagccgacagagtgtacgggccgttaacgacctctccatggacgtcagaaaaggtgaaattgtggtcctcctcggtgcaaacgggtcgggcaaatctaccacactggatgccatctccggtctaacgacaatcacctccgggagtatcgacgtagactacggcgactccggcggacggtttggtctctgcccacagaagaacgttctctgggataagcttacagtgaaagagcatataaagatattcaacaggctgaagagtaccggagaagtggacagtaatgagcaacttctcaaattgctaaacgactgtgacttagctcagaaagtgagctcgctcacgaagacgctctcagggggccagaaacgaaaagttcaattggccatgatgcttaccggcggctcatcgatttgcgctgtcgatgaagtctcatctggaattgatccaattgcacgcgccaaaatatgggacatccttcttgcagagagaggatcacggacaattcttttgactactcattttctagatgaagcagaccttctcgccgatcacatcacaatcctatccaagggttcgctcaaagcacagggctcgagcgttgagctaaaggatagattgggttcgggttaccgaattcatgtgctcaacgttcctggctcagagaaggtaaccggtctgcagttcgacagtattgaaaaagaggtccattttgatgataccgtctactccgcgaaagattctacggaagcttctcgtctgatgtcagtgttggaagaaaagggtgtcacagaatatcgtgtcagcgggccgacgatcgaagatgtttttctctcagttgcagaagagttagactcggaccgactacgagaagagccttacatttga

SEQ ID NO: 833 - DNA, 696 bp, A.fumigatus
tcgagctccctttatcatttccaatttgatagctgcagcgatacccgtatcagcatgcctctcttttcttcttcttcttcttcttcttcttctgcaaataagctgacccaattccctcgtgcgcaggccttcgagaatgcctccaccagtgtcgctgcttctcagatgcgtaacgctctgaatgcgcttgccgagaccgttcccgaccccgaagagaagaagcgcttcgaggccgagatggacaacttcttcgctctcttccgcagattcctcaactacaaggccaagggcaatgtcgtcaactgggaccgcatcaaccctcctgcgcccaaccaggtcgtcgactacaatgacctgggcgccgaggcctcggtggagttcctgaacaagctggccgtcgtcaagctcaacggtggtcttggtacctccatgggttgcgtgggccccaagtccgtcattgaagtccgtgaaggcatgtccttcttggatttgtccgttcgtcagattgagcacctgaaccgtacctacaacgtcaacgtgcccttcgttctgatgaactcgttcaacaccgaccaggacacccagtccatcatcaagaagtaccaaggccacaacgtcgacatcatcaccttcaaccaatcccgctaccctcgtatcatcaaggactctctcctccccgctcccaataacgtttga

SEQ ID NO: 834 - DNA, 198 bp, A.fumigatus
ttcatgcatttttttttctattctaccacaataagctctctttatatcattgccccttttgtcaactttgctacaatcattattcccattgatcgagctccctttatcatttccaatttgatagctgcagcgatacccgtatcagcatgcctctcttttcttcttcttcttcttcttcttcttctgcaaataagctga

SEQ ID NO: 835 - DNA, 381 bp, A.fumigatus
actcgttcaacaccgaccaggacacccagtccatcatcaagaagtaccaaggccacaacgtcgacatcatcaccttcaaccaatcccgctaccctcgtatcatcaaggactctctcctccccgctcccaataacgtttgacgctcctctgcatgactggtaccctcccggtcccggtgacgtttttgagttgctgtacaactcaggcaccctggaaaagctgctcgaccttggtgttgattacatcttccctctccaatgccgaaaaaccccggcgcccgttgtggaatctcccgatttttgcacccaccatggcggaacactggttgcccaattacatttttggaatttaaccgaacaacaaccaatgcccaacttctaa

SEQ ID NO: 836 - DNA, 624 bp, A.fumigatus
  unsure (617): Identity of nucleotide sequences at the above locations are unknown.
tccccgtctcctcgctacattcccgcccatttgcaggaagaagtgcttggcaccgccgcccgctccccgaccccggaatccgccagtagtgccgccgactatccttcgatcgcctgcgcaggactcaccctacacagcgacaccatgacggatatgtctggttccgacaaaaaggatggcagcgttccgcctactggaggtgacgttcggtcatcctcccccggtattaaacggtcggctcctaacgccgaccaggatgtggatatggatctaggttcgacggagaagagatctgtttctctaacccatcacacagacgcgatggatataaccacagcggagggaaactcgaacggcagcagtgacaactctgggtcagacaatgtctatcccacaccatccagcatgtcgacctttaccgcttccacggcgacccgaagggaatccaaggcccaggcctccatctcgtctcatgatctccctcctatcgacgaccaagtcgctcaggtgacctgcaccatggctcagccgttgaaggagaaacagaagggatatctggtatccatgtcttggctaaagcgtcttcacgcaccggggctagaaggacacgcgatcgngagccac

SEQ ID NO: 837 - DNA, 312 bp, A.fumigatus
  unsure (197): Identity of nucleotide sequences at the above locations are unknown.
tgcaataagcatggactaaataccaaaatggatcttttgaatctaatgcaactgggagaatttcggcctagtgttcacggcctcggtgattttgaacctaatattacttttgttccatcgaaaccctttctctctgatggatccacttatcatgcggatacaatttttgccattactcctgtctcagcgctcgtagngaatgcatcgcggagtttccataatgtacagtcctcatcttctatcgtcatcatctatttgttcgactctcatggcaccaggtcaaccacaaaattcgagtatattgggagcatt

SEQ ID NO: 838 - DNA, 192 bp, A.fumigatus
tgcaattcactaaacccgatgcgtccaccttctcactttgagcaggaaatgcaaagatcgaaggcctccttccaagcctacacatggacggcctacagtacaatatcgccttgtccatctttttcattccttatgtccttgctggtacgaaagatcaccgtgaacgatatttttgaatatctgctgacgtag

SEQ ID NO: 839 - DNA, 729 bp, A.fumigatus
actcatagcgcggttccttcgacccccgtggtgaagacatcagtgatgatacgcaactgtcaagagggtcatttgcgtgcggagagagatttcctcgttgcttctgcgaaatctcgctgggtagttcccttgatcgcaagcttccaggaccacaattacctgtacctgataatggactacatggtgggcggggatttccttggcctcttgatgcgaagaaacattctgccagagcacttcacgaggtggtacgctgccgaaatgatactctgtatcgaggaggctcacaaacttcgatggattcaccgggatgtcaagccagacaacttcttgatctcagcctctggtcatatgaaaatctctgactttggcctggctttcgacggtcactgggcgcatgatcaagcctactacaaccaccaccggtactccttacttgaaaagctcggcattcagattgacggtgacggagaagacagggaggaacgcaagtcacaaggtgcttcaaagaatcacaatgagctcaaacccgaccggaatccaccatctgtcaatgtattagactggcgtgacaataaccagaggcgcggatttgcccgtagcatcgttggcaccagccagtatatggccccagaaatcatccgaggagaagcgtacgacgggcgatgtgactggtggagtgtaggcatcataatatacgaggtacatccatctaagataggactttaa

SEQ ID NO: 840 - DNA, 198 bp, A.fumigatus
agacagtggagcatgcgttcgaagcaattaaagtcctatcttagatggatgtacctcgtatattatgatgcctacactccaccagtcacatcgcccgtcgtacgcttctcctcggatgatttctggggccatatactggctggtgccaacgatgctacgggcaaatccgcgcctctggttattgtcacgccagtctaa

SEQ ID NO: 841 - DNA, 597 bp, A.fumigatus
accgagattctggaaatctctctcttccaccaccctttggaccacatttctcgtctccaaatgagaacgcttatacttgtctttctgtggctcactgccgtcagttcctatccccgtggaattgattgggactatgctatagcgtatcaccagcaagtcctccaaggagagaacgatcgagggtttgggctgaacgagccattcatcccgactccatctcatatccttcctgaaaagaaacctttttacattgatgaaaccgtgcattactacgagagacacttcaatggctcaggggaaaacggggaataccgtcgctcgtcatgtcccgcggtgaatgcgctggccaaccgggggtatatcaatcgaagtggaaggaacatcacctacgctgagctggcgcatgccgtccgcaaggtgtggaattttggagatgataacgttattctcccaccaaaagaatccctggtgcttcattctactaattccttcccccagagcatgctagtgttggcgcccaacgttcgcaatgcatggttgggccggaaaacactgaatcttgattattccatgcaaaaatatgttctcgtttcctaa

SEQ ID NO: 842 - DNA, 672 bp, A.fumigatus
tcacagtacagtgacgccacctatggcccgtctgtgcctcacattcagaatccgttcaccgctacagggacggggaagaattacggtcgcaatgactcgggtctagatcccgagacagaagctcaaattgcgcagtggcagagcgcttatgccaacaaggaggaagctccgggaggcaaggtagcaggccgtcgcgacggagctacgggcatgccaggtgctaccgtgggaaccaacacaccgaccagtgcgacagcgacgagcacccccacacttgcaagccacccagagcaaaatgccaagaccgttgtgcgatccggcggtggccagacgtggaccgatccgactctgctagaatgggatccggcgcatttccgactcttcgtggggaacctcgcgggcgaggtgaccgacgactcgttgctgaaagcgttttcgaggtattcatctgttcagaaagcgcgagtcattcgggataaacgcacgcagaagagcaagggttatggatttgtcagtttcagcaacggggatgactacttcgcggctgctagggagatgcagggcaagtacattggctcacaccccattctgctgcgacgggccaccacggagatccgtccgacgactaaccccaaggccgggaagaagaacgctggcggtcacagcggatga

SEQ ID NO: 843 - DNA, 276 bp, A.fumigatus
aaaaatcgaagcgatcaatttgacttggactgcacggtctctggtcatagcatatgtcaggtcggtccctctgggacacgtgcggcgcgtcttataatactgacatattcgaacagtatctttctcatgtcgttttgcacttctctagaaggtcagaccgtcatgtcgctcggagcatatgcaacgagtgcttttagcaagcactcattgatttccactgttttggttgtccagaatgtggttaacggtaagtgctataaccctgcccgtctataa

SEQ ID NO: 844 - DNA, 246 bp, A.fumigatus
  unsure (139): Identity of nucleotide sequences at the above locations are unknown.
cacccgtggtgcaaaacaaggtcgactgcccttgtgaactacagcctgcactcaacccagttcatctctacttacgggtcctctattacagcaggccagccatcaagctcagggctagggctcaggggtctgagcgtangctatggccaacgcaacggacaccgtattgttgacgacgtgtggaccgatccctcaaatgagaactcagtagaatcttattcattaagcatattaaatgcgtggtag

SEQ ID NO: 845 - DNA, 249 bp, A.fumigatus
cttaacgtgccggagtgggaagtggccagcagaattctcctctacccggcctacaacgatactagcccgggcacttctactgttgtattctctatgatagcggagtgtcacgcagatggcatcgttggcggggctacattgacctctgatgataacaacgttgcaaatgaccaactctgcgatgtaattgggggttttatctattcatctactccatacacaaaaccatatctaaccagtactggttag

SEQ ID NO: 846 - DNA, 435 bp, A.fumigatus
ccggggggggagttttcgaaggcgttgccggagaagagggaattcctacagcgggcggacgtgctcagcgtgcattatgtgctgtctgagcggagtcggggcatcctcggggcggaggacctggctgcgctgcggccggacgccatgatcgtcaatacctcgcggggtccgctgattgatgagcgggcgctgctggagacgctgaacgcgggtcggatacggggcgcggcgcttgacgtgtttgatccggagcctttacctgttgatagtccgtggcggacgacggcttggggggttgatgggcgcagcgaggtgctattgacgccgcatatggggtatggggaggaggagctgatcaatgggtggtataaggaggcggctgagaacttggagcggtggttggatggcaaggagttgcatgtcaggttgaattga

SEQ ID NO: 847 - DNA, 423 bp, A.fumigatus
tacaccaaaatccatagcagattcaaaatgtccacccagaaagcagtcgtcatcaccggtcccaagcaggcggacttggtcactcaccccatccccaagctgcgagatgactacatcctcatcaagaccgtcagtgtggccctgaaccccacagactggaagcacatcgatcgtctggttgctcctggagtgctagtcggctgcgactacgccggtatcgtcgaggaaatgggcaatgacgtccagaagcccttcaagaagggcgacagagtctgcgggttcgctcacggatgcaacgccgtgcagcccgaggaccgcacctttgctgagtacatcgtcgccaagggcgacctgccaatccacatccccgataatctgagcttccaagaaggccccacgctgggttttccgtatcaccaccat

SEQ ID NO: 848 - DNA, 222 bp, A.fumigatus
gtgattgttagtcagcttcagaatgggcaattaagaggggggggaaggttagaatattctccggagtatgtcagtatctccggatggccggatttaagcagcggaattagtcacccagaagttgctaagagctcttgctctaaccaggaacagactagcccccgcctagcgcgatatactacatacaagacagaacgtccttaccaaccatcaaaccattaa

SEQ ID NO: 849 - DNA, 234 bp, A.fumigatus
cgcgatatactacatacaagacagaacgtccttaccaaccatcaaaccattaagtctctagacttccattttcagtatagtgacaatgatagtgtatattctctatattttgcatccgatgggcgctattcgaccaacattacagggacaaagcactggcatctgcaacattcgctggctatatctgacgcgcccttagttttctaccatcggggcggcagccatccgcgctag

SEQ ID NO: 850 - DNA, 1086 bp, A.fumigatus
agacaggggcaatatggccctggtgtcgggactccccgccctgattgggcgctgagcagcgatgatctcaacaagatcgtccgtagctccgctgtgaccggctctggtctcggtacctctcctaacgttgcgggtactccggatgaggaggtcgggtacattgccacagatgaatacactcaccgtatggcaaccccggctcccgaatcgcgccgcagctcgcgcttggtcggggagtcccccttgcgcaacacggacgttcccgcttcagaggttggcgttgagcgagaggggcgcaagtctgaagacgctggtgttattcatgtcgatgacccgtaccacccccttcatcatccagatggttttgcaccgaccccagcgcctgaagaacaatcccatgaaatgggcgcgggtcttgaagatgaagatgaacctattctggctgcggatgaagtccgccctgaatcggcctatcaacatcctgccgtctctcccaccttcgatagacggcctagcgagtatgatggcaggagtcacactcctagcgttaaccacagtcgctcaaatagtcggtcggccccccaccaaggtggcatgcccactctcgtgagatacaactctcgcgacgaacgtgaggagacacacacgcctctggatgacgttgaggagtatgagccgctatttcccgaggatgataaggacaagacatccatttccgctgcggaccgcttcaagcagcgtcctgaaatgctcaagcaccgcttccccagcgaagatatctgggaagattctcccaacagcttgcaactccatgccactgtttccacaccggacattcctaaacaggaagcgtttgagacgccggaacaggagtcgttccgccgcagtcacgctcctcaccttgatcctcgccaggtcgcagaacacatccttgagtccgaagaatcaaaagaaaagacacaaccgcgccctgaaatttgtaagcagcggttccccagtcgagacatctgggaagatgcacctgagagccagacgctcgtgacaacaatcgaggtcttacaccgacggggcaggaagaacacgcgc

SEQ ID NO: 851 - DNA, 516 bp, A.fumigatus
ttcttgatggacatggcaagccatagtggccctgaatttgaccagttctgcacagagaactctatcatccctctctacatgccaccacactcctcccatctcttgcagccactggatgtcagctgtttctcccccttgaagcaagcatatggacaacatgttcagaagagtatggtgcttggcatcaaccacattgacaaggatgagttcttaaccatatattcttcaatttgtacagcagccctgagtgaaagaaacatccagagtgggttcagagctactggattagttccatatgatccagagcaggttctttcacgtctcaacacccagatgtgtagaccaacccccccaggaacctcccatagttcccaatcctcttgggtcacggccacaccacataatatacgccaagtggagctccaggctgagaaggtcaagggatatatgcagcagtgcatgcagggtccatccagtccgtcttcaccgcggggctggaagggacgtgccaggtga

SEQ ID NO: 852 - DNA, 198 bp, A.fumigatus
atacaatcgctcgatctgcaacaaaagctcaagctttaccatggcaagtatatgtctgtcgcgataacgtcactctgcttcctgttggttctgtctgccctggcttgtgtcaccctccccaactatctattcagcacggcttggccccgccagcaagtaaccaggctactccgtcgaattaactgcggcacagagtag

SEQ ID NO: 853 - DNA, 765 bp, A.fumigatus
  unsure (683),(699),(701): Identity of nucleotide sequences at the above locations are unknown.
cgattccaacacagtatcatgattggtatgggccagaaggactcgtatgtcggtgatgaggcacagtcgaagcgtggtattctcaccctcagataccccatcgagcacggtgttgtcacaaactgggatgacatggagaagatctggcatcacacattctacaacgagctccgtgtcgctcctgaggagcaccctgtcctcttgaccgaagcccccatcaaccccaagtccaaccgtgagaagatgacccagattgtcttcgagaccttcaacgctcccgccttctacgtctccatccaggccgttctctccctctacgcttccggtcgtaccaccggtatcgtcttggactctggtgatggtgtcactcacgttgtccccatctacgagggtgtcgctctcccccacgccatctcccgtgtcgatatggccggccgtgatctgacggactacctgatgaagatcctggccgagcgtggttacacattctccactaccgctgagcgtgaaattgttcgtgacatcaaggagaagctttgctacgtcgctctcgactttgagcaggagattcagactgcctcccagagctccagcttggagaagtcctatgaacttcccgatggtcaggtcatcaccattggtaacgagcgtttccgtgctcccgaggctctcttccaacctancgttctgggtctgganancggcggtatccacttcaacactttcaactccatcatgaaatgtgatgttgacgtccgtaaggga

SEQ ID NO: 854 - DNA, 279 bp, A.fumigatus
  unsure (223),(239),(241): Identity of nucleotide sequences at the above locations are unknown.
agatcctggccgagcgtggttacacattctccactaccgctgagcgtgaaattgttcgtgacatcaaggagaagctttgctacgtcgctctcgactttgagcaggagattcagactgcctcccagagctccagcttggagaagtcctatgaacttcccgatggtcaggtcatcaccattggtaacgagcgtttccgtgctcccgaggctctcttccaacctancgttctgggtctgganancggcggtatccacttcaacactttcaactccatcatga

SEQ ID NO: 855 - DNA, 204 bp, A.fumigatus
cgctgggttcgtagttcgggtatgtgcaaggccggtttcgccggtgatgatgctccccgtgctgtcttccgtaagtcaacccctcaccccataatgttaaacatccgagtgaaccccctctgccccatatcatcccttgatgtcactgtgcagattgtcgccaggggaatgtgtcaaccgttgcccttgcgtccggttggataa

SEQ ID NO: 856 - DNA, 873 bp, A.fumigatus
  unsure (65),(67),(83): Identity of nucleotide sequences at the above locations are unknown.
tcccttacggacgtcaacatcacatttcatgatggagttgaaagtgttgaagtggataccgccgntntccagacccagaacgntaggttggaagagagcctcgggagcacggaaacgctcgttaccaatggtgatgacctgaccatcgggaagttcataggacttctccaagctggagctctgggaggcagtctgaatctcctgctcaaagtcgagagcgacgtagcaaagcttctccttgatgtcacgaacaatttcacgctcagcggtagtggagaatgtgtaaccacgctcggccaggatcttcatcaggtagtccgtcagatcacggccggccatatcgacacgggagatggcgtgggggagagcgacaccctcgtagatggggacaacgtgagtgacaccatcaccagagtccaagacgataccggtggtacgaccggaagcgtagagggagagaacggcctggatggagacgtagaaggcgggagcgttgaaggtctcgaagacaatctgggtcatcttctcacggttggacttggggttgatgggggcttcggtcaagaggacagggtgctcctcaggagcgacacggagctcgttgtagaatgtgtgatgccagatcttctccatgtcatcccagtttgtgacaacaccgtgctcgatggggtatctgagggtgagaataccacgcttcgactgtgcctcatcaccgacatacgagtccttctggcccataccaatcatgatactgtgttggaatcgtcagcgaccatgattcgagctagcgtaacagctcaggatgaggaaaggggggaaaatttacccatggtgacgggggcgaccgacaatggaggctatctcgcaagttag

SEQ ID NO: 857 - DNA, 471 bp, A.fumigatus
ttcgtccttcgtctcttccttgataatcttctctacagatacctgaccgtcagccttgcgtccgtaccaaccgccgagatcctcgcccgcgccggccttgacgatactggtgatgatctcaaaggcgacctgtgccgctgccagagcggtggtctcgcccttgttatcgtagctaggggagacctcgacgatatccgcgccgacaatgttcagcttctcaatgccgcgcagaatgcggatgaactcgcgggtggtccagccgcccggctccggggtgcctgttcccggcgcggtggaggggtccagcacatcgatgtcgacggacaagtaaacgggctgttccgggtcgaggccaatgcgttcgatgatcttgtccacgatgcccatggggcccagctcgtcgatatcatcggcgtggatgcgcatggtcttcaccacggggctggaaggatcacgtctcatcggggctga

SEQ ID NO: 858 - DNA, 492 bp, A.fumigatus
atgagacccttaccttcagccccgatgagacgtgatccttccagccccgtggtgaagaccatgcgcatccacgccgatgatatcgacgagctgggccccatgggcatcgtggacaagatcatcgaacgcattggcctcgacccggaacagcccgtttacttgtccgtcgacatcgatgtgctggacccctccaccgcgccgggaacaggcaccccggagccgggcggctggaccacccgcgagttcatccgcattctgcgcggcattgagaagctgaacattgtcggcgcggatatcgtcgaggtctcccctagctacgataacaagggcgagaccaccgctctggcagcggcacaggtcgcctttgagatcatcaccagtatcgtcaaggccggcgcgggcgaggatctcggcggttggtacggacgcaaggctgacggtcaggtatctgtagagaagattatcaaggaagagacgaaggacgaattatag

SEQ ID NO: 859 - DNA, 1215 bp, A.fumigatus
  unsure (247),(298): Identity of nucleotide sequences at the above locations are unknown.
tttcagagaaggatgaaattttcaatacttccccctgccaagggcagtccccacttgtcacatcccagcaaggtcacactggtcgacgtggagaaggagattgccaaattcttcgccgagaaaaatggctcgtcgaaggaagttgacctcgaagcgcagggcggtgcccgcaagaagagacacgccttcatctcgtccatacgatataccgctctcgacatctaccggcgtctcttctccctagttntcctcgccaacctggctgtcttcattgctgtcatgacggcagaccgaaagntactggcccttgtgaacgccacggcggccaacgtacttgcctgtggcctcgcccggcagccgctggtggtcaatgccatttttgtcattgtctgctcgattccacggtccgcgccgttgcggctgcgccgcgtcgcggccaaagtgtaccactatggcggggtccacagtgggtgcggcatcgcttccttcctctggtatgcaggcttcgtgggcctgatgtcaaaggagtactggtcaccagcggctggagcgggcaacgccgccttctcaatcctgcctgtggtcctctcaaacatcatcctagccttactgctcgccatcatcctcgtcgcccacccggccttccgcatgaagaagcacgactggttcgagcttacgcatcgcttctcggcttgggtcgtggtggtcctcttcgtcatcctcctgctcgtcttttccggtgaggccagtcgcgctgccaaccaacctctggggaccttccttctccatctcccagctttctggtttctcgtgattaccgtcctcgctatcatccacccatggcttctcctccgcaaagtttccgtcgttggggaaaccctttccccgcacgcggtcaggctgcacatgaaccacacaagcaccaccttcggcaagggcatccagctagccacgcaccccttgcaagactggcacggctttgccaccttccctgatcccgacggagcgagcttctcgtgcctggtctcaagagcaggcgactggaccagtgcccgcataaaatgccccccgaaacacctctggaaacgcggtgttctcatctacggcttcgcttacgccatgcgggtcttcaagcgcattatcatcgtcacaacgggctcaggcatcggtccctgcctgtcttcaccacgggcaggaagcatccaagctgacatt

SEQ ID NO: 860 - DNA, 576 bp, A.fumigatus
gcggttgagaaatataatgatgcttccgatcaagggtccgaaacgcggagcccgcgtttagttggccatcccgatgctgcccatagctctccctgggagttggacccagacgccgacgatgcgctatgggagatgtacaaggatattgccagaaagtttgaagataatgaggatgaagtaagaccattggtacagcctgagaaaccggaggtctattttgatgaagacgatgaaatccccgatgaagacaacaagggaccgaaattatctcctaagaagagaaaagaattgacgaagctttctgtcgcagaactcaaggcaatggttcgaaaaccggaaatcgtcgaatggacagacacgtcagcccctgaacccaaagcttcctcgtccatatcaaggctcacaaaaaatgttgttccctgtgcctgtttccatgggttcttaaaaaagagaatttcctgttcttccaaaaacgagggggtggaccaaacccccttttggcccctgccaaaaattcatacccggaagaacgggtatctcaaaaaaatgccaaaatgccggctttgggagaaaaca

SEQ ID NO: 861 - DNA, 189 bp, A.fumigatus
aaaatagtgctgttatgcaaccatggatgttctcccgctagagatcttccatggatcatgtggcatgcagatacatggatacttcaggtacctagttcaatcgtctactatctatctacaactaccttaggcacttcgcaacacaatttcttcctctcgaccactcaaatcatcgatgatactacttga

SEQ ID NO: 862 - DNA, 861 bp, A.fumigatus
acgccatacgcggtaccttccggccccgggcgtgaagacgcaagatgcatggttcgtgatcccgctttccctgaggccgcaacagattggctaatcctctctactccagatggtcactacctgaatttgcctgttatgaacgagacgggcgagattgtcggcatggtggatgtgctcaagctcacatatgccactcttgaacaggttagtcaaagttttttccgaaaatctggactttcaactgacccgagatgcaagattaactccatgcaatcgcatgacgatgaaggccccgcatggaacaaattctggttgtcaatggatcatgaatccgattcaatggtgtctggcagccaccaagcgccgaatcgatccgttctcagtccggaatcaccgagacatggtgtcgacagtgtgctccctaacgaatccgcgtcccaccacggcggagatgagctctcggaatatcacgaccatcaccataaccacgacgagaacactccgttccccttcaaatttaaggctcctagcggccgtgtgcacagagtcaatgttgtcacttccgctggggtcgctgacttagtcgcccaagtcacagccaagttaggcaacgagctggaggccgtcggaggtggagccaccgtcgaggagggcaaactcagcaatactggttacgccttgagctacttggacaatgagggtgacactgtttctatcactaccgatcaggatctggcagatgccgtcagtctcgcccgtcgctcgcaccgtgataaggtggatctttttgtgcacgacccctctcagcccccaattccggcaacgttggatccccagcctgctccggccaaggtcgtcgaa

SEQ ID NO: 863 - DNA, 684 bp, A.fumigatus
  unsure (359): Identity of nucleotide sequences at the above locations are unknown.
atatctccttatttgacggatctacccccctcgcttcccttcctttctacctcgaaattttcaatacaagaccttgatcgcatcgaggagccaacaatggatattcatcgctgccgtttcgtgccttacaacccccaggcgatcaatgcactctcattctctcatcctccctctgcggaacttgccggtcgaggtgtccctaccctccggcttgccatcggccgcgcaaatggcgatatcgagatctggaacccaatgcgcggcgcctggttacaggagacggtcatgcgcggaggaaaagataggagtatagaagggcttgcatggactctcgacccgccagaggctggacctgacgngaccaagattccgggaaaactgcgcttgttcagtattggatactcgaccgcggtaacggagtggaatctggagcagggacgccccatgcgtcactcgagtggaaactacggtgagatttggtgtatagcagcacaaccaagatggcaggctacgaagcgcggcaaggatggaaagcctctgccgcccgcggagggagagtacaccgggcagcatttcgcggctggatgtgcagatggctcaatcgtgatcttgtctactgccgacggcgacttgaaatttctgacggctgatgcgtccatccacaaagagagccagagtccttag

SEQ ID NO: 864 - DNA, 189 bp, A.fumigatus
tgctcaaaggccgttggatcgcagaaaggtggatccactggcgatgccttcatttttgtcgctcttttttccatcccttttcaggtagattattacgtaggtacctctgacactgaagatattgtcatgagacagaaggagacaataatactatgtctattagaaacaagatatcatatccatgtatga

SEQ ID NO: 865 - DNA, 186 bp, A.fumigatus
tttggcaagcacgttggacgaagaagaatgatgaagggaaagaaggagaagaaaagagaacaaaagactggatgggtggaattgattggaaaggagccttcaaaagacaaggcagtgggaaaggaaagtgcctttagggaggaccagacaagaaaggaggcgtggccccagcaccgggtccggtaa

SEQ ID NO: 866 - DNA, 195 bp, A.fumigatus
ttgggaaagcgagagagtctcatcgcggataggaagatcgactgtgaattcaatgtgaccaggatagtctgggctaatctcagatgttggaagtttgtccgcttgtggtgtttcaagctcgatgacattcgcaaccgtcgttttgagtttgagcagcttaacgataacacggagtctcgtctgaagcatgtgtga

SEQ ID NO: 867 - DNA, 834 bp, A.fumigatus
ggtgccccaaaatgtggcagttttcggtacatgatccgggttgtcgtgaacaacaagcccgacggggagagcgacgcgcgcaagtcccttgcctcggcgggaaagaaagtgcgcatcatccctaccgtcgacgaggaaccgccactcaacgtcttcgaaggcgatgacgtctactgcacccgcaaggagaaggacgtcaagcgcggtctcatgcgcggcaagctgggccgcttagttgtggccgcctcgcagccaaagccaatccaactgactgcgccccagtacgagacaaaggagtctgtcgggacagtggcaaccattcatctgcgcttcgatcctgtcggcaacgaagcgccgccccggctcggcagcgtctggagtcgactgcgcgtatcgacatactacgccgcggtcccctgggaagactacccctccgccctgtcggcgaccatgtgggcacaggttgggaagagtgtgtacactgagaccgtccctctgtctaccctctgcgtcgcctcggcccagtggactaaacactcggcctcgagcccggtccgccggagctccctggagtcgacttcctcgtccgaatcgctcaccggaccctctgcctctttctcgaggagcacctactataccgcctcggtggtggtgccggtctccctacccgcgtccaaggcctttgttccgaccttctactcctgcctcatctcccgcatgtacactctcgacctgagtatctcgtaccacactcccaatgccaatatcctgactcccaccgcctcccttcgcctgccacttcagctcacctcccagcccaaggcagatacgtct

SEQ ID NO: 868 - DNA, 465 bp, A.fumigatus
ctgcgccccagtacgagacaaaggagtctgtcgggacagtggcaaccattcatctgcgcttcgatcctgtcggcaacgaagcgccgccccggctcggcagcgtctggagtcgactgcgcgtatcgacatactacgccgcggtcccctgggaagactacccctccgccctgtcggcgaccatgtgggcacaggttgggaagagtgtgtacactgagaccgtccctctgtctaccctctgcgtcgcctcggcccagtggactaaacactcggcctcgagcccggtccgccggagctccctggagtcgacttcctcgtccgaatcgctcaccggaccctctgcctctttctcgaggagcacctactataccgcctcggtggtggtgccggtctccctacccgcgtccaaggcctttgttccgaccttctactcctgcctcatctcccgcatgtacactctcgacctga

SEQ ID NO: 869 - DNA, 396 bp, A.fumigatus
ttgtttattctgagacaaagtacagagatgctgacaggagcaagttacaagcatggagtgattcatcccctaattgaggattcccttttgcgatcggtccgtaacgagatcaaagaacacctcgacttcactgagaaggaaaccgatatctacaagatctttcagtctggtgatctggcgaatctggacggcttggacgatgcttctttgtcaaagctaccttccttgctgaagctgcgtgatgccctgtactctgcccgattccgggaatacttgtctgccgtgacgggctctggcaaacttagcgggcgcaagaccgatatggccatcaatatctacaacgaaggatgccaccttttgtgccatgacgacgtgatcggaagccgacgtctgagc

SEQ ID NO: 870 - DNA, 231 bp, A.fumigatus
gaaaggttatctttgtccattctccataattcttcgataaaagtatcgatatatacttgcaaaatgaagcggaagaccgatacaagagaggctctgaatggcaatggccagccggagtccaagaagcgcgcactgtcaaacgaagaagtggctgcgcgcttccgtgatggcctatttgagccctcggagcagcagaagtataccaaagcatatgcccagtctagcccgtag

SEQ ID NO: 871 - DNA, 591 bp, A.fumigatus
gctcccggtctaatattacaagcgaatgaaaacccaccctcaggacagcaatcccagcagatccgctccgaggaggatgaccgttccattcgtaagctacgtgaggtctttccgccggtggagaccagcctctctcaattgccagaagcgaagaaactcttaattctccactcattgctactcctagttttgagtcttgaacactataacgcctggtctcgggtcctgatgctgttcgtgacgtccagcttagggctggacgtgaaattactaaacgaagatgaagtcaaagtggcgagggggttgcttgacactgctctggcactgtcgtctaacgccccaaggcaggatgagagtcgaagtcgcgattcatcccgaaaatggaaggttgggatcgcgtcagttgcgggtgctgccctgatcgggatcactggtggactggctgcgccccttgttgcagctgggcttggtactgtcatgggcggccttgggcttggcgccaccgccgcagcagggtatctcggagctctcgctggaagtggtgttgtcatcagcggacttttcggtgcttatggtgggcggatgaccggt

SEQ ID NO: 872 - DNA, 192 bp, A.fumigatus
accggtcatccgcccaccataagcaccgaaaagtccgctgatgacaacaccacttccagcgagagctccgagataccctgctgcggcggtggcgccaagcccaaggccgcccatgacagtaccaagcccagctgcaacaaggggcgcagccagtccaccagtgatcccgatcagggcagcacccgcaactga

SEQ ID NO: 873 - DNA, 216 bp, A.fumigatus
agaatgtgtcaagatcatgcgcgaaggtggcaatctttccttggccgcgttgggctttcgaggccgctgttcaaaaagatcctcaacacgttcaaaccctggaccatgcttggatccgccacagcggcaaatgagaaggagcttcctgcttttcgtgccctggaacaggcgctggagatcgatcccaacaatttggacgcccttatgggggctggc

SEQ ID NO: 874 - DNA, 1053 bp, A.fumigatus
  unsure (743): Identity of nucleotide sequences at the above locations are unknown.
atgatggacgagtttgccgcacaacaaccaggccagattcccgggacagcaccacaaccatttgcgatggaacaactaaggcgcgagctagatcacttccagaccactccgccgagaacggggtctcccgggtgggcggctgaatttgatactggcgagcatgcccggatggaggctgcgtttgccggccctacaggaccgctaatgaacaacgggtccgcattcacacctgcagagtttgctcgcttccaacaacagagtcgggtcggcatgccacaaacgtcaagcccagccacgtccgtgtcgccggtgatggccggttatcagcgtcctatgggcatggggtacatgggtatgggaggaatgggtatgatgcgcccatcctatacacccatgggcatgcaacaacagcccgcggaggccgctactcaggacaagggcaagggtcggatggtcgagctcgatgatgagaactgggaggcacaatttgccgagatggagacggcgggtaaccagacgctggacgatgaggccaacgcggcgatagaggcggagctgaatgatctcgataggtcagtccccactactgataccggtaatgctcaagattacgatgcttttgagagcgtatggcaaagagtccaagctgaaacggcgacaagtagaaaactggcagatgaagatgcttctttcgaaatcaacgacaacctgcacatgggagaccttggcgagtgggacggctntgacaatctccaaacgcgtttacgagatcctcagctgggcgattacatgttcgaagaggaaaacgtgttccggaatgtggccaatccctttgaagaatgtgtcaagatcatgcgcgaaggtggcaatctttccttggccgcgttgggctttcgaggccgctgttcaaaaagatcctcaacacgttcaaaccctggaccatgcttggatccgccacagcggcaaatgagaaggagcttcctgcttttcgtgccctggaacaggcgctggagatcgatcccaacaatttggacgcccttatgggggctggct

SEQ ID NO: 875 - DNA, 210 bp, A.fumigatus
  unsure (76): Identity of nucleotide sequences at the above locations are unknown.
attggatacagaacaccctcgtcccccatgcacacaatgtggcaagctggggatccagtgtctgttcacaacaaancacccatggtcaaggaactcaaatggtatgcattttacattgcattggagaagtaccagcaatctcattatagtttagattcgtcgctgaataccgctccaattcagagagtcacccccaatccagatgaataa

SEQ ID NO: 876 - DNA, 798 bp, A.fumigatus
  unsure (621): Identity of nucleotide sequences at the above locations are unknown.
gcggtttttgctggtctgaacgtgaatcccgactcatggagctgcatcatgcagaggcaacgaaagaatcttatgccggctttctcataccgccacatcaagaacctctaccccattttctggtccaagagcatcgaaatggtcaagctgatcgaaaaagaccttcatagccgagcagatgccaaagacaatattgttcgcgtgagcgaatgggccagcagagcaacgctagatatcatcggtgttgccggaatggaccatgactttggttctctccacgattctaacaacgaactgaccaagcactaccggcggctcctcgaagagccgccgctcgcaatgcgtattatctttgtcttgggcgtcctatttgggagcgtcggagtcgtggaaagcctcccactgaagcgaaaccgcgagattcgcgaaagctctctctacatccgcgacgtggcccgccaaatgatccgcaaaaaggaagcaaagatgaagagccaagcatccgcagaaacggggacggacatcgtctccgtggccctggaaagcggcgccttcaccgaagaagaactcgtagatcaaatgatgaccttcctcgccgccgggccacaaaccactccacanccctcccattgttattgtaccccctgtgccaacttccgaacgtgcaaacgccctcccgcaaggaattcgttaccactttctcccatctcgccgagagacccgaaaccctcttccgaagccaaattcaattccttcctttactccaacccttctggaaagaaagttttcggttccccc

SEQ ID NO: 877 - DNA, 807 bp, A.fumigatus
gcgcaaagcagatggccccacgagttcaggggtgaagccatctataccgcagaggttgatgtccattcccccaagctcacggttggagataccctttatttcgcggctcgtgcccgaacaccacgacacatttttgggggggtgaatgcgacccagtatgccggccacatgcgagacgtgatcatggccatgtttggtatcagccatacgaagaacacaattgtcggaaacgacttcatccgcggtgtatctggtggagagcgcaagcgggttagcattgcggaagcttgtctcagcaatgcaccgctgcaatgttgggacaattcgactcgtggtcttgatagtgcgaatgccattgagttctgcaaaaccttacgcatgcaggcagatatcaatggcaccacagcctgtgtctctctatatcaagctccccaggctgcgtacgactatttcgataaggtcctggtcctatacgaaggtcgcgagatctactttggtcccacatccatggcgaagcactacttccttcagatgggcttcgtatgccctgaccggcaaaccgatgccgactttctcacatctatgactagccatcttgagcgtgttgttcagcctggttatgaagatcgcgtacctcgaacacctgatgagttcgctgcacgatggaaggcctcaccacagcgagcacagctgatgcaacacatcaagagttataatgcaaagttcgcactggatggggaatacctggataagtttaagcaatctcggcgagcccttaaccgccggactggacagaaatgcgtcgaa

SEQ ID NO: 878 - DNA, 282 bp, A.fumigatus
  unsure (30): Identity of nucleotide sequences at the above locations are unknown.
tatttccccgattatgagggcggtgccgantacgccgcggcctgtgattacatcctgaaccgcttcgtatcactcaaccaggccgagcaaaagcagatctacactcacttcacatgcgccaccgatactacacaaatccgtttcgtcatggcggctgtaaatggtgcgtcttccgaggacccttgtatactctttgattaccgaccactaacgtcttccagatatcattatccaagagaacctcagactctgtggtctgatctaatgagccattatacttga

SEQ ID NO: 879 - DNA, 213 bp, A.fumigatus
ctcaacaagcgaacgctcctagagtacatcttgatcaatgtcgtctctacttcgcttccccaatttgggttgggagaggagggggtttggtgcaggaaagggaaggagggatccaagcaagcgacccctaagatgtatctgtatctgaaccctcgtcgaacgcaagatgttagggtatgggagggacatctaatcgtttatgtcatacagtaa

SEQ ID NO: 880 - DNA, 435 bp, A.fumigatus
acttgcaggaatttcgcgactctggcgcaacgaggttattacaacaacatgattttccaccgcattatccccaacttcatggtacagaccggcgatcctactggtaccggcaggggaggcagttcaatctacggcgagaagtttgaggatgagattcatccgggtctcaagcacacaggagctggtgtgttgagcatggcgaacagtggacccaacaccaacggcagccagttcttcatcacccttgcgcctacaccgtggttagatggaaagcacacaattttcggtcgagtgaaacgtggaatgcgagtaatacagcgaatgggactcgtcaagacgaattctgaggataggcctgtcgacgaggtcaacattattcgcgccaaagtcgtgaagaaggcgtcttcacgacggtgcaggaagggtccgtgcact

SEQ ID NO: 881 - DNA, 603 bp, A.fumigatus
agacgtccattgatgttcaattcaagcaaatccctatttgcttattgtctcccgctaataattgattgtattctaggtttccggcaccagggtcaaattccatcgccatttgcctgtatcactaagatattgggaaccactcccaagcatccaattcacacaatggcgactttcagtgctgtttcgaggaggccattcatagcattgccgtttctaataccatcctgtgagccggtggctctggagttgcgcagaaatcagtcttcatacagacgtacgaaacaacgtcttcgcgttaagccggatgcctcttttggcttctcttcggatcaaacccaggatcacatcatcttcaatccaccttcgagcgctccgtctgtcttccatacaccgacaaaatttcttccccctgatgatgctcggaggacccttcgcaccgacgtgtcaatgaaaagtgatcagaatcccgaaaaccttcctcctgtattcaattcgccaacggaaaaaaagtatcacctgactccatctgacatagaggaaatccgcaaactcagactcagcgaccctatgacttggagcaggtggaaattagccaagcgattt

SEQ ID NO: 882 - DNA, 315 bp, A.fumigatus
attgtccagattcggatcgctaaccccttattcttacagcgtagcgccgctctcaagatcgactgggtcaaggtgaccagctctctcggcctccgcggccagaccgctgcctctctccaggccttcaagaagcgtaatgacgatgcgcgccgcaaggtccagctcctgtccgagcagccccagaccgtcaacttcgaccactaccgcagcatcctgaagaaccaggctatcgttgacgagatcgagggttatgtcaagaacttcaagcccgctacctacgatgtcaaccgtcacctgaaggctatggctgcctaa

SEQ ID NO: 883 - DNA, 276 bp, A.fumigatus
aacgctatcgcggatccttcggccctagtggtagaaaacgaatggggtgataccgtcggaagctggaagaatgaaggcgcaccggatctacatctcttgaccaaggaggaagtggagctctgcaatgtactacacatccaacccaagccatacctagtgatcaaagagacgctgttgaaagaggcaatgaagcaaggggggagtcttaagaagaaggatgcacgggctatttgcaaggtaggatctacatcgttgttgttccgctccgttttctaa

SEQ ID NO: 884 - DNA, 189 bp, A.fumigatus
  unsure (91): Identity of nucleotide sequences at the above locations are unknown.
tatccaggaatccaggccaaatgcctcattctgtccggccaatataatgggcttaaaccatatttaggctggaatgccctcccattcctanccttcgcaattagtatcctggtatcccaaacaaaaatgctggtccgaaaaaaaaatggcactccgccgggaattcgaaacccggggacctccccctag

SEQ ID NO: 885 - DNA, 267 bp, A.fumigatus
tccgacccgcagtctgtaacccccgtggtgaatacttatctctgcttctggcactcagttggaaattccgtcgacctgtctgtgtcgcgcgacccgatgtcgacactcctgtgtatgggattcgaaatgatctcgactgcaagggctgaggtaaccggtcaagaatatttagaatattatcttgaaatgaagtacattgacttccaaccgttgcagaccgcaatgcagccgcaatgggtatgcggcgaacaagcgcccgcattctag

SEQ ID NO: 886 - DNA, 222 bp, A.fumigatus
aaacaactgacgaatacgaggatatcccactctggttatgcttacattctctcttatattcgtttcattccctctgttgactcgactgcatcctttggaaaactactgaaaaagaggaaatcaactgaaaccatggccacttcataccaacctccgtctcaagagggccattatcctcgtaagtactatttcaaagccgaaccagaccaatatacgtgctaa

SEQ ID NO: 887 - DNA, 363 bp, A.fumigatus
tcgccgtcgatttttgcccggcctgcaagtgcactcagtatggtctccagttccgcaggcggctcttctgtctctgcagtttcaaacgaattctcggcctctacttcggccatatcgtccaccaggtcatcatccgggcgggaaaaaccggccaagctggcaatccagtcgccatcgggcaagatcctccggctcactcgcaaggcagatcatatgatcagcagcgattcttcggatcccaccgctgatggcagtgtgtgggagacggtgatcaagatcggggagcgcgggacctggcgcggactcgtcctcgccgaccgtgttgcccggtggtgtgttttctgtgaatgggaatgtttctag

SEQ ID NO: 888 - DNA, 300 bp, A.fumigatus
  unsure (269),(270): Identity of nucleotide sequences at the above locations are unknown.
cacttctgttgggtatgcgcgcatggctgggaagccttgcgccgaggatgggcccatggtgaagttgttgaaagatgctggtatggctgcaaacctttttttcctctgttgcgtatcctgactcgtacaggcgctgttccgtatgccaagactgcactgccggtgacacttttgtcatttgagtcctacaatggtctttggggtcggtgcttgaacccacatgtgcctgagtactcacccggtggttcgactggaggcgaaggtgctcnntgcttgcccttggggcccgggggggtttcc

SEQ ID NO: 889 - DNA, 456 bp, A.fumigatus
cgaatcaacagggaccagaagcaaaaggaacgggccgcccgtttcgcttccctctccccagactaccacactgcgttcacggcgtcagataagagtattatcaacacaccaattgaacagctcgttgagtcagtccacaagtcccacctttcaccaaccgatgttctccgcacgtatggcaaggtagcagtgaaggcgcaggaacgcacaaactgcgtgactgagctgctgctgcccgaagcggagacatggcttcagaaggaagtcaatctcaaaggtccactggccgggatccccgtctccctcaaggattcggtgcaggtcaagggttttgacacttctgttgggtatgcgcgcatggctgggaagccttgcgccgaggatgggcccatggtgaagttgttgaaagatgctggtatggctgcaaacctttttttcctctgttgcgtatcctga

SEQ ID NO: 890 - DNA, 762 bp, A.fumigatus
cagcttgctcagctccccagaaattcaaccgaaggccttgggcggatccgccacagctcagacttgacgaagagactcgctgagctcgagacagagtaccacaagagctatacccggcctgcgaattctgggcaggtagccgtacgaccatgtcttcatcttcaggagggcttcgttgcacgatccatcaacagtgaggaagaccagctgtacgtcaaccatattgctctctcactcgggcccggtcttgattctgggcgattgaggtttgcatggcaagatactgctgacaatagtgagatcctccggacttgctttgctcctttggagaaggagattgttcaagttgtcctcacgcctggtggtgcaatttcatggacggaagacgaatacgacagcctggaggactgcatcaaagagcaaagagccaggcagcaagagatttctcgcggtatcattaaaaatatgacagatgtccctccagtacgatttcatctagcaacattgtcatcgaagcgtccgttagttttgttcatcgcaattcatcacgctctctatgacggcgaatcattctcgatgctcctggaggacgttgcagcgcgttacgtaggagagcctgtgacccggcgaggttcgccagccgctttcatcgaccacgtatatggtcagaacctggagaaggcccaacaacactgggtgaacgcgctgagtgactgtcagcctacaactcttccgtggtttcaccacgggggtcgaaggtcc

SEQ ID NO: 891 - DNA, 555 bp, A.fumigatus
  unsure (532): Identity of nucleotide sequences at the above locations are unknown.
atgtacaggaccggtgacattggtcgcttgatgagcgatgattctgtggaatatgttggtcgaggcgacgaccaaaccaagatccgcgggcagcgtttggaacttggggaggtctcagaggttatccgttcctcttctcctgttcaaatcggcgtggtcaccacggttaccaaacaccctggtctcgcgagaccgcagctcatctcgttcattgcccgatctggtgacaagagccgtcagcgcatcggagatgcaaccataattcactctgacctggcgacgttgggcaaggaacttcgggacgcctgccagcggaagctgccagcctacatggttcccgagatcattctgcctatcacctttatcccactggccccgatgtcaggaaaggcaaatatcaaggagctgcacagcatgttctcaagcttgcctctcgcgagcattctacaaggaaacaatccaggaaccagcgatactgctgcttttactgatcggcctttgtcttccgacaaaaaagctgtagtcagcgaanatttgcgctgtgatcaaggttga

SEQ ID NO: 892 - DNA, 954 bp, A.fumigatus
ttgagcgtgtccggccagccgcctggtttgacgggcgatgtgcgcttgacggagggtaaaatccgaatgggtgcaactcgatcgttctgcccgcagtacgcctggatccagaatgtgtcagtgcgagagaatatcctctttggaagtgattacgacgaagaattttacgaccgcgtaattgatgcatgcgctctacgagccgatctagatattttcccaaacggagatcagacggagattggggaacgaggcatcacagtctctggaggccaaaagcagcgaatcaatatcgccagagcggtctactccaaagccgatatcattctcatggatgaccctctttcagccgttgatgcccatgtcggacgacatatcatggacaaagccatctgcggtcttctcaaggataaatgccgtgtcttggcaacccaccagcttcatgtccttagccggtgcgaccgaatcattgtgatgaatgaaggccgtattgacgctattggtacctttgacgatcttgtacggacaaatgaacacttcagggaattgatgtcaagcacttcgcaacaggaaaagcagtcggatgatgatgatgtcgacaaaaagtctaacgaaggcgaacctttgaaagaccagattgacaaggctagaccagcagccgcgttgatgtcaaaggaagagctagcgacggggtcagttgggtggccagtctggaaagcttatattaccgcctctggatctttctttctcaatttcattgcttttctcgtgctgttggcctgtctcaacggtggtctaattatgaccggcctgtgggtctcgtattggacgtccgacaagtttccaaacctgaccgctggccagtatatgggaatatatgcgggaatctgtgcagcgcaagctttggccctgtatggcttcgcactacatgtaacccattgccgcagcggtctctag

SEQ ID NO: 893 - DNA, 207 bp, A.fumigatus
catcaattccctgaagtgttcatttgtccgtacaagatcgtcaaaggtaccaatagcgtcaatacggccttcattcatcacaatgattcggtcgcaccggctaaggacatgaagctggtgggttgccaagacacggcatttatccttgagaagaccgcagatggctttgtccatgatatgtcgtccgacatgggcatcaacggctga

SEQ ID NO: 894 - DNA, 738 bp, A.fumigatus
  unsure (715): Identity of nucleotide sequences at the above locations are unknown.
cactcggctagacgacatggtataccacggccaaactcaacatactcgttcgtctcggacatgggaggcgatggtcggaacttgtcgcccggtgcttccccttaccttcatgcacgcacctcaccaaggaactcctcgtcccccgatgtccgtccactttcttttgtcgatctcctcaacacaccctatcctcagccaggaccgacccccgggcaactggacaactcccatctaaaatcctgggtgggcaacaatgcctccttactcagccacaaacagacctttgatatgtatctcgccaatgtgaagaaaacggacgaccccgcagtacagtacgagttcgccgtgttcatggtcaacgcgatgttggaaatgccgccggacgatcatgaagcacgcaaggacgcagtgtatggcggaaaagcggcggggatcactcgtcatagtctcctcaaggaagccaagtcgatctttcaacgtctggctgaccgtagctatccgtttgcgcagtactacttggcagatggatatgcatccggactcttcagcaagggcaaggaagattatgaccgagcattccccctgtttctagccgcgagcaagcatggtcacgtcgaggcatgctatcgtaccgccctctgttatgaattcggttggggaaccagggtagaagcggctagagcacaacagttctaccgccaagctgactcgcctnttcaccgcgaaatggcgatcaag

SEQ ID NO: 895 - DNA, 201 bp, A.fumigatus
  unsure (28): Identity of nucleotide sequences at the above locations are unknown.
agacctcagaacatagctacaattctcntagcctcagagaacggtggaggtgagctccacccacaagactttaggccttccgacgtcgctattctttccactttcgccagtagcccgtttgagggatctgatcctttcccggcacttggccacgaggtccaaaagtttagatccctggggatatgctctttgttcttttga

SEQ ID NO: 896 - DNA, 249 bp, A.fumigatus
ctacccaaacacaaaccgtttccagttgtctgccaatcgttggaccccctcctgcaaagaccagccacggagctcacatatctgccgagcaacttcctcgagcaagtcgtccatctgctgtccagcagtgtgaaggtcactctcaataagcactctgtcctccggcaaagctttgacaactgcaatgactttctgagacgatggcccgctgaaattgatgacattggaaaaggagaagtacacgtctga

SEQ ID NO: 897 - DNA, 777 bp, A.fumigatus
ttctcgcaattcatctcccaaaacacggaacggctactatccttttcccaatgctctggttggcaaggttcggccttgatcgtgcttccagacttccaaagggcctggacccagcagaaggttgagaatcgtaatgcgcatataacacccggatctcgtgaaggccggaaactctcaccttacagggtgcatatggaacaccaaaaggctattctgaaggcccagcttcgcctcgccggagaacttcgacgaccagtctcagtacacagtgtccaagcacatggagcggtgttcgatgttttcaaggagctatggtccggccatgagcgcagagtaccatcgcgacgggagagacgaagacgtcttagcgttgaaggggctcacgcagagagcgacgcggaagacgagcaagtgcaaaagtcactaaagcgcgaaggttcacctctcccatacccaccccggatctgtatgcattcgtattcaggtcctgtggagcaattgaagcaatttctgaacccttcaaatccctcagacgtgtacttctccttttccaatgtcatcaatttcagcgggccatcgtctcagaaagtcattgcagttgtcaaagctttgccggaggacagagtgcttattgagagtgaccttcacactgctggacagcagatggacgacttgctcgaggaagttgctcggcagatatgtgagctccgtggctggtctttgcaggagggggtccaacgattggcagacaactggaaacggtttgtgtttgggtag

SEQ ID NO: 898 - DNA, 204 bp, A.fumigatus
cgctgccaggtcgtcgcagtttacatcgccggcgaggcagtcggcgccctcacgcaaaccgctatcggcgatagactgggccgacttcggttcatggccctgatgtgtgtggtcgtgacgatcggcaccgttatccaaacagcatcaatcaacattgggatgttcctggccggtcgtgcccttgctggatatgctgttgggtaa

SEQ ID NO: 899 - DNA, 234 bp, A.fumigatus
  unsure (118): Identity of nucleotide sequences at the above locations are unknown.
gaagattttcccatggctccgcgtagggtcctctactcactcagttacagaggaatggtagccactgtacccatctacctcagcgaaatctcggccccgcgccatcgaggcctcatangaagtatctcaggttgcggaatctcgtttggaaccatggcatcgaactgggtgggcttcgcctgtagctttgcgccctatgggcccgtgcaatggcgactgccgctgggcatccaa

SEQ ID NO: 900 - DNA, 216 bp, A.fumigatus
caagggcaaaaggattgtggtgagcgtgtggtaggcgacaaaccatcggattttaatcgcaacatacgtataaaccagacgacccagaaagcagttgaggatattagtcctgtctggttcctgcgacagggtaaactccaggctatattctatcagtttactgattctatgattaataacaccgttaatgtgtatcatggtatcatgcacggctga

SEQ ID NO: 901 - DNA, 864 bp, A.fumigatus
ctattttcttccctggctgaaccctgcttgttcaggctgaatttgttcttcacgattggctccattaccgccaatgtatctgctctaccggtcgggaccatccttgaccgatatggttcgcgcctctgtggcttcatcgggtccgccctgcttgtcgctggaagcgtgttgatgtcgctttcgttttcgcgaccggacttcgatgggtacatcattgcgaacttcttcctagcccttggagggacattcgtttttgtgccctcgttccagatcgcgaatgcgttccccaagcatgcaggcatcatcgtcgctctggttaccggcgcatttgatgcgtccgctgcggtgtatttattctacaggatactctatgagagcaacccggagacttttacgccgcagaggtttttcctagcctacgtggctgttccggtctgccttctgcttgccctgcttacgatcatgcctgcccaagattatcaatcatcgcatcagctggaaatcaagatggaacaggccaaggattctacgcgggatattcacgagtcagaccaagagattgaaagtgacaccgagctgcgacgggtgcgaagtcaacgagccgaagaacgcatggacgatatgcgacagattgaccgagttttgggtgatgccgacgaaagaagacatcgcgaggagcaggaagcggagcgccaagcgaccagcgtggtttggggtgtcctccatggcttgcccgcacgcaagcaaatggccacgccgtggtttattctcatcaccttgatgactgtgcttcagatgctgcggatgaactatttcatcgcgaccattcggggtcttcaccccaggagccaaaatcggcgctag

SEQ ID NO: 902 - DNA, 213 bp, A.fumigatus
gctcacatatttaataattataacctatttataattcccttaaataactatacagggtctcttactgtaatctactatagtaataaccttagatattatatagagtcctattgcaaagccagtttcattaaagttctagatattatctttatagataccatgttcctgaatagctctatatatagttttaaaccactgttttataacctttag

SEQ ID NO: 903 - DNA, 219 bp, A.fumigatus
aaatctaatatgttgttaaatgttggaattaattatttaatggggtgtaagaaaattcctccctccgtcgttatccgtctctcgggccgtggaattacgttttccgaggaacgaatttccctatctgaacgaacgggacattatttattggtggttcaaatcaacctgaatctggaacaccccccttccctccaagatatctcatggaaaaatataccc

SEQ ID NO: 904 - DNA, 198 bp, A.fumigatus
agatcgtcctcctggcaggtcgtcattgctcaaccctttcataccatcattttccaagccacaaattttctggactgcgtcatcgcatggtttttgattttgactgtctttcctagtttcggttcgtacggcaaacgaccggaaaatagcgtccgtcggatgcttgctaaatcaacaaccaatcagcgattgggataa

SEQ ID NO: 905 - DNA, 657 bp, A.fumigatus
gggggggctggcggattttcgcgtctgtggagaatagccttcaagggacctcttcgccagcttattgtaagccttccctccgctccgctggtggccctcccattaaccctgccaagtttccaagaagtccaaggcctatcggcgctggaggcatccatccgcatcctccccagtctcgtcgtcggcgtccttctgaacctggtaatcggcgtgttcgtgcacaaagtccccgcattctggatcgccacggtcacctccctcctctgcgccggatcgcccttactcatggccgttatccagccgtcctggccttactggggcaatgccttcgtcgcgcagctcttgcaggcggtcagcttcaatgcgctctacactatcggcctaatcattattacgaatagtttcccggatgacacgcaggccctggccggggccgtcttcaacacagctgcgcagttcgggagtgccctgggactggcaattctgcaggttatctcgacggttgtgacggaggagtcggccgctgatgggactggtgcgctgatggcaggataccgcgccagtttctggacgatgtttgggtttatgattctttgtacccttctcgggtactttgggctgcggaaggcgggtaaggttgggttgaaacgggattga

SEQ ID NO: 906 - DNA, 423 bp, A.fumigatus
  unsure (36): Identity of nucleotide sequences at the above locations are unknown.
cattccccagcctatgatgaaagccatctcactctntatattaccatgtcgcagatattctcaatatgggtggtcccattccacgtctctccagtcagactcaccacggtcatcaaccttaccacggattcaggagtccagaagccgtcaatggtgaacgggaatcatactctttactacatcaccaagcaagaagatctttaccaggtgtcagagtggatcaagtttctggttccccatgttgggtatctctttgttcttgcttttcaatcatttgcgactctcttctgtctgcttggtgttgtcatcttgtatcctatcatgtggctggaggagagacgtgttattccttacaagatattgcgtaagggaaaccttgtgtacaatattgagaggaagataccagagattaagaaagaatga

SEQ ID NO: 907 - DNA, 870 bp, A.fumigatus
agacagatttttgacgagagcggaagcctcaggcgccttgacaccgttggcggcacgtccatcagcagtgtcatggccggcctggcctttgaggagctggtgatctctgtcgcggacgctctggatcagcttctctcgcagatcgtggcactcctcgaggcccggccgaagccgcgtctgtggtttcccaccagcattgaatacgccgtcggctgggtgctgcgacgggacgctcgcactcccgttgcgggacagtcgtctgacccggacccggacgaccatgcagtccagacggacgaggcgcagcagctcttccgccggatcagccggggataccgtgtcaagcagcggagtggtcttggccgagtggtgctgggagtataccactggtttatcagcgccgagggtctttttgccttgcgcatggtcatcctgacgattgccctggcggtgccggccgtcatcccatcgagctcgggattctactaccgcgaaaaaggcctctggggactcatcatggggcagaccaccctgctggtgtacatgtccgactttatgttttcgctcatctgccgggccgttggcacgattatcggaggtgctgtaggattggccgcgtggtatattggctccggccacggaccggggaatccgtacgggcttgctgccatctcggttccggtgattgttatcttcctgtgggggcgactcttcctcagtcccgcgatgctgccagcgaccgggatgagtgccgcaacccttttcctcatcatccgatacagtttcgctgaatactatgccctctgtcccccttccccctccccctccccctttgggcttttttgcttcctgatccctgaccaccgcaca

SEQ ID NO: 908 - DNA, 201 bp, A.fumigatus
tggactgaagctaatctgtttccccgcgtcctggtccgggccgcgtggggttctcacagccctagtctcgacactgacaagatcaccgataacaaagacttcaagaaatggatcaataactatctcggcgttggcgagtgggtcatggaccagtcggtggctgtgctgtcgtccacgagttatttcgaacgcaagcggtga

SEQ ID NO: 909 - DNA, 183 bp, A.fumigatus
gcagctacgaggtcctggcgacccaagcccaagagtatcgccaacactgcgaagaagctacgagacttgttcagatgtacggtatcagcgcgcaatcagtcggcattgaccgtgcaaaatttttggatctggattcgccatgagattacggtgtccatcaccaacgagatcccctgcatatga

SEQ ID NO: 910 - DNA, 213 bp, A.fumigatus
aatcttttgattcagctatttcacagccctgcccctaaggatgatactctaagtgcttcaattatcgtgagcagctacgaggtcctggcgacccaagcccaagagtatcgccaacactgcgaagaagctacgagacttgttcagatgtacggtatcagcgcgcaatcagtcggcattgaccgtgcaaaatttttggatctggattcgccatga

SEQ ID NO: 911 - DNA, 195 bp, A.fumigatus
  unsure (71),(92),(147),(179): Identity of nucleotide sequences at the above locations are unknown.
cggattgctgcaagctttcatccgttcgtaacaggagcactgcacattgtcactcctgattggattaccanacgaattattattctactatnaccactctttctaaatgttacaagttacagtgtccttggcaccggctactacttnttctgggaatggtactttatctactccataantatcctccctaactaa

SEQ ID NO: 912 - DNA, 969 bp, A.fumigatus
  unsure (123),(124): Identity of nucleotide sequences at the above locations are unknown.
tttccaaccaatgcatttcccagaaacccgttggtaaccctgttacttgggttcaagccgggttttttcacccaagggccgaatccccaactctccggaaaggacgtaatttttgtttggaanngttgccggggcccctggaacccaaatggaattggatgtttttggggaattaccccgtcccttcatgcaatcatggggcatgattatgccggaacagttgtggcagtcggagattccgtccgtgagctgttcaaggttggtgatcgcgtttgtggactcgtcaagggcgcagacaatacccggcgcgagagtggtacctttgcagaatatattgtggcgaaggctgcaattcagatgaagatcccagacggcgtcagttttgaggatgcggccactgtgggagtcggtgccactacagctgggcagtgcctctttggaccgtcttgtctgaaactgcagtggccagaggcaccaaatcagattgaaaatcgagacacgattctagtatatggaggagccacatccgcgggaagctggattattcagtttgctaaactgtacgcccacttcctcagctctaatgacatatcactcacagtcgatagggccggattcaccgtcctcacgtgttcgccgaataattttaatctagttcgccaatacggagcagatgttgtcttcgattatcacgaccctgtgtgtgcccgaaagatccgcgagcataccagtaataccctccgagtcgtctgtgacaccgtagcaactcaggagtctgtgcagatttgcgaagcggctatcggtgacgcaggaggcctgtatcattcattgctcccggtgcaaacgacacgcgcagacgtgcaagcaacttttgcaaactgctgtaccatgattggggagacatttgagtatggtcctgatcggtggtattcccggtcttcaccacgccgtagaaggtccgcattggtt

SEQ ID NO: 913 - DNA, 195 bp, A.fumigatus
  unsure (66): Identity of nucleotide sequences at the above locations are unknown.
cttatttttttcgccgcacatagcatacaggccttcacgatgaagcgttctgtcgagactttgttngccacagtctctgtgttttatgctcagactgatattgagaaggagccttcgctgtctgcgatagaatatgcagcagcctccatccagccttactctcccgtttcgaacgttgtagggtgttgcatttaa

SEQ ID NO: 914 - DNA, 192 bp, A.fumigatus
gacctcatatcggccatctgctcacgatttgaatttcgaactaatttactccacagcaccaatttgtatgcagtcacgcatccttcagagccaaactactgcgctgctgttggaggcgacacatttggcatggacaatgacaactttaaccagattcctgccaatgttttcaacggtcggggatcctcttga

SEQ ID NO: 915 - DNA, 666 bp, A.fumigatus
  unsure (160): Identity of nucleotide sequences at the above locations are unknown.
accccaaaaccattgcttgggaaaagtatccagaagcctttccttaatccggaattcaaagttttcacttattccaccaaggagacttatgtcaatgactatgtgggcaagcataacccactggtcttgtatgactctgtcaccaagaacagcactcgtntgcgccagatcaagaactttaccagcttcgaggacgacctggccaacaagaaacttcctcaatgggcatttatcactccaaacatgaccaacgacgctcatgacaccaacattactttcggagccaaatgggagcgaagctggattgcgcccttgctcaacaactcatacttcatgaatgataccctaatcctacttacctttgatgaggatggcacttattccaagagcaacaagatcttcagtgttcttctcggtggtgccattcccgatgagctgaagggtactcaggacgatacgttctatacccactactcagtgattgcgtccgtgtccgcgaactggggccttccttcgttgggaaggtgggattgtggtgcgaacattcttgagattgtggcaaacaagacgggatatgtcaactacgacgttgacacaaccaatctccgcctcaacgagacctaccccggtcccatgtcagcgggcgaatactcgaaagtcttcacc

SEQ ID NO: 916 - DNA, 279 bp, A.fumigatus
  unsure (22),(38),(40),(83),(84),(88),(116),(127),(142),(176): Identity of nucleotide sequences at the above locations are unknown.
aataagatgtttaatttcccgnaacccacggaggatantnagattttttttcatttgttgggggggcgagttgtaacaatatnnatantattagcctaccttagtttgcaaagtantaatgccatcngtgcaggttcatacntagtctctacttttagtaaagggacaagaggccngttcacccatggcacgagtacatctgttccgccaacccaccatgagacaatgattggatctgggatcagtgagcagtccgaccagtttccttcgaggacgtga

SEQ ID NO: 917 - DNA, 249 bp, A.fumigatus
aaaacgtatgttacgagctatcggagacaatatcacctcgctattattaaacagggaactgatctgatattctcacagaaaaaaggtggttccgcgaagaagcagattgcacagctccaagctcaagcagcacacaacaagtccgccgaagccaagaagaaggaggctgagaaggcccgccgtgaagccgagaagaaggccgctgaggctgcaaagaaaggaaccttggagttgttcaagcccgtgcag

SEQ ID NO: 918 - DNA, 1080 bp, A.fumigatus
aaacccaaggatgctgacttctgcgcaacattcggtgtcactgttctgaacctttttcaagtggcttgggcattggttctgcgactctatacagggcaggatgatgtttgcttcgggtacctggcctctggtagagacagtaatgtgtcagggatagacgacattgctggtcccatgatcaacatgcttgtatgtcgacttcagcctacccgggacaagactcctcgcgagcttctcaaacaagcccataagcatctcacactggctctctctcatcaacatgtcccactcgcagaagtccagaaccgtcttcggactcatggaaccccgctattcaacacgttggtcaatctccagaagtcgaacgttggacaaggtatctctcatcttacaatctccaccattggggcaaatgatcccaatgagttcacgatagggttgcagattgccgacaatgggcaatctattgatgtactcttcggacattggctttcacgggtatctgtggatcaggccgatttgctcgcatctctgctgtcaagcacggtcaataacatcatggcgcgtccccgtgcccgtctcggaacaatcaacttttgcaacggagtacacgctcagaagatggctgaatggaacgaacaggctagaaggccggtggtcgagtcgacactacactcgattattcaagatcaagctagacagcgtccgagtacgattgccattgcctccacagaagcaatgtggacgtatgaggaattagaacgagctgcagatcagacagctcggtatcttctgcgccaaggggtccaaccaggcacaattctcccattctggatgggcaagtcttcgcgagccatccgtggttatgctggccgatctttaaggttgggcttgcgcctgtgccggctcctagatcctgcttcacccccccagaccggttggaaattgatcctcccaccaaacttggggccaaatattggcaatcagtggacccctgtgtccatggaattccttgaaccctggaagggaacctgcggaacctatttggcctttgacccaacttggggcgggaagccttca

SEQ ID NO: 919 - DNA, 675 bp, A.fumigatus
ttgaccgaaatagggaaaccataccacgtagcgctggaagaggacctcaccgaggctattacaaccatccgctactacagtggctgggctgataagatcgcgggccagaccatcagcacgacgtcgagcaagttcgcgtatacgattcgtcagccgatcggtgtcgtgggacagatcatcccgtggaactaccccttgtccatggctacgtggaaactcggccctgcgttagcttgtgggaacactgttgttctgaaacctgccgagcagacacctctcagcgcgcttgtgcttgcggagctgattacggaggctgggtttcctcccggggtcgtgaatattgtcaatgggtacggcagagaagccggtgctgccctggcatctcatccgctagttgataaaattgcgttcaccggctcgacacaaacagcaagagagatcatgaagatggccgcggggacattaaaagatatcacgctcgagactggtggcaagtcaccgctcctcgtattcccagacgccgacatggagcaagccgtcaaatggtcgcatttcggcatcatgtcgaatcaaggccagatctgcacggctacttcccgcatctacgtacaccaggatgtcttccattctttcttggagaggtcttcacccggggctgaagaagggcgttccact

SEQ ID NO: 920 - DNA, 483 bp, A.fumigatus
ctgtggatgccctcccaccccgtggtgaagacccccaggtcccgtcaatgtgagttaagtgctgctacagctcccataccccgacttcccaccgctaacatctgttttcaggcaccaccactgaagagcacgccggttttgaccaaaaccaaagaaaggatatccgacccggtaatcgcagcattcattgctggaggggttgccggtgctgtatctaggacgatcgtatcaccactcgaacgcctcaaaatcttgcttcagattcagactgtgggcagagaggaatataaattatctatatggagggctctcgtgaagattggaaaagaggaaggatggagaggcttcatgcgtggtaacggcacaaactgcattcgcataataccctattccgccgtccagttcgggaagctaccacttctaccaaaaggtaaatctcgaggactgttaccacggtccattgagttgtggcctaaacgttga

SEQ ID NO: 921 - DNA, 249 bp, A.fumigatus
  unsure (5),(16): Identity of nucleotide sequences at the above locations are unknown.
tccantgcgggtgcantgggatccaaaataaggactggcaatttacgccgttgggattacggtctattcaaaattggactgaatgcagacgccatggacaagtacgttgatgactggattgttgggattaccgatgtgaccgaggttttcaaggcccattcaaaaatgcccggccgaagtaccggatggaagaatccaacaaggttggtgcctgcccaaaaggtttatccctttgtcccaagaatttaa

SEQ ID NO: 922 - DNA, 225 bp, A.fumigatus
  unsure (178),(219): Identity of nucleotide sequences at the above locations are unknown.
caaatctccactactccctacacggtggcttcaattcttttccgggcgtcgcccatcgacccagccctccatccttcctctccgcctgctccccagacccacgatcttgccagctacaaccgttctacttccattgacgatcaatctacgactcagcagccgggagcggatgctatancgggtgcgtcgccgaaatttttcaaaattggtcgatattangactga

SEQ ID NO: 923 - DNA, 564 bp, A.fumigatus
cgtggtgaagactcccgcggcgagcgagtcacccctaccaacgcatatctcgactggctcgccgtctccctgttccgccagtggctcgtggacaacaccactcctccgccggctccgattctcaagaacgcctcgacgaacggtctgcccgccgccggcgcaaacatcagcgttagcgccggcaacaataccagccgcagccatcgcacccaggaaaccacatcgcgggcccctcctccctcgccccctctcaccccagcacaggtctaccgactcataggctccccctcaacacaagcctacctctcgcacgacgaactcaagaaattcctcaaagtgcaccccaccccatccgcagactcgctctacactcgcgacgtcctcaaacgctttgagcgtaaaatggacgaaatcaagcgactggcccgggagatcgtcaagccgctcctgaggaattttctggagttggacctgaagggtaccgacctgggcgactcggcgctcggcgcgttgccgtatctcacctgcacgaaagtcgaggacgaagacatcccttgggattga

SEQ ID NO: 924 - DNA, 546 bp, A.fumigatus
cgctttgcagtttttggcagcgaagcgcgaccatttgaccctgagaagaaacctcctcatgtcccagcagatcacacccaccagtggcgcgtatttgtcaaaggagtcaatgatgaagacatctcctactggctgaagaaagttcagttcaagctacacgagacatacgcgcagaatgtacgcaccatcgagcagccaccgtttgaggtgaccgagaccggctggggtgaattcgaaatccaaatcaagctctacttcgtgccggagtccggcgagaaaccacagacactatggcacagtttgaaactacacccattcggacctggtgcggaggtcaagaaagagcgcagagaggtggtgatcagccagaactacgaggagattgtatttaacgagcccatggaaccgttctacgacctactcacaggcggacctacctcccagcaaacgcagaagggcaaggggggtaagaatacaaagcaagctgcgcagcagcgtggaggtaggaccgcgtcttcaccacggggctggaaggagccgcgccat

SEQ ID NO: 925 - DNA, 180 bp, A.fumigatus
gagtcgaagaacatcactgatatctgtaactacttgcatatcacaataatggataagctcttggtcagaactttgacgatgacccgctttgaaaattgcagccaggccccgttccagctattcgactatttaagttccttcgacactatcctgctttattgttcaatatttatttcgacg

SEQ ID NO: 926 - DNA, 645 bp, A.fumigatus
  unsure (4): Identity of nucleotide sequences at the above locations are unknown.
gaantcgatccttcttcaattcacttcaaagatggccaactgcaagggacaattctcaagtccatatctgccaatgagaaagtcaagctgccacttgtgatttctttcctggagtctggagctgcgcgcatcgtggtcgacgaagagaagcggatgaagggcgaaattgacctccgacataacagccaagtgcgcaaagagcgatacaatgaagcagagcaatgggcactggttggtggtttggaatcgagcaaaactgccgctgtggacacagaatccgagactggattcacaaaggtactttacgggccggataacaagtttcaggcaatcattcgccatgcgccgttcagcgttgattttcagcgcgatggccagagccatgtccgagtgaatcacaagggcttcctcaacgtggaacactggcggccaaaggtggatgtggcagagggtgacagtgttcaggaaaaatcgatacctcagcaagatgaaagcacttggtgggaggaaacttttggtgggaacaccgactccaagccaaaaggtcccgaaagtatcggcctggacatcacattccctggctacagccatgtttttgggattccagagcatgccgactcgatgtctctgaaggaaaccaggtag

SEQ ID NO: 927 - DNA, 681 bp, A.fumigatus
  unsure (566): Identity of nucleotide sequences at the above locations are unknown.
gcagcaccgatccgaatgaccccacagcagcagatagggacgcactttttggaggagctagggaccgggtacaacagcagcaacagaatggtcctcctcctccatactcagaaccgaacaatgcttacggcggcggaagccaatgagtacaacacttccacgtatcaggagagacagctcactgcggaagaagaagaagaggaagaaattcagaacatcaagcaggagatgcgattcatcaagcaaggcgatgtcgcatcgactcgcaatgctctgcgcgtggctgcgcaggctgaagaaaccggccgcgaaacgctcgcccgccttggggcccaaggggaaagaattcatgacaccgaaaaagccttggatgttgccgctatcgagggccgacttgctgaaaagaaagcaaaggagctgaaaactctcaataaaaccatttccccggtccaactttcaaacccatttactacccccaggagacaacgggaccaaaacaagaagatctttgagacccatcttcttaaacgggcacctcgggaaggcacccccattaaggcttttcnaaccaccccaagaattgaaccccccttcccggggagattaaaaaaaaacccggtaaacccctttggaaaaaccgggaccaattttcccggacctttcccaatttatcatttttaa

SEQ ID NO: 928 - DNA, 345 bp, A.fumigatus
acagcctgctggatcaggctcgacgaaaggacgctctcccatcagcacccctgcacctggaggcatcccacgccacacacccaccacggctatgctcccaaccagtatggcaatcaaggcggatacggcgctgatcgatttggtaatgctggtggtgcctcgacctcccgatacggccctggtggttatggaggattaggcagcaccgatccgaatgaccccacagcagcagatagggacgcactttttggaggagctagggaccgggtacaacagcagcaacagaatggtcctcctcctccatactcagaaccgaacaatgcttacggcggcggaagccaatga

SEQ ID NO: 929 - DNA, 231 bp, A.fumigatus
  unsure (8),(28),(29),(34),(38),(42): Identity of nucleotide sequences at the above locations are unknown.
aaatacanatttcatatttattatatannaatanaaanaaanaacaccccccccctggcgcctttctgtgtttctctgcgtttcttacccttcatctttcgcatgacgcttgtcacttttggcattatcattcagggaatcatggctaaagagcgggcgccccttatcatttccacctcatacgtacaaactaggactggcagatttcatcatctggaattgcatcaatag

SEQ ID NO: 930 - DNA, 432 bp, A.fumigatus
gtacgttgtggagcgtgtactgattcggggagagtgagagagtgtcaggctgtgtacctggtggcacacagctgtctgtctattgactcctggagaagtacaaatatccccttcccccggtttctccgcgtcctgttagttgctctttcattgtttttgaacctctctttctttctttctttctttctttctttctttctatctttctttctttctttctttctttctttctttctatctttctctctctctttctctctttcttttgtttcgttcttttctaccaacaagctcctacaatcttgttgtctgtccgctttggagtcccccgtacctttgtacatacctgttcctgacccgtttgtccaacgttctgtcctctcatcctggcgcccccttttgcccgcatgtcaggcaggccactgtccctga

SEQ ID NO: 931 - DNA, 630 bp, A.fumigatus
acctctctttctttctttctttctttctttctttctttctatctttctttctttctttctttctttctttctttctatctttctctctctctttctctctttcttttgtttcgttcttttctaccaacaagctcctacaatcttgttgtctgtccgctttggagtcccccgtacctttgtacatacctgttcctgacccgtttgtccaacgttctgtcctctcatcctggcgcccccttttgcccgcatgtcaggcaggccactgtccctgaatgtatccactattgccccgatgggtttccctaccctctgggatatgaacgtaacttcccttgctctcatcgatgtttcgtggttgagaatgaaccgccactactacctaacgacgctacggttttcttgctctgggttccatcactcgacaacgccttttggcaaagtcctctttggctcactaaccatgaatgcctccattgccacccccttgttaccgccggtcttccaacctctggtgtgtggatcctcgaatcctcccctcctctgtttggccagttccctcctaaccctttatttatttgcccaggttgccttgggtgggttgcctttcttccgcctctctcttcccgatga

SEQ ID NO: 932 - DNA, 540 bp, A.fumigatus
  unsure (143): Identity of nucleotide sequences at the above locations are unknown.
agccctgtcaacatcaccaatgcccaagtgccagacccaagctgggaatgggcttggccgtcatggtacgttgatatgtccggtgacgtcgacgaccagggctggcagtattcgttctcatttagctcaaaagcctggcatgngactcatccctggttccattcgtttgttcgaaggcgacgatgggttagactgcgcgtaaagcgcactttagagaagacacgtcgtggacgatcgggattcgagatggctcacatgttgaacgaagattattttacaattcactctccgcggaagcaaagcagagctaccagttcgatagcggtgtcggggaatctgagtcgcacgaccactggagtggaagaggaggctctgttggaagagataggaaacattcctacactaatgtacgccctgaaggctgccattgttgatcgtgagaagataaacgttctgaagcgtttcatcgaggatgggggcgaagagcttcactacctagatagcaaggtatcccaatcactcgtttctcgttgccaatag

SEQ ID NO: 933 - DNA, 750 bp, A.fumigatus
cggcggagagataaagtagcgggcgagaaggagcaacgtggagtggaggaagatgcaaagaaagagaacgtttccatagaagggaagtcggatcatacggaggacccatctcccatccctgtcaatggagggggttcttcggacacgaaatcatttgcgagcaacggcgggaacgaagacggtggacggaagggtaagaaaggctcaggggatagggctttacagaagccatccgttccggagttctatcctcaggtcatggctatccccattgccaagcgccctctgttccctggcttctacaaagcgatcaccatccgagacccaaatgtagcaacagcaatccaggagatgatgaaacgaggacaaccgtacgtgggtgccttcttattcaaggatgagaatgccgatggcgatgtgattgaaaatcttgacgacgtgtacgatgtcggggtgtttgctcaaattactgctgcgtaccctcttcgtggagaagccagcggcgtgacagccgtcctttatcctcatcgtcgcattaaaatttcatctcttcttcctcctggtgaacagtcgaaggctggcaatactgaggacaaggctcccgaaaagaagggggatgttgtggcgagctttgaagagggcgttgccgaacccgcgccaaaggatctctacgagcctacttctttcttgcgcaaataccccgtccgcttgtcttcatcctcaggaagcgaccggatccgcgaaaattgg

SEQ ID NO: 934 - DNA, 504 bp, A.fumigatus
tcgtttgcgctcagatcgaccaacgagcctatctccttcactctgtctttctgtatgtttggcccagagaggcgtaccaacaaagcagacttcaaactaaccaagagtcccagcccctgcctcacatcgagcctgttcggcctcttcaacttcgtctttagcatcctctgtcgcaacatcctccccatgaacaatctatcaaccatcgtggtcagtctctgctgcgcttttgtgtttctctacgcgctaggcgcattgtggatctatggacggacgttcgcggacaggacgcgcatccagtacggctctgcgagcccgaccctacttaccgaggaggagatgcagcgccagcagctgctccgattactgcagcagaatgggaagaagaagaggtccagtgcgaaggcggttcagaagacgttcaaggttgatgtgccggaggttgtaagtccggggaaagggtgggatcggtatatgccgccgagggaggagtatttcatttga

SEQ ID NO: 935 - DNA, 468 bp, A.fumigatus
taccacgtctcgtcgtccggggccgccgtgctgtctgcctcgcccatcgccaaggccctggccatgggcgtcacctcccacgacgtgatctacgggggcgacgtctccatcgacgccaccgccaacggcaacggtggcttcatcttccgtgtgtccaacgccacggccgggccggatagctacaacgggtactatgctgggatcggcgtcggatacgtcgtgctcggcttcgcggaccgccagtggaatgagctcaagagggctccggcggcggatatcacggccggacagacgtaccgcctgctgatccgcacgaggggagactcgatcgctgtctacgtggatgacttgaacacgccgcggatggtggtgcaggatggaaggtatagtgctgggttgagtggccttcgggcttacatgacgaccatgtctgtgagtaatgtgaggatttatcacggcttgtgttga

SEQ ID NO: 936 - DNA, 288 bp, A.fumigatus
cgtatttcaggtcagtttgaggaaactcagggacgacattggaaaggaggcctggagtctcgagcaacaaatggattgatattgactcgtttagcaagaactactcagaatgcaaccgaccctcctataagcactagtcttaggcgtcctacaagcctagtattaggcgtcctactaagcactagtccgggtctactaaacgctaggtttggcgcaaccacaaggctagtgttcagtagcgagaccggttggatcagtctacacgccggcggctggaaggtacaaagt

SEQ ID NO: 937 - DNA, 204 bp, A.fumigatus
tcaactcccagaatcgtcgagtataccagaccgacttattaccctagcgccagcgtacagaagcaacaagatgtcccaggtggtattccccggcgagagtacaccatggaccctcgtccccgtaattgctttaagactgacggaccttcaaggatgctccttatcaccgtttttggcctaacacgaagaaatagtttgttttga

SEQ ID NO: 938 - DNA, 585 bp, A.fumigatus
ctttgtttctcatacctatggcacgtcttccctgtcgtaccacagtggtactcgtcaccagatcgctacggctctctggtcgctgaagaaccggtcctcgccatgggcctgataatgaccgcatccaggtaccacccactgagtggatttaatggacatgcacggtccgaaagaattcactggcgcacatggccgtggtttcaacgtgttctccagtcatccatgtggggttcgccagtgatgcgaaagctcggttctgttgctgctttgttgttgcttatcgaatggcatccacgagctatcaactcgccagaggacctggtcggcgactgcagtgaaatagaactgtttgatccgcaaggccagccatacgaagctgatacaagagagtctgcagaacatgatcaactcccagaatcgtcgagtataccagaccgacttattaccctagcgccagcgtacagaagcaacaagatgtcccaggtggtattccccggcgagagtacaccatggaccctcgtccccgtaattgctttaagactgacggaccttcaaggatgctccttatcaccgtttttggcctaa

SEQ ID NO: 939 - DNA, 417 bp, A.fumigatus
tactgtatactccactcctggtctggcatcaggtttcattcttttaatctgctttcttcttattttcacgtcaccatgcggtcgattcacctcctctcttttgtatttggtatcagccccgttctggcctggaccgagctccaccatgcgccattcatgaacaagaatatcgatgccatcgttgcaccgggcacgtacacctcgcacatgcataccttcttcgggagtgatgccatcaccaacgtgctgcccacctctgcggaacttcagcggggctgctatagcggggacaacccaaatgacctctcagtctactgtatgttgcacataacgcccatcctcccggtttctcattctatcttttcgaattcaggggtgcccagtcttcaccacggggctgggagggcaaggcaacta

SEQ ID NO: 940 - DNA, 504 bp, A.fumigatus
cacgaatgcatcaatgacaaagactggagtttcagtctgccctccgacgcagcgcagagctttacaagcctaactggccaggaagcagacctgctggcctaccttttgagtccaaagcctgggccctatgcctctctgcttctcgcttaccgggactcatcccctaatcatcgcccttacctaaacaaactggacagtctgtatctggaaaagaaagaggagctaccacacagcgccttcatcacatcctgctatgcagccgcccacccgggcccatacggagcctacctattcgatgcaatcgagcgccaacgcgtcttcgtcgacaagatggttggatatctgtggatccgcagtcccggcgtgcacgggacgctgtccagagcaatcacccgctacgagtacttcttacagctattcaaactccgtcccggaacaactcttgtgccaacgctggacatcgatctggtgtggcatacccaccaatgctcggcgagtatgtac

SEQ ID NO: 941 - DNA, 381 bp, A.fumigatus
  unsure (358): Identity of nucleotide sequences at the above locations are unknown.
atacgcatgcgctgttccttccggcccggtggtgaagacgtgctgacagatgtctggctcagtggaccgacagatactggtatgcagcggctcgccctgtccgaggaggacaagagtgtgagggactggtttatcgacactgctaaagcactgaagtgcaatattactatcgatgaaatgggcaatatcttcgccgtacgcccgggtcgtcgaaaggatgtgcctgccacattcatcggcagccatctggacactcagccgactggcggtcgatatgacgggatcctcggagtccttgcaggcattgaggctttgaaggtcattgacgagatgggaatcgagactgagggaggtatangagttgtcaactggacaaagtaa

SEQ ID NO: 942 - DNA, 939 bp, A.fumigatus
  unsure (193),(706): Identity of nucleotide sequences at the above locations are unknown.
cattttcatagcgaggaaggggctcgattcccggttagcatgatttcttccggcgtgtgggcggagtgcatacctctttcgagggcccatgaccttaaggaagttcctacggtggcttcactacctaccgcagcctcctctccagagacaatgaaatccgccctgaaaaagatcaactaccttgggagtgtcncatgctcatacaaagaaacgccgatggcagcgcactttgaacttcacatcgaacaggggccacatctcgagtctgccaaccagcgcgtcggtgtagtcaccgccgtccaggcataccgctggtaccgcttgaacgtcatcggtagagacactcatactggtactacagccttccagcaccgagccgatgccctgtacgcttttgcccgcatgatggttcgcgctagggaagttgcatcttctcacggctgtttggcaagtgttggtattatcgaggcgaagcctgggagtgtcaacaccgtgccaggacttgtaagcttctccctcgatattcgcgggccagagaccgaattagtcgccgtcgtggaagcagaattgaggaaggatttcgacgcaattgctgccgaagaaggtaagggtattgggaagccatgtcgagtggagtggaccatggatttcgactccccagcggtcaaatttcacccagactgcattgaatgtgttcaagaatcancagaagccgtcgttgccgatgctggtgtctctgatcccaagtcacttgtgcgggatattatgagcggtgcaaggcatgacagtgttttccaccccaaacgagttccccccaatatgatatttgtgccgtgcaaggacggtttgagccatcatccccgaaaaattttggctctgtggaacactggtgccacacgcgcctcaatccattctggcaggcagtactcccaatattga

SEQ ID NO: 943 - DNA, 624 bp, A.fumigatus
  unsure (37): Identity of nucleotide sequences at the above locations are unknown.
gtagggcagagccagagattagtggacctggggggtngtcttcttgcgaggaggtccattcggccggagatgaggtccgatgggtatcggatcatcatgaagccatatctacacaagtcgacatcgtcatcacggttcatcagtacaagctattcaataatagacgtcactctcacaatgactcacctccgtagaatccatcaccagcaaggtagtcatacttttcatgatcatcaagcagtgtatatggacgaaatatctagaaataccacattaaccctaacccgtaaccaccatctagatattatcttacagacgaacatccaacaaattccttccaaaatggcaccgtataaaactgaagaggaatcaattcgaccattctccgaaaccaaatccgacttcgtggaaaaatacgtccttcgccctgtcggcaaacccctaacgaaggagtaccgcgtctacttcaacctcaatgacaagctcctctccccttggcatgatctggcgctgtacccaggcagcaaccgcgagccggtggtgcatatggttgtcgaggtgccgaggtggtggagtgcaaagatggaggtgagtcctctctgtgttctcatcgacacgcagtga

SEQ ID NO: 944 - DNA, 225 bp, A.fumigatus
  unsure (215): Identity of nucleotide sequences at the above locations are unknown.
cgacaccagatcgcaaaagacgagtacctccatcccctgaagcagaatatccaggacggtcggttaaagtacgttcccaacatctttccgcataaaggatacccattcaactatggcatgttacctcaggtaagctcatttatatgccttcaactaagagatctacagactgatagaaatcaaatagacataccaagatcccgagatccaagacnccctcactaa

SEQ ID NO: 945 - DNA, 741 bp, A.fumigatus
acagtggaccatctacggcttgtggcaaaattcaaaccttgtccaaaggtccaagtatgtcgggtcattggaaggccagggatagaagatctctatcgccttccaagcccccgcctcaaggtttcgttccaccctgtgtctcccgaagcatcggcagcagacctgaacacggatactctatacactctatttcgcccctatgggaagatcagagacatagagacacaaccgtctgacgggaaggtcacgcccaggtacgcctatgtggaattctctcggcccaagtacgctggaatggcgaagaactgtatgcacggattcaccatcccagaacaagaaggtggcggcaagtcgggtacgcggctcaagattaagtacgagcggaagatcaagctgtccatgattaaggactggcttttgaatcatcccaggatcgttattccggtgctcgccgccctcttggccgccatcaccgtcaccatctttgatccaatgcggacatttttcatcgaactgaaaataaagtcgacgcttcagaccgaagagaatggtgtgatgcagtggatccgcaaacaggtcaacaaggcaaacatcatctattttggtcgcaaaggggcggatcctcgtgggctcaccgccatatgggaggaccgtccggaagacattactccactgcaatcctggctaatggaaaatgtggaaaacttcatccatattcatggaccccgtggctccggaaag

SEQ ID NO: 946 - DNA, 771 bp, A.fumigatus
ggacccccgattcaacagacaatccgcaacatatgggcggacgttctgggtcgcacctctgaaagcatcggcctccagcggtccttttttgcccttggaggtgattccgttgccgccattcgggttgtcgcccaatgccgacaggcaaatttgcagctgacactgcaggatgtgtttcaagcacgaaccattcagtccctcgccgcatgcgcgacagccatcatagaaaagcctatggagacggtgtcttccctccttgagccgagtcaatgcgaaaatccagaaagcgagcttgcaaagctcgactcagaggtcctttcaggcctgggtggtcctgagaatattgaggaaatttacccatgttcgcccatgcaggagggaatccttttcagtcggtccagcattggtggatcatatgacacccgcttggttgtagaggtccttccccgtgacgggggcgaagtcgacttggatcggctgaagaatgcatgggcggcagtcgttcgacggcatcccatcttacgcacggtttttgcggaccgccccagcgatgactccgcctttatccaggtgacttttcgaaagtatcgacccgtcattatgggatgcgagacttccgaacaatcgctggacgatatgattgccatgcctgtccagccgttcgatgaccgcatggaaccctccccatcgcttcaccgtctgcacaagctcacaacggggttgtattcaatctgcttgagattcatcaagtttttgaccgaatgctgtccc

SEQ ID NO: 947 - DNA, 639 bp, A.fumigatus
  unsure (427): Identity of nucleotide sequences at the above locations are unknown.
gcgctgtcgaggcggaaatggaaagactggcaagtgaggtacgctttctcaagggaccctttggattctaaactgatcgtacagacaacgagtcaacatgactacgacctcttatgttccttccaagcctaccttgtctataccatcttgatgtacttcagccctctcggcaatgtatctgcagtaaccgataaaatcatgatgaccttaatggagcttgccttccgtactgctcagaatggcctattgtgtacggcggagaccactcatacgcggccaaattgggaatcttggatcgtggtctcggccaaacgtcgcgccatttacaccatgtacctactcaccagtgtctacaattcggatcggggtctaccaaactttgtggccgacgaaatgaagggggtctatgtccccgaaagcaaggtantatgggaagtcacagaccgagaagtatgggaaaaggagtatgaccgccacctcctggaatgggaagatggaatgctggaaatatcggagttatggcgatcaaccgagactggctcgactgaacgacgggaaaggattggaagatgggttcgtggggtggacgagtttggtatgatgttgttcgcagtttgtgcacatatccatggctgctaa

SEQ ID NO: 948 - DNA, 273 bp, A.fumigatus
tgcaaccatgccggaaaccatcctctgatttacggctcccttggtaaagatcctttgatgatcattataataatatgtgtgatgactggggttgctacgttcatgaaccttattaaacctaactgtaatcccatctcattcagtgttattggtgttctaatatactttactgtttttaaattgtcttcctttagtgtatatatatcaatgatgatgtggatagagaataaacatacaggtttcatagtctctacagatagaatatctatatga

SEQ ID NO: 949 - DNA, 237 bp, A.fumigatus
ggctgctcagcagccatcgaccatgatatccccgcttgcccaccatccgcccgggatttgacttcgacgtatgtggctgcaacgtcatataacgccttgaagatgcgccgctgcttatcacatgttctctgcgcgccgacgctcgatgtagactcgagcgcctcgacaaggcttttcatgtgggctaaatcggtggcttcggatatctcgatggtgtggcagaataggatgatatag

SEQ ID NO: 950 - DNA, 375 bp, A.fumigatus
ggcgggcggttggaacaccgcacctccagggatcctcacccacggtactgcagtgaaaggcaactttcctccccgtcattccgaacagaaatctttggattcttcactgaaaccaccgcgttctcccattgcacattcgtactaatcctagcactggattttcaacaaatcaaggcgggagaatccttctccgtgctgcctgcgtccaacgggccggggttgcccggggcttttccatctgctcactcacgcgctgcaaatgtcgaattcaaggaaaaaaactatcatgggcgcatggtgtatatgttgatctccccgcgttcatccatcaagccccgtcaaacagcttctccccagcaaggaatgatgggcacc

SEQ ID NO: 951 - DNA, 333 bp, A.fumigatus
gaatatatcgattccggctatcgtgataccaaaagccgcattctgtattcgctgcgctcgaacgctcgctacaagctgatcgttttgtgctgtgcgtttgttcgtttgatctacatttccattcagaatggcttccggttcgcgtctatcaaagccctcgtcattggccttgggctatgtatggggtcctgttcttgcaatttaagccgaatggttctggccttgtttcccaaacttccttatgcaattccgcaaagcccaactttcattggcaggcttttgccaaattccaatgcctatgcacttctaaatggcctaacgaatttaaggatg

SEQ ID NO: 952 - DNA, 1020 bp, A.fumigatus
cattgcgtatccttccaggcccgtcggtgtaagacaagaggatggctccaggcgtctcttggtccggtgcttgtctgggtgcgtttgaagtttgtcgatggcggttcagctgtgatgcgaatcccatgctacggccggtcgatgtttccagaagaaaaaatccaacgagaagtttccgtgatgcgttttctcgagtttcatacctctatcccagttcctcatatccttcgttatggcatggccgaggagagcccagatgaactggggccgttcattatcatggagtatatcgaccacaagtacgacctcgtcgacgcactgaatacaccgggaatcccagatgacgagcggccaatgctagaccctcagatcgcggaggaacggctcatttttgcttacggtcaaatggccggtatcatgcttcagctatcgaagcacacattcgccgagatcggctgtatagctcgagccaacgaggatgacgactttgacgacgtgtgggttgtgaaacaccgtccattgacgtcaaacatgaacgagctcgtccaagtgggaaattttcctccccacctccttcctgatggtccttttccgacctcgtcatcctactaccgggcccttgctgatatgcaccttgcccacctggtgactcagcgcaatgacgccgttgcctcacccgaggactgcagagcaaactgtatcgcaagatttctgttccggaagcttgcacgggagggtcggttctgcaagtaccacgaacggggcccgttcaagctgttttgcgacgacttccgtcctgcaaatgtgctgacaaatgcggaattccaggtcgttggggcagtcgattgggaatatacctatgcagcaccactggaattcgcttacagcgccccattctggctgttgctcgacctgcctgaatactggccaggagggctggatgactggacaaatgtctatgagacccgcctggggactttgcttcagggtactcgaagagagattcttcaccgcgggtga

SEQ ID NO: 953 - DNA, 513 bp, A.fumigatus
aggacgatcgctggtgtcaaggtcattcaggtcgacgagcctgctctgcgtgagggtctccctctgcgtgctggcaaggagcgtgaggactaccttacctgggccgtgcgtgctttccgtctggctaccagcggtgtctccgatggtactcagatccactctcacttctgctactctgagttccaggacttcttccacgccattgccgctctggatgccgatgttctcagcattgagaacagcaagtctgacgccaagctgctcaaggtcttcgtcgaggaggcttaccctcgccatatcggacctggtgtctatgacatccactctcctcgtgttcccagcgagcaggagatcaaggatcgcatcgaggaaatgcttccttacctccgccctgaccagctctggatcaaccctgactgtggcctgaagacccgtcagtggcccgagaccaaggctgctctgaccaacatggtcaatgctgccaagttctaccgccagaagtacaccaaataa

SEQ ID NO: 954 - DNA, 453 bp, A.fumigatus
gacgcgttactccttctccggcgtgaaggacgatcgctggtgtcaaggtcattcaggtcgacgagcctgctctgcgtgagggtctccctctgcgtgctggcaaggagcgtgaggactaccttacctgggccgtgcgtgctttccgtctggctaccagcggtgtctccgatggtactcagatccactctcacttctgctactctgagttccaggacttcttccacgccattgccgctctggatgccgatgttctcagcattgagaacagcaagtctgacgccaagctgctcaaggtcttcgtcgaggaggcttaccctcgccatatcggacctggtgtctatgacatccactctcctcgtgttcccagcgagcaggagatcaaggatcgcatcgaggaaatgcttccttacctccgccctgaccagctctggatcaaccctgactgtggcctga

SEQ ID NO: 955 - DNA, 558 bp, A.fumigatus
aaaagccagtcacaccatttatttggtgtacttctggcggtagaacttggcagcattgaccatgttggtcagagcagccttggtctcgggccactgacgggtcttcaggccacagtcagggttgatccagagctggtcagggcggaggtaaggaagcatttcctcgatgcgatccttgatctcctgctcgctgggaacacgaggagagtggatgtcatagacaccaggtccgatatggcgagggtaagcctcctcgacgaagaccttgagcagcttggcgtcagacttgctgttctcaatgctgagaacatcggcatccagagcggcaatggcgtggaagaagtcctggaactcagagtagcagaagtgagagtggatctgagtaccatcggagacaccgctggtagccagacggaaagcacgcacggcccaggtaaggtagtcctcacgctccttgccagcacgcagagggagaccctcacgcagagcaggctcgtcgacctgaatgaccttgacaccagcgatcgtccttcacgccggagaaggagtaacgcgtcg

SEQ ID NO: 956 - DNA, 879 bp, A.fumigatus
  unsure (12): Identity of nucleotide sequences at the above locations are unknown.
gaggatggtccnatgaacggcttggttgcaacctcggtctctgggagctcgatgggccaagacgagatctacgagcgctggctgcgcaaaccccttgaagcccacggggccgtcctaatctggttcgccggccgatggagcatcctcgtcacgcgcccagacctgctaacagacatgtttcggaacgaggacctctacgcaaaagcaggcagccagaagaagatcccctggtcggtgatcgcaacactggtcggcgacaacatcatcaattcgcacggcgacacctggaagctgtacacggggatcatgaagcccgggctgcagaagaagaactttgataccgcgccgctgctgctcaagtcgcggcggttcgtggatgagattctggcggagcagaactctgccggtcgcggcacgggcatcctggtgaacacgtttgtccagcagtgggcggtggatgtcatggggatgagctttctggatctggacctgcagagcctggagaagccgcacggcacggtgcgcctcgaagccatccagtctgtgatcaagctgatgctgttccggccgctgttcttcaattttcccgatctagaccaattcgcgtggctgatcaagtcgcggcagcgtgcgtacgagatcatgcacgagttcggggatacactcatggcgacagtgctgggtcgcatcgacagcaaccgcgagaaaggcatcaagcccgccgaggagatggtcgtgcatatgctggtcgatgcctaccgcgacggcagactgaccgaaaagcagttcaaggataatctcaagattgtgtttctgacggcgcacgagaacgcccagcagctggttaactcgacctttgtcttcacctctggaaaatag

SEQ ID NO: 957 - DNA, 189 bp, A.fumigatus
aagaaagaatctcgatcaaccgtcaaaatggtcagaacttccgtcctcaacgatgcgctcaacgccatcaacaacgccgagaaggccggtaagcgccaggtcctgatcagacctagctccaaggtcattgtcaagttcctcagcgtcatgcagaagcacggtaggttttatctttttttcttgccttga

SEQ ID NO: 958 - DNA, 348 bp, A.fumigatus
agatcttacaagtttccaaaactctttctgtttctttgtgtttggcagcttttaaatcttcgctacatccttactgacttgctatcaggctacattggcgagttcgaggaggtcgatgaccaccgctctggcaagatcgtcatccagctcaacggtcgtctcaacaagtgcggtgtcatcaacccccgctaccccgttcagctccccgacatcgagcagtgggccgtccagctcctgccctcccgtcagttcggctacgtcgtcctgaccacctccgctggtatcatggaccacgaggaggctcgtcgcaagcacgttgctggcaagctccttggcttcttctactag

SEQ ID NO: 959 - DNA, 516 bp, A.fumigatus
  unsure (406): Identity of nucleotide sequences at the above locations are unknown.
aagcaacaaggcagaaatgaggcatcgacgagatatgataagaccgagacagataagataagattatcaccacgtgcgataagccaaggatcgcacaattgccctcacacactccccttacactaccttctctcgtcctacctccctaggggaataacatcaagttctcactacacttcatcggcaatccctataacaagaccagcaatgacctcaattcaaatcctcgacggagggctcggaacctcccttcaagaccaacacggcgtcaccttcgactcctccacccctctctggtcatcccacctcctcgtctcagaccccaccactctcctcgcctgccagcgcaacttcataacagcaggctgcgacgttctcctaacagccacctaccaagtttccatcngaagggcttcgcccgcacaagaaccccgagttccccgatggcatcccccgccccgctatcggaaaatatctccgaactgcactgggcgtcgccgaacaagcgcgggttga

SEQ ID NO: 960 - DNA, 978 bp, A.fumigatus
cgcggatccttggcgcctcgtggtgaagacgaggccagttcgggtgcagcgtttgtgcgcatattaggcctcaagctggacccagccaatgcgccgagattgcatcttttcgcctggaacgtcggggctcgtcacccgccaccctcggccatgcctacggcggcctcggccacggccgtgccgatcgtggacatcatctcccaagacgagatgcgatcgttgatgacattctactttgagaaagtcgatccgtgctacccatttcttgaccgtgatgtggtactccgccaggtcagtaggcgatggctgccttcctcgtccgagtcggccctgccatacgggccctacgatgcggtactctgcggcataacggcgctgggatttctcttctcacgacgacgagccgtccccgcagagtaccgggtggccgaaaccgctcgacgcatccttgagcatggtctgctcgtcgacacccccgcgtcggtggacatcgtcaccggctgggtgctgcgagtcgcgttcctgcgcatgaccgcatcccgccatgttgcctggatggccagctgcacactgatgcacctcatcgaggcatcgggtctccatcgcgagcccttgccagagacctccctcagccagacaagtacgccctgcgccccagagatccgccgccggctcttcggtatggcccgccacctgatcgtgtggatctccttcgagctcggccggtcccgagtcgtcctgcacggagggggctcgctcccgctcgggccccgatcgcccaacggcccttcggagtatttcaacctctcccccgtcttgggaaagcctcgaaccccaagcaaacccaatacccccgcggcctggaatccatcctttgccggctgtcctcgaaggttcttccaggtttcaaacgttccctcatccgttgccggaatggaacctcccaggttctggcctggtaccgggcgcctcctcccc

SEQ ID NO: 961 - DNA, 633 bp, A.fumigatus
acccccgaagtccagcagatcatcgcctccgaaggcggcaaagtccaatacatcatcgccccagacatcgagcaccacctacacatcaccacgtggaaacgcgccttccccgacgcccaaatcctcgccccagaaggcctctacgagaaacgcaaaacctcacggtcctacccggacgaccccgcattcgaccacatcttcaccaaggacggcaaacactcgctgagcatctcggacgagttccacgcggatttcgaagtcgagtacatggacggccacggcaaccgcgagatcatcctctgccacaaaccgtcgcggacgctcatcgaggcggatctgctgtttaatctcccctgcaaggagcagtatgcgcaatcggaggagtctcctacggctgggctgctgaatcgggcgtttatatcgttgttgcaggccacggcaagtccgccgacggcacatcggcggtttgcgtggtatgttttgtcgaagcaggatagggcgtcgtttgcggagtcggtgaggaggatctacaactgggattttgaccgtgttattccgtgccacggggatgttattgagaatagggggaaggaggtgtttcggagtgtttttgagtggtttctggagagatga

SEQ ID NO: 962 - DNA, 213 bp, A.fumigatus
tcaccgcaattttcagtgcgcgcttcatgtgcaaatgagagtgagacaatcaagctcattgaggactcggcgccctcgaaaggagaagcgcaattggctggtgattatctaaatgctagagaatacactgtgggctacctgcagcttagccaggtcaagcgaacagcgcggcacccattgttgttgtgtcttttgtgggcatcaaggagatga

SEQ ID NO: 963 - DNA, 234 bp, A.fumigatus
  unsure (96): Identity of nucleotide sequences at the above locations are unknown.
ctggtcccaaaaattatcgaggattccttcagacccagccagcacaagttcatccacttcaagctggactcaagaaagttttgcatccttgcgtgnagtatccacactatttgtactaggttgcatggggcagtcaaaccagtgccattgttcggtggttcgaaacaggaccttttcctcactcggacgtataacaagaactttacaatctcccaagttcgtcacgtagagtag

SEQ ID NO: 964 - DNA, 411 bp, A.fumigatus
  unsure (385): Identity of nucleotide sequences at the above locations are unknown.
gatttaatcactgatatcgtccttgatcaaaccaggctgtggtctcgattgctgcttcacttctgggccctggaggccgaacgagaagtcgacagaacctcaaaattagatccgatcgaatacctacaacgggcctacgaggagactatccgcgcgacgacctcaccgaatgaatggctgggcaccacaacgacggtgactgcgcttttacacttcactggcgacaacgcagagaatgcaaagcccctactctacgtgacgaacttgggagattgtaaagttcttgttatacgtccgagtgaggaaaaggtcctgtttcgaaccaccgaacaatggcactggtttgactgccccatgcaacctagtacaaatagtgtggatactncacgcaaggatgcaaaactttcttga

SEQ ID NO: 965 - DNA, 198 bp, A.fumigatus
ttgcgttgtcccaggttcttccgtgaatactcgcagttccttcccatcctcgacatcggactgacccccaacgcatactactcacaatctccttttctgttctgggctgttattggggttgcgtgcaggtcttacccgaaaaatccaactctgtcttcaccacggggctggaagggtccgtgcaatcaatgtcggtcc

SEQ ID NO: 966 - DNA, 507 bp, A.fumigatus
  unsure (17): Identity of nucleotide sequences at the above locations are unknown.
acaggagagacaatccntattcgtctgttcttgggtggtttcgatctgacacccaccttccgtgatgtcaacaaaaagtactccacaagatactatctgagcctagtattgatcgatgaaggtaagcagaacaaaaaaatgaaagcacttgcttgttcggatattttctgcattggcctggactgcccgatcgattccctatggcgaaccaagtgtcgtttgtatgacttggaaagccggtcaccattgtcgcggcgttgtttgctgcctgcattggtacctgaggtttccatatgttcaacttgcccaatgttatcccacggtatcccacctagacatttcaatagccgatcggctattgaaatcacctcggaccagtcatggcggtcagtcgactcggaccggctgacttgcgatctcattccgaacggcaaaatcccccacgctaagccacacttggatgatcccactcgcgtggcggccccactaggccccgggttttcgtaa

SEQ ID NO: 967 - DNA, 474 bp, A.fumigatus
gccggttaccttactacccttggccaagagttggcgaacgaaagcgccgctccgcacatcagaaccgccgccggtctggccttgaaaaacgctttcactttcagagatctcgccaagttaagggaggtacaggagcgatggatttcagggatcagccccgaggtgaaggcacaggtcaaggagctggcgctcaagactctcgcttccaaagatgcccgggccggccagtctgctgctcagttcatagtttcgatcgccgccatcgagcttccccgtaacgaatggccagagctgatgaaccacctggttcagagcgttgcaaccggcaccgatcagctgaaacaagcctccctcatcacaattggtttcatctgcgagtcgcaagacccagagctacgggaaagcctggctgcccactctaatgccatcttgacagcagtgtcttcaccacgggggccgacggatccgcgctaa

SEQ ID NO: 968 - DNA, 276 bp, A.fumigatus
caaagtggcccgacgaatttctgtcatgtcaacgacttgacgttgatcgcccgggcgcatcagttggtaaacgagggctacaagtatcattttgcgaaccaaaacgtggttactgtctggagtgcgcccaactactgttatcgatgcggaaatctggcgtccgtctgcgagattggtgacgacctcaaaccgacgttcaagttgttcagtgctgtcagcgacgaccaacgacatgttcccgtatcgcggccgggccgcagcgagtacttcttgtag

SEQ ID NO: 969 - DNA, 393 bp, A.fumigatus
acattctgctacagcgcgatgggtctcatcgcgttcattctcgacggcatctgcaagcattgctcaacgcagtcaacatgggtgcttgttggaataggactactatccatcctcgctgtatctgtcattatcaatgtgctgcagcagctactcttcaaaaatccccacgagcctcctgtggtcttccactggttccccttcattggtagcaccatcagttatggcatcgatccgtacaagttctttttcgactgccgcgcaaaggtgtgcattgtcgctgccaaatttatgtgtctagctaaccaaatttgctttttggcagtatggcgatatcttcacattcattctacttggcaaaaagaaaacggtgtatcttggtacgaaaggcaatga

SEQ ID NO: 970 - DNA, 627 bp, A.fumigatus
  unsure (26): Identity of nucleotide sequences at the above locations are unknown.
attatgtaccactgtggtacttcccnccccgtggtgaagacggatgggatcactgctagtcctcagtcattccgtcctcctctgacggatgctacgcatagactgaacaactgcgctactccaaagagtgaaaaaggatcacatatcgaagcagaagatttgctgataacaccagaccgaatgtctatcgtcacaagcccgttggcaaccagagaaaatgtgggggaaaaccgcgcctctcccaacccaaactctcaagccggctcgaaaaggaactcagcaatctccacgacttctaatgtgtctgggaaggggaagaggaaaacacatgttgggccatggcagttgggaaaaacactgggggaaggggccacggggcgtgtaagattggccaaacatgcagtcaccggccagaccgcagccatcaagattgtatccaagaggtctgccgctattgctcagagcgaaagtattgcagcgatggaccgcaatgcaagcctctttagtggtacaggcaccagacaaatgccgtccggcattgagcgggaggtggtcatcatgaaactcatcgagcatccaaatgtgatcagcctgtacgacgtgtgggagaaccggggagaactgtaa

SEQ ID NO: 971 - DNA, 756 bp, A.fumigatus
  unsure (49): Identity of nucleotide sequences at the above locations are unknown.
catttcgtctctagatacctgtttctagagtatgtccaaggcggcgagntattccattatgtacaaaatcacggaccgttaccggaggaagaggcagttcggttgtttcgacagataattgcaggccttgggtactgccatagattcaacatctgtcatcgggatttgaaaccagagaatatactgctggactcctggcgcaatgtcaaacttgctgacttcggtatggctgcgcttcagccagctggacattggttgaatacctcctgcggaagcccgcattatgctgcgccggagatcatttatggccgaaagtaccgtggagacaaggctgacatttggagttgcggcatcattttgtatgcactgctgacgggctacctgccattcgatggtggggatcttccaagtactctgcgacaagtgaagcgaggcgaatacactattcccccggagttgagtgtagaagcagccgacctcattcagcgcatcctgcaaaagagaccagaagaccgcataacgatgcatggaatatggatgcatccacttcttaagaagtacgaacatttccatcaggcaatgtcacatcactacctcggccctgcaccaccgttaacagcacaggactgcgggccaccagtactcagcagacaggatattgatattgatattctgagaaatctgcagacattgtggcatggtgtcaaaacagagggtcttcaccacggggctcgaaggtccgcgctaatgcgttag

SEQ ID NO: 972 - DNA, 459 bp, A.fumigatus
attccccggcccggacggcgacgtgcacgatgtcggcagcaacggcctcatcagtaccgccgactcgctgcacccggaattcgtcggcccagagatcctcgcggagctgccaccagagtgcaaggaggcgctcgtcgaggccgctgcccgcgagtgggaatggaagtcgaaatggcgcagcgaagcgatagacgggcaacgcacgacgccgctgaagagctatgcttggtttccgtagttatcattcttgctgtacttgcgctgcggctctttcccattttcatcgcggtcctcatttgtctatgtcatcacgtcgcaatcgtatcaggcatgagcagggtttgtattcttcaaacggaaaggagaacaaaaggtgcttttctctttttttattcttttcttttaatcttttgtcatgttcattcctcattttccattttagatgtgctaaatgcctaa

SEQ ID NO: 973 - DNA, 810 bp, A.fumigatus
cacagccagtgcatgcctctctatcactcttccgcgaccatccttggtttcatgtcctgtctgatgagtgcatccacatttgtcatcggccacaaattctcggctaggagcttttggaaagaagcccgtgagaataacgccacgattgtccagtatgtgggcgaaacgctacgatacctcctggccgtgccgcctcaaatcgacccggtcacaggcgaagacctagacaagaaacacagtgtccgggccatcttcggtaacggcctgcgacccgacatctggaatcgggtcaaggagcggttcaacgttcccacgattgccgagttctacgccgcaaccgaaggcacctccggatcatggaacctttcctccaacgactttaccgcaggggcaatcggtcgaaacggcgccctgaccaagctaatcttgggcgccagtctcgccgtcgtcgaggtagaccacgagtctcaggagccctggcgcgatccgaaaacaggcctctgccgcaaagttccgcacggccagcccggcgaattactttacgcaatcgaccccaacgacccttcggataaattccagggctacttccagaactccaaggccacggaaagtaaaatcattcgcgacgtcctccgcaagggcgacgcgtttttccgcacgggcgacatggttcgctgggatctggaaggacggtggtacttctccgaccggctcggcgacaccttccgctggaagtcggagaacgtctccacgagcgcggtcggtcttcaccctacgggactcgacggatccgcgctaataggtggcaag

SEQ ID NO: 974 - DNA, 414 bp, A.fumigatus
gctgggtttaatcgccgccctccaccccgtggtgaagaccaagcaggcgtcagcacgagcatggcgggccaggaaggagtggccagtgtctttagcccaatggcccggactttggatgatctcacttactttacgcgagcgatcatcggcatgcagccatggaagtacgacaacactgtccatcctatcgcttggcggtcctcggaggagaaggaagcgcagacgaaacaactgcgcatcgggctgatgtcttcagatggtatggttgccaacatacacacttatacaaagctgaccgtccccaggagtcgtccctccgacgcccgccatcaaccgtgccattgccaccactgtcgctgcactcacagctgccggccacacagtctccgagatcacacccccggcatccgctga

SEQ ID NO: 975 - DNA, 615 bp, A.fumigatus
  unsure (497): Identity of nucleotide sequences at the above locations are unknown.
ccgtccccaggagtcgtccctccgacgcccgccatcaaccgtgccattgccaccactgtcgctgcactcacagctgccggccacacagtctccgagatcacacccccggcatccgctgaccccttcactggtctaacgcttgcctctcaactcctcaactccgacggctgcactactttcaactcccaccgctacagcttcgaaccgtccgaccccggcgctgaacaactgacgcgcatcgcgagactgccccgtccccttcgctacctctactacctctacgtccgctacatcaggcgcgataccaaatgggccgcgctaatccgcagctttgaacacaaatccgcagccgagcagtggaagctcgtcgcccgccgcgaggccttccgcgccacctggcacgcctggtgggacgccgagccgcagcaatacgatttcattttgtgtccggtaacgccaaggcttgtctttcggaccaaggcaaatcgccaagcccngtcctcttgtggggtatccttccgtgggaaacgggttaatactctgcggggtgtttacacgttttcacacttaaaccgaaaaaaggatgctcttctggcgccgtttaaaccggtttaa

SEQ ID NO: 976 - DNA, 333 bp, A.fumigatus
tatgcgagacccctcaccgcgccggcgatctacttcacgaagctgaccctgctcctgctatacctgcgcctcttcttgctgaatcgtcccgtgaagttcggtatttggggaggtatcgtgttctgcacaatatactacaccgctgcgttctttctcaacctcttcttaagagatctgcatgcgctctcgaagttggcgtacagcgtaggtgttttcagtgttgtcagcgacgtatacatcatcacacttccgttgctggctattgtgcagctgcgcctgagcagggccaagaagtggcgcgttgctgctgtattcctcactggacttttgtga

SEQ ID NO: 977 - DNA, 216 bp, A.fumigatus
tcaattttgaacttgttggtcgattataccttttttaataattataggctgttctattataaacactccttaagtgaacagccaggtccaagcatccaaagggcacggcgtccactaattcgactaattagctgggcaaagccaactttcaccactcatggtacattgacaaagcatgcctggctcttgctagcctctaacaactcctgtcaatga

SEQ ID NO: 978 - DNA, 429 bp, A.fumigatus
gttcgctgtatctgttcttgcagtttctgggtggaagtattcaccgactggcgactctcattcgacatgacatctattgaagagggtggaatcgtctttcatccaaaggagaacaataacgaagatgtgaaagtcgcctataaggagtatggggacatgaaaatggagagtactgcgcaggatcttgctgagagcattgccgatgatgtcaagcaaaacatgacggctgctctggaaagcgtgagtgaaacactgtcccaggcgatggccaatgcaaaccgcctgtgtctccctgcggccggcactttcttcatgaaagaccctgttttcaacgagggcggtgatctgctggtcaaactggaatatgatgggtacgttttgtccaatgtctatctgtccgtgctctgccacagtaatctgaccgtctaa

SEQ ID NO: 979 - DNA, 459 bp, A.fumigatus
ctaccacttattccttgtctgtcgaacagaccgatcctgtcttctttcagaacaatctcttcagtctctacatcctcagtcaacatgatgttcaccaaggccttcttcgctgctgcctttgccaccctctccactgccctgccccatgtcatccagcgcagcggcaactcctccgcctctggaggcggcgtccagatcgtcaacaacctgagccaaaccgtctacgcgtggtcggtcgctgatagcgtcagcgacatgcataccctctctgcggacggcggctcctactccgaggactggcgcaccaactccaacggcggcggcgtctccatcaagctgtccaccaagcccgaccagtctgacgtccttcagtttgagtacacccagtccggtgacaccatctactgggacatgtcctgcatcgacatgggcaccgactccgagttctccaagttcggc

SEQ ID NO: 980 - DNA, 291 bp, A.fumigatus
tcaactctgggcttggtaaggcttgacagtccctttctttttccccgtaacattcagcatcagaagacggacagtgtacaattcgctgactaccctatagccctttggaatctcatccttgctgccagcgctgcagtgtactgtgacaaggctggacgtcgacccctgttcctgacatccgttgcagggatgttatgctcctatgttgtcgttatgggtttatctgccggcttcgccaacaccaaacagtcctcactaggcattgctgtgattcctttactatttatgtga

SEQ ID NO: 981 - DNA, 192 bp, A.fumigatus
ccgtccccacacagctatttcgggttctatgacatggcatttactcctcttccaattgcatacaccgttgagattctgccctttacaatccgatccaaaggaatggcgctcttcacgagtaccgccacgatgggcaacgcgttcaaccaattcgtcaatccgattgcgctcaaagccatctcatggcgatag

SEQ ID NO: 982 - DNA, 255 bp, A.fumigatus
tggccatgcactgactcctgtatgcttagttacgcggtgtatattgccattttgctgttctacttttgtttcatcttcttcatgttccatgagactaaacgtctgtcggctgaagatgcagcaagggttttcgactacaacaggaagggcgctgtcatggataacgccggtgatgatgttgaacagggccctgtcagccccgacaacgagaaacaagaatccaggtccgttgttgaagtcaaggacagggtttga

SEQ ID NO: 983 - DNA, 390 bp, A.fumigatus
tatgatcgctatatgcacatgtcgacaaccaatattatcattgggcaacgtggcaatgataaagcttcactagcactctcctctttcattcatgctctctttgaactggagtgctatgccgttgctcgcttggtggtcaaagagaacaagcctcctgtcatggtgttgcttgctccttccattgaacctgattatgagtgcctcctcgaggtccagctacccttcgcggaagatgtccgaacgtatcgttttcctcctctggacaaggtgatcaccgtctctggcaaagtagtaaccgaacatcgaaatctgccgaacaaagatttgcttgatgcaatgagtgaatatgtggatagcatggagcttgttgataccgacgagaccgggtaa

SEQ ID NO: 984 - DNA, 573 bp, A.fumigatus
ccccgtgctgaagacgtgtcccgcccggggaatgagggccccatcgcatggatgcctacaatacccagtaagcgtaagcagatggtaggtggtggagtcgggatgaagggtatcatctcggctatggccgtcaatcccgtgggagatggtattttggctgcgggtacattttcgaggcagataggtctgtatggggccaatgggattggggagtctctcgggacctttagcattacaaagacggatgctcatcgccacattgggggcgcgggagtcacgcaactgctttggagtccctgcggaagatatttgtatattgctgaacggaaaagcgacggggtcttaatattcgacatcagagtcaccgggcagcttcttggctggctagaaggtcgaagggctttcacaaaccaacgcatgaagatcgatgttgtacctgtcgcacaaggcgagtcccatgagatctgggctggaggaactgatggatatatgagggtatggagaaaccctacacacactgccggaccgcaaaaatgtgactgggaatggaaggtccacgatggtaagcagtga

SEQ ID NO: 985 - DNA, 372 bp, A.fumigatus
atcttcgaggagcatgatttttttacgccccagccgcgcatcgcagatgcttacttccttcgtctcattctccacgactggaacgatgcggattgcactcgaatcgtccggcagatctcctccgctctacggcccggtgcgcgactgctcattatggatgccgtcttgccggagcctggtgaagggtctctgcagagtgagcgacggttgcgacggagtgatattgggatgtacacgctcttctccgccaaggagagaagtctggctcaaatgcgccggctggtggaagattgtgacagtcggctacggtttgagaaattgtatactccgcctgggagccatgctagtatgctcagttggatctgcgagtaa

SEQ ID NO: 986 - DNA, 954 bp, A.fumigatus
cgcggatccttcgagccccgtggtgaagacccttggagctttctaccacgcacactttacaatgagttttcttttttcttcaacatctattttttgcttgtggctctttcacagatcattcccgtgcttcgcatcgggtacatgtcgtcctacatcgcgcctctagctttcgtcgtctcgatatccttgggaaaggaagccttggatgatattggccggcgaagacgagatgccgaagccaactccgaagagtttacagtgttgtcgtttgacaagcccgtgggcagaagggcgtttgcaacgcctgcaaataattattcggattccgacgaagttttcgagatcactaagaagtctagggacctgaaagtcggtgacgttctcaaggttcgcaaaaaccagcgccttcccgcggatgtggtgatcttgaagactatctccaatgactctgtcactgcgcggcgaagctcttcagctgaagttaccgcggatcttatgcgacccgacccagaatcagttcaaccgtccgaggttgagcctagttcaagtgccgccgcggatgaaattggtacttcttctgctagtgacacattcatccgtactgaccaactggacggtgaaactgactggaaactacgcttgccttcggtcctatctcagtccctgcgactccgggatttcactagactcaaggtcaccgccagcgcaccggacaagcgagtcaatgaatttctcggcactattgaacttggctcacagtcgggtttctacgatccccttgtcgacaaagcgcagactggcggcgaagcgagcagcgaggatcggcaagccaattctgcgcccctcaccatcgacaacacggcgtgggcaaacacggtcctggcatccaatacaataacgtatgccgtcattagtcttcaccacggggctggaaggatccgcggtggcgtatcc

SEQ ID NO: 987 - DNA, 207 bp, A.fumigatus
  unsure (51): Identity of nucleotide sequences at the above locations are unknown.
gtttcacactcaatctttcttaacatttacagcatggaaggcctaatcccntcacgactgcttttttcccgtgagaccgggtaccttgtcattcccggctttctctccccagaggacatcacctccctcctgaccgagaccaacaaactcctcgacgacttcccactgagaatcccacccactcaccaaattcaccactggcgatga

SEQ ID NO: 988 - DNA, 762 bp, A.fumigatus
  unsure (603): Identity of nucleotide sequences at the above locations are unknown.
gaatcccacccactcaccaaattcaccactggcgatgacgaaaccgacaaaaacaacacccacgtcggcgacgactacttcctgacctccggcgacaaaatccgcttcttctttgaaccggaagccttctcctccaccctcgaccccgcaacaggcaagcccaccctcctcaagcccaaacagcaagcaatcaacaagatcggacatgcattgcactcactctcctctcccttcgagaaagtctccctgagcgcgcgcaatgccgctatcgccaagtcgctgggcttcgtggacccgcgcgtgctgcagagtatggtgatctgcaagcagcccgggatcgggggcgcggtgccgccgcaccgggactcggagtttctgtatacgaggccgccgtcagcggtgggatggtggtttgcgctgcaggatgcggggccggggaatgcgacgctggggatgtggaaaggttcgcatcggcaggggatcaagcggcggttcgtgaggaaggtcggggagaatgggaaggttcttgggacggagtttgtggagaatgatgggcctaagatgccgaggggtgcggagggtgacggtcaggatccggaccanggaccggatgttaaggatgagaaattcgaaattctggatatcatggccgggtcgctagtgctgattcatgggaacgtgctgcatatgagcgagaagaaatacagcccccgcaacccggttgcctattccttccatgtccttgagggtgccgaccggatg

SEQ ID NO: 989 - DNA, 864 bp, A.fumigatus
cgctccgatgaaccatctgaacaggatctcaaaccccgtcccggaacttcggccctttttgattcctttgcttatcttggctccggagagacgaaatggtcccatacgctcgttggctggaccggcgatgtggaaacaattcaagacgtctccgttcccctgcaacacatccccgtcagctctggcgcaaggctaccgcccgcactcaatggcgttgccgttccactgaacaaagcagccggccccgtggccgtagactcgaagcaacgaccacccagccacccgcttctcgaacgcttcagagtcagtcaagaagaccgagcgcgtcttgacgctcagctgagctcgggtcgttacggcgagatcgctcctgtatggttgtcggacgagtccgaagagcccgaggagtcttcgatcttcctggaagatcaaggccgatggaggcgatatgcggagaaggagctgtaccccctgcttcattacaagcagcacggccccacggatggccggtccgaacggaagtggtggggagattatgtccgcatgaaccgactctttgcggaccgtatcatcgaggagtatcaggaaggtgacatcgtctggatccacgattatcatctcttcctgctgcccagtctgctgcggcaacgaatcccgaacatctacatcggattcttcctgcacgccccgttccccagcagcgagttcatgcgttgccttgcgaagcgcaaagaagtcctgacgggtgtcctgggtgccaacatgattggcttccagacattctcctactcgcgccacttctcgtcctgttgtacgcgcgtcctgggcttcgactcgaataacgccggcgtggatgcttacggc

SEQ ID NO: 990 - DNA, 777 bp, A.fumigatus
gcccctcacgtacgtacgtttcttgcctacggaccgaaacacagagactcatggcgcttcagacccctgccagatgacggtaagctcgatattcaagagtggaacaagcagctggtgcaattggcgagtgcagttggaccaactgtccttggctctttggcgagtgctacatgtacaggtacgactgttgctgccaagatcagatcgaggaattgcgctgagagtccctctagaagcatccagagaatgctaaactcttcaaaacactggcaaaactacgatgttttcaagcgccaaaaggactcgaccttcgtcaaatcgagagccgcagtcgaggagctcgccagtcgttatatgcagatcgttgccgatacgcgactcgcccaagacgagagcaaggaagcggcccagaagttgctgtttatcgaaatgacagagatcgccctgtggggaaacgcgactgacctgtcactcctcgccaacctgacgctggaggacctgcaaaacctgcagggccgcgaggcgatccagaaaagccagcgtaacatcgtcgataacgacaccgacgatgtctgggcctatcttcagcgcacggccggtcagaccagacgccagatcgacatcatcctcgacaatgctggcttcgagttcttcaccgatgtgctctatgccgcctatcttttggaagccggcattgcgacctctatcagactgcacaccaaggagttcccgtggttcgtttttcaccacaggggcccgaaggatccgcgctatgca

SEQ ID NO: 991 - DNA, 375 bp, A.fumigatus
cttgcaaatatagttgccatcactttccttcagcacaccgaccccaccctcccccactaccagcctgaggcctgggatttcactcgtggagcagctgctacaattgaccgtgacttcggcttcgtcggtcgccacatcttccacggcatcatcgagacccacgttcttcaccactatgtcagcaccatccccttctaccacgctgatgaggccagcgaggccatccagaaggtcatgggaccacactaccgcagcgaggctcacaccggctggactggcttcctcaaggccctctggaccagcgctcgcacctgccagtgggttgagcccaccgagggcgcgtcttcaccacggggctggaaggagccgcgcagt

SEQ ID NO: 992 - DNA, 624 bp, A.fumigatus
tggggttttattgccggcccttccaccccgggtgaagactggaagatctctcacggcaagcaccacaaggccaccggtaacatcgctcgcgatatggtcttcgttcccaagaccagggaagaatatgccactcgcatcggtcgtgccgcccatgagctcagtgaattgatggaggagacccccatcctgaccgcaaccaacctcgttcttcagcagctgttcggatggcccatgtacctcttgaccaatgttaccggccacaacaaccacgagcggcagcccgagggacgcggcaagggcaagcggaacggctactttggtggtgtcaaccacttcaacccttccagccccctgtatgaggccaaggatgccaagctgatcgtcctgagcgatctcggtctcttccttgtgggaagcctcctctactatatcggatcaacctatggctggctcaacctccttgtctggtacggcattccttacctctgggtaaaccactggctcggtaagctcctctcgtccacctttcttgcggcatggaacaggtttttgctgacttgcaaatatagttgccatcactttccttcagcacaccgaccccaccctcccccactaccagcctga

SEQ ID NO: 993 - DNA, 513 bp, A.fumigatus
gaagacgtcaccattttcatgatctcagggaatccagggttaattgggtactaccataccttcctgtcgcttcttgctgacaaattgggttcgcgcggcgcgccgagtacaattcagagtcgtagtcatacgtgtgaatttcagatctacggacatagtctgggtggcttcgagctcgagcagcatgaggatctagatggcagaaagcgcttatttgatcttgaggaccagatctgctatgttcaggagaagcttgatgagttccttgcgggcggggagacgaagcagaaggtcattcttgttgggcattcggtgggcgcttatatcgctatggagattctgaggaggcatcgggagaggtcagatgctaaagtcagggccggggctgataaggccgacttcgatatcgttggcggaatcatgctcttccctactgtcgtggatattgccaagtcgccctctgggcagaagttgacggtgagcttcctcccccggtttacggtgcagtactga

SEQ ID NO: 994 - DNA, 282 bp, A.fumigatus
tgtgttaagggggcttctaacggacgcagacacatggcctctgacgagatgcagaccatcacttcggacaaatggggcgatgatgtctggggtgtgtcgacggccagtgagccgctgactcgtctattcttttacttcggccgaaatgaccattgggtggcggagcggacgagggacgagattattgaccttcgagggcgcgtagaaggcgggcctaccatgtcggtttgtgagcttggacttccgcacgcgttctgcttaagtgagtggttttctggctag

SEQ ID NO: 995 - DNA, 327 bp, A.fumigatus
agtaagctatatgcaatccgtgcgatcctaacccaagaactatttaatgcaccgtttagcgacagcctcaagatgctcttcatcggtaccgcaacaacccccaataaccttcacattaggaaccaaaggcaacacgccctcaaacccatccgtaaagacagaaatatccccccgatcaagagtctcactattatccagctcatcatggctcttcaggctcgcattccccttgatcaacccaattctcccgcgcacatcctccgggacatcgcgcagcgccgcagcaatccgcagtattcgcacagcagcgaagatcccacagcgtta

SEQ ID NO: 996 - DNA, 225 bp, A.fumigatus
ataaatgctctggaatttgaatgcatgcctaaatcagcattctactggatagttaatccctcacacccatggaacttgcgcttgatatcattcgacttcatgtttccgtatctccactacagacaatcggtagataacggcttgacctccctctattttacaggtatttctgctttttacccttccgtcttcaccacggggctggacggacccgcgcttaagaaa

SEQ ID NO: 997 - DNA, 507 bp, A.fumigatus
caacttactgcggacttgacggattgcctaaccttcttggacaaattcatcaaggagacccagcgtcggcataacccttcgtatcagcctgggcgaaccgccaaggtagatatgattcttcctggcggctacaagcttccacaggactcggtcgttattggcgctctgcaccatcttcacaataacccagacgtgtggagcaatcctgcgcggttcgatcctgatcgctgggacacagaggaggtcaagaacagacacaagactgcctatattcccttcgccactggtcctcgcatgtgtatcggtttcaactttgctttgcaggaagttaaagtcttcctgcccaagctggtgtaccgatacaagttcaccagggagaatgatgggcatatcgagtacgatcccatgtttcaactgattcgaccgaccaacctatatgttcgcgccgaacggcgtgttaaatggccaccaaggtcagacaatgcggttccgtcaccttcactgtga

SEQ ID NO: 998 - DNA, 327 bp, A.fumigatus
aaacaagaacgctggtgtccgtcggcttctccccacatttggcactccccggttctccacgacgggatgtgggaagacgaagcccatgccatgatcaataatatcattacaccaatcacccctattattggcttgaatcctacaaatatctgctcttcattgtcgcatgagggcctggtcctaaatattaaagggaaccaaggactgcatttgcggtgcagtgtggttcatctctcaaaaaataatcaatctactcccaagtatttattaatcaataacagtgcactcgcccatacggagtactctgcagatacatccatattatga

SEQ ID NO: 999 - DNA, 450 bp, A.fumigatus
cctaacgcaggtcactcgcagtcatggagtgtgccggctgtccctccacgcccgcccctcgaggcgcagcaattcggcaatggagcgccttcccactaccgcttccagtactcagcatgcacagggcggcgtagagccctactgatcggaatcaactatattggacagccgaatcagctccgcggatgcatcaacgacgtcactaacatgtcgactcttcttcatgagcgatacgggtatcggcgggaggacatggtcattctcaccgatgaccagaagaatcccctgagcattcctaccaaggcgaatatactgcgtgcaatgcagtggctggtcaaagatgcgcagccgaacgactcgcttttccttcatttctcaggtgggtggctgtgggtttgcacgcttcgaggcgatactgaggtgcttagggcatggcgggcgaactcctga

SEQ ID NO: 1000 - DNA, 264 bp, A.fumigatus
caggatgtatggatgcttcaatctagctcgcgtagcgatcacttaattgagcgcattccgcagaagcaaacctcaaagcctacttctgatatcctcttctttcccttgcacgatatccgaaacaaggcccgccgccgcaagggtctcctcatccttgaaacgcttgcctacgagctgcagaccaatcggggctccctcataccgctcatgacgatacttggcccactcgcgcgcatcaacctcgctccgggggcgatacccccc

SEQ ID NO: 1001 - DNA, 588 bp, A.fumigatus
cttggggtgacaagggtagacaacaccatcaacaacgacctaggcgcagcacgtatcattaacggaacgaccgtcgaggtggaaatgccctcagagcagcttgacattgacagtggctacgacgccgccctgcgcaacctccgtgaccgtctcgaagtccctccacccccagtgtccgagaaccatcagcaagaagactattaccgcgccgtgcgtacatgcatggtgtccatctggatggtcgccaatgtcatcctcgccatgtccgtctccgagatctatggcgtcgactctggtggaacaaatgtctatctgggcatcattttgtggtcagtggctgtgttggcgctgatccgtgccgtcgggtccacgacgtatgcgatcttgttagtggtccagaagatcgttgagggcaagaccaagtttgatgcaggcaatattgtgaattccaacgctgctacttcgagttatgtgtcgagcagatcgacggcgcagtatggtggtgggactagcttcaaggataaggtgacagaggctggttggaccctcaagaggacagcaggaaaggctatgttctggaagaagtaa

SEQ ID NO: 1002 - DNA, 192 bp, A.fumigatus
ggggggtatcgcccccggagcgaggttgatgcgcgcgagtgggccaagtatcgtcatgagcggtatgagggagccccgattggtctgcagctcgtaggcaagcgtttcaaggatgaggagacccttgcggcggcgggccttgtttcggatatcgtgcaagggaaagaagaggatatcagaagtaggctttga

SEQ ID NO: 1003 - DNA, 702 bp, A.fumigatus
  unsure (215),(228),(238),(292): Identity of nucleotide sequences at the above locations are unknown.
gacaaaaccgtcccaatagtttttttgcccgtttgggttctggtgactcaggaaccgatcaagctgcgctcgaagctgttgaacatctttctgggggggcgcgaaacccccgcgtccctgctcagttggacagtgttgatgctcgcacgccaccgggcagagttccacaagctccgacagaccatcgtcgacgaattcgggacttacgaccaacnccgcaacatcacnttcgctgccntcaagtcctgccaatacctgcaatactgtctgaacgagaccctacgtctgttcnccgtggtccccggcaaccgccgctccgcgacgagggataccaccctcccccgcggcggaggcagcgacggcacccagcccatctacatacgcaagggccagaccgtcgtctacaacgtgcacatcctgcaccggcgcaaggacatctgggggcctgacgccgaggagttcaagcccagccgctgggtcgatcgcaaggtaggctgggattatgtcccgttcaacggcgggccgcgcatctgcatcgggcagcagtttgccctcactgaagcgggatacgtgcttgttcggttgctgcagcgcttcgatgcgattgaggacgtgcagccacatctggagatccggcattctctgaatctgaccagtgcgccggcagataatgttactgtccggcttcgcgaggccgcgtaa

SEQ ID NO: 1004 - DNA, 489 bp, A.fumigatus
ccgttgaatgtcactgattccgacctgaccgcggacatggtccagccgccagcggagcgagacggcgccaccgagatgacactgagcctgatcgggttcgaatcgatttccattgttcgcaaggtcagcttcattccccctcgtcaccgtcaggttaggacaaccagcagtgcatctgtcaccgagctgtcgttgcccaaacgagaggcactagctgagcagctccagagccgccttgagacccgctacctggcgtattgcgatcctgccgaccccttcctctttgtctcagctaccgtggcgcggctgatcatcgcccgcgtatggctgatggtccactatccctgtaagcgggcggatagtaaaggcgtatcagcagcattgctgcaggcgagtctacaggataagatctttcacctcgccattgagatcttggagcggtcctgctccgtcctgtgcaatctgagtatcgctcattgggcctggtga

SEQ ID NO: 1005 - DNA, 714 bp, A.fumigatus
gatgaacaccggcgagatagcgcagagtctcgcccaggagagcagatgagccggattcgtcgcagccttcaccgcacacttcgtgattcgcaccacggacaacaagggcataatgctcggggtaaaaagcagcgggactcgatgtctagcgaagtggtgcccgaggacgagcaagatacgaaggaaggcgagggtctctcccgcaaggcgccgcagttcaccgtccatgggaagaaggcatctattgtcacttttgggtctgagtggcagaatatgactcccgaagagcgtctcaggctgcgcaaacctactccgtcggaggagccccgcgcctccgaccctgcgattctgagcggcggcgattcgaacggcacggaaccgataaacccaggaatctcccagtcactgcgaagcggaagcactgcaaccaggatcagcattcttgatccggtcgagagcgagggttgcagagacgggaatcctaccgcgaacctggaagacacaatggtcaagagcgaccccaacattgatctaagctctcgtcttccgacctctgatggcgctgggccgtccaccgcggcatttccgggatcatcggtattgcccaaagatcagccgtcgtccccttcgacatccgccgacgaggcagctgtcgacgaatatacgatccaaaaactgcagtcgagcccacccgagcaagctgtacatgcataa

SEQ ID NO: 1006 - DNA, 285 bp, A.fumigatus
  unsure (244): Identity of nucleotide sequences at the above locations are unknown.
tggcgctgggccgtccaccgcggcatttccgggatcatcggtattgcccaaagatcagccgtcgtccccttcgacatccgccgacgaggcagctgtcgacgaatatacgatccaaaaactgcagtcgagcccacccgagcaagctgtacatgcataaagagcatcctgaagacaatcacctccatttacgacttcctacccgattcattccagtttttcctttccctttgttttggcgtcgatntacggcgtttgaagaattcattccggccccaatatgcctga

SEQ ID NO: 1007 - DNA, 243 bp, A.fumigatus
ccccggcgtgatcaccatggtaggatattatcgatctccgagtggatgggatactttctcctgtatgaaagcatgctggataccgttttgtatgctcgggaccgctaccttgctcctggcggcaaaattttccccgacaaggccaccatgtacttggctgcgattgaggatggcgagtacaaggatgacaagatcggatgtgagagttctctggcttacgttaggcttttaaaggagtactaa

SEQ ID NO: 1008 - DNA, 486 bp, A.fumigatus
ctcggtatagtctgggataacgtttacggattcgattacagccccatgaaagagattgcccttacggagccccttgtcgataccgtcgagctcaaggccctggtcaccgatccttgttctattattactttcgatctatacacggtcactaaagcagacttatcgttcaaggtccctttctcccttcccgtcaagcgcagcgacttcattcacgccatcatcgcgtggttcgacattgatttcactgcttgccacaagcccatcagcttctccactggccctcacgccaagtacacacactggaagcaaactgtgttctatcttcgcgacgttctcactgttgaggaagaggagtgtgtgtccggtatcttggagaacaagcccaatgacaagaaccctcgtgatttagatatccagatctcttacaaactggagaccacggacaagttgcgctatgatgagggcagctgcttttacaggatgtag

SEQ ID NO: 1009 - DNA, 249 bp, A.fumigatus
cggctccctgtggtagaaaacggtatacctgtcgacgtaatcctgcgatccgcccggtatgcctatgacaacacgccggactgtgagtctcgactgcgcgctcattacttagcgatgatcattcgcgcccgtcatattttcaagagcagcggaaccatgcaatttgacatggaaatgggccatagattctactttgatttgtttgttgtgatgtgtaaccacatggatgatctggagggacttgagtaa

SEQ ID NO: 1010 - DNA, 195 bp, A.fumigatus
tccaatcgtttccttttatctgatactcactcttggtttctacgaggtgggccggtctgtggtttaagcaacccttggttttaccactttttaatcttactggcgtgccgtgtggcttgctttgtgtattcagacgtcacttttctgaaggctgtctttcacctacggggctggaaggtccgcgattcccgcgat

SEQ ID NO: 1011 - DNA, 282 bp, A.fumigatus
agcagctacgagcgcgtgaaatccggcctctgggcaggcagcgagtgggtcgcatggggcacgcagaaccgcgaagcccccgtccgcaagatcgagccgggacactgggaactcaagtccctcgatggcctggcgaacatgtacgtcgccatggcggccttcctgggagccgggtacctcggcctcgagcacaagatccctctcacggtgaaggattgtctctgtatgttacctcttctgtcttcctctttccactacatgaaactgccggatgggtactaa

SEQ ID NO: 1012 - DNA, 234 bp, A.fumigatus
gcagacgatgcggcgaccctcaccgacgcccaacgcgaggatctcgggatcacgactcggctgcctaatactctcgcgcagagtcttgatgcgctcgagtctgatcatgcacttcaggaactgctcggtccgttcctggttcgcagttatgtgattgtcaagcgggcggagtccaagaagctggctgctatgggcgacgaggagcggaggaagtggctgatagagaggtattaa

SEQ ID NO: 1013 - DNA, 855 bp, A.fumigatus
ggagtgcgtttccttccaggcccgtggtgcagacaggccctgatgcaaaccaccctgttcgagacgttccggaagcaagacacctcgtccccattagccaagcgtcagatgaagatcttcttcttttccctcctgggaatgacgctctggcagttcctccccgagtatgtctttccgttcacctcgtcacttgccttcctctgctgggttgcgccccggaaccccgtcgccaattttattggatccggtatgggtggaatgggcttcttgaacctctccttggactggtcgaacatcaactggaacggctcatcgattctgctgacgccctggtggacgcaggtggtgttgttcttggcatttgccttcaactgctgggtgcttctccccgcggccaaatggggaaacctgggctcatacaagcacggactcatgtccaattctctcctcacgacgaatggcaccaaatatcccatcctggatctgctgacccccgactttcgtctgaaccaaacggcctacgaggagatcggccccatgtacatggggctccagaacgtgtgggcgacattcttcgaatacgccaaggtcacggcgtcggtggcatgggtcgctacttatggctactcccaagtcaagggcaacctcctcaagatgttcaggtcccggaataaaacctcccagaccaaaggcgaaggtatcaatcaccagtacaccgaccgcctcaacgttctccagcgatcctaccaggaagtcccgctctggtgtcacttggtgatgttcatggccggcttcatcatcctcatagtctccatcgcctgcgggtcttcacgaacgggacggaaggataacgca

SEQ ID NO: 1014 - DNA, 477 bp, A.fumigatus
tggctgaatgaacgtcggcaaacggagctgggtgcatactacaatcagcgtctgttctcaagtgccagaattgctatcattctgaagcagcttgcacagattgtgcagaacgcctctaataaccccggggaggccattggaagaatagatttcatgacggatgatcagaggtcgctgctaccagaccccacctcagacctgcattggtccaactttcgcggagccatccatgatatctttgctcagaatgccgagaagcatccagacaagctatgtgtggtggaaaccaagtcggaacagtctcctcaccgcgaatttacctaccggcaaatcaatgaggcgtcgaatatcctaggccatcacttggtccgggctggcatcgagaggggtgatgttgtcatggtttatgcctaccgtggcgttgaccttgtggtcgctgtcatgggtattctcaaggcaggggcaaccttttcggtc

SEQ ID NO: 1015 - DNA, 573 bp, A.fumigatus
acccagtacacaagggagtttcgtactggatatgttgaggcagcgatcgattacttttgcctgctctgtcttaacgccgacctcccaggttctctgggcaaatctcaagcatccgtgtgtcacgaagcattgcgggaatttgttctagagacgagggattttgccaaactacttggtgacatccgctcggacgggactcgaattaagggcttgattgagcagcgcatgagcttgatcaaattggtcgatcaagaagaatttctgaaaaccataacaatacaagctgctgcgatcgcagatgacaaggggctggtaacggatgcagtcctcttgtatcaccttgctgaggattacgaccgcgtaattgacatcatcaaccgagcactgtcggatgctgtagcactggagttagggagccccggtatgaagctgcagccgttgcggccacgaactgatcttcaacagcacgccaatgatgaacatgaagaggccgtggaacccggaagtagcctaagtcttacagcggtggatgatccggtggttctggcgaagaatatgattggtctctacaat

SEQ ID NO: 1016 - DNA, 240 bp, A.fumigatus
gcaatgcctgataccgttgatccccttgccgacacagccttttatctcctcctttctggcgtcattatcttcaatagcctgaatcacttcgttattcgcaaagagtcggttgattacgacactttgctgtcttacaacatctttgctggcatctacatggccctctaccatcgatggaaaaccactgccggacaagtggttccaaatcagcctcaacggaaccagtctcaacactcgtga

SEQ ID NO: 1017 - DNA, 405 bp, A.fumigatus
atcacttcgttattcgcaaagagtcggttgattacgacactttgctgtcttacaacatctttgctggcatctacatggccctctaccatcgatggaaaaccactgccggacaagtggttccaaatcagcctcaacggaaccagtctcaacactcgtgatgtcgccgaaattgctgaacgtactccaatcactgtatgtgaacggacagttatcgcagtaggtggctgcgttggcatcgcctcatatgttgtcaccttcgccagaagtattgctacaaccatcaaggatctgtccaacgggggaaactgcaacgctatgcacggcacctttgaaggcctgaagtggacttactactccactggccggaactgtgataccactgctcaacatgataccatcgctggt

SEQ ID NO: 1018 - DNA, 807 bp, A.fumigatus
gttgtcaaccgggagcgtctcaacgtctccgagctggagaggcagtttgagcgcatttatcagattgcgcagcgtgctcccccggtcggcgttctgactgtcgccaaccgtgacctgtgggccgatgctaggaagaagctgctggcagccaaccccgccaacgagcaggctctgcgcgacatcgagtctagcggcttcgtcgtctgcctggacgatgctacccctgtgacgctggaggagcgggctcaccagtactggcacggagacggcaccaaccgctggttcgacaagcccctacagttcatcatcaatgacaacggcaccgccggtttcatgggtgagcacagcatgatggacggcagccccacccaccgcctgaacgatcacctcaacaacctcattttcaacaacaagattgacctctccgagaagcccgtgcgctccaacctgcccgacccgcgccccatcgaattccacctgaactcggaggtgctcgaggccatcgacgcggcctccaaggagcaccgccagcagatgtccgctcacgagctcaaggtgcagtcctaccagggatacggcaagggtctcatcaagaagttcaagtgcagccccgacgcctatgtgcagatgatcatccagctggcgtacttcaagatgtacggcaagaaccgcccgacatatgaatcggcttcgacccgcaagttccaggagggtcgtaccgatactatccgtagtgtctcggacgagagcgtggctttttgcaaggcccacgccgacccctccgtcccccgccaagaggtcgtgcgc

SEQ ID NO: 1019 - DNA, 189 bp, A.fumigatus
caggagctggtaaggagtacagggtcaacggcgccggtatcccccgcggagggcgcggataacccccagaagaaccccgccaaggaggacgagaacattgtggtggtacgcaagaaccagttcttcaaaggtgccctaagttgtcaaccgggagcgtctcaacgtctccgagctggagaggcagtttga

SEQ ID NO: 1020 - DNA, 570 bp, A.fumigatus
  unsure (498),(544),(567): Identity of nucleotide sequences at the above locations are unknown.
cctcatcgagacctcctgcctcgcgagcatcgtcatcacctacaccacgatcgtccagatggtcgccctgcagtacggcagcacccacggcgtcgcaataggcgtctacgtcctctggtggatcgccgccttcctgtccaccctcgccgtcatcggcatccccttcgtccagctcaaagtccaacccagcagcttcgagcgcatcccccccgccattttactccccgtcattgccgccctcacctgcgccgcaggcggcggcgtcatctgcacttctaccgcgctcagcccccgcctccaggtccccgtcatcatcgtcgcatacctcctcgtcggcgcgggcatatccctcgccctcggcttcgacgccgtcatcctcttccagcacttctccgatcagcagccctctccgcagaaggtatggcaggatatgatcctctgcgggcccttttggacaaggcggcttcgcgctgcaagattctgggagggtgcgtgcanaagagttttcccgcatatgcccgggggacgctgcttggcgcacagngcggttggccccgatgccgcggntaa

SEQ ID NO: 1021 - DNA, 927 bp, A.fumigatus
  unsure (851),(897),(920): Identity of nucleotide sequences at the above locations are unknown.
tgtcatctggccaatttctgttttgcgctgcatagacgatcaaaacgcttttcctccacttcagcatactcgacatgtctgatcaacatattgatcgatatcatgccagctcctccagcataccctccagcccgtgcgctgttcaacttctccccgcaatggttcgtcatgccccaagggaccgccatcatctcggtcatcctgcaccaactgcactaccagttcggcgcattgcgtatcctagccaagatcgtctggatttataccatcgtgcttctcgccatgacgctcttcctgtacatcctgcgcctcatccgatacccaagagaagtctgcgatgaactgcgccataacctcatcgagacctcctgcctcgcgagcatcgtcatcacctacaccacgatcgtccagatggtcgccctgcagtacggcagcacccacggcgtcgcaataggcgtctacgtcctctggtggatcgccgccttcctgtccaccctcgccgtcatcggcatccccttcgtccagctcaaagtccaacccagcagcttcgagcgcatcccccccgccattttactccccgtcattgccgccctcacctgcgccgcaggcggcggcgtcatctgcacttctaccgcgctcagcccccgcctccaggtccccgtcatcatcgtcgcatacctcctcgtcggcgcgggcatatccctcgccctcggcttcgacgccgtcatcctcttccagcacttctccgatcagcagccctctccgcagaaggtatggcaggatatgatcctctgcgggcccttttggacaaggcggcttcgcgctgcaagattctgggagggtgcgtgcanaagagttttcccgcatatgcccgggggacgctgcttggcgcacagngcggttggccccgatgccgcggntaagcca

SEQ ID NO: 1022 - DNA, 210 bp, A.fumigatus
gaacactatggtacgtttgatcgtcctggttttactgtttttacagccattgaccataaaatccaggttcgccgtgccatcaagggcttcgtcgccgacaacccggagtacgagcgtctgcttcctcacgtcaagggtgagttagataccttttacccgtgttggacggggacaattgacgtttggaattggtggctaatttctgtatga

SEQ ID NO: 1023 - DNA, 315 bp, A.fumigatus
gaagacatggggggcaagtcagctaccaaggccgcttacttcgataagctcaagagccttctcgatgagtacaagaccgtcttcattgtcggtgtcgacaatgtcagctctcagcagatgcacgagatccgtctcgctctccgtggccaggccgtcgtcctgatgggtaagaacactatggtacgtttgatcgtcctggttttactgtttttacagccattgaccataaaatccaggttcgccgtgccatcaagggcttcgtcgccgacaacccggagtacgagcgtctgcttcctcacgtcaagggtgagttag

SEQ ID NO: 1024 - DNA, 435 bp, A.fumigatus
aaaacacgcacgtatgtcgccataaagtcggtcaacctctcgaagttgaataagaagttgaaggacaacctgtcttctgaaattcatattctcaaaggcctctaccatccacacatcgttgcgctaatcgattgccatgaaaccacctcccacattcatctggtgatggaatattgcgctctgggcgacctgtccctattcatcaagcgccgagatactcttggagatcataggtacacacgggatatgatcgccaagtatccgaatcctcccggtggcgccctcaacgaagttgttgtccggcatttccttaatcagctggcgagcgccctgaagtttcttcgcgaccggaacctcattcatcgcgatatcaagccacaaaacctcctgctttgtccttcgccctcgtcctatcgcaatggcgtcactcaagta

SEQ ID NO: 1025 - DNA, 909 bp, A.fumigatus
gatgtggccggaaacgctgtagacctccttccagaagaaccacgcatgatcattggactccactgggccgatactagctccaatttgatcgtagtagcatcggatagcaagatttccgagctggcaatctgggatgactcattgcgcccagatgagtttccttctcctcaagtggtggatggttcggtatatgaccttagctggctcggggacaaacaggcctatgccagcggtcatggtgtagtttaccagtgcgatgtggactccagcattcgtatcgcggagactttctcatggggcgaatcagacagagtttggtccttcgttcgctgtgccaacgccggctcatcccctgtggcagtagctgcatcatctgatactgcggcattttgggtgccaacgcatgatatgcatctcgatgacgcgcaccaaggagatatcacgtctattgagatacgtcctcatcccgagccatgtgaaaagactcagcatggtcattctgtcgttcttgcctccgcatccaccgacggtgccatcaaaatctggcaaattgacctagaagcaaaacggtttatctgtcttcatcgcctggtcctcggtcagtcaatgccaactctggccgcctgtttctcacccgacggttacgctgttgctgctgcgagccgcgacagattgtttatctggaatgcagagagaggaggtaccgcgatggctacctgggtcgtacccggctccgatgaagcaaagtcagatggagaagcagatcatgcggcaaacggtcaaaacggggccgtgggattgctgccagatcgctccctttcgtgggataccgatggtaagaagcttgcattcggtttcgcaaaacaggtatgcctcttacttctggtcaattgcttaaccatatactga

SEQ ID NO: 1026 - DNA, 297 bp, A.fumigatus
accaattgcctgacagaagttgttttcgaagatgctcttgaacaagctagacgcctggaccagctgtttgaggaaaaaggtcaactcgcgggccctcttcacggcattcccgtcactctcaaggatcaattcaatatcaaaaaagtcgatacgactttaggttacgtaggccgctcgtttgctccagcttccgaggatgcagtgcttgttgagatgttaaaaggtatgggtgctgttatcatcgcaaagacaaacttgccgcagagcattatggtctgtatcccgctgggaccgtaa

SEQ ID NO: 1027 - DNA, 759 bp, A.fumigatus
tgccaaatggcgaggtcaagtttcaccgcgttcttggtggccttcaccactgttgtgaataccatctcaccgagctatgcattcaacagcctgttgcaccgagcctctgactcctgtccagcatcatatgagcaatgcaacaactccaatctgccatcctctttttgctgtccgtcgacatctacctgcgtgagtctggataacgacagttccgccatatgctgccccagcgggcaaagttgcgcatttattgagccaatcacttgcgatgtgtcacagcaaaatgccactctccacccaaaagccgtggtcaagacaatacggcttggtgataccctgccaaagtgcggggattcatgctgtcctttcggatacagctgccaaagcaatagcatttgcgccatgagcacatcgactacttcgatagccacgaactcagtctcttcccttaccacaacagcctccagcattccttccgctccctcaacagagtctatgacatctatgacatctacagttccaacagctgctactagttcctcgaaagtcacagacagtgcatcctcaaccgatggtgtccacccgactatcataactgcatctgatccagcagatccatcagccttcggtgctgcttctagctgccatgggactacagctactatgacggacgcatgcccttctttcccaaccaaagcaataattgccgggttcttccccggggtcttctaccacagggaagcgaaggatcagcgctaa

SEQ ID NO: 1028 - DNA, 243 bp, A.fumigatus
agacatgcaccatatctacgttataccaatcggatcgttggaagaggaacagaattgctattagataaggagaatgctactggtcatgcttgtaattccaccaccttgcaaacagtcaataccaagttcatgttaatgcagctgcccaacactctgctgttcgatttttcagctatgcagtttccacaacattcacagagaggtacaagaaaaatcaagaacgtagctctgtggtcacaataa

SEQ ID NO: 1029 - DNA, 537 bp, A.fumigatus
gggggggggagaagatcttccagccggcggctgatacaccaacgaagatgctcgcaagcgacgaaagctctttacgagagagaacttgctaaaggagtcagtgaaaacgaagagatattcacgggcgaggagtctgttagcacgggtgcgcaaccacagtgggccagcaagtaccgacctcgcaagccgcggtacttcaaccgggtgcaaatggggtacgagtggaacaagtacaaccagacgcactatgatcatgacaacccgccaccaaaagttgtccagggctacaagttcaacattttctaccccgacctcatcgataagacaaaagcccctacctaccgcattgaacgcgaacatggacggaaacgtggacaatcatttgccgcggctggcgaagaggatacgtgccttattcgattcatggccggacccccgtacgaagatatcgcattccggatcgtagacaaagagtgggactacagcgccaagagagagagaggatttaagagcacgtttgacaaggcatatcctgtt

SEQ ID NO: 1030 - DNA, 198 bp, A.fumigatus
cctggcaatgctatatccatgatcggtgcgcacacagactcccctgttctgagagtcaagcctgtcagcaacaagcgcggagagggctatatgcaagttggtgttgagacgtatggtggaggcatctggcacacatgtccgtttactgacttctatccctacatggcccactcaaaactaatggtcgtcagggtttga

SEQ ID NO: 1031 - DNA, 474 bp, A.fumigatus
cgaagtgggcctggtaagggaaatgacttctcctattccaccacgcaacctaataatgaggaacagatcggcgctacccttggaggagggatcgggcgccttcttgggcacgttggatacgccgcagacaccgtgctctcgatgcgggtcgttgtggtggaccagagcggagtagctcgcgcagtcgaggcatcgcccgacgtcaactccgatctcttctggggtcttcgcggtagcggtcatttgttcggagtggtggttgaggctacattccgagcttacccgtggacccatgacacatggcacagctgtctggtctttccgcctagtgacgcaggattggtggcagaggctgtggagaaggtccattaccagggaggtatgcaggggcggctggtattctgcgctccaaacaagcaggtaagtctgtccagaaccctttactggaacccactggctgactttgagaattag

SEQ ID NO: 1032 - DNA, 222 bp, A.fumigatus
cctattgttcttctccaaatgtggtatatgggatcacacgaagaggctgccagcaaattccagcctctattggagctcccgtctatgacagatcatcctttaaactttgttggccgccggattccgtaccctaacctcaatgactccagcgaccgtatatgtggctacgggggtagaaagaacctcgccgcgtttggcttgaaaatcttcaccacgcggtga

SEQ ID NO: 1033 - DNA, 423 bp, A.fumigatus
gctgacatgtgtcctcaggtttcttatgcggtgcagaaccagaggccgtttgtggttcgaggaggtggccacagcaatggcttctcgacagtcgacagccctgggatcatcatcgatctctcgcgtatgagaaaagtcaccgttgacgtggagagacaggttgttgttgcacagggaggcgctactatgggcgacggggtgaaggcagccagttcagtcggaatggctgtcgctaccggaacctgtaacgaagtgggcctggtaagggaaatgacttctcctattccaccacgcaacctaataatgaggaacagatcggcgctacccttggaggagggatcgggcgccttcttgggcacgttggatacgccgcagacaccgtgctctcgatgcgggtcgttgtggtggaccagagcggagtag

SEQ ID NO: 1034 - DNA, 348 bp, A.fumigatus
tttgatcctcgtcctcctggcttcagctgcccatctgcaagcaagattcagtcgtactgtgatgctgccgatccatactgttgcaatggaaacgatgccaacactcatcaaggctacggcacggagtacggacaggcagctcttacttttgtcaagagcaagctgagctcgagcggctcgggagggggttcaggaggtggctctggaggttctggaggctcgggtggctccgggggaaccgttgcccattatggtcaatgtggaggccaaggatggacaggcgccacctcatgccagagcccctatacctgtacagtaatcagccagtggtactctcagtgtctgtga

SEQ ID NO: 1035 - DNA, 750 bp, A.fumigatus
tttcacaggggccgtgctttgtcctaccagatgatcaatgcaaccaacggtggtcccagctatacatggtcctccatcgcgctaaccgacgcctttcagaaggcagagatgccaatgcctttggttgttgcagatggtcgctaccctggagaacttctcatcagcagcaatgccaccgtctacgaatttaatccttgggaatttggaacttttgaccccacagtttttggatttgcgcccctcgagtatctaggaaccaaattcaatggcggctcagtcccaagtaatgagagctgtgtgcgtggctttgacaatgttggctttgtcatgggtacgtcctctactctcttcaatcaattccttcttcagatcaactcaacggctttgccggattggctgaaatccgtcttcaccgacatcttgaaggacattggcgagaatgacgaggacattgctcaatatgctcctaacccattctaccacttttccaacacaaccaaccctagtgccgctgaattggaactggatttggtggatggtggtgaagatctgcagaatataccactgcacccgttgattcagccagagcgacatgtcgatgtgatcttcgccgtcgattcctctgccgataccacgtacagctggcccaacggatctgcccttgttgctacttatgagcgttaccttaaattcctcaggcatcgccaacgggtacttcccttcctgccattcccggatcagaataacctc

SEQ ID NO: 1036 - DNA, 282 bp, A.fumigatus
cggcagttgggtggattgctgcattcagccacctatctgtctggcctgagcggtggatcatggctggtgggatcaatctacatcaacaactttactaccatctctgcactccaaacacaccaaaagggcaccgtttggcaatttcaaaattcaattttcgaaggtcccgatgggggtagcattcagattttggattcagccacctattatagggacatcagcaatgcggtctccggaaagtcggatgcaggctacccgacttcaattactgactactggtaa

SEQ ID NO: 1037 - DNA, 372 bp, A.fumigatus
tttgattacgttgcaaagctggaattaaactcgtacaactttcacagccccttggctgatcgtctggggtgctacctgcacccgtacgcggctttgattaatcacagttgcgactacaattccgtcgtcggctcagatggcgacgccctctacgtcaaggccctccgcccaattcggaaaggcgaggagatactcgtatcgtacatcgacgccacgaacccatataaaatccgccagacagagctcttggagcgatactacttcaaatgccgatgtccccagttcgggaaaagcacaaacacccgcgaagaacgcttcctccgcgaaccgcacgacctctctgtcctggaaaaagccgaaaaacgccgccat

SEQ ID NO: 1038 - DNA, 489 bp, A.fumigatus
tccttccaggggccgtgtgtgaagacggccttctctgttgttcaaagaaattcgacttacccgagttataattcaggccaggatgcgtcgataatatcgcaattcttccctccaggaagcgatcagacgatcaatttccctacatttctgaatattttgtcaagtctccttgcgccgctttcatctcggcaggaactgatgaatgccttggctgcttttgacgacgatgatagcggacagattgatgttgcagagcttcgcgataccctcttacacacagcgtcggaggatggacaattacccctgacggagaaggatattaacgaggtattgggtggatttaccggacgcagagtatttagtagcaaagccgggaaactgtctacaggagggaagagaggggaggtctttcggtatcaggaatttattgacagtgccataggaggatcagcaagtgggcgcagagatcctgatactgtcgcgagatag

SEQ ID NO: 1039 - DNA, 219 bp, A.fumigatus
cagacacaactctcagattatttgcctaacatccttagcttctcatcttctcatcctaatgaagctttttacactcctcatcatcctactacattgcctagtctcatccataagatcacctcttcctcacaggcctcaaaccacgctgaaagggcgataacctcagcaagcccagaccatccgtcagtcttctttggcatagctggatctttaacataa

SEQ ID NO: 1040 - DNA, 471 bp, A.fumigatus
aagggcgataacctcagcaagcccagaccatccgtcagtcttctttggcatagctggatctttaacataaggctactgcagcagtttgcgatctctcatctctggcttctcatcacccatctcattgctatcttcgagccagcaaccaatatgaaccttcttgatctacccaccgaggtgctcgtcatgatagcagaggcccttcaaaccgcccatgacatcaatactcttgcacggacaagccgcactctctactcctgtatcaactacgtcctctaccagtctgatgtgcagaatggaaacggaaaagctctgatctgggccgcacgacgcaacaagccagcaaccgcgcagaaatccctccaggcaggcgttaaaaaattgaaaaaaatggcatcgccagcccctgatgctctcgttaaagggcggccacgaaaccatgatgcggttgttattggacaaaagtgttga

SEQ ID NO: 1041 - DNA, 228 bp, A.fumigatus
tggcagacaggatttggcctagtagtcattatgacaactgacggaggaaagcgcgttttgattctctaccattatgatatcctggttcgagggcttgctttggcggtaacgttgagttcttctagttcgatatcggactatggtgtatcagagaagctaggggttctcattccttgttatcaaccctatatattcctgctttatctctctcgtgggaatggtaggtag

SEQ ID NO: 1042 - DNA, 546 bp, A.fumigatus
cccgctcggtctgctcttggcctgcttgatatgctggcccagagtctacctcccagccaagttgttgtgccccttcttcacgctttgggccagtacttcaacaacagcaaccctgactaccgcagggctggtatcatggctcttggaatgtgtgtcgagggtgctcctgacttcatcagcactcagatgcaagacatcttccccatggttctgcagctgctcgctgatcccgaacccaaggttcgccaagcctctttgcatgctgtggctcgtcttgccgatgacctcgctgaagatctcagtgctgagcacgaaaagctcatgcctctgcttttcaagaacttggccagtgctatgcaggagtacaagggtgaggaggatggccccaccattgatatcatgaaggccggtatcagcgccattgatgccgttgttgatggcttggacgagaaggacgtcgctccttaccagggcgagctcgttccgattctgcacaagctcttcaagcacccccatgtcatcagacagggctggaaggtatgcgtc

SEQ ID NO: 1043 - DNA, 816 bp, A.fumigatus
cttcagtccgcctacaccatttgggacttccttaacgtcgcctcgatccacaactcgagcacgactacccctccgccgagatcgcgagaactgttcctgctcgccaacattgagcagtacaacctggcctacaacacctccgagcctatccgcgccgtcgccggctctaccctcgccggcgaggtgctccagggcctcaacgagactatcgcctccaagggcaagagcaagctgaacgtccagttcggctcgtacggcaccttcctctcgtactttggactggcgcagctgcccgccgcaacggtcgactttaccggcatcccggactacgcctcctctatggcctgggagctcgtcaccaactccaccttggacgagttcccgcccgcctccgagatcagcgtgcgcttcattttccacaatggcaccatcagcagctcgtccactccggccgaatatcccttgtacggccagtcgagtgtcaccatcccctggtccgactttgtgacgcagaccgagaagatcgccatcacggacgacgagcagtggtgcaaggcgtgcggaaacacggacggcgcgtgtgccgcctacactgtttcctcttctggatcggagtcttcctctgcgggcttgagctcctccaaggatggagtgtcgcgacctgtcgctggtgttatcggcgctatggtcactctggcggtgatcctcggtctggaagcgatcttcctgcttgtcggtggattcagaatcaccaagaagcggagtgctgtgtctggggttgagaccacaactgttgaggggcccaagaaggtttga

SEQ ID NO: 1044 - DNA, 372 bp, A.fumigatus
  unsure (25),(26): Identity of nucleotide sequences at the above locations are unknown.
gaaaggcacgcatattttttggggnntttttttcccccccctttttcgaagcctatgggtatggatgactctattattgaggatgctcttaccttcaggggattccgttggtgtgaagatcccgaagcaagaagtacgagccttgttagcatcagcccgtcaaacatgcatttcggctacggtagacaagcctgccctggccgtttcttcgctgcgaacacgaacaaggcaatcttgggtcgcttgattgcagactacgagttcaaatttgagggcgacaacaacaaaagaccgaggaacctcacccttggggagcagattatgcccaacatgcacaccaaaatccttcttaagaagagggcctttgtttaa

SEQ ID NO: 1045 - DNA, 261 bp, A.fumigatus
ccaccgcattacgaggactggctacgcccccaggaacctgttgatataacagcgatcttgttagtaaaatccctcacccaccattctaaaacacaacataacaacctcactcaccttcaatggcacactcgacaggaagaaactcaccgattcatcttcgcacaatactccgccactttctcgagatcaaaatactccccaatcggcatcccccaaccgaccagcaaccactggtgtatctggaactcccgcggaacttga

SEQ ID NO: 1046 - DNA, 396 bp, A.fumigatus
tctctatatcttcatagagacgtaaacactaatactctgtcaacatcagaccattttgcacacgtcgatgatgatcatcagaccgatatagctcgccaccgaactttggtcagtggcatcctgctggagcgtgttgcttcgtcgatgtttgtgcttggatcttatccctctagatctcaagagcgacagactagaaggatcacctcgcttgctagagacccggagctaccgcaactgtcctcacaggccagtctcggcagaaactcaaagttctataacctaacccctgaagatagggaggctctgggaggaatagagtaccgcagccttcggctacttctcaaaataacgctgggtgagagtaaacttgagataaattccgtacagagaacctga

SEQ ID NO: 1047 - DNA, 645 bp, A.fumigatus
  unsure (34),(70),(122),(133): Identity of nucleotide sequences at the above locations are unknown.
gatccgcgcaatgagcagattttcgggtcgagancaacaagttcgccttctcccccgggccaactcaacnagatgctcaatcccaagtcgctcgctgcgttccaggcgctcgggggactgcncgggctagaanaaggctgcgggaccgacctgacgtctgggttatccgaggacgaagctctcctagacggtacggtcgattttcaagaagccactcagaacgaccagaaactctcaaaacaaatttcacacaacgcaccggtggcaccagcaccagcaccagaattgggcggcgggtcaagattccaggatcgtattcgtgttttcagccagaataagctgcctgcgcggaagtcgactggtttcctgaagctgctgtggttcgcgtacaacgacaagattatcattctgctaaccatagccgctatcgtctcgttgtccctgggtatctacgaaacagtcgatgaggggcatggagtggactggatcgaaggtgtcgccatctgcgtggctattctgattgtaactgtcgtgactgctgtgaatgacttgcaaaaggagagacagtttgccaagttgaataagagggtaggtggaatggtctccgcgcttttatctatttgttctaaccatgtcatagaatag

SEQ ID NO: 1048 - DNA, 435 bp, A.fumigatus
aatagcgatcgggaagtcaaggctgttcgctcaggcaaagtagctatgatttccgtcttcgatatcacggtcggtgatgtgctccacttggaacccggcgactctgttcctgcagacggtattctcatctctggtcacggaataaaatgtgacgagtcctccgccactggggaatcggacgcgatgaagaagaccaatggacacgaggtttggcagcgcattgtcaacgggaccgccacgaagaaactagacccgttcatgatctcaggcagtaaagtccttgaaggggtacgaacttacctcgtgaccagtgttggacccgactcgtcctatggccgtatcttgctctctctgcaagagtccaacgatcccactcctcttcaggtgaatctgggaacacttgccaactgtatcggatggattagctctaagtaa

SEQ ID NO: 1049 - DNA, 684 bp, A.fumigatus
  unsure (489): Identity of nucleotide sequences at the above locations are unknown.
ggcgaactgggcaagggtgactttcaactatacccggccggggtcttctcctggcagcacgacatgcgcatctacaacaagacagataccggcatgatcctgagtctgttcaacaacgccaataccccgaccgagacggttgcggcttcgacggggttgagctatgcagtggatttggtcaaccgcacggccaagacccttcggaccctgagcgacagcaaggacgtcatccacagcgtcagccaaggcaactaccaacagctgagcgcgtggggccatgttgtgctgggctacgggtcgattgccaagctcaaagagtttgacgccaataacaagccggtcctcacggcgcagttcggcaccgacaacgaggtggcctcgtaccgggggtacaaatgcgcctggaaggcgacgccgttctgggcgccggcgattgtggttcggcgggtgtcggatgattctgcgcaggtgtttatgagctggaacggngcgaccgagtatgacaattgggctgtgatggccgcggacgcgccagactcggtccggaccagcattgtcgctacctttaagcgcacgggcttcgagacgtctggtacggttcgggggttgaagacaaggtatctgcaggtggttgctcgtcggggagatattcccttgggcatgtcgccgattgtcagtctttag

SEQ ID NO: 1050 - DNA, 654 bp, A.fumigatus
agaccgacctgggatttggatatggcaccgtccacattctcgacaatacctaccggggagatctacacggtgaccctgcaggggaactttgtcaccccggaccacagcgtcccggagtcgttcattgacctgcacgagagtcacatctcggaccgcaatacgttgctggtcacggcctacaatgtcacccagcagtccctgacgtcgatcgggggcacgccggaggattacatgctggacagtttgttttttgagattgacattgctaccaatgagattgtgcattcgtggagcgcactggagcatgtcgaccagattgcgttgacggattccaagcaggggattgacatcgatcatggaacgcatgagcagccatgggatgcgtatcatatcaactcggtggaactgtttgacgaggggtatctcgtctcgctgcgtcactactggtctgggtattacgttcatggcaatgggacggtcatgtggcaatttagtgtattccccttccccccttccccttcttttttttggggtatgttagatactgacgagactagggcgaactgggcaagggtgactttcaactatacccggccggggtcttctcctggcagcacgacatgcgcatctacaacaagacagataccggcatga

SEQ ID NO: 1051 - DNA, 576 bp, A.fumigatus
  unsure (8): Identity of nucleotide sequences at the above locations are unknown.
cctggtgntagtatgtccacccccgtcgaggagcaccctgctcctagatatatagacgaaaagaaaaaagagaggttggatgatgttgacgtctccgcgtccgatgatggcacctatgtccatgatggctctgccgtcagtaaccacaatcacctcagggttgacacctcctacgatgacacccagagattacccctgcgctcaccttcggccgcgcgagaacgatccctgcgtctagaggatgacctggctttgcttgaggcggagcgtgtcgcatctcgttcgacccatgaggagatggaaaagggaagcaaggcggagtctatctcgcgaatccgttcgcatcgctcgcgcaatgtcgacgaatttgacgaagccacaaatccactgcacgagaaggccgccgtttacaacccgcctgaaaatccaaatacgaagatttccaagttcattaagaaggttcacgagtcgagtttcatcgttcgctatatcacctatatcgtcccgctggttgtgatccttctcattcccttacttgttggggctttggcctttcctgatgccaatgttggagga

SEQ ID NO: 1052 - DNA, 519 bp, A.fumigatus
cctgaccgagatattgaagaagtcatgcctctcactgaagagcaaaagcagcactggctggaacacggcttcatcaaaatccctcagtgtttcaccaagcaagatgccgacaactggacagcctccatctgggctcgcctgggcatctcaccgacggacaagtccacttggaatactgaaagagtcaacatgcccggccatacagttgtcgacgtgaaggactttgcacccaaggcatgggatgcgatctgtgagctcgtcggcggggaagagcgcgtaacggattggtgcaagggctggcgagactcgtggatcatcaacctcgggaaacccgaatacaagcccgatgatccgttggacttccgcaccttagacaactggcataatgatggagactttttcacgcatttcctggatagcggcgagcaagcgcttctagtgatccccttattcagcgatatcagatccaagggaggtggaactgttctatgcactgatggaatcggccttgtcgcttag

SEQ ID NO: 1053 - DNA, 474 bp, A.fumigatus
atgaggggctcttcgtggatccttatgaatcaaagtgcgacccctgaaaatctgcggaaatcgttcaaggtgactgaccgattttttcctagggacgtaattactggtctgttgcatcagattccgaagattttcgcccacaataagaagcctgagcctgcactgcttccaacattgaatgcggctctctccgctctacaagccacaggagggaaaatcatctgtgccgtggccaccttgcccacttggggcccgggggcattggtgcgacgggaagatcccaaggtccatggaacggatgcagagcggaagttgtttaccacggaaaatgcagcatggagatcgacggccagtaaactggcgggagctggtattggtgtacacatgttcaacccggcgcctaatggggacttatatggaacgttgctacgatcggtgagtctcttttgtcttggaaatgaggtgtcccactaa

SEQ ID NO: 1054 - DNA, 285 bp, A.fumigatus
tcgcagctacaccaggatacggaccctcaagcgctgagcaagttcaccgtccctgttatccaacagctcagacaagcagaaatgacggtgaaagttggcatcaacggattcggccggatcggtcgcattgtctttcgcaattccttctcccatgaccaactccaagttgttgctgtcaacgacccatttaccaatcccaaatatggcattaggtcgcacccatccctcaccaagttctcccaattcccgaatggattgaacaagggaattggtcccataagcaaa

SEQ ID NO: 1055 - DNA, 834 bp, A.fumigatus
gttctgctggtcaaccaggaactcggcggtaccggcgttgcggtagttgaccgtcttggccagcttcaccgcatccgccaaaatgcggtcgcgcacatcgttcggcagatccttggcgggggcgatctcaacgaccttctggtgacggcgctggacggagcagtcacgctcgaacaggtggatgacgttaccgtggttgtcaccgagaagctggacttcgatgtgcttggggcggtcgaggaaacgctcgacgaagacggtgccgttaccaaacgcagagcgggcctcggaggtagcacgctcaaaggcgtcccgcagatcggcctgatcgcggacgacacgcataccacggccaccaccgccgaaggcagccttgatgatgatggggaagccataggtgtcggtgaaggccttgacctcctcgtagcgctccactggaccaggagtaccggggaccacggggacgccgcacttgatggccaattgacgggcagagaccttgtcgccgagggcttcgatggtctccggggtggggcccacaaagacaataccagcattctcgaccttgcgagcaaactcagcgttctcagacaagaagccgtaaccggggtgaatcaggtgcacaccatgctcctgagcaatcttgacgatctcatcaatggccaagtaggccgcaacgggggtatattgaccgcgatgaccgatcatgtaggcctcgtcggccttctggcggtgcatggacagacgatcctcatacgagtagatggcgactgtctggagagaaagttcgtgggcggtacggaagatacggatgggaatttcaccacggttggc

SEQ ID NO: 1056 - DNA, 834 bp, A.fumigatus
gccaaccgtggtgaaattcccatccgtatcttccgtaccgcccacgaactttctctccagacagtcgccatctactcgtatgaggatcgtctgtccatgcaccgccagaaggccgacgaggcctacatgatcggtcatcgcggtcaatatacccccgttgcggcctacttggccattgatgagatcgtcaagattgctcaggagcatggtgtgcacctgattcaccccggttacggcttcttgtctgagaacgctgagtttgctcgcaaggtcgagaatgctggtattgtctttgtgggccccaccccggagaccatcgaagccctcggcgacaaggtctctgcccgtcaattggccatcaagtgcggcgtccccgtggtccccggtactcctggtccagtggagcgctacgaggaggtcaaggccttcaccgacacctatggcttccccatcatcatcaaggctgccttcggcggtggtggccgtggtatgcgtgtcgtccgcgatcaggccgatctgcgggacgcctttgagcgtgctacctccgaggcccgctctgcgtttggtaacggcaccgtcttcgtcgagcgtttcctcgaccgccccaagcacatcgaagtccagcttctcggtgacaaccacggtaacgtcatccacctgttcgagcgtgactgctccgtccagcgccgtcaccagaaggtcgttgagatcgcccccgccaaggatctgccgaacgatgtgcgcgaccgcattttggcggatgcggtgaagctggccaagacggtcaactaccgcaacgccggtaccgccgagttcctggttgaccagcagaac

SEQ ID NO: 1057 - DNA, 549 bp, A.fumigatus
ttcaccccggttacggcttcttgtctgagaacgctgagtttgctcgcaaggtcgagaatgctggtattgtctttgtgggccccaccccggagaccatcgaagccctcggcgacaaggtctctgcccgtcaattggccatcaagtgcggcgtccccgtggtccccggtactcctggtccagtggagcgctacgaggaggtcaaggccttcaccgacacctatggcttccccatcatcatcaaggctgccttcggcggtggtggccgtggtatgcgtgtcgtccgcgatcaggccgatctgcgggacgcctttgagcgtgctacctccgaggcccgctctgcgtttggtaacggcaccgtcttcgtcgagcgtttcctcgaccgccccaagcacatcgaagtccagcttctcggtgacaaccacggtaacgtcatccacctgttcgagcgtgactgctccgtccagcgccgtcaccagaaggtcgttgagatcgcccccgccaaggatctgccgaacgatgtgcgcgaccgcattttggcggatgcggtga

SEQ ID NO: 1058 - DNA, 873 bp, A.fumigatus
gacgcccaggccaagctgaatggtgaactgtcactcgacaacgctgatctactgttctcctacggcaaagccttatacaacgtggcggtgagcaagagcgatgtcctagggtcaaaagtagctggagagcctcaagctcaaacaaatgatttacctccaagcggctccaaatcattcgcgcatgtgcctggcgagagcattatcaaaaatgcgatcgctagtggggtggctaagcaagaacattccaaagattctaaatccagttctggaaagactttgaaccaggcctttttccaattcagtggcgatgaaaatttcgatgattcggattctgaggcagaagagggtgatggaggcgctgatggtgctgacgatgacgatgacgattttgccaacgcctttgaagtcctggacttggcccgtatactctaccacaagaaattggccgcagtagaggaatcatgtgaggagggaaaatctgccggcctgctgcccgatgtcaaatacatcaaggagcgtcttgcagatacctacgatctacaggcggagatttcacttgaaggggagagattcacggatgcggtggcggacctcaggactgcacttgatctgaggcagtcactgttttccatggaagatccttcccttgctgagtgtcactacaagctttcgctcgcactagaattcgcatctgtcaataattccagcgaaggcactactgaaggggacagtggccgccgtggcaaggtcgatgaagctatgagagaagaggctgcgactcagatggagaaggctattgagagctgtcgagccagaatggcccaagtacagaagaagaccatgatgaccgtttggaggacagtaacgcagtat

SEQ ID NO: 1059 - DNA, 270 bp, A.fumigatus
gtattgtttatcattctgcttcttgcctggaaattaatgggacattctctagtcggtctcggatacctcaaggtgtttgtccctccagaaaagatcctaagatggattgaaggaaagctgaacctgctgggacgactgccacattatgtctcagtagatcagaaaacctatggtcggtatggtgttcttcctacggcgactgcggctgtagggggtgagcggcccactcctctgagctatctgggtacgaatcagcgcctcggtccttga

SEQ ID NO: 1060 - DNA, 843 bp, A.fumigatus
tttattgatggccctgaagcccctggtgaagaccgggaaactgaattgcgcaacatggagctcgctgaacaggaacgcaagcgagctcaacaagaggaggacagccaagcaccagtccctctcaaaacgaacggggatgctacttcccctgcggcggaacctaatatcggcctcgaaaagaagccacaggccggtcctgtgatgcgaatcgtgaatggggagattgtgcttgatgctgcttccctccatgttgaccgttacgcagatgcggcgagaaatgcgggggatctagaggatgtagtagaaagctctcttactcggaagatcaaccaagccacctggggaaaacggtccaagacagaatcatgggatgaagagatgacggaactattttacagaggcttgcgaatgttcggcaccgatttcatgatgatcagcaagctgttccctgggaggtcgagacgtcaaatcaagctgaaattcaacaatgaagagcggcgcgctccagaacgaatcaaggaaacgctgttgggtccgcgggaaacaatagatatcacgacgtattccgaaatgaccaacactgtgtatgatgaccccaaagtggttcagcaagagttggatgaagagaagaaacggattgaggaacaacatgcaaaggaaaagcaggctcaggaggatttgcttcgaaatccagacggcacgactggtggtgatgccgcaccagggctggataacgccagtaacgtgcccgtaaagggcaaacgaaacaacaaaagacaggcgatgagagctatgggaggcggaactgaagaagtgattggcacgattgatgaccttccttga

SEQ ID NO: 1061 - DNA, 792 bp, A.fumigatus
ccgctgaacattgtgctaggccaattcttcgaccttctaaacatcttcaacataaatggctacccctccgagacgcacgcatacctcttcaacggcgacttcgtcgaccgtggttcgtggtccaccgagattgccctgctcctctacgcatataagtggctccgccccaaccgcatcttcttgaataggggcaatcacgagaccgatgacatgaacaaggtctatggtttcgagggtgagtgcaaagccaagtacaacgaacgcctgttcaaggtcttttccgagtccttctccgcgctgcccctggccacattgattggcagcaagtatcttgtcctgcacggtggcctcttctctgacgacaaggtcaccttggacgatatccggaaactgaaccgccacaaccaacgacagcccggacaacaaggcctgatgatggagatgctctggacggaccctcagaccgaaccgggccgcgggcccagtaagagaggcgttggcctgcagttcgggcccgatgtaacgaagcgcttctgcgagaagaacgggctagaagccatcattcggtcgcacgaggtccgcatggaaggttacgaggtcgagcacgacggacggtgcatcaccgtcttctctgcacccaaatactgcgacactaccgagaacaagggcgcattcatcaacattggacccgaactcaagcttgacttcaaggtctttgaagcagtgcctcatcctgacatcaggccaatggtaaaccctgtcctttcgtgtctgctcaaattacaaagctga

SEQ ID NO: 1062 - DNA, 258 bp, A.fumigatus
  unsure (171): Identity of nucleotide sequences at the above locations are unknown.
tcattccttcccacgatgaccgtcgactccaagccacaactccagcgcctcgccgccgatgccgacgttgaccggatgtgcaggctcctcgaagaggacggtgcctttatcctcaagggcctgctgcccttcgacgtcgtcgagagcttcaaccgcgagttggacgtgcanatggccattccacctcccaaaggagaacggctgctggcggaccaatccccccctcactttaaatatgtccccgacgttgcccccact

SEQ ID NO: 1063 - DNA, 534 bp, A.fumigatus
tgctcaggaatctccccatgcaccaactgtatcaagaacaacgttgaatgtaccttcgacgccagcgccgataaacgccgccgcggcgccctaaagcgcaaggtcaaccagctcgaagagaaggaggagctcctgattcagctcgtcagcatcctccgcgagagcggcactcggcgcaccattcaactcctcaacctcatccgcagcaacgcctccctgtccgaaatccaactctacatagatacgcagctgaagtccgagctggagcagacaccggagctcatcgaagtatgcaatgagatacaacggtttgagccaatggggtcgcggtcgtggcggcgtattctcgacgcgcagagggctttcgtagagcccttgttccgtgtgccggcggccccgtggacgactgtcaccgcggatgacgagtttgtatcgcatttgatttcgttgtggtttacgtgggttcatccgttctattactggatcgattttcaccacaggggccgaaggatccgcgctatgcgtctggggcaa

SEQ ID NO: 1064 - DNA, 591 bp, A.fumigatus
accggcaagatggcttcacgagagcgatctcccccttcgactgcatctaccaccacaatgcggcctccaacgacagctcttcttatctatccagtgaccttacttgtgggatcgctcttttccatcctttctcccacagcccgaggctcccgacaaagccgtcccgctcgtcccgcgtctctggccccctccatcaccaccgacgtgaacctttcccctccaaacccggtcaactacttcgcccgcaaggacaacatcttcaatctctactttgtcaaggtcggctggatctggaccacactcgcctttctgtccctgctcgtctcgcaacccgcctacacggccccttccgcacaccaaccgcgtcgactcgtccaggccgcgctccgatacagcgtggctacgctagtgtggtacctaatgacacaatggttcttcgggcccccaattatcgaccgcagttttgtgattacgggcgggaaatgcgagcgcgttgtggcggagacgtcgggcaatcccggcggtggctgttgcgcaggcgggatctgtttctgcgggtctggaaaagttgtttacggcggcagcttgtaa

SEQ ID NO: 1065 - DNA, 231 bp, A.fumigatus
  unsure (132),(225): Identity of nucleotide sequences at the above locations are unknown.
ttacgggcgggaaatgcgagcgcgttgtggcggagacgtcgggcaatcccggcggtggctgttgcgcaggcgggatctgtttctgcgggtctggaaaagttgtttacggcggcagcttgtaaggccggtggnggttcgtggacggggggccatgatgtgagtgggcatgtgtttatgcttgtgctggcgacgtcgatgcttggttttgaggctgttggggcgacnagggct

SEQ ID NO: 1066 - DNA, 441 bp, A.fumigatus
tcaccaatccaaaccagatgcagctcggaaggaaccaggtctgctgaagacttcaaacccatcgatccttcaacttctctagaacaggccctcgctggggctgtaactgacactcaaccgccgtctaccgcagagacagcgcaggctggagacaaacaggaacacaattcatcttcgacaccgacccatgatgacaaggctaatactggagaatctacggaacctgcacgtaaaaagcagaaaattggcgaagagaacggtatggccaaaaacggtcaaacagctggtccggccaccgataactcgacctcgaatgtcactggcaacgatgagaaaaagtcagggcgctctaagaaagtaaaagacacggcgaagcgtacagttcattcagatggtatcgggagtcggacccgcagtcggaccaaggctgcagcgacttga

SEQ ID NO: 1067 - DNA, 519 bp, A.fumigatus
aatgacgcgctggaagatatcgacgagttcaatcccggattccgttcgcagtcccagcaaaccatgcgcatgtccttttcctcatcacggagccggaccgtccgcaatgtacccaagcagcgtgctgcatccgccatgtctgtacggcagactgtcaacccgggccgtgtatcacccgcgctcagcgcaccgtcacagggctcggggctccaggtccctgatgacggccgccaggagtcgacatcccgtctcagcacgattctcaatacgacgattaagggatcctttggtcgcagaggccggccgggctatgccacttccagtgttcacgaagggagtcttcatgcggacagcctgcacgagcgggatagcgaagaagactttcggcgtatgatggaacaagactccgatcggctggagaacgtccgcgcttgctgcgacggcaagcacgatgtcagctcactttccaggacaagtcgttatagcccacgcgtcaatcgaatgcactcgcatcactga

SEQ ID NO: 1068 - DNA, 486 bp, A.fumigatus
  unsure (52): Identity of nucleotide sequences at the above locations are unknown.
aggaggggaatgcaatgccaatgttccattcaggtgggggaagtggttaacnagttctttcagttcggacttggtgttgcctatgaatacggcttgatggggtgtccggtggatcttcgccagagtttcttttggtatacgcatgctgcagcacaaggggagcaccagagtgagcttgccctgagcgggtgtattctgacgggttctgaaggcatacttcagcaaagcgacactgaggcctacctttgggcgcgcaaagcagccaccgcgggccttgccaaggcagaatatgcgatgggttatttcaccgaagttggcattggagtcgccgccaatctggatgatgccaaaagatggtattggcgggcagctggtaagtcctttcgcgccttctatcagtggtctctatgtgtcaagctaacgtatttgctttaccctaccagctcaaggtttccccaaggctcgggagcgtctcgaggaaattaa

SEQ ID NO: 1069 - DNA, 711 bp, A.fumigatus
acctgggctatccggacgatgctttcatgcggaccgcttgctacacggctggtgttatcctggtcaaaggacgactccccacggggcatcgcagccgcgcaatcgttgactgtggcgctttcagatctgccacgactgtgcttcctcgcggtcgcgttcttttcgtttgagtttatcatctttggctgcgcagcgctgttgcccacttacgtccgttatgctggtttcccgcttgacgtgcaattctacgcccttaccgtactcaacagcatgagctttttggggagggtgcttcccggtttagcagccgatcaactcggtcggttcaacattctcctggcgctggttgtcatgacgcttttggtgatgggttccgtgtggctcccgtttggctctcgcggccaagctacattgtacgcggtggtcgccatttttggctttgggtctgggggatggctgtccctggcgcctgtatgtgcgggccagctgtgtcagacggaggaatatgggagattctacgggaccatctacagcgttgctgcgtttggggtgttgttgactgttcctgtgggaggagagctgctgcagtcgactactccgaaggtgctgatcggtttctactcggctgttctcatggtgggactggtgagcgtagtcatggctcgatgggccttgttggattggaggtggaagtggagggtcaagctgtag

SEQ ID NO: 1070 - DNA, 306 bp, A.fumigatus
gatcctacccgcgacgccggcctcgggacgtggtggcatctaggctaccgtttgatgcacgatatctcccacccagaccaagagctgggtaggatctattggcacaatggcaataccggccttcagacccgggagctctgtcacactactggtaccggaatctggttcagtcagcattctgcttgggatgggatattactcaagagcctatatacgtacctatgtatagtgacactgtctagtttgtcatatgtgagcgtcctgtccggtctgacgcgttcgagcatgtcgaataagatattgtag

SEQ ID NO: 1071 - DNA, 840 bp, A.fumigatus
atggatcggctctcgaacacacaaaattcatctgtctctcccaggactccattgcacgctaaccagcagccagctgtgagagcctttccagctacagagcctgattggtatatgagccacaaggtatacgcgccatcacagggaacttcagggccaattttcgtcgatgatcagactatgtccacctggcctctactggctgaccaacaaccctcaccgagcccatcggatcgccatacctctcacaatggctcccccgtagctatgtcaggttccaatgctttccatcagcgccgcatctcgcaggggatggacacagcattagtcaacgcgacatccacagtgacgcatacttttagcggcataccatttgccgtcaccactgaatcttgcacgccagagcaagtctctacaacggcggcaacagcacctgttcagtggaccgtccctcattggtacccactgcctccgggagccatttctcaacctccgccagtccaattttatcctcctgctcctccaagccctccgtcaacaagccccgtggaccctacaatgcaagcaccgcactcacaggttgacttctctgcatatttgcccaactattctggcccttctcaatatcaggtgtgcgaaaacttcgacagagtcaagtcgtggaaacgagttatgtctcttcaatatacacctgacacaacggctcttaacccacgagctgaacgacctgaggttgctaattatgccgactggaaagcgtctctgccctcccaaatatctagctttcattcccatggaatcctggaatcccccgtctccatttctccctccatgttgcaaaat

SEQ ID NO: 1072 - DNA, 489 bp, A.fumigatus
  unsure (471),(478): Identity of nucleotide sequences at the above locations are unknown.
aaaaaaaggcgaagtgggttcggatttaaaagatcaaccgctcccacactgacccttcgttcaattttcttgccctccatctcccccaactcttccacctcctttcaggtgctctcactttatagtctgcatctttcttcaatttttctttgttcatattcagtgcaaattgaagctatatgtcggacgaagtctacgaaggcgccatcggcattgaccttggtaaggaacctgcattctttcttttattttttaaaaatttattctttctttaagaaaaagggctatcacatataccataacacgattttcacaaagaaattgagtttcgctaagacatcaatccaggcacaacctactcctgcgttgccaactatgaaggcaccaacgttgagatcagtatgtttccttgaaggcatcacattcggcaggaataggcccggccatggatcgtttgttcatcagaagcangggcggnaaattaacctc

SEQ ID NO: 1073 - DNA, 189 bp, A.fumigatus
tcttttaaatccgaacccacttcgccttttttttcacttttttttttcaattttgttttttacttcgcctcccgtctcgttttcccccccaattcagccccatggttggagaaggtttccaatgtcaacgccctggttatggtattttcacaacgggcctggaaggtccacgagtattgcgctaaaaaa

SEQ ID NO: 1074 - DNA, 444 bp, A.fumigatus
ggcgggattcctgatctttcgacgctcgtgcttaagaaatccgaccctcccaccacaccaaactggttcctggcccagctgtaccgtcagtcaacatgggtctatctgtaccgtactatccgcccgtccaagcccagtgataagatagctcaggtggtggacgatggtctctcctacttggatcaactgccgcaagattccggagcctttagcattgtcctgatgcccttgttcctccttggttgctcagcattccttcctcgtcagcgagaacggatacagaaaggcttcgagtccctcaaggcttactccaacctgcgcaatatcgaacccgccttcaaggtggttcgacgggtatgggagatcatggataccaaaaccgaagacagctgggactgggagaagatcatcaacgatatgaacatggacttcctcatcacctag

SEQ ID NO: 1075 - DNA, 678 bp, A.fumigatus
cggctccgttcagatcttgcccagcacttcctgatgaaggccaatgtaacagcgattcgccgtgtaagaaagaccgataacaaccgtattgcgagagccaccggtgccacaattgtcaaccgtgtcgatgacctgcaggagtccgacgtgggaacgagatgcgggcttttcgagatcgaaaagattggtgacgaatacttcacgttccttcggaaatgccaggaacccaaggcctgcacgatcttgctgcgtggtccctccaaggatatcttgaacgagatcgaacgaaacctgcaggatgctatgtccgttgccagaaacgttatcttccacccgcggctgtgccctggcggtggtgcgatcgaaatggcggtgtcggtcaaactgagtcaactggcaaagtccatcgaaggcgtccaacaatggccctacaaggctgtggcggatgctatggaggttattccccggacattagcacaaaacgccggtgccagccccatccgtgtcctcacacgcttgagagctaagcatgtcgagggtcagcacacctggggtctggatggtgactcgggtaacctcgttgatatgaaggagtatggcgtctgggaacccgaagcggtcaaactccagagcatcaagacggcagttgaggtacgccctaaaacaatacccatttga

SEQ ID NO: 1076 - DNA, 213 bp, A.fumigatus
tgccattgcttgacaaggaagccaagttattgctatacaaacaagcatgaaactaacacagacaaaatgaataccacttgttcaattgtttggttcgccaatgtcgatcttaacggcctaattgagatagcaaagctcgtaatcctagcatttttttaccgattgaaaccccaacaaaacaacatggtcatccttgttcgtgatatcaattaa

SEQ ID NO: 1077 - DNA, 738 bp, A.fumigatus
accttgaaggaacgatgggaaaaccgtcttcctaaaccacatgtctatcgcgtcagtcccaaagatcgtgaatgcattgatcgcacgtttgaccctctacgtgaagctggcaaacttagtcctgctaccggtcataccccttcggcgtatccagtcttcgttgtatggaaaaccgtcactgatcagaacggccaaaccaaagaaaagggacgtgtggtcattgacttacgtggcgttaataaggaagtcgttccagatctataccctatcccgatacaagaagacatcattaatatggttcgtggttgccgttacattacggtcatcgatgcctgtcggttcttctaccagtggccggtaaagcgatcgcatcgaaaccgtcttgctgtcgtcagccatcgcggccaggagatattcaatgttgcaattatgggatttatcaattctgttccatatgtccaacgacaaatggatcgactcctgaatgaccttgagttcgccagaacctacgtcgatgatatcatcattgcctctatgacattcgacgagcatctgaatcacctcagcactgtcctacagcgcttgcaagacatcggtatccgattggaaccaaccaaagcattcgttggattcccaagtgttcagctattaggacaacgcgtagacgccctaggtctgtccactcctgaagaaaagcttgctgccattcgtaccttggaattcccgcgcaacctcaag

SEQ ID NO: 1078 - DNA, 624 bp, A.fumigatus
atatcgatcggcgggccaattcagattgatgtctttgtcttttatctctttatccgaccctctgcattcgcagtccgtcccgtaatgctgtcctcgactctctacgcagggtggctcctctccctcgcagccccagccctttgtgtggtgcaggagaagctctcagctgttcctagtggctggacactcatcgaggatgcatcggagagcgacacgatcactctctcaattgcccttgctcggcagaacctcgaccagcttgagtccaagctgaccacgctggcgaccccagggaacccggagtacggcaagtggctggaccagtccgacattgagtccctatttcctactgcaagcgatgatgctgttctccaatggctcaaggcggccgggattacccaagtgtctcgtcagggcagcttggtgaacttcgccaccactgtgggaacagcgaacaagctctttgacaccaagttctcttactaccgcaatggtgcttcccagaaactgcgtaccacgcagtactccatccccgatcacctgacagagtcgatcgatctgattgcccccactgtcttctttgggtcttcaccacgcggctcgaagcaaaagcgatgcggcagg

SEQ ID NO: 1079 - DNA, 216 bp, A.fumigatus
  unsure (186),(201),(202),(203),(204),(207),(210): Identity of nucleotide sequences at the above locations are unknown.
ctttctaaggataaccttacagcaggtctagatacaatggcgatttctaaagttcaaccagctatcctagtctttattcattctgtcttctggccttactgtagcttccttaataagataaataagagccttgtaattaacctgtctgcctatttaagtgtcttcaccacggggctggaagattgnagtgctaataaattnnnnaancgnccgtcg

SEQ ID NO: 1080 - DNA, 408 bp, A.fumigatus
  unsure (252),(389): Identity of nucleotide sequences at the above locations are unknown.
caggtcgccgcggacgccattgatatctatgtccttggcgtacagggtctcgacgagattgtggcctggtcaaccgccagtgtgcatggcctgccactggcctccgctgtgccagggaatacgttcgatcctgtgcagctcacccatgagtgtaagcagatctctcaggccattatcaaggccaagggggcaatgccccttggaattggcgctatcatctccatgatctgtttatctatcctcggcgaacancggcatgtcctccccatcagccattttcaaaaagagtatggctgttgtttcactttgccactggtcttgggaacgaaaggtaattctcttaacaattcctatccggtcaatgggggaggaatgggatggaatcctcnagtcttccccagcctttga

SEQ ID NO: 1081 - DNA, 639 bp, A.fumigatus
agcccgcaatcttcccttacatgtactctcacagattcagactgtacattttctactgccttagttatcatgctctccactgatgggcctcgcattggcattatcggtgtaagccaggtcggcgctgcagccgctaacgcgctgattatgaactcagttgcgcgcgaactcatcctggtcgatatcaaaactgagctccgaaatgcccaagtccaagaactctccgacgtcagccgaatgagtggacgcgcagaaacgcgtgtccgagcagggacatatcacgaggccggacagtgcgacattattctcatcactgctggttccaagttctctgtcggagaaaccagcgtgcaacacatgtaccacaacctggggattgtccggagcgtgatccaagcgatgcgccccttccgatccgatgccatactcatcgtcgtgtcgaatcctgtcgatctgctgaccacactcgcgcagcagctctccggtctgcctcgctcgcaagtcatggggtctggtacccttcttgactcggttcggctgcgtgggctcttggccaataaagttggagtgcgtgaggaccgattccaaaacgtgatctggctgacggttgcgatgacaggtcgccgcggacgccattga

SEQ ID NO: 1082 - DNA, 225 bp, A.fumigatus
ccattgttggttgagtggggtctggaaatgtatagccagatctatggatggggtactctctcctatggagtacactatttatttcacagcatgagaacatcccctgaaggagaaagctgtctatccctcatggctactttttacaacaccaccgacagatatcaaggtacattgcacccaaacactctcactgccgagatcgtcggttctatatctccgagctac

SEQ ID NO: 1083 - DNA, 333 bp, A.fumigatus
agtaacaaactcactctgtatccttcatctacgattgaccttcaaattaagaagcagaaaagcagtgcaatgcctccaaagagaaagcgttccacagaaagcgacgtgcatgacgatgcagcgcgcaacaagcgtttcgcgtacctgaagccccaagtccggcaggtttccgagcggactatcaagtcgaaatggacaacactccctgagcccgttcaagacaaggttcgtgatatgtttcgagcgcttgaacggccagttattgtgcggcagccgaatgaacgaaaacgcatcgaaggtcttcaccaggcggctggaaggatccgatcaatg

SEQ ID NO: 1084 - DNA, 207 bp, A.fumigatus
ctcgtgactcccgggaagcttcttcaagctcttctccttcccctcagtcaccccgaactctccactgggtcttgcccaacaagctgctttgacatttcatccactattgcttcccctcttttggtctccctgtttattctcgtcgacctcccgatctccaactccgcttgctggttcgtgtgttctatatacgtacaacagctgtag

SEQ ID NO: 1085 - DNA, 450 bp, A.fumigatus
tcagtggactactttgcagcaataccctctgtctggcgatcttaccgaaaaccatcgcatcggctgccagaccaaacgaatcaaactgatttctatccacagctttggtgcaaacctcgctttaccaccagcatggccaccagtactgtcaaggagcccgctccgcaaccctctgtggatttcttgcaccgtccgtacacacgcgccgctctgcccttcatcaatggtggtctcgccggcatgactgccacggccgtcattcagcccatcgacatgatcaaggtccgcttgcaactggctggtgagggtgttcgcactggtcctcgtccctctgcgtttggcgttgcgcgcgacatcatcgcctccggaaaagtgctcgacctttacaccggtctgtcagctggttgtcttcaccacggggctggaaggagccgcgctgagcgtatacat

SEQ ID NO: 1086 - DNA, 357 bp, A.fumigatus
tatgttcgggaaacaatagattgcggtcgaacggaaagccggactcaccagagaagtgaggaagccatcagtccagctgacatctccattctcgttcacttcgcggaacgggcactcgttgcaaataagttcgacatgctgttgctgagcagtgaaggcttccaagggatggaaaccagtgaaatcaccctgtggaacgataatatcaccctccatcttcgggacgactacaactgccttggcgcccagagcaacggcaccgccgaggaggaacgaacgaaggttcattgtgtcaagcaacaagttttaaaaagcacacatgaggtaaaacctacaacagaagggaaattagaatga

SEQ ID NO: 1087 - DNA, 411 bp, A.fumigatus
  unsure (245): Identity of nucleotide sequences at the above locations are unknown.
cagcgcgtttccttccagccccgtcggtgtaagactgcgatgcagctacagttagagcgcttcttcctgatccggaacacggccgccgaaatgcggttcgtggatcagcgcagccggtacctggttgaggtgctgaccgtcccgtgggaattgacgggtgaggaggtcgagcagttgcggcttgaggcagaggcggaggaggagcaggctgaaaaggagcaggagcgagcgcgtatgaggcttangaggcgtgtggagcgtgaggagaaggaccagcgtcggatccagaggatgtgggaacgtgaggagcagtttagggagaaggaggcggttctgtgccaggaagctgggcgcagggccatgcgcgctattcagcgcaaacgcgtcatgaatataagcagtgaaatgtga

SEQ ID NO: 1088 - DNA, 438 bp, A.fumigatus
cgcggcaccttcgacccctgtggtgaagactccaccggagctcaaggtgcccaatatctcacaggcactggagacaaacatacagcgatccctgcagctgggaagtcgttggcaggtccatctgttcctgatattctagcagctacacgtgcggatctttccgaagcccaacgtgctcgttcggagttgcaggcccggctaactgagctgagcaccgagttggagaagctacggaagagaagcacgcaagatagcagacgtatccatgttttggagagtgaagtaactcatctacaaatgcgtgtaaaggatagggacgcagaattgaaggggaaggccaagttactcgaggcatgtcattcattcatccgccatgccgccactcgtttgctgacacggtcgcttcgtaggatttccaagacgaactcgcctctctga

SEQ ID NO: 1089 - DNA, 447 bp, A.fumigatus
cacatccctccaggagtctggaccctcatcttcggcgcaatgattggggtggaacggttcaccgtccgcaaacttgccggcgttattgcttccctgattggaataatcctcatctcccgcgtagatctgtcgtcaacggactccccgcccggagatgatggcagttcaggtaccttcccccacaagacgaccgccgagattgctcttggcgacgccatggccgcattcagcgcagtcatgtacggcgtctacactatcgtcctaaaaagacaagtcggcgatgagtcgcgggtcaatatggtgctgttcttcgggctagtgggactctttaatatgctcttgctctggccgggattcgtcatcttacatttcaccgggatcgagccgttcgttctccctgataccgggagaatatggactatagtgctggtaaggaatacgtcgtga

SEQ ID NO: 1090 - DNA, 219 bp, A.fumigatus
gggccaatgtgcgcccagccggcctttgtatccaaagaggagaagaacgcgtacgtggaagaggtcatcaagatgctcgacatggaggactttgctgaagcagtggtcggtgtgcctggcgagggtctgaatgttgaacaacgcaaactgttgaccattggtgtggaactggcggccaagccgaaactgttactgttcttggatgaaccaaccaggtaa

SEQ ID NO: 1091 - DNA, 951 bp, A.fumigatus
  unsure (755): Identity of nucleotide sequences at the above locations are unknown.
gacaatcttgctctgatttctgcttgtgctaattggtgtagtggtcttgattcccagagctcttgggctatctgcaacttcctccgcaagttggctgacgcaggacaagccatcctgtgcaccattcaccagcctagtgccatcctgttcgagcaatttgaccagttgctcttcttggctcgaggtggcaagacagtgtattttggccccattggagagaactcgcagacgcttctcaaatatttcgagtcgcatggggctcgccgctgtggggatcaagaaaatccagccgaatatatgcttgaggttgtcaacgctggcaccaaccctcggggcgaaaactggtttgacctgtggaaggcaagcaaagaagctgccggggttcagtccgaaatcgaccgcatccacgagtccaagcgaggcgaagctgaaagtaaagatagtaccaatcccaaagaccgcgaacacgaggaattcgctatgccgttcttcaagcaattgcccattgtcaccgtgcgagttttccaacaatactggagactacccatgtacattgcggccaagatgatgcttggcatatgcgcgggtctgttcatcggtttctcattcttcaaggccgacacttccctgcagggcatgcagaatgtcatcttctccgtgttcatgctgtgtgccatcttctcctcgcttgtccagcagattatcccattgttcatcactcagcgtgctctttatgaggtccgcgagcggcccancaagacgtattcctggaaagcgtttatgattgcgaacatcatcgtcgagattccctatcaaatcctgatgggaattctcgtgtttggctgctactactacgcagtgaacggcgtgcaatcctctgaacggcaagggctggtcctgttgttctgcatacaattttcatctacgcgagcaccttcgctgaatttgtga

SEQ ID NO: 1092 - DNA, 273 bp, A.fumigatus
tggcgtcgagattacttcgatactgcttcgttccacgtgggctctaaggagtatcagggcgggcgctggcatgactacaccttcactcatcatcctttcatggaggccaaaatcgaaacttcattctggtatgatggagaaactctgactttgcgcgtagatacgctttgtaggttcaaagaaaaggccccggatatactagcttgggggtatgaagactcgctcgaagtttccacaccaggccaccagaaagtggcccagtgtattctttga

SEQ ID NO: 1093 - DNA, 192 bp, A.fumigatus
  unsure (28): Identity of nucleotide sequences at the above locations are unknown.
ccatggtattcttcagctgccgctgatntaaaaacctgcgacgttgaacatccacgtgctttttggtcatttgctagttcccagatatctcgaaacaaatatatcgaaggaatgcagctggtcgtcactatctgggtcttcccaggtgagcctaagactgctgacgctaagatgtccagtttgccaacctga

SEQ ID NO: 1094 - DNA, 264 bp, A.fumigatus
attcagaatcttcccacggacgcacagagtatgtacctctctaccgtgaaggtccccacagtgatgatggcgatctcccgctccacaaaaaatcaatattctttcatgtccaataaccagcgacgaatttatgcaattgagctcctggttcgctcattgcattacctgatttggctctcttctaaggtacatatttacacaaaattgagtcctccaatattcctctccacctggttctaccggaagcaagcccacccaaattaa

SEQ ID NO: 1095 - DNA, 765 bp, A.fumigatus
gttgggcgcgactgcggctctttccggcccttggtgaagacagtcctgttttttgcgacgcataactcggcccaggagctcgaccttgacctgtggccacctagtgctgctatgacttttgctgcgcttccctatgttaagagcttttacagcgcagtctatcacagattatttggcaagctggaaaggaagtggattgccgaggtgcaaccacgccaagcagatatcaacgagtttgatgataatgcgccacctgagcatccggagggaagaaacgatgctgagaatggccagatattgatggaaattgatctggagttccaagttggaatgggtaatgatgtacgtcagggcattctgggtctccatgccggagaaaacgcccagaacaacgggcaaaaccaaggaggcggtcaaaatgaaaacaatctgggactcgcgaggccacacgacctcatacatgaaacaagcaacctccccgatatcattcttggggctctcgcatttccagcaatctcggcatccatgggaggtctgctcaagtatattctccccaagtcgtggacaaccgcaccctcagccttggagcgcggccgacctggtctgctgcagacgcgctggggacgaagtgtcatcggaggatgcgtgtttgtgctgctgaaggatgcattggtactttactgccgctggaagcttgcacagacacatagaaaacgaaaggtgctgaactacgaccggaagaagaagaaagtggtggaccactga

SEQ ID NO: 1096 - DNA, 579 bp, A.fumigatus
ccccaatggtacggctctttccagccccgcggtgaagacaagggggcgacggtgattgcgactgcggggacagagcgcaagagacaggtcgcgcaggagtttggagcggactatgtgattgattactgcaatcagaagtggcctgaggaggtaaaaaagttgtgtgcgcagcaccgcacagggaatgggaaggcgggcgtggacgtcgtgtatgatccggttggtatgatcgatgccagtctcaagtgcgtggcctggaatgcgcggttgctggtgattgggtttgcggccgggaaaatcgagaaagtcgcgctgaaccgggtgctgctgaagaacgtcagtcttgtcggcttgcactggggccagtacgccaagtttgagaaggagacggtaggcgttgtctggaagggaatcttcgatctggtggcccaaggcaagttcagagggacagccttcacagacgaaagatttgtgggattggagagtgtgcccagagccttgcaggctctcggaagcagagaaacctggggtaaagtagtggtgaaggtcattgacgatgaggcgaagagcaagctgtga

SEQ ID NO: 1097 - DNA, 189 bp, A.fumigatus
  unsure (40): Identity of nucleotide sequences at the above locations are unknown.
gatgaaggattggatgtaggcctacctattttttccacantaaatcgtagccctcagcacgcaacttacgttttcggccttatgactctctgtttgtttggaatcagcacttttgccgacatgagagactcactcacagcgacagacttccagtacgtctgtatcttaccgtcggagacgtgtaaatga

SEQ ID NO: 1098 - DNA, 192 bp, A.fumigatus
gacgtgttcaagttgttgggaagcgagccagaatttaagaagcccgttatggcactgtacgagggggccaggcaagtcttgcacaacggcatgaggtttatggttctcagccctgttgaacggtacgtgaccacgtcgaatcaaggaagacgacttggactaacatttcacccttttttttccagcatgtaa

SEQ ID NO: 1099 - DNA, 1029 bp, A.fumigatus
ccccgtggtgaagacgtctccttggagcctattccaagctcgaccgacacgttctggatacacatacacatcgccaacccctccgcatttgtcgaacctgacagctcaatcatggaatacgccgccgtgcgtaatcagactctctatgtccccgagcgcacatacccgatgctgcccagctcattgacacagaaccatttcagtttggctcctggtcgccctactctcacattcagtgccaaaatgaatttgcagggtgaagttctggaaacgaaaatcgccaatggcattgtcagaaacgtaatctatattacgcacgacaagctacgtagtctttttgaaaccaccactggatcttcggacaccctgacagtgggaggcactatcacgcagccgcattctcgggaagagttacagagctcgctgacaccagaagacgaacgtgctttccataccttgcgtaaactgatgctggcatttcgtgaatatcggctcaaaaacggtgccatggagtggccgtcgcctgctgacaattcagtctctgtctttgcaggaacggcgcccatgaaaccctacaccatggatatcaccaatggccgctatcacttgggcgatccaatcatccagttgcgcttgcaggatgtcgacccgcacgaagtacctgacctcaccaagcgaaatctcgtctcgaccttgatgaatttcgcttgctggatctctgggaaatggtgtgcagagcgcaacatcccagcagtttacgacggaacatgctatcaccccgaatacccgagactaacgaacgaaaacatggctgaatatggaggagaaggatggctgcacttcacaccccccaagggtatctcctcatcgacccccatcccacatattcccctcggcctggacgcttatatcaaatccacaagcccacttcggcgatacgtcgacctcctcgcacactaccagatcgaagccgcgctgcgcttcgcgcacgcacacgggcgccccttagacgcctcgaaagatacctaa

SEQ ID NO: 1100 - DNA, 186 bp, A.fumigatus
cccgtggtgaagacgtctccttggagcctattccaagctcgaccgacacgttctggatacacatacacatcgccaacccctccgcatttgtcgaacctgacagctcaatcatggaatacgccgccgtgcgtaatcagactctctatgtccccgagcgcacatacccgatgctgcccagctcattga

SEQ ID NO: 1101 - DNA, 426 bp, A.fumigatus
tcaataccggggaagactttgcgcaaattcttgttgttcatcagggccttgatctcggcagaattcttatccagatccccattcacgcttgtgtcttcgctggctgtttgtgtggaagaggacgaagccgaggaagccgaggaaggctcctcgttgcctctgtggcctattgtaccaccgaccgcacctcccacgatggccccaatgatgatgaaagccaggatcgcccccacaatccatccgcgcttcttgttaccccctcctggcttcggtttcacccagcgacccttctctccagcctcgagaccagctcctgggaccggtccgtacgatgtatcggcagcactcttgcccccgaaaagccctcccagatttcccaaaaccccacccgctgcggcacctcccgccgccgcaggaatggcctga

SEQ ID NO: 1102 - DNA, 798 bp, A.fumigatus
atatcgctttgggggcagccgctgcccccgctggacagttggaccccgggtcaatccgtttcgcatcttagctcgacgaatccatcgcaacgcaacctctatgatatcccatatcaggatgtagggggtctgaacgccggtccctaccaacggcattcggcttatagctcgaacgatctgcctgttgatatcaatccagatgagatcgtcgatgatggtgatgacggttttgtgccggcgccgaactcaggatctggtgctcgcaagtctcaggccattcctgcggcggcgggaggtgccgcagcgggtggggttttgggaaatctgggagggcttttcgggggcaagagtgctgccgatacatcgtacggaccggtcccaggagctggtctcgaggctggagagaagggtcgctgggtgaaaccgaagccaggagggggtaacaagaagcgcggatggattgtgggggcgatcctggctttcatcatcattggggccatcgtgggaggtgcggtcggtggtacaataggccacagaggcaacgaggagccttcctcggcttcctcggcttcgtcctcttccacacaaacagccagcgaagacacaagcgtgaatggggatctggataagaattctgccgagatcaaggccctgatgaacaacaagaatttgcgcaaagtcttccccggtattgattacaccccgtggggtgtccaataccctctgtgtctcaagtatcctccatctcagaacaatgtgacacgggatatggccgtgctcacgcaactaacaaagtct

SEQ ID NO: 1103 - DNA, 324 bp, A.fumigatus
  unsure (110): Identity of nucleotide sequences at the above locations are unknown.
cccagacgtacccagtggccacaaacagaggccgacggatttcggacataccatgttatcatgtatgacattgatctttcggatagagatatcctgtcgagcctgacagntacagcatttcgcgtaaagaccgaggaatcgtggcacctaaccacattgaatgataccgacagcacaatcaacgagatgcaattggagttattcagggaacaatgggaacgttacaaagaaaatccttgggataccgagatgagagggcagattttcttccgccaagagacacagattcaactatttgagcgcataatcgaccttgaggagtaa

SEQ ID NO: 1104 - DNA, 474 bp, A.fumigatus
  unsure (29),(35): Identity of nucleotide sequences at the above locations are unknown.
gccatagacaacacaggcaccccaccccntacgcnccacattaacgccaaacgcaaaaaaaaaaatgcagatgcccttcctcaaagggcggcagcggcccgtacaacatcatcggcgggcggtgcccaaggcgccgacgacaaggtcatccagcacaactccggcggccaggtcaacatcgacggcttcaccgtctacgactttggcaagctctaccgctcctgcggcaactgcgacgagcagtatgctcgcaccgtgactatcaagaacgttgtcgcgaactccggcaagaccctggtcggtatcaacagcaacctgggcgacacggcctccatcgacagcagcacctgcgccaccgatgtcaagaagatctgtgtggagtataagggtaacgacaccggtgcggagcctgaggagatcagcgagggccctagtgatgcttgccagtactcggagcctctttcctcttgctag

SEQ ID NO: 1105 - DNA, 573 bp, A.fumigatus
gagcgctgttccttccagccggcggggttgaagacgaatcggtacgcggagctgcctgtctctgaactccttttcgagttggcaagtccatgtgatcccgagtccgtgacatcaactggattatgtcccaccgaagacgggatcggcgagattatcagcgatctgctggtagccttcgtgatcaagagtcttctgacggtggtgacattcggcatcaaggtgcccgccggaatctatgtcccgtctatggttgtcggcggtctcatgggccgcattgttggccatgtggtacaattcttggtggtaaagtttccaaacttctttctattctcgacgtgtccggtgtactcgggcatggagtcctgcgttgttccaggagtgtatgccatggtagccgcaggggccaccatgtgcggcgtaactcgtttgtctgttactctggcggtcattctgttcgagttgacgggcagcctggaccatgtcctgcctttttccctggcagttctttgcgccaaatggactgcagatgccattgagcctcgtagtatctatgtaagtctagcgcccatatga

SEQ ID NO: 1106 - DNA, 207 bp, A.fumigatus
gttggcgacagcattgatgatatgactgccggtcatacggcaggcgcagcgactgtgctgcttgtcaacgagcacaatactcatctcaaggaccacgctcatacggacctctgtatcgagcgtttagacgagctgattgacatactagaaaacggtttcgttggtcaccggcgagataagccacccacaagtgacagggatgaatag

SEQ ID NO: 1107 - DNA, 462 bp, A.fumigatus
  unsure (97),(112),(113),(126),(148),(245): Identity of nucleotide sequences at the above locations are unknown.
agacagcgaggacatgatgcccagggcaggccgccaaaccggcggtcggaacgtgaacgcgaacgccaaccgcccaaacatccgaatcggcagcggnatagggagagcaagnnaccttgctcccgntggccttcgcgcttcgaccggnagacccgccagacgtatcgagaccgtcaggactatgggttccacaattcccgccagcgctccctgtctcccaacgcgcgctcgagccagggtagagntaatgatcgccggcagccgccgcttcgctcgcctcttcggaatcgactggagccgtcccgtcggacaagaggcggaggaaatggtgggagtcgagacggtcgtggcggacggggtggtgggaacaaaagaggtggtgccagcggaacttccaacggagatggctatcgcccgatgccgagtgctgcgaaaaagaactgggacaggtacagactatga

SEQ ID NO: 1108 - DNA, 300 bp, A.fumigatus
ttgagccggccgacgcaatgtatacgtgtccggatcgcggagtgtgtggttcggggggcagccagcgctgcggacaaggctggggcgtccaagcttgcccgccagccgagttacgataccaactactttgataccttggagcagagtgacggtggtgcgcttgctcctggtgacaaggcgcttctggatcaggtcggggacgctctagctcggctgggcagggtgaagcgtgtgggattggcggtcaaggagaagcaggattttcttcgctcgtggacgaaaacgaggcggacgtggtaa

SEQ ID NO: 1109 - DNA, 564 bp, A.fumigatus
acaacggataaagcttcatctcgactttatccgcacttctcctggactctttatgaaggggcagtttcccaccgagatgactgggcaattgtttcattgtcgaagataatagacaaaatgaggatatcttccgcgcttcttgcgctgggcctcctccctgaagcgctctgcaagagtgtccatcccgcagaaacatacaaatcctgccaaaggatcacccctgatcctcttcaaggctgtccccatggcactgtatttgtcagccagaccgaccatcgggctcatttcaagtccatccaggcggccatccactcgctgcccaatgatacctcgtctcatgtcatccttatcggcgctggaacttatgtggagcagctcaacgtgacacgctccggcccgttgacgctcctgggccagtcgaatcgcccctggcagcgggagagctatggcgatatcaaccccaacactaccgtccagaacgatgtgcaaatctactggaatgcagctaaccacaacgccgcattcccggtcttcaccggccgactggccggacatcgccccaac

SEQ ID NO: 1110 - DNA, 858 bp, A.fumigatus
  unsure (105),(130),(162),(173): Identity of nucleotide sequences at the above locations are unknown.
atggggcccataagggattggcgcacgatatggaatagcgatgccattggcacctttgatgctgcccttgttccgtcgcaacaatcgctttctcgaacggaatcngtgtatcttccacgtcaaccgcaanatgtcaccgcatcgcctcgtctttcgtcgtcntcccatcttcntggatcccaacaacagccgcctccattgcagaggcctcatgcgtctccagagcgatcgtcttcctatggctcaatacaatcgcccttccagtatcattcggcttctgcgctgagtgccggtgcgcaatcccaacgaggccagagtccgccccctccagctcctccatttgcttcctccggctcgcgtgactcctattctgcgtccgccagttataacacggctgcatcgttggcctctccatacaccccgcaacccgcgagttccacaggtcctttcccagagcagcaacagcagcagtcgtatttcgcgcagcagcgatcccagtccatccagtctgtcctctcccctccacccgcgaccaaccactcattcccacccagagacagtccttcctcagctgcttcgcagtcgcatccgtcacaactgttctcaccccctgcgcatgggtcgttgcctgggactccgcgagcatccgctaccacatcactaccgcgtcaaacaacgccgtccacgcgtccccaatcctccggtcatgactcccaatcacaccatggctcaagcccttgggttggcccggattctcaagtccacatgtctccaacttcgatgccaagagcttcgcgtcaggattcaagacaccgggagctgacccctcgacaatttcctccgagagttgacaggcga

SEQ ID NO: 1111 - DNA, 375 bp, A.fumigatus
ctgtcagctctcagcccctcagcctcatcaatagccttcctgagactcgagatctatccgactgattcatgttcatcgggctccaaactttccaagcttaagtcaacaatcagtagtttgactcgacagcaatatatcacctttgtagtgattggagaattatgtacagagacctccagtgtccgtccagtccgtatcaagacgactgacatcattgagcacattctctggcaactcctccctgccaataatttgattagcgtgcgaacgttgctatggaacatggtacgatattggctctgtccaaacttacaaatgccattcctgcgagcccctgactctgcctggtcggctattgagtccctaggagaaata

SEQ ID NO: 1112 - DNA, 234 bp, A.fumigatus
cactatcttcagtcgttcaatcgtaaatccgatctctgcagacactaccggatacataccaatgagcgaccttatcattgtaccgtcaaggactgcaacaaaagttttattcagcgcagcgcgttgactgtacactcgagaacacacactggcgaaaagcctcacgtctgtgatcatgaaggctgccacaaggccttctctgatgtaagtttattgacaccgggcatgtcttca

SEQ ID NO: 1113 - DNA, 798 bp, A.fumigatus
gggcgccccatgttaaatgtttcttggcatcacccagagctgttggtccttctcagccagctcggagctaatatgaaacggagggctaagctgcatcaatggtccacactattccacgcgccgattaaaggctgtgtaaactgtatgcgtaccgtgctagagctcggtgtcgactctagtgctgtcgatgagggagggttgtccacaatgtcctatgccgcatgggaaggacctctgcaatgcatgctgcttctgtggtctcatcgtagtgagtcacaattacctcaaaagcccctcgatatcctcaatggcttgaggttgcaggaaccaaatttgactaccatgaatcacgagatagtggcctcgagtgacatggacactgctgatggcattcctgacctttcactgcccccacccatcattcctttgagacgctacggacacaatttcctggataagaaggtattcgtccaaattctattcgagccaggtagctcaggctcgctttgctttgaccaagcaggtcgccatcctgctgctcggttgaccatttcgtcgaagctctctgatttaatacctcgcacaattatgctccctattcaggaagattccaggaccatctcttttcatgttgataacctagaatcatttgctgttgattttgaggtctttcctacctttggttcgaaagtcattgctaaaagcgtcgctctacctaccgtgtttagagccgataaatccagtaccgggtcatgcacgctgccgctgtttgatcctagactgcgctcaattggccag

SEQ ID NO: 1114 - DNA, 600 bp, A.fumigatus
  unsure (15): Identity of nucleotide sequences at the above locations are unknown.
gttccattgagccanagaaagcaagtcaagcacccctataatggaggtaaaccccccgcaggagcccctcctggtaagaagggcgacccagagaagacaaagccagaatggtggcccgccgatgtggttcacaaggagcctgaccatcttcgaaaggatcgtacgtgtacccctccagaaggtttcctgtgtcacgtaactttgctgacagatgtagaacgcctgtctctgttgattcatatcatccgcaagcttggaagattcggtatcactacagatcaattgcaggagatcgcccacgactgcaagcggcagctcagaggacctcacagactccaaatcctggacgaggtcttcagagtgagaaggatggaagaacgctatgaaagaggagaagttggtaggcagcatcttcttttcatgaaatttattttaacagctgttgacgagcctcagatgccaacacgattgtatatgttgtcaaccgagagtcgaacccgaaagagaaggatgctgactccaacgtggatctggaccagaagcatgagcaagaagacgataatgcggatgaggcacttcccattcaccactctgaggtga

SEQ ID NO: 1115 - DNA, 549 bp, A.fumigatus
cgagcctcagatgccaacacgattgtatatgttgtcaaccgagagtcgaacccgaaagagaaggatgctgactccaacgtggatctggaccagaagcatgagcaagaagacgataatgcggatgaggcacttcccattcaccactctgaggtgaactcaaccagcctgatgtcgagctcagtcgaacacatgggcatggcggcaccaagtcgcccaatgaatattggggatgagaggaaccagttgtttcctttaccggagtcgttgagcttcggtgaggcaccgcgagatgatcggaccttctttcccacaacctctgagtataccgaagattatgcatcacagcagatgcttagaacccctgcaacaacggcgcttgtcagccccaatgagccacctgccgctttcgattatatgacacaggcacccatcacctcccccggctcgggagcctatttccctcccccgccaaattatccctggccatgtcagaaccgggcagtttccaaccctggaacccttcgtttccaaaccaatctcttcaacccg

SEQ ID NO: 1116 - DNA, 201 bp, A.fumigatus
  unsure (200): Identity of nucleotide sequences at the above locations are unknown.
acccggtatttctcccggatcccaaatctacgagttgatgaagtccccgtcccaagattagttgcgaagaccatgacctatccgaaagttgtcaccggttacaccaagaagaaactgcagcaaagggttcgaaacggaccaaagaaatggcaaggagcgaactacatcatcaagagggtttcggatttcaagctgttttng

SEQ ID NO: 1117 - DNA, 657 bp, A.fumigatus
aagtatggtaatctcaacatgatcgccgatcagatccaagaaggagacgtgatcgagcgtcacattgaggatggcgatatcgtccttttcaatcgacagccctcacttcacaagctcagtattctctcacacttcgccaaagttcgcccgcatcggacgttccggcttaacgagtgtgtctgcaatccatacaatgctgatttcgacggtgacgagatgaatcttcatgtgccccagacagaagaagcaagagccgaagctatggagctgatgggtgtgaagaacaacttggccactccgaagaacggagaacccatcatctctgccattcaggatttcatcagtgctgcctacattttaagcagtaaggataatttcttcgaccgtcggtcctttacgcagatttgtctttatatgctggggccggaaaccagatttgatcttcctccacctgctgtcctcaagccccaaatgctttggactggaaagcaggtcttcaacatcctgatgcgtcccaacaaggacgatcctgtcctggttaaccttgacgccgcttgcagagaattcaaaccgccaaaggatggtcggccaaaagacctggatccaaacgatggctggcttgtcatccgtaactccgaagtcatgtgcggcgtgagt

SEQ ID NO: 1118 - DNA, 342 bp, A.fumigatus
tatgcaatcatcaaaatgaattggcataatctctctacaatcttggccgttcttacctctctgctggccctcattgtctgcggtcaagaggacaacctcggtctcaagaatggatacatctccctgtccacggcgaattgggacctgaagcttgtcaaagacgctcaggttcttgcatctcttacgcccaaggggaagtcctttgatttcctcccctttgactatctctccgtccgcaccgagaatcagcaatatcacaatggggatatcaccttcagctaccgagctacaggcgagatcttcaccacggaggtcgacggacccgcgaatatccacgggggg

SEQ ID NO: 1119 - DNA, 210 bp, A.fumigatus
gttctcatccatcacaacggtacggggaagcggccaggagttgctttggttgcggcatcagcaaactactggagtatgctgattgctattttgttaggtggccatctatcggatgatactgtggacactcgataccttactccatacgtcgttacagacacggccaacccacttaataccacgctcatccctccgagagtccgaatgacc

SEQ ID NO: 1120 - DNA, 453 bp, A.fumigatus
tttcaaaaagagcattttattgaagattttggactacttagactcaagtggtttacatggccgagtagctactcatggctgccaatttctttaacaacaaggcccgagctgcagctgctgcagctgccgcagcatccaccagttcgaagcaaaagccaacagatggaaaggaggagcagacacggctgcagccatgggttgagaaatagtatttactatctagcccattgtctattttacgcaatggttgttctaacggagatccatagccgtcccaagaccctcgatgatgtagccgcgcaagaccacaccacgaaagtccttcaacggacattacaagcttcaaatgtacgtcatacaagacttcctaccaaagtaaattcgaagatgaacgttactgacagaactagctcgtcttctaccacgaggagcggcggatccgcgctaagaatt

SEQ ID NO: 1121 - DNA, 192 bp, A.fumigatus
gccctaaaatgtattagcacaattactcctcatcctaagccaacagcaacttacctctccctcttctccaacccaaccgtcacaaacgtcgctaggataagaatcccagacaaaactgtcaccgtaataaaccccttcctgtactccggtgcctcaacctgccgccaaacaatctgcggcaaccacgcctga

SEQ ID NO: 1122 - DNA, 318 bp, A.fumigatus
tacatcattgctggagcagggtacggcctaagcgggcttctaatggcgtatgtattccccttctcagtaggcgtatcgcaaactgaagacaacagatgggcacatgagatctgcgccgaggataacgaggaacgggcattggtggtgggtagcatgaatgaaatggcgtatgtctttcaggcgtggttgccgcagattgtttggcggcaggttgaggcaccggagtacaggaaggggtttattacggtgacagttttgtctgggattcttatcctagcgacgtttgtgacggttgggttggagaagagggagaggtaa

SEQ ID NO: 1123 - DNA, 990 bp, A.fumigatus
  unsure (802),(814),(861): Identity of nucleotide sequences at the above locations are unknown.
gaatcaccggtaagagtccagcatcaggttcccaacctatacgatgatcccagctcatactggatgcaactcacagatgctggtgccaatggagccgacatgtcaagttcgacttcggccgcagcaaacgggactggaaaggaagttgacgacggctcggacgacgatggcactgaaaacccccccgcagtagctgccgagcacagcactgcgaagaaaaagaagaacaaaaagaggaagcccaagaagaagcaacccaaggtccagaccgatccgccatcgattcccctctcgcagctattcccgaacaactcctatcccaagggtgaagaggtcgagtacaaggacgagaatcgctatcgcacgacgagcgaggagaaacgtcacctcgacaacctgaatagcgacttcctctcggactaccgtcaggcagcggaagcgcatcgccaggtccgtcagtgggcgcagagaaacatcaagcccggtcaaacgctgctggagattgcgaatggcatcgaggagagcgcgcgatgcctggtgggccatgacggcttaacggagggggactccttgatcgccggcatggggtttcccacggggttgaacatcgataacattgtcgcccactacagccccaatgccggctgcaagaccgtcctggcgcagaacaatgtcctcaaggtcgatattggcattcatgtcggcggtcgcattgtcgacagtgccttcaccatggcgtttgatcccatgtacgataacctgctcgcggcggtcaaggatgccaccaacacgggggtgcgcngaacgggcatcnatgtccgtgtgggcgaactaggcggctacatccaggaagcgatgganagctacgagtgcgaaatccgcggcaagacgtacccgatcaaggcgattcgcaacctgtgtggccacacgatcctgccgtactccatccatggaacaaaaatgtcccctttgtcaagtcgaacgacttga

SEQ ID NO: 1124 - DNA, 288 bp, A.fumigatus
  unsure (44),(56),(103),(236): Identity of nucleotide sequences at the above locations are unknown.
cctgctcgcggcggtcaaggatgccaccaacacgggggtgcgcngaacgggcatcnatgtccgtgtgggcgaactaggcggctacatccaggaagcgatgganagctacgagtgcgaaatccgcggcaagacgtacccgatcaaggcgattcgcaacctgtgtggccacacgatcctgccgtactccatccatggaacaaaaatgtcccctttgtcaagtcgaacgacttgaccanaatggaggagggggacttcttggccatccaaacctttgggaataccggcatt

SEQ ID NO: 1125 - DNA, 207 bp, A.fumigatus
ggatatcgcttgtgcgaccagctcagcagaagatggccgggcatccgtcttgcgggtctaattgatcagtcggagaccttccacaagtttactctaaagtcgagaatggatgtggtcctggcggtcattcctggccatcttttgaccatttaccaggctttcaaccaaggagctggccattataattccgtgggtagccaaccgtct

SEQ ID NO: 1126 - DNA, 366 bp, A.fumigatus
aagtcgagtgcccaaacaagagtttcgggcctctggaccgcaataatgggtgttgaaacagcctccttacaggatcgcctcgagagatgggcacagaggctacaaaatctaacagtgtctcctctgacccgagactatcccgagaaccaaaaggccgatctgaagagagcaattgaggcctttgaatccctcaagctgccaagggatgtgcatactggactgcagaaactctctggaccatcatccggtttcattactttcttggctgcttttgttgttctcgtagctcgtttgaccggcgatgaggatatcgcttgtgcgaccagctcagcagaagatggccgggcatccgtcttgcgggtctaa

SEQ ID NO: 1127 - DNA, 225 bp, A.fumigatus
tatctggacaaaaacagccttaacttcgcttcagtgtatggcctcaaacaagggacgcacctgcacggacaggactatgcctggctcggctcaatcttctactttggctatttaatcgcccagtatccggccggatataccctgcagcgacttcctatgggaaaagtcctgtccatcactaccatcagtatgtcactgcttagaactcatctagatcaatattaa

SEQ ID NO: 1128 - DNA, 405 bp, A.fumigatus
ctggagacaatagcgacaatggctgatgactgtggcattcagggcgtcctcacctcgctggcgactttcaccttcaccacgaacttcaagcactcctcgccgtacgcgcacttgctgccgccgtggtctgcgctcttgactcacccgatcgacaccatcgggcaggcgcttgccgtcttccgcatgcatgtgcagcatacctcgatggagacgaaggagaagcgcctcaagcgggtcgaggatgcggagaagaagcggcagtatcggattgcgcatgggttggaggagcccaatgagaagactgagagacagaacccggaagtggttgatgatcagtcgccggtcgcggtcgatattcctgcggttggcccggatgaatacgttgactgggataggaagaagaag

SEQ ID NO: 1129 - DNA, 531 bp, A.fumigatus
gcactccgcaccatgactatcctcgtgctaggtggccgcggcaaaacagctagtcgtctatccttgttgctgcacaacgccggagtccctttcctggtcgggtccagttcaacttcgtacgtaggtccctacaagatgacgcactttgactggctcaacgaagatacctggaccaatgtgttcctgcgcgcatctctagacggcattgacccaatttccgccgtctacctagtgggaggtcacgcaccagaattagttgatccagggattcgatttatcaatgtagctcgagctcagggtgtcaaccgcttcgtcctcctcagtgccagtaatatagccaagggaacacactccatgggcattctacacgctcacctcgattctcttgaggatgttcaatatgtggtcttgaggccgacctggttcatgggtaagtttccaaaaaccacatcctgccggaggtttgctgagccccctcctagagaacctcctggaggatccacatgtcagctggatcaaaaaggaggataa

SEQ ID NO: 1130 - DNA, 288 bp, A.fumigatus
ggccgacctggttcatgggtaagtttccaaaaaccacatcctgccggaggtttgctgagccccctcctagagaacctcctggaggatccacatgtcagctggatcaaaaaggaggataagatctactccgctaccggggatggcaagatcccatttatctctgcggacgatattgcgcgagttgcgttctctgtactcacagaatggaagtcacaaagagctcaggagtattttgtcctaggcccagaggttttcagcccgacgggcgaaggaaccaagctaagcgta

SEQ ID NO: 1131 - DNA, 627 bp, A.fumigatus
gataatgcggtcaacagcttgaatgtaattcatgtcagcggcacgaaggggaaaggtagcacctgcgcttttacgcgcgccatccttcgagctcatggtatgaggacaggatttcccaagcgcattgggctctacactagtccacatctgcaatgcattcgtgaaagaatacaactcgacgaccatccagtccccgaagatttgtttaccaaatacttctttgaagtgtgggattgcgttatgcctgaggatatacagcaggattcaggagttgctaggcagcctcgatacctccagttcctggccctcttggccttccacactttcattagagaaggagtacaggcggcaatcttcgaggtccaccatggcggagagtacgatgttacaaacgtgatccagagtcccgttgcgaccggaatcacatcccttggagtggatcatgttgcacagcttggacctactatcgaggcaatcgcttggcataaagcgggaatattcaaacctggtgcacctgctttttctgtaaaccaaaaacccggccccgcagacgttatgcgcaagcgtgctcttgacaaaggcactacgttgacattcgtctcaactaattatatctcgccagggcgc

SEQ ID NO: 1132 - DNA, 420 bp, A.fumigatus
cttaatttgcctagtgtgaccgatgccgtcaacgatgacaactcagtcattgccctttccaacaataccatggagacgcttcagctattccgtggtgacacagtgttggtgaagggcaagaaacggaaggataccgttttgattgtgcttgctgatgatgacctggatgatggaagcgcccgcatcaaccgtgttgtgaggcacaatctgcgtgtcaagcacggtgacatcatcaccgttcacccttgcccagatatcaaatatgtaggcttgcctttatgtatcctctcaaatgaaaatggaaaactaacccttcatctctctgcaggccaagcggattgccgtccttcccattgcaaacaccgtataaggtctgactggatcccttttcgacgtctacctcgccccatacttccgtga

SEQ ID NO: 1133 - DNA, 192 bp, A.fumigatus
aggcaagcctacatatttgatatctgggcaagggtgaacggtgatgatgtcaccgtgcttgacacgcagattgtgcctcacaacacggttgatgcgggcgcttccatcatccaggtcatcatcagcaagcacaatcaaaacggtatccttccgtttcttgcccttcaccaacactgtgtcaccacggaatag

SEQ ID NO: 1134 - DNA, 294 bp, A.fumigatus
aatacaaaattattcctagcgcgctgccctctccacgtggtgaaggaggtcgagctcatcggccattttgatcatatcgtctctatcataattggcaacgccaacggtacgtgccaacccactgttgacgcagtttgcaagaccctgcgcgacagtcgatatcatgctaaggtgaattggtccatggacaaggtacacatccacatgttcaaggccaagcctttccaacgagcttctgagttcgttttccagaccgtgcgattggagaaagacgtttgtcgggtctggccatga

SEQ ID NO: 1135 - DNA, 717 bp, A.fumigatus
ttacgcaaaatgtcagttgcaggaagccagcatgtcttgcagacagggctgcattctggtatgtccgctacagaagggccaatgcactcgccccacccgaatcccgttgaccccaagatgagtgaggagtcttatgtgctgcccagtgagatcataccagactcgagggcccgaatcacactgcggggaaaggcccacgatgttctagtgccttatatatgcatcggtgcctggtcctggggcgataaagccacgtggaaatacgatgcagaacgtgaccttccgaggatccgagccgcttggtcgaagttgcgacaggtcgggttaacttttgttgacacggcccctgcgtatggcgacggagacagcgagcgtatctgtggccagctgttcaaggacatgaggcgggaggaattcatcatacagacaaagtggatgtcatggccagacccgacaaacgtctttctccaatcgcacggtctggaaaacgaactcagaagctcgttggaaaggcttggccttgaacatgtggatgtgtaccttgtccatggaccaattcaccttagcatgatatcgactgtcgcgcagggtcttgcaaactgcgtcaacagtgggttggcacgtaccgttggcgttgccaattatgatagagacgatatgatcaaaatggccgatgagctcgacctccttcaccacgtggagagggcagcgcgctag

SEQ ID NO: 1136 - DNA, 294 bp, A.fumigatus
tctcgcttatcttcggccctgcgtgaccataccggggcggcccatgtgactttgcccttggtgacaggggagacgtgggtcaaggttcccgagtccatcagcatccgacttgtgggtgtacctaagcctgggatcggtggaaaagacgttatcctatacatcttgcagcagttgaagaggaatactgtcgcttccgataggatcgtcgagttctctggtgccggcgtgcagtatttgtcggctgatgctcgatttgctatttgcaacatgacagcggtacgtcgatgcagttga

SEQ ID NO: 1137 - DNA, 588 bp, A.fumigatus
ttgatgaaggaactcggtggcatcaccgggatatttgtgcctgatcaaatcacgcgagccttcgtggccaacaggcgcttacaacgacacaagaatctcatcacgtacttccgacccgataacgatgcgcagtacgccgcagaactcgacattgatcttgcaaatgtgcaatccttttttgctcgatacccgagaccagatgatgtggttcctgtctcggattacgcaggaatgcagttggatggttgcttcattggagcttgcaccacaaccgaggaggacctcatccttgcagctcttgtgctagagcaaggactgaagaaaggctatcggccagttaaccatgggaagaggaagatggtacccggatcattgccaatcctgcatagactacgcgaattatgcctcaccggcgtcttcgaagcggcgggttttgagattggggtcccaggctgcagctattgtgttggcatgtcggcagatcaggcagtttcaggagaagtctggctgtcatcccagaaccggaattttgagaatcgcatgggtaaaggtttgcatgcgtgccgcctatccagattgtttagctga

SEQ ID NO: 1138 - DNA, 546 bp, A.fumigatus
tggcgaaatacttccccatggatgtccgagaccttcaagcttactcccaatgatcgtttcactatgctgagtggtatcgctcacgatcctattcagcgagatatcttcacaccactcttcctgggagcccagctgttggtcccggctcgtgaagatatccaaaacgagaaactggcggagtggatgcgcgagtatagcgctactgttacccatctgacacccgcaatgggccaaattctcgtcggcggtgcctctgcgcagttccctgctcttcatcacgctttcttcgtgggtgatattctgatcaagcgagactgccgttccctgcaggccttggctcctaatgtcaacattgtcaacatgtatggaactactgagactcagcgtgccgtcagttactatgaaatccccagctactctagccaggagggcttcttggatactatgaaggacgtcattcccgcgggtcgcggaatggtcgacgtgcagatgttggttgtaaaccggttcgatcctagccgcatctgcgccattggcgcagtttgt

SEQ ID NO: 1139 - DNA, 672 bp, A.fumigatus
atgcaggtaatgcactctgtcttctctggggaacgatgcttcctagcctcggaacgctggcatgcggtgatgcggcagcgcatcaactcattctactctgaagagctagaagatctgctagaggaattcatagctctattcacactggcaccgagccttgttcacgcgctctatgatatcaaagcatcagatatgacgagtcctgcaacctggaagaaggcgtccgaaaccttgaccaggattcttgagatgcagaacagactgttagaatggtacagccgtttttctcgaatcgcaccgcctgcgtgcgaaaggctgtcagcgaccaatgacgcagtctatcccaccgttctctattattcagatctgaatatcgcctcaatattcaattcctaccatgcgtacatggctatcatacacgaggccctacggacccttggttatcctggcgaacatggagctatggtcgcctttttccgagatcagatttgcaagtcagtggaatacaacggtgctggtccactagggccgtatcgaatgggatttccgctgcgtgtggcttacgaggtcgcagaccccaaaacaaaggcttggatagagaaccgcttggcgcatatgtcgcagtattatgcagctgtgcaacccaataattttgccacgcaatttgattaa

SEQ ID NO: 1140 - DNA, 207 bp, A.fumigatus
aaccacaacaactaccgtaagcgctggtatactgtcgccgtcgtcgatccctttcgctggcgcttcgcatcgtcaagcccattggtgctcctcgctccgttctctgtcgcccaggaacatccaatttccgtcattgtggttgtcgcggctactgagacaccagctacaaagcgtcacagatcgaacttgtcggtcagataccattaa

SEQ ID NO: 1141 - DNA, 456 bp, A.fumigatus
  unsure (179): Identity of nucleotide sequences at the above locations are unknown.
gtcacaaaggcatattctaccccaattcggatcgctgacttgaccagggtcctcgtgggagctccccgccgctctggacccatccccaactcttccgggacgcttgcagtaaacacgcagacatcctactccttcgactctcattcgaagaccaatgagatccgtgtattagacatcgntaccggccgatccgccctcatcacgaacgatccgggagccagcagtccacaatggctggagaacagcgaccagctggtgtggctgaagaccaaagcaaatggaaacaccagcttcattgtcggagatgcgcgggaggtcgacaagacatacactgcgggcactgtgccaggacctgtgtccgacctcaaggtgactgttgtcgaaccgggcaaaattgatttgcagtggtgggaaggccccccggactcttctccacatggctggcagccgcaatag

SEQ ID NO: 1142 - DNA, 588 bp, A.fumigatus
tactggtatgctaccaccgtatggaactgtcacagtttgactaacttcttagtgaccttctcttacacaacggcgttctggtcatgggaagactgggagcttcagttggattggatggctctacgaggcattaacttgccccttgcttgggttggccaggaaaagatcttggttgaggtcttccgtgagatcggtttgacggacgctgagatctcgtcttttctgagcgggccagcattccaagcctggaatcgattcggtaatattcagggttcctggggtggtgaactgccatattcctggattgactctcaattcgaactacagaagaagatcgtccgccgcatggtcgaactgggcatgaccccggttttgcctgcgtttacagggtttgtgcctcgagcggtcagccgtgtccttccaaatgcaacagtggtgaatggttcacgatgggaagaatttgatgaacgatatactagcgacaccttcctggagccattcgaccccagcttcatgcgcctccagcgtagctttatcaagaaacagcagcaagcgttcttcaccacgcggctggaaggaacagacact

SEQ ID NO: 1143 - DNA, 204 bp, A.fumigatus
cagccactcgcggatccttccagccccgtggtgaagacgatatacaagactgacattttcttttccaccgctgtttataaagctactccatggataatccaggaaaccggagtctgccctccgaagtccgcacctgcagcatggatccttggaggtattgcttatagcggagtctctccgaaatccggcctctcctcagaatga

SEQ ID NO: 1144 - DNA, 585 bp, A.fumigatus
agagcatgcggtgtggcatcatcgacaaccgaaacgccgctcttccaagtttgcttcaattaccgcatgggagctggccgcaccgcagcgctgcaaggagtcgagatgaaattcttggactatgttgacgctcagaacccatttgatctcgttgcgactgtcgatgacttagacgacggaactgccatgattaccctctatctacaagattacttgtacgaccaggagggtgctcaactactcgccaccatgtacgcgaacgtgctgcaagtactggcagagaacccagagagattagttggctctgtgtcgatttccaacgctacgttggaggacgagggtgtcaaactaggcaccgggcccatcttggaccttgtagctccgtctactcccactttgtcaaagattttccacacatgggtagacaaggacccccacgctctcgctgtcaaggacactaccggcaagtcgaagacatacgtgcagctcgcagaaagggccaacgccattgccgcgtcgctgctgaacgccggcgcgccgccttccgtctttaccaagggcagcggcatccgagtagcaatcgcc

SEQ ID NO: 1145 - DNA, 186 bp, A.fumigatus
tcgaactgcttgtggaaccgggtcccggccgaggtggatgggaccccgcagaatccgcaccggtttaatctgttgcaccccgactttcctaccgatatgggggtgcatctctacccgctcaagactaatggcagagatgtggagctccagagctacgatcgcaccaagaaggccagagcgagctag

SEQ ID NO: 1146 - DNA, 411 bp, A.fumigatus
gctgggacacaagagggtccccagactaccgacttccagttccaaatttcgagcggaggttacgagcctttccggagatgcttccccacgggcatgttccgttctccgcaaaataaaaacttcgactgtggagcacgagaaagggagaaatcacatttggctcacccacccaggcgaaagaatcttgcccaatgttcgaatgcgcctgtccatggtgctatcatggtccaactcccactaacacagactagtgccgacagtcccgctgcgtgttacctcctggctcctgtaaatattgctcttctagccagagtaccagggacaatggcagttcgtctgttcaaacgtgtgggctactcactcaaaattctcccctacaactcaatgggctcaaccggcccagctctctaa

SEQ ID NO: 1147 - DNA, 240 bp, A.fumigatus
gatcttgtaaccgatccccgagccgtttgtgactgcacgacaggagggctgacgggaattagctaccggggaagccgtgcggtcgacctcagggccgtcttctggaactacgagagcaacaagttcctcagcgacaaggggacgatcctctccgatcacaatcccatcacgaccaacttcacctggaccttgtccaatgccttccgccagagtgacatcttcggtggcccacacgggtaa

SEQ ID NO: 1148 - DNA, 369 bp, A.fumigatus
acaagatttttacgatctgcacgcggacgccgggtatttctttcctgccttcgtccgttctgtagcaaagctgacttgcacagatccaaagacgacgatgtcaaggctcgcagcgccaatctgcagcagctggccgattacatcaaggtcaactcggccggcaatgcggtgctggtgtttggcgacaccaatgcacggtatacaaggactggcgacaatatccgtgtcttccagacgcagaatggcatggtcaacccgtgggtggagctgattctccagggagccgcgccggccgaggggagcaatgccttgctctgccggaatcctagcacaaccagtgactgtgaaacggtcgataagatcttgtaa

SEQ ID NO: 1149 - DNA, 249 bp, A.fumigatus
cctggatgcagaggacaaggcaccgaccgtcccgacactctctcgttcgacgactcagacaacgcttccaccgtatacttcacgcccaggaaccgcggcaccggagcggaacccaactcttcctactctccccgacgtatcgtggacggagaaaccggccatgagccgaacggtgacacaatcatcggcgcattcggaatcaacatcgtactctggggctacggccgtctccggctacagccctcttga

SEQ ID NO: 1150 - DNA, 183 bp, A.fumigatus
tcgcgggtccttacctgcgccgcctgttcctcctgtccctaccaacgtgccgatgcccggagcacgttcttacacgcccatatcacggccgccgacaacccggccaacacgtacaccggcgccgccgtccgcgaccaacgcatcaagccgtatgccgacgacgatgcaccagggcgactatga

SEQ ID NO: 1151 - DNA, 1080 bp, A.fumigatus
tccccgccattgcggcgcgcggagcctttcagccccgtggtgaagaggcacttggatcgcgcgccgactcaaccacacctggcccttgaccggaaaccgaccctccctatggtggctgacctggatgcagaggacaaggcaccgaccgtcccgacactctctcgttcgacgactcagacaacgcttccaccgtatacttcacgcccaggaaccgcggcaccggagcggaacccaactcttcctactctccccgacgtatcgtggacggagaaaccggccatgagccgaacggtgacacaatcatcggcgcattcggaatcaacatcgtactctggggctacggccgtctccggctacagccctcttgatcgcgggtccttacctgcgccgcctgttcctcctgtccctaccaacgtgccgatgcccggagcacgttcttacacgcccatatcacggccgccgacaacccggccaacacgtacaccggcgccgccgtccgcgaccaacgcatcaagccgtatgccgacgacgatgcaccagggcgactatgaggaagcgccacgccgatatcccgatccctacagtactgatgcaccttacgatgaaaactatggtgcgcatccatcgtatagtgcagcccctgatccttactcccgttccgtgacgcgtggaattgctgtctcgcctggcgaggactatccaactcggacgctatctcctcagagtcacagaggaacaccccagccatcatcatccgacccaccaacgagctatcccgtacgagcatacactccaggtaacgctgggacggctcgacctccgctggccgttgatgcagctgcaagttacgccgaaagaacatacaccccagtctctcagagagccacaccccgaccgcagcagcagagctcacagcagcaaggaggttatgttgcatttgatccttcctcgatgggcccgagccaaccgagtgccggcattcgacccacacattctccggtttatcatgcgtatagcggaccgagcagtgctacgtcgcccaacgggcctagcaaccgaggaccgcctgtacgggcctac

SEQ ID NO: 1152 - DNA, 276 bp, A.fumigatus
cgcgtatccttccagccccgtggtgaagacattttctctgcactgaaataccttgtgctgattgaaagcgcctttaccctcaactttgccgcctgttttgcctacagaggggtccccgctatcctgcctgctatcttgcgacaagggacaactgttgtgcagcagttacgaccagtcctttacccgaatatttttgcgatccttgatatagattgcatgggaactgggatattgaacaaagtccaagctttgggcctggtgttgcaggaaacgtga

SEQ ID NO: 1153 - DNA, 222 bp, A.fumigatus
gataatggaaaactagaataccacataccagcgcagtatgatacagaccgacctggctttaactacaccgtcgttaagcactctatgggcatcaacaagcatcctttagctgctagtttcccccaagcaactggccagccatcactgcttggcgacccagcagatctcgcatctgtatgtctgtgtcttacaccacgcggctggaaggtccgcagcttgcgt

SEQ ID NO: 1154 - DNA, 249 bp, A.fumigatus
ttctctaacagaatctccggaaagatgaccgctgcgctcacaatctactccgcaaccttcatgcgttacgccctcgctgtctctcccaagaactatctcctcttcgcctgccatttcatcaactgctccgctcagatgactcaaggataccggtacctgagctactggaagtatgttctctactcgcctcctccacattgccgtcccctgtgccttcttcttctctcaacacaactatggaatgtgtaa

SEQ ID NO: 1155 - DNA, 342 bp, A.fumigatus
gctgagtcggttggctccaacctggatacatcctcttcagcagttcgtgtggaaaagttcggccttcgtctggacatcgaccccgaattgcttttgtttggtccgtctttcatcaatgacacaatatcctgcaccttatcacagtggggtccccaccccttctataacagactagtcgcggccaagatcacaacagaacggtgtttcaacaatgaagccttaaccaaagatagaatggcaacatgttattattataaagcgttatacttgatcaaaagcattagtgcgttcaaaattcagaaaaccggccaaatcgagttcggaatgaaacaattgacttga

SEQ ID NO: 1156 - DNA, 549 bp, A.fumigatus
cacatagacttccggcgcgtcgttaagacagttcgtcagtggcggcatagagctctccaactcttgtcgtccgaaccacccgagaatttggtatcacctccgactctcaagagcgcatcgccgctccaatcgatcaaggacttgttggaaccgcctgggtcacaggccgaaccaatcagcatcaaagtcgacgtaacatctccaaaagagtctcatccgcccggtgccccaaatttcaccgccgaacgcaagtctcccgttctttcacccctgaaaaagtttgcaatatcaccttcggatggaccagtccaagccttgcttccggcactccagacgtctcctccattagcaactgccaaatcgccagagaaccaccaacagcatagcctgccgtcgatacagactgctttggctgagatctcggggccttattctcttcctccagtctcgacatcccctccttcaataccgaggaatgaatcagcgtgggatcatcaacgccccggacagtttgctccgccacaggttccccctagtccttactcacat

SEQ ID NO: 1157 - DNA, 486 bp, A.fumigatus
taccagaaaatccgacaatcatggagcaaatataatttgttcaacctgagtcgatttcgcgcccctccgaccgcaaaccgcaccttcttccaacagaaatggactgccaagtccgttgcccgagcataccatggcgaacaggtccgtgaaagccaatggtctcggatgttcacccgccgcatccgcagcgtcgtacccatgagcccagagaaattggctagtgatgatggttctgcaatgtccgccggtcgaggagcgggcctggaatccgaagcgagcggcgatggcacagctggggcccaggaccagacctccttgacaccctatacacagatgacttttgctcctctcgagcgtcggctggatgttgccatcttccgggcgatgttcgccagcagtactcggcaggcccggcagtttgttgtacatggtgcggtgacggttaatggcaagaagctctgcttctttggccttgtagtacgacgc

SEQ ID NO: 1158 - DNA, 204 bp, A.fumigatus
atggcttgctcccagcctcacattgaggtgggggcctccggtttccggacatcttccaaggtccaaaactttgatgttcaagggttcctgaacttcttcgtgcctacaggtggagcccgagggaacattcttttcaagctcttagtgcaatcgccgagactctggctgtttgactatcgcgggctcaaaatttggaggcgctga

SEQ ID NO: 1159 - DNA, 252 bp, A.fumigatus
tacacgagaagatggatcaagacgtctaactcaattttcgacttcgtaatctgtgcagcctcaatcattattgaggcgtccacctaccgtgcagatttcagagtgagtgaggcttaccatggtaacaatattaaaataacaattatgcagcttcctctggtgggtgataattggaatgggtcttggctagactgttgtttatcagtcctaggcacttgtcagtgtctcgacgagatctgtccttttgcctcg

SEQ ID NO: 1160 - DNA, 1203 bp, A.fumigatus
ttgggccaagcggtcccccctcttccaagaaggcaaagaagaagggttatttccaacaaaagccccgccggggccgttctgccaatgggacctcgggcaaagcgggcaagggcaatgttgactttcaccaacccacgcggctttggattgggttcgtcgttcacattaaccgctcaatggacctcgggggtggactccttcaaatccgacttgtgcgagcgcatcccctacaaaaacatccagtaccacgacggctccgaccctatccgcatgcacaactactacactctcctcttcagcaaactcgtgtacgaacccatgaccggccgatacggcccttccaactctctcctcttcgcccgctcatccgccccaggcggccaagcttactccgtccactgggacggcgactgcgaatccacctatgaagccatggccgagtccctccgcggcggcctctccctcatgctctcggggtatatcttctgggcctcggacatcggcggtttcgagggaaccccacccccagctctctacaagcgctgggtccagttcgggcttctatcctcgcactcccgcctccacgggtcctcctccttccgcatcccctggatctacggcgaagacgcctgcaccgtcctccgcgactgcgtcaaacgcaagatcctcctcaccccctacctcctcctcgaggcgctgcgcggccaccgccaaggcgttccgctcatgagacccatgttcctcgagttccccgacgacctcaacacctacccgctcgacacgcagtacatgttcggcgcgaacctgctcgtcgcaccggtgttctcggaggatgggtcagtcacgttctatgtgccccggacgccggaggacgcgtgcggtaagtggcgctcgtggtttgatcatgccaagacgtacgagtctggtcagtggtataccgagacgcatggctttgataccctgccgatccttgttcggccgggctcggtgacgcctgttaatcccaagtttaatgtgcccgagggtgatgccctggatggactggagttgctcgtcaacggtactttggcggcggatgtggacgtcgaggtggtataccccattaagacgtacgcgacgctcaggactgtccgtgtctcgcccagtggcgataccgtgactgttgccgatgctaatattaaggtggtctgcattcaccaatag

SEQ ID NO: 1161 - DNA, 408 bp, A.fumigatus
ccggccgatacggcccttccaactctctcctcttcgcccgctcatccgccccaggcggccaagcttactccgtccactgggacggcgactgcgaatccacctatgaagccatggccgagtccctccgcggcggcctctccctcatgctctcggggtatatcttctgggcctcggacatcggcggtttcgagggaaccccacccccagctctctacaagcgctgggtccagttcgggcttctatcctcgcactcccgcctccacgggtcctcctccttccgcatcccctggatctacggcgaagacgcctgcaccgtcctccgcgactgcgtcaaacgcaagatcctcctcaccccctacctcctcctcgaggcgctgcgcggccaccgccaaggcgttccgctcatga

SEQ ID NO: 1162 - DNA, 198 bp, A.fumigatus
aagcccgaactggacccagcgcttgtagagagctgggggtggggttccctcgaaaccgccgatgtccgaggcccagaagatataccccgagagcatgagggagaggccgccgcggagggactcggccatggcttcataggtggattcgcagtcgccgtcccagtggacggagtaagcttggccgcctggggcggatga

SEQ ID NO: 1163 - DNA, 546 bp, A.fumigatus
ttgttcttctcgttgtatattcaactgacacttgcaggttcgcctctaaaccgtctctcattcttgcgctctgaacatccgttcctctcggccgcccttaagcacccgtctactcgctttgtactgttgaaagaccttgcgcctctcaccaagagtccttctgaactctattacgcaaagtatgacgaagtacggaaacttgtgcccgagaacttcttcgacaagtccgaggaggagatgatcaagcagtttgactcgcgaaagacaagtgctcagctcatcttcctggggctggatgaaacgcggaaacaggatggtctggcttggaaaatctacaccggagccccctattttgctttggatgtaacgccgaaaggttcagaggagcagcaggccaacgcaaaggacatcatcagcacagtggtggctaaaggcctcagcttataccagtcgagagtggtgatgactttcatcggcggacgagggtatgtgaactgtagacaacgacaacaggttttcacccgacggccaggacccagcaggtag

SEQ ID NO: 1164 - DNA, 351 bp, A.fumigatus
  unsure (155),(266),(276),(284),(287): Identity of nucleotide sequences at the above locations are unknown.
ctaatgtcgcgactgtcccggttatttgacaagtctaaacagactctacccgttacctcggcaagcccagacggccctgcctggactgaggtcggcaatgccgccgatcaccttccagcagagcttgaatctctctactggactggggtcaacanagagctggactgtattgtttctactctacgacgatggcaagcaccccatttccagcacattcaacccgacgcagacaatacactggtcaacggcttcgacaccttcgtcgncgatgttgtnccgcagtncgngcagacaccctctcagctaccattccaagtattcactgagctcaccgttaaaggcgtttggtga

SEQ ID NO: 1165 - DNA, 576 bp, A.fumigatus
ctctctctgacgacgcacctggcgcttttgtcgacgcgactgcccaaactgaaatccaagggcgaagaggacccgttcttcgacgatgattggaacgtagcggaatatctctaccctcgtcagagctctgggaatgctaccacaccctcaccttcacagttcgttcgacctccagtgacgctgctggtcatctctgtggccgataacatcatcttcgatcccagcagggaggagattgccgttgcagataccgtcttggccctttcagtcagccgcgatggcgagactggtagtctgaaattgatctctatgagaacaattgaccctccatctcgtctgacacagccgggtgtgccgaattcggagaatgtcactacgatagggtcttcggctgctgcagaggatgctgctatcctgagcccttccaccggcgaggaggaagttcctggagtctggaagcctcgacgtggcggggttaaaagaagtacgatcgcgcgcatggtgaaagcggtgctggagaaaggtggtgtcggcgaggatgtactagagggactagagggagtttccgtcggttga

SEQ ID NO: 1166 - DNA, 783 bp, A.fumigatus
ggacttgatacttccagcgccgcgtgtaagatcgattcttctgcacgattaccgccaggcaaccgatcgcggcccactccacctccagcacaatcctcaaagccacctgcaccatcaacatctcttcctgttcggccaaaggctcctgcccgaattgttccacaattgtcacaggaaagtctgatatcgactcaccggcatcgtgagaaaggtacagaggcatacaaaagaggtgactatgccgcagctcacgatgccttcacctctgccctcactatgctccctgataagcatcccatcagtatcgtcattcgcagcaaccgtgcaatgacagccttgaaggtcggggagccgaaagtggccatcagtgatgcggacgccatcctggagctgatcggcccttcaaagggagaagccgagaccattgatctcgctaacggtgaagcggcaaagtcaatgaaagatttctatggcaaagccttgatgcgcaaggccgaagctttggagcaattggaacgctgggctgatgccgctcaggtatggagacaggcggtcgagaacggccatggtggaagtactagtatccaaggccggaacagatgcgaaaaagccgctggtatcagcaaacccgcacagaaacctcctgcgccggcgaagcggccgccagcacccgctccgaagaaaccgtcggctctggacgacctccaaggtggctcgctgtcgacgggcggatcctccgaggctgtcagccgtttgcgagcggccaaccaggcagccgagcgc

SEQ ID NO: 1167 - DNA, 474 bp, A.fumigatus
ttgaccagactttcgcgaacttcttctcaaatttggaagaggaatttggcctacacgaagctccatcaagctgtcttgaacgaacaagtagatgaggtgaaagccttgctaagccgaggggcaccaattgatgtcccagatcggaaggggaacttaccagtgcattacactgctggacaccaggacgagaagattgccaaatttctactcggctatcgtgtgggaaaaatcgagcccttggtaaagcaagatcttgctcgactcacgcttgaccatcgtaatacggacgggaatacccctatgcatctggccatttcagcaagaagcttaaactatgaccatcaaaagagcattgtgacccatcttctgggggccgggggcaacccttatatccccaacaaccttggagtgactccgatacaaaaggctgtggaactcgtgttcccgaacaatgaactgggattatggacatca

SEQ ID NO: 1168 - DNA, 780 bp, A.fumigatus
  unsure (711): Identity of nucleotide sequences at the above locations are unknown.
tctcagagaacctcttccaacgcatctactctcacaacctcttttgggatggacggtgccgctgtcacatcgctcgtactcggtgatgaagacatgccgaccgagcaggcccaggtcccacatgatttttctgagaacaaggggcatgccgccaacaccattggagaagacgagcgccttgaagagcctccaagggaactacctaccgctcaagccacccaacagagcaacctcgttggcttggcccgtaccagttcaccgcttaaacgcgttcacgacgataaccaaagccgaatttcggcgtggaataactttcatgcagtggctgcaagagacgaagcagcggaaaatgctcgtcgcttggaagaatcacaagataactcagcctcacaactgccccatagtcttacctggcgcaagataagcgtcgacgaggatgatccggtgcgaaaggtcacgacagttgagaaacctgctgacgagaacgaatcggaaaccaagaagcagaagacaggccatgccgtgagcgctacaaagaattccgacgagatcccgctcgacctcgatagtgattccgatcagggaatatctacgacggctgagacccagggagcaactcagaagcagaacgcagttgttacccaacctgccgccccagatgttactggtgaatcaaagctttcaggcaccacccaacaggacaagcctcangttagaagtctagactctcaagacgttcgtaatctccttcccaccagcttctctcaacccgaaagtttt

SEQ ID NO: 1169 - DNA, 858 bp, A.fumigatus
tttcattccagccgtctcctgcttgaatcagcgatctctactgcaatgatatactcgctgcgaatcctgcagtggctttgcatcactgcagggcttgacctgctcgtgccatccttggctgcagatacaagtgcatggaagtccaggtctatctatcagacgatgacagacagatttgcacgtacggatgggtccaccactcatccatgcaacaccacagaagggctacgctgtggtggctcatggagaggtacaatccaacacctcgattacattcaaggaatgggattcgacgctatcatgatctccccaatcgtccagaatgtcgaggggcgcgtgcagtacggagaggcctatcatggctactgggtccaggacatgtatgcgctaaacccacactttggcactcaccaggacctgttagacttgagtaaggctgttcatgatcggggcatgtatctgatggtagatactgtcatcaacaacttggcgtacatcaccgacggacgaaacccggccacgagcattgactattcagcgctcagaccattcaatgactcaatgttctttcatccatattgcaagatcaccgactatgacaactatccattggcgcaaacatgctggacaggtgatgatgttgttccccttccagatctaaagacagaagatagccaagttcagagcatgctcatggactggattagaaaaatgatggctacgtattcaatcgatggcctacgtctggatgctgcgaagcatattacaccaatttcttgcctttgttccaaaacgcttctggcgctcttattactggagaagtcttcacgccggggctggaaggaaccgcgctgcggg

SEQ ID NO: 1170 - DNA, 396 bp, A.fumigatus
  unsure (380),(381): Identity of nucleotide sequences at the above locations are unknown.
gactcgtcatcgcgcttccgcttcttgccagccgctaggagcgatatttcgctgtcactttcgctttcgtcatcgctacccaggaactccttcagctcgtcgtgcactgcagcttgctcttcagcgtcatacccaatgggggacatctcgttgagtccggagaatttcagaatctcttcgttgaattgcgacccctcatcgtcatccgtccagaatccaccagtttcatcgtctgatgacgacagccagccgctttcaagctcttttgacccaggcgaaattggctcgccccgatcatccggatgcacaggaagcaggtacggttcctcctccaaccgtttccagtcttacaccagccgggatcgaagcacaagcgtacnncaatcccgggcccca

SEQ ID NO: 1171 - DNA, 627 bp, A.fumigatus
gactggaaacggttggaggaggaaccgtacctgcttcctgtgcatccggatgatcggggcgagccaatttcgcctgggtcaaaagagcttgaaagcggctggctgtcgtcatcagacgatgaaactggtggattctggacggatgacgatgaggggtcgcaattcaacgaagagattctgaaattctccggactcaacgagatgtcccccattgggtatgacgctgaagagcaagctgcagtgcacgacgagctgaaggagttcctgggtagcgatgacgaaagcgaaagtgacagcgaaatatcgctcctagcggctggcaagaagcggaagcgcgatgacgagtctcaaggcacagatgaagacgagtcggacggtggtcaaggcgaagagggagagatggagggctcgcgcctgtcgcagcggatcaaacggtcctatgagcgtactacggggcttaaagaggttgcaacggctgataccacaagcacagcggaattaacacacactagcttgccaaaggaacgtagtggtggagagacggatgacgcgttgaacgatttgaacgagtcagaggagcccgcggtccttcacctcggagtgcacgtgcccgacatatttaaggga

SEQ ID NO: 1172 - DNA, 249 bp, A.fumigatus
ttggtggcaaaactagacaaaggcaacattgcagctcattcccggctaaacccagagaggcgagaccataacggcgcatattggattggttcctcatccctgagtcttgttctagttagcgcggccatatgtcttgcttctagtctcacacctacaatgtcaattatagtgatgtttcagtggtattttctgctgataactaacctgaggacctacgttctagatggggcggcgacactcgattgctga

SEQ ID NO: 1173 - DNA, 348 bp, A.fumigatus
agcaggacctgcgcgcactcatacaggccatcgagatatattggagagcctgctgaccaaacacttcggacaccggactttatccaccatactgacggctatccatgctatgacgatgcagcgcccaaaatcaagcagtactgtcccagatttgaggcagactttaaccacatacccatctccgagagttcacttataatccgtggcatccaagcattggttgcaatggctactcaagagcacaagaaaacccttggccacgccgtgaagctgcattctatcgttgctgatattcatgtcgatatcatgaccatgatcgttgtcttgatcggccgccgccatcattag

SEQ ID NO: 1174 - DNA, 486 bp, A.fumigatus
gcccctgaggaaccaaaaaagccggccctcccggaaattgttaaaaagttctcgcggcgcacggtgcgtgtcacaagagagcacaatgccgaatgcaaaaaactgttgaagttgatgggtatcccgtacatcgacgctccgactgaggcagaggcccagtgtgctgtgcttgcgcgggcagggaaggtctatgccgctgcttccgaggatatggacacgttatgtttcgaagcgccaattcttctcaggcatcttacgttcagcgagcagagaaaggaacccattcaagagatccatctgaatcgtgctctagagggactcggcatggatcgcaagcaggtaggcgactggcttctccccagaatcccttcatggatacgatcttctcatgcttacacccggctgcacagtttattgatctatgcattcttctcggctgtgactatctggaacctatcccaaaggtcgggccaaacaccgctttga

SEQ ID NO: 1175 - DNA, 690 bp, A.fumigatus
ggcagaggcccagtgtgctgtgcttgcgcgggcagggaaggtctatgccgctgcttccgaggatatggacacgttatgtttcgaagcgccaattcttctcaggcatcttacgttcagcgagcagagaaaggaacccattcaagagatccatctgaatcgtgctctagagggactcggcatggatcgcaagcaggtaggcgactggcttctccccagaatcccttcatggatacgatcttctcatgcttacacccggctgcacagtttattgatctatgcattcttctcggctgtgactatctggaacctatcccaaaggtcgggccaaacaccgctttgaaactcatccgggaacacggaagcttggagaaggtggtcgaggcgatcgagaacgacccgaagaagaaatacgtcataccagaatattggccctatcaggatgcgagggaattgttcctccatccagatgtgcgagaagctgatcatcccgagtgtgacttcaaatgggaggcgccagatgttgaggctctggtggagttcctggtcaaggataaaggtttcaacgaggatcgggtccgcaacggagctgcgcgcctgcagaagaatctcaaaacagctcagcaatcacggcttgagggcttcttcaagccggtcgcgtcttcaccacggggctggaaggagccgctccat

SEQ ID NO: 1176 - DNA, 486 bp, A.fumigatus
atcagaatgccacgcaaggcaattgattcgcgcattcccgcgctcattcggaacaatgtacaagaaaagaagagaagcttcttcgtggtggtcggcgaccgcgccaaggatgtgattgtcaacctgcattacattatgtccagcgtcgatgtcaagcagaataaatcggtcctctgggcatacaagaaagacctcctcggattcacaagccatcggaagaagcgagaagcgaagatcaagaaggaaatcaagcgaggaatcagagaacctaaccaggaggaccccttcgagctttttatcaccctcaaccagatccgatatgtgtactacaaagagacggagaagattttgggtaatacctacggaatgtgcattctacaagatttcgaagctatcacgccgaacctgcttgcccgtaccattgagaccgtcgaacgaggtggtatcgtgttgcttctgctcaagggaatgaagagcttgaagcag

SEQ ID NO: 1177 - DNA, 234 bp, A.fumigatus
aagacgaacggtttcagcctgaaccctgtcgttctctctcccaaggccaccgttggagaggctaaggcgctcaaggccaaatggggcttcggaggcttccccgtaacaggtaagcacacaatcttgctttctctcagctgtcacccctacatgatgattctccaacctatctcttataactttcgttccagtggagcaacgagagttgcgatgtacaaaaactattttatctga

SEQ ID NO: 1178 - DNA, 699 bp, A.fumigatus
  unsure (342): Identity of nucleotide sequences at the above locations are unknown.
tttacctccgtcacaatcactgttcgcaagccattgtctaatctgtgttttgtgacagaaaacggaacactccgctccaagctcgtcggtatggtcacatccatacatatccagttccacaccaacctcgatgatccggtcactgcaattatgtccaccgaccttgtcaccgcacctgccggtaccactcttgccgaggccaacgatgttcttcgtagctccaagataggaaaactccccatcgttgatgcagacggaaaccttgtctctttgctgtctcgcagtgacctgatgaagaacctccactacccattggcatctaagcttcccgattcgaagcanctgatctgtgctgctgcgattggtactcgtgaagaggataagcacagactcaagcttctcgtcgaagctggtcttgatattgtcgtcctcgacagcagccagtgtaacagcatctaccaaatcgagatgatcaagtgggtgaagaagacattccccgaaatcgacgtcattgccggcaaccttgtcactcgggaacaggccgcagctctgattgctgccggtgccgatggcctggaaaattggcttgggctctggcattcccctgccattcccccaaaaattcttggttttcggtcctcccgaggccgttgccgttcgcaagttgtttccttggctgctcaatccggtgtcctctga

SEQ ID NO: 1179 - DNA, 738 bp, A.fumigatus
  unsure (370): Identity of nucleotide sequences at the above locations are unknown.
cccctcggggaatcagaggacaccggattgagcagccaaggaaacaacttgcgaacggcaacggcctcgggaggaccgaaaaccaagaatttttgggggaatggcaggggaatgccagagcccaagccaattttccaggccatcggcaccggcagcaatcagagctgcggcctgttcccgagtgacaaggttgccggcaatgacgtcgatttcggggaatgtcttcttcacccacttgatcatctcgatttggtagatgctgttacactggctgctgtcgaggacgacaatatcaagaccagcttcgacgagaagcttgagtctgtgcttatcctcttcacgagtaccaatcgcagcagcacagatcagntgcttcgaatcgggaagcttagatgccaatgggtagtggaggttcttcatcaggtcactgcgagacagcaaagagacaaggtttccgtctgcatcaacgatggggagttttcctatcttggagctacgaagaacatcgttggcctcggcaagagtggtaccggcaggtgcggtgacaaggtcggtggacataattgcagtgaccggatcatcgaggttggtgtggaactggatatgtatggatgtgaccataccgacgagcttggagcggagtgttccgttttctgtcacaaaacacagattagacaatggcttgcgaacagtgattgtgacggaggtaaatcattatgcgttgtcgatttcagataa

SEQ ID NO: 1180 - DNA, 264 bp, A.fumigatus
cactccccgcatcacagcaagctcgacgaccatcttcgctctttagactctcaaatccacaagtctagcctaatatctgctttgcatctgtcatcggacaaaatggagcggccgaacaagccctcagccattggtgtggctgcatcactaccccagcccaccatcaccttccgccaaaacaagatcgaggccaccttgcccaccggcgagtcagtcaccgttcacttatatggagcaactgtcacctcggtcttcaccacgggg

SEQ ID NO: 1181 - DNA, 618 bp, A.fumigatus
ttccgcggatccttccagccccgtgtgaagaccgcggcttttgccaaggctgtccgtgccaacaagggttgcttgatcatggacaccacctggcgtgatgcccaccagtcgctgttggctactcgtgtccgcacgatcgatctgctgaacatcgccaaggaaaccagtcacgcgtacgccaacgcttacagtttggaatgctggggtggtgccactttcgatgtcgccatgcgcttcctctacgaggatccctgggaccgtctgcgcaagctgcgcaaggccgtgcccaacattcccttccagatgctgctccgcggtgccaacggggtcgcctactcgtctcttcccgacaacgccatttaccacttctgcaagcaggccaagaagtgcggtgtcgacatcttccgtgttttcgatgcgctcaacgacgtcgaccagctcgaggtcggtatcaaggctgtgcaggccgccgagggtgtcgtcgaggcgaccatctgctacagcggagacatgctgaaccccaagaagaagtacaacctcgagtactacctggaggagcgggaacacactgtaagactgatccctgacatcctaggggtatcggatttgaacatatga

SEQ ID NO: 1182 - DNA, 369 bp, A.fumigatus
acatcgccaaggaaaccagtcacgcgtacgccaacgcttacagtttggaatgctggggtggtgccactttcgatgtcgccatgcgcttcctctacgaggatccctgggaccgtctgcgcaagctgcgcaaggccgtgcccaacattcccttccagatgctgctccgcggtgccaacggggtcgcctactcgtctcttcccgacaacgccatttaccacttctgcaagcaggccaagaagtgcggtgtcgacatcttccgtgttttcgatgcgctcaacgacgtcgaccagctcgaggtcggtatcaaggctgtgcaggccgccgagggtgtcgtcgaggcgaccatctgctacagcggagacatgctga

SEQ ID NO: 1183 - DNA, 489 bp, A.fumigatus
tgcccaccagtcgctgttggctactcgtgtccgcacgatcgatctgctgaacatcgccaaggaaaccagtcacgcgtacgccaacgcttacagtttggaatgctggggtggtgccactttcgatgtcgccatgcgcttcctctacgaggatccctgggaccgtctgcgcaagctgcgcaaggccgtgcccaacattcccttccagatgctgctccgcggtgccaacggggtcgcctactcgtctcttcccgacaacgccatttaccacttctgcaagcaggccaagaagtgcggtgtcgacatcttccgtgttttcgatgcgctcaacgacgtcgaccagctcgaggtcggtatcaaggctgtgcaggccgccgagggtgtcgtcgaggcgaccatctgctacagcggagacatgctgaaccccaagaagaagtacaacctcgagtactacctggaggagcgggaacacactgtaagactgatccctga

SEQ ID NO: 1184 - DNA, 591 bp, A.fumigatus
gatgtcagggatcagtcttacagtgtgttcccgctcctccaggtagtactcgaggttgtacttcttcttggggttcagcatgtctccgctgtagcagatggtcgcctcgacgacaccctcggcggcctgcacagccttgataccgacctcgagctggtcgacgtcgttgagcgcatcgaaaacacggaagatgtcgacaccgcacttcttggcctgcttgcagaagtggtaaatggcgttgtcgggaagagacgagtaggcgaccccgttggcaccgcggagcagcatctggaagggaatgttgggcacggccttgcgcagcttgcgcagacggtcccagggatcctcgtagaggaagcgcatggcgacatcgaaagtggcaccaccccagcattccaaactgtaagcgttggcgtacgcgtgactggtttccttggcgatgttcagcagatcgatcgtgcggacacgagtagccaacagcgactggtgggcatcacgccaggtggtgtccatgatcaagcaacccttgttggcacggacagccttggcaaaagccgcggtcttcacacggggctggaaggatccgcggaa

SEQ ID NO: 1185 - DNA, 303 bp, A.fumigatus
gcgcatcgaaaacacggaagatgtcgacaccgcacttcttggcctgcttgcagaagtggtaaatggcgttgtcgggaagagacgagtaggcgaccccgttggcaccgcggagcagcatctggaagggaatgttgggcacggccttgcgcagcttgcgcagacggtcccagggatcctcgtagaggaagcgcatggcgacatcgaaagtggcaccaccccagcattccaaactgtaagcgttggcgtacgcgtgactggtttccttggcgatgttcagcagatcgatcgtgcggacacgagtag

SEQ ID NO: 1186 - DNA, 330 bp, A.fumigatus
gcggacctctctattacatcggttctgaagagaaagtttcatctatctggcgtcattttattgttcttcggtacaattcaaatcatggagtacgtttttggaaccctgagcctactgctcccagttttggatcttataagaaaagggaaaaggagtatcagagatatgaagcagttgctacagaatgagagcgatatggagaagctggtcttttcattgaaaaagctattggatgggcttaaaggagtgtcttttgatgaagatatccccgaattgcacaaagacctttacatctcactcgagaaaaaaatgtacgagtctatacgatga

SEQ ID NO: 1187 - DNA, 243 bp, A.fumigatus
gagttcgctgcccagatgaacctcaacctcggcaacggatggggtatcgtccgtactatcgtcgaccgtatccgcgccctcgacgctgaagaggaggaggacaaggtcaagaagtacgtcctcatcaaggaccccaaccgccctgtcatccgtctgtacagcgtgccccccaatactttcgaggaggacgacgaggccgccgaggagcaggaggagaaggccgaggacgagtctgaggagtag

SEQ ID NO: 1188 - DNA, 192 bp, A.fumigatus
attgtcattatcattgaattttgtacgttgtcatatcagaatattatcctccagctaaactatattaatcaagcttgttccaaaatcaactttaaccaacaccatacatttccagagttccgttcccaaacagctactcccaccacacaacataggcaaccagaccaggtatggaaactagcccattcatga

SEQ ID NO: 1189 - DNA, 480 bp, A.fumigatus
cattaccggcgtggatgcttctgctgggccgccacccatgcctcccgattcgaaccatccaagttccaactcattcactttcacccccccgggcaggggccccgcggcggccctggcgaaccactgaaccttggcgacgggcagatcatcgaggccagcgcgacagccaggctcctaggcgtcattcttgaccaacgcctcacctttgagtcacatctcaagcatgtggacaccgcagctacccggcgtctgcaggcaatcagcgcgctgggcggctctaaatggggcttgcgcctccgggagctgcggcatgtctacacagcctgtatcaccccaatcatgctatacgcggcctcagtatggtacgcgcctccggttcggggccggaagcgcctccacagccaacagacaaaggtgttaaatcagatccagcgccgggctgggaagctgatcgcgggagccttccgaacagttaagtag

SEQ ID NO: 1190 - DNA, 261 bp, A.fumigatus
ggcggttctgcgagtgaggagcactcttctctctctctgtggttgtattcctctgcctgcctgtctgagcttgacacccagcattgggcttgggcttcagtcattctagactccgaagcctgccacagcaaggtaagagatcagacctaccagtaccaagaggcggagaagaaccagcagatcccgttcccacggtgtatcggcccttctgccaaaagagacgcacggtcttctacccagaagatcctactcccatggtag

SEQ ID NO: 1191 - DNA, 183 bp, A.fumigatus
acttttagccgatccacatctttattattttttatttatattttaattattatttttatttattacaattatttttgcccctctctcgtcctcccttttttttttttttttttttttttttttttttttgggggggggggggtcctgcgtggtatcatttgctataatttccatttcctttga

SEQ ID NO: 1192 - DNA, 1107 bp, A.fumigatus
ctaaccattgttccacacccaaggcactccaaacctgatgctagcgaagggcagtggacgcatgatctgcacgagacggtcgcaggcgatgaacccaccaacaagccctctgccgtaccagaatccatgtcggactttgccccaaaacctgtccctacggcccctcgttctacgcccccgaacaggtctttctcgagcaccaccctgatcggcaatgtgcctgttgtagtgtttctgcagggcatggctcggcccatacctttccctgccgttccaaaaaagcaacacactcgtctccctcaacatcgtcccccattgcgtcgagacaagcccgttcgcatatcgttacctggacagtctcctagatacatattcccctcgacagagcgctcgttcatctttattccccgagcgctgatgccaaatcagcagggttaccgtggcaggggccggggtgggttttatggcggacgccgtccgagtttttatgcaggctccgtctacaccccaagcgtcaccgctagccgaagatcgtcgatgggaaagccagcttctcatgatggatacccctcgccggctgcgtccgtattgtcaagacatacggtggttacgaccgaaaatgggaagccaatcgtccgtctgcctccaccttccaggccattaggcggcgtgccaccagcagccgctgctactggtcccgcagccgttgttcccgcgtcactgccacaacctatgcctcaaccccagccccaacagccctcgtaccgcgagagccgtccggctcccattccaatgcatcagccgcgtcctcagaaagcggtttctgtcgccgatatagagactcctgcaagattctcctttaatgccccccaaccacagcaggaacaaccgttccaacaccaggttcctatgcctatcaatgggcccggctatggtgctgatgttcaatctgcccatgcagctgggacgccttcatcacacatacccgagcgagcaatccatgctcaacctttccagccatatggcttccaacaagcccagccattttatcctgccgcttatccccccggtcttcaccacggggctggaaggatccgcggtggtcta

SEQ ID NO: 1193 - DNA, 1122 bp, A.fumigatus
aacttatatacaatctatgacggccctcacggaactctagaaatggggcgtattcaacgccatcaaacacaacaaccctccaatcagcccggcagaaggcaacgtcaacacccacccactgaagataaagcccaactgcctccagttcaccgctcccagatcataattcatcagcgccaccccagtagccgcacccgtcaagcactgggtcgtcgacacgggcaaccccagcctggacgccaacaacaccgtgatggccgcgcccagctccgtcgcaaaccctctggtcggcgacatctgcgtgatcttgttacccagcgcccgcacgatattatacccgtagaaccagaaccccagacccagcagcaagcccgcaatcacaaggaaccacaccggcgtcggcgcctcggtatctaccgcgccagcacggtacgtcgcatacacggcggcccacggccccaccgcattcgccacgtcgttgctcccgtgcgcaatcgacatcatcatgggcgagaccacctggcagtaggtccagaagtgctcgacgcggtcgtcgtagcggcgcgcgcgcgagtggatgtcgcgcagcagggcggagtcgtgcgtgaccacgtcgcgggtgacgccctgcaggaggcagaacttgatccagccgagccatttccgggggtgtgtccaggggaggtcggcgaccgggtggaggaagcgttcgtgcgggccgaggtgtttcttgcggggtttgagctccggggtggattgggcggagtcggctgtgcgttcgatgtcgtgagtggactcgaggaatttggtgtcggtgggttgggattgttgcggttgctgctcggtggtgtggaggtgggctttcgcgccggcgaggacttcgccgtaggcgtcttcgtagtagtttgtgacgaatttgtcgccttggccggggaagtagagcgtgcatgtatccttgagaagccatgggccgagggggaggtggtagacgcggacgcgggcgtcctgcttgacgaggcggcggtggaagtatgggaggaagaagactactccgatgaagaggcagtcgaagaagacgcccaggatgatgccgaccgctttgccggcgccgaattcctctag

SEQ ID NO: 1194 - DNA, 543 bp, A.fumigatus
tcttcttcctcccatacttccaccgccgcctcgtcaagcaggacgcccgcgtccgcgtctaccacctccccctcggcccatggcttctcaaggatacatgcacgctctacttccccggccaaggcgacaaattcgtcacaaactactacgaagacgcctacggcgaagtcctcgccggcgcgaaagcccacctccacaccaccgagcagcaaccgcaacaatcccaacccaccgacaccaaattcctcgagtccactcacgacatcgaacgcacagccgactccgcccaatccaccccggagctcaaaccccgcaagaaacacctcggcccgcacgaacgcttcctccacccggtcgccgacctcccctggacacacccccggaaatggctcggctggatcaagttctgcctcctgcagggcgtcacccgcgacgtggtcacgcacgactccgccctgctgcgcgacatccactcgcgcgcgcgccgctacgacgaccgcgtcgagcacttctggacctactgccaggtggtctcgcccatga

SEQ ID NO: 1195 - DNA, 852 bp, A.fumigatus
cgcagcgacgagcgcaatcctagccctcttcatcgtcgtcgaagcccccaccgccccctccctagaggaattcggcgccggcaaagcggtcggcatcatcctgggcgtcttcttcgactgcctcttcatcggagtagtcttcttcctcccatacttccaccgccgcctcgtcaagcaggacgcccgcgtccgcgtctaccacctccccctcggcccatggcttctcaaggatacatgcacgctctacttccccggccaaggcgacaaattcgtcacaaactactacgaagacgcctacggcgaagtcctcgccggcgcgaaagcccacctccacaccaccgagcagcaaccgcaacaatcccaacccaccgacaccaaattcctcgagtccactcacgacatcgaacgcacagccgactccgcccaatccaccccggagctcaaaccccgcaagaaacacctcggcccgcacgaacgcttcctccacccggtcgccgacctcccctggacacacccccggaaatggctcggctggatcaagttctgcctcctgcagggcgtcacccgcgacgtggtcacgcacgactccgccctgctgcgcgacatccactcgcgcgcgcgccgctacgacgaccgcgtcgagcacttctggacctactgccaggtggtctcgcccatgatgatgtcgattgcgcacgggagcaacgacgtggcgaatgcggtggggccgtgggccgccgtgtatgcgacgtaccgtgctggcgcggtagataccgaggcgccgacgccggtgtggttccttgtgattgcgggcttgctgctgggtctggggttctggttctacgggtataa

SEQ ID NO: 1196 - DNA, 1149 bp, A.fumigatus
ctcgcagcgacgagcgcaatcctagccctcttcatcgtcgtcgaagcccccaccgccccctccctagaggaattcggcgccggcaaagcggtcggcatcatcctgggcgtcttcttcgactgcctcttcatcggagtagtcttcttcctcccatacttccaccgccgcctcgtcaagcaggacgcccgcgtccgcgtctaccacctccccctcggcccatggcttctcaaggatacatgcacgctctacttccccggccaaggcgacaaattcgtcacaaactactacgaagacgcctacggcgaagtcctcgccggcgcgaaagcccacctccacaccaccgagcagcaaccgcaacaatcccaacccaccgacaccaaattcctcgagtccactcacgacatcgaacgcacagccgactccgcccaatccaccccggagctcaaaccccgcaagaaacacctcggcccgcacgaacgcttcctccacccggtcgccgacctcccctggacacacccccggaaatggctcggctggatcaagttctgcctcctgcagggcgtcacccgcgacgtggtcacgcacgactccgccctgctgcgcgacatccactcgcgcgcgcgccgctacgacgaccgcgtcgagcacttctggacctactgccaggtggtctcgcccatgatgatgtcgattgcgcacgggagcaacgacgtggcgaatgcggtggggccgtgggccgccgtgtatgcgacgtaccgtgctggcgcggtagataccgaggcgccgacgccggtgtggttccttgtgattgcgggcttgctgctgggtctggggttctggttctacgggtataatatcgtgcgggcgctgggtaacaagatcacgcagatgtcgccgaccagagggtttgcgacggagctgggcgcggccatcacggtgttgttggcgtccaggctggggttgcccgtgtcgacgacccagtgcttgacgggtgcggctactggggtggcgctgatgaattatgatctgggagcggtgaactggaggcagttgggctttatcttcagtgggtgggtgttgacgttgccttctgccgggctgattggagggttgttgtgtttgatggcgttgaatacgccccatttctag

SEQ ID NO: 1197 - DNA, 300 bp, A.fumigatus
  unsure (118): Identity of nucleotide sequences at the above locations are unknown.
aaagtcaagcttcgctaccaagtgctacaacagcgtgagaactacgagcgctgggcagaatggaaagatgacatcgtccgccacgagcgtgagcaggatagattagccgctgcgaaanaggagagaatctcgcgtgaaggcgctcagaagcatgcgtctcggaactcggtatttggtgatttccccaagggtctagggcacggcatgatgggcgccgcttggcagatactgggcatgcaacatgctggtcacaaagcctttgaccagcctatcgagacttctctggcgccttcttattaa

SEQ ID NO: 1198 - DNA, 687 bp, A.fumigatus
attctgaggaatgaggagttgatcagggttgatcaggatgtgttggggttgcaggcgacgctggcgagccgagggttggaagttgatgtgttgacgaggagtttggaaggtggggatcggctgatcacggtcttgaataggggagatggggtcgcggtggttagtgtgccggttgagtggatggggttgcagagaggttgtccgtatgtggttaaaaacctgtgggatggggaggtgcaggtgctggaggaggagatagtgatcaggctgaactcgcatgctacgcaagtgtaccggatcgctttgccggatgagtgctctaccgtcattcctactgggatcgtgttcaatacggcatcggggaactgtctcacggacgagaacggcgagagggttgggttcgaggcttgcagaggatcggagacgcagatttggcaggtaagcgagctgggatatctacgtccgctctctaggacatcgcattgcttgactggagggagtcaagcctctgtccagttgtgcactgagcagaagaaccagcaatgggcttatgcgataacaggcattctcaagaatgaacacacagagatgtgtttgacggagggaactggaatatctcaatgtggatttgagcgagatagtcaggtattcggtctgccgagtggtgtaaacatcaagcccagttag

SEQ ID NO: 1199 - DNA, 507 bp, A.fumigatus
tatcggagacgggcgaccgcgccgccaaacgccggagacattcctccgacgagggtcccgaacccgtctacgacgacaccgtcttctaccagtccctgctccgggacctcgtcgagcagcgcatgtcgtcctccgacgccatcacgaacggcatcgacaccctccacctccagctgccgtcccggcaaggcatccatcctattaccggcatgcgcaaggacaaggtcaaacgggacgtggacacccgcgcctccaaaggccgaaagatgcggttcgatgtccacgagaagctgcagaactttatggcgcctgaagaccgcggcacgtggaccattaccgctcgcgaggagttcttcgcttccctgcttggaaagacagcaagtgggttattgcgcgaaggggacgatgaggatgccagttctgcggaggaaagcgatgaggatcgtgaagaggttgggttgcggctgttccgcagctagccggctgccggtcagtggatatacctag

SEQ ID NO: 1200 - DNA, 519 bp, A.fumigatus
ggtctaacgcatgcttggatccttccaggccggtggttaatatcggagacgggcgaccgcgccgccaaacgccggagacattcctccgacgagggtcccgaacccgtctacgacgacaccgtcttctaccagtccctgctccgggacctcgtcgagcagcgcatgtcgtcctccgacgccatcacgaacggcatcgacaccctccacctccagctgccgtcccggcaaggcatccatcctattaccggcatgcgcaaggacaaggtcaaacgggacgtggacacccgcgcctccaaaggccgaaagatgcggttcgatgtccacgagaagctgcagaactttatggcgcctgaagaccgcggcacgtggaccattaccgctcgcgaggagttcttcgcttccctgcttggaaagacagcaagtgggttattgcgcgaaggggacgatgaggatgccagttctgcggaggaaagcgatgaggatcgtgaagaggttgggttgcggctgttccgcagctag

SEQ ID NO: 1201 - DNA, 429 bp, A.fumigatus
cttagtctcatagatctcggaggcgacagattcggatcatttgtattggattactttaagcacgtgtctcgaccaacacttaagcatatgggactgtcgcttcttcgcaagaccgcatctccccatgacaccctcttttacacggtctgtgtcaattcaatggcctacaagttcataaattgcctgttgatggatgaggatgatggccagctttcccagatgctacgggaacgcgctgcgaagtacaagcgaactgcccagaatgcgttgaggagaatcccactcctgacatcaccttcccttgctcttttacaggccactctttgcggcgtgagtcataaaacatttcgtttcttctgtcacaatctgacagagagcagattttcctatgccaggggtcaggtgagactcagctgtgctgtgatttga

SEQ ID NO: 1202 - DNA, 318 bp, A.fumigatus
agaatcttcattcacgttgacgagcaccttacgagggactatttggacctaaataagaagagcatcggttccgtactcacagttcacctgcaggatggttcagaactggccgaagttctgatagagtacccagccggccacgtacgaaatcctgccacagctcgagcggtgcaagaaaagttcaccaaaaacatgcggttaatgtttaccgagacagaaatctcgaagatcctccaagagactaggaaggacaacctactcatcatggatttcgtcgatcttttcgtgaagcaatcaccaccaggtccgagattgtag

SEQ ID NO: 1203 - DNA, 261 bp, A.fumigatus
  unsure (35): Identity of nucleotide sequences at the above locations are unknown.
gccaaacatttggtccgaacagtttcaatacgttntccgattggaacatgggggagccggataatggaaatttggatgcccttaaacacaatatttgctagtgggggcccagctgagcagtattgcgggaactgggattatggattgccgcttagcagagcatacgcggaatactttggtggcagtatcgctattcagagtctgtggggctgggggacggatgtttatcttactcttcaaggagttggcaagattgagtaa

SEQ ID NO: 1204 - DNA, 894 bp, A.fumigatus
ccacgaggtcaacaagatggccatgctggagagggtagaggtgagtctagccggtctgtgtatgaaggactcgctgactcaatcctgcagaaccgcttcaatattcaacttcatgcgcccgccgttgttctgctctatctgactacacgcaaatatgttctgagcagtatgtatccgtatatgacgcttctgggacagtctctcggctctctggtggttgcctatgacgccttcaacctgctcgtcccggacgtgttcatcgacactatgggctacgcattcacccttgcgttctgcaagatgctttttccctctgttcctaccggtgcatacgtccactatcctaccatctcgaccgacatgcttcaatccctggatgacagcaccggcctaaaaggggtcaatgcgggcgcgggcaaggggttcaagggccaggtcaagcgcaagtactggttggcgtttgcccgtctctacggttgggtcggaggtcatgttgatgtcgtcatgtgtaactcttcctggacatcggcccatatccggaccatctggggcccctcacggacgagcatgaccttcaaagagcccaccgtcatcttcccgcccaaggcagtgtcagagatcgagtcgaccatcactgtcgatgaggactcggagcgcagccgggaacccatcatcctttatatcgcccaattccggcccgagaaaaaacacccgctggtcctgcgtacgttcgcccgcttcttcattgagcggaagacgaaacccccctcgggcgccctcccccagccaaaaacgggtcctcatggggttcggtccgtcactcccagccccgaaaaaaacccacctcttataaactccggccggctggcccaacaaaactccggcatccgggga

SEQ ID NO: 1205 - DNA, 651 bp, A.fumigatus
aaacggcccacggctgagaatgcctctgcaaatgtggaagccgaggttctagaccatttcggtcagtttgccaacagtgagaaacttaaattgcaagagcggcgccgtaaccaggcatcgtatgaccggacggtgaagctgaacgagttgatgaaattctccaagaacttcaagcttgctacacctgtccccaaggacatggtacgtattcttgcgaaggacccacagaagcaggaggaaattattcagagagctcaacaacaggcggaggagaagttggcctcaaagactgcctcgggagtcactgagcagaagcccacatctcgtgtcagtggaacagtgcagaccactacacagcccgagcgccccaattatcctcgcggtcgccagatgtaccctcccaccggcccgcaagctgggcccgctgggcggctcccaccccaaggaatgcacccaggtcgtccgggcactggtatgctcagtcaccggctggctgataacctgcaacagcggaagggagcagcaatggcgcctgtgcccacgcctttgccgatccaggaggttcgcattcctcctagtggccgtgcggcagatcaaccgggcgtatccagcccgaataagacgcagacgcttacctctgagaactcgagc

SEQ ID NO: 1206 - DNA, 630 bp, A.fumigatus
cggggattagatccgatcctagtgcagcagatcaagcgatggaatcggacggcggcggtcccaaccacgggaatgatcccgcggctggcgttgcggtcggtgcatgacgagaacgtgcgtcgggaggtttatctcgccagccgaacgtcgagcaagcgacagctccatcggctggaggagttgctcctcaaacgagcggagctggcgaagctgtccggctatgagagtttcgcgcacatgacgctcagcgacaaaatggccaagagtcccgaggcggtctcgaattttctgacggccctggtggagagcaatcggaagctggtccgggaggaactgtcgcagctgcaggtcatgaagggcgccccgctccagccctgggatcacgcgtactatgttcaccaacgagtgctgcagtattcgcaggcgcggcggtcccgcgaactgagtgcggttcccgagtttttctcgctggggaccgtcatgcagggtctgtcgcgactgtttgaccggctgtacggcgtgcggctggtgccccaggagcccgctccgggggagacgtggaacccggacgtccgacggctggatgtggtgtcttcaccacggggctggaaggatccgagcggggttcag

SEQ ID NO: 1207 - DNA, 426 bp, A.fumigatus
cgttggatgcgcgcaatgcatgtagacgcctttttcgaatactgccttggccatcctcatccgtactacacccagcttccggcctctaatgccgcggtcagtgacactcgcgacggcgtaccgctagaagaagaccttgccttgcgtgcgcttgtccctgagtggaaaccgaaacgtgggcgcaaacgggccgatgaaagggagcaagctaacgagaagccaacgaaacgacctcagctagatacgtccgtgggggtgttgcacgcgggttcatttacagatcagtctgcaacatttccgcaaaacgccatcccatttagtgctttccctgacaacgatccatggatgaccgctgcatcgtcattcccagctgatggatctaccgacaaccagcaaggccaagagcttcggtggagacctctagag

SEQ ID NO: 1208 - DNA, 942 bp, A.fumigatus
  unsure (786): Identity of nucleotide sequences at the above locations are unknown.
acgcggattatcacccgtggtggaagacagacggtactcttcaaggatcagctggttgaggagagcctcttctcgggtgacgacgacgatgcacattttcataaggagactaagcctacgtccgcaaagtggcctatccttgacgcgccgccagacgtggtctttcaaaaattaaaggaagtcgatcccgttatcgccagtcggtggcatccaaacgacgtgcgcaaaatccgacgatccttggagatttactttcagaccggcaagccggcctccgagatttatgcggagcagaagcgtcagaaatatgcgacagggacaaatggagagtcttccccgggtataggacagctccgttacccgacactgatattctgggtgcattcagagaaggagactttgaactgccggcttgccaaacgcgtagattctatggtggaacaaggcttgatggcagaggcccaaagaatgtgggcttatattcgggagaaaaaagggcaaggcattactgtcgatcaaacaagaggagtctgggtctccatcgggttcaaggagttagcaccctactttgacgccctggaaaacggtgaattgagtgaaggggagctcgaagcactcaaacagtcgtcgatcgagctggtgaaaattgcaacgcgtcaatatgcgacatcccagatcaaatggatacggaataagctttggaaggcgctcgctgacgcaagtgccaacaaaaatttgtatcttctggacagtaccaccgttgaagactggcaaaagtgggttacngagccgtctgagcacttgactcaggcgctgctcaacgacgaaaccctaacgggacccttaatctctcttcggacttggcaagagaaaacctatgccccagggaaggtccggcgcagaaacaccccaacgaaattcttcccaacttttacttgttga

SEQ ID NO: 1209 - DNA, 219 bp, A.fumigatus
gccttgtactctcgcgacttccaaacatgcgtctcatgccattcaacaacaccctcctgttccgtctgcgaagaggggtatacatgtaccatgatcagtccatcatgttgccaatgcgccacctaccaatgtgttcagatgttcacttcccgccagaagcccccattccccccgccatatggaagccggtaccaatgttgggggctttttgccagaaga

SEQ ID NO: 1210 - DNA, 693 bp, A.fumigatus
  unsure (70): Identity of nucleotide sequences at the above locations are unknown.
tctcgtttgcgtccagcccccccccccggcggaccgcttgaatacgtttggaccaccttcttccttaccncctcgcggagaagaccgcatgaagcccgcgtgctacacaacttacgctcgaagccagcaaacttagccagggccctcattcgagcagccttcgaagtccatcatgtcaccacgtatggtcctgatggcacggtaatatccgatctaaatacggcctcagaatctggattcttctctgccctccattcccctgcatccgcctcggctcccgaaaacaggcggcatatcctcaactgcgatgcttgcaggaaagaagagttcgagcgacagacagcaagatcagcagcagcagtggagacatcgaaagaagctgctgcgacttcttcgacagatgtcagagcccaaaacttctctgacactggaagtcctgttcctcgaaagactctagcagatgcgagtagctcaaccgtcgtgagtgacactcggcaggtgctttcgccgggtgctcaagagttcaatgcccgtatcagcattggtgggatgacttgtgcatcgtgcgtcaatactgttacaaaagaggtccaacagctcgactttgtccgtgaggtgacggtcaaccttctcaccaatagtggaacggtgggctatacaggccctcaaacaaaccattggaaagattgttga

SEQ ID NO: 1211 - DNA, 639 bp, A.fumigatus
agacgacgccatgcgcatcagatcctcagcctagaacatttcttacatatagatgttgaactacgggtgcaacgattcgtcctcaatcacgcgccttggttaaaggctgttctcgcgagagtatattactcgcacattgtattgggcgtcatcttcctcgtctatgggtataccttctttcaaagggaaaaataccaaggagtccgccgcactctggctctcgaaaatgtaatagcatttataatcctcactctttggcgatgtagtccgccacgactgctgccggaggagtacggcttcatcgatatgctgcatgacaacgatgccggatccgcctggacacaaaacaagttccagcttacaattgcggcaatgccttcgctgcattttggtaacgctttcttccttgctctgtgcttgttgcgatacagctcacactggatccttcgcgtggtcgcgccgctctggcccatgatgatgggggtgacaattatcgcgacagcaaaccactttgttttggatgccctggtcggtgtttgcgtgaccttgacggcatatagattcaatcatgctgtgttggttttgttgccggtggagcgggtactgttcaagttgctccgcattgagaagccgcaataa

SEQ ID NO: 1212 - DNA, 189 bp, A.fumigatus
ctaatatctaaccagtgttctcgtctttcagccatcttcaggtctgccctgcattacccagatcgagacaacttcgccatgggggctaccaggcacattattgtctgccagtacaagtactggctgtgctctatttctatcgttctatttactcaagtgaccgcggcaggaacttgtttgctacgttga

SEQ ID NO: 1213 - DNA, 189 bp, A.fumigatus
actttaataaaggagaacttatggttaactatatatgtgtatatagtggctctgtttaaggttaatctgtctagtgggttaaagataaagttatggttagctagtaaatcagtctttaaatatactgctagtttactaactgaatatgctggtagaagagacctttgctttatatatactactgtataa

SEQ ID NO: 1214 - DNA, 414 bp, A.fumigatus
ttgacgcattgcgcgggtccttctggccccgtggtgaagatctcgccacggtacaatgaaccggaatatttactatatattaaatcaaacaaaccatacaatcagcacgaccagcctaatgataaggacccaggatatcaagcattccttaatcatccagcattcaaacgcggagatttccctgaatctaaggataaaccatatgtatttatagttaatgttagacctatagtcacaacctacaataaatatagggctacattcccattacagaatcatctgcatacccatctttcagaatatctacacacacaggaactaatccctgttacccctactactaataacctaactactatctatattattaaatctactcacaagccaactaggcttattagaatccattcctag

SEQ ID NO: 1215 - DNA, 384 bp, A.fumigatus
tattatactactacaaagattagaattaacagtatattagaatactataagatatgccttaatacaggctgcttctctaccattagaaatacagagtttattaaagcattatctagcataactatcactaagcttacagacagcatcatagttttaggcattggatcctgttatcaatcaaaccattctactatgctaacactatggttccctagattaataaataatagtggttctgcgaacgcatttgctaagattactatctattactatttagtcaatggcctgaagcctaagctacttattagaactaatgtcatctgtagtaaaggattcatacttaattttaaacatagcattacaacaattagttcttgtagttaa

SEQ ID NO: 1216 - DNA, 297 bp, A.fumigatus
gctaaaccacatcagatcacttatacagtagtatatataaagcaaaggtctcttctaccagcatattcagttagtaaactagcagtatatttaaagactgatttactagctaaccataactttatctttaacccactagacagattaaccttaaacagagccactatatacacatatatagttaaccataagttctcctttattaaagtctataataaaacacccactctaattacagtcactcatcacacttatatagggaccatctctgatactaacttcatcactacctactaa

SEQ ID NO: 1217 - DNA, 426 bp, A.fumigatus
  unsure (89),(342),(415): Identity of nucleotide sequences at the above locations are unknown.
tcacttcgctggaatttgcggtgtcgtttcccgctccccaatccttacgaccctcgtgccttccctctcagtattcgtttttcattgcntacaaacccaccgatgaagcgtacccgtgcgcgacagaatcgatcccccctgacggggagtgacggcagcgagagcgacttcgtcggtagcagccctgactgggatgagcagcgggatgccacttatgagacggatgtgactgagccagatgtcaccgagccggatgatcgcccgagcccacgaaaacgcctccggtcggatcagaaggaccctgctttggagccaagtctgtccaatgaggcagacgaattntacgacgaccccctcgatgacacgggaatcgacccttgtgagatcgacgtcttaaccagccggctggacggancagcgatgcga

SEQ ID NO: 1218 - DNA, 234 bp, A.fumigatus
  unsure (155): Identity of nucleotide sequences at the above locations are unknown.
acctttcccatggggtacaaggatatcatcaaaaagtacatcacccaccatgtgaacaatcacagccacaaggaggagtgtggtaagcaacctgtgtgcaacaaggttgtccagtggttgcaggatgccaatattttccccactttcatggcccntaccaccccaagggttggcattctcaaagtcaaggataagtcactcctaaagctgacaattctatggtctatcgtttaa

SEQ ID NO: 1219 - DNA, 201 bp, A.fumigatus
tcaagaaacactgccctgctgcaccatgataccgtccagaagacctttgagatgacagcagcagaactggatgctatgatttcctgcacttatctcggcactggagcagaaatggcaagatacatgaaacatatctccctggccttttctaacggaccacaaatggtgaactcactctactggaaagtatttggcgtctaa

SEQ ID NO: 1220 - DNA, 519 bp, A.fumigatus
gttgaggaatacccgttcacgtccctttcccaagaggaacgaaaggaacagatccgaacccgctacatgggcgccatcattgacatcattgctgtggctatcttcattgaaattgtgggtgtcacgtaccagcttactgggcttatagcgatggaaagagagctcggaatgagccagttgattgattgcatgttgcccaacacctctcactggcaatcacaagctgctcggttcattgcagcacacctggctttggatatcgtgtattgcccagcatggattatctccggtgcaatcctgaaatttggggtgtacggcaagacctcggctggaatagtcataatctacaatatcctggccggtctcgcgttgtcctccttttccatattcggcgcctcatttttcaggaaggctcagctcagcggtatcactgtcgttatcctttgtttgattttgggagtaatcgcgcaactggcacctgcttcgacaaacggtgctgttgtcattctcagtctccta

SEQ ID NO: 1221 - DNA, 750 bp, A.fumigatus
  unsure (709): Identity of nucleotide sequences at the above locations are unknown.
cggcctcgggctgataagacagcgaggtgcgtggctgatcacctcttggggatacaagataaggagtcacccatcaacactcgacatctcatccaccgcgctcagtttgggagagacgacatggcaaccaatgcaaatgcacccaccaaatccttcatcatcaagcatatgaacaccagccatgccgactcgctctctctctacctacgcgcctactgcggcgtctccgcccactttgcccatcccgccatccttcaagacatctcccactcggacctcctcatcaccgcaaagggaactcgctacagcgttcccattaacccacccatgacctcccttgccgaaacccgcgcccgcgtcgtcgccatgcacaaggactctctgcagcgcctcggcctctccgacattaccatcgccgagtaccggcccccgcaggggctccaggtcgtctcgctagtcctggtggtcgctacgctggtggtgtttggtcggcggagcaatttcctgccggagagtgcgttctacgagacggtgggcttagaccggtatccggtgtttacgcggttctgctacgatgttgcaccggtggtggttggcttattgctaggctcgcatttggtggaggcgacgctgtcggcggttaagatgttgaggccgcatggggtgcggtttgcgtctgggttgtgggttgtgtggattgtgtccaatntcgtggaaaggtttccggcgtggcggcggtttgatgagatg

SEQ ID NO: 1222 - DNA, 360 bp, A.fumigatus
  unsure (9): Identity of nucleotide sequences at the above locations are unknown.
tacttcccnccccgtggtgaagacaatcccaccacgcggaccatgtccctgtccgatcgggagcaactggtccagctctcgcgcgagttcgatgccttgatcgtgaccgatgacgtctacgatttcctgcagtggtccgtggatccagactgccccctggctgctccagacgaggcacgcgtgcctcggctggtcgacatcgatcgctacatggatggagggccccaggatgaatggggaaacgtcatcagtaacgggagcttcagcaagttgatcggccctggcatgcggaccggatgggcagaaggcacggccaagcttgcctacggtctctctcaaacgtatttcctcgtcaactaa

SEQ ID NO: 1223 - DNA, 459 bp, A.fumigatus
agcgtactgaacaatgcctgttggtcgtgcggggaaattgccgtcaccgagaaagccaatctggcaccgtacgccgacaagctgtaccatggactgtctaccattattaacaacgaggaaattatcgactcggtgaatgagaatgccgcgatggcgctcggaagattgggtttctgctgctccgatcaacttgcctcgcgcctggccgagtatgccggctcgtttctgaagtcgatgaacaagattgagttcacgcgcgaaaaggcatccgcattcctcggtttcaatcacgttgtgatgaagaacccgcaggccctggagtcttgtctgggcgagtacttccaggccattgccaccttccctaccaagtcacttcatcaagaggactaccgtgatatccagagctcgttccagcaggttcgttgtagttttatcccactgttcgatggcatttgctaa

SEQ ID NO: 1224 - DNA, 243 bp, A.fumigatus
aatgtagtattagatagcaactaccgcgtattggataaaaaagagccaggctgtccgcgtagtggttcagtgataatctatctgggtttgggagtgccccccctccacagtccgcagttcccccccccccacctagataataagctggtcctccccttaaatctccatctgcccctcccccgtcgggcttcccctgtttctttctgttcttctgcttccttttatttcgttttcaccacaggg

SEQ ID NO: 1225 - DNA, 216 bp, A.fumigatus
ttgttaccctatgattatagtcacccgtattacatggcccttgattactcttttttccctcttcctatggacgaatctgttgactatatgccacttttatttctttccttatcgtacctgatcagagaatggtctattcagatggaacaacaaaagaacttttccaaatttattagtggtccttcagtcaaggaaggaacgagcacagacatatga

SEQ ID NO: 1226 - DNA, 855 bp, A.fumigatus
  unsure (747): Identity of nucleotide sequences at the above locations are unknown.
atcctttcttccagcccgcgtgaagacactcttcgagcagtctccagcgggacctgcaatgcagctgaagcgcagagactcgcaaagcaacacgccgaatttggtcctctcggccacccgtcgcatctctatgtgagcaaacacagcgggggcgaaattgccgacccggtcctcgacgagccgccgtacttcaccgctttcacaacctacatcagcttcctcattttgatcttcctcggccacttccatgatttttgcgacaagtacttccgatctcacacctacaagcacctccgcccgcagaatggctatgcctcgttgtacagtgatttcgagagcttctatacacgacgcatgaagcggcggatcaatgattgtttcgagcgaccgaccaccggggttccaggaagatatatcactttgttggatcagcagtcgaatgacaacctccatttccggctcaccgggacgaccacggacacgttgaaccttagctcgtacaactatctgggatttgctcagtccgaagggccctgttctgatctcgccgaagaaacgattcggcagaatgggatcactatggcgggctcggttgctgaacccggcaccccacagctccatgcggaggtcgagcagctagttgcgcgattcgtgggcaaggaagattcgattgtgttctccatgggctttgtgaaccatgccacgattttccctgccctcatggaaaagggatgcttgatcctttcngatgaattcaatcacgcgtccattcgctttggggctcgtctctcaagaactgccatccaggtcttttcccataacaatatggcggatctggagatgcgactcccatag

SEQ ID NO: 1227 - DNA, 501 bp, A.fumigatus
ttcggagtggccgatgtgatgactcccacacgaactaaggagcccgaccaatcgtacaagcctatgaatttcccagctggttactccagtcactggccgtctatggtgatcgagactgcgttctccgagagtcagggcacaccggccaatgatgcgcgctggtggttgaacgcttccgggggagaattgaagatcatcatcaccattgcagtccagaagaaacgggaggctatcactattgacaaatgggaggcgaccagccggcccacacgaggcgacccggggaagacggtgcctgacgttgttcagaaggtgactatcacaagggagggaggtgatgccccagtgcatgtcactggggctcccctgatcatacggtttgagaagctgttcctccggcctgccgaggaggagaaaggggagggggacgtactgtttactcacgatgatttggccgaaattgccgacaaggtctggagtgtcctcaatacgggtaactaa

SEQ ID NO: 1228 - DNA, 558 bp, A.fumigatus
tcgtcggccgccccagggcccggagacgactatgcgtacacggtcgacactctgctggacgaaatcatcgacacactggaccagcttaacatctccaaggtccacttcgtcggggagagcacctcggacatgctcgatgaagccttggccgcccagtttccttcccgcctgcgcagtttgacaacgatctccagcccgacccttctcccacccgcggcgctccggctcttcgcatttggatacccgagccggcccgaggcgtgtcgccagctgggctcgaggggctggggcgagcgtctcgcgcgggtcccgggaacgctgtcggcatcggaccccgcgtacgaggcctggtggctgtcacagatcgccgtcagttcaagcgagggccttgcgggctatgctggatttctctccaccttcgacgcgcgggcgtatctgctgcgggtttcggtgcccatgttgatccttgcgccggcgaagagcgcggcgactaccttggaggaacagttggatcttgcgagacaggtcaaggggtctaagctgttttcacccacgggt

SEQ ID NO: 1229 - DNA, 573 bp, A.fumigatus
cccttgcagcttcagcctcgattagtcattatattatcagcccattatggtgaccaggcatcaatcactggcaccctgtctgatgaacctttatctgtccatttcatcccatctcactcattcctttcctttgctgcctataataagaccttcaagatgcatctaatccttcatccaaagactctcatcctgctgctagctgtgctggtcacaattgtatgcatctcgatcaggcgcttcctcgcccggcgccagttcgcacgccagcacggttgccagccagtagcaaggtccctcaacaaggatcccttcctaggcctcgatactatccccgagactctccgcgcggcaagtcagcaccgaatcctcgaaaggagtgtcgagctcttccgtctctacggcaacacctttaccgtaaaggaactacacaaatatgccatcctgaccatagagccggagaacatcaaaacaatcctatcattgaacttcaaagattacggcctcagccatcggcttcaaccgttcaagccactcctaggcgaaagcatcttcgacaccgatggcgcacactga

SEQ ID NO: 1230 - DNA, 255 bp, A.fumigatus
gcttcgtcgcgggccttgatccggcccagctttactcgcggccaagttaccgacttgacggcgctggaagacttgatgcacgacctcttcgcgttgcttccaggggatgggaaaaatgtcttggaactgcgggagctgttcttccggtatacgatcgaatccgcgaccgatttcctgttcgggcactcactccgggatctcgacgaatactcccttcgaactggggtctctgccctgctttttattcatccctaa

SEQ ID NO: 1231 - DNA, 519 bp, A.fumigatus
cgactacttagggctccgacatccggtggccagtaccattggatctccatgttggccccacgatggacggtgaaattcctcagttacatgtgtggatggctcaccgtcattggatggcaggccacctttgccacagcgtgctacctctgcggtacgatggtccaaggtgtggccgtcctcacgcgtcccaactaccaaccccaatcatggcatcctaccttctacttctgggccattgtagccttcgctgtcagtatcaacgtggtcggtcgcaacgtccttcccaagtttgagggacttattcttgtggtccacattctgggcttcttcgccatcctcatcccgctcgtctcgttggcggacattggttccgccaaggacgtcttcaccgagtttgtcaatcaaggtggctggccgacccaggggctgtcgttcttgtgttggcttgatcggctctgtgtttgcctttgtgggaggcgatgccgcagtgcacgtaagtctaccattgctctctcttga

SEQ ID NO: 1232 - DNA, 192 bp, A.fumigatus
  unsure (76): Identity of nucleotide sequences at the above locations are unknown.
cagagtcagcatcagaaaagcaaggacggcaagccactggcaactggtgactggcttgcaacattggacaaccccnaatcgggaaattttgaaagtggtaaaagaatcctgaacagccctcactgttggccattccgaatgggattttcctccaatctggctgcaaactccggaatttgcccccaaggttga

SEQ ID NO: 1233 - DNA, 258 bp, A.fumigatus
gtgcacagagtacggagtagtactcggtattctgtactctgcgcatcccttgccgccccgctgatacatatcacattgcacctaggcatgcatttgaaactggggaactaccagccgatgtgcgcattctccaacctccttgttgttttgaacctacgatcaaccgttaccacaggaatttgccctatccgtttcaaggacagtctatctacagagtacccatcggtttggtgtacagcacgcttgcttggagattaa

SEQ ID NO: 1234 - DNA, 453 bp, A.fumigatus
agcagttttttatttacaacatcgtccagttcatcactttcgttccctcctgacctccgaacggcacatacattcaaaatgcgtgtcagcaccttgctccctctcgctcttgcggccggtaccgctgctgcctccaagaatggaactttgggtttcgccctgggcaataagaacgaaggcggcaaatgcaaagtccagtcggactatgagaccgatttcgatacgttaaaagaagtgacctctctcgtgcgcatctactccgcgagtgactgcgacaccgcaaagcatatcatccctgcggctaaggcgaagaacttcaaagtcgtcctgggtgtttggtatggaacccgtcacattacatccgctttacgtcaagcggctaggttgctaacattgccccgtttggtaggcccgattacgacaaatctttcaccgacgacttcaacgccttga

SEQ ID NO: 1235 - DNA, 264 bp, A.fumigatus
ttaagtataataccccaacagtctcagggatgcgatgggcgacttacatgcaacttgcaaccgaccctcatggaggttttgaaacagttacatgtctctgtctctcagaattttgatagacttttcgatgacgcctataaatccttacatacggaactcacgcgtcgcgacgagtacgtcaagaagctagacgtagagctagcacgcacagacagaaataatgcttctgcagaggtcctgaaactcaaccgtgagatttccctc

SEQ ID NO: 1236 - DNA, 240 bp, A.fumigatus
aagtggcaatggccacgatttccaactggatccacctatatccccatcgaccaacacccccaggagccagaacagaatgctcctgcgcccttccccaccgctgcttcttctaaaacacgcaaacactctggtattcatggaattaacaccacgaaccatggacaactttggtttaccctccctcagggaaaatatcccccaacgggtacacaaccagaaagcttttggaaacttgattcc

SEQ ID NO: 1237 - DNA, 267 bp, A.fumigatus
tccggagaagaggagagtgtatgcgcttcctctgacacgacttgctcggcaaatactgacaacgttaggtatgtcacggacattgaatacttcaaggagacggaggttcgcaacgaccccgtagcggcaaagaataatgcagcgcattgggttattgtcgtgatggatgctctcacagctggtgtcgaagacattaggggtctttcgccgaaggacgaatatatcaatcttgaggattttgaacactttatgagtgacagtgactga

SEQ ID NO: 1238 - DNA, 909 bp, A.fumigatus
  unsure (858): Identity of nucleotide sequences at the above locations are unknown.
gacgacttcttctttccggcgtgtagacagataatgagaattgggatcatccacgtcggtgccccggctggcggcatgaaccaagccacccgcgccgctgtcggttactgcctaactcgtggacacaccccgcttgcgattcacaacggtttccccggcctttgccgtcaccatgatgatcaacccgtcggctctgttcgtgaagtcaagtggctggagtctgatgcttgggttaacgaaggtggatcggatattggcacaaaccgtagcctaccgtccgaggatttcgagaccactgccatgtgcttcgagaagtacaagtttgacgcactgttcgtggtcggtggtttcgaggcttttacagcagtcagtcagctccgtcaggcccgcgataagtatcccgctttcaagattccgatggttgtgttgcccgctacgatttcgaacaatgtgcctggaaccgagtactcgctgggaagcgacacctgtctcaacactttgattgatttctgcgacgccatccgccagtcagcgtcgtcctctcggcgtcgtgtcttcgtcatcgagacacaaggtggtaagtcgggctacatcgccactaccgctggtctcgccgtcggcgctacagccgtgtacattcccgaagagggcatagacattaagatgctctcgaacgacattgacttcctgcgggagaactttgcccgtgataagggagccaaccgtgccggaaagctcatcctgcgcaatgaatgtgcctccagcacctataccacacaggtcatcgccgacatcttcaaggaggaggccaagggtcggttcgagtctcggtcggcggtccctggccacttccagcanggaggtaagccatcgccgatggaccgtatccgcgctctccggatggccgtc

SEQ ID NO: 1239 - DNA, 210 bp, A.fumigatus
tggatgattgggaactacagacacagagaagtgagaggtgctatctttcgatctcgagtacacattcggataaatggtgtgcactccaatggattccttctccttaaggcctcctcccttgagatcaccgccctgcacttatttacctggtttctgtatttttcccactgtcccccgttccttgtttttacccctacctctgttaattaa

SEQ ID NO: 1240 - DNA, 195 bp, A.fumigatus
tcctcctataccctctccaaagttactatcccaccacatttcttttatgcattcaccccttttcttttccgtctccctccccctttccaaaaaccccaaactcccccctcgaaaaaccccttttttaactttgcacaacaattggtttctcttcccaacgcttccaactcggtttctttaaaaccccttccctga

SEQ ID NO: 1241 - DNA, 684 bp, A.fumigatus
ttcccaatcatccatcaatctcgttctcactctctaccaaggctgctggttcagcttgacttcaagatgatcccagccgcaaccgccaagtacgactggatcctcgccctcacctccatcactttcgtcttcagtgcctttggtaacggagctaacgatgtggccaactcgtacgccacgtccgtcgctgcgcgcacgctgagcatgtggcaggtcggcatcctggccgtgtgtaccgagttcattggggcggttgccctcggagcccgcgtgaccgataccatcaagtccggcatcatcagcatcgaccggtttgagaacaagcccggccctctgatgctggcaatgggctgcgccgaaatgggcaatgctgcctggctgatgctggcaaccgggatgggctggcctgtctcgaccactcaaacgattgtcggtgctctggtcggtgtcggcttcgccgctcaggcacccattcactgggaatggaccaagggcagtgtctcccagatcgccgcatcctgggggattgccccggccattgcagccggcttctcggccctcatgttcggcatcctgaagtacagcgtcctcgagcgcaaggatcccttcaagtgggccatgcgtctcatccccggttttcaccacggggcccgaaggaccgccaatggcctggtgaagcgggca

SEQ ID NO: 1242 - DNA, 870 bp, A.fumigatus
  unsure (609): Identity of nucleotide sequences at the above locations are unknown.
tatctcctcatttctaataaaccaactgcccacagcctgaccccgccccagtcacataagccccagcagaagacgccttcctcttcttataccacacccacctcaaccaaggcaaagcgaggctgcgagagaaacagaatggctcccccaacagaactccaccacctctacaccaccatggccgccttcgtgacgtcctgcatgtcagcccacgatccctcccacaacccagcccacgtccaccgcgtcgtcacattagcccgcacaatcctcgagaaagaacagctcttgcacccggacatcacctacgacgaggatgtcgtcaaactcgctgccttgctccatgacatcggggacaggaagtatctgacgcaggtcgccgcggcgacatccgcagctggagagcagcagcagcagcaggcggcggttgatccgggccggatggtggagcaggcgctattagcgcacggagcggacgtggcgctcgcggcgaaggtgcagaccatcgtgacgcatgtgtcgtactcgaaggaggttaaagatcctgcgacggtgcggaggttgatagacgaggaagggtatgtggagctggcggtggtgcaggatgcngaccggttggatgcattaggggcaatggggattgggcggtgttttacgttcctgggcgcgcagggaaggaagtatcttagtcctgaagaaccgtgggatatgaataacgctatagctcactttcaggacaagctggagcggttggaggggatgatgaaaacgcagacggggagggaaatggctcgcgtgcggacacagcggttgatcgagtttcgcaaatggtgggaggaggagatggaggaggcaactcatattccttga

SEQ ID NO: 1243 - DNA, 420 bp, A.fumigatus
  unsure (117): Identity of nucleotide sequences at the above locations are unknown.
gctatagcgttattcatatcccacggttcttcaggactaagatacttccttccctgcgcgcccaggaacgtaaaacaccgcccaatccccattgcccctaatgcatccaaccggtcngcatcctgcaccaccgccagctccacatacccttcctcgtctatcaacctccgcaccgtcgcaggatctttaacctccttcgagtacgacacatgcgtcacgatggtctgcaccttcgccgcgagcgccacgtccgctccgtgcgctaatagcgcctgctccaccatccggcccggatcaaccgccgcctgctgctgctgctgctctccagctgcggatgtcgccgcggcgacctgcgtcagatacttcctgtccccgatgtcatggagcaaggcagcgagtttgacgacatcctcgtcgtag

SEQ ID NO: 1244 - DNA, 195 bp, A.fumigatus
cctacaacagaagagggtatcagaacagacctctctgctgttgttagatcagcagcttttttcgccatgagttacgttaaaaaagatgaggacgctgatcaggtgatgatcaagctcgatcggacctccgtcttccaagatggtaaggggattctcagttcccctgaagaggctaccaaactaccaagcaattaa

SEQ ID NO: 1245 - DNA, 294 bp, A.fumigatus
acagaccaaaactccgaggagatttgcaacgcctccacggctccatggagcccctggagttgcgtggcgccgatcttagtctccgacttgccgacggttcgatctctggaattccaagagggtttgattctgtactactctgtagttagttactattatacggctgacgaggggaaaccggtttggactgtgcccctccacgctacagtcgccttcactggtaacaactcctctgaaatcttgagggataacgatgccaataaagaaagcatcattctggaagtctacctgtga

SEQ ID NO: 1246 - DNA, 291 bp, A.fumigatus
gttcttgtcatccatgagagttgtaccggaatctctacgacttcgggacttacttctattctctcattttccaggttgatcgccctgttcgagctagccggcatgcctatgtttgactgtactcagattgtcgcgtgcattccccgctcgcaggaggtaacagattccgagattgtgaggaacctgggctggtgtggttttaacctgacaacattgaaaccttgggtttctgagcagtgtgtggagcactgcctgagcacaaaatggctttttttatgtgcggaggtctaa

SEQ ID NO: 1247 - DNA, 1179 bp, A.fumigatus
gaagacatgaggccggggagaagaaggtggacgccatgggttacccccaaggcggccgcgagttcaaatgtcggacattccgtgtgccgcgtgcggggaaaggagctgttcatgctggcgaccgaatgcgcacgggtgctcgggtatcgagactcatacctgctgttcaacaagaaccggtctctgcacaagatcatcgcgtcgcaaatcgaaaaagacgacctcatccaacaggatgttctgccgtactcgtatcggtcgcgccaaattgccatcgtctcggccaagtcgatctttcgtcagttcggcagcagggtcatcgtgaatggacggcgtgtgcgcgacgattactgggaaagcaaggcgcgcaagcaggggttcaccgaagatgacctggctggtgaaaaacggccgggggccggcaaggctcgagacgccgccgccgccgaggcagccaatgctgcgaatctgttgccgaccctcacccatggcgacgtcatctacagcaatgcgctcgagaccatgcctcatggcttgccggttggggggccagcctcgtcctcgctggcttctctgccgatgatccacatggctaccaccaccgacgatccccggctgagggagtacaacagtatgcctcgcgcgcgccaggagatcacgggccagccgtaccaagaccgcttgcagcccagctcggcggctgaaatcctcaaccatgcatcgcacacggccgacttcaacaagattctgagcaaccagcgcagtttccgtcagaagggcctggaggagttttactccagccagcgcgaggtccccgagaccgcggatctcgctcaacccgcgcagttggacgccaccgtgtcggtctcccagcccttgcaatcgccccagatggcgtcgacgggcttgatcagctcgacgcagccgcaggcgattcttcccaaccaggcgccgatgatggccggtcagaccgccttccaagcgcccacgggaccccagcagggcgctattgctcagtctcccatccagcccgtgcctgcagttcgggccaacctgatgcatcagcgttcaaacccttctatgttctgggggcacgccggaagccgacccggaccgtatgggtacccggcggcaacagcaacaaaatggtgggggcagagcaccttccggcggctttaa

SEQ ID NO: 1248 - DNA, 495 bp, A.fumigatus
gccaatatactaacatccgtttttttattaggactctactataaattgcatggttgctaccgacccaccacgatgaaaaagtccatcattaaacgacgaaaacgtgttgtgcctgccttgagagaccaatctcctagtggagctacctactcgtccaacggttcgtctgcgtcgccggaggcatctccggcggtattggctcacagccatgatgaccactaccgatacttgagttcggatccaacattgcaggctaaccaccagcgacattatgccgttgccccaccgcctgtggatttcactcacttcagtgctaccgggagtctctcgttgccgcatcaccccccccctcctatactcctggagcctgaacggctgagcgcacctagtcactctcccattccacagttcggccgacgttctatctcacccagcacttccggcagtgcgaagaagcgaactcttgcggagaccacatcatccaccgatactgcc

SEQ ID NO: 1249 - DNA, 459 bp, A.fumigatus
gagcgcgtttccttccttccccgtcggtgtaagacgggcggtcaacaaagtggcgacggatttgctcagagcgaatcggcttcacagggtcactgtcagtctaactcaggaggtggttcctgtcctggtggagggaattgcaatgggactggcggagccgagggatgcgatggttgccctgcctacaacaaccgagtttacaagtctgctgctcgaggcacggttcccatccactcgtggagagctacaaattcagggtccgaccgacctctcgctgaaaccgaaaacgatgcgggaaagaatggcgcaacggtcgaaggaggaaacatgctggtctcctgtcaaaactgtgggaccactgtgactccactttggcgacgggacgaaaatggacatccaatttgtaatgcttgtggtacgtcgactctcccccagtcttgtgataagccaatatactaa

SEQ ID NO: 1250 - DNA, 897 bp, A.fumigatus
acccccgagtatggatcaagtccagggtcgagttcccgatttgatagagcggacagttcggaggttcagacgggtggtccgaacggcactttaggactcggcttaggcagccttcgggtgccgacgcagttagatcctgagcatcacattgctttcctggagaaacaacgaaagaataaaggggcattgcgcattcccagccctagggagtatgaccgcggcggcgtgccggaggtcctggaggaagcagatgatgaaggcgagggatccaagcggacgcgtagcagcgaatctgacgacgagaactctcggaattcggaggagtccgaccaagttggaccactagaagggccgcacatcaccatcaatgaaccggacatacagcagacgagaaccagaaattcgacgttccctcgtctggacacacgtcccacttatcgagacacgaaagatctgaacgatacttcagccctggaacgttcaaggtcacgacgccctactcttagcaatcttgttcgctccttaacccaagaacgggagcgtacgacgcttccatacctcagttggaacgctactgttgcacgaaattctaactttgttgatctgaccgaggagcagcgtgatgagctgggaggcatcgaataccgagccttgaagactctagccattgtactcacttcttattacctcttttttcacatcctgggaatggtctgcctcgtcggttggatcatgaccactcactggggtcaggtcgttgagcaaatcggacaaggtcgtccttggtggggcatcttcactgcgggatctgctttcaacgacgtcggcttcacgctgacgcccgactccatgacctcgttccaggtcttcaccacggggctggaagggtccgcgcat

SEQ ID NO: 1251 - DNA, 510 bp, A.fumigatus
cagattcgggagacggagccggacctcaagggccgcttcatcctgcaggatcggccgattgtgatcgaggagaatgggcgcgagctggaatcgcatggcattgagcctatggcgcatgactttttccagccgcagcctgtaaagggtatgggccccatccctgtcccttcctttcctgactgcctgagactgaatggaataggtgccttggtttactacgtccgccgagtgttccacgactggccggatgacgaggtccgacagatcctggtgaatctggcggcggcgatggcgcagcactcgcgcatcctgatcgtcgagttcatcatgcctgaagtcggggccaccatgtccaatgcgtacatggaccatacgatgatgacctttgccggggtcgagcggaccgagaagaactttgcgagcctgttggaccaggctgggttgaaactggtcaagacgtggagggcacctggagtccctgtcggggttgtcgaggctagattgcagtga

SEQ ID NO: 1252 - DNA, 189 bp, A.fumigatus
cttcttcgacagtccaaggctgttcttcaagctttcgaagccgagcgcacctacctttacgtctcgacaaaggcgagaaagcccgaacctcagccacccgagcttatgactgcgctccataatgcctctgatactattaataatatccgcgaggtcttcaccacgggggccgacggatccgcgctatga

SEQ ID NO: 1253 - DNA, 570 bp, A.fumigatus
  unsure (567): Identity of nucleotide sequences at the above locations are unknown.
aatcctggaagcagtgacagcgaggggcttcggctattgactggaaaacgcattagcatgttccttcagtcgtggtatttgtttcgcaagagggtcacaatattgcgccgcaaccctatcccatacttggccgctttgctcatcccagtcgttgcggccggacttgttactcttttcctgaagggtgctacgaaggcaggttgttccggtgatagcgcgtatcgtgcatctggctttgagtcactggcgtctctggaaaacttcgaatttgtggttggtcctcgagacaggctgtctatctccgctcttgagagcttcattggctccctatctggtttgatacggtcgactcggaatacgtctttgaatctcaactctcgatttcacctagtaaacagtctcacggagtttgaagattatatatctcacaactataccaacataacccctggcggtttctacctgggagacgcaaattctgcgcctacattcgcgtggaagggagacaacagtcacttcccgttatccggtcttcaccacaggggtcgaaggatccgcggatcgcgntaa

SEQ ID NO: 1254 - DNA, 543 bp, A.fumigatus
gaagactcgcggtgggcttgcccggcggtggttatatatcccaacatgtatcgactttctacgctcctgatggcgttgggctctgtcaccctggcagacaccaactcgaataccttcaatccgctccaccatctggccggaatttccccttactttacacccaatgaccctcagctcgacccctcggtaccacagggctgcaatgttactcgcgcagcttatcttgcccgtcacgccgccatctatgccaacgattttgactatgaacgctaccttgagccattcatccagaagctgcaaaacaccacgcatgattggtccaagggaggaagcctctcgttcctgaacaagtggaacgcgccaatcaccgaagcacatctcgaaaaaatcacccgaattggtctgcaaggaatcaatcatgtttggcatcaatatccacgacaagtatccagacttccaaaccccaaagaatgtatggacagcaacatcggagagaaccgtcaagactgcacaaggatttatccttggatacaccggcaatga

SEQ ID NO: 1255 - DNA, 270 bp, A.fumigatus
caaccccaggaattcgtctcccactacaccaaacctatcattacgcgtctccaagcccaggcccccgccttcaacttcacgtccgacgacatcgtcgccatgttcgagctctgcggctatgagaccgtcatccgcggctcctcccccttctgctccctcggcctcttcaccgccactgaatggctcgccttcgagtacgggaacgatctcatgtacttccacaacacaggctacggccgtgacttatcccccgccatcggcttcccctgc

SEQ ID NO: 1256 - DNA, 624 bp, A.fumigatus
acaagtggaacgcgccaatcaccgaagcacatctcgaaaaaatcacccgaattggtctgcaaggaatcaatcatgtttggcatcaatatccacgacaagtatccagacttccaaaccccaaagaatgtatggacagcaacatcggagagaaccgtcaagactgcacaaggatttatccttggatacaccggcaatgaaacggctcaaatcaaactcacccaggtcgggggagtacaagcacgccgcagccgactcgttaaccccgtacaaaagttgcccggcatacagctccagctatggctccaaacagtccagtgtacgtactccccttcacctccactcacagcacgagctaacaaccccaggaattcgtctcccactacaccaaacctatcattacgcgtctccaagcccaggcccccgccttcaacttcacgtccgacgacatcgtcgccatgttcgagctctgcggctatgagaccgtcatccgcggctcctcccccttctgctccctcggcctcttcaccgccactgaatggctcgccttcgagtacgggaacgatctcatgtacttccacaacacaggctacggccgtgacttatcccccgccatcggcttcccct

SEQ ID NO: 1257 - DNA, 186 bp, A.fumigatus
  unsure (48),(55),(93),(94),(104),(118): Identity of nucleotide sequences at the above locations are unknown.
atggaaatcccctcatatcctcatcatatgccactaatagcggaatanaaagaanatggtagcagaaacacccgcaaacccctcattcaccannaaaccacttnccaggccacccagncagcccaacgcgcgcaaactggaatcactcaccagcctttcttttttcccacaccgcatttcatataa

SEQ ID NO: 1258 - DNA, 210 bp, A.fumigatus
  unsure (119),(169): Identity of nucleotide sequences at the above locations are unknown.
ctttatatccgtcccggttcttcccttcccaaacccaagcccgggccagacgaaaagaccggacccgttccggagtatgataagggtggttcacaggccaaacgcctttcggcgtctgncggcccaaacggaagttccagggggagggccggacgatccaagcgcccgnctgataaagacaagacccagggggggaggagggttatatga

SEQ ID NO: 1259 - DNA, 768 bp, A.fumigatus
  unsure (28),(35),(152): Identity of nucleotide sequences at the above locations are unknown.
ggggtttgcgggtgtttctgctaccatnttctttntattccgctattagtggcatatgatgaggatatgaggggatttccatttacacgactgcccagcaagaaactgaggtcatcggttgatgctgcaccagaaaacctgaaccctatccntgaggtaccaccacagcaatcgcctaggcgaggtcgaccgccgaagaagaagaagaagaagccagaacggtgcccggaagaatctgcggggcacacggagaagagcgcggaaatgacaagcaaaaggcagacgcgacggaggagatccccggttacagagccagaaccgcaaccgcagagtgtcacacgttcatcggcgcggaagcgtgaggaggccgaatctgtgcccaaggagaaaaagcgacgaaaaggcagaccgagcaagacggaagtcgaggcgaggaacggctttgtgtcgcctgaaccacagcagtccagtactgcgaagattgcgctgcctctagccgatacgcctgtgatccagcggaacaaggagatgcgaaaagaggccaaatcggaaaaaggagggaaggggaggcggagtagcctggggatgagaggaaggagggccagttcactgattgattctggggcatctaacggtacgaatggtcttgttgaatttgcaatggagactgctgtactgactaccttccagcgttgcctcacaaagaggtcgacacagccgatttctacaaacatattgcagatgggctcccagaaccgcggaggatga

SEQ ID NO: 1260 - DNA, 285 bp, A.fumigatus
agttcggctcctgccaggcccgtggtgaagaccagtctgctgaacccatcgaataatgtgctcaatgcggacagggcactgttccatcctaaggtgcctttgcatttagaaggaattctggctctgaatctgctgagcgtctatgagtacgcacagcgagggaatttatgcacaatgactgaccgagctaatgaggcgctgacatcagcgatgaaaatgtcgttgcatgagtctcttgaggaggatgaatacggcggaggcccgggcgaaggacctggtggatga

SEQ ID NO: 1261 - DNA, 183 bp, A.fumigatus
cccatcccgttatttttattgcgattgtcttgtgacgatgccacccgggccatgatttccctgcacagtttcactcctcttaagttttattattcacttctcagaccgatagctaataataaagcggcttcctacggacgcgtcgcatttccagtgaatcaaatactacttgactgccaataa

SEQ ID NO: 1262 - DNA, 462 bp, A.fumigatus
aaccttttccatacctgcgccccgcggttaaaaccgatcatccagcgcctctacacggccaatatctaccatgatctgctttacaccctgggcttcaccgaaaaggccggtaacttcgagtacaacactaacgggcaaggcggcctgggaaatgactatgtcatcctgaacgcccaggacggctctggcaccaacaacgccaactttgccactcctcctgatggccaacccggccgcatgcgcatgtacgtctggaccgagtcgacgccgtaccgcgacggctcctttgaggctggaatcgtgatccacgagtatactcacggtcgtacgtattaccttgctggttttattgacacacgactcaccccttttttcagtttccaaccgactcactggcggccctgccaactccaactgcctgaacgccctcgagtcaggcggcatgggcgaaggctggagtga

SEQ ID NO: 1263 - DNA, 231 bp, A.fumigatus
tttcatggcgacggccatccgtctgaagcccggcgacaagcgctcgaccgactacaccatgggcgaatgggcttccaaccgggcaggcggaatccgccagtacccgtactcgacctcgctgagcaccaaccctctaacgtacaccagcgtcaactcgctgaacgcggtgcacgccattggcacggtctgggcatccatgctgtacgaggtgttgtggaatttgatcgataa

SEQ ID NO: 1264 - DNA, 462 bp, A.fumigatus
tccacgagtatactcacggtcgtacgtattaccttgctggttttattgacacacgactcaccccttttttcagtttccaaccgactcactggcggccctgccaactccaactgcctgaacgccctcgagtcaggcggcatgggcgaaggctggagtgatttcatggcgacggccatccgtctgaagcccggcgacaagcgctcgaccgactacaccatgggcgaatgggcttccaaccgggcaggcggaatccgccagtacccgtactcgacctcgctgagcaccaaccctctaacgtacaccagcgtcaactcgctgaacgcggtgcacgccattggcacggtctgggcatccatgctgtacgaggtgttgtggaatttgatcgataagcacggcaagaatgatgcgccgaagcctaccctgcgcgatggggtgccgacggacggaagtaccctgccatga

SEQ ID NO: 1265 - DNA, 660 bp, A.fumigatus
  unsure (526): Identity of nucleotide sequences at the above locations are unknown.
cggaaacagcagagtttctctctttcactgctccatacccatcctctcgttctcagtcgttctgttctccttatatccgttttcttcataccccttgacaccatggaggctcctcctcaaatgccttcaatctccgtggtggcatcctcgcgcgccgttatctcaggccgtttgacatcagccacgattgttatctctcgtaccactggcaagatcactgcagtatttgactcggtcattcttgcgtctgaatttcccgcggggactccatacaccgactattcccctcatgtcctcttgcctggtctggtcgatgcacatgtccacctcaatgagcctggccggaccgagtgggagggcttctacactgggacgcaagccgccgcctttggtggtgtcaccacagtcattgacatgcctttgaatgccattcctccaacaacaaccgttgctggcctaaaggaaaagattcaggccgccgagggcaagtgctgggtggatgtcggcttctatggcggtatcgtcnccgggaatgctggcgagctcaaggctctggtccagcagggtgtccgcggtttcaagggtttccttatcgatagtggtgtatgtatctgttctctcgcgcgttcttcggtgcacactgaccgctttatcctttga

SEQ ID NO: 1266 - DNA, 741 bp, A.fumigatus
gtgtgccgacacttactaacctgtcatagcgggtactatggcccggacggcaaccacaatcagcaagaaggaggatactacgatgctggtcagccgcacgaccactactacggtgaccactactacgaccagggcaatggccagcagggctacgataatcggggaagacgtcgaggtgattcagaagaagactcggagacatttagtgactttaccatgaggtctgaaaccgctcgtgccgccgacatggactactatggtcgcggtgatgaacgttacaacagctatgctgacagccagtatggtggacgtgggtacgggtaccgcccgccgtcttcccagatctcgtatggggccaacaggtcctccggagcatcaaccccagtgtacggcatggactacggcaatgctctgcccgccggtcagcgatctcgggagccttaccctgcgtgggcgtcggacggtcaggtccccgtttccaaggaagagatcgaagacattttcctcgatctcgtaaataagttcggtttccaacgagacagcatgcgcaacatgtatgatcacttgatgacgatgctggattctcgcgcttcccgcatgacgcctaaccaggcacttctttccttgcacgccgactacattggaggtgacaatgccaactatcggcgctggtattttgctgcccacctggacttggatgatgccgtgggattcgccaatatgaagcttgtgaaaagctga

SEQ ID NO: 1267 - DNA, 396 bp, A.fumigatus
  unsure (8): Identity of nucleotide sequences at the above locations are unknown.
atgatcancggctcccgcggcagcgagggcatccgggtcgtcctctcagatgaatcagtcagcgtcgaacccttagacatcacaaaggctaaggccgcagagtctatcctggagcagttgcctgaaaccccggacttcctcttcgtgactggcggttcccgcggggacgaagcgctcttccgctgggccaaccgtctgcagggcgaaaataagattccggacgtgaccacggtcaccgtgggctctcacgccacagaggccacggcagttcttcccaccggcatgagcatcgcggacgttgtcaacaccctgacttcctcgagcgtgaatggtgcgaatattgccaacggccatgaacctcctgtcaatggtgacaactccgccctttcctcatga

SEQ ID NO: 1268 - DNA, 855 bp, A.fumigatus
tctcctgatttcattacttacagtatggttgccagatcaagattctcgcccaccatattctatgctaacacgccgcagtctatccgcgaaaagtccaacctcgaccccaacctggttgaagatgtctgtgttggtaacgtgcttgcgcctggttccgcatacatcgcccgctccgcggtgcttgcagctggcttccctgtgacggccgccgcctccattgccaaccggttctgttcttctggattgctggcgatccagaacgtcgctaatcagatcatggctgggtctatcgatatcggtatcgcggtcggggccgagagcatgagcaccaacgccgatggaggggccccagagatgtcggctcagatcctgtcgcatcctattgcctcccagaacacccaacccatgggccagacctcagagaacgtcgcagcccagttcaacatttcccgagagcaacacgatcagtttgccgccaagagttatcagaaggccgagcgcgcgcaaaagtccggttggactgccgacgagattgtgcccgtcaagactcaagtcaaagatcccaagacgggcgaggtgaaggacgtcgtcgttgatcgtgacgatggcattcgatatggcaccaccgttgagtccctcagcaagattcgctctgcattccctcattggaaacccagtggccccacccggggaaaatgccattcgaatccccgatgggcccccggtgtttttcctataaaccggtcccttgcccaagaaatccggaacaccaccattggcaaatttgggcgaacaactttttccgggtttgggaaccccgatttttgggttttgggccctcccttggatatcccc

SEQ ID NO: 1269 - DNA, 705 bp, A.fumigatus
ttgcgtacgcttagcgcgcgaccttcgaccctcgtggtagaagacgatcctatgggtgtgatgcgcttccacttcaagagtgcaactgatcttcggaacctggagaagatgggcaagtctgatccatacgtcagggttctgctgtctggaattacaaagggccgtacggttactttccgaaataacctcaaccctgagtgggatgaggtggtatatgtccctattcacagcgcccgtgagaagcttactttggaggttatggatgaggagtccctcaacgctgaccgcagcctgggctcatttgaaatcaacgcttctgactacgttcatgagaatgagaacggcgagtatgagaccgacgacgagaagcagctcatctcaagtcctcttcgcttgggccaccgtgaaaagggtgttctcaactacaccgttgcattctacccggctgtgcctgtagttaaccctgaggatgaggaagaagaggaagctgaggagatggaaggtctcgatgtcccagcagtgaggaagagtatcgactctaggcgcaaaagctctcattccaagaaccctagcgtcgattctaaggcgtcaaaatccaccgccaatggccaaaacggtgctgcgacaaacggtactacgactaatggtgatgaactcaaggtacctgtcttcaccacaggggggcgaacgatccgcgctaagcat

SEQ ID NO: 1270 - DNA, 762 bp, A.fumigatus
aagagatgtttgccggcccaagattcgttatcaatttggttaccgtgccgggctgtcttggctgactgcaggcatggtttcggtaaagacatatacgacgccagtgttgctcagacatgcatttcgaacttgctcgctatcggctaccgtcgtttcctaattgacatatactggtcggtggagcagcgaaattggatcctttgcccagtcgcaaaaccgcaggacgctcaggttgtcacagtctcgaccacgcgttctcccacagccacggccagtgcagtcacaggcaccctcacagcagtcgccgctccgtcaggctcgctactctacgagctcggtccctatctttgctccgataatctggacctttctgggctagttgatattttcgcagagcatttccgagtcaccaactctcaatggaatgtgtatacgacgttcatcacggtaaaccttcatgtggcatcaagtactgcgtccttcgatcagccagctgcatccgtcaccaacgagcagctgccgttaccgtcagaatacgtgagcgctttgtttaatgcgcgtctttctacatacatatacaggccgtccgaattagccaaggagcgcaagaacctcaacgaatcatggtatgcagttgacgatggataccagcctatcacggaatacttcacccttcacgaggatgcgaatggaaagcaaagtacgccggatggctggccctcttcgaaatatgtgcaactcgcgcaagagcggcgaatcttc

SEQ ID NO: 1271 - DNA, 660 bp, A.fumigatus
agaatcctgcaattcttccagcagatgtgcggtggtaatctgatctctgtgtacgcctcaacgatatttgagcagaacctcggcctcagcgccagcctgtccaagaacctggccgcctgcgccttaacatggaaattcatctgctgcttcatcgccttcttcaccatcgaccggctcggccgtcgagtcgtcttcatgatcagcggcactggcatggcgatttgcatgattgcgctggccatcaccaacagccgcggcacagataacaagggcgcgtccatcgcctccgtcgtcttcatcttcctcttcaatctcttctacccgatcggcttcctcggcggtaatttcctctactgtacggaagtggctcccgttcgactgcgtgtggcaatgtcgtccatctcgacggcgaaccactggctgtggaactttgtcgtcgtgatggtcacgcccatcgcactggacacgatcgggtaccagtactacgtcatgtatgccgtgctctcggcgtgcatcccattgctggtgtacttcttctaccccgagactatgaaccgcaacctggagttgctgaaccatgttttcagggacgcgtcgtccccctggaaaattgtttctatggcgaagcatctgcctcagggtgaggtcaccgatgcataa

SEQ ID NO: 1272 - DNA, 315 bp, A.fumigatus
agcatgatgggtttctttccggtccacggacaggacgtttacctgatcactccgccatttttcaaggaggtcagcatccgcaaccaggtgacgggcaaggtggcaaccgtgcggaacaccaatttcgaccccagctacaaggcgatctacatccaaagtgcgaaacgcgacggcaagctctggacgaagaactggatctcgcatgattttttcgtggacgggggcgttctggaacttgagctggggccggctgagagcgcttggggcacccatgtggaggatttacctccgagtctaggcggctacaggatgtag

SEQ ID NO: 1273 - DNA, 972 bp, A.fumigatus
  unsure (956): Identity of nucleotide sequences at the above locations are unknown.
tgttttaagccccggggaaaagtccgttgttccacaccccttacgcagcacattggacagcagcccgcaagcgagccagcggtcttcaggctgctagttctcgcagacccccaactagaaggtgatagctctctccctagtccggacaaagagctctccgcccgaatcaagcagcactggacttcaatcaggtcgtctgtaacggattccgggtcgcccttccaccgcgatgtcttacgcaacgtaactgccgcgcttcgcacactcgcgcacgaagacgttccgcggtcgattcaggccgcgagaaagcgacttgatttagtcgggaacgatttctatctcgcgcatatataccgtacgctgcattggtggtcacgccctacgcatgtcacggtgctgggggatctgattggaagccagtgggttacggatgaggagtttgagcggagggcagacaggtactggaaccgggtgtttagagggggcgagcgggtcagtgatgacattacggttaccgggtcagcggggtatggagcaggctccggggatgtgtccgcgttggaggagctgaatgcgacggactcggcttggacgcggaggatcatcaacattgctgggaaccatgatattgggtatgcgggagacgccagcgaagaccggattgagcgatttgaacgcatatttgggcgcgcgaactgggatattcgctttcagcataccctcgggaaccaagccggtggcacggcagacgctactgtcaagcctaccctgcacctgatcaacctcaacacgctgaccctggacgggccagccctatccgaacaagtccagtcgaacagttacgcctttatcaacgatctgatcacccatcgcacgtaccccgttgaagatcggacaacctttacacttctcctaacccatctgccgctacatgtcttcaccgcggggttgcaagnggcgtgctataataat

SEQ ID NO: 1274 - DNA, 189 bp, A.fumigatus
cgagggtgtcaatgctgctacatcccaagcgcctctgcgctcttctccacctcaaccaatacgttcgtcacctcctatcgcgccccctcgctttattcgccagggtacacctccaacgccttctcatcccacaccttccgccactgttcctcactctcgccaacgagagtcgaccacaatcaacgatag

SEQ ID NO: 1275 - DNA, 813 bp, A.fumigatus
ttttccagccggctggtgaagactcaatttcttaaggataagcctttgcgtcgtgcaacaatgtcaagtcttcctcttcctgttacctcccagagagagcctgctcacacgcaaagttccagcacgacaacatgggccattcccccacccaaccacacctttgtgccgaagagctctaagaatgtggatctttcttctgatgccacaatacccgcctcagaccctgctcttcaggacgacatgagtgacgagggtgtcaatgctgctacatcccaagcgcctctgcgctcttctccacctcaaccaatacgttcgtcacctcctatcgcgccccctcgctttattcgccagggtacacctccaacgccttctcatcccacaccttccgccactgttcctcactctcgccaacgagagtcgaccacaatcaacgatagcgggtacttctcttccctagagtcttcggcaatgcgtccaaagaagacagggcatatattaacgtcggacctggatattgacccccctcgtatcaaacgtggccgagcagaagaggagatagcacgaattcgaagctcttcccacgatatcagtccaagacgtcccgggatgctcacagatgctggggtagtaacggggtcttcgccggctcgcggtgaatacgtcagcatgctgcctcctcctctgacgccggtgaataaattcaagaagccagttaagcccccgccgtccgtgtctcccaacacaaaccttccggaatcaccgcaagaaaatccaacaaatggtcaattctcccttaaaaaaatcggggcttaa

SEQ ID NO: 1276 - DNA, 246 bp, A.fumigatus
ccctgtttcttttcgtttgagggatctacgacgcaggttgcttacacatctacagagtctggtttcttggtgttcaagttccacgaggctcagctctctcgatcgaatgtgcagttggaggttctgatggacgaccacatgttcccgtcatactcgacacctaagatccgctcaaaagctgccaagctcgttgatggtttgtcacccgagggtaaatctacgggaaaagaggctgactcctattag

SEQ ID NO: 1277 - DNA, 663 bp, A.fumigatus
  unsure (592),(609): Identity of nucleotide sequences at the above locations are unknown.
gatgaacaccagtatattgagtatgcccgtcagcagaaggcgtacaagaagcttacgacaatatttacggatgctttacgacttcaccctaccagcgtggacctatggatctatgcagcacaatacaatctggatgatcatgcagatatgacaatggcgcgaacctatatgcagagaggtctgagattttgcaagagctcaaggaaactgtggctgcactatgcgaaactcgagttgatctacatcgccaagcttgtcgctcgacagcggatattgggcttggaccagaagattgaaacgactaacccggctgaagggtctggattcgatgaccctaatgccgatatgatcgctttacctaaaattaccggggaagatatcaaccctagcgccggagatgaagacggagttgatcatgttgctctggaaaaattgaactcgacgcctgctttgagcggcgcggtcccgctggccgtctttgatacagcgatgaagaacttcaacaacgatgaccgcttcggccacgaattctacgacatggtctccgaattcgaagacctaccgtgcctgcgcaagatcttgggacatgtanttgaggtgatgtcgcancacaaaccaaacagctaccatacgcatatctgcaacatcaaatacccaactgct

SEQ ID NO: 1278 - DNA, 738 bp, A.fumigatus
  unsure (622): Identity of nucleotide sequences at the above locations are unknown.
agacaggatggtaagggcgaattttctcctctgaaggcgataactgagcgtcatcatccctactttgtcgagcttctggctactgaggcaggtgtcgagcccgccgacattcttgacttcgaaatgattctatttgacacccaaaaatcttgccttggtggcatgcatgaggagttcattttctcacctaggctggataacctcaacagctctttctgtgccactgttggcttgatcgagtctgttgctgattcctcggcactggatgatgagacatctatccgactgatttcattgttcgaccatgaggagattggaagccgtactgctcagggcgcggactcaaacctccttcccgccgtcattcatcgcttgtcggttcttccttcgacttcgtccgaccaagacgatgtatctacagcctatgagcagactttgtctacctccttcctcctatccgccgatatggctcacgcagtacacccaaattacgctgcgaagtacgaatccgatcaccgtccagagatcaacaagggccctgtcatcaaaatcaatgccaatgctcgctacgctacaaactcgcctggcattgttcttcttcaggaagttgctcgaaaggcancggaaaatgggggcgaaagaatccctctgcagctcttccttgtccgccacaattccagctgcggtagcactatcggacctatgcggtctgcctgcactaagtgccccaacccttga

SEQ ID NO: 1279 - DNA, 1227 bp, A.fumigatus
  unsure (407): Identity of nucleotide sequences at the above locations are unknown.
tgcctcaagcccttcggggataacacatttgtccagatgaaaaggctgcagctccttcgatggagcagttcggtccgttcaccacggccacgaactaacagccgcttgcaccagcgtgtatgtgctagtttacggtatcaatcgacatcttcgcctgttactcaggccgaagaacaccagtcgattgaagagcaatctttgcgttcaccaatacctccttccaactcacgacagtcgagatacctcctcccttctcccccggttgaagccgcgcgtgagtccgcaaaacttgccgcgctccatgcacgactttacctcccatctcgattacccctagaaacactagctcgtgcactggtagacgcttcagcggacccgaatccagatttcaacaatgaatcgctggntacgttgggccatgaccttctcacgaactacacctccgaacacctcatatgcacatatccccgacttcctctgactgtaatctttgcggccatgtatgcgtatgtcggaccgaaaacactttccgcgatggctagggaatggggtgtcgagatggctgtcgcccctggaggagaggttgaccctggccttctgcagttcaggagggtctctcccggcacggatctaaatgcagaaccagtcacaggtacagcgaggcccaacgaccatcggaagtcatggaggaagtcgattacatccagagtcgtctacgataacgagttcggtgatccggtcaaggaagtcgccgactcagcggcccaggctgtctctgaaacccacggcgctcaaggcgtcacggccgaacaagccagtgctaccttcgtgcgcgccgtcatgggcgccatctatctgcatgctggccgccctgctgccaagcgtttctttgagcagcatatcttgtcacgacacctcaacatctccgagttgttcaatttctcccagccagctcgtgacctcacccggttgtgtgcgcgagagaacttcgaacgccctgtcgccaaaatcatcagtgaaactggtcgtaagagcagacaccctgtctttgttgtcggtatctactctggtcaggataaattgggcgaaggcgctggcgccagtctgatggaggcccgatcgagggctgccgtggccgccctcaagggctggtatttgtacagcccgctgaacgttcgtgtgcccagctcgatggaagaagagggcgctgcgccctggaagcgtctt

SEQ ID NO: 1280 - DNA, 582 bp, A.fumigatus
cgattccagtggtgcgacctctccaaaacagacgcagtctcgacgaatcagtcagccgctcatctgtcgaagcgcacgcaccggttctttgattcccgggggcccgacgggtcacgcgcaccccggccagacgcgggtgctgatggcgtacgggcagtcatccaaggtggtcaagtcctgaccttcaagcgcgaccatcacaaactcttctcgcatcatggatacatctacaccatgcttcttgtccgaggcctgcttgaatcatcgcctacggaggaggtgcttgtgacgggcgctggcgacggcgtggtcaagctgtggcggttggaccaggacgaggcgccgtccgaaatggcagcgctcgagaacggggatccggttcttgcgttggccgtcgacggatcgttcctctactgtggtctgtccgggggtgcgctaaacatttggaatctggactctcggcagctggtgaagcgcatcaccggacatacaggtgacctgtgggctgttgatatcgttcagggattggtggtttgtggtgattcgaatggagtcatcaaggtatgttcttggctatactga

SEQ ID NO: 1281 - DNA, 237 bp, A.fumigatus
tgttggagcgtgtctgatctcgtgaccagaaatttaattctcgatttgaagaagtgggcagctggattgctcaccgaggaacgatgcttgcgtctgcaacccgcccgtttcagggaccggcttatctaccccagtgggggccatgacattaccgtgggcaatttggatatgacgggaggtgtcttaccagccgaaaggaccagcccccgaccattaacgggtaagatcgagaacatt

SEQ ID NO: 1282 - DNA, 201 bp, A.fumigatus
  unsure (29): Identity of nucleotide sequences at the above locations are unknown.
cgaacattgagcaatgaacacactattancatcacgcagctgatggaccatgctcgaaatcatataagcacccaccgaggtactcatggccggctgggatgcaagattgaacgtacccaggcttacgagggccagattaccaccacggcttatgacattatcctcagcaagatccagcaactgcaaagcgtatgcgtatga

SEQ ID NO: 1283 - DNA, 441 bp, A.fumigatus
cactccgtggactttcaaggaagagcgcctgcatccctcatctcattagtggtactacgctattgttcctcggcccctgcagcgtatttaagaatcccaggaatcaaaaacaacgctcatcgcttgttaggcacaaagcaagcttgcttgtttcgcgataaatatgattatataacatcgactggtttatcgatatatgggctttcggcggactccatcaaagcaaacagctcgttcaaagccaagcagagcctcccctatcctctactatgcgatacggcgtctactctcatttcgagtcttggctttaagaagactcctagaggtacgacaaggggggttttcgctgttgataaacaagggaaggtctacttttgcaccctggaagggcaaatgccacatgggaagctgttacgcaatttatctcgccgtgttacataa

SEQ ID NO: 1284 - DNA, 207 bp, A.fumigatus
gccagtcgcaaacatcggggaacggagttcaccagggaagtcattatcggtgatgattgctggattggagcgaatgtgactatcttggctggggtgaccattggatcagggtgctccatcggtgctggctctgtggtgaagagagatatcccgccgtatagtattgcagtgggaagtcctgctcgagttatcaggtcggcagtctga

SEQ ID NO: 1285 - DNA, 195 bp, A.fumigatus
  unsure (9): Identity of nucleotide sequences at the above locations are unknown.
ctattcgtncacaggcgaatctggccccagaacgaataccttgatcttgggatctacaatactatctttagagctctctctcatattccctcttttctttctccgattgcctacgaaaaaaataaccgattgttgatttctctcgcgaacaggcggtttgactcgaatatcgtgctatctcaagaagcagaatag

SEQ ID NO: 1286 - DNA, 243 bp, A.fumigatus
ccagggttgcggaatgagcgactctgtaaactaatgtttagtcttactaagccacaactgacggggttggttactttccagtacctcctatggtcttatacttcaaaacaataccatctcttattcaagccaattatgatgaaggatggcatcagtgtcccacttcctgtcgtcatgtggcataggtccttgatcatcccaccccactgctctagtcatagggactgttcttgttcctgttga

SEQ ID NO: 1287 - DNA, 240 bp, A.fumigatus
tttttttattgcacggacccttccagccccgcggtgaagaccaccgacaagtcaccgatccgaacgcgctctggcgccggtcaaaagaagcgtggcaccaaggagtccgacgaaggtttctcgactgttcctcccaagaagggggccaaacctcagacgaaggaggaattggagaagttccctgatgtccctgacgtccagggcactaatccttttgaggaactggagaaagctgcttaa

SEQ ID NO: 1288 - DNA, 189 bp, A.fumigatus
tcaattaggttacatccgggagtgtgtgtccaggaagatcccctgaaggaatggctcaataatgtcccaagtctaatcaacccctgtacaagcagtccgtccacggcaaaactcccgcctgtcgagactgttcagaactttgagtggaagaaaaaatacagttcagctatcgtgcggatcccccactga

SEQ ID NO: 1289 - DNA, 285 bp, A.fumigatus
gctgtccgggttgctgctgataccctggcggggttggactatgctggtaatgctgctgatgtgggttttgctgaggtggcagctggcctgtgggctgagcagcagtatacccatgaggtggctggcccccatgttgagaactctgctgtgacatttgctgttgctgtaggtggtgctgaggttgctgctgaggctgctgaatgtggtgttaatttgttgccgtttctgggcctgtctgtttgccgttgctgccgctgccgtttctgctgggacggctttttttaa

SEQ ID NO: 1290 - DNA, 903 bp, A.fumigatus
caccacattcagcagcctcagcagcaacctcagcaccacctacagcaacagcaaatgtcacagcagagttctcaacatgggggccagccacctcatgggtatactgctgctcagcccacaggccagctgccacctcagcaaaacccacatcagcagcattaccagcatagtccaaccccgccagggtatcagcagcaacccggacagctcacattccagcaaagccctctgcaggcaaactttcaacaatataaccctggtggttccgtctccgtgccagggagagccaacggtggtcaatcaaatcatggatatatgcctggaattcctcactactcacaatcacaacccactcaagtgctctatgagcgtgctcgcatggcggcttcggcgaaatcttctccaagcagtcgcaaatctggcctaccaagccagcgccgcccctggactaccgaagaagaaaacgctttgatggctggactggatcgcgttaaggggccgcactggagtcaaattcttgcgatgtttggccccgggggtactatcagcgaagccctgaaggaccggaatcaagtgcagctgaaagacaaggcgcgcaacctgaaactctttttcctcaagagtggtatcgaagttccttattacctgaagttcgttaccggtgaactcaagactcgcgctcctgcgcaggccgctaaacgcgaagcacgggagaggcagaagaagcaaggcgaagaagataaggctcatgtggaaggtatcaaaggcatgatggccctcgctggcgcacattcacagcccgttccgctcggacacgggcacgaggcaatgtctgcttctcccagccttccggatactggcagccattctacgttcgatcaaaccgcagaatcttccccacgg

SEQ ID NO: 1291 - DNA, 384 bp, A.fumigatus
gaacgaaaatacttcgattcgggcgactatgcattgagcaaagccggtaaagcttcggatgtcggggtcactaatatcggttctaagcaccctgttccggagaacatcccgcatctgactgctacatcccccggtgcaaacaatcccgctgctgccagtaatggtagcagtgccagctctcaaggccaacagcaccatggcagtattagcggtcaccctggctcgattggatttcagagtcggagccccgtgaaggaagcaagctacttacaacgcggaactagcgtcgatgatacggagggtgtcgacgattcagcaaagggggggaacgatcccagcgtgagccctcctcctgatcgcgatggtgttcccatccgccgatag

SEQ ID NO: 1292 - DNA, 234 bp, A.fumigatus
cacagatggttggtccagctggctgaagataaaaattatagacggatctttaagaatgctgtattattaaatagtgctttatatatagttaaactatttactaataaccttttaatcctcacatttagcacactaatagttatatctccgcgaatactatgttttaagctccttatagtgattgataaaggtagaaacctagttcttgcctatatagagttaagtacctgctag

SEQ ID NO: 1293 - DNA, 201 bp, A.fumigatus
cccttatccacagctctcaaaactgtgatctacgagtctccccgtcttactttttccctttaccctttcttgtcacagtacattttttcgaacttcaacgttctccatggcggacagaaaggccattcagccgaatcctcacggtctgttgttgaacctcgacgatccatatgcggatctgaaaatcctgtccttgaatga

SEQ ID NO: 1294 - DNA, 906 bp, A.fumigatus
aacaatttcccccccaggttaattcaaccaacccacccgccgttcaaagccctgaaggaaagattaatgctgcccggattcggagtgcatccccatcggcgcggtgtcgtggatgaatttccctccagcgcacttccaacaccggcggaagccacagcgtccggaatgccgatggggcatcatcatcaccaccaccatcaccaccatcaccatacctcacgtccgacagcctccgtggcgaactccgcagctttgtcaccgatgcgtgaacctcgcacggtggttacaattgaacctgttgtctcgagtgtagcccatcttccacggcatcatcttgggtccaccctgtatattccacgtattgatattccttccgcgaaagctcccttggagagcgccaaattcggctacaccactactccgctcccgattccccgattcgagggcaaggaaaactgcacgtttaccgtacgtgtacctcgatttcgtatcgacgcgggtcgccgcgaggaaatatgcgcgcggcgagccctctggggcactggaatctatacggatgattcggaccctgtggcggcagccatgcattctggattcttccgcggtgcttggagtgaagaaattgacgtggatatgcttgacctcgagattcgtgacgcatatcaacacgcacctacgacggcggaggatatgggcttgacaggagaccgaccacggattccgcccgtacctccaacagacaaggatctccacatcacactcctgatcctgccgaagctggaacgatatgaatccagcgtcctttttgggctgaagtctcgttcctgggatggcaaccacgacggcatgagctttaaagtgctccgcgtggagtgggttgatgagggtgttggtcgcggcggtctt

SEQ ID NO: 1295 - DNA, 453 bp, A.fumigatus
cagcgtagtcgacgcgtttacaccgaagccatccaaccagctaccatgccatccacaccgcatcaaacctctgggagatgggtggagcaagagggaaggattcaactagcaatatcagcgttgcaaaagaatgaagtggccagcatccgccgcgctgcagagatcttccatgtgcctcgatctacccttcgaggccgactgaacggatgccaatgtcgagttgaaaagcgcgccaatcatcaccggctatctcctacgcaggaagaatcaaggcttgcaacgcctcatgcacttcggcaatcacaaaagcaagcatccttagtcaagaagctcctaaaacaacgatctcaaagcacttcgacgacttcgaaattggccatccagcagattatcaagggttgcgagatgattatgcagggtgtcttcaccacgagggccgacgatccgcgctag

SEQ ID NO: 1296 - DNA, 414 bp, A.fumigatus
gcaggtcgtgctttttgggattcatgtttcgagatgataagttgcgtcgtcattttgctattggccagtctggcagcagccttgtccgccgtccagttccctgacaatgcgaatcacatattcaacgccatccattcctcaatgagacaatggggctcgtccctccatcacaatggcatgtcgtttttcctcgcatccgtgcctgcaggcacccagctgtatcatggcacacaccagcgggatcgagtgaatgggacagaatggctcgcctttgaacccgaacacgccatggtctttgccgcgttcggaccaggtcgtggacctccacctggcggtccggacagtcctgattatgatgatccacgcaggcgttcgttccgtcttcaccacgaagcagccgcatccgcgatagtt

SEQ ID NO: 1297 - DNA, 660 bp, A.fumigatus
  unsure (598),(654): Identity of nucleotide sequences at the above locations are unknown.
atcagaacaatcaagagagacggggggctaattctgacagatgttcttctaatcgacggtctcaccaaacgtttccgtctccccggctggcgtatcgcctggatcgtcggtcccaaggagttcattgacgcattgggttccgctggctcctacctcgacggtggtgccaatgtgccattccaggaggccgctatccctatgctcgagccttccctcgtgcgcgcggaaatgaaggcgctgcaacggcacttcagggagaagcgtgactatgttctaaagcgactgcacgagattggtttccgcgtcaaagatgtgccccaggcaaccttctacatttggctcgacctgacgtccctcgaaccgcctcttcccaaggaggccaatatttccgacggactgaacttcttcaatgcccttctgaccgaaaaggtcatcgtaatccctggcatcttcttcgatttgaacccggcaaagagaagagatctgttcgacagtccttgccaccatttcgtgcgcttgagttatggaccacagatggatttcctcaagaagggtctggacggcatcaaaaaggtaatccgtcgtgctcgtggaaaanccgttgagcttcggcctcacactgatcctcactgggaagatgaagttgccctgtcngattaa

SEQ ID NO: 1298 - DNA, 234 bp, A.fumigatus
gaaaccccacctgcaacggagtatcgagtaacctccattcgaccctccaagttccggttcaccacatttgttacccataacggcccgttcctccaattaataaccccttcatccaagggtgggatcccaaccggggataacttcattcaatcttccatcaaccatttttctcaacttttgaaaattcatgaaggccagaacttgccccccaatactctccccccccaaatttaa

SEQ ID NO: 1299 - DNA, 237 bp, A.fumigatus
  unsure (21),(77): Identity of nucleotide sequences at the above locations are unknown.
tccgtcgtgctcgtggaaaanccgttgagcttcggcctcacactgatcctcactgggaagatgaagttgccctgtcngattaaaccgtctcatcgattaactgccaccctcgttatttcctccttccaacacgttgaaacatgttacagaaaccttccatacgaatctggaataagccacctacataatatcatgtggcagactaagaaaccccacctgcaacggagtatcgagtaa

SEQ ID NO: 1300 - DNA, 825 bp, A.fumigatus
tggcatcttaggcttgacggaaaaggggttttcaaacaaggtctgctttctctacgcacgaaacttcagcagcggtactacacgtcggttgcagccttctcggccgacctagcttccatattcacgtcggaaataggggttcaacctgccggggacactgctgagttgcagatgcagatcagcgggcgcgctcctgaactccctcttgaacagcgtgagaagagaaaattagctaagcgcatcattaaggccatccagcccgctctcgaggatgcgatcaagaaagaaagcgagctcaaccgcaagcccttcgaaaaggaactgaaagagctggatctcatgtttgagaacagcgtcctctcccgaagaggatcagtggaagaaggatctgcaaagccagctgaaggcgaagcgcgtatcgataatccggtttctggtgaagtttcggatggtgtgcaagagaaagtgggtagtaaagcagggcttcctgccaaagtcgagcctcaagaggaatcatccacctcggccctacctgagaaggctgaggatactgccacgcttgatgccgggaacgaccggcatatcccagatgctcaggcacaggatactcccatgactgattctgctgagcttactgcttcggcggctgtgacggagccagaagatcagattgctcctggagcatcggcaacaattcccaccagtgctgaagcacagcaggaagccgggccaagcaaggaggaagctaatagctcgccactactcgcacagctaactgaatcccagaaagggtcctcacactcgtgttcaccacggggctggtag

SEQ ID NO: 1301 - DNA, 810 bp, A.fumigatus
acattggttcaatcccagagttccacggccgtcgcctgcattcaatggacccaacggaaacgttcttcagcggggtccggcggtcgaatcggtggattggcacagcagtgttccagccaaaatctcaagtccaccaagctcaaagtgccgttcgcgttccactcggcccaagtggacccgattctcgagtcgttcgaagagagtgctcagggggtcatcttccacgaacctgccgtcccgttcgtctctgctctgaacggagaggtaatcacggagtcgaactacagcgtgctgggccccacgtatatggtgaagcattgtcgggaagccgtcaatttccttggcgctcttgaggcgacccggcacgccaagttgatggatgacgccacactctgggtcgaagtgggatcccatcccatttgctcgggtatgatcaagtccacctttggcccgcaggcgactaccgttccttcgctccgccgcgacgacgatccatggaaaatcctctccaacagcctctccacgctgcaccttgcaggcgtcgagctcaactggaaggaattccaccaggacttcagctcggctcacgaggttctcgagttaccccggtacggctgggatctgaagaattactggatcccctacacgaacaacttctgccttaccaaggggggtcccgttaccgcggaggtatcggcgcccaagtctaccttcctcacgaccgcggcgcaaaagattgtggaatgccgggaggacggaaacaccgcgacattggtagttgagaataatatcgcagagccagaactcaac

SEQ ID NO: 1302 - DNA, 513 bp, A.fumigatus
ccctttatgaaagctgactgggtacactatatctcagcggtcaagtgcaatgacaacaaaacattgttgactatgttgtcgagagccgggaccgggttcgattgtgcctcgaagaaagagatgcagcagatcctccagcttggcgtcaatcccgagagaatcatctttgctgcccctcgaaaggcagaagaccacattaattacgcccacgagcatggaattgacaaaatagtggtcgatagtgaggatgaattgcgaaaattggcggagattgttccttcagcaacgattttcttgcggttacgggcagacgacccaacctcccgagtacgtctttcggagaagtttgggtcggatctcctcgaggctaggggtatattgcaagtggccgtcgacttgtcagtcaaagttactggtatctgctttcatgtgggatcggctgcttcggatccaggagcctacgtaagatctatcgcaatggcccgggaagtctacgactataacgagactctg

SEQ ID NO: 1303 - DNA, 486 bp, A.fumigatus
catccaccaaaaacctctgcaactgtgtgttctcttccctccgtatcaccgcacaagctgaccagcctcccagcatgcaaaatcttccgtttctgcagcgaaccatgccacaaagccagcctgcaaaaacacctcccctactgcatcccctccgtgtccctccgcgagtccaaatccctcgccgtcaagcctcgctgcccaccctgggttcgagaccaggctctctcaaaaatccgccctctcgacagggacaggaccgtagacgtactcgccagctacaccttctattttgacccgcgcaactttaccaccttccggatgaagctcagctccctcacaaacacccttatcatcttctctctagactccgacatccgtttcgcaacaatcgacagtagcttatcaccatcatcatccggacatggcaacacaagctcttcgtcgccaacaactgccagcgccaacccccggggaatccaatggcta

SEQ ID NO: 1304 - DNA, 864 bp, A.fumigatus
tcgaaggctccttgcacccccgcggtgaagactttggctttgcatgacaatgcgcaggaatccgtggcttcttcccttcctggtgcgactgctcagaaccatcagtctcagacaggccaaacaaacgagccgacaaagtctcctagtcatcgccaaaacaatagtaacacgttgcttggcggcatgtcacccagcgaggctgctgttcagtggccacttgatcgagtgctgctatggcttgcgaaaaatggtttctcgagagattggcaagaaacgttcaagactttgcaaatcgagggagctgatttcctcgacataggtcatggggccaatggtcggggcaacttcaacaaaatgcacaacgaagttttcccccagctagccaaagaatgcgaagctagcggaacaggatgggacaaggaacgtgagcttggggaaggcaaacgcatgcgtcgacttattaggcagattcacgatgacgaaagctttgacgtcgggatccctgctcagaaacgtcgtgaatcccaagccccatctgaaggggcgccggatacctcacctaagttatctcatgagcctcagtctgctggaccgcattcagggacgattgaaaatagccccaacctcagagcacctcagctcgctcagccccatagacacagtgtccaaatgcgctccgtcacattgcccatcccgaccactcacgatattgcttcatcacatttcagccacaaggacggtatatcgtctcgatcagacttctcgcgatcggtattagttggccttggggttgatcatcgtcagcagaacccatccatgtccagtgacaactgcaatttggtagccccttttcgatcgtattaa

SEQ ID NO: 1305 - DNA, 198 bp, A.fumigatus
  unsure (118),(142): Identity of nucleotide sequences at the above locations are unknown.
ttttggcttggttggctcaacagtgtcataggcaaaagcacgattgaagcttcaaataatcctgcgcagaccgatcgattgttcttgatcctacggtatatttacaggatggactggnctatgcaatttaccccacggccgnttaggctaacgaggagggctaaaatttcgacagggctaccccttgaagcaaacctc

SEQ ID NO: 1306 - DNA, 318 bp, A.fumigatus
  unsure (285),(310): Identity of nucleotide sequences at the above locations are unknown.
gtttgttacacctcgttgcagaatttgaaggattctaaaggcagtttcggcatgacttgggaaaaagatggcacatcgccttctcagcatccaagcgatatcgaagcttgcggtacgccagatgcctcaaagtctaacaacgatgcggccacggaaggtccaacttctgcattcaagccgctcgcccttctagatcgattccttgcagtctggatcttcctggctatggctattggtatcattcttggtaactttgttcccaacaacgagcaaaactcctggaanaagggaaaattcctttgtggtgtcngtggctaa

SEQ ID NO: 1307 - DNA, 972 bp, A.fumigatus
gacggaggtatcgtgcgcagtatagtcggactagatgtcttcaagcggacgtacggctaccagcatgaaggtgtatacatcatcgccgcccggtggctgtcagctttcaactacgccacgctcctcggcgccatcataggagctctcctgtcaggattggcttacgatcgtttcggtccacgcgtgatgattaccatttgctcatgcctctccatcggcttcatctttgtccagttcttcagccacacgcccgcccaactgtttgtcggcgagctggtgaacggctgcatcatcgccttctacccgatctgcgcttccacgtacgtaagcgaggtcaccccgctcgtgctgcgcgggttcgtcgcgacaatgaccaatctcgccttttcgatcggctcgctgattgcgtcggggatcctcaagggtgcagcggccatggacaccacatggtcgtacaagatccccatcgccgcacagtgggctctccccacagtcatgctgctgctggtcgcattcgtccccgaaccaccgtactggctctgcaagcatggccgggatgacgccgcgatcatctcattgcgtcgactgacaacggcacctgcggccgaggtctacgtggctcgcaaactggcgcatattcgggagacattacggctggaggaaagcttccagggcgaccgaccgacgtatcgggaatgcctacggggtccgaatctccgccggctggtgatctgcgtgatggcatacaatatgcaggcgttcactgggaacgtctttttcatcaactacgcagtgcatttcatggaggtggcggggctggacgcttcgcatgcgttctcgatgaatattggtctgacggccatcggactgctcgggacgtgcctctcatggtttctgctgtcgtacatcggtcgtcggacaatgtacctgttcggctgtgtcttcaccacgcgccggcaaggaccagcagta

SEQ ID NO: 1308 - DNA, 723 bp, A.fumigatus
  unsure (695): Identity of nucleotide sequences at the above locations are unknown.
tctgagctggctcgatgcagccaaagtatggattcgtggctcagcgccctgccgaaggatgcgcaatacattcccgcatccaaaaccaactttgaggatggagaagatgttcttctccttcatggcgccatgctaagaatgctctatcatgcgaccataagcgcgctctacaggccgtgggcttatagccgggatccagacaaatcgcgctttgaaatcacgcaaaatgcgcggtcgaagatgcacgatgcggctttaggtatcacgcacattatacaggggctcaatcaattaaatctgactcggttcctccctcagtctggtgtcactgtgatcataccagcagccgtggcgcacctgtcaaatatcatgtccaacaaccccgccgtccgagaaactagtcttcagcactttcagagatgcatccaggtcctacggggactgagggatctctatcccgccgcggacatggaagtcgccaacattgaggcagcagtcaaagtgcagtccgatagcgttagcactttcctcaagattatggaatacagcaatgttagcatcgaccagctgcaacccccagaaccgccattacacaaacaaagcattgattcaaacatgcatacggcttgttcaccagagggtagttcaccagatcggcgagggtccttcgtgggagcaacggatgcgcagcccanagagcaccgtactgggtccttacaaacg

SEQ ID NO: 1309 - DNA, 264 bp, A.fumigatus
cgtgggcagctcagggagcgcgaattccgagcctccctcctcttctcccgcgtgcccttcctcctcccagtgcccctcttcgcccccgaaactgatttcaataaatcccacatgcaccatgtatccgaccagggcggcgacgccgcccgctacagccgcaatggagacaagtatgtctttcttctgcccggtggcgtactcggacaaggcgcggctctctatccccgacaaccccgagtcaggcgactgcgccgcctgtcgtaa

SEQ ID NO: 1310 - DNA, 543 bp, A.fumigatus
gagcgatgtccttccagcccggcaattgaagacgctacggcctctgcgggaagtcggagaacggctccacgagcgaggtcgccgaagtcctgggcgcgcatccggacgtgcacgaggccaatgtctacggcgtcgcattgccgaaccacgacggccgtgctggctgcgccgccatcgtcttccagcagcagttacaagccgccaacccctccgaactcgctgcgccgtcccagaacgtcctcgacagtctcgcagcccacgtcctcaaaaacctgccccggttcgcggctcccctgttcctccgcgtcacgcccgagatgcaagcgacaggcaacaacaagcagcagaaacacgtcctgcgcaccgagggcgtggaccctgcgctcgtcagcggcaaggataagctgtactggctgcaggggaacacctatgttccattcgagcagaaggactggaaccggttgcattccggacaagtcaagctgtgattttatgattcttccattgtacccctacttaatggccattactttcgtgccttga

SEQ ID NO: 1311 - DNA, 402 bp, A.fumigatus
agcgatgtccttccagcccggcaattgaagacgctacggcctctgcgggaagtcggagaacggctccacgagcgaggtcgccgaagtcctgggcgcgcatccggacgtgcacgaggccaatgtctacggcgtcgcattgccgaaccacgacggccgtgctggctgcgccgccatcgtcttccagcagcagttacaagccgccaacccctccgaactcgctgcgccgtcccagaacgtcctcgacagtctcgcagcccacgtcctcaaaaacctgccccggttcgcggctcccctgttcctccgcgtcacgcccgagatgcaagcgacaggcaacaacaagcagcagaaacacgtcctgcgcaccgagggcgtggaccctgcgctcgtcagcggcaaggataa

SEQ ID NO: 1312 - DNA, 459 bp, A.fumigatus
agacgctacggcctctgcgggaagtcggagaacggctccacgagcgaggtcgccgaagtcctgggcgcgcatccggacgtgcacgaggccaatgtctacggcgtcgcattgccgaaccacgacggccgtgctggctgcgccgccatcgtcttccagcagcagttacaagccgccaacccctccgaactcgctgcgccgtcccagaacgtcctcgacagtctcgcagcccacgtcctcaaaaacctgccccggttcgcggctcccctgttcctccgcgtcacgcccgagatgcaagcgacaggcaacaacaagcagcagaaacacgtcctgcgcaccgagggcgtggaccctgcgctcgtcagcggcaaggataagctgtactggctgcaggggaacacctatgttccattcgagcagaaggactggaaccggttgcattccggacaagtcaagctgtga

SEQ ID NO: 1313 - DNA, 252 bp, A.fumigatus
ctgagcagttctatgagaacaccggcgatggtacttcgtaccatggatactggcagcagaatatgtgagttctctttggccgcggtgattcatactattcgacgaagccacgaggtcaatgccaattatggaacggcacaagatcttagatatctggccaacgctctgcacgcgcgtggcatgtacttgatggtcgatgtggtcgccaaccatatggtacgccgtcttctcgagttgtacattataatctga

SEQ ID NO: 1314 - DNA, 246 bp, A.fumigatus
ctggttaagggctacaacggagcgggaaactcggtcaactacggtgtcttcactccgtttgattccgctacctatttccacccatactgtctcatcaccgactacaacaaccaaacagctgtggatgactgctggctgggagacactactgtctcgctacccgatctcgacacgaccagcacggcagtgcgaagcatctggtatgattgggtgaagggattggttgccaactactccagtcagtga

SEQ ID NO: 1315 - DNA, 195 bp, A.fumigatus
atgatactgaccgagatagtcgacggcctgcgcatcgacacggtgaagcatgtcgagaaagacttctggcccggctacaatgacgctgctggcgtctactgtgtcggtgaagtcttttcgggtgatccacaatatacctgtccataccagaattacctggatggtgtactcaactaccccatgtacgcattatga

SEQ ID NO: 1316 - DNA, 183 bp, A.fumigatus
tttccgtacggatttgatcctgacgagagcagatactatcaacttctttacgcgttccaatcgaccagcggcagcatcagcaatctgtacaacatgatcagctccgttgcgtctgactgtgcggatcccactttgctcggcaactttatcgagaaccatgataacccccgatttgcctcgtaa

SEQ ID NO: 1317 - DNA, 666 bp, A.fumigatus
  unsure (12): Identity of nucleotide sequences at the above locations are unknown.
gtaccttttagncccgtggtgagcacatctgccatgagagagtccatcctttcagtccttacgttcttctccctcctgctcattgtccaagcaagagatgatggccggatgaaatacaacttcaactccgggtggaaagtactcgtgggcaatcccgcgtctgcacagtcgccgtccttcaacgacaacgattggaaggacgtaaccctcccccatgcgtggaacgaagatgatgctttccgcgtggacattgccaacccgtccaccggaattgcctggtaccggaaacactttgacctgccagccacgagccggaataagaaagtctttctcgagttcgaaggcatccgtcacgccggggagttctaccttaatggcaagtggatcggtcgcagcgagaacggggtcatggcctttggctttgatgtcagcgatatcacgctctacaatcagaccaacgtcctggcggctcaaatcgacaatagctggacgtacagggagaaggccaccagcacgccgtaccagtggaacgacaagaatttctatgccaactacggcgggatcaacaagaacgttttcctgcatgttacagatcgactgtaccagactctaccgttgtactccaatctgcagagcttcacggcacgggccggaaggatacgcgat

SEQ ID NO: 1318 - DNA, 333 bp, A.fumigatus
agacactttccacatgctcccgtgctgacaatttgtagttacaccgaagaccagatgcgcgctgttcagatagcccaccgagaagccaagaactggtccgactgggtggcgctcgggacagtccgagtgctcagatggggtatggacttcgtgaccgggtaccgacaccccaagccgggccaggaacacgacgccaaattcagaatgaccgagcagaagtggcttactcgatttattttcctcgagagcgtggctggcgtgccaggcatggttggagggatgctgaggcatctgcggagcttgagacgaatgaagagggacaacggatggtga

SEQ ID NO: 1319 - DNA, 402 bp, A.fumigatus
tcgagcttcccgcagttcacgttgttgctaacaatagccaggattgaaactcttcttgaggaggcatacaatgagcgcatgcatttgcttaccttcctcaagcttgctgagccaggatggttcatgcgactcatggttctcggagcccaaggcgtcttcttcaatgggttcttcctttcatacctgatttccccacgcacctgccaccggttcgttggctaccttgaagaagaacccgtcatcacctacactccggccatccaagatattgagacaggaaagctgcccgattgggtaaaaattgggtgccccccaatattccccgtcccattctgggaaatatgcccaagggggctccgcaagaagaaaacaacttttggctggttacctgcgggggctgaa

SEQ ID NO: 1320 - DNA, 255 bp, A.fumigatus
agacggacagctgagagtatagtccgtatcgatcgagagaatctcgaagctgcgaatttttcctctgggctgagtctcactatgttgaacggccaacccatgactggggagtcttacacgtcgtgggggatgacgcaagaagaattggatcatccctggtgggggaatccgcaagttatcaatcctgccaagcccctggcccaaacgggaaaaatgggtaaaccccgttccaaaaccgctaagacattggggtga

SEQ ID NO: 1321 - DNA, 360 bp, A.fumigatus
aatttcctcgagttttacccatgttctctgaatgatctaacactaatagattatcttcatgtgacaaaacgttttggcatagtagctgtggcgcaactacccactcattttgtccttgcaattaaatctcgatacaaccctttagcactgctcttcaacacttcgtatgagagactgctaccatggcaccgaatatccggcagactgatattccttctgatcgttgtccatgcgactttgtacctaaactactttatccagacggcaacgctgcaagagcatctcgcctctctcaagatcatccttggcattgcatcattcatgtcccttttcgccatgatgagcaccagcatcgaaggg

SEQ ID NO: 1322 - DNA, 342 bp, A.fumigatus
gagccgcagtctcaatccgagacactcaatgacaacgccaacgaaaatcacggccaaagcaccacaaacaaagacgggagcaagaagagaaagaagcttcctgctgtgatggaacgcgacgaaggcggcgatgtcgagtctcacacaaccgccagaacacccaccaaatccatccagactccaaccaagccatccagtgtcggaactcccgtcccctctagtgcgaagaactcgatcggagcaaagaccccaactagcgccataacccgtccatcccatgacgagatgcatccgagcaagcttcaccagagtattcgacacgccgctggcaagacaaacgta

SEQ ID NO: 1323 - DNA, 270 bp, A.fumigatus
  unsure (36),(42),(61),(144): Identity of nucleotide sequences at the above locations are unknown.
tgccgcggccaaatttacttaaggtatatagcttgntgcgcntataatccccccaccattntacgccaggaaacaaccgccaacgcgattcacaaaatataccgaaacccggtaatcccgctcgcaatcccaccatgcaagccntgcaccgcctccctctcctccctctctagccttttattctcccttaccaggacgaaccttaaccaagtccccagcaccgccgccccagcctgcaacccgatacaaatccccagcgcaagccgataa

SEQ ID NO: 1324 - DNA, 600 bp, A.fumigatus
  unsure (546): Identity of nucleotide sequences at the above locations are unknown.
gacggctccttcggcttcaccaacttcttccccaccctcacctcctccctcggctacagccacaccatctcgctcctcctcgccgctccgcccttcatcttcatgaccctctacagcttcctccacagcctcctcagcgaccgcctccaatcccgcttctggttcttcatctaccccatccccatcgccatcgccggcctcctccttttcatgaccaccgactcgctagcagcgaaatacgtcgctaccttcctcatgatgttctgcgtctgcatgaacgggacaacactaagctgggccgccagttccatgccccgcccccctgcgaaacgcgccgtcgcgtatgctttcatgaatggcgtgggtaatacaaccggtatctggacaccgttcacctatcgggaccaggactggccgtattatcggcttgcgctggggatttgtatcgggttgcaggctggggcggcggtgctggggacttggttaaggttcgtcctggtaagggagaataaaaggctagagagggaggagagggaggcggtgcanggcttgcatggtgggattgcgagcgggattaccgggtttcggtatattttgtga

SEQ ID NO: 1325 - DNA, 642 bp, A.fumigatus
  unsure (618): Identity of nucleotide sequences at the above locations are unknown.
tcccccatggttattcgcgtgtcggtcgcctcccgaggtgaagacggaagcactgtcaaacgggtggtactgacatcctcgtttgcctccgtcattgacatttccaagaatcccggacctgatttcacctacaccggcgcccactggaacccaatcacttacgaagaaagcgtcgaccctgccaccagcgcggtagtagcataccgaggctcaaagaagttcgcagagctcgaagcctggaacttcatggacagagaggggcctcctttggacctcgtcacgctctgtcctccaatggtgttcgggccgattgtacatcccgtggctagcattgcgcagctgaatgagtccaatgctgttttgtggagcgttgcagccggcgctgatccgttacctgccgcgagagtatctgcctggattgacgtgagagatctcgctgaagcgcacgttcaggcgttattgacaccggaagccggtgggaagagatatgtccctgcgtccggggagccattttgttacgaatatgcggctgatatcatcaaggagaagttcctgtgggcgcgggaaacagtgaccacaaactatgaggctgggaaaaaggccgggccgacatacaanctggacggggcgcacagtgactaa

SEQ ID NO: 1326 - DNA, 411 bp, A.fumigatus
  unsure (14): Identity of nucleotide sequences at the above locations are unknown.
gcgtttcacggtcntaacaaacccaatcagatcatcgccgtcgcagccctgctggtcgcccctgtccttgccgcccctactgaattcgacacccgcgcctgcgactacacctgcggcagcaactgctacagcgcgagcgccgtgagagccgcccaggaagccggttatgagctctactcctccgacgagaccgtgggcagcaacaactacccccacaagtacaacaactacgagggcttcgacttccctgtctcgagtccctactatgagtggcctatcctgagctccggaaagatctacagcggtggttcccctggtgcggaccgtgtcgtcttcaatagcaaggatgagctggctggtcttattacacataccggggccagtggaaacaactttgtcgcttgcacttag

SEQ ID NO: 1327 - DNA, 1242 bp, A.fumigatus
tggctagagtatagggtaggagaattggcaaggtacccggtccattgggttcccccaaagccagtcaattcaggatggtcggggagcatgggggaaattgggtggggggatactggattagcagaggccgccaattgggacattttcacagaatttgaatgggggggggagtccacgttatggcgtgcaatcacatccaagtttggagggggaaagtcggacgagcagaagccgtcgtccagtctccaagtagaagtcagcacgagaatgcgcgcctcgacccttggtattcagctccaggaggggctcgtgatcgacaaccagttgctttcagcacccgacgtcccggctaagagaatgattcgattcaagctgccttcggatatgagctaccgatgcggggattacttggctgtgttgcctgtaaacccgagcagcgtcgttcgccgggccattcggcgtttcgatcttccctgggatgccatgctcacaatccgcaaaccgagccaggcccccaaaggctccacatcgattccccttgacacgcccatctcggcttttgaactcctctccacctatgtggaactctcgcagccggcctctaaacgcgacctgaccgcactggcagacgccgccatcaccgacgccgacgcgcaagctgagctacgctatctggcatccagccccacccgattcaccgaggaaatcgtcaagaaacggatgagtccgttggatttgctgatccggtacccttcaatcaagctgcctgttggcgatttcctggccatgctcccacccatgcgggtgcgtcaatactccatctcttcttctcccctggcggatccctcagaatgctcgattacgttttctgtgctcaatgcgccggctctggcggcggcatcgttgccaccggccgagcgagcggaagctgagcagtacatgggagtcgcctccacctatttgtccgagctgaagccgggcgagcgtgcccacatcgccgtgcggccgtctcattccggcttcaagccgccgatggatctgaaggcgccaatgattatggcgtgcgcgggaagcggacttgcgcccttccgcgggtgtatcatggaccgcgccgagaagatccggggcagacgcatctcggtcggagctgatggccagcttcccgatgttgaacagcccgccaaagctatcctgtacgtgggctgccggaacaagggcaaggatgacatccacgccacttga

SEQ ID NO: 1328 - DNA, 288 bp, A.fumigatus
ataccaagggtcgaggcgcgcattctcgtgctgacttctacttggagactggacgacggcttctgctcgtccgactttccccctccaaacttggatgtgattgcacgccataacgtggactcccccccccattcaaattctgtgaaaatgtcccaattggcggcctctgctaatccagtatccccccacccaatttcccccatgctccccgaccatcctgaattgactggctttgggggaacccaatggaccgggtaccttgccaattctcctaccctatactctagc

SEQ ID NO: 1329 - DNA, 510 bp, A.fumigatus
gaggctcttccgtgtgccccggcgtgtacactcgatgatgatctcgacgacataccaaaatacgatgaaacccacccgtcccttgactcctccatcaaggatgtggaaggcaagcctgctactgacgactcccaggcctctcagctattcaaggaaaactccgagcaccgaaagcgcgagtcccaagggtccaacgatagccaggcaactcccgtgccccacgaaagatccaaggaggtggtagatggaccccataacactgacgaccaagagctcgctggtccgaagatggcagcaatcacagaatccctacgacgcccagtgaccccggatatgaatgagccggcctctggtccatgtaccccggactcagtgatccgtcacccgattgatgaagaggatgacgactcgcagacctcttccgacgaaagtgtaccggaacccgttgctactgtcaaggcccccaacggacttaaaacacgcccttctcttacaccggcggatgtatag

SEQ ID NO: 1330 - DNA, 333 bp, A.fumigatus
  unsure (164): Identity of nucleotide sequences at the above locations are unknown.
ggtcggatcactagctgtgtttcactgccagatattatgatcaagccatttttcccccaagtacccggatccctttttcgcaccgtcacagttctcataaccccgacaatcacacactgtagcctggctaccgttattgttcttggtgtacgtgtgcggcttgnacagtcacttccgcccaggttccgtgtggacgtgcgaatcaaggagggaacgcatagtaccgccgatgaggttaataagcaactgggtgataaggaaagagtggcagctgcactcgaaaatggaacattgatgggcgttatcgccaagatgctggaaacatgccaataa

SEQ ID NO: 1331 - DNA, 351 bp, A.fumigatus
aggggccatgttctgtcagacgggccaattgccgggacaccgctgtatacggtgcaaggcttgattcccgttattgactctttcgggttcgaaacggatctcagaattcatactcaaggtcaagctgcggtcagtcttgtgttcgatcgatggagcgtcgttccaggcgatccgctagatcgcgaagtcaagacaaagccactcgagatggcgcccgcgatggccacagcgagggattttgtattgaaaacaaggagacggaaaggtttggcagaagatgtgacagtgagtaaatttctggaaccggagctctggagaggcctgaaggaaagtggcgtcttggattcatga

SEQ ID NO: 1332 - DNA, 564 bp, A.fumigatus
  unsure (513): Identity of nucleotide sequences at the above locations are unknown.
gacgcggatcttccaccccgtggtgaagacaggtccaaagacgctagcacgttcatcttcaaaccggaggattttgtcaccgtcagcgtacggtttacccgcgtcggttatgcacagctcaagagccaagattttccggcacctaagtcctggattggaaagcttcctccaaggaatgaccgaattgcatttgaccgggcggaagtagggatgaaactttcgtgtggctttgaaatgctcctcaccgatcctcagaaccaagacaaggcctctgtgagagaaatgaagcttctattggaagatgtggattctggagatgagagattaccgacggatgaagagatctccagatgggataagagacaggatgatgaaaaatggctagacatcagttttgaggatctcgaccgagagctgaagggcaaggacaagagcaaagccagcgacggacaggccaggggcgcatttggggatgccaccgcgcaagaaaatcttcaacgcatcgtggctcanttcgagaaattcttgaatgatgattctgctggattcgaaagcgccgatttc

SEQ ID NO: 1333 - DNA, 384 bp, A.fumigatus
gtacaaagacccccaatgaacgattgcgcttgtttgctaacccacttcagtgacatcggcggtggtggctatggtcagaacatcggatacggtgtttcggctgacgagatcggagtcatgatcaccaatctgatgtacaacgatgagttcggctactatgatggtctgtacggccaggccaaccctgacatgacttatttcgagaagtggggccatttctcgcagatcgtgtggaagagctctgtctctgtcggctgcgctactgtcgtttgcaattccctcggcaacgtggactcgagtcagccatcgcccttcaccgtctgcaactactaccctcctggtaagtgtgatcaatctttatcccttgaagtatgccggttctga

SEQ ID NO: 1334 - DNA, 213 bp, A.fumigatus
gatcatatagtgcaatggcatccgactgtcctcgcgagaatggcgcttgttcctcaacgaagcattaatgcttacagcaaagattccactgctgcttcggccgacggcacttacaaggacggagacttggttattcggttctttggatgcgattccgatcctaagcgcacttgtgcgcattcttcaccacggcctaccaatccgatccatccc

SEQ ID NO: 1335 - DNA, 459 bp, A.fumigatus
  unsure (3): Identity of nucleotide sequences at the above locations are unknown.
tcncgagtgcgtgtccttccaggccccgtgggtgaagaagcaatggcatcgcaccctcattcaacttatttctttcatctcgatgctcataccttgatcatgaaccctagcaaatcgttagagtctcatatccttgacaagaatcgccttcaatcgctgatgctcaaggacgttcccgttgtgccgccggacagcattatcaagactttctcgcacctgaagccagaggatgtcgaccttataatcagcacggataacgaggacttgaaccccggaagctttgtgcttcgacagggcgactttgcgcgattcttccttgatatgtggttcgatcctctgtatcggaagtataactttcagaaagcggagatgcacgctttggtatgtttccatcctcgctttctaatggccggcgatgatcgtactaacagctacccgtcttttactaggatcatatag

SEQ ID NO: 1336 - DNA, 423 bp, A.fumigatus
  unsure (52): Identity of nucleotide sequences at the above locations are unknown.
accatcgcccatctctcagcaaactcccataaagtacacgtcgacggcctantctcaacccctctcagcctatctatccagcagctcgcaagcgaattcccccagcatgaagtcatctgcgctctggaatgcgctggcaaccgacggcacacgatgcgcacgatgctgaaggaagtgcagggtatcgattggggggatgcagcagtgatgaattgcaaatggcgggggccgagattgcgggatgtgctgctgcgcgcgggggttaaagcgagtcaagaaggcctgcatgtggagttttcgtgctatcaagtgaagtgtcaggaggatgggtggtttggggcgagtgtgccgctggaaaggtgtctgggggaggatggggatgcggttcttgcgttgcaggtgcccttgtctcgttcgctttag

SEQ ID NO: 1337 - DNA, 402 bp, A.fumigatus
atgaatgacgctccgctccccgtgaaccacggatatcctgttcgtactatcctgcctggcattgtcggcgcgaggtgggtcaagtggctggatcgcatcacggtctcagaccatgagtcgcccaatttctaccaacagcatgattacaaggtcctgccgccagcggcggtcgatcaagagtcagcgcagccgttctgggcgcagacgccccccatgtctgatatgccgatcaactctgttgtcgcggttccagaagataatgagacggttgcgttgtcgagttctggggtcatggaggtgacggggtatgctgttccgcatggtgcggacggaccggttacccgtgtgcaggtgtcggtggatggatattcaacccgggcctggaaggtaccgcgattgcgc

SEQ ID NO: 1338 - DNA, 375 bp, A.fumigatus
atgtgtaatctggaaaggcatgttgatcatgaacaagcatgcttcattcacccgattgtaccgtcgatgctgaccgcaccagggaaaggaatcgtcatgttcacaggctgcagccatgttggagtggtcaacgcggccaagcatgcaattgaatgcatggatggatctgatcctcttcatgcggttgtgggaggcttccatctggcgactagtgaggagcagcagatggagagcacgatcaaagacctgaagaagcttgacccggctgtgcttctcccgggtcactgcacgggttggcgggccaaattcgccatcgagaggcttatgcctgggactctggtgccttgtacagtgggtatcaaggttacattctga

SEQ ID NO: 1339 - DNA, 270 bp, A.fumigatus
ctaactttgataacggagatagtcatcgttaaggcgtcatccggtccccgatatgttgtcggctgccgctccaaggtcgataaatcgaaactgaaacagggcactcgtgttgcccttgacatgacaacacttaccatcatgcgcatgcttccgcgtgaagttgatccgctggtatacaacatgtcgttggaggaccctggtcagatcagcttcgcgggtatcggtggtctgaacgagtcttcaccacggggctggaagggaccgcgcaat

SEQ ID NO: 1340 - DNA, 285 bp, A.fumigatus
  unsure (2): Identity of nucleotide sequences at the above locations are unknown.
tntacgcaacatccgtttgaagccctacccgccggcttcgcttttccaacgatgaacggcggaagcgaccctgagagagagcaggcgctcgaagattacaagaagagcttacttgagcttcgagaatgggaagctaagcttaagaacctgcgtatgggtatcaaggacctgcagagagagttcgatatctctgaagagaacatcaaggccttgcagagtgtcggtcagatcattggcgaagtgctgaaacaactggatgaggagcgatgtatgccattttcataa

SEQ ID NO: 1341 - DNA, 399 bp, A.fumigatus
  unsure (41): Identity of nucleotide sequences at the above locations are unknown.
gggtacaatagcggaaaccctaagcgcgcacagctgcgaanacctcaccgtctttttcttgcgccgagttcgatcctgaagcaacctcctgtcctcaccaacgccgtcaattcgacctcgaggtatgttctgcttgctgtcttctatttatctacagccccccagctagtctgggagagcaatcactgtctcgtttttggctttcttgtctccattggccgaaatggcgaccgagaacaaagcagtcaaaagaagcagggtgatacgcttctctcatcacgacacgggcttaagaacccctggggggcactctttgcgctcgaagactactggtggctgactggttttctctcttccggaagcaaaaatttctccagctgggtggatcccttgcggtga

SEQ ID NO: 1342 - DNA, 861 bp, A.fumigatus
  unsure (475),(659): Identity of nucleotide sequences at the above locations are unknown.
agaagcgggggcacactccagcaattgctgatcgatcccatgtacagataccatacacaatcacccgaagcgcttttcgctcatgttcccggtgtccaagtggtcatgcctcggtctccgtcacaagcaaagggcctcctcctcagcgcgattttccagagcaacaaccctgtcatcttcatggagcccaagatcctgtaccgagcagcggttgagcacgttccaaatgaattctacacattacctcttaacaaagcggaagtggtcaaaccaggaaatgacgtgacggtcgtctcgtacggtcaaccaatgtatctctgctcagaagccatcagagctattgaaaaggacatgggcgccagcgttgaactcattgatctccgaacaatatacccttgggaccgacaaactgtcctagacagcgtcaagaagaccggacgtgctatcgtagtccacgagaaaggtttaaattggnaatatttcccccaaaaaaaaaacccccttttaaaaaccccccggggggggccccggggtttttcccgggggggtttggggcccctttttgggaaaaaaaggggttttttggggccctttggggccccttttaaacccccccaaatttttccccccccaaaaagggggaaaaatttggggggggncccccgggccccccccccctttttttttcccttttttttggggggccccgggggcccccccccctttttgggggggggaaaaagggggggggggcccctttttttttcccccccccaaaaaaggggtttttgtggggggaaaaaaaaaaaaaaaggagccccccccgcggggaaaaaaaggggggtttttttgggggggggg

SEQ ID NO: 1343 - DNA, 558 bp, A.fumigatus
  unsure (202),(386): Identity of nucleotide sequences at the above locations are unknown.
cccccccccaaaaaaacccccctttttttccccgcggggggggctcctttttttttttttttccccccacaaaaaccccttttttgggggggggaaaaaaaaaggggccccccccccctttttcccccccccaaaaaggggggggggcccccggggccccccaaaaaaaagggaaaaaaaaagggggggggggcccgggggnccccccccaaatttttccccctttttggggggggaaaaatttgggggggtttaaaaggggccccaaagggccccaaaaaacccctttttttcccaaaaaggggccccaaacccccccgggaaaaaccccggggccccccccggggggtttttaaaagggggttttttttttgggggaaatattnccaatttaaacctttctcgtggactacgatagcacgtccggtcttcttgacgctgtctaggacagtttgtcggtcccaagggtatattgttcggagatcaatgagttcaacgctggcgcccatgtccttttcaatagctctgatggcttctgagcagagatacattggttga

SEQ ID NO: 1344 - DNA, 579 bp, A.fumigatus
agaataccacggcactcaagccaaggcccagcttgtccgcaatccccagaacactgttgcatacttcagagactatgttggcaagaagtaattagtcctggacctggatttcgctattcggagaacagacatgctgattttgctttacacagcttcaagtcgatagatcccactccctgccatcagtcagcgcaccctcagcaagttgactccactgttgccttcaccatccgggataccgccagcgagacccccaacaccgtcaccgtctctgagatcacaactcgccatctccgccgtttgaagcaatctgcctccgactacctcggtaaggacgtcaacgctgccgtcatcaccgttcccaccgacttcaccgacgttcagcgcgaagctcttatcgctgccgctggcgccgctggccttgaggtgctccagctcatccacgagccggttgctgccgtcctggcttacgatgccagacccgaggctaccgttactgacaagcttgttgtggtcgctgattttggtggtacccgttccgatgccgctgttattgcttgccgcggtggcttgtacata

SEQ ID NO: 1345 - DNA, 549 bp, A.fumigatus
  unsure (50),(105): Identity of nucleotide sequences at the above locations are unknown.
ggccagctgattctccggaagctggcagagcttttcgcagaggctgcaantagtacgcaggtcgaagacggacttgcccctacaatagtgaatgaagacgaggantgcacagtgcgccagtccctgttgtatttctcagatgtggccttttttattcaaacacaaccaaatttcagaagttctggcgaaggcatcacccaaactgaatcttccgcaacttcttcctctttccttcagcgccagaatagtcgtccactctcactctcttcatccatacttcaatatcacactttgcccaatagcctcgacgaggtttcccctcgatcttctttctcagatacatcttccgatttaactatcactccacttcgaatccagaaaaaagcctggatgccacctggaccaggttctgcgtcaaaggatccctttgttgattcttcgactgggggcaaccacaccgcaggcaaccttgataacatgtctcagtttcaagtctctgaaggtacagctctgctgtttctagttcaaaattcctatgctctgcaatga

SEQ ID NO: 1346 - DNA, 744 bp, A.fumigatus
  unsure (728): Identity of nucleotide sequences at the above locations are unknown.
ctccgaggtgaagacggatcgattgtgtcctttagccagacgggcgagtacggcgccagtgggatggataccactggatatctgtatgttccccgggcatgccagccagggtcttcgaccgtctgcaaactccatgtggccttgcatggctgcaagcagagctacagcatgattggaagcaaattcgtgtcgaataccgggtacaatatgtgggcggataccaacgacattatcattctctacccgcaagctgttgcggataacacgatgcacaccatctggactgggatgccgctgcccaatccgaatggttgctgggattgggttggttggtatggcgcaaatgctgatcaggtcggaggtgagtcaaagagttggttgagggccatactttttttttttttcttttttttttctttttttccctttttttttactgactcgaatgctttaggcgtgcaaatggctgcgattgtgaaccaagttgcccgggttgtcagcggctacggggccggcagcagttcttcaacgactgctgcgaccccgacgaccaccactggctctataacaacaacaactactactactgctacagtaacgacgaccgctgttgccccgttgtatggacagtgcggtggaatcgggtggacggggccgacggcttgtgccaccggtgtttgcaccgcctataaccccttaatatgcacaatgtctcttggatattgtanggacttggaaccttga

SEQ ID NO: 1347 - DNA, 504 bp, A.fumigatus
tatacttattggataatttctctcaatcagccaagctcatattttgcaagatataagaaagcctatgaatcgatgaaggcttgtccgctcgtcttccagcatccatccgaggcgcaacagctgaatggacttgggccgaagctatgtgagcgattgacggagaaactgaaggcgtactgtgaagaaaacggactaccgatgcccgaacaccctcagaagggagcagctagcaaaagaacatccgacgagggtgttgatgatcctccagcgaagaaaccacggaaagcaaagccatatgtgccgtctctgcgatccggtccctacgcgctactcttaggtctagcaacactggatgagaatgcatcccaaggcttgacgaaagctcagttgatcgagaaggctcagccatattgcgatagttctttcacagcccctcctgacccttccaaattctacaccgcctggaattcgatgaagacgcttgtatttgacaacagcggccga

SEQ ID NO: 1348 - DNA, 657 bp, A.fumigatus
gtcctcggcagtgccgttgaagctatgggccctgcggcggtactggaaatccttcctttgaatatcattcagcagaagaatggccaaccgggtcgcgtctggtttcttccgattcttagagacagcgttaccaacaccaatctcgctcacttccgctctgagcttgttcctctgagcgaagcattgtaccaaaaggtcgtcgactatggttctgcggagaagaccgttgagaagaagatattcgagacgctcgtgcagcagacctgggccatccttcctggctactgcgagcttcctctagatttggttgaggctttcgatcagagttttgcagaactcttgtctaacgttctctataaacaaaccgagctgcgtgttgacatatgcaatgccttgcagaccctagtcgagtcgaatcaagctattttgtccattgagtcagaggaggacgatctgattctccagaggaggatcacaaaagcggctgcgaagaagaacatttcccacttggctggttttgctagcaatttactcgcggtgctgttcaacgtctacagccagacactcccgcattacagaggctacattctgcagtgtatcaatgcttatttgagcattacccccgaaaaggttagtcattctctatatcaaatctga

SEQ ID NO: 1349 - DNA, 591 bp, A.fumigatus
tgtgggatagttgcgcctttcgtcctctccgatcaacccgctggcacgagcgctttccctcgcggtcactacctcatccctgatacaaacgcactgctgaatggtatggatctctttgaacatactggagctttctacgacgttatcattcttcagacggtcctcgaggaactcaagaaccagtcgctgccactctacaaccgcctactttctttaatcaagacggacgaaaaacggttttacctattcttcaatgagttcagattggaaacgcacgtgagacgaggtcagaatgagtccatcaatgaccgaaatgaccgagcagtacgggcagtggcaaaatggtactctgagcaccttcgcagcacgctaaagaggggcaagaaggagaagtcggtaccagcaattgtcgtcattacggatgataaggaaaatcttcgcaaagcaaaggaagaaggtgtgacagcgctgtcgctgtccgactacgtctccggattagaggatgccgaccggttacttgacatgatcagcgaggcgagggaagctagggtcttcaccacggggctggaaggatccgcggtggcgctatga

SEQ ID NO: 1350 - DNA, 279 bp, A.fumigatus
cttttcccagccctgatcggtgtcgacgacctcctcaacaagcaatgccagcagaacgttgcttgctgccaggacaacaagtctgttgctgtaagttccttcagttcttccctagttggcacacttctcacgatattagactggcggcctcatcaacattgccacgccagcctgcgttgctctcgactctatcatctaagccagttgcgagtgccgttttcccagacccttgttcgatatcttcgggatcaacggttgcatatagcactcggtgtatag

SEQ ID NO: 1351 - DNA, 249 bp, A.fumigatus
  unsure (89): Identity of nucleotide sequences at the above locations are unknown.
ggaggggggatgaacatgaaaggttcgggacataccagtaaatgtactctcccattatttggaggtatacgatgcccaaatcatttagnttcctttcgctccagaaataccgttctcgcttacttagcttgggatcttttcgtgcgcgtcgagaggtttggaaccattcgtgcttggatgaatactagtcagtacgccattattagcttatcatccatcatggactcacctcagttgcagtgtgattga

SEQ ID NO: 1352 - DNA, 411 bp, A.fumigatus
aagctgactggcaaacaaagccgcggaaaagataccacctctcaccagatatgcactgattttggaatttgtaacgttcgtgcatcgctccgtcttgtagcatggaagcgcaagcgcagagaagacgtctcctttatgtctagctcagaatttcatccgatcaacacagacagggcgcagagccctgatgcatcaacagaatgtcacgagtcagacagtctcgacaagctgcgttggtggcagaaagcaaccatttatcaggtattaattcagagctttcaagacactgatggagatggcaaaggggaccttcgcggaatagttaatcgcctcgactatttcgtcgcgcttggtattgacgtgatctggatttcacctatttatgaatcaccaatgcgagacatggggtaa

SEQ ID NO: 1353 - DNA, 309 bp, A.fumigatus
  unsure (96): Identity of nucleotide sequences at the above locations are unknown.
tattcatccaagcacgaatggttccaaacctctcgacgcgcacgaaaagatcccaagctaagtaagcgagaacggtatttctggagcgaaaggaanctaaatgatttgggcatcgtatacctccaaataatgggagagtacatttactggtatgtcccgaacctttcatgttcatcccccctccttaaacctccctatgtctggcgcacggttctcgtttggaaattgggacaacctggccggcgaatttctttggcgtattccgccatccctatggcgaatctgggggctgacggaggaatcctaacc

SEQ ID NO: 1354 - DNA, 201 bp, A.fumigatus
tctgcggtgatggatctgatggtttcgatttacgatacgtatctggcaccgcagaaggcggccggggtcgtgtctaacgggcatctcgcgtatgatgcgacggtgcagaagcaggtggagcctatgatggaaatggtgcgcgatcagagggagaaactggcgagggaggtcgagaggtggtgcaaggagcggggtgtctag

SEQ ID NO: 1355 - DNA, 210 bp, A.fumigatus
ggctgcagccgcggcagtcttgtgtatacgcccggcaaatggatgattgaacctactttgccgctcattagaaaggatctgcaggatgatttcattggattccgcgatggaattcttactcacgttgaccgcatgaccaattcagacaagggctggctgaaaggttggcaagatgatagcccgatgttcgaaatcctttgttcatcgtag

SEQ ID NO: 1356 - DNA, 282 bp, A.fumigatus
gaagttctcttccccttctcagacactcccatgtctacgaatactaacaccgacaccgctggccatacagccaagcgtgaagaatcacgactccgtgcagccaaggcatgcagacgatgcagccagcgcaaaatcaaaagcgatgcagtacagaatggactaccatgtagtcgatgtcggatggacaatacagatgattgcacgctgactctgtcacgaagaggcacctattatagaaaaggtggcgcgcgacctgcaattgtcatctgccggagtccgtga

SEQ ID NO: 1357 - DNA, 786 bp, A.fumigatus
cattttgagaaaaagtgcatctgtagtcaggccatatctggagatatgctcagtatagagcttctgttgtccatggccacacgcttcgtctttcacctcaaaggcaacgtctaccccgaggatatagagggcgttactctggatgcaaaattgcacgtcaggaaccttttttggatctgtttcaccctcgacaagatgttcagcttgcgcacaggacttcaaccctttatcgacgtgacgaattgcgatctaaggcttcctcgaatgcagacggtaactggccccctggaaggcttgcagcctttctatcgccaatacaaccacactatgtttctcgctctcattcgcctgtctttggtccagtcgaaggtctaccatggcctctactctttctccgcccaacgccaaagcgatgcggatctcctagctaccatccgcagcctggacattgccttggaggagtggcggtcctcagtgcccacgtcctggggcctacctacaccgcacgaaaatcgcatggccggtctcctctttgaaatgcagtaccactacaccatggctgccatccatcagacaagcagccggtgcactgcctgggtccggaaccaggacacccgcgcggcgggctcgagccttgccctcagcgtagcagcccgtcggtctttgttacgaaaagttctggagaccgatccacaaatcgagggacaattttctcttgtaggcgaccagtcatatgtttggagcaatgtttctcttgagctaataaccttggaaggttttggttaa

SEQ ID NO: 1358 - DNA, 546 bp, A.fumigatus
agaccggccgacctgattgaatcgccaacctttggtcgcgtcctgcaaggcctcaacgatgaatgttttgacttactgatgcaaaattgcatccaggaggcattccagtcgtcaccacaagcgtctgaaagcgtgccgcaatcattcacctcggttgccacagttgtcccacaggtgaagacagcggatgtcaagacgaagctcgcgaatgtccttgctgtgatggcgcggcaggcgcatgttattggcaacggcacaaatccgcccaacatctatctttccgccatggaccagaacgttcggaatctggaggccttcgcagccgtcatttacagctcgaactttgacttccagctgccaggcgcggagcagaaagaggaacaagtcactgccgagagagatcactctgatacgtcttccacggccccagtaatggtggacaaggatgatacccaagatcttaaccaagctagtccaagtgcagtggctgagaacaactcggctttcgagaaggcatggggaaaggcagtggagtcgagcgagtga

SEQ ID NO: 1359 - DNA, 297 bp, A.fumigatus
tccggcgcgtctaaatggacaaccgcgcagcgcagggcgtttgccaacgacctgaccaacccgcagctgatcgcggtgacggataacgtcaaccaggccaagggcgatgatggacccgaggcgtggaagcctcctcttagtaagttttctttctctccggcggacaatgatgctaacgggctagcttcatattattgcacgtatgcaaagatgtgggtgagggtcaagtatgtgtatgatttgaccattacctcggcggagaagaatgcgctggtgagcatgttggatacttgctag

SEQ ID NO: 1360 - DNA, 567 bp, A.fumigatus
ccgagtattactccagtgatgactctaggctacatattccgcttgatttccgcccggagtcctgacagcctagtaccctacataggccagtcgatgttcattatcctacctccgtccctctacgcagcgacaatttacatgacttacggccgcattgtcgtctacgttggcaagcctcatttgtccatcatatcacctcgaaaggtgaccaaagtcttcgtactcggcgacgtaagcgccttcctcctgcagttagggggcggtggcatgcagaccatagacagtatgcgaaacattggacagaaggttcttgttgtcggattatttgtccagctgatatttttcggcttctttttgtacgtctcggtcagtttccagattcgactgcgccgctcaggatttgacttgatcggggggttatggcggagactgcttcaaattttattcctcgcctctgcgcttgatattgcgcgctgcgtgtttcgcatcattggatatgtgaaaggaacaggcgggtattctatatttccacgaaggcttttatgtacctcttccgacttgattccg

SEQ ID NO: 1361 - DNA, 252 bp, A.fumigatus
  unsure (153): Identity of nucleotide sequences at the above locations are unknown.
gagcgttggtccttccagccgcgtggtgaagacaccaacatgaactttgtactgactcgaaaattctcaaggcatcgttatagcaaccgcaactccgaagaagccaactacttccctttcacacataagatacaaagtgcagaagacgcaccngaaaagttcccccagttgatggtaacggccgacaagttcgtcatgaaacgagattgggaagtggacgagatcttcgatggtcggaaaagaacaaggtga

SEQ ID NO: 1362 - DNA, 357 bp, A.fumigatus
gcataccgagatttaccgcttaagctacggcgagcctgtaaagtatgcatcgactctgcaatcctgagcacagaggcctttgatggaatcgaaggtcgtccgatcgtgacaaatatcttcggaactgcgcatgcgcaattcggtaacatgctcgtgttgtctgcgacttatatgtcttgtctctcagagctggtggaccgaaatgtccttgagaaacttcttaagcgaacaattaaattcctgttacagagccgatatatctcccctagtgttcgagccgatgcacggatactcaccgaaatctatgagaagatcttcggagagcccgccacgagttttacatccgcctatagctag

SEQ ID NO: 1363 - DNA, 363 bp, A.fumigatus
cgttgccagactcttcgcgacttgataaagaacggcttgtacgatgatatcgatcgttcatggcgcctgtttcgacagattctggatgggcttagtcatattcacagccacggcattatccaccgcgatctgaaaccagataatattttcattgatgtggcaagcaatccgagaattggagatttcggcctggctaccagtgggcagtttaccacagctgtgcgttcatcgactaccgcagattttgaaggcaacctcacgcgaagtcttggaactacttactatgtcgctccggagatgaagtctggcttcgcaggtcactataacgagaaagtcgatgtgagtataattgaatcacagtag

SEQ ID NO: 1364 - DNA, 792 bp, A.fumigatus
gcacccagtggctgtggagctctacaaacagcaagggcaagccgcgaagcagggttacaacaagcgttactggaatctggagaaagttctcccaatgactctagtacgaggattaacagccaacgagctgatccttatcctgccacaaacaccgcatccaaggaggcatcgcagtcgaccaaggaagatgacgagactatcaatctagatgacccacgttctcagtctggcaaatactggaaagctgagtttgacagctaccgtgcaagaacgacgaacgaaatcagaaagctgattcagtatcggtccgctgccaagaaattcgctctgatgaaggaagcagaagcttcgcgtctggctaaaaaactgaaggaggaagaagtgaaggtcgccgaaatggaacgacacgtcacacagctcgcgtcttccatggtggcggaaaaagcaaaggcagatagagagcaactggttcaagatttgactaaacagacagctttggccctgcagtataagcatcgagtcaacaccttacgcaagctcctagagcagcatggtgttgttggtagtgaggtggatgacatcgtgggaaaacgagaagcgaataactcgtccaacgatacaagccaggagctggttaaaacccagcaggctctgagtcaggcgaatgccaggattgaggagatgaaactccagcaagccgagttcgacaaactcaaggaactcgcacaaagctcagagcagaaggcttcggagctggctcgtcttgaccacacgggcgaaaatccacgctag

SEQ ID NO: 1365 - DNA, 783 bp, A.fumigatus
actaacaaatccctcggcgtcgcaggtctcgacaccgacctccccaccgcagttgaagctttcttcctagactccctcctaggcaaggcattcttctgcaccttccagatattcttctacgccgtccgccccatgttcatctacagtcctccattcacctatattcacctgcttaacctcatcactcaactctccttcgactatgccctcaccaagttctgcggcggttccctccagccactactttatctgctcctcagctccttcctcgccggctctctccacccctgtgctggtcactttatcgccgagcactacttcttctcccgggtggagagcggcggtacagaaagcattgaagagcagaggaaaatgcgggcgaacagcggagccagcaagcaaaagcagcaaccacaccctctggactcccttccgccaccagagacatactcctactatgggcccctgaacatcctgacatacaatgtcggcttgcacaacgagcaccacgatttcccggccatcccgtggacgaagcttcatgagcttcaccgcatcgcgaaagaattctatgagccgctcccttgtcaccgcagctgggtctgggtcatctggacgttcatcctggataagaatgtgggcctgtggtgccgtgtcaagagagcgcagggcggtcgtctcgttgggggtggaaatggccgagcgggggaggagatatgtgctgcttctcccgaaaccgacgaagagggagatggttggaaggaaagtgagattcagaattga

SEQ ID NO: 1366 - DNA, 552 bp, A.fumigatus
tttcttaataggcaggcatataattttcaacccttcctccttttcgttactacttccttcccagtacgtttttcttatcatccagtcttcacccaattccatctatctcagcaacctcgaagacctcttcatctaatcatcttcccaaacttcatcctaagtacaaccacaaccacaatgactcgcaagcccctccgcgttggcgtcctcctggtcggcaccgtccaactcttggaccttgctgccgtcgacctcctcttcatgatcgacccgtcctacctaaccgcctgcaccctccccaaacccctaatcgagctcggccgcccggtgtcagtggtctacatcggcaaagctggcccacaagctcaccaggaaacgacctccaacctctccctgcaactcacccactctcccaccgatcccgccgtccaaccaggcgcccttgacgtcattctcatccccggcccggagccctcgactgtcccggacgcagaatatctggacctggtgcgcgcccacaacgccgcaggcacgcacatcctcagcatctgc

SEQ ID NO: 1367 - DNA, 336 bp, A.fumigatus
gatcccaatgacaacttcctttccggaaacacagccaactacattgacgagatgtacctggcttggaagaaggacccctccagcgtgcacatctcgtggcagacatattttaagaacatggaagaaggcaacatgcccatcgcccaagcttttcaacctcctccgactcttgtgcctactccgaccggtggcgttcctcagaccatgcctggtgagggattgggcctgtcggctggcactgacctgactcatcatctcaaggttcagcttttggttcgcgcataccatgctcgtggtcatcacaaggccaagatcgatccccttggcatcccgccc

SEQ ID NO: 1368 - DNA, 807 bp, A.fumigatus
  unsure (6),(76),(84): Identity of nucleotide sequences at the above locations are unknown.
gcacgnttcaaacctggcgatcgcgtgttgggactgggtagcgagctcaaggacaacaaccccgccgaggccgctntccaacantacacggccatcccggcccacgtagcgtccccgatccccacaggactgtcatacgaaaacgcctccgtcattccgctgggcatatcgacggcgagttgtgggctgtttcagaaggatcacctggcgctgcggttacccacgagtccgcgggctgcgtcgagcggccagctcgtactaatctggagcggctcgtcaagcgtcggcagcaacgctatccagctggcggctgcggcgggctacgaggtcgtcaccaccgcgtcgacgaagaactttgagtacgtcaaatcgctcggtgcaggtcacgtctttgactaccacagcccgacccttgtcgatgatattagtaaggtctacgacagcaaaactggagttggtgcgctggccatcggcacggaggcggcaggcccttgctgtgaggtcctgtccaaggtcaactcgcgcaagtttgtctccttgaccaatcctcccactggtgcattgccggaaggcatcgaatccaaattcgtgtttggagctgctgtcaaggataacgagattgggccagccatcttcgaggcattcctccccaaggcgttggcagcgggtgagttcaaatctgccccaacagctgaggtggtaggtaagggattgggatcgattcaggcggggctcgaacaggtgaagaagggtgcgtcagccaagaagtatgtcatcagtctgcacaggcctcctagattgttattt

SEQ ID NO: 1369 - DNA, 627 bp, A.fumigatus
agacaggacatgggctacgcacagtccaagctagtcggcgaacacatctgcatccacgccgcgcagcagaccggtatccgtgcccgcgtcctgcgcatcggccaggtcatcggcgaccaggcccacggcatctggaactccacagaggccatccccctcatgctgcagtgcgcaaagaccatcggcgccctccccgccctcgatgagtccccgctctggctccctgtcgatacagtggcaggtaccgtcgtcgacatctccctctgcgactttccggccgtaccgcccgaacacgaacaggtcttcaacgtcgtcagcccgcatcccttccactggacccgggatctgctgccgtatctgcgcgccgcgggcctcgagttcgacgtgctggagcagcgtgcctgggtggcgcggctgaagcagtcgaaccctgaccctgccgttaaccctcctatcaagctggtggagttctttgcaagcaagtatgatacggacgcgccgcggcgggggaagaattggcatacagggaagacgaaggaggtatcgcgcacgttggcggagtcgaagccgttgagtcaggagctcgtgagcaagattgtggagtatttctgcaaggagtgttggtga

SEQ ID NO: 1370 - DNA, 384 bp, A.fumigatus
tcggcgaacacatctgcatccacgccgcgcagcagaccggtatccgtgcccgcgtcctgcgcatcggccaggtcatcggcgaccaggcccacggcatctggaactccacagaggccatccccctcatgctgcagtgcgcaaagaccatcggcgccctccccgccctcgatgagtccccgctctggctccctgtcgatacagtggcaggtaccgtcgtcgacatctccctctgcgactttccggccgtaccgcccgaacacgaacaggtcttcaacgtcgtcagcccgcatcccttccactggacccgggatctgctgccgtatctgcgcgccgcgggcctcgagttcgacgtgctggagcagcgtgcctgggtggcgcggctga

SEQ ID NO: 1371 - DNA, 192 bp, A.fumigatus
ctttcgacgcttttcgtccatcccgtcgttaacatatggatcccgatctggaccgtcttcgtcgccctcaggagcgccgccgcgctggtcctccccttcgccttcctctacgccgtctcgaactaccagcttgccgttggctccttcaacgagctcatctactgctacatggtgcacaccaatgccggctag

SEQ ID NO: 1372 - DNA, 696 bp, A.fumigatus
ggccaccggcacccctgcgggccctccacctacggctccatcgccggcgacgcctggtaccgcgcgcagtacatgctccaggaccagaaaatcggacactacatgcatatccccccgcgcaccgtcttcttctcgcaggtcttcggcaccgtcctcggcatccccatgaactacgccgtcatgcgctgggtcctgtccaccaagcgcgacgtccttaccggcgccaagcccgatccgctgcaccaatggaccggccagtcgctcatctcctcgaatacactcggcgtgcagtacgccgtcatcggacctgccgagctcttcaaacagagcgagatgaggccgctcccctggtcgttcctgctgggtgcgttgctcccgccggtgctgtacggcctgcatcatctcctgccgcgctggcgcatcgatctctggaacgtgagcattttcttctccgggctggcggtgttctacgggaatttgagtacgggatacacgtctgccattatcggggggtatgtggtcatgtactgggcgtatcggaagcggttcgaggtgtggaagcggtacagttacatgattgcagcggcgttcgatgccgggttcaacctgaacatgctgctgattttcttgttctttgggtcggcgaagcagatctcctgtcatcacgccgaggccggacagatccgcacttacgct

SEQ ID NO: 1373 - DNA, 285 bp, A.fumigatus
atttcttcatttggtccttgtacaccattagattacctctatacctgcgacgtgagtcttcaaccaataaaggctatatttccatccagttcctgttgtgacgacgatgtttccctcacacctaatgactacacaatcgtgtggatatgcgccttgcctttggaggcagcagcagcaagtgctatgctagacaagacccacaccctacctccactgtcttatggccaagccataccctcgatgctcttcaacacgcacctcctagtacatacaagagacatttag

SEQ ID NO: 1374 - DNA, 216 bp, A.fumigatus
ctggtttatactagaacccgaggactggacttggtaaagcaacatgagagtatcgaattcgtatatgtgaattactccgaatccagcacttcctgcaagcaggcgtccgtctgcactggaggcgagcgtgtggcaattcgcgtgacgactttccaaggtctgatcgtcaaatggattgagaagcacgagctcaccatcaaggtacgatacaacaag

SEQ ID NO: 1375 - DNA, 261 bp, A.fumigatus
gtagcgcggtccttccagccccgtggtgaagacgagagtaatgtttggaccaatgtctggcagaatccgacacagcacgccaaaagtggttccgacaagaacagcctctgccaacgcttcgattctaccacccttctctccttcttcgtcatctcagattgtttctactttccccccttctcaaggcatttgacttcaatttcactatgcggccgcagttgtttcgtgcggccgcccggtccttccgggtccctaaattga

SEQ ID NO: 1376 - DNA, 201 bp, A.fumigatus
gctgatgtggtgaggtgggtggaccagacatatatcgctgtcctgggatggaggctgattagatgttctagggctctccgtgcgttccagagcaaggattcgacagtcggcaagttgttcgcaaagcacatcaagctggaggaagcaaaacagttcttgcagcgcgcacggtatgttcactatgatcttggcctcaattga

SEQ ID NO: 1377 - DNA, 882 bp, A.fumigatus
agacccggtctcccagcttcttgggcggacggctcatttccttcctccacagtccggaatgaggccggtcacgtcactcttcaaggctggcttgctcaatggagtatgacaacgttccaatcacctaagacgactctggagtatctggcttatctcggctttgagtcgtccgataggagtaatccctctacaacggctgccttgaaagtcacgcggccacgaaagaaacgaaagcgccctggacgtgtgggtcgtaacgtcgtcttgggacacgtgcttggggctccaggatcgggcaaatcagcgcttctcgacgccttcctcgcgcgcggcttcagccacacttatcgaccgactatccagccccggactgctgtgaacacggtcgagctccccggggggaaacaatgctacttgattttggatgagctaggagaactggagcccgccattcttgaaaaccaggcaaagcttctggatcagtgcgacgtcattgtatacacgtatgattcctcagacccggactcctttgcctatattccccagctccggtccaagtatccgcaccttgaagagctcccgagtgtttttattgcgcttaaggccgatctggatcgtaccacacaacgggctgagcatcagccccacgagtacacggccatgttgaatatgccgagtccaccgctccatgtcagcgctacttggagttccattcaagaggtgtttgtacacattgcagatgctgcaatggagcccaacacttgttttccccggagtgaggaggacgtggaaggggaaatgggtgggcctggcgttagccacttgggagccaatggtttgcgcttggggcttgctgcccggaagaatttggcgaataagtag

SEQ ID NO: 1378 - DNA, 213 bp, A.fumigatus
gcttacctaggtattccgtcgattttctggtacatattccgtactgcccttgtcgttatcaacaataataatcaccgtcaaatcgtctcaatttccctaattgttatatataattttttttttattattattctggttttattcctgttccaacttgctttaacccctctggacaagcggggtcaaaaaagcccctcccataggcattggtag

SEQ ID NO: 1379 - DNA, 819 bp, A.fumigatus
ggtgaagacacctacactcacggccaccacccctccgtcctccgctcccacacctggcgcacagccgccaactcggccgcctacctcctcccccacctgcgcccagacatgcacatcctcgacgtcggctgcggccccggcaccatcaccgtcgatctcgcccggctgatcccacagggccacatcaccggtgtggaactctccccctccgtcctcgagcaagcccgcgccctcgctgccgaccaggccctcaccaacgtcaccttcctctccgcggacgccaacgccctccccttcgaggagggaaccttcgacctggtcctctgccaccaggtcctgcagcacgtgcgcgacccagtacatatcctagcggaaatgcgccgggtcacgaaagaaggcggcctggttgcagcgagggaatcggattatgcggggttcgtgtggtacccggcttcccccgggctggatgtctggcgggagacgtacctgaaggtgtgtagggcgaacggcggggagccgaatgcggggcggatggtgcatgtctgggcgaagcaggccgggtttgcgcgcgagcagatcaagtgcagttcgagtaattggtgttatagtacgcccgaggaagtggagtggtggagtgggctctgggccgagaggaccgtggcgtcggagtttgggaggacggcgagggagaatgcgggtgttgaggccgtagagttggaggggattgcgacggcctggagggagtggggtgcgcaggaggatgcgtggttttcggtcttgtcgggggaggtgctttgcgttaagggggggaggtggtag

SEQ ID NO: 1380 - DNA, 495 bp, A.fumigatus
agacacctacactcacggccaccacccctccgtcctccgctcccacacctggcgcacagccgccaactcggccgcctacctcctcccccacctgcgcccagacatgcacatcctcgacgtcggctgcggccccggcaccatcaccgtcgatctcgcccggctgatcccacagggccacatcaccggtgtggaactctccccctccgtcctcgagcaagcccgcgccctcgctgccgaccaggccctcaccaacgtcaccttcctctccgcggacgccaacgccctccccttcgaggagggaaccttcgacctggtcctctgccaccaggtcctgcagcacgtgcgcgacccagtacatatcctagcggaaatgcgccgggtcacgaaagaaggcggcctggttgcagcgagggaatcggattatgcggggttcgtgtggtacccggcttcccccgggctggatgtctggcgggagacgtacctgaaggtgtgtag

SEQ ID NO: 1381 - DNA, 303 bp, A.fumigatus
aaggaaagcaactcgaaccaccttgacctaattaccgtagtcatctatgatataatgtctcttgcaggagcaaacgaaggtattatctaccacctcccccccttaacgcaaagcacctcccccgacaagaccgaaaaccacgcatcctcctgcgcaccccactccctccaggccgtcgcaatcccctccaactctacggcctcaacacccgcattctccctcgccgtcctcccaaactccgacgccacggtcctctcggcccagagcccactccaccactccacttcctcgggcgtactataa

SEQ ID NO: 1382 - DNA, 882 bp, A.fumigatus
cccccatggcgcggctccttccagccccgtggtgaagacactggacctaagggcagtcgtgctcagtcagcgattcctgttaccaacctacctaagccgcctattccggcagtagccaatcctcctcttgctagtgttcctggaaataatgtgtcacaaggacctgcgttgtccgctatcacggaggctactcgtgctgcaactgctgcggtggctgccgccatggccaagctgccacagcctaatgctcagaaacagtcggtgcaggatgcagctgttgacgccgtgactaagcagataggtgaattgaagacgcacgaaggcggccgtcctccacgcggtggacatcgtggtggacgtagtggtcatcgcggccatcaccagggaccagccaagaaggttgaagttcccgacactgactatgactttgaaagtgccaatgccaagttcaacaagcaagatctggtcaaggaagctattgccaccggctctcctgtgaccgaggccggagcacacgtcgagaatggtgaggtcgaagctgttgataccgctcatcatgcgccgtccaccactgcttctgcttacaacaagtccgcctcattcttcgacaacatctccagcgaggctcgcgaccgcgaggaacgctccggaggtcgacctggtggtcgtgagtggcgtggcgaagaagagaaacggaacatcgagaccttcggccagggtagcgttgatggctatcgcggtcattacagaggccgtggcagaggcagaggatacggtggccggggccgtggtgggtatggtcgcggctacaacactcgagaccgtggtaactatcgggggcgcagcaactcgcagtctaccggggtgcctgcaccggtctaa

SEQ ID NO: 1383 - DNA, 351 bp, A.fumigatus
aggtcgccccgcgcgtcgctgcgcttgagcggcatgccttctccgggtaccttcagaacctggccgggtgataacacctccccgggagtcttgggatgggtgatttcgatgccgcggccgtcgagatgtttgatgaccacgcgggagaagccggtcagcgcttcggccagtgtgacgtcgatgttggctgtgaggtctgcgccggctcgtcggaagactgggtgttcctcttccacgatatggaaaactatgtcgccaggttcctggccgggtgcctggtccgcctcaccttccaacacgattttatctccttctctaagcggatatttagccagaggattcgcgccctag

SEQ ID NO: 1384 - DNA, 588 bp, A.fumigatus
ggcgcgaatcctctggctaaatatccgcttagagaaggagataaaatcgtgttggaaggtgaggcggaccaggcacccggccaggaacctggcgacatagttttccatatcgtggaagaggaacacccagtcttccgacgagccggcgcagacctcacagccaacatcgacgtcacactggccgaagcgctgaccggcttctcccgcgtggtcatcaaacatctcgacggccgcggcatcgaaatcacccatcccaagactcccggggaggtgttatcacccggccaggttctgaaggtacccggagaaggcatgccgctcaagcgcagcgacgcgcggggcgacctctacctcgtcgtcaacattaagttccccgacgccaaatggaagcccagtgcagccgtcctggaaagactccgggagatgctgcccaagcctgatcccttgatccaggccgatacggtcgacgaagtcgactatgaccctaaaggaaacctagatgactttggagcccgcgatgggcagggtagttccgcatgggaagacgaggaggaggacggagagcccgcgcagtgtgcgcctcagtag

SEQ ID NO: 1385 - DNA, 402 bp, A.fumigatus
gtaaatccccgcagccggggttggaccgagttgctgacaagcgtcattcggattcagcctactgttgatgtttttgagaagcgcatcgccgccctcgaggggggtgtggcagccgttgcagcttcttccggccaggctgcgcagttcatggccatcgccgcgcttgcccacgctggcgacaacatcgtaactacgagcaacttgtacggcggtacttataaccaattgaaagtcttccttcctcgtctgggcatcacaaccaagtttgtccaaggagacaggccagaggacatcgccgcagccattgatgaccgcaccaaggctgtctatgtggagactattggcaatccgcggtacaatgtacctgattttgaggccatcgccaaaggtcgctcacgataa

SEQ ID NO: 1386 - DNA, 270 bp, A.fumigatus
  unsure (156): Identity of nucleotide sequences at the above locations are unknown.
gatcaacaactttcaagaatcttggcgggttactttcttaccgatcccctttcgaccaaccggtgctcgaaattccgtcttccaacatgcgtcaaacctagttggaattgggtgggtccttgtgaaaccaaccaacttgcgcggcatttggttgtntgtaacaaccagtttcaatttatgaactgccgggtcaaccccacccccaacaataattccccccatatttcctcccgaaaacgcgtcccgaaagggctctcccccgggaattga

SEQ ID NO: 1387 - DNA, 264 bp, A.fumigatus
acccgccaaagccggcacataaaggagcttgatggccccagtctatcagcagttcccatggtacctaattcagagagaaatagtaacaggaccctgaacaatttgattcgcttcgccaatctagcttccgagatccaccagaacatagtctcctacccagagtccaatctatatgacctgcagaataggaagagaacctcgagtatttctaatctggatggcgcttttcagatgcttatgggcattctcagaaagcccagttaa

SEQ ID NO: 1388 - DNA, 195 bp, A.fumigatus
tcattagcggccataattcggtcgacttgggcagccaattctgattggatactcacagctgctcccattgcggataataccatccaaaactgcgacgaggttcgagataacatggtcgacctcatcaagccctgcaaggacagtgatagcatcggagctgggattggtatatttcttcttcagcacacatgctaa

SEQ ID NO: 1389 - DNA, 858 bp, A.fumigatus
acaccgtacctgcgcgtgatgatccggtatagtcgcatcgcggccaaggtgtggaagttcatctcggcctttaacaacaccggcgagctcaaaaaggacgagatgaactatctggactggctggtcttgcaatgggcggccgccatcccggcgtcgctgcggttgggggcggacagctccacggaaccacgcatcctccgccggctgcgctcgctgctattcctgcgagcgaaccagctgcgcatgctcatccaccggccggtcctgcactccgcgggccatctcgtgcggtatccggccgagtgccagacggccgtggacctggccaatgacacgatccgcttcatcactcggctgatcgagacgtcggacatttaccatctgcatcaggtggcgttcaactggtttttaatgtcggcgctggccgtcctgtttctggcggtggttcatgcgccgatccagttcagcagccggtgcaaggaggagttctacatggccctggagctggtcaacggcttctccacgcaatcgtacatttcgcggcgcctgtggaaatcgatcaagagcctgcgaaagctcgggccgcaggttgggctccggcagtcggctactgacccgcgcgttcgggcggctcatcagacggtggatatggcgccgaccagcaacccgagccagaccccgcaggacggggcgcagatgacgcaggaattgatggagtggtttgaggccgtggggacgttggagactcagattatgggcgtgacgcaggtctttgacgatggcagtggccggatggccaatgggtatatgtatgactatgggggcgatctgtccaatgtcatgcgcgatttgttttga

SEQ ID NO: 1390 - DNA, 273 bp, A.fumigatus
cgagcatattccccggctcatgggcaaacaccagcccctcgatctttccccccgccatctcaaccgccaactgcggcgtcaccccgcacgcctaactgtccgtcagcaggggcctgcccctcgtatccagccacagatgaagggccaccttacccaaaacacaggcacctcaccctcctcgaacaccggcgcctcaccccaatccggggtcttgatatccttgatccccaaccgttccgccccgtcccacccccaggcaaccggctccccatg

SEQ ID NO: 1391 - DNA, 399 bp, A.fumigatus
agagctcgaaatcacctcgaggtcatttcacagaccaagactctatccaatcgagactctcaaacatcctctatctccacatacctcagctgtaccatcaaaccattcaatatgaagccctccattgtcaccttcctcatgcttgcagccgtcaccgcggccgtctccgccgaggatccgaccatgtccgctctgaagtcgcgggtggaggagatcgctggccaggtccatggagtcgaggaccaggaaaccaccccagatctgtcccattgcgttgaaccaaaactgtgctgcggctccttgacaactcccctggatcccattttggaccctattctgcttagtcttggcataaatgctgcccagaataattggttcccgttggaatggctcctttga

SEQ ID NO: 1392 - DNA, 261 bp, A.fumigatus
ttgctgctcgatatactcggtgacccattgcgtcacttaagacgctgctgcaaatgtattggtgaaggttgcggtggacgtttactaaccgaacggcaaaatgccgtctatgagtttgaacaatgccgtttgccgaagtattctcgctatgccgacctacaagagctgaagagcatgactaacttgaccattacatgcacttatacttctctaatgttctcacagccattagtcggtggagtttacatacgctcgcactga

SEQ ID NO: 1393 - DNA, 468 bp, A.fumigatus
gggccgcttggtaaaaatgactttcgggcctttcaactgctccattgtgggccatttatggatcgccagactggcgcaaaacccgacgaccgtgtgggcttcgaaccggacaaatggcagaaggatgtcctcgatgagcttgacaaaaaccatagtgtctttgtcgtagctccaacaagtgcgggaaagactttcatcagcttctatgctatgtcgaaagtgttgcaggaagacgacactggggtcctggtatatgtagctccgacaaaggcgctggtgaaccagatcggtgcagagatccatgcacgttttcggaaaaggtactcgggccctgagcagacagtttgggctatcgctactcgcgatgtccgtataaacgatcccttgaagtgtcagatcttagtgaccgtgcctcactttctccagattgtaagtgcaatgaactcagctatcactatttctctataa

SEQ ID NO: 1394 - DNA, 618 bp, A.fumigatus
  unsure (498): Identity of nucleotide sequences at the above locations are unknown.
actcagctatcactatttctctataattatttcctactgacagcagtctttaagatgcttttgtcctcggcgaacgccaccacatgggctcctagagtcaaatgcatcatctttgatgagatccactcgataggtcataccgacgatggtttagtttgggagcaacttttattgctcgctccatgtcgtatcatcgctctatccgcaaccgtgggaaatccatcagagtttgctgattggcttcaatcgactcagaataacatgggcgtgactctcaaactgattcagcatacacagcgttactcagaccttcggaagtatgtttatatgccggcagatcgtcccttcgatggcctatcccgaccgaggcataagggcctccttgagcctaaattcattccaggcttgcacccccttcacccaatcacaagccttctcagcaagcagcggcaaatacctgaagatctttcccttgagccgagagactgctatacactntggagatgtatggtaaagtactcatcagtcgactttcctgtgccagaatctctgagtccacaacttgccctcccacggttcattaggcggagcgatgtgtacgaatgggaggcgcagcta

SEQ ID NO: 1395 - DNA, 345 bp, A.fumigatus
gcaagagcgtatctaacgatcttcataagttttctgtccctggctctgtccaacgacttggtgatgagctccatcttgactctgtcggcttcccacctggcctggatcacacggaatcaggaaaccaaacagctggcatatcatcatcgcggtatcgcgatcaagggtctgcacaaggccattggtacattctcaaaggagaactgcgaggccatcctggcttcatctattcttctctcgtggcaagcgtctgattggcaaacgtgggcatccttgcagcaaggccttagtacggtgagtatcctaccggtcaaaaagcggttcgaaagaggggaaagaaactaa

SEQ ID NO: 1396 - DNA, 240 bp, A.fumigatus
gtgatagactggacttgccctcaaaccagtttagctgtaatagtcccctgcgtcgccagtccgtcgtcatgtacacaggcatccgaacgcgatctgaaggccaagtctttcaaaccccttgcatttagtcgagactattctggccagtcaaataataccgatctaggcggatctcaaagatatacctacgttgcggagaatgctgcgctcagacgcacgcggatctgctttgaggattaa

SEQ ID NO: 1397 - DNA, 1188 bp, A.fumigatus
  unsure (31),(35),(36),(53): Identity of nucleotide sequences at the above locations are unknown.
gtggtatctatgtgcccggccggcgcgatgnaaannagaaccgtgaggccgcnggacaagaaagcggcgtcgattgaggagacacggaagagcttacccatctaccagttccgggatcagataatccaggcggtgcatgatcaccaagttctgatcattgtaggagagaccgggtccggcaagaccacgcagatcccgcagtatctccacgaggccgggttcaccaaaaacggtatgaagatcggatgtacgcaaccgcgacgggtggccgccatgagtgtcgcggcccgtgtggctgaagaaatgggagtgaagctgggcaacgaagtgggctatgctattcgttttgaggacaacaccagcgacaagacggtgctcaagtacatgaccgacggtatgctgctgcgtgagctgctaaccgagccagacctgggccaatactcggccctgatgatcgacgaggcccacgagcgaacggtgcctactgacattgcctgcggtctgctcaaagatatagcccaggcgcggccggatctgaaactcctgatctcctctgccaccatggacgcacagaagttccagaaatactttgacgatgcacccatcttcaacattcctggccgtcggtatcccgtggacattcattacacttcgcagcccgaggcgaattacttggcagccgccatcacgaccgttttccagatccatgtcagccaggggccaggagatatcctggtgttcttgaccggtcaggaagagattgaagcggctgaacagagtttgcaagagacggcccgcaaactggggagcaagatccccgagatgatcatctgccctatctacgccaacctaccgtctgagctccaggccaagatcttcgagcccaccccacctaaagcgcggaaagtcgtgctggccaccaacatcgccgaaaccagtttgacgatcgacggcattgtctatgtcatcgatccgggattcgccaaggagaatgttttcaatccgcgcacaggcatggagagcttggtggtgacgccttgctcgcgagcgtcggcaaaccagcgagctggtcgagccggtcgagttgggccgggaaagtgtttccgcctgtacacgcgatgggcttactacaacgagttggaagagagtactacgccagagatccaacggacggtcttcaccacggga

SEQ ID NO: 1398 - DNA, 1170 bp, A.fumigatus
gtggacagtcaatacctgtattttcccgggtgcatgatcatgtcatttgacgatccgtcgacgaggacgaccgaggtgaagctggttcgagtggcgcagggaatcaatctgcagaaactcgccaacactcatcgaatctacaaaaatgtggtgcatgatgtgatcggagtggaagaggctattcaggaactggaggatattcaaaagaaaccgccgcgattcaacaagtggatcgtcgtgttggtatacggattggcgtctgcgactgtaggaccgtttgcgttcaatgcccggccgattgacatgcccatcatcttcttcaacggctgtctgctcggcctcatgcaacaagtcttcgcgcctcgctcggcgctctactcgaatgtcttcgaagtgacggccgcagtgctcacctcattcctggcccgcgcctttggcagcattcccaaggccgtcatcgacggcaagcggcagtttctcttctgtttctctgccatcgcccaatcctccattgcgctgattttgcccggcttcctcgtgctatgcagcagcctcgagctacaatcccaccagatcatcgctgggtctatccgcatggtctacgcgatcatttactccctcttcctcggatacggcatcacagttgggacaaccatctacggactgatggacccgtcagctgtatccgacatccagtgtcccaaagccggggccttcaaaaacccatacctgcagcggtttcccttcgtggccatcatgaccgtctggctgctcatcatcaaccagggcaaatggaaacagttaccggtgatgtcgaccatcgccatgtccgggtacatcaccaactacttcagcacgaagcggatgggctccaactcgcaggtcgccaacaccgttggcgctttcaccatcggcattatgggcaatctgtacagtcgcctgtggcacggacatgctgcaacagccatcctccccgctatcctcgtgctggtcccctcgggtcttgcagcgtccgggtcgctgatcaccggcgtggcgtcggctgatcagatccggcacaacattagtagtcccagcgggacctcgcagccgggggcgggcctgtcaaccaattcgtcggtgtggacgctagcggtggcgatggtttgtcttcacgcaggcgcgccgcag

SEQ ID NO: 1399 - DNA, 402 bp, A.fumigatus
gccccatcaacgtatggcaggctcacggctccactctgtgcggagtttgagacatcgtcggtgccaacatccaccctttcttcaacgcggatgtctccgccgaccaggccggcaagttcgttgctcaggagatcaaggtccttgagagcatctgccctggcaaggatgttctcaacctggagaccggctggcctcacgctggtaacgccaacggcaaggctgttcccggtacctccgagcaggctatcgccatcaagtccattgccgacgaagtcggctccaagtctgtcttcttctcctactttgatgacctctggaaggagcccggtcagttcggtgtcgagcgctactggggttgcttcgacaccttcaactaaagcgcgggttgagcttgcgttctga

SEQ ID NO: 1400 - DNA, 327 bp, A.fumigatus
gacatcgtcggtgccaacatccaccctttcttcaacgcggatgtctccgccgaccaggccggcaagttcgttgctcaggagatcaaggtccttgagagcatctgccctggcaaggatgttctcaacctggagaccggctggcctcacgctggtaacgccaacggcaaggctgttcccggtacctccgagcaggctatcgccatcaagtccattgccgacgaagtcggctccaagtctgtcttcttctcctactttgatgacctctggaaggagcccggtcagttcggtgtcgagcgctactggggttgcttcgacaccttcaactaa

SEQ ID NO: 1401 - DNA, 1161 bp, A.fumigatus
aatccctatgaggtgacaaaggaagacaaagttcaaccggaaaaccttcccccggctcagatttcattgactgattgccttgcatgctccggatgtgtcacgtctgcggaagcagtgttgatatccttgcaatcacatacggaggttctcaatactcttgattcgtaccccgaattgccgcttggttctacaagctaccaaagaggcacacaaaaagttggatcagcagacagcgatggtcgcatctttgttgctagcgtcagccctcaagtcagggcgagcttggcagccacatacggaatcaccgagcgggaggcgaaatatatgattgaccaatttcttatgggccctcacggtctcagagctggtggaaaacatggcaatgggtttacatgggttgtggacacgaacgttatgcgtgaagcagtgttggctctgacagcggacgaggtcacgagctctttattatcaactggatcgggcagccttcccaagagtccaattctttcgtccgcttgccccggctggatatgttatgctgaaaaaacacacccttttatccttccgcatttatctcgcctcaagtctcctcaggcgttgagcggcacatttctgaagtcagtgctaagcaaggcacttggggtcccgccttctcagatatggcatttagctatcatgccatgcttcgacaagaagctggaagctagccgggaagagctgacagacattgcatgggcttcaaccttcacccagtcacagacaacacccgtccgcgacgttgactgtgtcataaccacccgtgagctactaactttagccactgctagggggctttctctacccaatttgccgctcaaaccattgcccgcgtcatgtttaactccatttccagatcaagccctagaatcatttttgttctctaagagctcgtcgggccaaacagtcgaatcagggacatctggaggctatcttcatcacgtcctccaaatcttccaagccagaaaccccggcagcaagattgtcacccagcgtgggcgcaacgccgatgttgtggaatatgtgctcatgtcgtctggggatgagcctctttttagggcggctcggtattatggcttcaggaatatacaaaatctcgtcagaaaacttaaacccgcacgcgtg

SEQ ID NO: 1402 - DNA, 396 bp, A.fumigatus
gctccctgcgttgcactttgctgcctcattctgaccagtactgatcaattctttgagaaacagagtactcagccatcatgccctcatctgctcctctcgctggcactgccaatggcaatctcaacgccaatgacaacatcactcgcttcgagcctcccagccgagtgctctctcctcttactcacactctcttccacaacaagacgagatgcttcgtatagtaagtgtttcctggctgcaaacagggtcaatggctgggctgatggttatcacagcggtatgcaacccagagccgtgcaaggcatgctcgacttcgacttcatttgcaagcgtagcactccttcggttgctggtatcatctacacttttggtggccagttcgttagcaagatgtag

SEQ ID NO: 1403 - DNA, 270 bp, A.fumigatus
ctatggaatcgtaggtactggggtactagcgagactctccttcctgtctaccaggatgtggccaaggccatggccaagcaccctgacgttgacaccgttgtgaacttcgcctcctcccgttccgtctacagctccaccatggagttgatgaactacccccaaatcaagtccatcgccatcatcgctgagggtgttcccgagagagtatgtcttgcttacatttacccgcatagagtaaagaagttaacggtgggaacagcgtgctcgtga

SEQ ID NO: 1404 - DNA, 354 bp, A.fumigatus
cggtgggaacagcgtgctcgtgagatcatggtcactgccaaggagaagggtatcaccattattggtcctgctaccgttggtggtattaagcctggtgctttcaagattggtaacaccggtggtatgatggacaacattgttgcctccaagctctaccgcaagggttccgtcggctatgtttctaagtccggtggtatgtccaacgaactgaacaacatcatctctcaaactacagatggtgtccacgacggtatcgccattggtggtgaccgctaccccggtaccactttcatcgaccacctcctgcgttatcacgccgatcctgattgcaagatcctcctcttgctcggttaa

SEQ ID NO: 1405 - DNA, 189 bp, A.fumigatus
acccgttgcgctcagtgccacactgtcgagtctggcggtccccacaaggttggccccaacctccacggtctcttcggccgtaagaccggttccgccgagggatacgcttacacggacgccaacaagcaggccggtgttacctgggacgagaacagtctggtatgtttgtcattttccatacttgcctga

SEQ ID NO: 1406 - DNA, 567 bp, A.fumigatus
tatcgtcacagggctttcggtcttctgctctacctgaccactgccagcctctccttcgctctggtcttcgacaaacgtgccatgcaacatcccaaattccttcgccatcagatacggcttgaaattgggcaggcgttgcgcgcaatgcccgtgatggcggccctgactgctcctctctttctggctgaagtgcgaggatacagcaagctgtacgactttcccaccggaagtcccttccctctctatacctaccttcagtacccgctctttatcgcatttaccgattttgccatctactggattcatcgaggactccatcatccggccatctacaaacgcctgcacaagccgcatcacaggtggatcatctccacgccttatgcgagctacgccttccacccagtggacggctggtgtcagagtctcccgtaccatgtctatccgtttctctttccactgcaaaaggcggcgtatttgggtctctttgtgtttgtgaccatctggactgtcatgattcgtgagtctcctgagctcttaatttctgaagctgcccgatgcttatgttga

SEQ ID NO: 1407 - DNA, 291 bp, A.fumigatus
aatgaatgcccagatgatggagagtacgcgctcgactcgcccgtgatcaatggatcggcctgccacacgattcaccattactatttcaactacaactacgggcagtttaccacgttttgggaccgtattggaggaagctatcgtaggccaaatcgggagctattcgacaagcagcaacggctccagcagaccgagatccagcggcaagttgaggagatggagagattggtaaaggaggttgaaggatctgacgatcggtgctatgagcaagacaccaagaaaacttcctga

SEQ ID NO: 1408 - DNA, 675 bp, A.fumigatus
  unsure (558): Identity of nucleotide sequences at the above locations are unknown.
gtggttatgggcagtcgaactcgatctgatttaaatcttctttgcagatatctcacccacgggtcatggtgccttctctggccggtccagctccttatcttgcggatacagaagaggaagctttcctgggaagcattctggcgacgtcacgtttatttgttacgcaccacggcgcaaatggttgagtcgagggatcttcatctcacgtcgcgcgatttgcaccggtcaccgattccctacatgctcaggaccacggctttcgtgaccgtcgccctcaccattgccggtggatcatggtatgtggcagttaatcttacgacagccagtgacctgaccgcaatctacaactgttccgcgttcttcgcatatgctttctccattccgctactgaacgataagctgcggtgcgacaaggtgtgtacggttgtcgctgccattgtaggagttctagaggttgcgtacggtgatcgcagcgaatgcaaacagactccggacggcacagtgtggaaaacaaagcaggacgcacagaacagactctggggcaatatcataatcggngtcggaagcgtgctttactgtctgtactacgtattgcacaagcagtacgcttgttcccacgagggcacaagcgcgggccggaacatgatcttggccacaccttcggcagttgtatag

SEQ ID NO: 1409 - DNA, 231 bp, A.fumigatus
ttgcattacgcaactagcttcgctcccctgccgtgtaagacaaacaccatggaatacagtcacatgcacatgaacatggcttttattcatattccgcttccagaataccgtgactcctcgaattactatagaggaaattggtcggaggctcccaccgcaccggggttcaactctggtttcaaagacgctctagaagaggaaggaattttgttcgtgagctgcggacagtaa

SEQ ID NO: 1410 - DNA, 276 bp, A.fumigatus
cttattactagcgatcatgttaatgattactgcatgcttaacaaagaccgagaccagaagccgtctctctggatgtgctacggaggcggtgctggttttggaggctacggaggttatggtggctatgtccgtcgcgtccgattctatgattttgacatgaaccccggccgtgttgtgacgtacaagcgacttgaatacggcgaagtagaggccaaaattgacgaaatgatgatcattgacggaggcgcagtgaagggacctgacgaacaccattga

SEQ ID NO: 1411 - DNA, 207 bp, A.fumigatus
agaagctttagtctttggtacagggaacttctcagtttcaaagtctggtgtctaatctctaccatcatgaaagttaatgctactttgactctgctgctgcttggcctggcagttgcttctcctgcctcggaacccaacagcgaagacagtcttcagggtatgtctcattctctcatctcagggttgatctataacgctattacatag

SEQ ID NO: 1412 - DNA, 219 bp, A.fumigatus
tattaccgcgatgactcctcttctgcggattggaacatctcaattagaatctacgatactggatgcaagttctgttgtcatcgtaaacttttttgccatttcatttataataaactctcggacacctctccatggctcaacgtctcactagagagcaagacccgaactaagaagcgagcaattgaccggctctcatgtgacacccaaaaggttcggtga

SEQ ID NO: 1413 - DNA, 795 bp, A.fumigatus
cgcaatcgcggtccctccatgccggtggtgaaggcccttatatatccgcaggctcaaagtggcgatttccctcatctcctgatgtatgggccgtcgggtgcaggcaagaagactcgtgtgattgcgacgctgaaggagttgtacggctcgggagtagagaagatcaaaattgacgctagagtcttccaaaccacaagcaatcgaaaacttgaattcaacatcgtatcatccgtctaccatctcgagatcaccccatccgacgttggcaactatgatcgggtggtcatccaagagctgctcaaggaggtcgcgcagactcagcaggttgatctatctgcgaaacaacggtttaaagtcgttgtcatcaacgaggcagatcatttgactcgcgatgcgcaagcggcgttgagacgaactatggagaaatacagtcccaacctaagactgatcctgctggcaaatagcacgtcgaacattattgctccgatccgttctcgaaccctgctggtcagggtcgctgcacctacggaggaacaaatctgctcggtattacagaacgctggtaaaagggaaggctggccggaggcccctggactcaacaagagaatagccaaggagagcgatcgcaatattcggcgagcgcttctcatgttcgaggcgatatacgctcagacgtgggtgctcagtgctatatgtgattgccggtgtgtaactaacaatgctactcaatcagggagaaggtcacggacaacacgccaattcccccgcctgactgggaagctcttatctcattaa

SEQ ID NO: 1414 - DNA, 192 bp, A.fumigatus
caatgctactcaatcagggagaaggtcacggacaacacgccaattcccccgcctgactgggaagctcttatctcattaattgcagacgagatactcgctgagcggtcaccggcccgtttgctgcaggtccgcgcgcggttatatgacctccttacccactgcataccacctacgacaatcatcaaggtttga

SEQ ID NO: 1415 - DNA, 867 bp, A.fumigatus
  unsure (64): Identity of nucleotide sequences at the above locations are unknown.
ggtgaacgcatgcgcggatctttccggcccctgtggtggaagacgactcatgcagattatccgnaaaagaagcgacctcgtgtagacgatgattctcactcttccgaggtccatgatctcgtgcgtcctcggccgctctcatggcgcccttcggctccggtggagcccccgttgcaagctgcccagcttcgttctcttggagtgctctccatactgaattcccccacaaaatctgctcctccttgtctggtatcttcggggggagataacctgagtctggtcagacatcagtcgtctgcccctccatgttctccttctgcacctgcttctcatgtccgactgcattcatcgccaacgcttcgtctagcttcgccctcgatacatcctgccaaacagcaatcgctctcccctggttcggtgaaccgtcagattctctcgcctgtctcccccacatctcggtttgtcggagccggagggccgtatgctagaaagcacagtgctatgcagtctcccctagctcaggagtcacggccgggattgtatccgttgtcctctgggtcgcctctgccgctggaaaatgcgacagtgaacccgaatcatgggcccgaaaccatagccccagtacccgtgtccatccactctacccaacccttccacagtcgggggacgagcgtgaacccgacccctactcccaactcccaagagaggagccccacgactcctctttccatttatggtacgctcggtcgatcatcgccagcaatcgtggggatgcccatctcacaatctgcgccagcgttcgccaattcccaggtatacggaacgtccgaaacggtcagtcgattgccatctgttgtcggtgaatag

SEQ ID NO: 1416 - DNA, 225 bp, A.fumigatus
cgctgcagcgcaaaaaaagccggcgtgacgttattcgtaacccttcccggcaacgagcgtggttctgagcctatcgcgaccatcgccaagttgaagacacatgtctactacaaaggaaacctagtgatgatcgctaagcttgcgaatgtggtctcggtctatgtgcctggcaagtgtcctgcctggacggtagaggttgcagaggggatggtctatctctggtaa

SEQ ID NO: 1417 - DNA, 336 bp, A.fumigatus
agaaataagagaccattgtactcgatcctggcctgggctgatcatttacctagtgtcaacaataacctgcacatctcggtatcaatgccatgcattgaagttggaacaatcggcggcggaaccatccttgaaccgcaagccgccatgcttgatctgctgggtgttcgaggtgcacatgccaccaatcctggagataatgcccgccagctcgcccgcattgtcgctgccgccgtgctggcaggcgaattaagcacgtgtgctgctttggcggcgggccatttagtcagtgctcatatggcacataatcgcagtaaagtggcggcgaagactggatga

SEQ ID NO: 1418 - DNA, 315 bp, A.fumigatus
agacagctagcctggaacttgtctgctcattcaaaagcatggcatcatcaaaattactcgcactcaaagctccctccggcgctcgacacaaaagacgtcgacgcagaccccgtgcccctgcacgtcaaacagcacagccaaagcttgcccggcggcgacttcacaatctccacctatcccacggatgactctccgctcggaacgaagctcttctccgtgaaaggcgatttcggctggttgagtagcaaacggcatctcagcgatatctcgggcctcccgctgtttgacgctgcagcgcaaaaaaagccggcgtga

SEQ ID NO: 1419 - DNA, 252 bp, A.fumigatus
aggtctcttctattagtatatttagttagtaaactagcagtatgtttaaagactgatttactagctaactataacttcatctttaacctactagatggattaaccttaaatagagccactatatacacgcatataattaactataagttctcctttattaaagtctgcaatgaaacacctactctaattataattacttattatacttatatagggactatctctaatactaactttattactgcctactaa

SEQ ID NO: 1420 - DNA, 705 bp, A.fumigatus
ttcaagtgtaacagatccgactggcagcttgacataaaatccctcgagttctatgaggcatcttcaatcaatgccgctctgaggtctttctcccattctatcaatttcagacgcactgcggacatcaacgacatctcggcaaagccacagaggaaggtcgtctttccagcctctgccccggtgtcccggtttgtcgaaaagacagcgatcaggtaccggcttaagaacaccaagtacatcctcgagatcgcccgttacgatgagtacagtcgcatgactctgccagggtacgggggacagagccctgccgccatcaccggtccaatctccgaggttccttcaagttcttggggtgcatcgatcttcgatccaaattgggacaacttgctcggacagcacgcgaatataccgctcggacatactgcaagatacagtcccagtttgaacacgttctttccatccatagaagagaccaccggaggcaaatgcaaaggattctgggagctgattgccttggtaagacaggttgcagagcttctaggctcaacgaatactgccgctgaaaacgggaagcagcgagttcctaagagtccttcgagcgagaagtctgatgaagccggtactgcacgtcaaaaacaccagcagttcaacaacggccctcaaatgcgtgtcttgttggatgcagatcttggcacattgttctga

SEQ ID NO: 1421 - DNA, 783 bp, A.fumigatus
  unsure (737): Identity of nucleotide sequences at the above locations are unknown.
agtaaaccagctgagccccaaggccagccgactaccacttcggactattttgcgtcctcaaaaaggaacaccaaacctggcaaaagcgaagacgtggcgaagactaaggaggtccggccttctcatactgcatctctcaatggccgtgacgctgaggacgcttctgaaacgaagaacaaaaagaccctcgaccaatcacccagacaaagctctcgcaggacggccaataagagcacagttgttctacaagacgacgatggcttaggaaatgatgacattttcgcgacagactatcgaaaaccaggtcaatacgacgacgactacgttgaagaggatgagcacgacggagacgatgactttgagaaaatggaagtcaaaccagccagtgcggcttccggccagtcgtcgcgcagaaagaacgccaacgcagccgagtcagccgacgtggccatgaacgacgcaccagcagagcccaaaagcgcctcgcgcacaggccagaaacgaaagtctgcagccattgaccgggatggagattacgaggattgtaaaacctcgaaaggccctgcgcgcacaagagcaatcccatcagctcccgctgccaagaaacagagaggagtagctactaagaaggacgagccagagagcaaggaaatccaggatatattcgacagcataccgaccatcaaaccaccttccccaccaccgccatcaggtgagaaggcgaaatttaattttgntgctacgcacagatgccgagatcctgtagaaattcgccacgggtga

SEQ ID NO: 1422 - DNA, 831 bp, A.fumigatus
aatcacagtaggcgatttgacagatggaatggccgccttgtcgataaagcccgagggaacaggttatttcggttcgtatcggatcgaaacgaaggaaatttcagccgtctgctaactcccttcacaggcgcatcttccagtgtggtgcctcttcgagcattattgaagcatggtttcgatttgaattttcccgcaagtccgaacaagccagcggaaagagtgcctcttaaaagccagcttctgagcactgcaccttccgggctcattgagcaagctttcatggacgccttctttctcaattaccataccagttatccattcgtacacgaagctactttcaaagcgcaattctatgaacaagttccccgcccgcatggacaggcgtggcagattcttctcaataccattctagcccttggggcgtggagcatcggagatgataactccgaccttgatatcacattctaccaggaagccagaagccacctgcagcaggtgtctgtttttgagacaggaaatcttactctcatcttggccctgctactcctgagtaactatgcgcagaagagaaacaagccgaacaccggctggaatttcttgggcctggctgtgcgaatggccatgagccttggtctgcacaaggagttcccagggtggaagatcagtcttcttcagcgagagatgaggaggcgattatggtggggtgtgtatatattcgacagtggtgcggcgaaaacctttgggcggcctatcctcttaccagaggacagtgtcatggatgcgaaacacgttctcaacattcacgacgaggtataccaatcccctccataa

SEQ ID NO: 1423 - DNA, 219 bp, A.fumigatus
gctctcacatcaacgaccaccgtgctacccactgaggagaacggaccgactatctactcaggcatgatcgcacaggcgaaattccacctacacaccaatagcgtgtaccagcgtctgatatcaacaccaagtctaaccgcggaggagacattgggtctctccaaaccaatggaagactggtacgtcttacaccagacgggctgcaaggacatgcgatga

SEQ ID NO: 1424 - DNA, 216 bp, A.fumigatus
cttaccaacacagaatatgaaaatcttttacccaacggcaaaacggatcaatacatccagtgtaccagacagcgcctagatagtcctgtgaaatatcacttttttcgtccgaaaacccctggtggtcgagatattctcttcctgggctctctggagctagagacaacagacgaccggctctacacacggaagtccagcacctgggctgcttcgtag

SEQ ID NO: 1425 - DNA, 528 bp, A.fumigatus
  unsure (42): Identity of nucleotide sequences at the above locations are unknown.
agcttgtgcatttcttacccccatattctcattacaggggcngaagccatggtcattttacctgttaagagtattttgcgggtcatcagttcttccatcttatttctcagggtcctgttttggggcaagacccaccaaactcaggaatctctggatctactagaccaggctatagctgtttggacctccgatcttctggacgatatataccttgtttcgcggtatgcagccttgctaaagattcatgtctcacggctcggcagaccctttgccaattgcagcaggttttcaagcaaaggcgaatcgtatacccaagagcctggtacaccagtgcccacagctgctgaaagattcgactgggatcccagtatgatggatttaggtgaggccaacggctcggatgactggttgtcactcctgctagaccctttgatggcgccgtttgggtcttgggacaatggactcacagatctgggaacggcctcaggcgacctgaatttggatttcgtctggaacttgcccccatga

SEQ ID NO: 1426 - DNA, 219 bp, A.fumigatus
  unsure (156),(163),(201),(204): Identity of nucleotide sequences at the above locations are unknown.
cacctattcttaatttcttccatgtgcctgttcaaccaatatacccacataacatctgttcctaattttccctgctctactgaattgtctataacaacgaccgaagcattgggaggcaagcataaaacccaaatacccgtttatacctggagttgntactgtnttaaccggccgggatggccggaaatgggctcaatcccnccngattccgccgccccg

SEQ ID NO: 1427 - DNA, 1449 bp, A.fumigatus
  unsure (411),(419): Identity of nucleotide sequences at the above locations are unknown.
ggcctcttccttcgtctgctagattcaaatatcgtgataaacctaagagactacagctttatcaacaccatcaacttttactccaagttgaagcaagatatctcactcctcaaactcacaatcagcgctccaacaatgtacgaactccttgcctttataaccataccttgggtaattgctcaccctcggttattcatggcagtagcagctgccacgacatacttcatgcactcgactggccggacctttcacaacgtacacgcgaacatggcctcccaggtaactggcattctgcccgaagaccttcgaagagacgacgttctctccaaccgaatgacggtagtctttcttcatctgttcgtcttccggtatttgcgcctcatcgtccatcttatctccttctggctcttntaccatcntacccctgtccccaaaaaccctgccctttccccatctgactgcacaatcatcctccccaccattgatcccaagaacagagactttgaagagtgtatcacctcgtgccttcggaacacaccaggtgccatcatcattgttactgttggagaccaactgacgaagctgaccaaagacatcatcgccccctacaagcggatattcccgaataccgagatctctgtcagaaccgccgacgaagctaacaagcgccgacaggtcgcgcatggccttcgatacgtcaagacgaagatcaccgtcctgctcgatgatcacgtcgtctggcctaccgaacgcttcctcccgaccatcctggcgccgttcgaagacccgaaggtgggcatcgtcggaacgaacaagcgtgtccgccgtaccgacacagggttcaacatcagatcgttctggaacatgcttggtgcgctatacctggaacgacacaactttgagatccgtgctactaacgcgattgacaatggcgtgtttgtcgtttccggccgcacgtctgcgcatcggtctgagattctcaaggatcccaagttcatcgccgagttcacgaacgagagattcttcttcgggctgtttggtcccctgaacgcggacgatgacaacttcatcacccgctgggacgtccgacacgggtggaaggtcaagatccagtactgccccgacgcaatgatcgagacgaccctgggtacgtatcccaagttcctctctcagtgtctgcgctgggtccgaacgacctggcgcagcaactcggccagcttgttcactgacaggacggtctggtatacccagccatggtgcgtgtacgccgtctactggacctcgttcgtcaattttgccttgttctacgacggtgcgttggcgtataccctgctcaaaagtccgctcggaaccgctgataacctgaaatatctcgcggcctggatcttctgcacgaagatggtcaagctaacgccgtactttctccgcgagccccaggatctcgtcatg

SEQ ID NO: 1428 - DNA, 1284 bp, A.fumigatus
aacccttggacccgggcttcaaggaggcgatcccctcggcccaagggggggaagtgttcaccccgcccaaatacgcgggcggaattcgggatgtttggtgaatggggcccctccccccccgcaatgtttggaattctgcggccgagacttcaccggtcggctgatacgccatcttttcttcgacctgttccgcgttttgggagcccgttagacaccattcccaaacgatcttcatctttcggtcgctggacagaacagcaacggcaaaacgaccggtccatggtctcccgacccagaaatatgggcgagacagccgagacgacggatccaggttctcccatgaccgtccgtccgcgcacgtctctggacggtgacctcttccagccgagtcgcgagggtcttttttttccgcgacctgcaccagtcagccctctcttctcatcacatggcgcggggggtgcaggacaggtgcgtcctgctgcgcatcctctttccagaactattacacagtcctcgtccaattcaagtttggcagacgactcgcctactcatgagcccatgcataagtccgagcggccgcgcggcgtcttcgatttctccaaatctcttcctgcgggtgcgacacgacctggtgtcgtacgacacctaaatcgtgaggactcgacatcatccgtcgactcgtttgcgacaccggagaattacaaactggtcaaacctctgccagccgcattcatgtcaacaggcttaatctcgaagaagaatcgtaatgcaggagatcaccagaacatgctcggtttcaacaagaacatgcctgatacgccttgcaagcgacccatcaatctgtttcccacagggcagaagccgatgtccgagtgggaacgccctcgattgatgcctcaagcggatgtcgtgccatctccctccccatccaatccccccagcgcgcgccccacgtcggggcctttcgcacggggcatgggtatctttgggaactcatttaacaagccagacctctcgcgtcgaggcagcctcgtgagcgtggacggtgatgagctgacccagtctcagtcgccttgcgctcagccggacagtcagccattgagcgaatacgatcttccgccgactccaacgaagcaaactttctttccctctcgaacctatccgcctgccacgcagcagattgcatccttggaacgactatccgaagtactcggaaacaactcaagtcctttgcacgacaggttccagcggtcttcaccacggggctggaaagagcgcgtccat

SEQ ID NO: 1429 - DNA, 876 bp, A.fumigatus
  unsure (113): Identity of nucleotide sequences at the above locations are unknown.
atttatgtggggccagtttgggaaagaattctctcccacatcggtggagtttacaatattcccaactttcacgtccgtggcggtgtttgccagacgaatattgtttccaacantgccttccgtgggtttgggggcccgcagggaatgttctttgccgaatcttttatggaagagattgcggatcatcttgacattcctgtcgaacagttccgacagcagaatatgtatcagccgggagacaagacccattttcaccaggagctcaaagactggcatgttcccctgatgtataatcaagtactggaggaaagcgcctacgcggaacgccgcaaagccgtggaggagtataacaagaaacacaaatggtccaagcgtggaatggccatcattcccacgaagtttggcatttccttcacagcattgttcttgaaccaggcgggcgcattggtccatatatatcacgatggcagcgtcctggtcgcccacggaggagttgaaatgggccaaggactgcatacaaagatgacaatgatcgcagcagaagcacttggtgttcctcagtccgacgtcttcatctcggagacagctacaaatactgtcgccaatacatcctctacggcagcgtccgccagttcggaccttaacggctacgccatcttcaacgcatgcgaacagttgaacgagcgcctgcgtccgtaccgtgagaagatgcccggggccagcatgaaggagctcgcccatgcagcctacttcgatcgggttaacctctccgctcaaggcttctaccgtacccctgatattgggtacgtctggggggagaacaaggctcaaatgttcgtcttctaccacgaggcggcaaggatccgcgtattgggg

SEQ ID NO: 1430 - DNA, 528 bp, A.fumigatus
tgcgcaactcaaaaccatcctcttccgatttactcccatcgatttgcctcctccgcaacttatagcctactctcctcccgcgcggtcattgaccaccgcatattgatttctcggattgcaatcatgacagacatggtcggaggacagagcgacgatgtccaccaggtgccgcctcctcttccaccggcccctatggagaactacacctttcctgaacatcgtttgaagcgcaagatggacgacccggagaagacccctctgctcctcgtggcttgcggttccttctcccccatcacctacctgcatcttcgcatgtttgaaatggcggccgattacgttaaattcagcacggactttgagctcatcggtggatatctctcacccgtttcagacgcgtatcggaaggctggtctagccagtgcggaacataggtatgaaatctcgcggctattctatccgctcgttcagactgctgacgcaatgtgtcttatgactcatcagggttgctatgtgccaacttgcggttga

SEQ ID NO: 1431 - DNA, 396 bp, A.fumigatus
gcgaaatttccccccctcgtcttgcgaccatctgttaatgagtccgcccatgtagcctggcctattgccgacgaggccctcacccagaacctcctggatttggtgcagcaagcttctcactaccgtcagctcaagaagggtgccaacgagggtatgcctgtctggttatccttttgtcttttgttcttgactgacattctgcctcagctaccaagactctcaatcgtggtaccgccgaaattgtcatcctcgctgccgacacctcccccctggctatcctgcttcacattcctcttctttgcgaagataagaacgtacggtttctccttccgatatacttctctactccggtcgaatactaactatcaatcaggttccttacgtgtacgttcctag

SEQ ID NO: 1432 - DNA, 246 bp, A.fumigatus
  unsure (120),(219): Identity of nucleotide sequences at the above locations are unknown.
gaacgtacggtttctccttccgatatacttctctactccggtcgaatactaactatcaatcaggttccttacgtgtacgttcctagcaagctcgctctgggccgtgcgactggtgtctcncgtcccgtgattgcggccagcataaccaccaacgaagccagtgacctgatgggccagatcagaaccatcaaggacaaggtcgagagactgatgatctanacgtggtttcgatctgtggatgagtga

SEQ ID NO: 1433 - DNA, 345 bp, A.fumigatus
aagttgtctctctttttctatcgtctttcccttccagtcgccatcacaatgcccgtcacggcttcccgtgccgtgctgcggcaatcgcagttcctgactcgcagaaccgcggtcagatatgcctccaacacttctgaggctgcctcaaaggccagtcagactgcctcctctgctgtctcgaaggcctccgagggtctctcccgtgtcacttcgacggctggtcctgcgatctcgaacgctgctcagggtctcggtagcgctctgaggaaggtcggtggaagaaccgggaaggtcattgcctttgtgtcttcacccacggggctggaacgatccgcgctatgcgac

SEQ ID NO: 1434 - DNA, 294 bp, A.fumigatus
cgcggctccttcgagccccgtggtgaagactattcaggccagaacggcaagaaccagcgggttctgacgtggcttgcgagcgactctcggaccgatcctcaggcgaaggggaaaactacggaatcgttcactggtgatctcttacctctgatcaccgatctgtactccatgactggggaggcttacccgtccaaatccgactacatgggtatcttccagttcggtaccgaggctttctcatcaagtacgaatgtcacgttctgggcacccaaattctctgtagatctgcgatga

SEQ ID NO: 1435 - DNA, 1122 bp, A.fumigatus
ttccgtgctgcctatgcgctcggagttcttgccagtggcttcgctgataacttggatcagttgaaggagctgtgcaccaaggctttcgccgtcagcccccaggtcctgatcgaaaagagtatgaagggctggaaggaaattgagtatgaggtagtccgtgattgccaggacaactgcatcactgtctgcaacatggagaactttgatcctctcggtattcacactggtgactctattgttgttgcaccttcgcaaactctgtctgatgaggattacaacatgctgcgtaccaccgccgtcaatgtcattcgacaccttggcgttgtcggagagtgcaacattcaatatgctttgaaccccttctcaaaggaatactgcatcattgaggtcaacgctcgtctgtccagatcttctgcccttgcttccaaggccaccggttatcctcttgccttcatcgccgctaagcttggtctgggtattcctctcaacgagatcaagaactcagtcactaaggtcacttgtgcctgcttcgagccctctctagactactgtgtggtgaagattccccgttgggatcttaagaaattcactcgtgtgtcgacccaacttggctcttcgatgaagagtgttggtgaggttatggccattggacgtacctttgaggaagcgattcagaaagccattcgctctgttgacttccacaacttagggttcaatgaaaccaatgcactgatgtccatcgatcaggagctccagacaccttcagatcaacgtctattcgccattgccaacgccatggctgctggctacagcgtcgacgacatctggaagcttactaggattgataagtggttcctcgccagactcaagcgcttgagtgactttggcaagctcatgagcacctacaatgcaactactgttcctcgtcctcttctgcgcgaggccaagcagctcggtttctctgatcgccaactcgccaagttcctgagttcgaacgagctgtccatccggcggctacgtgttgaagctggcattatccccattgttcagcagattgacaccgttgctgctgaattcccttcaatgaacaattacttgtacctcacatacaacgcatctgcc

SEQ ID NO: 1436 - DNA, 924 bp, A.fumigatus
ccgagaaggttttcgcgcaaagccaaatttaagcccggccccaacctggggagtttttacccaaaccccttaggccaagagaggccagtttttttaaggccgccccctgcccaaaggcttgttaaaatgtcagccaccccggacacaagacgcccccgacacacttccggcattgacggcacaggcacaccggcaaccagacacaaacagtgttcttaccggagcttcaccccttccctcccgggaatagaaccgcccttggggcccctaaccggtgcagggcacaatgcgattgtcgggctcctgaacgcgccgtccctgcggcagctgaagacacacatccagcgcgcggaggagaaactgactgattcggcgggggaggtcaacgagcggcttacggatgcgcgggtgcggtatcagaaggagagggcgcggaagcggcggaaagcgaatggggagatgcctcttgctgagggggtcggtgcaaagcaggagagggaggatggcagcgaggatgacgatgatgatgacggggaggagagacaccggcttgcgcggttggaggagcaggttcagagtgttacggaggaactggaggctcggatgcggcagacgattgatgcggaggtgaagctggagggtttgaagggggtgctggcggatatggccaaggaggcggaggaggctactgttgcgggtgccggggctaggactgctcaactgcggagtcggcggacgagacggagacaaggcgatgacgaaggggatcaggaccccgaagaagagggcgatgaggactacgaagcgacgcccgagccgcagatgcctggtatcccgcctagccggcggctagaacagaagctggatgaggagtcggcgcggtgggcaggtcaatccttgactcagaggtacgtacttgcatag

SEQ ID NO: 1437 - DNA, 456 bp, A.fumigatus
ctcagaggtacgtacttgcatagccccatggctggacgaaaggaagaatggccgaaattaaaaacatacagatactccacgaacaatgcctacatcggcttctaccgcatcgtccacgacgccaaacaccccggcgaggacatcccacccctcccgcactcctccacttggttcgcgcacatggaagatccccacgcaaccacaacctccaccaccgagcagacatcggcccgacgcacccgccaacgccggagtccttcgcccgctgactcggacgagatcgccatcgagcgcgagcgcatctctctcagatgccccctcaccctcctccccttccgggaccccgtcaccagcaccaaatgtccgcacagtttcgagcgcgaggccatcaccgatatgatagcacacagtcccacaactgtccctgtcttaaccgcggggctggaaaatcacgcg

SEQ ID NO: 1438 - DNA, 540 bp, A.fumigatus
  unsure (183): Identity of nucleotide sequences at the above locations are unknown.
aaaatggacggggtgggcggctatgccggctggcgctggattttcatcctggaaggacttctgacagttgctgtggcccttgtcgccccctttgcgattcacgatttccccgagacggccacctttctgaccgaggaagagcgccgatgggtgattcacaaactgcggtctcaatccgggcgngacaccacacaagacgggaccgaccatgaggaatcgcgattccgcgtacgctatgtgcttgatgcgttgacagattggcaaatctacgtggccttgttcagtatgcttcccctctgcgttgcgcgacgacgactggttggactaatggatcagtgtactggggaatcaccacccctctctacggtatctcgtacttcctgccatccatcatcaaggacctcgggtacaagtcttcaacggcgcagttgctcacggtgccgatttacatcacggccgccattgtggctatcgcatcagcctggctgtcggatcgtcgcaagcagcgatctccattcattttcttcttcatgtcgctga

SEQ ID NO: 1439 - DNA, 429 bp, A.fumigatus
tgcgttgacagattggcaaatctacgtggccttgttcagtatgcttcccctctgcgttgcgcgacgacgactggttggactaatggatcagtgtactggggaatcaccacccctctctacggtatctcgtacttcctgccatccatcatcaaggacctcgggtacaagtcttcaacggcgcagttgctcacggtgccgatttacatcacggccgccattgtggctatcgcatcagcctggctgtcggatcgtcgcaagcagcgatctccattcattttcttcttcatgtcgctgattgccatcggcttcatcattgtccttgcctccactggtcggggagtgccaggggttgtctactttggtgttctcatcgccgtcgtcggtaagttttttgcccaccaacaacgcacccgtctgacaagacaggga

SEQ ID NO: 1440 - DNA, 195 bp, A.fumigatus
  unsure (153),(170): Identity of nucleotide sequences at the above locations are unknown.
gatcaatcttgtatcgtagatcctcgtatatcaccctgtctggcacgcagtgatccgtttactggagagtactgcagtccgcttgcacgccaggctttcatggattacactgagatattccgttatcagatcggccctatggggtatgtagtnttgaccgcagcggtagncgatcaggatttggttaaaaagggg

SEQ ID NO: 1441 - DNA, 339 bp, A.fumigatus
tgctgtcgttcattggtctgttctcccagcttgggaggggccattggatacgctgtggcggctgccatctatacaaacgtcttccctggcgcccttgagtctcgtctccctgcggacctcaagtccaatgccacgtctatctacatgggtggatacactgtacagcagacatatccgatgggctcggctgctcgtgacgcgatcaactatgcctggggccgaagccagaggtttggcgcggttgctgctacttgcattctgattctgggaatccctgccattgcggtctggaagaactacaatgtcaacaagcaccagaacaagggggtgatgatctag

SEQ ID NO: 1442 - DNA, 240 bp, A.fumigatus
gagacactctcgaacaaaccacttccgaacaccatgtcccgcgaagcttatcaggtcccctcactcggcgcccagaatacctttggcaccgagggtatggccgctggctcgatggatgggcctgtcgtcgcctatttgtgcggcgaatgcaatgcgcgcgtctccctgaagagaggcgatcagatccgctgcaaggattgcggtcaccgtgtgctgtacaaggagagaacgaagaggtga

SEQ ID NO: 1443 - DNA, 237 bp, A.fumigatus
tctgcggactcggatagcgagggatctgtcacgacggagccggtttctgtcctgtcaagggataaccagattcatgagtttttgaactattggtcagagaaggttgatatacccctttcccggctcgcgtacacgtcctatcgcgaagtggagagcgacgtgggtaagacgaagaatgcgcccaacgaaactgctcgtgttgtggaattggcaggaaagatcggaggtggttggtga

SEQ ID NO: 1444 - DNA, 951 bp, A.fumigatus
agaaagcatgtcattcctggagacaacagactgcagatttgtctaacatcatactcctctaaatcaagattgtgtttaaaccttcgttatccatgcattaagtcccagctcgatagtacttgcggattaaaaagttcatatgagacgtgcagagagcatgccactatgtccaagcaagacagccttctcactagaaaggctttggcatcatcggtgtcagggactacgcttttggtcatgatccagttggtttcgcggctgttcacctttgttgccaatcaactggtcctgaggaacctatcaccagcgactctgggagcagcaactcaactcgagttgttcatggttacgatcttatacttctctcgtgaggccatcagattagccattctgagacagcctcttgattcgccatcatcccccgatatcagcaaacaagagaagccgcgcatagcttgcgacaaggaaatggaagctcaatccatggcgactcaatcaatagtgaacatgtcctacctcagccttgcagttggaattgcgctttctatcttgctcggtactttctacatacagtttgctgctgagcaggttgctcaaacatctttctatcgctgcagtgtggcaatcgtctgtctcgcgtcgaccttggagctatgcactgaacctttctttgctgtagtccacagatatatgctgtacaagactagggcaaccgttgaaatggccgcagcattcgtaagaagtctaacaacgtgtggtctacttctctgggcatcttggaatggaagcaatgtcggtatacttccatttgcacttggtcatctcttttatgccttggtgcttctctgcggctactctgcaactctgtcaaactcagcgagtagatggcatttttcgtttctgcccagccgcataagatcaaggtatgtggaggtcattactatcaaatag

SEQ ID NO: 1445 - DNA, 537 bp, A.fumigatus
ctttatccccccccaaaaaggctcatggagagtgatggtatcaaagtcaacgacactacaccgcgcgccgcacaagacttgcgatttacaccttcttttgtcgacccgaactctctatcctatatgaacttcccagcccaacagagtgggtattacacaccgaattcggaaggtttggggccattgtttcatagccaagctggagacctacacacgcccggcatgagcatgatcacaccaatgtcccttacccaacaactacccggcccaaccttaaccgctggtggccaggcatttagcctggaccactatgatcagcactatatcaatccacattttcacaacccacaggcattcgccccacaaccgtctttcgcacccagcgcatttgttcaccgcgattcaggctacgacgctatggatgagtctgtggatgaaatgtcgctaaatgatgtcgatattcagggaaatacttcccagtttgccacttcagccgcacatgatctttcagatactccaggatctagtgagaagtga

SEQ ID NO: 1446 - DNA, 201 bp, A.fumigatus
acacacgctcgatccttccagccccgtggtgaagactcactcacaggtagaaaaaactcccagaagccagacgatgagttcattcaacgatttcagaaaactttctcggaggttgtccccctaggctcgcaacgcaacgctcccggtttggggcaagtggctggcaaccagcctatcactccgtctaggtatgtaatctaa

SEQ ID NO: 1447 - DNA, 204 bp, A.fumigatus
ccgttcattctggttccgatcggatcacccgatttgttgaccagcacacatgcgttgtcatcgaacttgacaatagttccatctggtctctgcatctccttctttgcgcgaacgacgacagcatgtcggatatcgccgcgacggaccttgtttgcgatgccgctgttgtttgtgctctcggggccgaagtttcgctgtttctga

SEQ ID NO: 1448 - DNA, 267 bp, A.fumigatus
cgaacttggatcctgatatggcttcaactggtaataggtgaccggattgtggttgtggttcagaaacagcgaaacttcggccccgagagcacaaacaacagcggcatcgcaaacaaggtccgtcgcggcgatatccgacatgctgtcgtcgttcgcgcaaagaaggagatgcagagaccagatggaactattgtcaagttcgatgacaacgcatgtgtgctggtcaacaaatcgggtgatccgatcggaaccagaatgaacggttag

SEQ ID NO: 1449 - DNA, 261 bp, A.fumigatus
caatccaggactgcgactaatttcatcgacagaggaaagggtactccccgccgcaaggtcaagaatgtccacaagtcctccggtgccgacgacaagaagctccagaccaccctgaataagatgaacgtccagcccatccaggccatcgaggaggtcaacatgtacaaggaggacggaaatgtcatccacttcaccgcccccaagggtgagttcctcactccagcttccgtctccgtctccccaaatccagaaggtagataa

SEQ ID NO: 1450 - DNA, 216 bp, A.fumigatus
gatgctgtcccgtcgtcgacagccttctttttgagagtttcccttctctgcttcacaactacctgtgcccacgccaccatgtctgaggaacccactccccatgaccacggtgagagcattgccgctcctccagacctaccaccaggatggaaatacagacagcgccgcatttttggcttcaacatcccctggtatgcctcgcctagcgtgcagttg

SEQ ID NO: 1451 - DNA, 189 bp, A.fumigatus
ggggttgggaagtcccttaaaaactccacactcaaaatgctgttgcccttggaatattttaaaatttccaagaacctccccatgaaatgttcggaaatccacctgtttaactatccggcctccattatgccccccattccgtggtctctaaattcccaaggcccacccaggtggtggcattttcccccc

SEQ ID NO: 1452 - DNA, 486 bp, A.fumigatus
  unsure (345): Identity of nucleotide sequences at the above locations are unknown.
ctgaggaccccttacgactgtcaatctcatcagactcaagaggacgtcgaatgttgctgtctggcatgtataaatcggacaagatcgtatgatggattcatggcgtccctgttgaagaatgtagtcaagaacccaccctatgctctattcgccattcccggactgcctgatattcccatgtggtggtgcaactcgtgtactgcatatttgcgcaaggaatcaactcccgtcatcaacatccgtagcggttggagtgccggcctcaacaccgattggactgccccggacaagattacaaatactatttcaaaccaacagctttggttttacgggtggtggattggnataacccttaaaggaggaagtccattggcgaatcctaaccccaccacagaaaagatctttctttgttcaaccttggctaaacaccggcttatttcttggattaagggaccaaccttcttaacaccctgccttaaggctaat

SEQ ID NO: 1453 - DNA, 600 bp, A.fumigatus
atcacttacgatgattccaagcttgcctctgacctgactagccgcttggcccaaatctatcagaagcccgaggcctttatgatggtcactattcaacaagatgcatgtctctattttggcaactccgcacttcccgcgtatttgatgaaagtcttcgccttgccatatctcattgcgccaattaccaacttgcgaaacacgattcttattcaagcagcacttcaggacctgcttcatgttgcgccgagcaggggtattgtcttgtacattccaatatctgaagagaactttgcaacaaatggagttactatgatgggtgaaatcgcccggctagaaggccacgccgaagaccaggatgcagggatcctcagaagtatctcacggtcgatgaggcgaaggattaaatcaaacagcaccactagtgcacctttgtctgtggcaactacttcctcttggactcctggattcgatccgtgtcagcaagagtggcatgatgccagaagaaggaatgtttccagtgaaggggaatctaacacagtcagaaagcctaaaagcatgcgagactttgtttgccccgccgttctggcctcggatatgtag

SEQ ID NO: 1454 - DNA, 573 bp, A.fumigatus
gacattgcattcccgtcatttcctagcctttcagatcagccatacccctttggctactcgcgcttcttatccatttttgtttttttttttttttttacttttgccgggctcggtccaaactcatcgatgccttccgactcctttgacactgactacgcgcagcgcgagaggtctcgctcgccccgccgacgttctcgcagtcctcgacggagccgtcgctcgtactccccacgcagtcgctctcgcagtcgtgacgattatcgccgcagtgatcgccggtctcggtctcctatgagtactgctcaaggcgcaactggaggacattcaggatctggttacggtggccgcagcagttaccctccttcgagatcttttgaggaacgctcagtcgccaaagaacaaatgatgcaatcagtacgcgaatcgtcccaacaggaccgccgggtctatgtgggcaacctatcctacgatgtcaagtggcatcatctcaaggactttatgagacagggtgagcagggtcatatcgtgtcggcagtgcgacgcagcttttgttggatgaaaacttgtggctga

SEQ ID NO: 1455 - DNA, 273 bp, A.fumigatus
catccgtctggtagaaaccctcacccatcgggcatagaggtccattcggtgtatggccacatttggtcggatgacccgtacgccggcggagtcatgccggtgcggaaaccgggattcatgggcaagtaccacgatgagatccggaaaccacagggaaatgtgcatttctgtgggtcggactttgcggatggatggcggggttttgtttcgggcgcttttgaggatgcatatcgcgttacccgagaggtcgagaccagtctatctatcaaatag

SEQ ID NO: 1456 - DNA, 654 bp, A.fumigatus
agactgtgcagtcacattctggtctatgtctcacggaccaagaatttccaaaagggtggcaacagctatgacgccattgctaagaagaacgaccagatgtatgctctgatcgcgatctgcgtggctcttcaccccactcgtctggacgacactatccactcggctctgcgtgagaagtacggcgagcagctccttcgtctccaacacggcggtcccgatgctcttcctctgttcgaggagctcttccgctccgcttgcccaaagttcatcagcccaactccccctgattttgacaacccggctcttaacatcgaccctgtcgaccaccacaccgctatttttatggacgaggtcaagaacaccttgtacaatcctaccatccggtcgtatctcaaactctacacgaccatggacttgaagaaactcgccggtttcctcgaggtccagcctgaggtgctccgttcttggctgctggtgaacaagcagcgcagccgtcaggtgcgctgggttgagggtggtctgttggagggcgaggtcgtcagcgcgaatgacctcgattatgcgctggagaatgacctgatccacgtcagcgaaaccaaggccggccgccgtttggtggattggtacttgagaaacttggccagagtttactag

SEQ ID NO: 1457 - DNA, 654 bp, A.fumigatus
tcgcttggtgtccgttccggccctggtcatattaaccgtcctggtcggcgtggacagggacagcaggacctcgctctgcccgatcgcagagacggcggagatgtttccgatatcgaggaggagagtgacgaggacttcattgatcagtactatggcgacgaggaatataccctcacacccgagcaggctgaggaaggtcgacgactccagaacaacccccagtcccaaagtggacgtgccaccccgagagaacttacccgctcctcccagttcccctcaagcccgtccgttcattctgatatgggtcttgctccccccacccggccattcctggaacctggcaatcgtctgagcagtgcctcggtgctgtccgtcgattccgtcgttggtgacaagaaggacttcaagctgcaaaaggttgatcctttctttaccgacagccacggtgaatacgctcgcctgttcgaaaagagtctggagaacctgaacgcggccaactccgagacacagctctgcattgaagagttcctcgtcaagagtgaaaaagaatggttcgacaagttccgggatgccaagctgggccgtctgaactcgcccgctccatctgtcttccgtgggtcttcaccacggggctggaaggatccgcggggacgc

SEQ ID NO: 1458 - DNA, 522 bp, A.fumigatus
  unsure (284): Identity of nucleotide sequences at the above locations are unknown.
gcatgcgcggatccttccgggccgcctgtggtgaagacaacaggtctcgttgactcgaaactccatggccagaggaagaccatgtttcaacgagcgattgacctcgggctcccagcatcgtttgttgagctgcgtcatgaggcgacccatagagagctaccgtctcttgtggtattgcgcaatgcgacgcaacgctcattagagtggctctgggactattactgggccaagacagactctgatgttgcgcttgcatcaggaaggcctgcctctgcggtctctancggtgccgaaaatggcaatgtagaagaaatcaggagcgtcatcagaaccgccctcgagcatccagcgaaccagggcgacctctcagagccaccacggaagaagaggaagtcagatcagcaatcgtctttccttgccgagcagctgggagcgatatgtaaggcgtctagcaggagtcctcactcactttctcgagtcctcattgaggatgccataattgtaccaaagggacgaaagtaa

SEQ ID NO: 1459 - DNA, 210 bp, A.fumigatus
tcgtccctcttctgtcacctgcattgcgaccacattgactcgacattggttggcaacaccgattatctggaaatcctcaactctaattattcaccttgcaattacctgcagatcgttacgtggccaaaatggccacagctgatgtccctgcgcggactcatggttcgtcttctcaagcgttctgcccctcatgagacaaacccagactga

SEQ ID NO: 1460 - DNA, 972 bp, A.fumigatus
  unsure (920),(953): Identity of nucleotide sequences at the above locations are unknown.
cagttgatagttcgcagtggacgtcgccacccattttctagctggatgaagagacttaccggtctgaagggctcctcgaccgattcgggcacaattcgctggtcccataaacgtcatgacgctcacaagaacaagagaaacaataagaacaacccttacccgctctccggtaccacgaacgttgtcagggaatacagcagtgatttcgtgccctccgtatcggatacaaatgctgcgaatgggccacgatcgtgctcatatagtgaaccttccattgcctgttccggacacgacaatcaggtgcctgcgacaagtgcaaagtcaacggctccgaccatctcaacgaatggggacaccgccatctcagaggcagcatattccaagtcaggaacgatggcgacagcaggaggagggattagctctcagggcggaggcgaaggaagcaccttctcttcgcccgcgccgtcggtccgttcgttgacaactaccttgactaccgtgcaatccgccgcgccatccatccacttctacaacgtgcaaagtacacatcagggcctagcacatgcgaactcgacgcacagcaacgcgagtcaacaagtacaattttcccagccatttccttcctcccccgcgaccgcagtgccaccccaccttgtccctcacggtcactcccatacatacagcactgcgactgccaacaatatccttactgacaatgcatccatcctcacccttgcttcgtcttcaaaacggcgccgcaggaactcgctggatacgaacgcatcggtccgcgctctcgcgccgtcctctgtatttggtgggagtcgggagagcctgccactgagcgtgctcagtgcaaatgttggagagccatccaacacgtccacattcagtacacccggggtactcaatcgtcctancatggtgggtcttgctagcgcggaacggattantgtatactcagcgtctggt

SEQ ID NO: 1461 - DNA, 318 bp, A.fumigatus
  unsure (298): Identity of nucleotide sequences at the above locations are unknown.
cgtgtcaactctacctcatccttgcaggttcatagtataatgtaccgtttccacccatcggtgaaatacaccaccgcctatccttctcagcaggaaattcgcgaccagatcattgacgtgtggaaacgctacggcctccagaagcgtaccgctttcgacactccagttacgtctgtcaaacagacaaaggacggtaaatggatcatcaacgacaacgaggaagagtatggtcgcttcgatggcgtgatcgcgtctgtcttcaccacggggctggaagacagcagactctcagttcgangatggggggcgggcggggcg

SEQ ID NO: 1462 - DNA, 402 bp, A.fumigatus
actgagtgttcatcttctatggctcaatcaaaagccaagtccacaattgtggacttcttcacacatcctttccttgtggtgttcagtttagtctatatgctattccagaatatcctcacctgggttttctctcctgctccgccgcctccagcatcaactgccaatggtcttcccaagaaaagagtagctgtcattggtgctggtttgactggcgtatcgtccgcggcgcactgcattggacatggattcgatgtgcaactattcgaagcccgtcccaaggataaaggcctcggaggaatctggagcgtatgttgtgttctctatggagttgatttgaattctgctaatgcatgggccgttagcgtgtcaactctacctcatccttgcaggttcatagtataa

SEQ ID NO: 1463 - DNA, 201 bp, A.fumigatus
tttgaggaccttcccgtgaagccgcttactctgactaccgcccatccgctgcccacagacgtgctattgaaacccacattcagtcctttctacgtcgttatcttcaagaagaatggcctgagtgtcttttgtcaaattatgctagattctagacatgtttacctttcttctatgcaaatcttttatcagctctgtaattag

SEQ ID NO: 1464 - DNA, 927 bp, A.fumigatus
gatggcacaattcatccagaaggagtctggaaaaaggattcgcatatgggtacttatgaaccatcagatacgctttctatatccaaagatgtgatcgttcaacactggcaatacgggcaatcggatcctgtcagcctggcaaatgatgggtacattatgatcaattcggaggatcagtgggcgtacatgtcgctgaaaaacgaccatatgcccatatttccggccccgtatccatacttgttcaatacctcgcgagtgttgaacttcgccaacatcgacgggtggcagtggaccccagcgctcttcaacccattcaacgtcactgagcaacccaacaagcaggcagtccagggcgcaattctagccgcatggaatgacaacggaccggacgcgacaacacagctggaggccttctacgcgatgcgcaatgggatcccgattgtcgcctctcgagcatggacaggcgatcgaggcccgcgactggatgaatctagcttgtcttggtctgcgaaactgcttactgcccgtgcggctggccagaaccttgacaggagatttactggtggggtcaatcacaagacggactcgcttttcagctggacgtccggcaaacaatcaggagaaaggatccacctcgggtacggcagcaagggaatgaattatacactagagctcgacgtcgcggggccattcgtgctgtcctccgaggactgcgctctaagtctatccgcatctggtactttggcctttacatccgacggatgggagtacccgcttcgctctgtcgccgaaaacccggattcgaccaatgtattcgggaacgaattggacaaacaaaactccctccacgctgaaacccgtccaaatcctctcccacgccgatcattattccgcaccaaagttcttggaagggaacacaatctgggt

SEQ ID NO: 1465 - DNA, 555 bp, A.fumigatus
ttattcgccggccaggcgttgagtgaatttgcagaatatgcagataagcagcagtcgcatcgctcggcccaggtggccccgagcgatagcggctactcgactgcccacgccaccgaggaccacgcggaactggatatccttgaccaactcacactatccgataccccgaagacggtcaagttgaaagatctactgctcggtacgggtgaagaagcagaagatagtctgcagctgctgggcagtatcctgcaggcccggattgacgagggccatggggagaccatcttcgacttgggacttgaggatggtggcgactcaatgggctttgaccttgagcaatggaatacggctctacagcgcctgcgagaggcggcagaggccctcccggcgcattgccgaaccctgcttacctgcaatgtgggcgacccggaggagtcgaaaaccaagaatgaccggatcaagggtgcctggggcaagatcctgatccgccagcctgcggatactgtggaggagatggctgatattagaataccggttgttgggaatgtcgacgcc

SEQ ID NO: 1466 - DNA, 222 bp, A.fumigatus
agctttgactcctgggttcccttggtgaactttcaaagcctttgtgcatattggcgagcatgttcggtactcgagggttacaggaacggagcagtcttcgctgctagcaagcatgctgcagtcgggatggtcaaaagcgcagccttcgaggttggatcaaggggcatccgagtgaacggcattctaccgtgtgttttcctactattttacctaacttcgtga

SEQ ID NO: 1467 - DNA, 222 bp, A.fumigatus
cttcgtgatgaagttaaccaagtatatagtggacctatcgacacacctatgtttcatcaagtcagagaaaacgccggtctgtcttcctccgcatcagatacgccgattcctcggcctggtcaacctgaggaagttgcaagcattgcagtattcttactgggtgaccagagtagttatgtgacaggggccgtatggaatgtggatggtggggcaaatgcttga

SEQ ID NO: 1468 - DNA, 183 bp, A.fumigatus
tacccgctctcgtgccaccttgttggagacgtgtcagcccctctcaagggcaatagcaccgataattgcatacatggtatgggcaagcacaagttcgattccagagctggcgaggttgtttggatggaagaaatagcccgtgtcagcaggtacgcggtcaatcacttggaagggcgaatatga

SEQ ID NO: 1469 - DNA, 336 bp, A.fumigatus
tcttctgaccggagcagcccaacttcagccagagcgtccagcaactcgcgatcatcatgctggccgaacgggtccagaacctcgcgcaccgtgccagcaaacacaaccggttcgtgcgggatgatgcccacgcgcgagcggagatcgtgtagccgcacctgggcgagatcggtcccgtcgatgtggatggatccggaccgcgcgtccaggcagcggaggagcgccagggcgagcgaggatttgcctgcgcctgttcggcccacgatcccgactcgctcgccggcgcgcagggtgaaggtgaggccctgcaggacgggcgggaggtcgggcccgtag

SEQ ID NO: 1470 - DNA, 546 bp, A.fumigatus
gttcgtcgcctccgtgaccatcaccttcgtcaccatccgcaccctcgacgcccccctcgccggattcgccctcagcttcgccctggaactctccgagcacatctcttggctcctctcgcagtacgccaaactcgaactagacgccaacgccgccgagcgcatagtcgagtacacgcagctcgaccaggaaccccaatccggcattcccgtacccgcctcctggccgcccgccggcgagatccaggtgaccgatctctgcgtggcctacgggcccgacctcccgcccgtcctgcagggcctcaccttcaccctgcgcgccggcgagcgagtcgggatcgtgggccgaacaggcgcaggcaaatcctcgctcgccctggcgctcctccgctgcctggacgcgcggtccggatccatccacatcgacgggaccgatctcgcccaggtgcggctacacgatctccgctcgcgcgtgggcatcatcccgcacgaaccggttgtgtttgctggcacggtgcgcgaggttctggacccgttcggccagcatga

SEQ ID NO: 1471 - DNA, 1029 bp, A.fumigatus
ccatctaagttcgtcgcctccgtgaccatcaccttcgtcaccatccgcaccctcgacgcccccctcgccggattcgccctcagcttcgccctggaactctccgagcacatctcttggctcctctcgcagtacgccaaactcgaactagacgccaacgccgccgagcgcatagtcgagtacacgcagctcgaccaggaaccccaatccggcattcccgtacccgcctcctggccgcccgccggcgagatccaggtgaccgatctctgcgtggcctacgggcccgacctcccgcccgtcctgcagggcctcaccttcaccctgcgcgccggcgagcgagtcgggatcgtgggccgaacaggcgcaggcaaatcctcgctcgccctggcgctcctccgctgcctggacgcgcggtccggatccatccacatcgacgggaccgatctcgcccaggtgcggctacacgatctccgctcgcgcgtgggcatcatcccgcacgaaccggttgtgtttgctggcacggtgcgcgaggttctggacccgttcggccagcatgatgatcgcgagttgctggacgctctggctgaagttgggctgctccggtcagaagactatgctccgggggattacaaggacgggttcctcctcgatgcaactatcatcgaaggaggacgagacctctcgcagggccaaaagcagctcctctgtcttgcgcgtgcgctggtctcgcgggcgaagatcttgatcatggacgaggcgacggcgtccatcgatatggagtcggacattcggatccagcgcacgctgcggcaggtgattcgtgggtgtacgttgctggttattgcgcatcgactgtcgacgattgcggactttgataaaattattgttctggatggggggagagtggtggagatggggccaccgggcgagctgatgatgattgagaatgggattttccgggggttagtgcaggagagtggagagagggcggtgattgaggggatgattcatggcaatactagagaactctga

SEQ ID NO: 1472 - DNA, 930 bp, A.fumigatus
  unsure (885): Identity of nucleotide sequences at the above locations are unknown.
tccgggtcaaagaccctaagagatcaggtgggtaacccgaataactatgcagtcattggcttgggcgctgattgcctgctttatcttttctcagtggagttctacaagttccttgggctcaatcagatccagcagctcgactttcctgagaacaagttctccctctacttcctcgcctacaatggcccccagtcgctgcagggcgaccgtcactggacggaccgcaatgcagtgctggaactcacgcacaactatggcacggagaatgaccccaattacactgttgccaatgggaatacggagccccatcgcggtttcgggcacattgccatctcggtcgacaacatcgaagcggcctgcaagagactcgaagacgctgggtatcaattccagaaaaagctcaccgagggtcgcatgaagcacattgcgtttgtaaaggatcccgatggatactgggttgagatcatccgccgccacgaccaggatgtggggactgcgacggatccaggcacctaccgactgaaccacaccatgttacgggtcaagtccgctgagaccagtctcaagttctaccaggaggttatgggcatgacccttgttcgcactatcgagaacaaggatgctgccttcaacctctacttcctgggataccctgcgtctaaccccactgcccaggaaggtgcgaagaatcctgtggctgaatgggaggggctgctcgagcttacctggaactacggtacggagaagcaagaaggcaaggtgtaccatgatggtaattcggagcctcaagggttcggtcatatttgtaagccaccccgtcatcttttgcaccggtcgaactgcgctgacattgatgtgcctgcagggtttctgttgacgatcttnttacacagccagccatggaaggaaattatattgcgtacccaagat

SEQ ID NO: 1473 - DNA, 318 bp, A.fumigatus
  unsure (141),(256): Identity of nucleotide sequences at the above locations are unknown.
ctgtacaactatgcaacatcatcatcatcatcatctagactgtcatttcaagatcaaccttcacgagccgctcgtgagctaactacgctcactcaaccaatcaccaaagccctcacctcaatactctctctcggcttcgcnacctccctcgtcctcggatccgaaaatgcagaatgcggcacccgctccgcaatggctcccccttgccccgcctccgctgctgcagccgcaagaatatccgagcacttcaacaacnacctctcctcattctccatccctgagagatacatccaccgctggtttccgattatactttga

SEQ ID NO: 1474 - DNA, 429 bp, A.fumigatus
tgtcaaatcatggccgcaacacacggacgaaaatccaccgcggacagcaacgtctccgagcctcacgtcctccgcggcaatgtaagccaccaagtccaagccttcaccgactggtcgcaggcccgccgattccgcatcctcgacacaatcaagcacgaccacagcgagatcaagtccttttacgagctgatcgtcagctcccccggccccgaggaacagaccaaataccagaaccagttcacctgggaactggcgcggcataccgtcggcgaggagctcgtcatttatcccgcgctggagaaatacctcgacgacgggaaggagttggcgaggaaggatagagccgagcatcagactgtcagatcccttttccctttttcctttgtatgtagtggggagtgcgtcttccccacggactgcaataccgcg

SEQ ID NO: 1475 - DNA, 393 bp, A.fumigatus
  unsure (390): Identity of nucleotide sequences at the above locations are unknown.
gccatggcttactctccggcaccggcatcgccagctactggcacagctggacaaaccctgagcagcagccttcaccctagaggccgatctccaagccccgcgacgaacgcgcccctctcgaaacgggacaagcgccgcggagcactacaagaacggctgcacgatctcacggcgaccttcagccataaccgagacgcgcaatttcgccagcagctgcatacattgcagtgcgatatgacattgatcaacaatgcggatccgtactccccgggtccgctgcccgactcggcggaggaaatcgcggctttggttgagaagacgatcggtgggggagcttttgcgaaggagatggctaatttgtctggcatgtggtattcaaggtttgtgcangag

SEQ ID NO: 1476 - DNA, 546 bp, A.fumigatus
cgcttcgatattactcaagaggccgaggtgcgtatccgctgccccgagcgagaagagcgagccgaccagctcggcacaattggtcaggtagctcgttggcaccgacgccggaatcaaccatgcaaggctggagaccagcttgtcgagcagggacgacgacaccgacgacaccaatcccgtcgcgccgggagcggctgcgctcgcggtcggggtgtaccggctcaacatccgctgcgtcagggtcgaatgcgtcgtcccgccggcgcttgtattgccctgttgggcgggtgtagacgagccgccgctgccgtcgggaccccagatgacgagaaggataggaaagagtttcgcgcaactgctgacgagcagggcggtgctgatggccgtggggctcgccggggacggcggtggcaaaggccggatgctctgcgccggcgcggtggacgcacggcgcaaaggcggcggggggaaggggaacgatccctgcggtgtcgacgcggggctgtggtgatgttggtcggtaccgaaattggtggtggacgctga

SEQ ID NO: 1477 - DNA, 1140 bp, A.fumigatus
  unsure (185),(410),(435),(438),(464),(467): Identity of nucleotide sequences at the above locations are unknown.
gacctttcaaatttgtgggtaacccggggatttttttgggtaagagggttaattattcccggcgggggatttttttctttcaattggagggaaactccaacatggggcgggatcgggggttttccaaaggttgcgggttcctgggttgcccgaacacccattcatcgtgcaaaacttcttttttntaaggttggaagccctcgcaattctgggcttcatctcacaggtagggggtggccttgggttttctcaccgaccccaatggcaaccggcggcattcacacaacggggcccgaggaactgtccccgtcgaatccctcaacccccgtcttcccttcgttctcgtcccagtcccaatcggttacacgttcagggcaacagtcacccaccgcgggaatgacaatgagccngacgagacttacacctcacggttcntcncaggacatttcgctctcggccagtgntgntaccctgggcacctcagcgtccaccaccaatttcggtaccgaccaacatcaccacagccccgcgtcgacaccgcagggatcgttccccttccccccgccgcctttgcgccgtgcgtccaccgcgccggcgcagagcatccggcctttgccaccgccgtccccggcgagccccacggccatcagcaccgccctgctcgtcagcagttgcgcgaaactctttcctatccttctcgtcatctggggtcccgacggcagcggcggctcgtctacacccgcccaacagggcaatacaagcgccggcgggacgacgcattcgaccctgacgcagcggatgttgagccggtacaccccgaccgcgagcgcagccgctcccggcgcgacgggattggtgtcgtcggtgtcgtcgtccctgctcgacaagctggtctccagccttgcatggttgattccggcgtcggtgccaacgagctacctgaccaattgtgccgagctggtcggctcgctcttctcgctcggggcagcggatacgcacctcggcctcttgagtaatatcgaagcgctatatatcctgcttggatgcgggtatctgcgcgcggtggccttggctgtgaccggcctgctcgcgcggtggatggtgcagagggtgattctgggtgcggtgggaatcggctaa

SEQ ID NO: 1478 - DNA, 765 bp, A.fumigatus
  unsure (240): Identity of nucleotide sequences at the above locations are unknown.
tccaagcaatggtggctaacaatgagcaagtatgcggcccggggtatcggaatggcggcatttcagggctggcagcagatccatatcgcgactcacgactcgattggcaccggcgaggatgggccgacgcaccagcccattgcattggcagcgctgtaccgtgcaatgccaaatcttctttacatacggccctgtgatagtgaagagacggctggggcgtttatcgcagcaatgcaagcnacatccaccccgacaatcatctcgctgtcccggcagaacttggagcaatacccgaaattttcctcgcgagaaggggtccagcggggtgcatatgttttcatcgaagatgagcaggctcaagttacgttgattggtgtgggtgctgagatggtctttgcagtccgtacgcgacaggtgctgcaggaccgttttaacatcagatctcgcattgtgagtttcccatgtcagcgtctttttgcacagcagagccaagaatacaggagggaggtcttgaaatatcggtcaggaatcccccgtgtcgttattgaggcatatgcggtcaccgggtgggagagatacgccgatgcgggcttcacaatgagcacatttggacattccctacctggtgctgcagcatataagtactttggattcgacgagcatgtgattgcaccagaggtggcaaagctcgtggacgaggttcagcgggacggcatcgaaagcttgcgaggtgacttcagggacttgaatccggtgcgccgttag

SEQ ID NO: 1479 - DNA, 336 bp, A.fumigatus
tccatcatggccgacatcaccgcggtcggtgaggagaacccttctcctacccaggacgacctgcagcaggccgccggcaatggcgccgctgacaaccgcggtcccaagcgctcgagaatgagcgcagaagacgatgacgatgatgatgacaagcccggtcgcgagcgcagaaagattgagatcaagttcattcaagataagtcgcgtcgccacatcaccttctccaagcggaaggcgggtatcatgaagaaggtgcgtactttggcgtctccctgcccgcggtcatcgcctgtctctcgagtctcttactttttcttatcctgtcctcttgtttga

SEQ ID NO: 1480 - DNA, 201 bp, A.fumigatus
cggttcaatgcgatcgcaaaacaggcctatgagctctctgtcctcacaggtactcaagtattgttgctcgtcgtgtccgagaccggtctcgtctacacttttaccactcccaagcttcaaccactggtgacgaaggctgagggcaagaatctcatccaggttagttgtcttcaccacgggcggcggaaaatccgagatgcg

SEQ ID NO: 1481 - DNA, 306 bp, A.fumigatus
  unsure (157): Identity of nucleotide sequences at the above locations are unknown.
gcgttgatcagcagttatgccgccttccgccgccacttccgcgggttggttttgtatttgggtacaatccccaacagagctcgcaaagctactatcatccagcatcatcttcccaacatctctcacaatcaaatcttccacatgatccacacggacntagaaggcatgctaaccctgtcaatcagtattcttctagtctgggcaataaaggttaaccaggttaatagttcagctctaccatacgccttcccttctctttcagggagccctactgcgcttccagatcatggatatgcttcagcgtaa

SEQ ID NO: 1482 - DNA, 747 bp, A.fumigatus
ttgttttcgtctcgtcaaactgtgctaactattcaggtggccgatttggacttgatggacggccacgtctccagactgattgacctagttccgaaagacggctcggcgtttgatatccagcggttgttcttcctcctcacgatcgattcggcgactcatttcctctttggcgaatcggtaggctctctgcacgctggcacagacacgggccttctgggcagatcagccgtcggtaacgcggagggcttcgcagaggcgttcaacaaggctcaggagtatctcgccgcgaggtcccgagcggtcgtcttctactggatgatcaaccccaaggagttccgcgatgccaacaagcgcgtccatgaggtcgtcgaccactatgtccagctcgctctcgagtctcggcggaatccggagaagaagcagcctggaggccggtatatttttgctgaggcgctggccgccgagaacgacaatccgaaggtgttgagggacaacatgctcaacatcctgttagcggggcgcgatacaaccgccagcctgctgagctcgactttcttctacctggctcgccatccgaacgtgtggatcaaacttcgtcaggttattgtggacgccttcggcgacgccgagcaccccaaggaggagatcacacagacaaagctcaaggatattccgtatctgcgatatgtgctgaacgaaggtacgttaaccccccggactcaaatgtcttcaccgcggggttgcaag

SEQ ID NO: 1483 - DNA, 330 bp, A.fumigatus
cctgtcacgatgtgcgcggctccttgccgcctcgtggtgaagactgagctcatcgccgagcagtatggaaagtacggtaacacatttacacagacgatctttggacaaccgctggtgtctacgattgagccggagaatctcaaggctctgctcgcgacccagttcaatgatttcgagctcggcacgagacaccgagagttttatccgttactcggagacggaatcttcacgctggatggagcaggatggtcgcatgcgcgtgcgctattacgaccccagtttacaagggaccaagtgagtgattgttttcgtctcgtcaaactgtgctaa

SEQ ID NO: 1484 - DNA, 699 bp, A.fumigatus
  unsure (650),(658): Identity of nucleotide sequences at the above locations are unknown.
gcgcaggaacctccctatcatctgctggctactggagcgaacatttcgcgaaaagtaagaatcattttcactggctgccttctcggtgaatcaattgcaggaggccaaaagctaatctgtccgttctacagcaacctagactgggaaatcgtgatcgtcgacgacggctccccggacggcaccctcgaagtcgccaaacagctacagaccctctggggctccgaacacatcaacctcaagccgcgggccggcaagctgggtttgggaaccgcatacgtgtacgggctgcagtacgtgcgcggcaactatgtcatcatcatggatgcggacttcagccaccaccccaagttcattcccgagatgattcgcatccagaaggagacggacgcagacatcgtcacgggcacgcggtatgcaagccgcgatggcatcaagggcggggtgtatgggtgggatctgttccggaagttcacatcgaggacggcgaacctgatcgcggatgttatgcttatgcctggtgtgagtgatctgacggggagcttccggctgtacaagaagagtgtgctggagaaggtcatccacagtacgcagagcaaggggtatagtttccagatggagatgatggtgcgggccaaagcgaatgggttcanggttgcanagtgttccattacctttgtcgaccggctgtatgggggatag

SEQ ID NO: 1485 - DNA, 243 bp, A.fumigatus
gatctcaagtctgtcgcttctgaatctctacagtcaatcacaatcaaaatgaagttcaacatcatcgccgtctcctctctcttggtcctggctactgcccagtctaccaccgagagcgcgccctccaccaccaccagcctgagtcccgaggcctcctgcgccgccaaatgttcgtatttctatcttttcttgaactatccgtctcataaagctaaccttgcaattgcatttaggcggttctaa

SEQ ID NO: 1486 - DNA, 351 bp, A.fumigatus
actatccgtctcataaagctaaccttgcaattgcatttaggcggttctaatgatatttgctgtgttgctggatgctacaacgttccctgccctagcgaccagcaagccaacgacaccatcagctgtgttgctgcgtgccctcagggttctggcactcctagcgacaccgacaagtatgccgcttgccagaacagctgctacagcagccacttcttccccgcgaccatgacgaatgctggttccgccaagactggtgtcagctccaacaccgcgaccaccaccggcactggttccagcagctctgagactggcacttctggtatgtcgctggttctatttggtcatttctga

SEQ ID NO: 1487 - DNA, 189 bp, A.fumigatus
atcttgtcgaggatgccaaagctaattggacaatctgcaggctccgactccaccgcctctggctccggcactgctaccagcagctctaccgccacctcaactcccaacgctgctgttgttagccagatgcagctcggtgtctctgccgctggtctccttggcttcgttcttgctgcttgggctctgtaa

SEQ ID NO: 1488 - DNA, 246 bp, A.fumigatus
tgtatggaagaagtctcatatctcgttggcagttcccccactatggttagggatctttcgagacagttcgataacaagagtcgcgagtctggaacaccccactgcatcaaactgcgatgtccctgttttctgcttgctgggaagcacatggaatcgtcctactatgtatggtatgatgtagtagactttttcccctctgctatcctcgaaatgaagaattacccatggtttatcaggaagtactaa

SEQ ID NO: 1489 - DNA, 1356 bp, A.fumigatus
  unsure (1176),(1265): Identity of nucleotide sequences at the above locations are unknown.
tctctttttttgcccctttttcggtccgctaaccatgggattcatgcagagaataagagcttccagccacctatctttttgaaatgtggccctctgctccgctacacaggactgaaacgagtcaggattgatggaccaaatggccctttcgacaaggagacttggagaggtagtgttatgattgttacgaaagattcacgctcttcctatgagtctccgcccaccctgagattgttttcgcagccgatggatcttctgccgcctccgccagtcgaagtcagtgacgctcagcttgcaccggaatacgtcgatcccacagcaggtctcatgaagctgggtagggacgggaggccgctttatgtcaagccgatcgaccataccgaggaaggagtggacttgtcatttgtggagaatgatgatggagtctacgagatgtcccccagtaacctagactatagcagtgacggcgtcaagcagtcgatccccgccaacaggcttcactcagtggacggagaaaccgtaggagcatacaaagagattcccggggcgcgcttgtacgccgactcggctcgggatgtgacattctggaggttcaacattgaaatagaactgggtgagacgcaacaacgaattgcataccgcttgaaccacggaccggccctgggattctgggtaccggccagagggcagtctatgaacattatgttctatagctgcaatggtttcagcctaggagttgattccaacaaattttgcggtcctgaccctctctggcgcgacgtcttgaacgagcatcagactcgccctttccacgtcatgattgggggcggtgaccagatctctaacgacagagtcatgctggattcgccccgattccaagaatggatcaaggtaaagaacctgactgacaagtatgacatgccgtttgacccagaattccgagctgagatagagagcttctatctcgagaactactcggcttggttctcacagggccttttctctctggccaattcccaaatcccaatggttaacatctggaacgatcacgacatcattgaaggtttcgggtcgtatccggacgagttcatggccacaccagtgatttcgggactgggtagaatagcgttcaagtactatctgctcttccagcatcacagcttgactgaagagacngaagcagatgagcctagctggcttcttggtgcgcagcttggaccctatatcaaccaaagaaatcgaaatgtgttcatgtctctgggcanagaaataacttttctggggttggattgcaggaacgaacgactggtaaggataatgtgctttcctggcggaaaggaaaagggtaaatgctga

SEQ ID NO: 1490 - DNA, 357 bp, A.fumigatus
agacgctccgaagccctaaaaccgctccaagcaaactcgattatatcagaatgcgacatacgattgttcaaacctgtgctaatgctccttttcttgctcttaggctgcccaactccccagcgcattgtgacctactctctgtcttccaaccgtcagcgccctctcgctggtgctttccacgctgccatcttcaacaccttccgcagattcagaagccaggttctatacgtcgttcctccttttgtggtcgcctacgccgccatgaactgggctattgagaggtatgcgccctcttgccttgcgtctctcttcgctctccaggcttcaaaccagtcgctgattgttgctattgtatag

SEQ ID NO: 1491 - DNA, 324 bp, A.fumigatus
ggccgaccgataaggaccattttggcccctagcgccagagccttagctacatcagcaccgcaacgcacgccagaatcgaagatgacttctagatcttttcccaccgcatcgacaatgtctggaagcatgtccaaagatcctactcccccatcctgctggcgtccgccatggttggatactactattccctgcattccgtactcaactgccagctttgcgtcctcgaccgtttgtatacccttcagtacgattgggccatcccaatgctgccgaaggaattggaggtcttcccacccatggctcatcccagggaatatcatatga

SEQ ID NO: 1492 - DNA, 666 bp, A.fumigatus
  unsure (9): Identity of nucleotide sequences at the above locations are unknown.
gtcacactngacacctacatcgttggatggcgcccctcggacttagacaatgggtatcatccattcctccggaaagaccacatcggggtcgcaactggcttctccgaccctgtgtttcagaagaagtttgcggaaaagcacggcaaaagcatcccagtagacatggcgactgcggcggccgaatgggctcatatgatattccctgggatgagccatgggtgggaagacctccaattccttcggcagcattgggatggcccaatcgtactgaagggtatacaaacggtcgaggacgcaaagctggcagttgagtacggaatgcagggaatagtagtatccaaccatggcggacgccagcaggatgggggagtaggatctttggacatgcttccagacattgtcgatgcggtgggaaaagatctagaagtcatcttcgattctggcgtgcgttgcggtgctgatgtagctaaggctctggcgctaggggccaaaatggtccttatcggtcggccctacgtgtacggacttgccatcgctggtagggagggtgtccgccatgtactacagagcaccttaggtgatctacagcttactcttcatctgtcggggatcagatctgtgcagccagagcaccttaatcgatctagactacgacggatggattaa

SEQ ID NO: 1493 - DNA, 375 bp, A.fumigatus
aatcacagctgccgttgttatgttaccctcaagatctttatcaagtctgcatccatgggacagcaattggatgatgagctccagatgtataaacgcatggagaggggctcaaagaaccatccgggtcgcagtgctgttaggtcgttactggactcctttgatgtcgacgggcccgaggacaaacatcggtgcctcgtgcatcctccattatgggacagtgtgttgacctttctgcaccgcaacccggagcagaggctacctgctccggtcctggcatttgtgcttaagcgcctgtttctggcgctggactacttgcatacagaatgccagattatacatgccggtatatattctggaggtcccatggacgtatag

SEQ ID NO: 1494 - DNA, 408 bp, A.fumigatus
aagatggcctcacagatttggaacattttcgagggcgagtccttatttactggctatgatccagaatctcacacttatcgaagtcgagcccatctcgctgagatcatcaagctgcttgggcctccctcgcccagtcttcttgcccgagggaagctaagccataagttcttttctgacgaaggtaagccaatgcccctgtccttccaatatccgctcactctgtccaacgttatagatgacttgtgtgccaaagttctgtcagaaggtcggattccgcttgagaagagggaaacaacgctccaaggacaagacaaggcggattttttgcgcctaatgctgaagatgttacagtgggacccagccaaccgtagctctgctagggaactgcaagaggatgagtggatgtct

SEQ ID NO: 1495 - DNA, 270 bp, A.fumigatus
ggagaatttctgacatatttatgcgttttaggcttccatacgccttctaagttcctaagtatcgatcaccttgtcagaatggagagcttcgatgtcacggacattagcaatgcgctcaaggaagtgaccggggaaaagatatacaaaaacgtcgaagcttccaatctcgctcgtgagaagggatgggttctacccgagcagtacgactacaccaagttacaacagtgggttctgctggagaacccggaagatgtcactgaacaaaagtga

SEQ ID NO: 1496 - DNA, 480 bp, A.fumigatus
gcatcgtcaccggataagaaaccgccttggttgagaactcttggcaccactatgacttctacacttccttatttgaccagtcctccagcaacccatccgagcaattccgatcacaaaaagctacgctcggcctgtgattcgtgtcatcagtgcaaggtcaagtgctcgggggggtctccatgtttccgttgcacgtccaagggcttgaactgtcgctacggttatcaaaacagggcaggaaagcccaaagggagcaaaaaccggaagacattagagagagagcatcagctacggatggaatggctgacaagtcaattgcgggatgccaacggagggctgggaaacctgaacatcgatctctccgatccgacgacactactaccaagtccatttttccagtcaacccgctggaaacaggtgagtcgctgcctctgccaccccggttacctactgtctctaatgctcgcaggggccaattaa

SEQ ID NO: 1497 - DNA, 204 bp, A.fumigatus
gaccgtgaagattcggtatgctttggtcttctaggtgccttgattgacagaactgattttctctcgattcccaggttacagctgcagggagaacttcaggcgaaaagcgaggccgtcaagaaatacaagggcgtttttcatggagttaagggtcattttgcaaaaatgaaggtcctcggcggcctgtttccgggaaatcggctt

SEQ ID NO: 1498 - DNA, 648 bp, A.fumigatus
gcagcgcgataccttttagccccggcctgtgtacaccctttgcgtatagatggtaatgcttatgtttgggaacaaactccgactggttggaagccgactctagtgcttctccggatcaacagagctgcaacttttgtgcgttggtccccatcagagcagaaattcgctgttggctcgggagcccgcgtcattgccgtctgctacttcgaagaggagaacgactggtggatttcaaagcacctgaagaagcccattcggagcaccatcactactctctcgtggcacccaaactccgttctgctggccgcaggttcgacggactctcatgcacgggttttctccagcttcatcaaaggtatcgacactcgccccgagccaagcgcttggggagaacgtcttcctttcaacacagtctgcggggagttccttaacgactcagctggatggatccatgccgtgtgcttctccccgagtggaaacgctctagctttcactggtcatgacagcagtgtcactgttgtttaccccagtgcccccgaacaacctcctagggccatgttgaacatcaccacacgcctcttgccttttactagcctgatttggaacggggaaaacgagattattgccgcgggtcatgtgagtttctaa

SEQ ID NO: 1499 - DNA, 354 bp, A.fumigatus
gattgcgagccattccgcttcagcggtgatgagagcgggtggaagctggcaggtgctatcgagagcaagacgggagccggagctggcagtgtgcgggacgagtcggccctcaatatgttccgccagatggatctcaagggacagactcacgcggacacacagctgaagacgatccatcagaacaccatcaacacaattagggtgtataaagagacgggcggtgcggtccatcagtttagcagtgagttatacatgcttcattataaggcactcgccttaccggagagagatatcactaacggctgtgtgctagcgagcggagttgatggtcgtgtcgtggtctggaccatctag

SEQ ID NO: 1500 - DNA, 885 bp, A.fumigatus
  unsure (674): Identity of nucleotide sequences at the above locations are unknown.
ccctcagacctgaagaatggcagtgcctattctctgaacgggccccgatcaagcgctagttcctacacacgagatttaccacattcgaaagatggcagcatgcattcgttagggaatggatcggtccgcgatccaagggagagtggccggttctcgatgacgatggacaaggatttcactcgaaaatcttctgatgctggagccagtgctggcattggctcagctgcagggtccatctccagcgcgcagcaggtcaatgggatctcgccgagccaccgcaccaccaacggaaagtccctggttaacggcgaccggccccaaccgtcggctgacgaagtggtttctcagaactcggctgcggccgcgaacgggaacaccatcgtcgcctcactccccgaagataccagccggctcgcgtccgaacctgatcgattggctgcctcacggacgacaactcctcaccgttattcttccccgcctctcccttccgcctccgctgacgctagtcacccgcaagatcccgcagcatcatcaggccttcgacatcgacatacgctgcaagttccccgagcgacaagcgcccgccgtaatagccgcgatcaaggggacgagactgcttatagtaatggtaggctatctccgacggcaggggccatccgccgaacgtcactcantttggttcggcgggctacaaaaaccaatcccgcggactctgttcctgacgaagccaacgcgaacgatgatgcaccgcgttgggcagaagcgatcatgcagaggagagcgtccagaaggaaacgccgcgatgaacacgatgacgaccgcgtcttcgttgggacgaccgttgaccaaaaacccctgaaatgggtgactgccttcaatatgctg

SEQ ID NO: 1501 - DNA, 300 bp, A.fumigatus
cacttattatcggaccttgccccgtctttgttaaaacccgaatggttccgtagtgtatttgctgtgctggacccgcagagtgcagaactcctcaaccttcgcatctcctatgacatccgcaagaacaataaccgaaacaaccagaccaccctaacacacgatctgcactgggcaaactggtccagcagcgcagacccttacctcacctaccagtacgtccggaccctcaacaccacagggaattggtccgtgatctgggagctctactggcaaagctgcgacgaggaagcggaatcgtga

SEQ ID NO: 1502 - DNA, 477 bp, A.fumigatus
tctgggagctctactggcaaagctgcgacgaggaagcggaatcgtgatgagaaggtgctgcctagtgatcatgacggcggggtctttgaacactactactcctggtggcagcacttcactattgacgattccgccctcaaaaaggtggatctcgtcgcagcgaccgccaacgccacctgcccgggggacaggaacgctattgcaatcaatgttaccgatacaaccatgcattcgcccccaggtctcaactccgcaggccgcgacacttgcgtcgttacggccaccacgactgctagtgccacgcgcaccaccccggacccctgtcgcgtcgctatcgatgcggatgccgaggccagtatggccgccgttcaccagaaactgctctgcgatcatctgaaaaattctaacccgcctgaggtctgtcctgctgaggagaatggcgctcagcagttggctgcacttggtgtagcttcctag

SEQ ID NO: 1503 - DNA, 402 bp, A.fumigatus
aaaaggggggcccttttttccccaaaaacccccccccaaaaaaaagaaatttttttcccttttttcccccgggggtttttttttcccccaaaacctccttttttttttccgggggccccccctttttcccccccaaattttttttgggaaatttttccccccaaaattttaaattttccccaaattttttttttttttccccccccccctttaaaaaaaagccccaaaattttaaaaaaaaagccccccccccaaaaccccgggggggggccccaaacccaaaaattgggcacttcccaggtcctgcgcagcctggcaagggccacacgcgcatccccctcccgatccatccacatccagcccgcttcattaaggccatcccgaccaacatgcagcgtatga

SEQ ID NO: 1504 - DNA, 357 bp, A.fumigatus
cagaacctgagccctctgtcacaaccaactctttcccgtccattttcccactcagcccccgtctcatcgtccccattccgcctcacctcgaaacccgacaccgaccacacaatccccccggaaccacccctcgacggcgaaccggccccctactacagcccctacaaaccaaagcgccaatggcccccggatatgtccaaactttccccgaagcaccagttccggctcgagcgcaagtatcgacggcgcgcggcgctcaagtttgctcgacctaagtgggtcaagacgacaaacttgattcagtggggggtaatcggatgtaagttttctgtctttgtccgggggaaagctatatag

SEQ ID NO: 1505 - DNA, 549 bp, A.fumigatus
caaccccccccgggggggggggggttttttttacctctttttttccccccaaaaaaaaaaaaattttttttttttggggggaaaacccccccccaaaaaggggttttaaaaaaggggggcccttttttccccaaaaacccccccccaaaaaaaagaaatttttttcccttttttcccccgggggtttttttttcccccaaaacctccttttttttttccgggggccccccctttttcccccccaaattttttttgggaaatttttccccccaaaattttaaattttccccaaattttttttttttttccccccccccctttaaaaaaaagccccaaaattttaaaaaaaaagccccccccccaaaaccccgggggggggccccaaacccaaaaattgggcacttcccaggtcctgcgcagcctggcaagggccacacgcgcatccccctcccgatccatccacatccagcccgcttcattaaggccatcccgaccaacatgcagcgtatgatcttctttatcccttctctcgtcattccacttctctaa

SEQ ID NO: 1506 - DNA, 189 bp, A.fumigatus
tatgcttttcggagtcgactggtcatgaacggcggtcgttcattttctatttgtcttcagtcggttattgagggcttaatagcacttgagaacctctctgtgtcccggcatgctcgtgtatggtacctgctagtagttcgaagtattgagtctacctctgacacgtgggctcatcggcacataacatga

SEQ ID NO: 1507 - DNA, 678 bp, A.fumigatus
ggggtaaattccaggcccgatttggggtggaacccttcagtgaaatttgtggcttgggagggtattcaggcaggccagaaacacggcggtgagttcgggcactggcatcccataaatggctttgttgcattgagggtaacaggcttagcatgcccgcataccagcagcaggatccttcttcaccagcagccacatccccagcaacagcagtattcatccttcccgtgggaccagctctcaaagtcccccaagccaggcatatccaatttgagcaaattagagagtgctttctctagtttcctgccgggtggctcgtcgagggaagaacgtgttgagaatgtagctccccagcatcaggctccataccagcaccaacagcctgatcgtccatatcaaccacatggccagcaaccttatgagacgcactcccagccacatcatccccagtactatcagccacctccacagcagcatcccggtggtgggtacggtgagccccatgggggctaccagagtaccccttatggagaccaatatggccacccacctccggttcctggctacaggcccccggaacatcagcaccacgagcatcatcaccaatcacatgggcatggcgaggggtatcacggttatcccgggtcgggctatgacaatagatacggttctggatattaa

SEQ ID NO: 1508 - DNA, 378 bp, A.fumigatus
ttgggattgtttctgttctttattgccgtgcgtctcggcgtctacaactattcgctgaaagtcctcaatgaaggacagaccatactcggcacgaacgagcagcatcctccgctgatgaagtcctttacgaagcagttctgggacatgtacctcacggtggtgcacctcatggacccctggaactgggcgctatactacaactattacaacccgcacctgtggacaattccagtggagttccggtgctcgattgtcctcttcctcaccatcatcgcaacctcgcgcgttacagctgttgctcgcctctccctcgttagcggcctagtctggttctgtatgcgcgtcttcaccgacggcggctggaaggacacgagcttc

SEQ ID NO: 1509 - DNA, 585 bp, A.fumigatus
  unsure (455),(561),(584): Identity of nucleotide sequences at the above locations are unknown.
cacaaacatcatcctcaagatatgttgctcattgacaaggacacacggccttctcctgcgattcatgatattcccctcgatgacctggagtcaggcccatatggaagcaagtcgtccttcaactggacgaatctatccgactacaccccctcccgtgtgctcacacgtccggatcggctgtcttcgcacgtacagcacgtctcaaatcactggcaggaatatttagatcgttggctcaaaagattgggcatcgcgctcacaccgagctatctgcaacacttggtgggtggggagcctccccagcccacaaaattccatgcgatcgcggcgctggatggcttgagaggctgggcctgtctgctggtcttcaattttcattttctcttcacctacacatggaaagtcgcagtgggatggggtttcaataacgagaactacgggatctttcatcttcntatcattcacttcctgttctccggccacatcatggttgctatcttctttgtgatatcgggatatgtgctatcctacaagcctctgaagatgatccgtactcgctcntgggagcaaacactggctacttng

SEQ ID NO: 1510 - DNA, 414 bp, A.fumigatus
acagaaaggggtttggacgcctgcattttccaggtccgcccagccattgctgtggagacaatctttgaacgagcgctccgttcagtatcaatacaccgtcgaaagagtcgccagactttcgtttttcttcattttcaggttctaacacatttcgtcaaaatgggatttgggcaattcgactctatatgccaaaaggcagcactccctctttgctccttggtgggcccttcgtccccaatatcaggatccactggcatcattcccaactgctatgcgcggaatatcgagttggcaaacaccatcatatttgaaggtgctgcgtccttcgtacatatcattgctctaggaatgacagtcatcatgattctgcatgtcaggtccaaattcaccgcagttggtgagtctcgaacctag

SEQ ID NO: 1511 - DNA, 690 bp, A.fumigatus
acgccaattgcgcgatttgtccaatgcccgtggtggaagaatatcttcatcgccaacgccggcgtcatggccaccccagagggccgcaccaaggacggcttcgagacccagctcggcaccaactacctgtcgcacttgctgctcttcctcctcctccgcccggcgcttctggccgccgcgaccccgcaggcgaactcccgcgtggttctcctctcgtccatcgcgcaccggtactcggaggtggagtttgacaacctcaacctcgacggccagtacgaccggtggaaggcgtacgggcagagcaagtgcgcgctggtctgggcagccaatgagatcgaccgtcgctatgcctcgcatgggctgcgtgcgtttagtgtccagcccggtggcattatgaccgggctggtgcatcacttgtcggaagaagagcagagtggatttactgaggaccccacgcttgggccgcagtttaagagcccgcagcagggtgctgcgacctcggtttgggccgctgtcagtagatccctggacggcatgggcgggaagtatcttgagaatgtgcagattgcggaggcgtatgatgcgagcgggggtccgtgggcgccgggatatgccccgtatgcgtacagcccggagaaggagaggagactgtgggatgtgtcgctgaagctggtgggtgttgatgagtag

SEQ ID NO: 1512 - DNA, 1059 bp, A.fumigatus
acgagactcttcctgggtcgcgtgattgcaatccgacttgtttccgccttcatccaccagcgtattccctctcatgtcgtcgattgcgcccatagtcaccaacccaacacccaagatcccgaacgcggcgaagttggacggcaggaacagctagcgtccgctccgaaccaggcaaatggctctaccgaacggacgcctctcctgttacaatcaaagccgccttctcgcaagtccatgccgggtgccgttgagcgaccggcgcttgaacctctgcggtctcggttgactcgtcgcatcaatcagctcatgggtggcgttaaaacccaatgtgacgaaaacggcccgtgctatggtttctcgcagacgtgcggtcttgaatgtaccaagatcctcactaatacgcagatggctagcgtcgtcgaggagatgcctcgcccttccttgatcacgcatcacagcattggcgtgcagcttgactcggaacgcgtaggatttggagaaggggctggcccaggcctgctcccccagtcgcatgattcgacagaagacgtctcaggacaatcggacgccagtaactcccagaaaaaccaaagcagcgcatcttccttgcggaccggtctggaagtctatccccacaaatcctcagaggaccaaaacgattcgaccaaagagccacgggcagcatcggcgcaacaacaacaacaacaccatcaccacgtgccccagaatgcctttctctctatcggactccagacgtcgttggctattgccctccataagctcccagagggcttcatcacatacgctaccaaccacgccagccccacgctcggcatgaccgtcttcgttgccctcttcatccacaatatcagtgaaggcttcgccatggccctgccgctctatcttgcgctcaattcccgctggaaagccatgttctggtccagcttacttggtggtatcagccagcccgccggcgccgccctcgccgctttttggatttggggcgcgcggaacgccggccaccacgacgagaaaaccggtgctaaaccacgccggtag

SEQ ID NO: 1513 - DNA, 699 bp, A.fumigatus
agacaaacggtctcagcgaggacagtcgcactacccacacccagccatggtgaagactggcgcacaagcattggttccgtgggcaacttgctccccaacatggaagcaaagtatatgaccatgcctgaagacgggtcggaaccccgcgaagtgcctgtgggcgaggtgggcgagctgtacttgcgcggacccaacgttttcctgggctaccacaacaacccggaggcgacggcccagtgcctttccaaggacggatggttccagacaggagacgtcggctaccaagacaaggataacaacttctatatcaccgatcgtgtcaaggagcttattaagtacaagggcttacaggttgctccggcggagctggaaggaattctggtggacaacgaggcagtcgatgatgtcgctgtccttggtgtggagagcgaagcacacggaacggaagtgccacttgcttacattgtgcgaagcgcaaagagcaagaactcgaacatcactgccgaggaggaggccacgaggatcgtccaatggctggatggcaaagttgcataccacaagcggttgcgggggggtgtgagattcgtggatgagatccccaagagtccgagtgggaaaatcctgcgacggcttctcaagaaacaggccaaggaggatgccagcaaggctctagggtgtctgctccccaagctaagctgt

SEQ ID NO: 1514 - DNA, 474 bp, A.fumigatus
gcccatatgcgcggttctttcggtccctgggcgagaagactgctgcaggacccgcattacccctggcacgccctctcccggctcaacgcggacaagttcttctcggatatcatcgagagcgtcctcggcgccatcttcgtcgactcagggggtaaccttgcgccgtgcgaggtcttcgtcgagcagatcgggctgatggcctacctgcgtcgaatactggaccatgggattgacgttaggcatccgaggagcgtggtgcagcagttggctaagacaaatatccagtttgtgttgcagcgggttccgaccgaggagggaggcgcgagctatcagtgctcagttcagatggagcaggcggagctgtttgtagtgacggggtgcttgacagctgaagaggcggaggtgaccgctgccgttgaggcgattaaattcctgacacgggatgaggggtctacaccattgaacaagagctga

SEQ ID NO: 1515 - DNA, 327 bp, A.fumigatus
acccccggttggggtgggtccccgccccccctactgggtggaaagcgttgccctttcaaggacacccgtgccatcctgacgccctcccacaccggtaagctcgccaacgtggagtacaagccctccaatgtgttcaacctccacgtgcccaagacctgccctggtgtgccctctgagctgctaaaccccaagaacagctggaccgcctcaacaagcttcaccgacgaggtcaacaagctggccaagctgttcaacgagaacttcgccaagtacgcagacgaagccaccaaggaggttattgcggctggccccgttccctcccagtag

SEQ ID NO: 1516 - DNA, 498 bp, A.fumigatus
ttctccgacgcggcacgcttgttgaacttctaccaattgtggcttgacgacttattcccccgtgcaaagttcgcggatggtcttgccataattgagcgactcggccactcgaaacgcttacaagcgatgcgaaaggaatggatagatgaggagaagccaaaggacgcgtcagaaaatcataatgatgtcctgaaagcctccgaatcatcaggaagtcaatccgatgatcctgttgtagcatttggtggtctcaacatggcggatacaaaacgatcgaaaggggatattgctggtgactatatgtttgatgcagagaggatgcgtgttgaagtcaatttaaatccttccggacaacgcaaactagacgaggggctctttatgacagataacgatgatgtcgcgcagcagcctgataacctgggagcacctgacgacgatgaattggatgcacttctaaaagaacaggagctactcctgatgaacaatgcctctgcctga

SEQ ID NO: 1517 - DNA, 903 bp, A.fumigatus
ccactgtgcctgcaggatcgcgtggcccgccggcgaacaacgactggatggctcggttcgacccgagaggccaacagcaacagcagcaacctgcgcctcctcagcccccgcagccgaatcgaccggccacaacactggccgcgcagctgtcgtactatacgtatacctccggggcaaccccattccgcttcctctcttcccaacctcactgctccatctccggcccatacaccgtccccggctccgactcagcgtccctcgtatccaggatcgatgtacgcacaatcgccgtcctcacacacacagccagcgcctagtggcgcgcgcgatctgggctcgcagaatcagatttaccggcccgcagtcggatcccccacgtcacgccacaactccattgcgtacggctcacgacagggcccgccgacgcccgttcaatcacagacaagcctgcttggtctgggatctcggccgcctgcgccaaccgtgtctgccccggccccatcgaatcatatgtcggctcaccagacctatcagcagcatgtgcagaccatggtcaacggagcccatcagcagcaatcacatcgcggcccgctaggattgagtacaggctatggccacaattccccgcaaccgcaagcacagggttcccgtgcggcggggctgccaggaccgccctcgcaggcggccgccatgggccggtcgtatacgccgccggcgattctacagccgaacccggcaggatacggtccgagcggcccatcgtcggggatgcatcctcttcaggcgcgaccgtctggccctggaggtgttggtgagcctctttcctctggccacaatccgggacatcaacgggggtacagtcaaggatcaagtggaatgccgccacagcatgggccacgctag

SEQ ID NO: 1518 - DNA, 690 bp, A.fumigatus
ctgactgttgtccatcttatagcgaactcacttgttgcagtgggcgatgaagaaggcggcattcgattacttgactctgccaaagacgacaaaagcggattttccaaggcatacctaacctttcgtccccacatgaacgcaataatggatcttgaattctcgtccgatgatatgctcctggcaacagcttccggtgaccaaacggcacaggtgattgatatggctacgcagaaaccgatatactgtctatcaaaccatgtgtcctcagtgaagcgcgttcagttccaaccggcggcgaataataaagttcttgcaacttgcagccgggatggaaatgtcaacatctgggaccttcgatgcaaagggttcgaaaggccatccttacaggtccggtgctcgctggaatctgactcggacaattcgctgtcactggcttacaaaatgatttatccccaagttcttaatacgatacatggagctcatgcttggaccccccaaacttctatcaatgataaaccccaaccgcaaaatgggacgttccgaccacaacggaaaccttatttgacgtttgtttccccccggtcacgaaaatatctttgtgacaaccttcaaagcccatgcatgcctgagaataagagaatttcctaccacacacaaaaaccgttgaggcccccctttccttctcgttga

SEQ ID NO: 1519 - DNA, 567 bp, A.fumigatus
acgacggccatggatgcctcgtccagccatcgccgtcagcgcagtacaagtagacagcgggacgaccatgtagaatctccgcctgtgtcagtcaaagtgaagatgcacaatgacggacggcacgtcactctgaggagactgaccgaagaagaagccgccgccagtcgtgaagcacgacgaagggagaggagaaactcacgtcgtcgcgccggaagtgcgagttctttatcgggaaacgaaggtggctacgatcgatggcgccgggtggaggaactcgagcgccagcagcaggaacaaatccaacgtgaacagcaggcggccgcggctgcagccggttctgctgctcctttgggcgctgctcctcccccatcatttgtcccgccctcgagtcacttttctcccccacctccccctgtaccctccagcttgccctacggcagcatcgggtccccgggcacatttaccggcacagatgcgagtggcgactatgcaaacaatcgccggcgaagacgagcggaaagagctcgagctcggcaagaaagacaacagagtgttgatttcacatga

SEQ ID NO: 1520 - DNA, 1029 bp, A.fumigatus
  unsure (40),(928),(965),(983),(986),(987),(988),(990),(991),(992): Identity of nucleotide sequences at the above locations are unknown.
cccccgcctggtatgagggggtgccccaagcaccccaagntggtgaaacctcctccttcacagaccagcagcggcaggtccacgccggtccccgtcaaagatagacagaaactaggtctggaaggtggctcgaggagaccagagacgcgggaagccatggttgagagcatcggcgtgctggcacgtattcccagtttcatggtggagcttttcgtcaactatgattgcgaagtagatcgggcagacctctgtgaggacatggttggtctattgtcccgcaatgcctttcccgattcagcgacgtggagcacaaccaatgtgcccccattgtgtctggatgcactgttggggtacgtgcaattcatatacgatcgtctcgaggacgagccgcgatacgagggctttccgtccaaggaactgctgaaaagccaacgcaaaaagaagaggattatcatccagggcgcccaaaagttcaatgaaaatccaaaggcgggaattgcatatcttgcagctcatggtatcattgaaaatccggatgaccctgttctggttgcgcgattcctaaagggaaccactcggatttcgaagaaggttcttggggagttcatctctaagaaatccaatgaagcaatccttgacgcattcgttgatctgtttgacttctccggcaagactgtcgtcgatgcgctgagagacctcctcggtgctttccgtcttcctggagaatctgctctcattgaaaggatagtgaccacattctctgacaaatttgtccagaaagcccacccaaagggcgttgcagacaaggatgcactctttgtgctgacatacggcattatcatgcttaacacagatgcttacaatcctaatatcaggccccaaaatcgcatgacctgcaatgaatttgcaaggaatctgcgcggagtcnatgcggggagaagaatttgctccctgaattccttctngaagatctacgaactcantcnnncnnnacgagattatttttacccgatgaagcctgaggaataa

SEQ ID NO: 1521 - DNA, 987 bp, A.fumigatus
  unsure (11),(27): Identity of nucleotide sequences at the above locations are unknown.
cttgccaagtntggtgtcgtctgtcgngaacacgatgatggacttgagatcgacggcattgaccgctccacccttcggcagccggccggcggcgtattttgctacgatgaccaccgagtcgcgttcagcttcagcgttttatctctcattgccctaaagcccacgctgattctagaaaaagaatgtgtgggtaagacatggcccggctggtgggatactctgcgacagaaattcgccgtcaagctggagggcaaggagctgaaggaagccgagtcacccgttcttacccgtgccgaaaaggcaagtgcgtcggtgttcattatcggtatgcgtggtgctggaaagaccacaagtggacactgggttgcgtctacgctcaagcgacccttcattgatctagacgacgaactcgagcgcatagaaggcatgaccatcccggacatcatcaagcagcgtggctggcaaggtttccgagatgccgagcttaatcttctgcaacgaacgatgaaggagcgcccgaccggccatgttttcgcatgcggcggaggagtagtagagattcctgaagcgagaaagctgcttatcgattggcacaaaaccaaaggaaatgttctgcttatcatgcgcgacatcaagcaggtgatggcattcttgaacatcgataagacccgcccagcttacgttgaggatatgctgggagtgtggctgcgccgcaagccatggttccaggagtgcagcaatattcagtactacagtcagcacgccagcgcaggacttccccgggcgtctgaggactttgcgcgttttatcaagtttgtcacgggactagaggacagcctcggtaccatcaagaagaagcagcattcgttcttcgtgtcgctgactcttcctgacgtgcgtggtgcggatcagatcttggagcaagcatgtgtgggctctgatgtcttcaccacggggctggaaggatccgcggtggtcaaatcatca

SEQ ID NO: 1522 - DNA, 297 bp, A.fumigatus
gtgagtgaagaccagcagagtttaactagtgtaaagagattacttattcttaatagccattctagccaccagactgcagaatttgatgctttctataaggaaaatgtaattatttacctttatatactaccttatacttcccaccttctacagccactggatgttggcgtttttggcccgctgaaacgcgcatataggaagttagttaaaggaataatggttgtaggaaacaactatattgataaagaagactttctgcacctatatccacctgcacatgaaaaagtctttaattaa

SEQ ID NO: 1523 - DNA, 252 bp, A.fumigatus
tgcaggaaaagaccaataggcgtgctctctaatattggaataatcccacaagcatcatgtactttcctttctcgtatcaaacactcactgaaagcagcaagcagtgacattgacaacctcaactacatcattcaagcctgccaagtggcacgcaacgcagacgacttcactgtgtatgccatcctatatgccaaatccgcagacagaccctgtgagaatgagttaggaagctcgattcggcctcgaacatga

SEQ ID NO: 1524 - DNA, 210 bp, A.fumigatus
acgtcaagtgccgtcccacgcgtctctatcatcacctccgcattcgcgcttttcgtgtcactcgatcaggttcctatccaagtactgtcgaatggtctcgcctatatcagaatgaatgacgtgacaaactccttgctcacagagcatttcagctatacgcctttggttcgttttcgtccaccgagatcgtcttgcgatgggcaattgtga

SEQ ID NO: 1525 - DNA, 447 bp, A.fumigatus
  unsure (431): Identity of nucleotide sequences at the above locations are unknown.
gccatgccgagggctagtacagctcctggcgcgcggctccgatgcaggagagcttgcgacagctgtaaacggagaaagcagaaatgtaacggagaacagccgtgtacgatctgcatacagcgtcgcaaggaagcggaatgcaacttctcagacaaaccggcccgtttactaaaggctaatgctcctaaggagactatgcttcttagtgagcacatggtgccgactccgcagaggcaaacgaccatggatcgcctactgaacgccctcgaggatcatagcgcagacttggagcaacagacaacggatgacaacgacgggacggcgcctgtgcctaaagttcctaggctgcttcctgatgggcaaggaaaattcatgtattttgggcgattctgcaaacttttcttttctgccaaagtgttacttcgtatccntccctttggtcaataa

SEQ ID NO: 1526 - DNA, 207 bp, A.fumigatus
tggaagacgcttccacatcctacaatgccaggacaagttggtgggcatgaaggagtgggcaaagtcgtcaagctcgggccgggagctgaatcgtctggtttgaagattggagacagagttggcgtcaaatggatctcgagtgcttgtggaaattgccgtatgtgccatccgatattccaaagctttcatgtggtaatctcggcctga

SEQ ID NO: 1527 - DNA, 786 bp, A.fumigatus
caaacaagctttgcagaaccatgccaggcgggctccgacggactctgctttaagcagaaaatttccgggtattataccccgggcacattccagcagtacaccgtagggccagcgaactatgtcacaccgattccagacgggcttgcctcagacgaggcagccccaatgctctgtgcgggcgtcacagtctatgctgcccttaagagaagccgcgtccgaccagggcagtgggtcgtcatctctggcgctggtggtggactgggacacttggcagtccaactagccagcaggggaatgggtctgcgcgtggttggcatcgaccacggcagtaaagaagaactagtcaaggcctctggcgcagaccactttgtggacatcaccaaattcccctccgacgacaacggcgcggctatcgccgctcatgtccagtcgctgaccgatggccttggtgcacatgccgctcttgtctgcaccgcttcgaatgccgcatatgcacaggctctcctcatgctacgttttaacggcacgcttgtgtgcgtgggtatccccgagcatactcctgtacctatcgcaacagcaactccgggaattatggtcgctaagcattacacgatcactggctcggccgttggaaaccgaacggaagctatcgagactttagatttggcagcacggggtgtcctcaaggctcacttccgcactgagaaattggaaaacttgacagcggtttttcaggaaatgggcgaggtaaaacttcaaggaagagtgtttctggatttgtcttaa

SEQ ID NO: 1528 - DNA, 1194 bp, A.fumigatus
  unsure (35): Identity of nucleotide sequences at the above locations are unknown.
cgccctgcgcggattttcgacgtctgtgtgagaanacccaacgccgggactgctgttcacggatccttggattatatgatcgttcaatcggatactcatgggcagcttcttatcgctcaatcgcggcttgagtacctggaacatatgttgaaggaggatctgaccgttatcattccgtctattcgtggctcggagctagcagaccagacaaagtatcgaccgcttttcaagtcagccgacgcggaaccgcagccgatcatagctgcggactttgtcactgccgactcgggttcagggcttgtgcattgcgctcctggtcatggtatggacgactatgaagcttgtgttcctcgcggcattcctgcgtttgctcccgttgatgaccatggtagattcaccgacaaggccatgcccagtgatccaacgaggctgagtgggaaaagtgtcctgggagaagggactgtcgctgtgctcgagtacattgagtcgcaaggctacctactggcaaaacatgagtacgagcataagtatccgtacgattggaggtccaagcttccaatcatcattcgagcaactgaacaatggtttgcggatgtagcagacatccgtgacagcgctgtaaaggctttggaggatgtcagattcgtccccagttctggaaagcaacgcctggagaactttgtgcagaaccgtagcgaatggtgcatttcacgccaacgtgcctggggtgtcccaattcctgccctttataatcgggccacaggcgatgctgtgctcacccgggacagcgtctcgcacatcatgtctgtgatcgacgaacgaggcattgatgcatggtggactgacgatatgaatgaccctgcttggattccgcccacactgcgagaagagtccgcttccggctacaggcgcggcactgacaccatggatgtgtggtttgatagcggtacaagctggacagagattgacacccctcctcgtgatggatgtccagcggatgtttacctcgaaggcactgaccagcaccgcggctggttccagtccggacttctcacatacatttctcatcagcttgcttcagggcagactgctactcctcgagcgccattcaagaaccttgtcacccatgggtttactctcgacgaagaagcacgcaagatgagtatcttaaccgcggcgtggcgatatgagtca

SEQ ID NO: 1529 - DNA, 513 bp, A.fumigatus
  unsure (201): Identity of nucleotide sequences at the above locations are unknown.
ggtgatcccgtggttgcgccaattttgaagcaccccgatttctatcatatttgggcatccacccgtgatcctgccagacccggtgcaccagaattcattgcccgcggcgttgaaatcccgcgtgcagacgtggacgagggcagagaagatcttactgctgccttcgatggcgcacacattatttatgcactgacagatttntggcagaagcagtctgccacggcggaggtcgagcagggaaaagctatcgcagatgctgccgccgcgacaacaaccctccaacactttgtctggagcgctctgcctgacccagtcgccctgtcgggccgccagtttctcaatgtacatcactggaagggcaagagcttggtcaccgagtacatccagaaagagaaacccgaactgtgggcgaagaccaccaccatccttttccccaattactttgaaaactgtctgaccagccccggccggtatctgcccgtcaaagtaagacagccttccagcctggcataa

SEQ ID NO: 1530 - DNA, 375 bp, A.fumigatus
gacagccttccagcctggcataaacggagatggaatggcggagtactcacgttggagatctcgactcaggacgaagcgggtacctatactctcaaatttcctcacagtccgaacacggtgatgcccaacgttgctatcgctgatacgggcaagctcgtccacctggtcgtcgaagccggttcggcctacttcacgaaggttattgcgttctgggcccaagccctgtcggaggcggagaagctggctgaactggggaattgtatggttactcccaatcatactgtccacatttctaaattcgatgttagaccacaatgtcccaactcgctaccacccgtccagcccctattcgccacggactggaagatccgcgtc

SEQ ID NO: 1531 - DNA, 723 bp, A.fumigatus
ttagcgcggttccttccagccccggtgtgtgaagaccagcagcagcaggagcaagcgatggctgccgctcaacaagcgatcgtacagaatcaactggagcgcagccgaagccaacgtcaacagcagtcacgcgggccagaacctaaacagcccacgcaaatggggcattcgcagcacgccaatgatcatactaccgcgttgcaaagcccccagaaggcgcagcccgttccagcagctcgtcctcgacagcgcgctcgtcaaagtaatgctgtggacgttagggcgcggttgcttgccatctgtactccaggtgatccgacgaagctttactataatctgaacaagatcggtcaaggagcatcgggcggcgtttacactgcttatcaacatggcacgaacaactgcgtcgcaattaagcaaatgaacctggacttacaaccaaagaaagagcttataatcaacgagatcctcgttatgaaagatagcaaacacaaaaacattgtcaacttcctcgacagctacctccatggcttggatctgtgggtagtgatggaatatatggagggcggtaacctcaccaccttctccccttccttcttcttacccatgccattacccctccttcctctccgaaaggtttcccctccctccgtaaactccccctctgctgccacatctcttgtcttttccttaacttcttcctcctccctcggaattcgttga

SEQ ID NO: 1532 - DNA, 189 bp, A.fumigatus
ttttggacccttcacactctcactcgggcttactcaaaactcatctcacctgcgctctatgcaatcagcgagatctccactcacacatggaagtccgccccctttgctcgcccatggacgcgttgtccgcataaaacgggcatctatgctgaacattggttactgccgacaagaaggatgcaatggtga

SEQ ID NO: 1533 - DNA, 183 bp, A.fumigatus
caaccctcctcgatcaagatcatcaatttgactaaccagagtcgctgtctggcacagaccacgaccttctgctttacaaactcggaagacttccctctctgctcgcacatcgcgaagctcatgaccggagaaacaaagttccctctgttgagccacatgccttccgtctctgacacaaactga

SEQ ID NO: 1534 - DNA, 285 bp, A.fumigatus
aacactatcctcaagtccctcattgcagcaaccgcaccagagtctccctcgacatcacctccataccggttcaccgtcaacagcaccatcgttcagcaaggcttgatcgataagtcttccgcagcagacggggccgtcagtaatgccggcaagcgtggaatgcactctgcctcaggcgccttttgggatgtcaaccgtgatggaatgtggacatttaagtaccctggggctgaagagcggggcctcgatgtcattgtcagtgtggcatggtttgctctgggctag

SEQ ID NO: 1535 - DNA, 252 bp, A.fumigatus
gcccttggttctaggggccatgtctacttttgcgcaatgttcaaggaccccgaattaactcgtattgtcccaatctgcactttcaaagctcataaagactatctcacgcgggtctttctttctcctgacgtcaggcatttggcgacttgctctgccgaccatacgctaaaggtctggaatctcgatcctgatttcccccccggccaagatggcagcgataacagcagccaaggccagagccactggcaatga

SEQ ID NO: 1536 - DNA, 510 bp, A.fumigatus
aggtctggaatctcgatcctgatttcccccccggccaagatggcagcgataacagcagccaaggccagagccactggcaatgaatcgcctgtgccggaagccaaagagcctgtagcgacagatcccgttgcctccccgacatcacccaaggtccaggaccttcacgttggcgctgacctgggaagaagcggggagctgaacccgattacctacatcagaggtaatgctcctgcgaatccggagccgcagcagactttcccagtgcaaccggatgggcctcccatggatatggctacaggaacgccttttctagagaccacattagccaatcatcagcgctgggtgtgggattgcgcattctctgcagattccgcctatcttgtcaccgtttcgagtgatcactatgcgcgtctgtgggagctggcttcgggtcaaatcattcgtcaatacagcgggcatcaccgcggagcggtatgtgtcgcattgaacgactattcagaaccacgttga

SEQ ID NO: 1537 - DNA, 666 bp, A.fumigatus
  unsure (602): Identity of nucleotide sequences at the above locations are unknown.
gccagttcttacttgtgtatatatcaaaacaaacgcatagggataaaagtcgatgctctccttcttggtccaattcccccaccggcaattcaatgctcgtttgactgcctgaacaacattatgggacactcggtcatctcgcctgccatcttctactggggcaccccggtcgttcttgcgacaacggtcaacaaagacggaacgccgaatatcgcgcctatctcatccgcctggtggttgggaaatcgagctgtcctagggcttggacgaagttctcagacaatcgccaacatcatccgcacgcgacagtgcgtgctcaatctcccaggcgatgatatggtccaatgtgttaatgctctggcgcggacaactggcgccaaagacgtgccggcaagcaagacccagcgaggctatcgagatgagaaagacaagttcggcatcgcgggattgactcccgaatcttcgcatcttgtacagcctccacggattcaggaatgcccggttcagatggaagctgaggtcgctggaacccacgagcttttcacagatggtccaatcgagttacagggatgcgtcatggcgattgaagtccacatcctgangaactatgtcacggaaaaactgcggcttgctgcgtatgcgaacacgatcgatcccgataaatga

SEQ ID NO: 1538 - DNA, 1170 bp, A.fumigatus
ggcatggacgaacgacgcgccaaatttcgacaggatctcatctctgaggttaaaccatggtcaatgaataaacgaggtcctcgtcgctggcagcgacacctgcatcacttccgtcatgatgagggtccggagtcagagaaaccgaatggtctaccatccattgtcgtgaacgatgacgcgaacgtggagaacgggccgcgacacacaccaggccgaacggatcaagaggaaacggaatccgtctaccgcagtgcagatggatcgcgtgccggaagcattcgcagtgcacaccattatcgttcatcctcgccgctgaagagaacgaaattcgggttggctgtacctatgatgaacccatctacagaagatttagcatcagttaagagtggtaactcgatgctttcgcttcaggtgccggaaaccggaagtcgggctcctagcgagtacgatgaagatgacgaagatgaaaagcatcaggacattcaagaagtctggtttcccggcggacacgcggacatcggcgggggttggaaacttggcgagggcgaagaatggcctcttagtcatgcaccactggtatggatggtacacgaggcagagcgtgcgggccttcagtttgacccgcgcaagctcaaaaagttcgaatgttgcgaagagtatgacggggagatttcgcctttgcatgagcatctccattgggaacagaatatggatatgtgtcaagatccaagccatggagaagatgatgatgagcacatgagattcgcccgaaaggaggatgaacagaacgcgtctaaatccaagcgcagatttttggaagctctgtacgagtccagcacgaaaggaatcctgcatgattgtttggcttatggcaatgggctgccattcacgtcagtcttgtcgtggcggatcatggagtatcttccattccgtcgcatggatttgcaggacgatggctcttggaaaccgatccggtggcctcttcccctgtggagaggtgcgagatattcccaaggatgctcaaatccatgtctcggccattcgccgcatgaaggccaatcccgagtaccgaccgggcaacctaatcattggcggcggcggacgtggtgtcaaaagagctccagcagagtacggcatgtccttcaccacagggctgaaagatccacgtcc

SEQ ID NO: 1539 - DNA, 1128 bp, A.fumigatus
catcttcgacgcgtgagttcgaatttgggcccgcagcaacatcatggaactccaccgcccccgccacaaaatgggttcgcatatattccaaatccctcgatgtatcatcccaatgccaaccccaacatagcccaacaaccgcgcccaccccaattcgcacactatggaccgcaacagccactaccgccgcacgcaatacctccacatcccatgcctcaaccagtcccgccgcaccatcaagccccgcagcatctcccccaacatccacatccgcttgctcagcagacacctgcgatgggactctcgcaaccgcctcatgcgtcaataccacaggtcgcgcagcctttcttgcccgaacaagggagaaactcgatccctcctgcgtttccgacagagcagtcgcaaccacctcgaccggtatccctacccgatgtttcctcggcagatcagatggttggtccattaaaggtggaaacaagtccctctcctccgcaccagcgatcgctgtcatccaaatcgcgcagtatcttcacgccgatcgatgaccgcggctccgttctggcccgtcacttcggactcggcccgcctacgtgcgagtctccacgcactgagagtgcagacgtcaaggcagaagcaaaacagaatgactcgaaagaaatcaagccacctgctcaacctgttgcgcccccacccccgcctaggaccacagccgatgcggcacggtctcagtcagctcctgatatcaagccaccgccacgaacgaatagtggtcaactgccctcgaagcggccacagcttaaggtgcaaataccaagcgaaaattctgaccggggaagtgctacagcagattcttcgtcgtccaccggcaaccaaaccgtgactcctgccaaggctaatcccgacaccaatcactccggcgtggttctccctccaccgtcgccatctgccggagcaattctgagtgctggcgccacagggcccccaaatcccttcgctcggccaccgccgccgggaactgccagccagaacagcaatgcgtacaacagcaataacaacatagagacgccgatctctgctctacccagtcgatttgtgtcttcaccacggggctggaaggggccgctatat

SEQ ID NO: 1540 - DNA, 546 bp, A.fumigatus
tcatcttcgacgcgtgagttcgaatttgggcccgcagcaacatcatggaactccaccgcccccgccacaaaatgggttcgcatatattccaaatccctcgatgtatcatcccaatgccaaccccaacatagcccaacaaccgcgcccaccccaattcgcacactatggaccgcaacagccactaccgccgcacgcaatacctccacatcccatgcctcaaccagtcccgccgcaccatcaagccccgcagcatctcccccaacatccacatccgcttgctcagcagacacctgcgatgggactctcgcaaccgcctcatgcgtcaataccacaggtcgcgcagcctttcttgcccgaacaagggagaaactcgatccctcctgcgtttccgacagagcagtcgcaaccacctcgaccggtatccctacccgatgtttcctcggcagatcagatggttggtccattaaaggtggaaacaagtccctctcctccgcaccagcgatcgctgtcatccaaatcgcgcagtatcttcacgccgatcgatga

SEQ ID NO: 1541 - DNA, 498 bp, A.fumigatus
  unsure (17): Identity of nucleotide sequences at the above locations are unknown.
gggttcttcattggggngactgttcgccccacaacatttacacatttattaggccaccttatttctggccgatatcccgttcagatgaaagccgcttatccactgctcagcgacgaggctcactcggtcattgtggatctccctaattaccgctggaatcatccggccaaatactggtacaagcgtgaggtgagcaaggacgggcgtgttcgcaaggttccgcatcgcgacctcgggagtgaacctagccttggcgcatccatggatacgcacaacggtgtcatggcacgcaagaccgaggaactcaatcaaggcatgcagaaaactccggagacaacagttttccctggtgaatatggtgatcttctcagtaagacgctaagcagcttaagcagcatgttgcagttgacggagccagtcgatccagaagagttgctctcaagctatggattggattctctgtccagaatccaaccacgcctttggctgaatacatag

SEQ ID NO: 1542 - DNA, 738 bp, A.fumigatus
tttcatatcggcgttgacagtaaaagcggacagtatactgcggctgtcaagggcccttatggtgaatgggtgatgaccaacgacagtcgcgtgatatttacccagactctggaaaagagtatgagctcgccaggtgctggaaaggagaatgtttacatactggcgtatcgacgagtggaaacccagagcaattcagctgagtccaatacaggtttatcagccgctgtcacgtcctccaaccccaaagcatcaattactggccagagcgtgacctcttcagggcattccaatgccggctcatcgaatgaaccaggctcaagaaaagggtcgctcaagggtggtgtacaaatgaaagggatcattgagctagaagggaggcttatccaatggacgatcaaccagcagctgctcctggacccaggtaaaggtgcacttgtggctctggggccccgagcaagaacgcagcgtgctactctgcagctcacattaacttcagaagacaccggcgagatcctcggaggacaagtgaccacgtcgctcaaaccatggggagtgcagaagccaaagcgagggccttcaaagactgcagacaccaaagattccagtgccggtacgaagaaagcagcagacacagtgtccgggaaagcagccaagccgaaaggtgtcacaaagaaaccctccagtccgccaaaaggaacccgtcaatcggcgagactccggagtaaagctaaacaataa

SEQ ID NO: 1543 - DNA, 330 bp, A.fumigatus
gcacggattatcctggagacggacggggaaggacagcgggagcttggcggcggggttgacgttgccgtagagcacgtcggcaatgccgttgccgcattcgttgccgccgaaccaggcctggaggagggccttggctttgtgggcccagggcatggtgacgggcgtgccgctctggatgactaccactgtgtcggggtttgcgtcgagcacgcggctgatcatctcgtcgctgcctggggggaggtccatgtgatcgcggtcgtagccctctgtttcccattcgctggtgagaccggcgaagataacgacttgggaggcctgggaggctag

SEQ ID NO: 1544 - DNA, 510 bp, A.fumigatus
tcctatgagagctgttcctccacccctggtgaagaccgggcagacctacaaggtcgtcctgcaattcggcaccgctccaacctccgacctcgacatgcgcggcgtcgtcatcttcgggcccggcggcttccgcttcggcgccgcccgccgcgtcagccaggaggaactcatctccaaagctgcagagctagcctcccaggcctcccaagtcgttatcttcgccggtctcaccagcgaatgggaaacagagggctacgaccgcgatcacatggacctccccccaggcagcgacgagatgatcagccgcgtgctcgacgcaaaccccgacacagtggtagtcatccagagcggcacgcccgtcaccatgccctgggcccacaaagccaaggccctcctccaggcctggttcggcggcaacgaatgcggcaacggcattgccgacgtgctctacggcaacgtcaaccccgccgccaagctcccgctgtccttccccgtccgtctccaggataa

SEQ ID NO: 1545 - DNA, 738 bp, A.fumigatus
cctatgagagctgttcctccacccctggtgaagaccgggcagacctacaaggtcgtcctgcaattcggcaccgctccaacctccgacctcgacatgcgcggcgtcgtcatcttcgggcccggcggcttccgcttcggcgccgcccgccgcgtcagccaggaggaactcatctccaaagctgcagagctagcctcccaggcctcccaagtcgttatcttcgccggtctcaccagcgaatgggaaacagagggctacgaccgcgatcacatggacctccccccaggcagcgacgagatgatcagccgcgtgctcgacgcaaaccccgacacagtggtagtcatccagagcggcacgcccgtcaccatgccctgggcccacaaagccaaggccctcctccaggcctggttcggcggcaacgaatgcggcaacggcattgccgacgtgctctacggcaacgtcaaccccgccgccaagctcccgctgtccttccccgtccgtctccaggataatccgtgcctacctgaacttccgctccgagcgcggccgcgtcctctacggcgaggacatatacgtcggataccgatactacgagaaggtcgacctggccccgctcttcccctttggccacggcctctcctacacgaccttctcccgctcggatctgtccctcgccacgacccccgagaaaccccagctggaagacggcgagcctatcacggttaccgtctctgtgactaa

SEQ ID NO: 1546 - DNA, 666 bp, A.fumigatus
tcatccagagcggcacgcccgtcaccatgccctgggcccacaaagccaaggccctcctccaggcctggttcggcggcaacgaatgcggcaacggcattgccgacgtgctctacggcaacgtcaaccccgccgccaagctcccgctgtccttccccgtccgtctccaggataatccgtgcctacctgaacttccgctccgagcgcggccgcgtcctctacggcgaggacatatacgtcggataccgatactacgagaaggtcgacctggccccgctcttcccctttggccacggcctctcctacacgaccttctcccgctcggatctgtccctcgccacgacccccgagaaaccccagctggaagacggcgagcctatcacggttaccgtctctgtgactaatacaggtagtgtggctggcgccgagattgttcagctgtgggtggctccgccgccgacaggcgtgaaccgccctgtgcgggaactcaagggcttcaccaaggtgttcctgcaacccggcgagacgaagaaggtcgagatcgtggtggagaagaagctggcgacgagctggtgggacgagcagcgtgagaagtgggcttcggagaaggggacgtatgaggtgctggtgacagggacgggcgacgaggtgctcaagtcccgccttcag

SEQ ID NO: 1547 - DNA, 267 bp, A.fumigatus
ccacttgtttctcctttcctgcgagttactagtctctccacgggctctctgcacgcgaagattcgccccccagggaccttcctggccattcagggtgtccatggcattctgagcctcttccgtgctgctaaattcgacgaacaaatagtagtggtctccaggctcgaatcccttcccagggtgaggtgtgaacaatttgctgacattttcactttttttttttttggaacaaattactctccaaattggaaagtccattctacagag

SEQ ID NO: 1548 - DNA, 198 bp, A.fumigatus
  unsure (146): Identity of nucleotide sequences at the above locations are unknown.
aagaaactttatcggtttgagagtcatttcaccgtggcagtaaacagaatcaacgcttattcttgtgatgcgaataggatatggacacgggcggtcaggggcccacggttgaatcaaaccaccggaaccaaccaatgcggtgatanaaacggtaagagccaaccggcagaacagtttatttcaggcattatccgcatc

SEQ ID NO: 1549 - DNA, 201 bp, A.fumigatus
ttaaccaaccgaaacacctgtcctgtggacgtggtcggaaggtcgagcgctgtgtcccttgcacgccctatcaatgacagtcggcagcccagcccaatcacagacggaccctgcggcactctcagctcgttctacgcctttgacatgatcaggtcgaagtatatttatcaaaagaaaattttattggtatataagaactaa

SEQ ID NO: 1550 - DNA, 261 bp, A.fumigatus
cgatgtatatttatcattcaaagcattcattcaaagcatacgcagggaagacaagaagagaacgaacaaacaggaaaggaaacttttcctatgacccctctcatgtccaacatgtgtgacactcgctcatcagatactaacgtccctcatgtggactcaaaccccaacagcgctagggtagaacggatctccgatcgacgcctgatcttgctgggcgacggctccagtttgtttcggactgggaatattgataggtgctga

SEQ ID NO: 1551 - DNA, 468 bp, A.fumigatus
  unsure (90): Identity of nucleotide sequences at the above locations are unknown.
tcctcagctgccccgagtatgccgggaagctcggctgccagttttaccggtagctttggaattgcgccgtctggagtcaattccggtctntcgaccgactggggaagcaacttctctgccggtgtttcttctttctccacgcctgccactgggtcagtcgaccaattcgttcagatgggattcgaaccggagtttctgcaacaactcaatgatcggtatggtgaaatgcatattgacgagatggatggcatgatgtttggagtagaacaagaacatacgcgcaatagcgcgttagtacccgagggcgacgtatacaaactggcaggctctaccgatgctgctgcaccgctctccaacgtcgggtcagcacctatcaatattcccagtccgaaacaaactggagccgtcgcccagcaagatcaggcgtcgatcggagatccgttctaccctagcgctgttggggtttga

SEQ ID NO: 1552 - DNA, 672 bp, A.fumigatus
aagatcaggtcggtctcccacccaacccaggtcacgatcatcacggtcgtgggccaagccggtgctttcgtcggtgccaatttcttcggctacattagtactttctttggtcgccgcttaaccatgatggtgacctgtgttatcggtggtgccttggttcccgtgtatattctgccccgcgacatgagcttgatcgccgccgtcttctggcagcagttctgcgtcggtggtgtctgggggccgatcccgattcatctgatggaagtgaatccccctgcgcttcgctcacttctagttggcttgacgtatcagctgggaaatcttgcctcgtctgcatcagctacgatccagtcgacgattgggtcgcggtatcctttgcctcccattgaagctaataagaagcgcttcgattacggcaaggttattgggattttcctgggtgccgtctgggcgtatatcctgtttttcctcttctgggggccggagatagccgcggaagaaagggaggaggaagcagaggcggctaagtacctggaaaaccttcgttcagagggggtcagtctggctgagattggagttgtgcaggcgaggaaggccaagggggctgggatgccacctcgagataatgatgaagagaaggggaatgaggccattaccgagcacattgagtga

SEQ ID NO: 1553 - DNA, 234 bp, A.fumigatus
catttgctttatccattctttggcggccttgccagaatctgcgagatcgcccagtcgtacgagaaggcgtacggtgtcaaggccgatctccagcgattgggatccttagatgatccgtacaaactcatgcacgagaaacgcgagcagaatccctccgacatctacagctacatgtcgttgtatgtacttccctgggcccttttttccactggactgataggtgtccgatactga

SEQ ID NO: 1554 - DNA, 183 bp, A.fumigatus
gtgtccgatactgacggatttgacaggtttttctactactactgggtcaacggtcagaccctggttggccccgagacggacaatgccaagtaccccgaggtaaagcctgtcagctgggaaggttttatgtcgcagtggccgttgcagcaattgcccacagcgtactttgctctgaatgcttag

SEQ ID NO: 1555 - DNA, 219 bp, A.fumigatus
gaactgactaataggagcacagacgttttggaaatgagcattgtttctgctgatggacgacaccgagtgatcaatgcgtattcggatccagagtacttttgggctgtgcgcggcggcgggggaagtgcctggggtgtatgtgacctatgctatataccagagccgcggatatattggattggcgctgacctgttcatcctcaggttgttacatcggtga

SEQ ID NO: 1556 - DNA, 267 bp, A.fumigatus
cctgttcatcctcaggttgttacatcggtgacttacaaaactcatcctgttccacagaacctcactattgggttcgttcaactaaacgcaaccgacaggtccagctccacccgcctcacttctgaatccctaaaactcatcccagccgttacagacgcaggctataccgggtatggctcgtttacgcagggcttccaagcaatcttcctccaacccaacgggacaatagaatcttttaaccagacttttgctccgttttctaactag

SEQ ID NO: 1557 - DNA, 264 bp, A.fumigatus
acacagcttcccggtgtcactggagcgcttgcagcctattctgcgacctggaacgactatttgagaaccctcctgcaagaccctaatattgggactaacattcaggacacgtcacgactattgacagcggaggtaatccgagataaagccgacgatttggcggagttgattgtcgacaatgatcaagctgcaggatttaacttcagtaaggagggtcctgttttcagcagttggttccatcaggttaatccgtcactggtttag

SEQ ID NO: 1558 - DNA, 573 bp, A.fumigatus
ttctcgagaacttcgctgtgtagatgcgatccgctcattggccagcacactcccacatcgaatcgatcgaacggagccttacgtcttgagatggccaacaacttcaataatggcgactactatggcaatacctcattccgtatgactcccacgacctctggtagccagtccaacacctctcatgccgcccttgactgtagcaacgccgacatgatgatgatgacatttgcgccttttgatcccctccgaatgggcgacttttctttctctgaatctcatgggtcagatatgctgtcgagcggcatatcagcagacgagctgctgggttctagctcgtctcttcctgcgccccctgtgccgttggctgaccaattgcccaatgcattgttcccgtatgacccgctgtctggcatggagaactcggtgcccatggcactggacgctgcaagtgcaattgcatacggccattcttccgtataccaacaatcctccttgatgtttgaacagaccttcaatggacagccaatgcagcagcttccttcgtttcagaaccagactatgagcctagtattt

SEQ ID NO: 1559 - DNA, 186 bp, A.fumigatus
  unsure (80): Identity of nucleotide sequences at the above locations are unknown.
gccacggcgcatatctttcaatctgctcccgaggttttgggcggttatttatggtatatccaattctcctgttgtgcttntcaaggtaaccttttcttcaaatcctttgatggttttcgatattatcagggcccttttctgagtccgactcacgctttgcttcttttagtggcacaggggaactaa

SEQ ID NO: 1560 - DNA, 360 bp, A.fumigatus
gtttgcagattgtcactgagcctttttactctttggacaattctaaccgacggccacttgatagaggtcctctcagtccctaagaacatgaagctgctcgccgtgccgttattcgagctgtacgacaatacagcgcgttacggcccgcaactctctgccattcctcatctgctatcccgctataactttgagtttgttgatgagaacgacaatgttgtcgcagccacgccgggggcgccccttcctgagcaccagatcccccggaccaaggttctcgcaggcgaaaccaacgacgggcaggacgccggtatgacggactacactgaaggcggggagaatggaggggagaacgcgcagtaa

SEQ ID NO: 1561 - DNA, 288 bp, A.fumigatus
tgctccttgtgctcaagaccaggtgactatcttcacttcgacgatgacgaggttgaaggcttcaagaagcggctgaacgagcgtctggcgccggtgggatcccaattctcaggcgaaggcgtcaatgaagactgggagattggtgatacccttgcgcagtggtggcggccgaatttcgagacgtttatgtatccttttcttcccggacacgttacgcggcctaaggagtgcaagaaattgtacttcattcagctgcctaagaagagtaagtttgcagattgtcactga

SEQ ID NO: 1562 - DNA, 600 bp, A.fumigatus
ttggggcgcatggtcgcgctgcacacagagctaccgatcattgccgatgcggataccggtttcggcggaccgctcgacatttctcgcactgtgcgactgtatgaacacgcgggaatcgcgggactgcacatcgaagaccaggtaatggcaggctcgcgatccagatgtgccttgatctgtattgacgcgcaatcccatcaggtcttccccaagcggtgtggccagctccaagggaaagatgtcgtggccctggaagtattcattgagggcgtccgcagcgccgtcgaggcacgccaggatccggactttgtcatcattgcgcgaacggatgcgcggcaagccaagaggtttggcgggccacacgccggatcggaggccttccatgaagggatcaagcggctcaaggctgctgtagccgcgggggccgatatggtcttcatggaatgcccgcgcaccgaggacgagtgtcggactctggtcaaggagatgggagatgtgcccgttccgatcaatgtccttcccaatgtaagcaagtccggatttgaggatacatcgcggtatgctggtcttcaccacggggctggccggatccgcgcttaa

SEQ ID NO: 1563 - DNA, 366 bp, A.fumigatus
gagctatgtccatctatcggcgtcgtgcaaataaaactcggtgatctagaatcacaaaacgaggatgtctccacagacctgacatggtctactatactgaagtggggtatcatcacctataccagcatgctcattgtgttcatcagcatatgcaactgttgtccttcactcatcgaagtacggctgctttcactgctatcccacagaagctcctctggcccctttcttgcgtattcccacaatgttggccattttcggaaaccgacggggtttgacatcgttgcactggtgccctacaagcatcatgagcagacgtctgttttggactgttatctgcaggtattgttggatcttatcctgttctga

SEQ ID NO: 1564 - DNA, 183 bp, A.fumigatus
ctaccccctttatctcctttatttttttatttgttattcacccttatctccactacctccttaatctactttacaagcttcttattttttaatagagctactgcctcctttactagctctattattattattattactattcactattattactctcctctaattatatattattataaataa

SEQ ID NO: 1565 - DNA, 297 bp, A.fumigatus
agtacgtgcgctttgccttggggtgtacgtatagtacagcaccggggaaaaagacgagaagaagcagaaaccagaacaaacgacaaagcaaattatcaacattatctctctattacttgcaaggattcctctcttattccactattctatttgatcttctttcctatctggttggtcgcaaatttgttctacactctcgccaccaagtccactcgcttgtttcccgtccttttcccttcccctactattactacctctaccttggtcactctcatcggctaccctccactcgcataa

SEQ ID NO: 1566 - DNA, 594 bp, A.fumigatus
gtactacaccgcaagtatcgttgtgggaactttagcgctcgcttatggctccgttcctctatacaaaatggtgcgtggaagccttactggaggtttgctggttctagcccagacataaacctgaacaatcttcccttgcaggtttgtcaacagatcggctggaacggtcaaccagtactcacacaccggaccggagacggtgacacctcatcgcgcgtgacgccagtgaccgatgctcgtcgtcttcgaatcaccttcaatggttcagtgtcagacgtccttccttggaaatttacaccacagcagcgtgaagtctgtgtgttgcccggtgagacggcacttgctttttataccgcgacaaataaaggcccgacggacattatcggtgttgcaacatacagtgttactcctggtcaggtcgccccatatttcagcaagatacagtgcttctgctttgaagagcagaaattgaatgctggagagtctgttgatatgcctgtgttcttcttcattgacccggattttgtgaaagatccggccatgaagggcatcgacaccatcactttgtcgtatactttcttcagtaagagatga

SEQ ID NO: 1567 - DNA, 546 bp, A.fumigatus
  unsure (41),(77): Identity of nucleotide sequences at the above locations are unknown.
gtagatgctaacatgtttcagggctcagtggccaaggcggngacattgtatgtcattacagcctactgtgtacctgntacaatacaggctaacgcgaacgaacagccaatgaacccaacatgggtaatggaactgccgcgcggcgacgaaaagggagcattcttcacgatggacatgggaggcaccaacttccgcgtctgcaaagtgacactcaacggcaccgcaggcaaatacgacgtgatccaaatggacaacaagatccccaagtcgttgaagtctggcaccgcagagcaactgtggcactacgttgccgactgcctgcagcagtttgtcgatcgctattccatctcgcagaaagagctcgcggagacgcctctggcctttacattttcctaccctgtcactcaaacatccatctcgcatggcatcctccagcgatggactaagggatttgatatcaagggtgtcgagggaacagacgttgttgctgcactgcaaaaggttctcaaagacaaggtcagtcctacttcggtcctttttgcctag

SEQ ID NO: 1568 - DNA, 618 bp, A.fumigatus
  unsure (357): Identity of nucleotide sequences at the above locations are unknown.
aatctccccgctcggatcgtcgccttggttaacgacacagtgggtaccttaatggcgtcttcctacgtcgaccccaagaccgaaatcggtagcatcttcggcacaggcagtaacgcagcgtacatggagcagtgctccaagatcccgaaactggccgatcagcatctacccgacgacgcattcatggccatcaactgcgaatacggcgcctttgataacagccagcgagtgctccctttcactgtcttcgatgccgagatcgaccgcgcttcacctcggcccgggcaacaacgctatgagaagatggttgcgggattctatctgggtgagatcttcccgctcatcttgcttgatctncacaaccgcaaggtcatctttgacggtcagaattcctcgaaactaagcgaaccttatgtgctggactgcctgtttctggcgactattgagagcgatattctggggacctgcaaaccagggaagatacttttgagaaaacactcttcattacgcctaccccgcctggactacgcttttgctaacacctgcggcacaccaattccttgcgctggcgaagatatacccgggcggattgggggggaatataaaaaaccggggatt

SEQ ID NO: 1569 - DNA, 942 bp, A.fumigatus
  unsure (892),(917),(923),(926): Identity of nucleotide sequences at the above locations are unknown.
atgatggaaaatgatactatacgacttagcgagcgtccttacggatctcccgtacgcgagtcgccgtcgcaaatcacacctgcggcgacaccctcatcctcatctgtattatctggctctggaaatagggttacagcccctgcgcaggtattcatccaagaaaaggacttgtgcttatcagatctaaactcatacgttgccgtcggcgtcctgagaaagcgcaacgaacctcacgatgtcgatgccgacccttgggcggacgacgacaagtatccaggggcggagattgcaatgctgaagaaaggcaattgggtacgaacatgcgaatatacatatgtgaagcatccgcaatggtgctatgtccgtgtctatgtcctgcctgacgatgctgggcacaagtacgttgaccgttcaagcaagacattgagggaggcacttaaagttgtcatgtcgaaagtcaatcggtccgtcgatgcatgggatggtatcttcttttcggatgagcaagttaccgatggcaattcgaatgataccggtaccgaggacgagtcactgtggtacatattcaacacactgcgaaatcccgagccgcaagttgaagccgtgaaagacccttacgcgaggctcgccatgcgacaattactttcagaggaggatgctggcgacacagtactcgattctggtgtcgaagggctcaaaacacctttgtacccataccagcgtcgctcagcagctttcatggtccaacgtgaagcgcagccagcccagatgttggaccctcgtctgcagttattcaaggcccccaatggacgcgagtactactacgacgaagaagaaggcaccatttacaaagagaagaagctgtattcagaagcttgtgggggcatcctancggaaactatggggtgttgggtttnaaaaanggnaaaccccaatttttga

SEQ ID NO: 1570 - DNA, 192 bp, A.fumigatus
ggttcgttgcgctttctcaggacgccgacggcaacgtatgagtttagatctgataagcacaagtccttttcttggatgaatacctgcgcaggggctgtaaccctatttccagagccagataatacagatgaggatgagggtgtcgccgcaggtgtgatttgcgacggcgactcgcgtacgggagatccgtaa

SEQ ID NO: 1571 - DNA, 594 bp, A.fumigatus
tccgttgatgcagcttttgtccgcccaatctacgctggaaatgccatcctcaccgttcaatcgaccgatcccatcaaggtgatcacagtcagaggcactgcattccagggtactgagaccgagggcggctctgctgaggtcgtcgagggagctgaccccaaggctcccgctcagaccgagtgggtatctgaagagctcgccaagtctgagcgccctgatctggctactgcctctcgcgtcgtgtctggtggtcgtggcctgaaatcgaaagaggagttcgaccgcatcatggtgcctcttgctgacgccttgggagctgcaattggtgcttcccgcgctgcggttgacagtggatttgccgacaacagtcttcaggttggccagacaggcaagaacgttgcgcctcagctctacttgtgtgctggtatttcgggtgccatccagcaccttgctggtatgaaggacagcaaggtcattgctgctatcaacaaggatcctgatgctcctatcttccaggttgctgatgtaggccttgttggcgatcttttcgagaaagtcccagagcttaccgagaagctgaagagccaggcgtaa

SEQ ID NO: 1572 - DNA, 438 bp, A.fumigatus
  unsure (24),(25),(26),(27),(28),(29),(30),(32),(37),(38),(47): Identity of nucleotide sequences at the above locations are unknown.
ggagaggaggggaggtatctttannnnnnncntttannaatggaacnactctctgtaccttccagccccgtggtgaagacaagcgatctatatgcttttttgcaggtgctgatgctcattgaaatccaggggctgcccgagaactatgctcctcttcttgtggagaatatcaagaagggcgaatatacccacgtcgtcgcggggcattctgcctttggaaagagtctcttgcctcgtgttgcggctctgctcgatgtgcaacagatctccgatattacagcaattgagagcgaggacagtatgtggcccccggatcgagtctcgttggactacgtgatgagtcattcgcatattaatccgttgatgcagcttttgtccgcccaatctacgctggaaatgccatcctcaccgttcaatcgaccgatcccatcaaggtga

SEQ ID NO: 1573 - DNA, 648 bp, A.fumigatus
aaaatcataaaaggtacttccgcaatgagatctttgtatttacgcctggctcttcagcttctcggtaagctctgggactttctcgaaaagatcgccaacaaggcctacatcagcaacctggaagataggagcatcaggatccttgttgatagcagcaatgaccttgctgtccttcataccagcaaggtgctggatggcacccgaaataccagcacacaagtagagctgaggcgcaacgttcttgcctgtctggccaacctgaagactgttgtcggcaaatccactgtcaaccgcagcgcgggaagcaccaattgcagctcccaaggcgtcagcaagaggcaccatgatgcggtcgaactcctctttcgatttcaggccacgaccaccagacacgacgcgagaggcagtagccagatcagggcgctcagacttggcgagctcttcagatacccactcggtctgagcgggagccttggggtcagctccctcgacgacctcagcagagccgccctcggtctcagtaccctggaatgcagtgcctctgactgtgatcaccttgatgggatcggtcgattgaacggtgaggatggcatttccagcgtagattgggcggacaaaagctgcatcaacggattaatatgcgaatga

SEQ ID NO: 1574 - DNA, 261 bp, A.fumigatus
  unsure (25),(100): Identity of nucleotide sequences at the above locations are unknown.
tggtcgcgaaagccaaaggccccgngaccttatccatctatttacatatccatacagcgcattgcaacatgcatacatgcatgcatgctcctagtcgatntaagtactatatataccatcgaagccgctgcgaagatgggcgcatctccccttatttttattcttgcgacagtgattatcgccatgggagaagatgaagaaggtgaagaaggccccatgtctgtgtcgcaaggagaaggcgagacatttgttacccagtga

SEQ ID NO: 1575 - DNA, 1134 bp, A.fumigatus
  unsure (11): Identity of nucleotide sequences at the above locations are unknown.
tccatctccantgcatatgaaattcaagctttttttaaggccctcaatttagccgtcatgcttttttccacgcagtgggctcaagggaaacggggttgggacgagttgcatggggcgagcaggtgtgaaaacttcatggatcacaagggcgaagagcttggggacgagttcgagcaggctctccggcaatccatttgggaacaggcaaagcggacactccaagatgtctctgatctggagtgtttcagggttgttttcgctgagttgatttttggtcttgttcaaaagccgtattccaggaatgaatatgacccagacgcaacaattgggttggctactagaaatctgtgcaaaagcggtaccaattcaatttcacctacgatcgcagatatttttgcccgagaagggccgccgatattcatggagcgaggggcccgcaagatgcacgcacttaagtatcgattcgaagcataccaagcaggttttcggcaaggcgctcgcagttttgaatctgaaccgaatgctggagccccccaagaaatgagcgcagaagatggtcaaacaattggtctcttgtactggctcgcagtcatgtttgatacggtctcttcgtctataaatgagcgaccagtggtcgtccctgatgaggaatgtcaacatgatggagcacagagagcggcaaaggatcctttagaattaccggtaacgaatgtgcgatggaaacttgacctctatgcacaagatgatactgagagaccgtcccttttgcattggccttgtacatacgacgttgcaaccagggcagttgccaggtcagcagctgtcaaagtgctgcttttccgccatatcacatatcttcaaaacggcttgaggaattgtgagaacggcccagccatcgaggaaatcattaaggccacactatctgtatatcgatactgggacgtcactcatggtgctttcttccgcgacttaatcatgaactatgaatcagtccctccgcgcattaggagctggtttccatgtatcagtattccgtggcacttgggctcacttatgctcgcaaacctgattgattatgtggatgagaaccggcttggctgcgacagctacagggcgaaacgtctccatgtcggc

SEQ ID NO: 1576 - DNA, 276 bp, A.fumigatus
tcataccaatctaagaagggaaaaatggaaaataaactgtgttctcaattagccggccgggaatctccagcccctgaaagccagtccgctgaacagcagatccctttttgctggggtagaatacctcgcagctcgcagcaacggacggagattcaaatccagcaaacttccgacaatatcaagcctttccagttggaaagtaaccctattcatcctcttgagggccctgagatggccaaatatgcaggtgacaaagttaggcgtctgtcttattga

SEQ ID NO: 1577 - DNA, 501 bp, A.fumigatus
aagccgcagcaccagaggtatgtatgtattggcactgtctacgggctcactttgctaatcgttcaggcgtctaccgaagcggaaccatttgaggagagatggcgggcgactcagctacagtcaggctcttccatggtttcggcagccatcacctgcctgccgcctcgttatgtggcagatttcctggtccagatcttcttcaagtacgcccagacaaataatttctacgtggaagaggactggctgctggaaaaaatgcacacatgttatacaaacccatccagcctttcgtccgacgatgctggctccgtttgctctattctcatggtcctggctgtcgggacacaatttgctcacatggagtccgccactcctgtcaatcgattatcggccgactcctccattaactatgaccacaacttctcggaagacgaggttgggctcaccttttaccagtttgcgtcgaaattgcttcccgatatcatcgccactgcttcggtt

SEQ ID NO: 1578 - DNA, 327 bp, A.fumigatus
catagatatagagcggcggaggtgcggccaatgtgtaaatatccacaaggggtagtgctggccaaccttgaacctgcaacgcccgtgggcgtcgccatcttggcgtctgccccccgccaaggccccccgggcaagccagctcccgccccggccgcttcggtgccaccagttggtaccatggtattcattctactccttctgtccgccccctctacttcctcggcgggcgctgctcccccgcccgccaacctgccgaccaggcaccgccgcggccgcggcaagaaacctaaggaccagaaggccgacaaaggagagggcgacaagtga

SEQ ID NO: 1579 - DNA, 207 bp, A.fumigatus
tattggaatgttaaatgcgaatacttctgtcccttgagcgctagcttcggaatgcccctcccttgttgcaacaaggcacaggaggatatcgcgacccagtctcagtattctaggacagcaattaatgtaaaaatcagaaggagaaaacgggaatgtggggtctgttctgctaaagcaggtttgggatcctggacctgcgtgccctga

SEQ ID NO: 1580 - DNA, 465 bp, A.fumigatus
cgagctgcaatcatgcaaagtggatctgtagtggaaaggacgtcatcccggcgttttcctgcgcaagaactgtatgactccttggttgcttcaacaaggtgcgccgaagcagaggattccctgaactgcctgagatacattccctacgacgagataaacaatgcctttgaaaaatctccgtatggaattggtcgcatggccgaggccttcggcggaccttccatcgacggaaactttcttccgaattatgggagtctgagtctaaaggactctcggatggtcaaggtaccagtaattagcggcgtcgtttctcacgaaggtagcaaccagatcccagggtcagtgcgagactgggctgatctgcgagattatttgataagtattaagcatagcttggtcctgaaactttgcctggtgactgactgctgcgttagatcacatctcatttccaacaactgcggttga

SEQ ID NO: 1581 - DNA, 663 bp, A.fumigatus
agacacaccctcacctctcgcttccccgatatcctctgggaaggatgcgcctccggcggcggacgctttgaccctggagtcctacagtacttcccccagatctggacatcagatgacaccgacgccgtggaacgcatcttcatccagatgggtacgtcactcgtctaccccgccagcgcaatgggcgcgcatatctccgcggtgccgaaccaccaaacagggcgaacggtgccgcttaccttccgcgcgcacgttgcaatgatgggcggatcgttcgggcttgagctcgatccactgaagatgtgtcctgaggagaaagctgtggttcccgagctgatcgcgttggcggagaaggtcaacccgatcgtgctgaaaggcgagatgtggaggcttagtctgcccgaggagtcgaattggcctgctgtgttgtttgtctcggaagatggagtcaaagctatcctgttcctcttccagctgagcccgactgttaatcataccatacccagggtgagattgcaggggctggacaggcaggcgatgtacagcgttgacgagcaggggccgtattcgggtgatatgctgatgaaccttggattgcagtattcatttagcactgattacgctagcaaagtggtgtttttggaaagggtcgatgtgatgtga

SEQ ID NO: 1582 - DNA, 294 bp, A.fumigatus
tgttacgggttgacccaaacccaatccacgaccggtctaataatgtcggcttttagcaagctcccctctggggcatccatcgctctcaagccttttcgggtctccatcccggaagaggagctggatgagttccaggccctgttgaagctctccaagattgccccaccaacatttgaaaactctcggccaagcggccaatatggcattacctcggactggctgaccactcttcggaaacagtggcagaaggatttcgactggtatactatcttagtcctgtgcgagaggctatag

SEQ ID NO: 1583 - DNA, 834 bp, A.fumigatus
  unsure (171),(814),(818),(821): Identity of nucleotide sequences at the above locations are unknown.
gtctcgggtttccaccccagtaggattcacgagacgccgaaggtaatcttccccgccgtaataccctgccccgaacggaggatggtaatccagctgggcagacgcttacgaaaaggcccagagggtcgtgagagacatgaccttgcccgaaaaggtggatctgacgaccgngacggcatcttcatgggtccctgtgtcggccagacggggagtgcgctgcggttcggcatccccaacctctgccttcaagattctcctttaggggtgcgcaactcggatcacaacaccgcgtttcccgcgggcatcacggtcggcgcgacctttgacaaagaccttatgtacgctcgcggtgtggaactgggaaaggagttccgcggaaagggaatcaacgtacttctgggcccgtcagtcggcccgatagggcgcaagccgagaggtggccgcaattgggaaggcttcggcgcggatcccagtctgcaggcgattggcggtgcgcagacgatcaaggggatccagagccagggggtcatcgccacgatcaaacactatatcggcaacgagcaagagatgtaccgaatgagtaatgtcgggcaaagggcatactcgtccaatatcgacgatcggacgctccacgaagtctacctgtggccatttgcagagggaattagagccggggttggcgccgttatgactgcgtacaatgaggtaagtgcctccactttgtgtccgagcgtcaagccatctgatgagttggcccgccaggtgaatagttcggcgtgcagtcagtacagcaagctgctccgggacgtcccgntgtntgnaattcgcaactag

SEQ ID NO: 1584 - DNA, 681 bp, A.fumigatus
ggacgcgatccttccttaccgggcgtgaggacgagcgagcttcagcaatttggactgaaaatgtacgtttggcacattgcccttttgttagcattgtggcttatatcatttcatagttataacgccaacgtgaaggagcttcaagatacgccgggcagcgagtatttcgccttccttagccgtaaagcgcatgaaggagccctcaatcaggccaagatcgatgtggctgaggcacgaatgaggggagaaatcggtgaggccgaaaagaaaggacgagcaaaacaggagatctcgaagatcgatgccgacactgcagttttggagacaaagcggaaggccgaaaaggccaaggctgactctgaactcatgaaccgtcagactgagctcgataatagcgttcgacttgccaaaatttcggcccaacgccaagcagaaatgagagacgcagagctgcaaaagcaggttgagtctaagcgtgcagaaacagagctcgaacgcctacgagccgtggaggttacgaaaagcaaggtcgcacgcgagtcttctcaagaaaaagcagatgcttccttctatacggaacaaaatgctgcagatgcccagctatacaaacgaaagatggaagctgacgcaacctgtacgtctctgaacctatgtttcctttccttttttcatttgcgctga

SEQ ID NO: 1585 - DNA, 270 bp, A.fumigatus
cccaccaaggaggcccctgtcgacacatcggccactcccaccaccttcgttaccgccaccaagcccgccaccactgctgctcccgctgctccttcccccagctctggctctaactccggctctgactcttgcaactccggaagcgccagcggctctgtcaagatttacgggcagtgcggtggccagaactactctggtcctacaagctgcgaggccggtctcatctgcaaggagtggaacccttactaccaccagtgcgtcagtgcttaa

SEQ ID NO: 1586 - DNA, 1083 bp, A.fumigatus
gccaccaacatcacccggcccactaacaactcgaccaagctcgtctcaacccgtgccacgaagtgtcgcaccattcaggtagagtccggcgactcgtgtgcctccctggcgaccgaatgcggcatcacgccggcacagttcacccaatacaatccctcctccagtttatgctcaagtttgaccccaggcaagcatgtctgctgtacggccggtacccttccagacttcacgccacagcccggcgcggacggctactgctactcgtatctcgtgaagacgggcgactcgtgcgcatcccttgcagcggcctacgacctcacgaatgaggagatcgagtccttcaacaaggagacctggggctggaacggctgcgaaaagctgtttgccgactacaacatctgcctcagcactggctacccgcccatgccggcgcccattgcgaacgctgtctgcggaccgcaggtcaatgacacggccaaagcacccccggggacggacctgagcaccctgaaccagtgcccgttgaatgcctgctgcaatatctggggccaatgcggaacgacgggagacttctgcacgccttccaactcgtccacgggggctcccggcacggctgccccgggccagaacggctgcatctccaactgcggcatggatatcatcacgtccagcgcacccgccgaaacgtacagcattgcttacttcgaagccttcagctggaaacgctcctgcctgcgcatgtccgtcactagcattgacacttccgcctatacgcacatccactattccttcatcacgctgaacgaggacttgtccatcaacatcgatgaagttgctgaccagctgcccctcttcaaggggatggtcggcatcaagaagattgtttctgttgccggctgggcgttctcgacggagcctgccacataccagatctttcgcaatgcggtggccacccaggccaaccgcaagacgctggtctccaacatcatccggttcctagacgactacagcctcgacggcgtcgactgggactgggaatatcctgccgaccgtcttcaacagacgcgaggatcccaaataagg

SEQ ID NO: 1587 - DNA, 189 bp, A.fumigatus
ttagtactcttccatctacctgatacttggcaaatctatgagtggttcgatggtagttcggccgcccatgtccctcctggcttttgctcacttgtgcccggcgcctccaccagcttggaaggattcctctctacggcatatccagccgcatacggcgcttcttgctgcatcggtggcgcatatgcctga

SEQ ID NO: 1588 - DNA, 486 bp, A.fumigatus
gggctcggccccttgtttaaattcggagacgttgatttggaatgcgacgggcgaggaattaccggggggcccgacaggggacggggacggaagacggagacggaaacaggcacgagaaagtcctctcagacgcgaacatcctcatcctcatcctcatcctcatcctcatcatcggggctatcagcaggggcagctgcaggaattggggtgggtgctggcgccggcgtcatcctcgtcggggcgttggtctgggttctgttccgccgccgacgacgacatcgcgctgcatcacaccaacctcaatcggtgtattcgcccgctggtttaggaggtcaggcatatgcgccaccgatgcagcaagaagcgccgtatgcggctggatatgccgtagagaggaatccttccaagctggtggaggcgccgggcacaagtgagcaaaagccaggagggacatgggcggccgaactaccatcgaaccactcatag

SEQ ID NO: 1589 - DNA, 297 bp, A.fumigatus
agtggcggattgtaccccagccagaagtgctggtggattattatcaaagtctcgtcgagcgatgcgacggatacgaaatccagcgtgagcgctgagtactttcactgcaccgatgccgctgtcaagcttcattccagcgctgttatcctcctttttataggtggatttctagatctccaatcattgtattgtatttctacatgccatacatctaaggcgggaacggagttgatcttctatgcattactgggcgatgtgcgacatttcttctcatactggtgcagtctaatgccttag

SEQ ID NO: 1590 - DNA, 306 bp, A.fumigatus
gactcttctttggccttgttaccaccttcttcttatgcttctacgaccttgcggactacctggtcatcctcttgtacagcttcacgcaatttttcgggcgttccattgttactagcgtttggattatcatactccctgatcatcttgattcaatctcttcctacgtgtatagtcagattcgttcttttagatggtagcattatgtcatacgacgtttgtcatgcgtcagtggtgaaaactacttacatgacagattctctattgcctgaggcgtccaccctaattccacttttcaatttacagtaa

SEQ ID NO: 1591 - DNA, 639 bp, A.fumigatus
cataattctttccagcccgcttctgttgacgcggacgcctcgcgtgcgggacgctcgggggacttggaccttgaacacagccaatccaaacggctgcggccatccaagcccgacgtgaaatatctgccagagaattatgatcaggctgatccgcgggaccttgtcattctaatctctagcatgctgatggagctgattcgctttaacgacaagataccgctgaataacggacgcctgacacgtttccattctcgatcgccacctcggatttcggtccaagactatcttcaacggcttacaacccacgccaccttgtcgcctccgatcttgctcagcatggtgtattacattgaccggctctgcgctctctacccggcatttactgtctcgagtcttactattcaccgattccttattgccagtgcgaccgttgcgagtaaaggtcttagtgacagtttctggaccaacaagacatatgctcgtgtgggaggtatcagcatggcggagttggcccttctggagttagagtttctgttccgcgtagagtggcggattgtaccccagccagaagtgctggtggattattatcaaagtctcgtcgagcgatgcgacggatacgaaatccagcgtgagcgctga

SEQ ID NO: 1592 - DNA, 279 bp, A.fumigatus
ggcgggaacggagttgatcttctatgcattactgggcgatgtgcgacatttcttctcatactggtgcagtctaatgccttaggactcttctttggccttgttaccaccttcttcttatgcttctacgaccttgcggactacctggtcatcctcttgtacagcttcacgcaatttttcgggcgttccattgttactagcgtttggattatcatactccctgatcatcttgattcaatctcttcctacgtgtatagtcagattcgttcttttagatggtag

SEQ ID NO: 1593 - DNA, 189 bp, A.fumigatus
  unsure (120): Identity of nucleotide sequences at the above locations are unknown.
actgataggctaacgtccggacacctttttagtcttagtggtattatatttcgatatatgtctatggcgaacttcggtaagcaggacaattcaggaatcttacgtaccgtcctgaggacnagagagactaccagtgtgttctctaaatctttaacaagtctgttcctactaatgatacctcgtctttaa

SEQ ID NO: 1594 - DNA, 384 bp, A.fumigatus
cttcccttaccatcggcggtgcttcggccctgtggtaaagaccatgcaatgatcaactcccaagcgcaccagttgaaggacctcgctgaggaacgtacccatcatgccaccggtctcgtgaagcagtacgttggtgactacagcgccaaggctcaggagtacattggccaccgtcgcagtacttcaccagaagctaccaaggctgccggtcctgttgtcaagaaggaacctagtgccgaagccattgtcaagcaggagcccatccccgaacccgtcatcaagacaacagacttcccggaggccccaaagcaggagccggtagcagaaccgattgagcacaatcgccagcctctggagaccagggagcctttgctggctgcttaa

SEQ ID NO: 1595 - DNA, 300 bp, A.fumigatus
tatccccaagaaaccccgaaatcccctcttaacggttcggagggatttttcgagcccgataaagtctcaatgttcggtcgaccattttctcttgacgatgcgcacacacaattctttagatacggaaaatggggttacaataccattagatatgttttaacctgggaagccatcgagcatgagggcccgggtaaatatgacgatgaatggatctcattcactatcgaggttcttcggattgcaaagcagtatggattttacgtcttccttgatccgcatcaggatgttgtatgtttttga

SEQ ID NO: 1596 - DNA, 945 bp, A.fumigatus
tccgcatcaggatgttgtatgtttttgatgaaacctactcccagaaaagagcgctgtgtagctgacaacctgaagtggtcgagactctcagggggttctggtgccccagcatggacactttacgctgcaggttttgatcccagaggtttcaagaagactgaggcagcgctcgtccaaaacactttcgatgatccggccgagttcccgaagatgatatggagcaccaactacacgaggcttgtcagccagacgatgttcacgttgttctatggaggcagggattttgctccgaaggcgatcatagatggcataaacattcaggactatcttcagggccattttattgccgcgtgcagatattttgctcagaaaattcacgaggccggggacatcgagaacgaagtagtcattggttgggaaagcatgaatgagcctaatagagggctgattggggtgcaagatatttctgtgattccacctgagcagcaactgcagttagggacgtcgcctactgcttttcagggcatgttgacgggctccgggagagcatgcgaagagtctacatgggctttcggcggatttggtccttaccagacaggcagggagcttgtggaccctgagggcgagaccgcgtggcttccggctgattacgatgacaccaggtatggctgggtcagggatcctgggtggaagcttggagaatgtctttgggctcaacatggcgtctgggatccatcctcagataaacttctgcgaaaggattatttcgccaaaaatcctcaaaccggtgaacctttgaactatgataaattcaccaatccgtatttcatggagcattacagagcctatagagatgctctcaggagtgtctggccggaagccatcattttctgcccaccccctgtgtcttcaccacggggctggaaggatccgcggtggcgaaaa

SEQ ID NO: 1597 - DNA, 405 bp, A.fumigatus
gagagaatcaaatcctccctcagctttctgtgttcctgtgttcctgtgttcctgcattcctgcattcctgcattccttcctgcgatccagcagtccaaagcagcagtggccctgctgctttctcttcccccttctcgatctcacccttgtcgttcatttccctccccccccaatttgcacacaatggcacctctcaagctcaatagcaggaacctgtcgcaaatcgcagcggcaggtggcgcgctggtgaagatccctacctaccagcgcggtcgcgccgtcaaggagggaatcgtccacattggtgtcggcggtttccaccgggcgcacctggctgtttacatcgaccagttgagcacgaagcatgagggtcttcgaccggcggatgctaaacaggcccccaga

SEQ ID NO: 1598 - DNA, 573 bp, A.fumigatus
ctgtttaatagtactggcgcaaaatgccttcctgcctcgcaggtatccaaagccagaggcctggtgctacacgactggcacgcggaggttctagccctgcgctcattcaactactggcttctatctgaatgccacagcctgctggcccaggaacagcatgcaagatcaagctcaaccaatacaccaggtgcagcatcttcacctttcatccgccgcaggaagtccgccgaaaggcctagcacagcgcaatcagaaccagccccggcctggccccccttcgagctccaacctgacatcaaaatttacatgtattgcacctgcgccccctgtggtgacgcaagtatggagctctgcatggctgcccaagacgacccaagaccctgggatgttgcaccgggacccgagcgcaccgagtctcccggccccggcccagaactcctagatggtcgaggctacttctcccgcctcggcatcgtgcggcgcaagccagcgcgcgcggaacccgaaccaaccctgagcaattcgtgctcggaacagctcgctctgcggcatgtatcgtcccccctatcgtaa

SEQ ID NO: 1599 - DNA, 267 bp, A.fumigatus
gccagtcttggcgtcagcgaaggtactccatacaatcttgttccgtccacaaaggaggtggcgaatgctgtacgcactcgtgtgtactgtactactatctactggcaaaagattaatatcctggaaaataatgttcaggttctccaaaaacgcatctttcactgtactacatatagattgtctaacgtcgagcgttcaatccataattattctttcgtgtggcacaagtcctgttcccaccccataaatgcctatgattgttcataa

SEQ ID NO: 1600 - DNA, 795 bp, A.fumigatus
ttccttgaacagtctactgttttcgacgacctggctcatcagatcgttcaccagacgaccctctctttgcaccaggcgagcgctcaaatctcaagcaaatccactgcagacggaaagctcttcttaatgagccatctcttgatcctgaagcaacaaattgtcgcattcgacatcgagtacgtagcgccagaagtgtcgttcgatttctccggcatcaccaataccttctgggagctccgtgaaagaggcggcctcttcaacccccgcaacctcatgcgcctcgtcggccatggtctactcccacgcgtcgtcgagaatatgctcgatgcaaaggtagagcttgacgggcggctccgaaccgtgatcaacgatttcattaacgagttcgcaacaaagatgaccgcctctttacccgcaaagttcatcgataggcggaatctgcagcaaggagaactaatttatccgacatgccagaatatcgagaaggaagtccccaacttacgaaaaatactcggtgactatcttgacgatccccggatgaaagagactcttgttggtgcagtacaagaccgcgtcatccagatttacgaggactttttcgacagatatacatcgtctgaacggagcaagggacattctgtctccaagaaggggaagggccgcgaggacgccgtgtgggatgtggggagtttcgcagagtggtgtgaaaatatcttccgagtcggcatccctgagcaagatgacgaaggattacctagtgggagtttgagccggagcgggagtccagggagctag

SEQ ID NO: 1601 - DNA, 468 bp, A.fumigatus
aacatccctgcaacgccaaaggaatcgaaaccggtctggaccctgcaggcgcatgacacctctgtgtcatcctttgacatcaaccctgccattcctggcttcctcgtaaccggatcaacggataagcaagtcaagctatggaacgtcgagaatggccggcctagcatggtcgtctcgcgtaagatggacgttggtaaggtgttttcgaccaccttcgctcctgacaacgaggttggcttccggttggcggtagctggcagcaagggaaccgtccagatctgggacacctcgaccaacggagccgttcgtagagcttttgtgtctcgcatgcccgccctggaaggcgaggtcaaggagcgcacaatcggagtgcaagccgacgatgatgaatcggatgatgatgccgcaggggaggagatcggtgctcagcaaggtggagatggctgggaatccatggacgaggactag

SEQ ID NO: 1602 - DNA, 246 bp, A.fumigatus
aataaaacatttcgctttgcttataaagatagctgctggtcacggtgcttaaatctccgcttcattgctgaatacgctgttattgcctacgatagtgaggggacggtctcacttgcagccacttcaccagcctcaattttaaagctacctgtggtcaatcttcttcatgtcaagattgtggagctcagtgtggattcttccatgtcgcagagtaatactactgggcatgcaacgcaactctctcca

SEQ ID NO: 1603 - DNA, 603 bp, A.fumigatus
atactgtgtcgcaaagaaatcaattacgtcaaaatgtcgcagaaggagcgcgaacagctcactgccgaattcaacatcctgagctccctccgacacccgaacatcgtcgcctattaccatcgtgaacatctcaaagcgagccaggatctgtacctgtacatggaatactgtggcggtggtgatcttagtatggttatcaagaacttgaagaagacaaacaaatatgcagaagaggaattcgtttggcgcattttgtcacagctggtaacagcgctataccggtgtcattatggagcggatccggttgaagtgggatcgaatatactgggcccggctcccaagccctctggtctcaaaggcaagcaggcgcagatgactatcctgcatcgtgacttgaagcccgaaaacatctttcttggaagtgacaatacggtcaaacttggtgattttggcttgtccaagctaatgcactcgcacgacttcgcatccacctatgtcggcactcccttttacatgtcacccgaaatctgcgctgcagagaagtacaccctccggtctgatatctgggctgtcggttgcatcatgtatgtcttcaccacgggg

SEQ ID NO: 1604 - DNA, 261 bp, A.fumigatus
aacctaatatcaaacaaaactcatacagggtgcggttcattcggcattattcgcaaggtcaaacggaaatctgatggcttcgtaaggactcgattcaagtttgtgacgctggtgttggggctaatcaacaagctagatactgtgtcgcaaagaaatcaattacgtcaaaatgtcgcagaaggagcgcgaacagctcactgccgaattcaacatcctgagctccctccgacacccgaacatcgtcgcctattaccatcgtga

SEQ ID NO: 1605 - DNA, 324 bp, A.fumigatus
actaccagtttcctctttttgatctcaattctcttccaattgctctacgcccgccaccacaagcgcgagaagcgtttcggtccttccccggcaaacggttacacctacggcaccggcacccaacgccgtggcttctggcgccgcaacaagcgtaccccggaaaccgccagtgcagacgacatgcttccgggtcaccctacccctcacgacgtggaaatgggcgatagcgccgagaaacccggcgccttcggtggccgcttctcgcgcaacaacaatgctgtggcgaatggctatggtggctcggcctataccggcaactattga

SEQ ID NO: 1606 - DNA, 357 bp, A.fumigatus
cccatttccccccacaaatgtgaataccagcccccagtattctcaattccccgggtggagtctgggaacaagcctcaaattgagtctcaggccaagccccagtttgggtataagcgtgagccagagtctccacccaaacccaagcccaagaataaccccgtacctgagcatgcccctgagccgaagccttccgaaactgcgcatgcacagggattctcaaagacttgcgaacacggcgagatactgtgcggggcagatggtcagacatgggcgaagtgcgactggggcaaacctgttcagatgggacctgttgccgccggtacgcgctgcagccacggtgtcatcgaacgtacgtag

SEQ ID NO: 1607 - DNA, 237 bp, A.fumigatus
ataaaggctcagacagtgaaagcctcagctcttaactctcgtcagacctccctgtctcctatcctccccatttatcttttagccataagttataattctagcttgtctgcctgtccatcaatcaccgagaaaggacgtccgccaggtattatagagcagtatcctcgccccctcgacgatatctttcatgttcctgtacctggtctcgatcagaccagctctataggggccatttga

SEQ ID NO: 1608 - DNA, 201 bp, A.fumigatus
tcagtgctcttattattgggcccaaaccttgtttataatcatactcccgaaattcaattcgacaataattcctctcattttgaccgtgccatttggcgtaaatgccgcacagcaaccataagatctcgtctgcctctccttaatgcttggactttggatttcggaccatgcaatacagctacacgaaaaggtttatcatga

SEQ ID NO: 1609 - DNA, 192 bp, A.fumigatus
tatctaagtgagtatgcaatatatgattgcagaggtatatatgtgctcaagttaagtgatgtcatggctacacaggcgtacagtgacttcatagtcggtcaggcactccacgggaaggctacttttctgcgaggtgagtgggaaattgcgtatattgaccgatacaaagctcggcaaagtctatctgattaa

SEQ ID NO: 1610 - DNA, 195 bp, A.fumigatus
  unsure (102): Identity of nucleotide sequences at the above locations are unknown.
tgtggcctctccgggcgggcgcgatacatctttattacgatgcatcctccacgcctcgatttcagtggcgcgcccgataatgatccgactctgctcatgcangatcagtctctcttcggaagtgtgaggccgggagattggatacaccaagcttgtctacgtttttatgttgatttgatgatttcagttgcttga

SEQ ID NO: 1611 - DNA, 198 bp, A.fumigatus
cacggaccagaagaagccaccgacccggtcacgcgcaccctacacaacccatcccagtcctacgccgaccacaccaaagaatcaggcagtagtgtcgcggagaaaatcgccgaggcgatgcagccgggttcgtaccttctatcccggggggaagctttgccggatggcgcgttgatattggtgagctgcaggcgataa

SEQ ID NO: 1612 - DNA, 612 bp, A.fumigatus
  unsure (60),(65),(122),(213): Identity of nucleotide sequences at the above locations are unknown.
gtgccactgtttgccccggtctggactctcaccacgttgtataccttcctcctccaattntactngccaggagacccccccccccccaaaatagacaatatattggacataatcaaaatgcntactcagcaccgcatccttgctcttgtgtacaacgagttcgaagccctcgatcttttcggcccattgggcgccatcgtcccccgcagcgantactacacgctggcgttagtcagcctgcacaacctagactcgccacatggcgttgaaacctccatgaagaacggcatcggcgtgatcccgaccctctcactggccgaggccctccgggaggatcagcagttcgacaccctgttcatccctggtgggtttggcatgatgccactggtatgggacccaatcctgctgcagcgcatcggtcagctggtcgaccgtgcgccgaacgtcttttccgtgtgtacgggttcgattttgctggctgcgactggtcggctggacggccggaaggcgacaacgaacaagcggctgtatgatgagctgactccgaaacgtataatcccgccgtcttgtttccagatttccagagcacatgctaacattttttttttttaa

SEQ ID NO: 1613 - DNA, 183 bp, A.fumigatus
cctcatagcgccaccgcggatccttccagccccgtggtgaagacaaaggaatacgagcttgacctgtcttttgctcagggctacacttcaaaatgcactttgtctactatactagcggcatggtccgttacagatacgacagaattgaatccttcaggctattcccggctcctttacacttag

SEQ ID NO: 1614 - DNA, 228 bp, A.fumigatus
  unsure (199): Identity of nucleotide sequences at the above locations are unknown.
tcccgccgtcttgtttccagatttccagagcacatgctaacattttttttttttaatcggctagacccaggggtccaatggcaaaagcgcgcacgctgggtgcaggatgggaaatttttgacgtcctcgggtgtgacggccggtatcgacgcgggctttgctttccttgctagcacgtatgtcgcaccggaggaccgcncaggggcctttcccaaaacccccccgggg

SEQ ID NO: 1615 - DNA, 267 bp, A.fumigatus
  unsure (16),(107),(164),(169): Identity of nucleotide sequences at the above locations are unknown.
cgccagcgtgtagtantcgctgcgggggacgatggcgcccaatgggccgaaaagatcgagggcttcgaactcgttgtacacaagagcaaggatgcggtgctgagtangcattttgattatgtccaatatattgtctattttgggggggggggggtctcctggcnagtanaattggaggaggaaggtatacaacgtggtgagagtccagaccggggcaaacagtggcacctatctcacgtcagatgccggtgtcttggggctccttag

SEQ ID NO: 1616 - DNA, 462 bp, A.fumigatus
acagggagtcgtctgctgatgctgctatcggggatcgctccaaaaaaggaaaaaaagcatggccaagcaattcagccgacagctgactgtgccttggcgtcagcgtcatcacagcctggtctgcttcacaacattgaattgcaagagacgccgtttatgcaggtcttgttcattcttctccttttgttgtcgatttatcgaagttgtttgtctagccgagatggaaaaccaattgcttcatccctaaacagacgccggcaatgctgggaatgccgtcgccgccgactagtctgcgacttctcactccccgggtgccgcaaatgctatactgctggggtcgagtgtcctggctacgacgagaagaagccgctcaagtgggttacaacgtgtgaggttgacatcccggcctcggaagaagactgttcagcagagtactgccaagcagtctgtgtccggagatag

SEQ ID NO: 1617 - DNA, 621 bp, A.fumigatus
cggatcgggatcttccagcccttggcgaagaccacatcctctggcctccccagttcccccgtcaacgtcctccccttcaacctctcaatcacctcctcaggcaacccatcgaacatctccgtccgcaccgcccccggcgcaacaacattcaccctcaccggcgcaagatcgaccgctaacccccgccccagcccattgatcgcattccccagcatagctcccacactgtaccccggtggcggccgcatcgccaccgccccgctcgtcaacgtcagcgaagaccgcgccgattgcaccatgtacgtcgggacgtgcttcgcaagcatcaggccgcccaggagccgcacggtggtgagggcgcggatgtacgcggggtcgagggctgggtcagtcggcgggcggatttggagggcgtcgccggcggtgaagacgatatggtctaggaggaccttttcgcttttgccgggtgtgtctgcgttgttgggcgagaggttagtcgggaagagatcgggttgtgttgctttgtctagcaaggtcaagatgttcgactccaaggtggactcatcccccaggtcgacggtggtgccggctattctggtcgtgaattgctcatcggggtag

SEQ ID NO: 1618 - DNA, 900 bp, A.fumigatus
tatcaaacagatctctccgattcactctcagtccaagatagcccgatttcctcctacatcaacagtcctagtacctacaagggaatctccaccatgacaacccaaactccacaccttgtctctatcaacaagctcaccggcacccgcgttctcgtcatcggcggtacctccggcctcgggttcgcggtcgcccgcgccgccctcgaacacggcgccagcgtcctcgtcgccagctcccggcccgaaaaagtccagtccgccgtctcccgcctccgcactctctaccccgatgagcaattcacgaccagaatagccggcaccaccgtcgacctgggggatgagtccaccttggagtcgaacatcttgaccttgctagacaaagcaacacaacccgatctcttcccgactaacctctcgcccaacaacgcagacacacccggcaaaagcgaaaaggtcctcctagaccatatcgtcttcaccgccggcgacgccctccaaatccgcccgccgactgacccagccctcgaccccgcgtacatccgcgccctcaccaccgtgcggctcctgggcggcctgatgcttgcgaagcacgtcccgacgtacatggtgcaatcggcgcggtcttcgctgacgttgacgagcggggcggtggcgatgcggccgccaccggggtacagtgtgggagctatgctggggaatgcgatcaatgggctggggcgggggttagcggtcgatcttgcgccggtgagggtgaatgttgttgcgccgggggcggtgcggacggagatgttcgatgggttgcctgaggaggtgattgagaggttgaaggggaggacgttgacgggggaactggggaggccagaggatgtggtcttcgccaagggctggaagatcccgatc

SEQ ID NO: 1619 - DNA, 195 bp, A.fumigatus
ggtgtggtcattgtgaacacggctcgtggcgctttaattgacgaaaaagctctggtggccgctttggattccgggaaggtaagctccatcctagcctacttccttgagttatgggtagtaacggaatgcgacaggtcatgtcggctggtttggatgtgtatgagaacgagccggagatcgaacctggacttgtaa

SEQ ID NO: 1620 - DNA, 228 bp, A.fumigatus
atcataccaacgccatcgtttccgctctgttatatgcgtcgtggaggaattaggaattggacatggttttcgctgatgttgggtctttgtttgcatcaggtccgttacgctgctcaggacattccggccgcaaagagcgcccgcgcccggggctcttacctgcgtgtcagcttcaagaacacccgtgagaccgctcaggccatcaacggcatgaagctgcagcgcgcc

SEQ ID NO: 1621 - DNA, 258 bp, A.fumigatus
gttatgggtagtaacggaatgcgacaggtcatgtcggctggtttggatgtgtatgagaacgagccggagatcgaacctggacttgtaaataacccccgcgtgatgctactaccgcacattggaaccgcgacctatgagacccagaaagaaatggagctgttggtcttgaacaacttgcgctcggcggtggagaagggcgagatgatcacattggtgccggagcagaaggatatcttcaaggggcagaacggaaagtaa

SEQ ID NO: 1622 - DNA, 963 bp, A.fumigatus
  unsure (940): Identity of nucleotide sequences at the above locations are unknown.
tcgaatcgcagaggtcacggtacctactcgaatccactctcgacttctatcattgccactgttgctggcactgtacagaaaacgaacaaacttctctccgttcagccgctgcgggctcgatatatcccagaaatcggtgatctggttgttggacgcattgtggaggttcagtcaagacgatggaaggtcgatattgccgctcctcttctagcacaactacccctctccgccatcaacctgcctggaggcatcctccgtcgacggacaagcgcggatgagctgcagattcgaaccttcttcagcgaaggggatctggtggttgcagaagttcagagcgtgcattctgacggctcagcctcattgcatacgcgatcgctgaaatacggcaagcttagaaatggcgtattcctcgctgttgcgggaaccggtggtagcggagcttcgagttcgacagtgaagggaggccctggagcgggaactgcctctgcagggttgctaggcacctcaggcacgggtggtgtggttcgcgcccggagacaacagtggacagtcaacacggcgaacggaggcggcgaggtgaacattatcctcggggtgaatggttacatctggatcgcgaagcacgccgacggcgcggccgccgcgtcctctacgacggagaatgtatccatcacccgtatggaggagatggtatcaagctctatctattccagccagaacgacgagattccaccgcagacacggcgcgagattgcacgcctggcgcaatgtattcgcgtgctggttcaaggcggagttcgtgtggatgaggaaactgtcatgagagcatacgatgccagcttacaggtcgatctcgaagtcggtgatgatgaggatgaggacgagcggagaagagaaggaagggagtatctcgagggcgccaaagcttcagggatcctanctttggcgacggtagcacgatga

SEQ ID NO: 1623 - DNA, 738 bp, A.fumigatus
tcctgtgcctctgctctggccaagaaccccgatcgcttcgacgtgaccctcttcgatattgccccgtgcaccggcggccaagcaacctccatctctcttgacgagtcccgctacggcgccgactggctcaacgatggcgtgcaaggtggctctccgatcttccggcacaccttccacttcttccgtcggtacggctacgagcctcgcccggtgaaactgcaagtcgcgttcggcaagggcgtggagaatttcttcacgaatgtatttccctccccgttggttgaccagctgtcgggcgagatcaagaagttgggacgcgtgctcaaatggatcaagcgtttgtttccgattctggggctcttgcccatcaaggtgataatgaagctgttccggtttagcgaggagtttaccaataagatggtcattccgatcatggcgctcttcttgggaacggggaaccagacaccgaacgtttcggccgcgctgctggagagactgttttgtgatcccaatatgcggctttgggagtacgacccagacacactcctcccaaaccaacccaccatgtacacattccccaagctaggcgacttctaccgcgactgggctggagacctcgcgtccagaggcgtcgacatccgtctcaacacggccgtcgagattctgcaacgcaacaaccacagcattacgctacgtcccgtcttcagccacggggctcgaagatccgcgcttgcgtta

SEQ ID NO: 1624 - DNA, 474 bp, A.fumigatus
gatttatcgagagtcaggatttcaacaccaacatcgccaaggcatatatcgatcatcattttgtcctccaggtacaattggctccttaaagccctttcttcccccctaagaactacctacagcgatactaatccttatcagttattggagttattcgattcggaagaccctcgcgaacgggactttctcaagaccacattgcatcggatctacggaaagtttctgaatctgcggtcttatatccgtcgatccatcaacaacgttttcttccaattcacgtacgagactgagcgcttcaacggaatagccgagttgttagaaattctggggtctatcatcaacggatttgccttgcctctgaaggaggagcataagctctttctgacccgagtgctgctccccttgcacaaagtcaagagtctcagcatgtgtcttcaccacggggctggaaggatccgaagcgtgcgtcataat

SEQ ID NO: 1625 - DNA, 402 bp, A.fumigatus
  unsure (115): Identity of nucleotide sequences at the above locations are unknown.
cgccaagagcttttcatgcagaagattgaccagtgcaatatcattttcgacttcaatgatcctacagccgacatgaagtccaaggagatcaagagactggcgctccacgagctcntagactacgtggcgaacaaccgttcagtaatcaccgaacccatgtaccctcgagtggtcgagatgttcgccaaaaacctctttcgacccatccctcccccggttaccccccaaggcgaggcctttgatccggaagaggatgagccggtcctggaagtggcctggccacatatccaggttgtatatgagttcttcttgagatttatcgagagtcaggatttcaacaccaacatcgccaaggcatatatcgatcatcattttgtcctccaggtacaattggctccttaa

SEQ ID NO: 1626 - DNA, 744 bp, A.fumigatus
tgtggacagattctcccattcctaaccccatttctaatgcggtgtaatctgtcagcgcctccctccaaggacaccaccaagaagaccgatgcgaacggccaagctggtgccaatacgaatatccctccccccaaaactgataaaccccgaccacatgtctgtaccacttgcgggcgatcgtttgctcggctagaacatctgaagcgccatgagcggtcgcacaccaaggagaaaccattcgagtgccctgactgctcccggtgctttgctcgccgggatcttcttttgagacatcagcagaaactgcacatgaccacgacaccatcgtcgcgaccccgaaatgctcggagagaaagtaccggagctgctggtactggagcaaatcgtgtccgtaaaaactccattgccagcaactcgaatagcattcgtccccgggccaataccatcagtcacattgatggagcttctctaggcatagcgaccaacgaccccaatcactcggtacccgccacaggccatccgggacatgctcatcataccagcatgagttcaatgtccatgggtgcgaatatcgattttcatcgcgggtacagctcaagccatccctattccagcagccttcccaagctggagactcatggtctgcccatggatctttccggtggacttcgtaccgctcctgtgtacggcaactttgatctgaccatgggggactttttcatgaacccatgggactacgattaa

SEQ ID NO: 1627 - DNA, 285 bp, A.fumigatus
  unsure (88),(106),(108),(116),(125),(126),(136): Identity of nucleotide sequences at the above locations are unknown.
ctcgccgtcatcccccctcccgtcatgcctcccctcaggtacaacccccccactgattcaatgttgggaagaaaaactccagctttcnacttggatgaaacggctncnatcccgtncatgcccgnncctaggtcanaagcaccgaactccgggattgatgaagtcgttcccccctccgccatgagtacttggcaggccaaattgggaatcacccaaggccccgaatggattggaaccaaccgggttttcaaactctgctttccggctgggattaacccttttccc

SEQ ID NO: 1628 - DNA, 960 bp, A.fumigatus
cgcgggtccttcggcccctgtggtgaagtatggatcccacgcggggagacaaagtcccttcaactgtatcaccatatcatttggctttcacgggagggtctattgatcttggaggagttcgtccttcccatggtcgagcccttcgtggagttaaaaatcctcgcatacaagctcagagcctcgttttatcatatcttcgttctcttccataacgagccaccagtccatgcgcccggtattatgagcctccgaagccagtcttcagcgacgaataatgctgctgaagcagagtcgactcccaaggaccagggatcaaggttctcatttacttctaaaccagaagtgatcccgcgtccccaggatgcggcctcgaatccagacgacgctgcaagacgaagggctacgcaggctcctcctggcctagccccggtacagcctcccaaacccgcttcatcattccttcttccctctatcgattataccccaactgcaacggcatgcttcaaccatgccgctctccttgctgaacggtttctgcccggatcgcatcccctacgcctgtcgataaagctcgaatatgctgcttacctttacgattgccttcacgacccaaatgcttgtcgacgattggcgaagcaagctatagcagatgtttacaatgctcaggaaggcatggacgacgagagctttgaggacgccgccgagatagttcggatcctgggaaagatggtaaagcgctcgggcaagaatagcagcacgggacctagcagcacgtcagctggaacaccaaaaggggatatctcgatgagcgagggcagcctgaccccaaaagtacgaaaatccgtgtcacaggcgacaacaatgacttcagtctcgcctgctccggtgaataagtccccggtcaaaagtgatgcgccttctactgcacttccaaatccaagtatgacgaatcctatttga

SEQ ID NO: 1629 - DNA, 327 bp, A.fumigatus
agcggtggcgcggtctttccggccctgtggcgattattcatcatctctgcgaagcccggatctgccaccgatgaccgggctgcagacatgacttctgcgaccacagggccttttacgtatgatgcgtatggggtgttacgccatattggatcgaccatggggagcggacattatatatcgctggtgcgggatgcgcagcgccaatgctggcgcaagtttgacgatgagcgggcgaccgactttaacccacgcgatctgcgcttcaaggaccggctgcagaacgaacaggcatatattgtattctacgagcgagtcccggcgaaatga

SEQ ID NO: 1630 - DNA, 195 bp, A.fumigatus
  unsure (190): Identity of nucleotide sequences at the above locations are unknown.
gctccccacgttgggcgttatatctcttactcaattccaactctctctacttggggtgcagccgcgtcgtgcaagaacctatgcagggcgctctccgactcctttaattttcccgacattctcatgaccgagctctccctaattgcgagccaggcactagaaatcgatcattgtcaccttcgaggagctntttag

SEQ ID NO: 1631 - DNA, 645 bp, A.fumigatus
  unsure (15): Identity of nucleotide sequences at the above locations are unknown.
aagttattcgtcgantgttcaaccgtccacccggacacctcccgccgaacccacgccgccctaacgccgcgcggcgcctccttcatcgcctgtcccgttttcggcgcgcctgtcttcgcagacgcaggtcagctggtcgtcgtgcccgccggcgatgcagccgccatcgaccgcatcaggccgttcttcgagggcgtcaccgcccgcgccacaatcgacatgagcggccacgacgtcggccgcgccagcaccctcaaaatcctgggtaacacgctcatcctcaacacggtcgagtcgattgcagaggggctcgtggcggcggagaagttcggactcggagctgatgtttaccagcagtgggtgcatgggttggttggaggcatgttcgcgaaatacgcggaccgaatgtgtacgggcgactactacaagcgtgaggagccgctcttcgcggtggacttggcgcgcaaggacctgcggcatgcggccagcttggctgaggcggctgggatgcggctgcgtagtgttgagatcacggatgcgtatctgcaggaggtcaaggctgagaagggggaaaagggggatatcgcgggtgtctatggagctattcggaaggagtcggggttgccgtttgagaatcagcagtga

SEQ ID NO: 1632 - DNA, 252 bp, A.fumigatus
tttcccgggggggagcgaattaccttccatcccgctgctgaagacactgctacgggtagtatcactccaactgcgacgaataatgccagcggctcgactggatccggcggtaatactggtaactcgcagcccgaaaataccaataatggcagcaacgctcaaccgaacaacaatgcagctgctggctctgcggtctcgaaagcggcgtccgtggcggccgttgtgggattgatcggtcttgcttggctatga

SEQ ID NO: 1633 - DNA, 618 bp, A.fumigatus
tattattttggacagctttctctctcatccatacctaatttaaataccattgtctgtggcctactcttcagctcgaacccccttgtacaacgcatcgtgcaaccatcgctcccgatgtccactctcaatatgttaccggagcaatccgcctttggccggtctgcaatgcctggttccgatgctgtcaatcctggcccatctccgtttgctcctcctcctaattccttctctggtgactttcttggactctcgctccctgacgaagagcatctctggggtatgagtcctctctcttcctccatgccctcgtggaatggaaagaacgaacagatgttctccaatcctaaccttgaacgcgacctcaagcactcccatgtccgcaatggccagcctactccacctccatacggtgacaacaagactcacacggtcggtgatctatactcgctgtctcagtgccaattctccaatggagcacaaaatttccagacccataacgatcgtagaagcttctgtgagcagtcggccataaatagcaacggcggcagctccaaacgtcgcaaggttcgcgacgccaagatgacccaggccgaatacaacgaacagcagcaggagaag

SEQ ID NO: 1634 - DNA, 372 bp, A.fumigatus
agacctccagcacctggtctactcgaggttcacttcaccagatcagaacacaagaatcacgataacaacgcgctcacatcaacaacaacaacaacaaaattttttttcagcaataccaactcgttaacatcttcattatacacattcaaaatgtctctcttccacaccttccacactcctggcgactttgcccctctcttccgccttctggacgactacgatttccaccggtcgaccagaaatcaggcttcctctgtgcgctcctttgcgccccgctttgatgttcgcgaaaccaacgatgcctaccttctggatggcgagcttcctaggcgtcttcagcccacgggcgtggaaggacagcgattgcggacc

SEQ ID NO: 1635 - DNA, 582 bp, A.fumigatus
agaggtactgatatatcggcaggtgaccgagtggctttggaatgtggtgtcccatgctctaaaccaacatgctctttctgccgcaccggtaaatatcatgcttgtccagatgttgtctttttctctacgcctccccatcacggtacgctgcggcggtatcatgcccatccagaggcatggttgcacaagattccggacaacatttctttcgaggaaggttcactgctcgagcctctctctgtcgctttggctggtatcaatcggtccggcctccgtctggcggatcctctagtcatctgcggtgctgggcccatcggtctcatcacgttgttagctgccagcgcggcaggggctgagcccattgtcatcacagatattgacgagaaccgcctttctaaggccaaagagctcgtgcctcgagtacatccagttcatgtgcagaagcaggagagccctcaacaccttggagcacgtattgtcagagagctcggccaagaggcaaaattggtcctcgagtgtacaggcgttgaaagtagtgtacacgctggcatatatgtaggtcgactcggtcctgagacttga

SEQ ID NO: 1636 - DNA, 300 bp, A.fumigatus
gcccatagcaaagcctgtctcattaaaattatagatatcctcctatgtaatcccatattgtatgatagtgatttatatatggttaaaccactccctaattattttagggtcttcgcatttcgctcatcaataatcatagcattgattgtagcgtgttttcagtttatcacgacgtctaatgaacttcaaagcctaatttatactaactatttgaataggccttgtactatacacagcaagaagaatatcagctatttcttatatataggacggtcggggaggtgctctatattaatctag

SEQ ID NO: 1637 - DNA, 186 bp, A.fumigatus
aaccaacagcgactccataatttgacgagcctgcgagtaggcttcagctttaacctactccgcctatttatcggaccggaaatgcttcgaattaactccttcagctgtcccgtttttattaaccgaacggccaattcctgggaaatcaaggttttaccttttccccctccccgctccccaaaaatt

SEQ ID NO: 1638 - DNA, 309 bp, A.fumigatus
gtgatacgacgtgaggcgcgatactacctgctcagtgcgatggcgaaccaattacgctatcctaatagccatacatacttcttcagctttgccattcttcgtctctttggcgtggacaactccgagcaggatggatccgatatccgtcagcagattatccgagtcttgttggagcggctgatcgtccatcgcccccacccctggggtttgatcatcaccctccaggagttgctccagaaccgaagctacactttcttccaccttcctttcatccaggctgcgcctgaggtatgtcactcttcggtttga

SEQ ID NO: 1639 - DNA, 603 bp, A.fumigatus
agtatattcggtttccaggtatctatttctcctcaactgtgtaaggagactccctttactgatcgcactttagatcgaacaacccccattggaaagttgataagtagctatttacaaggccagtcccaagcggatgaccattcgattcatctcctcttctcagcaaatcgctgggagattgcgaagagcattgaagatgatatagccaacggcatcagtgtcatagtagaccgttactcctactctggtgccgtttactcggctgcaaagggcaatcctaatctgtcgctggagtgggcatggcagccagagatcggactgccgcagccggatatgtgcctcttcctccgcatatcccctgaagaagcagcgaagcgtggcggattcggcgtcgagcgctatgagaatgaaactatgcaaaaccgcgtgcgtgagctattccaaacgctttttgacctccagcagggtgattatattcacacaattgatgccggaaggtccttcgatgcagtgtcgcaggatattatgaagatagtgacagactatatcgggagacttgatgccatgggacctttgaagaggctgggagcactctcaaactaa

SEQ ID NO: 1640 - DNA, 312 bp, A.fumigatus
ttaattttccattccatggccatttttacgtctcctaagtcgcttcagaatgtcaatgccttggttcctcggcagttcatgactcaaatgccatcggggctcatgaatgctgggatgcttcaggatggcggccatccgagccatccatcattcttccaccttgtccttctggttttcgaagctgtattggaggtagtttgtgtcagcttgccgggttacatagttgccaaacaaggcatgttcgatgcagaagctcagaagttggtcgccaacctcaacgtcatgctgtttaccccatgtctgagtatgtag

SEQ ID NO: 1641 - DNA, 294 bp, A.fumigatus
  unsure (190),(263): Identity of nucleotide sequences at the above locations are unknown.
tatggcgcagtcttcatcaaacttggttctcaactgacggcggagaaaatcactgatcttgccatcatccctttcatcttcatcgttcagaccttcgtctcatattcatgtgcttgggctatatcgcgatgtttccgcttcaaaaaacgacaggccaattttgtggcggcaatggctgtacgtattccanaaattcttcaccacattccctatctaatcttctctattaacaggtcttcggtaactcaaactctctacctatntcccttgtcatgtcgctctcgcagaccctaa

SEQ ID NO: 1642 - DNA, 348 bp, A.fumigatus
gaaactcaggtttatgctctggagctccgtacttctggcattcgagcttggtttttccctcgaggttcgattccgaacgacattttagataatatcccggatccaacaacctggggaactgccttggccgactttcccaataccaactgcgacattgcgtcccatttcagcaatcagagtatcattgccaatatcgatctctgtgggcagctgggcgcacagcctcagttctacacccacttatacaactgtcctggcacttgtagcagttttgttgcacgcaatcctgccaaccttaccgaggcttactgggagtttaagagtttcaaggtctatcaagctcaataa

SEQ ID NO: 1643 - DNA, 795 bp, A.fumigatus
tctgtggacatccactgtcgtagacgctaccggctgttgcccacgaaagttcccaaccccagccttcccccgccggacccgtcactatggattgtgcattattcaagggcgcctcctacggaacatattccagcgaaccggattccagtctccccgcaagtgcaaaacatgctggctcaacgtcgtttcctccaaaaccagggtcaactggcgcgcaaagattttatgcttcatgatcggaacaattggcccacaatcaactttcctccacagatagcgccgcaagcacttgcccaaccggctgggccataccccaatgccatggttggccgtcagccgttctatccccagcctgggcaacctgcgcctcctcccgccgctgcagctccggccaaggcaccccgtggacatcgcgcctcaaccgcggcgatgactgcagctgcagcagattttgcactcgaggatgaagacgtttccacgggcgacttgatggatttgctgactcctcgggaagtaagcaaaatgagatatcagcaacaccacgagtggatggaagagatcttcgcctcgccgtatgcaatcagtcagatcacgcctgtttctttggggctcggtcgcaaaggcgaattggagactttgaccgcaggttttttcgatgcaccggttgggcctgcaagtggtgattcgaaagaaagcactgattctgctcaagcgacgaaaatggagcctgaaagggcaaaggagtttgccgaccgggttgccaaaaaagttgggcgacatgactgcagaaattga

SEQ ID NO: 1644 - DNA, 498 bp, A.fumigatus
agcgcggtaccttccagcccgtggctgatgatcgatgagggcatggaggacattgctgccgatgatggaggtctcgatcctctcctggaggagatggaagctgctctgcgcggggacaatgaagcgcaaccacagggagcgccttcctcggatactggccttgcgaatctctatcaagctggaactccaatggcgactaaaccttctacgcctgcagcggatacatcgggcgatgaaagtgactcagatgctgacgaggaggcggatgtgcctgaaaacgaactggatgatgagcagcttgagcaacagcgacagttccaacaacatcgcgaagagattgccgagctcgaggcccttattcgcgccgagacggtcaagtgggagaacatgcagaaccaaatcttgaagcacaagctcgccaagcgtatccaggatttgaagcgggatctatccttgaagaaggtctctgttggtgagggcgatgacgctgatacttga

SEQ ID NO: 1645 - DNA, 585 bp, A.fumigatus
tacccgatcgcatgttatgtacaactagcaatgacatatcctcatgcctatctactaaaacacaatttccagctccaatttatccctgcctacttgtttcaggcaactggatctcctgtacctgcacgaacggctcctttcacatccagattctcctcttccttcagcttccgctgtctcagcgcttccctttcggcggcctctccgcgggggtcttcaggactctggtcaacacgatcacctagaattcgatcatgttcctccctctttcgctccatgtccgcagcaagatctctttcttctccaaatccagggtgtcctggcccttgtgcactgccaacgggacctgcatgcgccccagcctgtgctcgctcgcttttctgtcttacagctcgagcaatgtctccttctgcgggttgctcctccacgccatattccaagtcaacatcagaggcggcctgcagattcttctgctcctgttcccgcctctgctttagtcttgcgagttcttcgtcattggatggtttggagtctacggtacgtcgggtaatggaagagactggatcaccgcgctggcgctggtga

SEQ ID NO: 1646 - DNA, 288 bp, A.fumigatus
  unsure (62),(148): Identity of nucleotide sequences at the above locations are unknown.
tgggattgcccgcccttcatcttcaaattggttgttccttcaaggagtcctaaccggcgcgngatcttcatcaacaaaaccgcggagatccgccgcggcaccaggaagtggggcatccacgccaagcaggaggaattggaaatcgacntgccggaattactcgtcaccaatttctcccgcccgctgcgcctggtcgtgcacgaaccgctcatcgtcgccgtcacggtgtatctcggtttcatctacgggctgctgtactgtttcctgacggcgtacggcttcgtctag

SEQ ID NO: 1647 - DNA, 345 bp, A.fumigatus
cagggggtgtaccacatgaacgccggcgtcggcgggctgccgctcttcgggatggtcgtcggcctgttcatcggcggcgcctacatctgtctgtttgcgagcagggcgtacaaccagaagctgcaggcgaatgccggcgtgccggtgcccgaatggcgtctcccgccggtgattgttggcggggcgctcttcgcggcgggtatcttctggttcggatggacgggcttcacggccgacgtgccgtggattgcgtcgacgctcagtggcctcttcacgggcttcgggctgttgattgtgttcatccagctgtttaattatctgattgatacgtatctcatgttgtaa

SEQ ID NO: 1648 - DNA, 330 bp, A.fumigatus
cctttttttttttctaacgagttcagtgcggcctcggccatcgcggcaaatacgttctgtcggtctgtgttggcagcgagcttcccgctgttttcgcggcagatgttcaataatatgggcattcagtgggctgcgacgctgctggggtgtgttgcgacggctctggtgccgatcccggttatcttctatctgtatgggaagcggctgaggatgaggagtcggtttgcgccgattcttgagctggatgaggcggcgcatgtccccagggagatgactgaaaataagggggaagaggaggctaatacgcagacggaggagagtcagtcgtga

SEQ ID NO: 1649 - DNA, 204 bp, A.fumigatus
accgtcctgcgacatacttcagatgttgctgtcgtcgtgtgtctcagccttggtattgctatggccatccatttgttcatgagggcttggaaccaaaacagcattggcatctacaccccccagcacttcttctcctccaaacagggcatcctgggtaggctgaacctgttgtccagcctcaataacctgcctgagctcgcctag

SEQ ID NO: 1650 - DNA, 558 bp, A.fumigatus
cggtttgagttgtcaggtacccgagacagcctccgaggctcagctgaagagcgcctacaagaagggtgcactcaaataccatcccggtatgtgattgtcaatgatatctgcgatggacggatttggagtctaacagggcgttttatagacaagaatgcaaacaacccagaagcggccgaaaagttcaaggaaatgtcccgtgcctatgaaattctttcggatcctcagaagcgtcagatctacgatcaatatggtgaagaaggtcttgaaggcggtgctggtggtccaggaatgggtgccgaggatctcttcgctcagttcttcggtggcggtggtgcgtttggcggtatgttcggcggtggcatgcgggatcaaggccccaaaaaggcccgtactattcaccacgtacacaaagtcagcctcgaggatatctaccgtggcaaggtctcaaaattggcattgcagaagtcggtcatttgccccggatgcgacggccgtggtggtaaggaaggcgctgtcagtcttcaccgaccggggctggaaggaaacgcgtacggg

SEQ ID NO: 1651 - DNA, 210 bp, A.fumigatus
gttgaaccaaattgtttttggggggtatcgcggcgaatggcttctgccagggtgatcatctcgggccaatgtctggcgcatttcatcatgggcagtgcgttcattgcctatggtatcatgcttactatcttgttgctcgttggtcagtactggttgcgccgcaccggccgcagtcaagagttcttcgactccctggtcatcgcggcctga

SEQ ID NO: 1652 - DNA, 414 bp, A.fumigatus
ggatgcgtcaacacctttacggagcatcgttggggaggaccatgggtacacaatgatctgcagcataccactatgggcatcgtctggtggtgtgcaggtcttttgggtatttggatgagcaggaagagaaatggccgccccaagcggaatctcatccccgcaatcgtcattctgctgaccggctatgcgatgtcggctcatccccagacgttgatgatcagcaccatggttcacaccatttttggctacacattgatggctgcgggttttaccagaatcgttgagattgcctttgtgctgaaagacaaaaatactgtgagtctcgacggctcggaccctagtagcttccaatatctgcctccttttgtaagttcatcttgcatctgtcttcttgaaccaggcgatcgggcgtag

SEQ ID NO: 1653 - DNA, 336 bp, A.fumigatus
gctgctggttcttattctaacctcaacgtagtcgtcaatatccttctacatatttacgctgtccacgcatggcccaactccgccaagccatctgcccattctcgatcttcaagcaccacagacccggttcaggactctacctatattaacggccacgcccgctcggcgtccgagactcagcaggtccatgacgccgaggcgtttgagttgcagggtcttatctccgacgaagaagatgaggacgtgcccggtaaccgaaaccactccatgggtcccagaaaagcggaagacgaagaaagcacccctttggttggaaaggaggcgtcgtcggcctga

SEQ ID NO: 1654 - DNA, 246 bp, A.fumigatus
gttttgaatccaccaaaagacccttatttcatattttccaaactagagaataacctatcccgctctgatgactatgacgtgattgagattcttggttcttgttgggaatggcgttgctggatttggtgccttgcttttcgttacttcctgactctatccgcggtttgttatgccttgtatatataccagaaggatggaatgactttacaagaattcttcaccacggggctggaaggacacgcgcta

SEQ ID NO: 1655 - DNA, 231 bp, A.fumigatus
accaggcgatcgggcgtagtttgggctgacaagtcattttcacagctcctgtacgcctctggcttcctgttcatgggtgcaacagaggagcaaatgcagctgctccacgatgctggaatcacccatgtgtcctatgttctgatcttgtacagcattgccttcattcttttcctctgtaagtggattgtctttctcctttgtccccttttaggctgctggttcttattctaa

SEQ ID NO: 1656 - DNA, 405 bp, A.fumigatus
tccttcggcccctctggtgaagattcacaatcctcccttttccaggtctacctgcgacttcggcctcccgtttcgcagcaccaggatccttacgctgaacgttgtcttgtgattgagtctccagaggagaagaccaacaatgctgagagcgatggggcgccatcggctcctattccaacacatattatactacagccaccaaatgatgccaggaagcgtgccgtcgagaaattcggcttcaccaaggttttcgacgagtcggcttcccaactgactgtctttgaggatactgggctggaatctttaatcagaggcgtacttcttgaaggtagagatgggttggttgccacactgggtgtgacagggagtggaaaggtgcgaacaataaggactgtatgggactga

SEQ ID NO: 1657 - DNA, 675 bp, A.fumigatus
caccaaaccagctacccatgggccaaggccaaaccgtcgaaaaagaagagcgctaggcaagccctcatcgacgaagctctgacccaaggagtccagcactgcgtgtacacctcggtcgaccgcggcggggacgcatccaccgacaacgcgaccacatcccgcactttcatcagcaagcaccgcatcgagcatcatctcttcgagcagacgcatggtacccagatgtcctggacggtgctgcggccggtcttcttcttcgacaacatcacccgggactttatcgggcggctcgtcgtgaccgcgtgggacgcgtacctgcaggggaagccgctgcagtgtatcgccgtcagcgacattggctatttcgcggcgcaggcgtttctgaacccggcggagtatcggaaccggtgcctgtcgttggcgggggatgtgctcacgtatgagcatatgcaggagacgatgaagcgcaagacggggcgggaggcgccgacgacgtttcgcctggtttgctatgctgtgctctggatcgtgaaggacctgcgtacaatgtttgagtggttgtatgcgcatggctaccgggctgatattccgaggttgagggagatgcatcccggcttgaaggatttcgagaggtggttggaggaggacagtcagtttgttaaccgtcgttcttag

SEQ ID NO: 1658 - DNA, 435 bp, A.fumigatus
tatctgcccgtggcgaagtctttaaacgttagaaaaatgaggtctatccttgttaccggcgcgacaggcaaacagggcggcgccgtggtcaacgccctcctcgccgaagacgccgacatcgagatcctggccgtcacgcgcaacccgcagtccagcgccgccagaaacctagccgacaaatcccccaagatcaaagtcgtgcagggcaacctggacgacccggcgggaatcttcaagaatgcccaccaagtatcatccgagcccgtctggggcgtgttcagcgtggcaggtacggactacggagtcctcaccggttcccacccccccaagcccctcagagcaggatcgactgacaccaaaccagctacccatgggccaaggccaaaccgtcgaaaaagaagagcgctaggcaagccctcatcgacgaagctctga

SEQ ID NO: 1659 - DNA, 366 bp, A.fumigatus
agactcaccatctccataatctctggcatcgtcacgttgatagcgtacacaaccagcccacgcgagctcacaccccaatcccaggactccctcttccgctgcggcacctccgccgccgaagccaaggccgcaggatgccatttcgacctgatgtccttctcctggctgccgtccgcctgctacaatgaagacctgacaaacgaattcctcaactacacggactggaaatggtcgctcgacagcgaggggcgccacctcgtcccaaaggagtatgtccagcagggagactttgagtacctcttcacgagctacgagtatcatgttgtacactgcgtgtttatgtggaagaagacgcagtgtattctt

SEQ ID NO: 1660 - DNA, 207 bp, A.fumigatus
ggatctgatacagtgggtgatcacctgacgcccggtcccacctgccgcccaatttccctcacagactttcaaaatgaccaaacttcaactgctcataactccactaatataactctaattaaagcagctttagaagtaattaaattattggaactaggtaaattaattaattatactttctttataaacaagtatggtgttagctag

SEQ ID NO: 1661 - DNA, 456 bp, A.fumigatus
gatttgtcgagttggatactggaatcgaggaagcaacgaatgtatgcttgctttgcattaaggcttgatctatggttctctaatggtttgtatttacagactctgatcgactccgatgccccggtgttgttgattcgagagaccccggaacacaaaacggccgtgggcactttcgattactcggatttgaatgcataccttcttcttgcggccggactgacgcagcctaatgaagaacttcgtgaatcgtatgaagagctggcgagaaaggccagggacgggcacaaaattccattgaaagacgtgaaagagctgggccggagtgagccgctgaccacgcttcctgcatcagccaacttgatgacggctgtcgagacgttcggcggcggtgttcaccgtgtggtcgtggtggatgaacacaagaacggcgaagtggtgggaatcgtcagtcaattc

SEQ ID NO: 1662 - DNA, 246 bp, A.fumigatus
cataaaaaacacgtttcctactcgctggacagcagtactttgcaaaggaaggccgttctcggcttcttcacggaacctaaggctcctggcgaggtcgtcggctgcatatgtcggcaccacaagcgacctttggccagcagcaagcgcgaggattgccgcgagaagtggtcgaactcgcctaccaaggatcaagaactcgaggccgaaagcacggcctggatcgccaacatcaatccaaggggctag

SEQ ID NO: 1663 - DNA, 207 bp, A.fumigatus
gtggcggatgcagagacggggatttcacttgaagctgcgcacatccttcctctatatgagctgttgactacgaagtactttctgcagaagatgacatattttctactttatcttttgtcctcttcttacgaagagattgcttgctctttggaagggaataaagatctacaaatagagggctgcgggtaccctaggacaggttgttga

SEQ ID NO: 1664 - DNA, 384 bp, A.fumigatus
  unsure (173): Identity of nucleotide sequences at the above locations are unknown.
agggtgtgtactgatcactgcagtatgctccctgccattgcttacaccctagatatgtaccgccgcacaggcgaattctacggcatcaacgaggcgctcttctcgtctgcgttggcagcgatgatcttcagtgtgcttggtgcgcagccgttgactatcgtgggtattacggngttgatctcgctgtttaactatactatctacgatatcgtgacgatctatgagccggccatctacccgaatttcatgtgctggacggccatctgggcggccatcttccattggatcgtggctgtctgtaacctgtgtgactatatgcgctatgtcacggactttttcgtcccagtcgtttggtgcctatgttgggattatctactggagtga

SEQ ID NO: 1665 - DNA, 309 bp, A.fumigatus
gaacaggacaagcgcggggcggctcccgaggccctccgtgccgggtcggatctgctggccgatctgcacgccacttcttgtggtctaaaggcactggccagtaccaccgccggagaggggctggagatctgtcgtcgcgcctgtggtggtcacggatacagcagctacagcgggatcggaccctattattccgactatcttcctaccctgacctgggagggcgacaactacatgctcacccagcaggttgcccgctatgtaagttcttgtgacctgcgtggactgtcatcgatgctaatgctggattag

SEQ ID NO: 1666 - DNA, 519 bp, A.fumigatus
ctcctcaaatccgctcgtgcagtgcttgccggcaagggaaccggcaacgacaccagccagatcctccaggcataccttgcgcgtcgcgacaagggtgcctcgttcgacattctcgaggtggacagcgatattgtggccgcgttcgcctggcgcacagcccacctcaccttcgaggctctcaaacaccgagatctcgagaagcggtcatggaacagcctgctggtcgacttttggcgtctgtccacggctcactcgcagtacctggtggtcaagaacttttacgaggcggtgtcgtcgccggatctggccgccaagctcggcccggagacgaccaagatcatgcacgacctgttccgcctgtacgctctacacacgctggagcgcgaggcggccgagttcttctcgtcgggcgccgtcaccgtccggcagattactctcacccggaccaacgcggtgatgaagctgctggacgagatccgacctcacgccgtccgcctggtggatgcctggaagatcccg

SEQ ID NO: 1667 - DNA, 750 bp, A.fumigatus
tacctaagcgcgtatcctgccagcccggtgggtgaagacgccgccaatttgcaggccacgatcaactcccgcgatggcttgggccaaactgcccagattctcctgctcggtccttcccgcttagacaatcagtttgcccgggacgcctacccggccacagcgacctcggccccggacgtggaaggactctcgcacgccgaggtccactacgtgttcgagcctactccacttcccggtcagagcagcaggcacggcggcaacttgagcatgagtagctttgccctgtctagatatccgctggcatggaagctcatgtcaaaaccgtgggcggagtccaacgactcgatcagcgatctatcaaccagaaacgaacacggatatcaggttgcggtcggcgcgattcggcccaagacgtcgatggcacagtggatcctgttggtcgaacagacgcaggcggaggccttcgccccgatcaacaagctcaggaaaatcattctggcatgcgtctttgggactatagggttcattatcctgatcgttcctccgctcacccatctggccgtggccccgattctccgcttgagcgaggccacgcgcaagtcgatcgagcccccgtcccagcctccgcatgattgccctccctccagcggaccgtacattgtaggaaccgccgaggcggagacggagccccgtgcttttggcgaccacatggatgagaagggtctagtagcgtgggtgaaacatttctga

SEQ ID NO: 1668 - DNA, 357 bp, A.fumigatus
cagagccgacacccgacatgcttcttgcccggcgtatgcgtcgtcacaggtggtctcaatcagcgtagatcccgctgtctttatcacttgttgactgtggtgcctcagattctgattcaccgtatcggcggaggcgatacgactgatgtactgggaaccgatgttgtaaaacgtctcacgcaactgaacatttccacttgccaggaagatacctctaatgcagatctggaacagctggtgcagtttttcgtctatgatatccccacttcgccgtgcactgtctgtactcgtggacgtaaattcgagacccccgataagagtctcggcgagtcgtgcaagctcgattgcctccggtag

SEQ ID NO: 1669 - DNA, 672 bp, A.fumigatus
attgcgtttaaccgttacctggctcttcgatcatggacagagctcatcacaccgatgctggcttgttctgagattgagggtggccgaaaaccaacgtttatcttgcattcaatccagttggttctccctaaactcgaagcagccatcgaggaggacctaccggaggcaatcgagcttgcacgactcgccgagactcttatcgggggtctcgaatttacgtccacgagtacagacagtgcacggcgaagtggggatatcatagacgaaaaactgcaccagctgttccagatctgcattagaggtatcttcctggcaagtggaaatgttcagttgcgtgagacgttttacaacatcggttcccagtacatcagtcgtatcgcctccgccgatacggtgaatcagaatctgaggcaccacagtcaacaagtgataaagacagcgggatctacgctgattgagaccacctgtgacgacgcatacgccgggcaagaagcatgtcgggtgtcggctctgctatttctcaatctgctggccactctggatcgagaaacagactcaactctggcagagttgatctcacaatcgaattatctcagtcttttcttggacgccatcagagcgctacctcacgaactgaagaacactcaagcaaatggtaagttgtggaggtag

SEQ ID NO: 1670 - DNA, 1296 bp, A.fumigatus
  unsure (736): Identity of nucleotide sequences at the above locations are unknown.
agcccttccttgggctttcaagaccacagcgacgatacctctaatatgatcaccaacggagagctgccatccgtgcccccgctgcatctgggagagagccgcactcctccttctggtgaccagcaccatcagcagcaccatgaaagtcggaagcactctagcagaaaacgccggaagtcggtccaccctgacattgttgcccgtgctatggtggataccacaatcgcaatcatcccagccagcgctttccggcgactgaccagggtctacccaagggcaaccgcccacatcgtccaggtcatcctcacccgccttcagagagttacgtttgcaacggcacattcctatcttggtctcagcaacgaggtgcttggaattgaaaagcaaatgaccaagtttaccacgtatgatctgccaaataacatgcgcggcgcagctctggatcgcctcaaagacaagttcatcaaggagcgggatcgcctaggctctgaggaagtcacgaagggaattgccctgcacaatccatctgcgggtagacgacgccggtcgagcagcttcctgagaaaggatgctgcgctgcaagccaagctgatgacacccagacgtgcggccaccgtggttaccccggagagtgcacccgctgagcacgacacatatggagttagtccaggcgacctattatcgaccattcaatcctccagattcggccccaggtatgagcagcctcctgcaaaantacagactcctttggctgaaaaggagaacacccatttccgacttcctgccatgcaagcgcgtcatactttccgccgacaagacaccatggacgaggacggactgttccgcgagtgcatcttggactgcatcatgaagggaatcggcctcacgagtagtactcgtgacgctttgcgcaaaagcaaccattctggcgaggcttctccgaagctcctttcctatgattctcgacgtcagaaggcgatcttcaccaacaacgcctttggctttattgacccatacgaaggctctggggacggggagacggagtcgctgatgtccatgtctgtaacgagtgcaggaggcacatcgccagtgatcaacttgcgggaagagctccgtaacgacatcgagatcgtctatttccccaagggttcggttttggtcgagcagggagagcgccacccagggttgtactacgtgattgatggattcttggacgtcggcgtgccgattgtcgacaaaggggaggacctcgtggggtctcgtcttcaccacggggctggcaggatacgcgcttag

SEQ ID NO: 1671 - DNA, 213 bp, A.fumigatus
tcccgctgtcattcttttttgtttgccaacatggtgtccagcaagctttctttcgtcgccacggctgttgcagccttggctcccctggcgtctgctttcgatgcctcctcaagatccaaccttgccatctactgggtacgtttcgaccgtagcaatcgccttcgcttccagtttctgcatgctgatcattgtcttgcagggtcaaggtcctaa

SEQ ID NO: 1672 - DNA, 747 bp, A.fumigatus
  unsure (699): Identity of nucleotide sequences at the above locations are unknown.
cgatatctctccttctctttggtctggccttcccacttcgcaagtcttcgtccgttgagagaccgtccgacttgcctgcagacatttgtctgcgtcctttctttgaccctcaccgtctacactcctttcttgtgcggtagttggctgggatttaatcccgctgtcattcttttttgtttgccaacatggtgtccagcaagctttctttcgtcgccacggctgttgcagccttggctcccctggcgtctgctttcgatgcctcctcaagatccaaccttgccatctactgggtacgtttcgaccgtagcaatcgccttcgcttccagtttctgcatgctgatcattgtcttgcagggtcaaggtcctaaccagctccgtctgagccacttctgtcaagagacctccttggacatcattaatattggtttcatcaactatttccccgatatgagcccgggacactggccgggctccaattttggcaaccagtgcgacggttctgtctacgttactaatgatggcgttgtaaccaagttgctgtccggctgccatcaaatcatggaggatattcccatctgccaggcggctggtaagaaggtcctgctctccatcggtggtgcctatcccccggaccagagtatcctctccgaggacagtgctgtcgcgttcgccactttcttgtggggagcttttgccccntcgcttgaggctgggaaggtcctcgtccctttgggatgtcgtcgttga

SEQ ID NO: 1673 - DNA, 321 bp, A.fumigatus
tgctctgttattcacctcatgcttgctggcctcaacctccttccctctacctccgagtctcatatcgttaaatacaacttgcacttctacgcatctctcttccactctaccaaccatctctcttctctcatactccctcaaacctgccaatcgtatctttctatccttactcagtgtcttccaatcatcgtcttgcactcattaagcttcaaaaactgtctatcttgcaatttcaagcgagctttcttcagtgttattgtgactcaagtaaatttcgtcgcgaagatgtcgccctccagttttcctggtgcccctgcgtga

SEQ ID NO: 1674 - DNA, 501 bp, A.fumigatus
agcggaagccacaccatcgccgaccccttcgttgctgtcaatatgacttccttcttgccagtaaataatacgtcttcgccgcaaactcggcccatggaggaggtagcaaccgcagccacacctcgacctcatacgaatgtgtcagccacagaagagaacaggtcgcgaactatgaacagtggcacagaagacgcaactccactcaacctgcataaggtccaagaggactcggcttctcgaacaaaaccgtcattaggtcacaatggaacttcacatggggaatccgatgcagaccgtgatggctccgatcatgactccgacgccgcaggcaatgcccctccatcaaagaagaagaaagggcaacggttctattgtacagatttccctccgtgcaatttgagctttaccagaagcgaacatcttgccaggcatatccggaagcacactggggcgcgtccgtttcaatgtcattggtcccagcgaatttcgcggtctggataa

SEQ ID NO: 1675 - DNA, 1014 bp, A.fumigatus
cccgcactcgttgcgtccgctcaggcgtaccgtatcttcgagtacacaggtacccgctgtacaggcgcggaagtgggcatcttccgcgttgctgggccaagtgcctgtaccaaattgaatgagggagtcgcttcctctgtcctagtcaagatcgataacatccacgacgaccagtactcggtcaatgtctatgagaatgaggattgtaccggtggtatcgttggcaaaattaccaatatcaacggttgcctcgatctgtacgctttccataaaaccgtcggcaaagccgtgcaggttgtccctgtctccaaaaagcgcgatagatccgtttccgccaccaagggtttagtgacagacttccaatacaaccttccggaggagactgagcagaagatgaaggttcccatcatgcatggcggcttccggacgatcagcaagtccgaccatgccgaggacgggacatacctgaatgaggcctttggtcttttccttcctcttccagaggagaacctggctgctgttcatgagctttggtccactcctcttgaaatggccccctacgactctgcgaacgaaacatcgctccatgatttgagcgagaggcagtttgaatgggcctattgtgagtggcacgctatttgcctaggggcagccgacttaggcggtagactcagcaactctcaggtagcccaagcactagccaactttgccggtagcacgccattcaggcaattttggaaaacagttgatgttatcgtggggcacaccgccaatggaatcacgatcatttcggcattgacgacctacggaacgcaaaatacaaagtgtgatactgacaagacgacaggcgggctgctcaaggatttggtgaacggagtgtcgaccgaaggtctcaccaacgcggtttttgtggtggaagatgatgagggaaggcaatttgaagtgggcatccagttgcgtccgatgggaggacgcaaccctaacagctgcggcgaatgtgctctctgccagtga

SEQ ID NO: 1676 - DNA, 1095 bp, A.fumigatus
agacgtctgctcgcatgccctcggaggttggataaaattccatctcatctgaagtatcccaccgaaaggcaggattcccactacaatttgcagtcactattcctgattcctcagcacgcaaggatgccgccagcaccaccggaccagaagccctgccaccagctgcagcccgccccgtaccgggccctcagtgaaagcattctctttggaagtgttgacgaggaacgctggtggcatagcacagcgcccatcctctcaaggcttctcatatcctccaactacgacgttgacgtacaatacaagtacctgtcgctgtatcgacacctggtcctccccgccttgggaccctatccccagcgggacccggaaacggggatcattgcgacgcaatggcgcagtggaatggttcttaccgggttgcccatcgagttcagcaacaacgtcgctcgggcgttgattcgaattggggttgatcccgtcacggctgactctggcaccgcacaagacccattcaacaccacgcgtccgaaggtctatctagagaccgccgcccggctcctgccgggggttgacttgacacgcttctccgagtttgagaccgagctggtgatcaccaaggcagaggaagccgtcctccaagccaacccggacctgttcaggagcccctggaaatcgcagatcctcaccgccatggacctgcagaaatccgggaccgtcctggtcaaggcgtatttctacccgcagcccaaatctgcagtgactggccgctcgacggaggatcttctggtcaatgccatccgcaaggtagatcgcgaggggcgcttcgagacgcagctggccaatctgcaacggtacatcgagcggcgtcgccggggcctccatgtcccaggggtcacggcggacaagccaccggccaccgcagcagacaaggcgttcgacgcgtgttcgttcttccctcatttcctgtccaccgacctcgtcgaacccggcaaatcgcgggtgaagttctacgccagcgagcggcatgtgaatctgcagatggtggaggatatgtcttcaccacggggctggaagagagccgctccaagtctgacc

SEQ ID NO: 1677 - DNA, 201 bp, A.fumigatus
accctgtactttacgtacgtggttcgttggcgcgctcttctgacggacaaccgcaaccctggattctccggctctactactacctggtacttctttgacaagatcttcgccttgatgagtgcgtcgacgttctcagatgcctctctttcccgcgaatcccagaggtttgtccgaccttccttcgcaccggaatggtcttct

SEQ ID NO: 1678 - DNA, 612 bp, A.fumigatus
cttttgggacctgatgggccccgtgtccctctcaccagagtgtacagtgatcttcttgccagggaagttgtcgaatacggcaaccgtggtttgcgcgtcattgctctggctagtgtcgacgatattgcggataacccccttttgcacaatgctcaaaccaccgaggagtacgctcagctggaaaggaacatgactctgattggccttgttggaatgctagaccctccccgcaccgaggttgctgactccgtgaagaaatgccgtgccgctggtattcgcgtgattgttatcaccggtgacaaccgcaacactgctgaatctatttgccgtcaaattggtgtctttggtgaggatgaggaccttacgggcaaaagcttcactggccgggaattcgacgccctctcggaaagtgaaaagctcgaggccgtcaagaaggcgtctctattctcacgtactgagccgagccacaagtccaagctggtcgatcttcttcaatctctgggccatgtggttgcaatgactggcgacggtgtcaacgatgctcctgctttgaagaaggccgacattggtgttgccatgggtactggaacggaatttgggggttttttttcg

SEQ ID NO: 1679 - DNA, 411 bp, A.fumigatus
tcctcgcccaaagaggccccagacgaccatctaatctgggaaaccgatacctcacgatctaacatgcacagcttttatcccgatacccaggaagattgttacttactactgaatgttttcctggccaatatcgatccaattgtgcgaatagtgcattgtcccagtttagctcgtcgctttgatggactcattcgcacccgttattccctagacaagactcaagttgacggcagttacagtaactgtatggcattcaacccccatcattccagtgcatttgagccgctggccatgtccagtttctatgcagccaccaatagcatgaagacaatagatgtttctacagtcttctacacagacaaatcccatctctggctgatgtacagtagtgatatctcgatacaagtttga

SEQ ID NO: 1680 - DNA, 651 bp, A.fumigatus
tctaacttaaaccagttctcgctcgtccaatgggctgtctcctggcatccagctggcaaaggctcctaccagagatcctggctgaacatcccgggcaaactggggtggtttctcatggagatcgtgggaccagcaaaactgctctacattctttacaaattgccgccagcgctcaacattacctcgctcccactatctaataagctcgttgcgtccctatacgtaatccactatgtcaaccgtgccatcatctcgccgttcttcgcggcccccagcatgtcccccatgcatgcgtccgtcgtctccatggcggtgctgttcaactggctcaactcgacctgtctggctggttggctggtgggataccacgtcccggtgctggggtacaagaccgacggcgccgtctcgggcgttccgggagggccgtcgtcctactccgccgcaacgcacttcctgccttgcctggggatggtcctcttcgcagccggtatgataggcaacatccactcggagcgcaccctcttccatctgcgccgcgaagcagcagagaagcgcgacgcggccgataagtccgacgaggatatcacccagcatgggagacgaggaccatccgacctttatccaggcatcgtcctcgtcctcgtctactga

SEQ ID NO: 1681 - DNA, 561 bp, A.fumigatus
gcaacatccactcggagcgcaccctcttccatctgcgccgcgaagcagcagagaagcgcgacgcggccgataagtccgacgaggatatcacccagcatgggagacgaggaccatccgacctttatccaggcatcgtcctcgtcctcgtctactgacgcggatgccaacgccaatgccaagggcaggaagaataagtatgacaaggtctacgtcatcccacccgcccgcggtgtcttccgttccatcctctacccgcattacgccttcgaatggctcgagtggctcggcttctctctcgtcggcacggccgtcttccccgccgctcaggcactcgcctatgcctcgccgcccttgcccatcgttccgtggctgaagcccgctgccgcgctcgcggagacactacaggttcccctgcctcttccggcggtcgtgtttgttgttaatgcggtggctaatatgctgcctcatgcgcgctgggggaggaagtggtatgtagagaagtctggggagaaggcggtcgcgggtcgaggggctgctgttccatggtgtccgtggctgtga

SEQ ID NO: 1682 - DNA, 1776 bp, A.fumigatus
  unsure (35),(1620),(1647),(1648),(1675),(1731),(1738): Identity of nucleotide sequences at the above locations are unknown.
ctcgagatgagcgacagaagaaggagaacaggttntccactcggcaccgctgtgcgtccttctcttctggcgtgcaccgagtgccgcaaacaccacgtcaaatgcgacgccaaaaagccggcgtgttcccggtgcttggatgcccgtctgccctgcaactatctcccgtcgcgaaggggcggtagacgcaaaccccgtagcagcctgcttccgcctctgcagggagtaacccccgacttcccaggcatggcgtatcagactccgctgtccgaaacagcgggcgggaatccaaccaccggcccatccagttcccccgtgacgggcaaagaggcctcatcggtcgcctcaaggaactcgccgcagaatgcaccgcttgtggtaccagattcgcggttcgtacgtctttactatgagcatttccacaatgcgcatccgattctggttcccgcctcctcgtacgaggagcggaattatcccagtttcctccagcatgtggtgcggttcatcggaagccattactcgctgcaggtctctggcgactcgttcaaggacgcgacgatgctgcaactgagccactcaggcgagcggacgccctgcatggtgcaggctttgctgttgtactcgatcttcctgtgtgcgcgaagtgagtgcagcgaggcggagaaaacgttctcccaagcaaccgatatcgccctggaactgggaatgttccgtcgagattttgcaacgacgttctccaacgggaatgagaccgaagcggagagtttacggcggacctggtgggagctgttcattgtcgacgtgttcatggcagcacgaccaccaaaggtcgtccttcgctgcgggaatgtcccctacgacgtccctctcccgtgcgaggagtatgtttacgccaatcgaaaggagatcccacccccagcgacctttacggcctttaagatgcgcgtatttctagaggaagacggagacgctcgtttctcgcgatattcatcgttcagttatcgcatcgaagcagccctcatcctggctcgcgtgcttgtgttgaacagtctgccggagacgcaccgcgatcatctgcaggccgtggagaatgcgctcatcagctggacaaaccacctgccaacgcacaaggtcgacattgtcgatatgtacggcaacgtcgacgagatgcttttccaggcccacacgaccattcagtacgccgccatgctgctccaccttccacgcagcaatttgcgccccgagttccccgatctccacgttcccatctgcccgaccactcctctgcgtctatcaccatcatgcacccgacacgtccatgatgtgaaagcaacagaagcctcgaagcaactctctaatctcctctccatgcgcccgagcgcacagggatacagcccgctgatcgtgtccccgctcgtcctctgcggcatggtccagctggcaaccagccgcatccactcgccagagtgtctagaccatcactgcaaccgcgtggtgctcgtgctgggctgcttaaaaatcctcagctcgagctggcctcttgcgcgccaggcccagcagcatcttcgacgtgcagcgggcgactcgtttacctcctggattgaatcgcagcatctccanggaacggccggtctggctcctgcatcnnagaatgatgcttacagggaatcctcanccgatcagaacacctggttcagtacaggccgtcatggggagaaacgggaagtccantctcttnttctcgccaggcatgctcctcggggtaattcgaatccc

SEQ ID NO: 1683 - DNA, 516 bp, A.fumigatus
ggattcaatccccacccaggaagagcacgaatcttcgaggacgaaaccaacaccaacgtggagaaggttggaaacacacggtcgccttccgcccatggaggaagatcaacctcgcggagtcgaaggacgccatgtctccgcatgaagcaacgacgctcagatcttcgctccgcattctccagtgccggtgagaaccatctcgatgagcacaagaagcaaccgaacggcgagaatgagcctcaacaggagccttacctggactatccgatcgtagatctgagggagctggatgacatgaccggcgctaccactccaacgtccacccccagccgcggctatttgcacgagcgtatcccgcctgtgcctccgcttccaaagaacctagctgccaccgctgcaaaggtagatagacggctagccagggagctctggaagatgaaaaacgcacagatgcaggactcgggccagacgccacctaaggaagaggattttcgatggcccgaggatattttctga

SEQ ID NO: 1684 - DNA, 540 bp, A.fumigatus
actgatacgccaagtgcggatcctcccagccccgtggtgaagaccatcggtgtagtattcgtacatgacgccgttggtccagtggcggaagccgtagacgtcgtgtttggggttgccgccgaccatggtgatgaaggtgaggaagatgaggcccaggaggaggaggattttggtcgaggccatgatgaattcggcttcgccgtagtacttgacggcgacgaggttcagcgcgaggcagatgaccatggccatggcgacccaggccgctgggttgacgtcgatctgccagtagtccatgatgaaggcgacggcggagtattcggtgcagacgagcatcagcccggcgtagaaatagacccatcccctagacagatattcatggtcagtgcgtgtcccccaggaaccgaagagaaaaaaaaaaaaaaaaaaaaaaaaaaaaaaaaaagggaacggcagaaggcgctttacatggcgaatccaaacgccgggtcgacgtatcgcgccgccagctcaaagatcgacccgcggatgggcaggtag

SEQ ID NO: 1685 - DNA, 510 bp, A.fumigatus
gctggcggcgcgatacgtcgacccggcgtttggattcgccatgtaaagcgccttctgccgttcccttttttttttttttttttttttttttttttttttctcttcggttcctgggggacacgcactgaccatgaatatctgtctaggggatgggtctatttctacgccgggctgatgctcgtctgcaccgaatactccgccgtcgccttcatcatggactactggcagatcgacgtcaacccagcggcctgggtcgccatggccatggtcatctgcctcgcgctgaacctcgtcgccgtcaagtactacggcgaagccgaattcatcatggcctcgaccaaaatcctcctcctcctgggcctcatcttcctcaccttcatcaccatggtcggcggcaaccccaaacacgacgtctacggcttccgccactggaccaacggcgtcatgtacgaatactacaccgatggtcttcaccacggggctgggaggatccgcacttggcgtatcagt

SEQ ID NO: 1686 - DNA, 363 bp, A.fumigatus
tctattgtccacaggtatatgctggcggccatggagaaaaaggcggtcctcgacgatcgccaggatacagacgccggcagcatcgttccctttccccagacccagcgtggtctgacgtcgcgccatgtccagttgatggccattggtggctcgattggaacgggcttgtttgtgggcatcggcgcctacctgcgcgacgcaggcccactctcgctgttgctgggctatctggtctggggcatcgcgttcattctccccatcaacctcagcgtcggcgaaatgtgcgcctacctgcccatccgcgggtcgatctttgagctggcggcgcgatacgtcgacccggcgtttggattcgccatgtaa

SEQ ID NO: 1687 - DNA, 285 bp, A.fumigatus
tgtattgtactcgcccaacatgacaagaacgatcgcattgaaagtctctcaacctgtcaaatcatcatgcctacccttccaactcgtcccctgggcaaaaacggccctcaagtcccccggctcggcttcggcttaatgggcctgagtaccttctacggcaccgccaaacccgactctgagcgactcgcattgctcgatgctgcatacgagctcggcgaaaccttctgggacagcggtatgtatttccccctcactgaccatgaagaccactcacggtcaatctag

SEQ ID NO: 1688 - DNA, 303 bp, A.fumigatus
ccgacatgtacggcgacagcgaggacctcctcggcaaatggttccaagccaacccctccaaacgagaccacatcttcctcgccaccaaatttgcgaaccgcgtgggcccagacggacaacgcttcgtcgagtcttcaccggaatacgcgcgcgaagcatgccatcgctccctcgcccgtctcggcgtcaagaccatcgacctgtactactgccaccggctcgaccggaagacccccattgaaaagaccgtcgaagccatggcacagctcaaggcggaaggcaagatcagatacctcggtctga

SEQ ID NO: 1689 - DNA, 591 bp, A.fumigatus
agaccactcacggtcaatctagccgacatgtacggcgacagcgaggacctcctcggcaaatggttccaagccaacccctccaaacgagaccacatcttcctcgccaccaaatttgcgaaccgcgtgggcccagacggacaacgcttcgtcgagtcttcaccggaatacgcgcgcgaagcatgccatcgctccctcgcccgtctcggcgtcaagaccatcgacctgtactactgccaccggctcgaccggaagacccccattgaaaagaccgtcgaagccatggcacagctcaaggcggaaggcaagatcagatacctcggtctgagcgagtgtagcgcagactccctgcggcgcgcgcacaaggtccaccccatcaccgccgtgcagatggaatactcgccctttgcgctggagatcgagagcccgcagtaccggctgctcgagacggcgcgcgagctcggcgtcgcggtcgtggcgtactcgccgctcagccgggggttcttgacgggggctattacctcgccggatgatttcgaggagggcgatttccgccggatgtcgccgcggtttagcagtcttcacaggcggtag

SEQ ID NO: 1690 - DNA, 384 bp, A.fumigatus
  unsure (159),(161),(207),(294),(306),(311): Identity of nucleotide sequences at the above locations are unknown.
tcgatgaaacttcttttatcacttttgatttgcatcgcagcagtcttcctctcataccagttcgcctctaattcagctcacctcgaaagtctaagcgcttcgctcagagaacaactcccaatcgccttatcgcagtacctgcgaaggaacaacatcatngncaccttcttcgtccctcccctcacacataccgagccgatcatcctncccctcaccgatatggccgtcccccgcgcaatccgtcaggtcttcctggccatcgaaaaagccgaaggcgccggcgcgcgcgttcgncgttccaatcgnacccncaaactgcgcaactttaacccctttctcatgctggaacaccttaccattcgccccggcgcagggtttccctga

SEQ ID NO: 1691 - DNA, 234 bp, A.fumigatus
tattgcagagagttctggtcgaagggcatcagactcgtagtcgcatgcgcagaaatgtacgaggcttttgtttcccaagttcccggactgcttgcgcaactaaagtattacccgtcccaagctccatccacggattccttgggttccaggattcccctttgctccaactccgtggccctgttgttcagaaccggtgccaaccgttaccttgaacgaccgcaaactccttcttaa

SEQ ID NO: 1692 - DNA, 1518 bp, A.fumigatus
tcccatttcacctgctcatactcgaactttgctagctgcggtacaattatgccgccagctttcgagtttcgaggcaacgaccgacggtcgcacaataacaataatccaagacatgagttcactttccgatatgcacgatccgggacgggcgaacgaacgctcttgactaccaaaagagaaaccactccagagcccatcttgggcgctacagcaggagatgaaaaaccggccatgaaatttgcgcccatttcaagcctcagtgacagcgaggaagccgagatggacatgtccgatgatgataaggacgacgaagcttcacatccgcgtaagaagcgtgcgctaggaacaaatactgcggctgctcctactccagcaccagtcacagctccaaaatggtccaacccagatccttatactgtcctacccccgcctgatgagacgttggggaagagggttgatgtcgtcaagctgattcgcaaggcgcggatcacagagaatgctaagcagccagcacctgcggatgcagtgacgaccaacgaggactttatatcatttagtggcctgatcgacgaagaagaagaagctaggatgaaggtgtcagacaatgctccttcgggaccgaaacgtctgcaaggaagagactctgctcccggaagccggaagagaacgcatgatgatgagataaagggctattccaagaagactggacgacccatggtcaggttttacgatgatggctcgattattgacgagtggagagcgcgctcgcaagaggacgcaactccgtggatgttgctcatggaaccttccttgcacctgggttctcgactgcacaacgaaattctgagtttctaccactgggttaaaccgatgcagtatgagcagattgtccgagcggatttgattacaaggctgcaggtagcattccaaagtaggtactatggtgtgcaacttcgtccgttcggctcgttcgcttcaggcttgtatttgcccactgcggatatagatcttgttctgctgtcatcaaatttcatgcgcaatggcataaagacttttggtgagcgtaaagggcagatctacgctttcgcggcctttctcaaaaatcttgaaatcgccgttcccaattcaatagagaccatcgcgcatgcgcgcgttccgattctcaagtttgtggacaagatgaccggcttgcgggttgatctgtcgtttgacaatgatagcgggctcatcgccaacaacacatttcaaaattggaaatcagaatatccggcgatgcccgtgattgtcgcggtggtcaagcaatttctgctacttcgtggtcttaatgaggtcccaactggtggtctgggagggttctccataacctgcctcgttaccagtcttcttcagcatctaccacatggccacacagcgcctaatctgggcagcattctcatggattttttcgaattctatggcaacaactttgacttcgagaagtcttcaccacggggctggaaggatccgagcgggcttcaa

SEQ ID NO: 1693 - DNA, 261 bp, A.fumigatus
  unsure (29),(63),(84),(96),(98),(99),(126): Identity of nucleotide sequences at the above locations are unknown.
cccctcccaccattcgcggttcacttcgncccttgttcaggtatcttatcaaagggcccaagnatcgtactcaacaactacatncttacttccatncnncccccagtctctcggaggtcgttggcncggcctatctctgagtttcatattgactcgttcctttttctttctttcattgcatatcggtcactttgcatgcgaggcttcttctctccaacgtctcatctaaccctcctcgctatcaaccaatcttatcgctga

SEQ ID NO: 1694 - DNA, 195 bp, A.fumigatus
gtgatatttcaaagtctgtcaaataataattttttttttttttttttttttttttttttgttttttaacatgtcgcgatccgatactagcagtctgttggactatccagaggcagcgggatcaatggggtttcgcggttcttctcctagccctacaaacgagatctccccttgcttgccatcatgccgcagatga

SEQ ID NO: 1695 - DNA, 960 bp, A.fumigatus
  unsure (26): Identity of nucleotide sequences at the above locations are unknown.
tgggaaacacccctattcatccgaantaaagcgacttttgggaggaaaccggaacgcaatatcttcggcaaggccgagttccagaaccccggtggtagcgtcaaggaccgtgctgcgctattcgttgtcaaagatgccgaagagaaaggtcttttgaaaccaggcggcacagtcgttgagggaacggctggcaacaccggtattggtttggcgcatgtgtgtcgatccaagggctacaagcttgttatctacatgcccaacactcagtcgcagggtaagatcgacctgctgcgtcttctaggtgccgaggtctatcctgtgcccgctgttgcatttgacaaccctcagaattacaaccaccaggcgcgcagacatgccgagtcgctggaaaatgccgtatggacgaaccagttcgacaacaccgccaaccgccaagcccacattgagaccactggacccgagatctgggctcaaactgatggaaaggtcgatgcgttcacatgtgctaccggaacaggaggcactcttgctggtatcacacggtacctcaagaccgccagcgatggccgcgtgaagtgcttccttgccgatcctccaggcagtgttctccacagctacatccagagcggcggcaacctgatcgagcgaagtggaagcagtatcacggagggcattggacagggccgtgtcaccgacaacctgaagcccgacatcgatctgctcgacgggtcgctcaccatcagcgacgaaaagtccattgagatggtataccgctgcattgatgaggagggcctgtacatgggcgctagctccgcgctcaacgttgtcgccgccaaagaggtcgatgagcagctccccaagggtagcaatgtggtgaccatcctgtgcgatggtgcttaccggtatgctgaccggcttttgtccagcacttgggttcagagcaagggcctcaggagatag

SEQ ID NO: 1696 - DNA, 480 bp, A.fumigatus
ttaaatagtagcactgtggatccttccagccccgtggtgaagactagctctcatccagttcttgtttccgcgcaaggtgttgatttcaccattgtgggcagcccatcgcaaaggctgtgcacggtcccaagatgggaatgtattggtagaaaatcgggagtggacgagagcgaagtgcgcttcgtaatcaacattgacgagatcatggtagtactggtacacctgaactggggccaattgacccttgtagacaatgtttctgttgctcagggagcacagatagaaccaattagcgagaccaatgacgtgagtggctcgtttccgaagaacatagagctggcgctcaaaggtcctctcgtcgaaagactcaggatcggtgttttctggcttatttccctcaccatatgcggacttcaagaccacaaatggctgcatgatgatcggctctctggacagagcagcaggtcccaagatggttga

SEQ ID NO: 1697 - DNA, 780 bp, A.fumigatus
catctttcttcactgatagcccgcaatctgctttgcaacatgacgcatcgaggagctgtgggctctgatgcacgagacggtgatggtgccggtgtcatgaccagtattccgcacaaatttttcatcaagaatttcgcccgggaagtcggcgttgaactacctccgctgggccagtatgctgtcggtaacttgtttttcaagcccgatcaggagtctcttaaggagtccaccgccaagctcgaggaaatcgcagaatctctcggtttgcgggtgctagggtggcgtgaggttcctcgcgactcaaccatcttgggacctgctgctctgtccagagagccgatcatcatgcagccatttgtggtcttgaagtccgcatatggtgagggaaataagccagaaaacaccgatcctgagtctttcgacgagaggacctttgagcgccagctctatgttcttcggaaacgagccactcacgtcattggtctcgctaattggttctatctgtgctccctgagcaacagaaacattgtctacaagggtcaattggccccagttcaggtgtaccagtactaccatgatctcgtcaatgttgattacgaagcgcacttcgctctcgtccactcccgattttctaccaatacattcccatcttgggaccgtgcacagcctttgcgatgggctgcccacaatggtgaaatcaacaccttgcgcggaaacaagaactggatgagagctagtcttcaccacggggctggaaggatccacagtgctactatttaa

SEQ ID NO: 1698 - DNA, 435 bp, A.fumigatus
cttcccgcgaacgcatcgcggggcggggcgggatccgcctggcttttcgatcgtggggacgttgcttcggaagttgaagatggaggggctgtttactctgcggaacggggcgagggttacgcgggttgtaaaggaggaggggtgcgtgaagggggtggagtatgtgactgtcgagggggagacacaaaaccacacggtcgaagggccagtcatcttcgctacgggcgggtttgcgggcgattccagcggtatgctggcgcagtatcggccggatctggccgattttccgtcgacgaacgaggcgagggaaggcacgcagccgattctcgaggcggtgggtgcctcggtggtggatatggagtgcgtgcaggttcatccgacggggttcgtggaccccaaggatccggcggcgatggccaagttcctggcggctga

SEQ ID NO: 1699 - DNA, 918 bp, A.fumigatus
ttggggcaccacgtccccgtccggaaggtggaccgcgccatcaagccaggcggcaatcccatcaagggtttttgggggattaacggcgccggaacaagattccagcaatgggaggacaatggcgatgtcttcttccaggacacgctccggtccgccggccaggcattcacacgggcaagtagcgacgagcgcgcccggcgggagacgctgatttcgacgctggcgtctcgttccgcggacgcggtgcactggctcgttgacgagaagggcgtggacctgagtaaagtcgcgccattggggggacatagcttcccgcgaacgcatcgcggggcggggcgggatccgcctggcttttcgatcgtggggacgttgcttcggaagttgaagatggaggggctgtttactctgcggaacggggcgagggttacgcgggttgtaaaggaggaggggtgcgtgaagggggtggagtatgtgactgtcgagggggagacacaaaaccacacggtcgaagggccagtcatcttcgctacgggcgggtttgcgggcgattccagcggtatgctggcgcagtatcggccggatctggccgattttccgtcgacgaacgaggcgagggaaggcacgcagccgattctcgaggcggtgggtgcctcggtggtggatatggagtgcgtgcaggttcatccgacggggttcgtggaccccaaggatccggcggcgatggccaagttcctggcggctgagatgcttcgcggagagggtgggattctgctcaatagcgatggaagccggttcgtgaatgagctggagacccgccagcatgtcgttgatgccattcggcagtcgacctctccgatggagacggctacgcgccagtgggatgtgacgctgctccttgatgagttttcaccagccgtg

SEQ ID NO: 1700 - DNA, 255 bp, A.fumigatus
ctcttgagacagatgtggatgggtacatacccgacagttccgtcgaaaatccttgccacaggcgagatgctcgccgactacatcaaaaacaacccgcagttgattgggaaggccgttttggatcgatatggtccagaaatcccctttttgcccaaggtacacaccgtctcgagaaaaacaacctgcatgaccttgactaatgaatactcagatcctatccttcgccaaagccctcccacttcaaatccaccctga

SEQ ID NO: 1701 - DNA, 441 bp, A.fumigatus
ctaatgaatactcagatcctatccttcgccaaagccctcccacttcaaatccaccctgacaaggccttggctgagaagctccacgcaaccgatccgaagaaattcggcgaccccaaccacaaacccgaaatagcaattgcactatccaactttgagctcttcgctggcttcaaacccctgaaagacatcgagtctctcatgaaactgaagccgctcgaacggtttgtcccgcctcacgacacattcgatgacgagcttctgcggcagatttgcaaggcgctgctaagcgcgcccccagtcgccgttgctgaaacgatcaatgagcttcagagcattcccgagcctcaatttggtcccaacagcagctatattccgggtatgctggagagacttcgcaaacagtattgtcttcaaccaccggggctggaaggaccagcgctt

SEQ ID NO: 1702 - DNA, 1119 bp, A.fumigatus
agacaccaaccacgtccgagtgcgtccccattcgcccagcgaatgcagcagtaccagtacggtcagcagcctcccgcgtcgaaccacaatccggtgggccaaagtccggcgcaaccgcaggcgaccgctcagccgcaaggaaattggcgaactaatcaacctctgaataggaccgctgcgaactacaaccgtcctacgtggaatcacaacggtaggcagtcatggaaccagggtccttctcgcgttggccccccaagagagcgagcctatgctgctaacgtacatgtcgaaccgactgtcgaacatccatccccttcaccacggtacgatgaaccggaatattcaccatatgttgaatcaaacgaacggtatgaatcaaacgaaccgtacgaccagcacgaccagcccgatgatgaggacccgggatatcaagcattcctccatcatccggcgttcgaacgcggagatttccctgaatctaaggatgaaccatgcgcatttgcagtcgatgttggacctgtggtcacgacctgcaatggatgtggggctacattcccgtcacggaatcgtctgcatacccatctttcggaatgtccacgcacacaggaaccaatccctgttacccctactactaatgacccaactgctgtccgtatcattgaatctactcacaagccaaccgggctcgttggaatccgttcctggcgttgcgctaccgcgaagatcggaattaacagcacatcagaataccatgagatatgcctcgatacaggctgctcctctaccattggaaatacagagttcatcgaagcattacctagcgtaaccatcaccgagctgacggacggcatcacggtttcaggcatcggatcccgtcatcgatcaaaccgttctgctatgctaacactatggttccctggattgatgaatgatggtggttctgcgaacgcattcgctaagattaccatccgttgccatttggtcgatggcctgaagcctaagctacttatcggaaccgatgtcatctgcggtgaaggattcatgcttaattttgaacgtggcatcgcaacttttggttcctgcagttcgattaaccttcccaatcatcgcgcaagctaa

SEQ ID NO: 1703 - DNA, 285 bp, A.fumigatus
cccgctggacggatcaaccttgattggaaccactatatatcctcatactggttgaccatgagttccccttcatcgaagtccgcaactaaacaccccctccaattatcgtcactcgtcccactcccaaaaggtacctctttgattcccacctcgacccctgccccaccaattccccaaacgaccctcttctattaccttaatcctcttgaattcccaaccatcggaacttccatttctcccaaatttgaattccccctcccctcatcaatcctcaaaaacctttaa

SEQ ID NO: 1704 - DNA, 501 bp, A.fumigatus
  unsure (486),(490),(492),(498): Identity of nucleotide sequences at the above locations are unknown.
acagacctcccgaaaaatgctactctctttctctgctccacagtccccgcttcctatgcccagtccgtagccgcagagctgcaatcgcgcggccgtgcggatatccgcttcatcgattgccctgtttctggaggcgccaagcgcgccgctgacgggacgctgtccatcatggctggtgcgtcggaggaggcgctgaacagcggacgcgagatcctgcaagtcatgtccgatcagaacaagctgtatctggtccccggcggcgtcggggccgggagcaatatgaagatggtgcaccaggtgctggcgggaatccatatcctgggtgccagtgaggcaatggggttcgcggcgcagttggggcttgatgcaaagactaccgctgagaagattatcggctctgaggcgtggacgtggatgcacgagaaccggctgcagcggatggtggaggaggattggaactcagtgtccagggggccggggcctttnctcntngatatntga

SEQ ID NO: 1705 - DNA, 396 bp, A.fumigatus
acactcaaacgggtcggatttgcaagtcgaagcaatcacaaattcaatcctacattcagagtccatacatacaaaggtcatcagataatcacaatgtccaaacctaccatcggcttcgtcggccctggagccatgggctttcgcatggccaccaaccttgtgcgcgaaggataccccgtcgtcggctgtgacgtcttcccagcctcggtgcagcgcttccagtctcagggcggaattccagcttcgtcgcttcgcgagtcggcagaggggaaggacttttacatttgcatggtcgcctcggcgccgcaggtgcagtcggttcttttcggggacgacggcgttgtgcagtgtacgttactccccttacaggcatctcaatatgaggaacaacgctga

SEQ ID NO: 1706 - DNA, 207 bp, A.fumigatus
aatacctcttcttcaattcatgttactactccctcagtcgcttcgcagagtggcctaactatcacccctcttagatgggttgctgggcactcgcaacaagaaggcgaatccaccgcttacacaatccgcttgaccacttcagtcgtccattcaaaatggattgagagaaactgtcttcaccacggggctggaaggagccgcgccatt

SEQ ID NO: 1707 - DNA, 963 bp, A.fumigatus
atcatccagctacaaaatcgcgaggtgtcatgttatgtggggatgttatacctattcagaagcgtaatggaacgaaagggtttggccagcgtctgggtcatggagaaacgcgggggctttatctgggttcttgaggaaatacaggagaatgtcgcctacatcttctgcgacgactcctggaccatcactggtacccgtggggaaaccgacaagatctggggccagggcgtggtgaagcttggatcacatatcacagaccttctcccccacttgccgacggattgcctaaaggcttcacctagcaaaggtatactaaaacttgccgatataaaatactttgctgcccgggcttctgctgagatctgtatcccggctattgttggaaaggaagaagatccgcgctgtctccgagtatccagtttccctcacgttgcgggcatgatggtcctgtcttcgtccacgctaaaggtgattagttctaatccagtgttttcgtcggccctcttcggccacgcacgaccggagggtatgcatgtcaacgacctaatacctggctttgacaccctgctcaacgtgctcagcgaagaggaaaatttgcccttggtggagggagtggtgattcctgaacccagcttccgaagagcacggacactttccatcctccgcgacggtaaggcgaacgtggcttccgtgttcctggaaccgatgggcatcactgctgcccatcgtgacgggtcaacaattgccgtagacgttcaattgcgcgttgtggaaagcgagacctttttccgtcaaaaccacagtgaggacatggaaagccatgacgaatcaagtgattaccaagaagatgcaatcgccataaaggaacttgtttatgctttatgggtcacgtattcgagaaagatccactcaatagggccgtcagcaaccgtcttcaccacggggctggaagggtccgtccag

SEQ ID NO: 1708 - DNA, 249 bp, A.fumigatus
acattccagatgcgttttcatgcgagaagctttcaagactatcacttcattgccttacaccgagtataccgaggccaaagccctaaagatttagatgagtttcaaagaatatctggcgttaatcagatcctctcattcggtgactgggactttctaatcatgccagagatatgccagatcttccgcaacagcgtcaaacccacaaataggctcactatggagacaaagattgccagcttcatcaagtaa

SEQ ID NO: 1709 - DNA, 675 bp, A.fumigatus
  unsure (616): Identity of nucleotide sequences at the above locations are unknown.
aagaccacttgtaccagatgtacgcctctcagccaaatgcaaatagctctttcctcacattccaacacttttgacatggccacccaccaagccatcatcctccctggtattaacttaccactcaccctcgcctcagtcccaacaccagccccccaatccggccaagtcctcatcaaggtcctcgccagccctatcctcgcatactaccgcacaatcctccccggcaaacgtccctatcccctctccctccccctcacccctggtgtatccccaatcggccgcatcgaggccaccggatccgacacaacagcactcaaaccgggccaactagtgtacgtcgaccttgccgtacgcgcacgcgatgaccctctcaaggaacacggcaccatcgtccttcagggcctcttcgtaggtataacccccgaagcgcgcatcctatccgaaaacgactggcggcatggctcgtgggcggagaaacagctcgtcccgctggagaatgtgcatgttctcgatgaatcgctgctgtgtgcgcagatgggttattcaccggcacggctcacatggattaaacaccctgcttgttccgtacggcggattaatgtcgggggccctgcanccggggagacggtgattgtgtgttttgcgacggggcatttcggcggtgcgggcgattga

SEQ ID NO: 1710 - DNA, 252 bp, A.fumigatus
cttaccactcaccctcgcctcagtcccaacaccagccccccaatccggccaagtcctcatcaaggtcctcgccagccctatcctcgcatactaccgcacaatcctccccggcaaacgtccctatcccctctccctccccctcacccctggtgtatccccaatcggccgcatcgaggccaccggatccgacacaacagcactcaaaccgggccaactagtgtacgtcgaccttgccgtacgcgcacgcgatga

SEQ ID NO: 1711 - DNA, 276 bp, A.fumigatus
acaaggctaacactgcatctcgctttgcttagtgatgaagatttgaaagaatacgaccttgatcactacgacagtgatgaggtcgatgaggatggagagaagatcaccatgttcggaaacgtcaagtcgctagcgtaccaccaacccaacgaggaagatccataccttgtgataccggaagaagaagaggatgaagagagagaggagttgcagatccttcccaccgacaacttgcttcttgcaggtaaggtcgaggatgaggtggcccatctttga

SEQ ID NO: 1712 - DNA, 285 bp, A.fumigatus
ggaaaacactttacgatgtcttctatgatcactacgaccgcttgggtgcggcggggagtcgctgcccaattccctaccaaatatgagattgacgaggaggaaatgaaccggatatccaagctcgctcggatgcagctcgaagaggcccagggtgatctggaggctgccagggaaggaaaggaccaggacggcgagaccatggaggaggatcagaaggaggaagcccaagacgcgatggaggacgattccgaggaaaagaagggaaagacaagtttcaatgagtag

SEQ ID NO: 1713 - DNA, 231 bp, A.fumigatus
ctttctgggacttttaaacctttttacatgtctcccctggaggtccggccccgccctgacccggatggcgtttggggaccatgcagtcgcaatggtccaggtcccagaccccaaatgtcgggctccaatgtttcctccgcccacgaaattgccgttagcccggtcatccgtgtgtgcgccaacaaggaaatccaagccattcaaggcacagagggatggcggcaagcataa

SEQ ID NO: 1714 - DNA, 909 bp, A.fumigatus
gagatacgggcgaaaaactacgcatcgtggatccccggcgccaagccctatgtcgatcaggcatttgacgacctcgaggagatcaagcgcaagcatggccaggaattcaatgagattgtcagtaatgcgtacaaagacttgcgcgaagccacaaagaagggcagtcttgacgtgaacaccgccgttaagatccgagacattctacaagaacacttcaagcgtctgtatgaactggccggcgagtctgcaagtgacatccttgacaaccatcccgagatcagggaaaaggtcggtggcagcttggatcagctcaaggagatgggcaatgcctatggtccgcaggcgaaagaggaggtagacagaacgtggcagcaagtgaaggacatcgtcacgagcggtgttaatcctgagaccatccagaagattcagaagctggcacaagagaagagagagaagctccagaagttcggtgatgaggcatggcagaagggtatggaagagatcaagccatacctggatcggaaccccaaggtcaaggaacttgtcgagagaaacagcgatgctttgagaaagggcaactatggggaactctgggacctgatcaaggaaagcgcgtcttccggcaatctaggaaacctggagggatacatcaacaagaccgttgatcaagccaagaagagtggtttcaacctggacagtctggcggacaagttcccaggtggttcagacattctctcccaactgcagtcactccaggatattgcacagaaaaagggtcccgaggcggagaagattctaaaggataccctcaatgacatccaggggtcttatcggaaagaaccaaacaggccgagacccttgctgagtcttttaccacaaggagtcgaaacagccccagtacgtaagaag

SEQ ID NO: 1715 - DNA, 606 bp, A.fumigatus
ggttcaaacttcaaaccgacccacgagactcctcagaatatatatatatatatattgaatacagacaggtgtttaaagatgagcgcaaatctgtccccgaaacaccaccacatcgttttccttcaggccgattattgcccaattcccaactttcgcttcccgcctggtcatacttttactacggctgtctatcagcagacttcactctcagaactccattcacgtattcatgatgcctcaattgttgtgttctcatatatcccatttgacgcgcacactctctccccggaggtgacaccgcatctcaaactcattgccgtcgcagcagtgggcacggactgtattgatctcgaagcatgcagaaagagagggatcattgtgagcaggtccgttggcgcaaatgtggattcagtttccgagcatgcaatcggactgtacttcgcttcccggcggcgcatactggatatgcacatgttgacgagagcgggcgaatgggcgcacaaaaaaggaaccatcatgtatcaacttctcgacaagcacggccagcctcctttgagttgccaagatgaagtagttggtattattggatatggggtttgttggtga

SEQ ID NO: 1716 - DNA, 606 bp, A.fumigatus
ttggtattattggatatggggtttgttggtgagtcggtccaggccccgatctggattccgtcaattgttgctctcgaggctgacaaaacaaatgtaggacaaaggatcgctcagctcgcgcgcaacctgggaatgaaagtgctcatctcagctcggaaagatcctgcaacatcatcgtcactgagcacggtcgataacatcgagcgagctccattcgatgcggtcatcagacaaagcacggtcattttcgtggcagtgccgcttagcccgtcaacgcggaatctcatatccaacccagagttgaaaaatatgtcaccgcatacggtcatcgtcaacgtctcccgcggaggaatcgtagacgaagatgcactactcgaggctttgaaaaagggtacaattgccggcgcggccacggatgtcttccgtcaagagcccgctggattggataactctccgttactgtccgatgaggcaaagaatcttaatctcattgtcactcctcatctagcgtggctatcgaagaaaaccttggccaactattcgcagatggtccagcaggccattgaaggatggagtgcaggacagccatgcaatgtcgtgacatga

SEQ ID NO: 1717 - DNA, 1182 bp, A.fumigatus
ccttcttccagcgacctcttgaaacgtcattcaacaatccacgccaagaatgcgggtcgccaatacctgtccgatgcgcctttgccagaccctgcgggccccgcgcaccttggcaatgttaatcaacagcttcagcagccccaccctagggctgaggacatatacgaatcccatatgcatatcgtccttcgctcgtcagactcgcgacatgcgcattctttcgactccagatatccagaaacgtttagcgcgatccatgacactactcaggatgttgaggtcagcagaggccttattggtggccccgaccaagtgcaagactacagagcatctttggaccccaacgcatactcatcgagcaagtcgattagccaaagcagtccgaactctgactccccatggccctacgccacttatggaatgtatggagaaggctgtctagatacggatttagcctggatcctcgacatcggttcggtggactatcccagtcctcagaaagatcatcacttgggccttgacagcgtccaaattcaagaatatccgagtaggcattctgagcggtgcctgcctggtgtcgtctccaccgtgggcgacacagcctcgagacatcgtaatggtcaggcatgcgattatccggctgacgacacccaaaatgattggcccgacgaggatcccgttccaggagcaccaccatcgtctgagataccaccaactgatattcccagtcaggaatcctgggtagagcctgacgaggtcaggctcttccaggatcgtctcaaaaacgtcaactggcaattcctgagaataacaccagacgtgagagctcgtatgttggccaccttggctgatagtgcttcgattgagcatggacacttgcctccagatgaatcgaagtttcctgtgccagaggtgcttgagtatttcctttcattctttttcgaattcgtccatcctaggttccctgttcttcacaaaccgacgttcagtacggccactgcgccaccatacctgctgttggcgatcatgcttctgggctccagccattctagatcaaaccgaggtaaattcgttgctgtgtatctacacctggctactacggtgtttatgaggttgcatgccttgaagccatcatttgtcagagtcttcaccatgggactggaccgagccgcgcttatgtaa

SEQ ID NO: 1718 - DNA, 1137 bp, A.fumigatus
atccttgtcctcaaccaaagcgtaaccatcgtctcctcacggatacaaatctcagaaatgtcgcaggaacatcgcttcgtagaagatggtcgaagaacacaacctcacacggcgggactatatgaccgagccgagattgagcaatttgttgtaagcgcaccttccgaaaggtcgccaaagagctccaaccattctcctctgtcttcggtcactcagcccagaacgcttcaaagccgcccagatatgatgagcctcacttctatattaggagggtctatggacggcattcaccagtgttcaacgcaaaggagctcactttctcgaggttctttcttgcatagttgcgaccgacaacagtgtccggaaaacaacaaaggaccactgggcatcgagaaagaggctgaacataaggagaataatcgaacgtaccacgagtttcacaggggaaaatatatgctgccgaacgatgaagaggagcaggatcgccttgatttcttgcatcatgcccttttacaggtgactggccgactgacccatgtccctcaccccactgatgcaagagttctcgatcttggctgtggaacgggtatctgggcgattgattttgcagaggcctttccagactcatttgtcgtgggagtagatctatcctccattcagccctccggacatcctcccaactgccatttttacgccccatttgactttgaattcccctgggcgaagttgggtgaggagagttgggacgtgatacgacttcagatgtgcggcgggagtgttgtgaattggccaagcctctaccgtagggtcagtgctcacctacgccctgatgcttggttcgagcaagtcgatattgacttccaaccgaggtgtgaaggtcgcgctttggacggatcggccttatataattggtgccacaatctaagacaggctaccagcgatgctgcgcggccaatctcccaccagtttcacgcgataatcgaccacctacaaaatgctgggtttaccgatattaagcacaagcaattcgtattgcccttaaacagatggcattcagacctctggatgcgacacattggtggctggtatggaagagctttatttgacagcattgaacccctcagcctcgccccgttc

SEQ ID NO: 1719 - DNA, 219 bp, A.fumigatus
cgagcgcggtaccttccagcccctgtgcgtgaagacgaggtcaactcccgagatttcgtggaattgctatctttcgccatgaaggtcccttgcttccttctattccttgcggcgactgtgtctgcccaacgtgttgccgtcggtttgcccgccgaaggagagaaattagctcctggaagttcgactgtggtacagattcagagaccggtatgcttctga

SEQ ID NO: 1720 - DNA, 609 bp, A.fumigatus
  unsure (18): Identity of nucleotide sequences at the above locations are unknown.
ctggctacattggtgaanaacgaattgcacagcttcagaaaaaaccagcagatgcacatgatgcagcagatgcaaagagagcattctgacatggacatgaacggacaccgcccacaatccccctcgtctgcagaaaatgcgccttcaccctcgaagcggcctcgcctcgagaacggtcctatgaacggacaacagttggcgcccaatggacggggtcaaggacaagccatgccaggtcagccaaactcgcaagcgttattgatgcaaaacgggctcaacccacgggcgatgaatccggcccagtttgcgggttttcaacaacaagggcctgctgctcagcaaaaatccatccaggtatatgctcagaacttagcccttcatcactcacgctcagcactgaataaccagggcattccgaatggtttaatgaaccccggtgtcatgccgaaccagactgatctggtgcctatgccagacggccagggtatgtacccaatgaacggcgactactatggcacgaatggccagatggcccaggtacgggctgggatgcagacacctggcggacagcacggtaaccatgctctccaggactatgaggtgcagttg

SEQ ID NO: 1721 - DNA, 267 bp, A.fumigatus
cataccctaataacataccctaataacatacccgatagcggttacgcttcgcgctctatctccctccccgacatatccgataccgatcagcggttatgctgtgcaccttatctccttctctcctccccccaatccatgattctaccgctctcctacccctccccctggcgggacatctctcctatagaggttagggggttagccttctcctccccccctctccgagccgagagagaccgagctttttcgatatctccctacgaatag

SEQ ID NO: 1722 - DNA, 843 bp, A.fumigatus
  unsure (771): Identity of nucleotide sequences at the above locations are unknown.
gggggcaagaagtacttagccaaaatagataagtcaatcatggcgggcttcactgtgggcgattacctggcagaaaggctgtcgcagattggaattgagcatccatttgttgttcccggcgactataatctgatccttctagataagctacaagcccacccaaagttatcggagattggctgcgcaaatgagttaaactgctcccttgcagcggagggctatgccagggcaaatggtgtcgctgcttgcgtcgtgacctacaacgtaggtgccttctctgccttcaacggcacaggcagcgcatatgcagagaatctcccgctcattttaatcagcggatccccaaacaccaatgatgcggcccagtttcatcagttacaccatactctcggaacgagtgactttacctatcagcttcagatggcggagaaaattacgtgttgtgccgttgctgtgggcagagcgcaggacgctccgcgtctgattgatcgcgccattcggggtgcgctgatcagtaaaaagccggcatatatcgagattccgacgaacctctcaggcgctccatgtacacggcctggcccgatcagcgcggttgttgatcctatccagagtgaccgagcgtctttgttggcagcaattgactgcgccgcggactatctgtctgggaaggaaaaaccgattatacttgctggtccaaaagtacgtaaagctggtgccgagactgaattactgtgcctcgcggaagcaatgggttgtgcggttgtggtgcanccagcagccaaaggatctttcccagaggatcacttccagtacgcaggggtcttctggggccaagtgagtact

SEQ ID NO: 1723 - DNA, 585 bp, A.fumigatus
tccagagggtctaccggtcaaggacgacgtccaacatacgcaccccaaggtccaagagctgcgcgaattgagcacatggagcgacggtcatctgtgggtgacccccgagcaacacggcaacctggtcagttcttcgccatccaaagtcttccagagagcactactgatcctccccagactgccgtcttcaaaaaccagatcgactggattcccctgtcgaccggcagcattcgacccactcaaggtcgtaccctagccatcgctcaagtatgtggaggatcccaatcgttcaatgccgtcaactcgctccggatcctggggcggtggatgcgcatgtttgtgatcccgaatcaaagctcaataccaaaggcatacacgcacttcccggatgccggtcaaccgggagactatcatctcatgccaagcggtaaccgggatcgcttggttgattgcatggaagagtttgtaaagtacacaatcttgatgcggcctcaccttgatctctttgcggaccggtatagtgaacgcgaagaaaggcgactgaaacaagccgcgctggcggctaaagccggaccggacgtttag

SEQ ID NO: 1724 - DNA, 228 bp, A.fumigatus
atcatagaaggtgaagaatggaagacagctttcagaacaaagttcagacattttaaatacctggttatgctatttagattaaccaatgcaccagcatcgtttgaaaggtttattgaggaagtactacacaaggttctgcactactttatagtagtctacctagatgacatcttaatcttttcaaaaaataaaaatgaacatgtagaacatattaaggaggttctataa

SEQ ID NO: 1725 - DNA, 243 bp, A.fumigatus
ttcattgggcttgtaaattattatcaacaattcatcaaaggatacgtaaaaaccatgacactacttttcaaactacttaagaaagggaaagagtttaagtggactaaagaatgtaagacagcatttactagaattaaagagaagattataaccgcactaatcctagtgcaacacgacccagacaaggaaacaaccattaaaaccgacgcatctaactacacaattggaatgagaataacataa

SEQ ID NO: 1726 - DNA, 327 bp, A.fumigatus
gcgctcttggtgtgcgtgacgagatcaccaataacctcgacagcgatttcgttctccagggacaagggtgtggtggcggtaatgtcgtcccaagcatcctcgtcatcgagatcaacatcctcgataccgccatcctctccaacaggctcgtcatcatcgtcggcactggcgaccttgaccttgcggccagcgataatcacctcttggccaacaagatccttggcagcctcaccaagagatacatccaggtcagtctcgtcctgctcaatgcaagcgaaaaggcccttgaccacaccatcgaggaagggagcgaagtgctctccataa

SEQ ID NO: 1727 - DNA, 768 bp, A.fumigatus
  unsure (623),(632): Identity of nucleotide sequences at the above locations are unknown.
ctcctgcaggagtttgctaccgtcaaggacagtgaggaagaattggacctgcgcgctagtgtcaccgacgcaatgggtgaaatgtcggctgctgctggtgcagagcgttaccaaccctacgtcgagcccctcatgcgcgccaccgaggaggcacttcacctcgaccactcccgtctcaaggagagcacctacatcttctggggagccatgtccaaggtttatggagagcacttcgctcccttcctcgatggtgtggtcaagggccttttcgcttgcattgagcaggacgagactgacctggatgtatctcttggtgaggctgccaaggatcttgttggccaagaggtgattatcgctggccgcaaggtcaaggtcgccagtgccgacgatgatgacgagcctgttggagaggatggcggtatcgaggatgttgatctcgatgacgaggatgcttgggacgacattaccgccaccacacccttgtccctggagaacgaaatcgctgtcgaggttattggtgatctcgtcacgcacaccaagagcgcctacctgccttactttgagaagaccattgagcaggtcctgcctcttgctgagcacccttaccaaggtgttcgtcgcancaccattancactctgcaccgctcgtacgcgatgctcttcgctattgccgaaaataccggtcagatggctaaatggaagcccggtctacctttggaggtccagcccgcccaggaaggtccagaagtttgggtgaaatcccgatga

SEQ ID NO: 1728 - DNA, 207 bp, A.fumigatus
tatcatgatcttcgacagagacagacccttcagatgtatcgagtccctcagaaaatcaccgaggctagctcatgcagcacctcgcaagaacgttgcaagcaatacatcatcctcgccgatccaacccgtttcaaacccgtttttcaattttattcgccgctcccttcgcgtctccaaacaaccccgccaaataagcaattcgattga

SEQ ID NO: 1729 - DNA, 420 bp, A.fumigatus
aaaaaaagcattggaggctgggctctcccgttctgggacctcaaagcgttcattacagatcaaattcctggtctcgcaggtccagaatccgtccatccaaccagtgcagccctcgccttccagctagccaacctctatggtctcctcagtatcctaggcatcggcgtctgctactcgactaccgagcccagggtgctgcgtaactacctctatgctctggccatcgctgatgtgggccacatctatgtgacgtatcgttgcatgggccatgacagatttgtcgacgttatcaactggaatgttttgacctggggaaacattgggatcaccggctttctgatgatcaatcgaattgcttatttggcggggttgtttggagacgcgaagggagcggcgaataaaattgaaaaacgggtttga

SEQ ID NO: 1730 - DNA, 444 bp, A.fumigatus
gaacatagaaaacaagcaatgtcgacccttcctccaaacccactggcctgcttctggcagaacaatccccacaaactacacgaccatcgctccaccgaagatctcccgacgcacagcgatgtcgcgatcatcggcgctgggtacgcgggtgtgagcacggcctggcatttactgcacaagcaccccaatatcaactcaatcacgattctagaggcaagaggtgcgtgttctggcgccaccggtcgcaatggaggccatctgcgcccagacctgtacggacatatccccacgtacattgaccgcgctgggcccgaagcagcagcggagattgccgagtttgagattgcgcatatccaagcaatcaagaaacttgtggagagcgagcaaatcgactgtgatttcagacttgtcttcaccacagaggggtcgaaggatccgcgctaa

SEQ ID NO: 1731 - DNA, 189 bp, A.fumigatus
cgacaggaattgcaaatgcatcgtcttcattggaagaatatggcaagctatctacctctccccaatctcaaagctaaaccatcaccgggtgagctggagcagggagataagacgttggttaaatatcgccaactggcctggccaccggatcacatcaatcccaaggtcctcatcttacttccgaattga

SEQ ID NO: 1732 - DNA, 567 bp, A.fumigatus
gataatcaatgcgcgggatcgtcgactcctgtggtagaaaacgctgcagaggtacagattgacacactaaccggtgactggacgcctctgcgtgccgacatcaagatggacgtcggacgcaccatcaatccatctatcgattacgggcagatcgagggcgctttcatccaaggccagggcctctttaccaccgaagagagtctttggcatcgtgcctcgggtcagatcttcaccaagggccccgggaattacaagatccctggctttagggacattcctcaggtcttcaacgtcagtcttctaaaggacgtcgagtgggagaacctccgcaccatccagcgatcgcggggcgtcggtgaaccaccgctgttcatgggcagcgctgtcttttttgccatccgggatgctctcaaagctgcgcgtaagcagtggaatgtcactgaagtgcttagcttgcagagcccggctacgcccgagcgcattcgggtaagctgtgcggatcccatcattgagagagtgagggtcacgcctcgagagggagagaagagtttctttgttgcgatttga

SEQ ID NO: 1733 - DNA, 192 bp, A.fumigatus
  unsure (13),(89),(157),(158): Identity of nucleotide sequences at the above locations are unknown.
tggtacctcgatnaaccctccggcgttcgacaggtggtgattggaccgggggtctccttcccttcgcgggggtttcggttctcaacccnaaacaaaattggggctcggacgattcccattaacgcgcatgaattcccctatgaggattatgaccccnnactatatggtctctgtgcggaaacctcctccaac

SEQ ID NO: 1734 - DNA, 189 bp, A.fumigatus
  unsure (72): Identity of nucleotide sequences at the above locations are unknown.
atgcttctccaggccccagctcctcggtatgaggcttccacaagcactgtggtggcttccgtgccgttcccngtgagcagcactcaccatgaggatgagaaactggggtttgccggcgagagacaatacgggtctgcgctcaaggtggacggcgctgcggacctgcgaggaagtagctatgtcgagtaa

SEQ ID NO: 1735 - DNA, 303 bp, A.fumigatus
ttagctcttatgttgcctcgcttggaatttccagcgatattgacagcatacattctgaccaacatgctcctcggatatgaaaaattgagctccaaggtcttcttccttgacagtttcatgatcgactatagtaagggtaccgatgcctgccaaaacaaggttcttcgcgatttcatttgccaatgctttgaacgtaatcagaaggatatttgcggaccgaatcctgaaacgaagggtattcagaatcagctcccaaacgcgcatggctgggaattcaaagtactcacttctcttgggccttga

SEQ ID NO: 1736 - DNA, 408 bp, A.fumigatus
gtgcatatttcccaacgacggagagccccggtttatgtgtgtctgacatgctatgatcaccagatgagattgctctctatgatcgtcaaatccgtctttgggggttcaaggcccaagagaagtgagtactttgaattcccagccatgcgcgtttgggagctgattctgaatacccttcgtttcaggattcggtccgcaaatatccttctgattacgttcaaagcattggcaaatgaaatcgcgaagaaccttgttttggcaggcatcggtacccttactatagtcgatcatgaaactgtcaaggaagaagaccttggagctcaatttttcatatccgaggagcatgttggtcagaatgtatgctgtcaatatcgctggaaattccaagcgaggcaacataagagctaa

SEQ ID NO: 1737 - DNA, 360 bp, A.fumigatus
  unsure (125),(202): Identity of nucleotide sequences at the above locations are unknown.
ctgccgctcgagtgggccgcgctcacagcgaagccgaacaataatctgcggggtgcaaacctacccccgacccacatcagagtgtcaccgtcaatgctgaaggcgcgaaatggacgcaagggcancgatgcgtggacttcctaccagggcaaggtctacaatatcactccgtacctccctttccatcccgggggcaaggganagctccttcggggtgcaggcaaagactccgggaaactgttcatggagattcacccatgggtgaactgggatgcgatcctgggggagtgtctagtaggcattctcgtatcggaaaacgaagcgaaagccaacgagagcagtctcgatacgatggactga

SEQ ID NO: 1738 - DNA, 201 bp, A.fumigatus
tggctgacgtatgggtttattctgttctctaggtgggatgaagggcttttggatatgtgtgtgggagagaagcggacactgacgatcccgcctgagtatgggtatggcgagcgcgggattgggcccatccctggcggcgcgacgttgatttttgagacggagttggtgcagattgaaggggttaataatgatgagctgtag

SEQ ID NO: 1739 - DNA, 273 bp, A.fumigatus
gcttctctttctcttggcctcgctggccgatcgaacggacatgctaatcaaagagatgtagccgacaagctcaccgaagtgatctccagcgcatcccaatcattctctgaacgcttcaacaaagtccttccaccacagtctcccttccagactgcagagtactctgagttctccaaggcaatgctgtcgaacctagttggcggtattggctttttccatggagatgatattgttgaccgctctgcagcatccagaagtttgaatgaacaataa

SEQ ID NO: 1740 - DNA, 558 bp, A.fumigatus
cggatccttccagccccgtggtggacgactggcttcagacatacttgcgagcagaatgaaggcatggctggctatggctgggacgagtacgatatcaggaaaggcggccggcagacaatccatgacaccggaaactccttggacttgacaatcgacttcattaaggtccctggtggacaacatggcggcagctgggctgccagagtgagaggtatcccgcgcgaagacggttcccccgaccagccgacatcgatcgtcttctatgctactttggagggactgggtaacctgggtgttgcgacggaatcgggtcctattgggtaccaaggggacgtgaaattgatgggatatacaaccgagcttggggacttctccatcgatgtgacggctggccctgaaaccaacgagcatcctgaacatgggcacccgtcctacgaggacaagccgctggatcgcactctggtctccagctctaccattgcgcctgaaaacctctggcaggtgaaacgtaggctcagcatcccgaggaattgctctctcatatggaattggcgctga

SEQ ID NO: 1741 - DNA, 375 bp, A.fumigatus
  unsure (33): Identity of nucleotide sequences at the above locations are unknown.
ctgcggccatttcaatgcgcggatggcctgctnctgtggagaagactacggctgctgcatctgacctacttcctcttgcatccttcatactgttcaaacgtacctgcatccgcatgtgcataccacaccaatatggtccaccttgctacagtcaagcgcgacagcgaagatgttgaacccctcgttaaacgcgttgattctatcgagcttgaaaccaccgatgatgacggtttctactccactgtatacggtactcggtttgcggcggagcagctgccccagaatgagatgcccgagaaggagatgccccgtgaggtcgcttaccgcatgatcaaggacgagctgagtttggacggaaatcctatgctcaagtag

SEQ ID NO: 1742 - DNA, 399 bp, A.fumigatus
tttgagcaggaagaggaagccgagaagctcatgaccgactctttcagcaagaactttatcgattacgaagaatatccccagtcggccgagatccagaaccggtgtgtcagcatgattgctcggctgttcaatgcccctatcaacagcgacgacgagcaccccgtcggcacctcgaccattggctcgtccgaggccatcatgctgggcacgctggccatgaagcgacggtggcagaacaagcgcaaggccgagggcaaagacaccacccgccctaacatcattatgaacagcgccgtgcaggtctgctgggagaaagccgcgcgatactctgatgtgcaggagctctacgattcggctaataagctgacgaatctggaaattatcgcgctcccaaagagt

SEQ ID NO: 1743 - DNA, 222 bp, A.fumigatus
aaggtgatatcttccagttgtatgactagaagtaataggaatgaagatatttttcagccagtgaaggcctatctcattagtagtctatctattaggactaactttaatcctgctattgtgtgggagctctatatctttataccagccctctatatggacctttcctttgaagataatgcatggaggaagcgcctagccggtagaattgatacatttaattga

SEQ ID NO: 1744 - DNA, 195 bp, A.fumigatus
actactaatgagataggccttcactggctgaaaaatatcttcattcctattacttctagtcatacaactggaagatatcaccttctaattcttaacagccatggcagctatcttacacctcaatttaatcagctctgcagcgaaaacaacgtgattcctatctacatgcctgctcattcttcttataagctttaa

SEQ ID NO: 1745 - DNA, 342 bp, A.fumigatus
attaaccctctctccataaggggcaaaatgcatggtttacatgattttgacaccttgcaaacaattcactctgctgcttttagacattacaacttcaacatgatttctttcagacagtgtcttgccatagcggccctgccgttagctcatacggcattggcattgaacgatatatcctctcgggctcagtccgcaaccaatctctgcggagacaatgattacatcattctcgagagttcaccatggattgtgtacaatatgttgtacaatgccgcccagatggttggcacgcaaggcacgaattgtcttcactcacgaagcagccaggaccgcacattaatg

SEQ ID NO: 1746 - DNA, 393 bp, A.fumigatus
aaaccttggactctcgctattgaacaaagcctggcacaatcatcagtccgtcctttgattcatctgctggcagaagatatcaacagagtcaacatgactatcagctacgactacccgtcacgggttcctgccaccacttcaatggcgaccctcgaagacagattcgaagtcatcaaggaggtcggtgatggaagctttggcagtgtcgcagttgctcgtgtacggacagccggctccaatgttgccaggagaggtactatggtaaggaacccacttgcggacgagatcagcccctcggggcatggaccgacccgtgctgatattatgccaggttgcaatcaagactatgaaaaagaccttcgactctttggccccttgcttagagctgcgtga

SEQ ID NO: 1747 - DNA, 327 bp, A.fumigatus
ggaacccacttgcggacgagatcagcccctcggggcatggaccgacccgtgctgatattatgccaggttgcaatcaagactatgaaaaagaccttcgactctttggccccttgcttagagctgcgtgaggtcattttcctacggactctacccgcccatccccaccttgttccagccctcgacatcttccttgatccactctcccgaaaactccatttctgcctggaatatatggatggcaacctctaccacctaatgaaattccgagaccataaatacttggaaggcaaacccgttgaaaagtatccttcccttttaaccccccaa

SEQ ID NO: 1748 - DNA, 390 bp, A.fumigatus
gaattaatcgcggatccgccgaccctcgtggtgaagacacagccgccgacgcccttcccacctccccgccctcaccgcgtgcactctccaagccacgctgcacagcccctagaaaccgattttcaaacacacggtaccgatcctcgcgcgtctcgtacatctccccttcctcatcccgaggctgcccaaacagattcaaatgcacaaaaggcgccgtcgcctgtggaaccatatgctgcgccgcatgacacagcgggaactcccaccccgacacccctggcgcactatcctcgtcagaagaatcatccattcgctcatccggccgcccgatccccgcctgcaggaacaccgccaacgcggccagcaccttcaccatcggctggcccttag

SEQ ID NO: 1749 - DNA, 921 bp, A.fumigatus
gccgtcacagccatcaccctcaaccaacaatccctgcacatcaccgccccatcatcagacgcccaattcacccaccacgtctctctgctttcttccaaatccgacacccagcgccgcgactcactcgcgcacctgacgacctcactcgtctcaaggccagtagactcccccctcccccagcccgtaagcgtcctcctgcccactctcctccccctgatcctagacgcaagctccagcgtccgcacccagcttctcaagctcctgcgtgcgctgccagccaatgacatccaggatcacgtcccccagctcctgccctacatccgtgcaggcatgacccacctggcagccgacatccgcgtctcggccgtcgaggtgctgtcctggctggtggacgtcgcaggcgccgaggtcgtctcctgcgccggagggtggatcaagacgctgaactgcttcctgtctgtgctgggctggcacacggaggagtcgtccaagtggtcggggaatcgggcttcgttcggcaagtcgggcgctaagggccagccgatggtgaaggtgctggccgcgttggcggtgttcctgcaggcggggatcgggcggccggatgagcgaatggatgattcttctgacgaggatagtgcgccaggggtgtcggggtgggagttcccgctgtgtcatgcggcgcagcatatggttccacaggcgacggcgccttttgtgcatttgaatctgtttgggcagcctcgggatgaggaaggggagatgtacgagacgcgcgaggatcggtaccgtgtgtttgaaaatcggtttctaggggctgtgcagcgtggcttggagagtgcacgcggtgagggcggggaggtgggaagggcgtcggcggctgtgtcttcaccacgagggtcggcggatccgcgattaattcta

SEQ ID NO: 1750 - DNA, 294 bp, A.fumigatus
caaagacttctcgcaaccgtcgtcgactctcttgcccttgaatgccatacgcggcgattttgcttgatccccaatggtaaagatgtccaccaaggcttccgcgaagtgactttcagggacctatgttgcgccgtgaataggatgtcctggtggatggagaagcatgttgccagctcggtcaagggagcaacaatcgcctatttggggagcaacgatatccgctacattatcctgatgcttgcttcacacaaaacaggctgcacggtcagtcttcattcactggagatggagtga

SEQ ID NO: 1751 - DNA, 492 bp, A.fumigatus
gtccttgatgagagctccgcagcagccgctggctctcacatggacttttacgtcgcgaagggactcatgaagaaggtgacggtcggggggctggacctaccgacggtgaagaccctccaggagtatggggatgttgtgtccggccggaaagaggatccgttcggccgcaagtcgtttggccattggaaattgacggaagttctgccggagtacgcggtttatgtcggacaggtgacgccggtcattcatttcacgatgggaggggtggtgatcgacgagcggagcagggtcatcggcacagacgggaccccgatagaaggcctctgggctgcaggggaggtgactggaggtgtccacggccagaaccgtctgggagggtcgtctcttctggagtgtgtggtgtttggacgtatagcagggactgaggcggcagcatggcacaaggaacactacccagaagctcctccctcgagtgatgtaacaaggagctga

SEQ ID NO: 1752 - DNA, 387 bp, A.fumigatus
atctcctacgccagcatcatatataatctggcaatcgttccctaccccgccatgttttccgtcattgtccccggccgggcctgcctcacagacattgtcgcggtagatgcacagcccaacgggcaggccacgaaattcgccttcactttccccctcaaccctcccttcacagaaatcgtcgtattcttcttgccgggcacggtcctcccgcaagacaccgccgcagcaatctacatccaattacccgaatccaccccttcacccaatgggccaccgttccggttcattggcgcattagccaacgagaaaccttccgcagtcttcaaagtccaaaggcgggtcctcaccaacaccgccccgccgctcagaaaccgaagagcaagatga

SEQ ID NO: 1753 - DNA, 747 bp, A.fumigatus
tgctgtgctcggtacatcttcaattcggtggtggaaaagttctactggccggaggattgctggtcggttgactttacagatcgaacagtcacactcgttacccttcctaatgcgacagccgaccagcggagccaactggtcgcagaaaccttccgggaagtagtcaagaggggaccctttgacatattgaaaggatggcgcaacgagctttaccctgtttacggcccaggcggagagttcctgttggaaatggaacgaagcgcaagtccactcttcggcatcgtttcatatggtgttcactgcacttgctacgttgaagacgagcatggactacgcatctgggtcccgaggcggtcccggacgaagcaaacgtaccctggaatgctggacaactccgtggcgggcggaatgagcaccaaagagaatccgtttgagtgtttggtccgcgaggcgatggaagaggcgtctcttcccgaggatgtggtcaggcaaaacgcccgctccgttggatgtgtcacgtatgtctatgttcgaggagcgcgggctggaggcgaaaccgacctgctgcagcctgaggttgaatacgtttacgatatcaagctcaacgctgacgttattccgagaccctgcgattcagaggtcgaggagttcaacctatacactatcgaggagaccaagaaggcactggcaaatggcgaattcaagcccaatcttcaccacggggctggacgatccgcgcatgcatta

SEQ ID NO: 1754 - DNA, 309 bp, A.fumigatus
attattttaagcgcggatgctggccatccctctgtggtgaagaactatcgtagcggtggcattggcatggagactctgcttatggagtatgcagcttcaaccatgatgctcatcaacatgttggtggatgcgccggaaaatgacctacaattgcgatgccacatccgggcccacttcatctcctgtggcaccaaccgtctcttgacgaagatggaaggcttccaatacgaagtgattgataagcagatcgagcggtccagagaaaatgaggccattgactacgaggatctccttcagcgagagcagtag

SEQ ID NO: 1755 - DNA, 1503 bp, A.fumigatus
  unsure (1177),(1252): Identity of nucleotide sequences at the above locations are unknown.
ttgataagcagatcgagcggtccagagaaaatgaggccattgactacgaggatctccttcagcgagagcagtagcagtatgaaggatagcatcgagggcgaggtgaaggacatgagcgatcccctgcaaatcactgatgccattctaaccagactcaatgggactcgtgcctatgattacttcctttccgctatgcagcacatgcttctcatacgcgagaactcgggggaggacggccttcgaatgttccagcttgtcgatgccatgctcagctacgttgccatggaccggagactacctgatctggattttcggcaagggttaacttttacagtacaaagtctcctggacaggctccatactgatgcagaggcaaggcgagcatatgacgagtcccttgaggcgcggcagatcgcggaggccgcaattgcggaacgggacgagatgaaggcgcaagtggagatgggggcggatggtctcgtgaagaagctgcagaagcagatcgatgaacaaacgagcatcattgagcttcagactaggcagaacgacgcactcaaggcggagcttgccgatgtccagcggctgcgtgctcaggagctgcagcggaatgaactggaaaccagagagctctatctgatgctccgggacgctcaggatatcgctgcatcgaatgccaagaagaataatctggccgagaccgatccatcgcacatgaagggtatcctggaacgggatagaatgttggagcggttggagaaacagcttgagcggacgaagacgcaattcaagctggagggcaaagtttggggccaacatggaccttctgatcgactgcgcgagctacgggagcagatggacggcgaacctgaccctgaggactttcaggaacaagctcgtcgaaacttggaaactagtgctctgggttctgttcatcgcaaaagaagccatgttccggagatggatgttgccaacggtcaagagaggccatcacaccaggatgggccacttctcgtcaactttggaagaccccgaatggatccggagcaagcgtctgatttgctgggggagattgcttctaaagttccaaagattgacgctgaagatgccgaaaccgacgagtttaatgctcaaccaactcagcttgagactgaagaagctcgggtcggtcaggttgaanaagtcaagcccgaggatgagactgaaaagcccgaagagaaacctgtatccgtgcctgcacctccccctcctcccncctcccccaccccgccacctcctccaggtggtgcggtaggcattccgccgcctccaccacctccaccacctccgccgccgccgccgggtgcccaaggtttggggagttccgcctccggcggctcctccaccccctcctggctttgctggaaggattgcctccacccccctccggcccccgccaggttcggtttggaaaaacccctaccaccttccgccccccctggtgtttggcggaaggttggcgaattc

SEQ ID NO: 1756 - DNA, 468 bp, A.fumigatus
  unsure (204),(279): Identity of nucleotide sequences at the above locations are unknown.
gggtttttccaaaccgaacctggcgggggccggaggggggtggaggcaatccttccagcaaagccaggagggggtggaggagccgccggaggcggaactccccaaaccttgggcacccggcggcggcggcggaggtggtggaggtggtggaggcggcggaatgcctaccgcaccacctggaggaggtggcggggtgggggaggngggaggagggggaggtgcaggcacggatacaggtttctcttcgggcttttcagtctcatcctcgggcttgacttnttcaacctgaccgacccgagcttcttcagtctcaagctgagttggttgagcattaaactcgtcggtttcggcatcttcagcgtcaatctttggaactttagaagcaatctcccccagcaaatcagacgcttgctccggatccattcggggtcttccaaagttgacgagaagtggcccatcctggtgtga

SEQ ID NO: 1757 - DNA, 339 bp, A.fumigatus
  unsure (254),(329): Identity of nucleotide sequences at the above locations are unknown.
gggaattcgccaaccttccgccaaacaccagggggggcggaaggtggtaggggtttttccaaaccgaacctggcgggggccggaggggggtggaggcaatccttccagcaaagccaggagggggtggaggagccgccggaggcggaactccccaaaccttgggcacccggcggcggcggcggaggtggtggaggtggtggaggcggcggaatgcctaccgcaccacctggaggaggtggcggggtgggggaggngggaggagggggaggtgcaggcacggatacaggtttctcttcgggcttttcagtctcatcctcgggcttgacttnttcaacctga

SEQ ID NO: 1758 - DNA, 273 bp, A.fumigatus
caccggcgacggtatactttctcgcactcagattcaaggaccaagctgacggaatatgcagattgcgtgtccttcaagcccaacagcaccaacatcctcgtacagaatctacactgcaacggctctcacggcatctccgttggctctctcggtcagtacaagggcgaggttgacattgtgcagaatgtcctcgtctacaacatctccatgtacaatgcatcggtaggagtctcacgccttcctgagtttctactagctaacagcttcttctag

SEQ ID NO: 1759 - DNA, 228 bp, A.fumigatus
gatggtgctcgtatcaaggtctggcccggtgtctcgtccgccatgtctgaggacctgcagggcggaggtggccttgggtcggtgaagaacgtcacctacaaccagatgtacatcgagaacgtcgactgggctattgaggtgacccagtgctacgggcagaagaacctgactctgtgcaatgaataccccgtacgtcccttctttctaatccataatgatcattactga

SEQ ID NO: 1760 - DNA, 300 bp, A.fumigatus
tggagtcatgcttccgatggaatgagctggcaaccaataatcaagtcctattatcagacactacctcggtttaaagcagtaagtgcatattctatcccagacgagcacctatgcgcagttaacatccagaaggctcttgtcgacctagtaaacgcggttagtttgtcgcataccctctctaggcgcaggacttacattggtgcagacgaagttatccgttcccttgggactcttcacgtcgatgttctcagcgtagatgtcagagcaaacctaagggtattagaaccgctgcttctgtaa

SEQ ID NO: 1761 - DNA, 546 bp, A.fumigatus
accgaaactcccgacggtatggcccggggtttccgcggcaaaccatcccaattccgttccagcttcaaggtcaaccgagaagcacgcgagaagcccctccgggagtttgtcccctacttccgtacggaagtctcgccacatgcctgcatttaccttgcgcccgagcgggacacggtgcgcctaggagaagcggtgctagcctatcttggcgaggccgagcgccacgctcttcaacgcatgatcatcgaggttaatgattatttattgtttgagacgtatggattggagagtctagggtgcatgcagagactaaaggaggtggacttgattgtctcgcagacaccggtggcttcgtaccaccggcgtgatattgttgaagtgattcgagatgcttttcaggagtatgtgagaaatcacacacagtggcagatacctcacgtcagggtggtgtctgctttgggaaagcagatgggcagttttaccatcgatcctgcagaaatggataccgtacaaccatcggtccttttcgatggacatgcgggatga

SEQ ID NO: 1762 - DNA, 675 bp, A.fumigatus
tttctcgctgccatgaaccccaacagtatccatcagggtgaccctgagggagaactgtttctcaattccgcgagtcgaccgccggcagagtctcctgtggtagggccgttacgcatcagcaaacgagatacaccttcaccagcatcccagggctctgcgccgcttccataccctgatgaccggccccgactgggccagatgcgcagctcgtctggttccaccgggtcaagtccgacggctggtgaatctggcagacatgggtcccctatttcatccgttaataacctgtcctcgatgccggcaggctccagcgcaacgagaccctcggagtacccggcagctctccgaccgcgggacggtcgcgagcccaagccagctacgttggccgaaagacggggcaataccgctcccaaaccattaccagaatcgccaggtccagatgcgccagacagagaagccttgtttggccggaaatatcagcgccttccggcgtcttcggccctatcgtcggatggaatgcagcgggaggaaggtattgcatatccggattatcagcagcagtattggccgccgcctcaaccatcgactccatctgctctctctacgcgggtaggggtgtcgcagagtctacaacctcctgtcttcaccacggggctggaaggagcgctgccacta

SEQ ID NO: 1763 - DNA, 273 bp, A.fumigatus
  unsure (26): Identity of nucleotide sequences at the above locations are unknown.
tggcggcgagctacaaaggtcctgtntatctctattctcgcccatgcagcacaattcgctttcctggtcttcgtcgagaatccgcacatagagaagacatacaacccgccaccaccccgaaagcgaactatcgagcaggataatgtatctatcacccctcagagatctgattcgcccagcgcgccagcttccgtggatgaacaagtgcccatgcgccaagttattcagcggtccactccatcggttcacaaactcctgggctttcggaaacct

SEQ ID NO: 1764 - DNA, 816 bp, A.fumigatus
  unsure (751): Identity of nucleotide sequences at the above locations are unknown.
cttaccaactcaatagtgtgtacggtgcctcaaacgcaggacatggtctctcaactaatatccccctcggaaccaaagaacctgtcagatgtcatcgtcctagctattctcgctgctcatattcttctcttatggcgacttcccgcgggggtcaaagtgcccgtttttgccttcatctacctcttttggcgcggtgcctacaatgctgggatcggatggctgcttcataaccagtcgaaccaccgaacgctcgtccgttgggccgagaagaccaagatcttcgtgaatccggccactggccaaaatcctcatgctaacttatacaagttgatcaagcgtgaattggagaccaagatcccagctgactactcgttcgaagatgctccaattgagtacaacacctggctcgtcttcagacgacttgtcgatctgatcttgatgtgcgacttcacctcatattgcctctttgcgatagcctgtagccaacgtccctttgatgagggcactctgatgactgtcttgcggtggtccgcaggcatcgtcttagtgctcttcaacctttgggtaaaattagacgcgcatcgagtggtaaaagactacgcctggtactggggagactttttctttcttatcgaccaggaattgacctttgacggtgttttcgaaatggcgcctcatccaatgtactccgttcggttatgctggatactacggtatctcgctaatggcggcgagctacaaaggtcctgtntatctctattctcgcccatgcagcacaattcgctttcctggtcttcgtcgagaatccgcacatag

SEQ ID NO: 1765 - DNA, 279 bp, A.fumigatus
  unsure (173): Identity of nucleotide sequences at the above locations are unknown.
tcaaccaccgaaccgccgataccaccgaaccgccgcttcgccgcgaatatcatcgaattcttggagccatctaatcaacacattatttctttaccactattattaaaaatgccactatccaaagagaatcgaatgcagatggccatatcagcatataaaaaggggcaattcanatcaaaagcagccgctgctaaagtctttggggtgtctaaaaagacccttcctgatcggctttgcggaatcaaaaccacgcgcaaaaacacgcccctaatagcctaa

SEQ ID NO: 1766 - DNA, 984 bp, A.fumigatus
  unsure (964),(968): Identity of nucleotide sequences at the above locations are unknown.
tattcgaatttctggcaaacagacttctctcgatatccttgcctcatttgccgtgactttctcagcggggtcgtttctctcgtcgctccttctcagcaagcttccttagcaacgctctttacgtacacgacacttcgtttcatcatgttgaactccatcactgagcttcctgagggtgtggcaaaaaactctgaaatccacagcctggcaatacggatcttggtggtggtgtttaactcgatcgctctttacaatgccgttgagctcgtgattctcattttccttacgttcaatcgctacagtggcctctacttttggagtcttctattgtcgggtgtacttggggttattccccacgctgttggtcacctgctgcagttcttccgtattgggcccattggtctcgccatctccattgccactattgggttttacttcatggtgcccggccagtcgtttgtgttgtactcgcgacttcatttggtggtgcagaatcagaaacttcttcggcgcgtactgtacattatcatcattgactccatcgtcctgctgattccaacgactgttctcaactatctgaccgtctacgtcggcacccagcccgttatcaaaggatacaattttgtggagcgaatgcagatttcctggttcaccgcccaggaaatgttcatttctggaatctatattgtggagaccatcaagttgcttcggttgcggccggacaaggcatcgagccgaaacaaaatcatgtatgagttgattgctatcaaccttgtaatggtactcttggacgtggctcttctggtcttggagtatcttcgtctctacacactcccagtcacactcaagggcgccgtctacaatgtcaagctcaaactcgaatttggcgtactgaagaaactggtctctctcatccatgctcctcaagtctcgaatttacaacgacgtcgaatgagtatcccancttngtcgacccatctcgaa

SEQ ID NO: 1767 - DNA, 261 bp, A.fumigatus
tgtgttcactcctttgctgaatctcagagagacaactacctctttgccgcaaccagcgactcagctattgccaaagcggagggtgtcaagcaaccctccatcgtgctctacaaggactttgacgaaaagaatgctgtctacgatggagcgatcgagcaggaagccatcctcagctgggtgaagactgccagcacccctcttgtgggtgagatcggccccgagacctactctagctatattacggtatgtttttgtccctaa

SEQ ID NO: 1768 - DNA, 444 bp, A.fumigatus
gccggtatccctctggcatacatcttcgctgagaccaaggaggagcgtgatcagtatgcagaggacttcaagcccgttgctgagaagcacaagggagccatcaacatcgccacaattgatgccaagatgttcggtgcccacgccggaaacctcaaccttgaccctcagacattccccgctttcgctatccaggatccggagaagaacgccaagtacccttacgaccagtccagggaattcaatgccaaagaaatcgggaagttcattcaagatgttcttgatggcaaggttgagcccagcatcaagtctgagcctattcctgaaacccaagaaggacccgtcacagtcgtggtggctcactcctaccaggacattgtcatcaataacgacaaggacgttctcctcgaattctacgccccatggtgtggacactgtaaagcgtga

SEQ ID NO: 1769 - DNA, 537 bp, A.fumigatus
gctaacgtgtcttttcatagtctggctcccaagtatgaggagttagcggctctctatgctggcgacttcaaagataaagtcaccattgccaagattgatgctactgccaacgatgttccggattccatcgccgggttccctaccatcaaactctatcccgccggtgctaatgattctcccgttgagtattctggctctcgtactgttgaggatctggcgaacttcatcaaggagaacggcaagtacaaggtcgacgctcttgtggctgcctcagagaaggttgaagaacggcctgatgttaccgcttctccctcagctacatccaccgacgctgaagctcctgccgctactggcgacgagaagggcgaccatgatgaattgtacactaccactttagctgaaggacgtcgatttagtatccaaatttcaagcttcatgattatattctaccccagcagattttactttcccctcagcgtgtcgagcgggccaattcccaaggaacctcactacccggcagacaagatcgcccactag

SEQ ID NO: 1770 - DNA, 450 bp, A.fumigatus
ctaaaatcatttgctgactcggattctcgacagcctttcagcgattcgtcttcactggccagacaccgcagaatccattctgggaaacggccgtacaagtgtccttatgcaaactgtcagaagacgttcactcgtcgtactaccttgacccgtcatcagaatcatcacacgggaactattgaggaggctgctgcagagacagaagccaacctgagacagaacaaagagagggtaagggcacctggtgatgggggtttctccgagcacgcctctgttcactcgacaccttcccctgcacaccatcctgtgtccattccgcctcccggtgacctaccacctctgaatatgcctcgttctgctggcgactactacatggggaatggatctattcctcctcacgttcggggtgatttctcgcaggccagtcctcgctcctcgccgacagccaca

SEQ ID NO: 1771 - DNA, 255 bp, A.fumigatus
ggcgtagcgacctcgctagacatggtaagatttccatgggaatacatgcgagaagtaaaacatcaagccactgaccacattctagaacgaatccacacggggataaggccgcacgcttgcgattggcccggctgtgggaagcaatttattcaacgttcggctttgactgtgcactctcgtgttcatactggagagaagccccatatgtgcgagagatgcggcaaggtatgcagatatactgtgttctatagctaa

SEQ ID NO: 1772 - DNA, 189 bp, A.fumigatus
cttatactaggaacttatctagatattacttttattatatctaagctagcttactttactaggaatcctagccctaattactttattatagtaaagtatatattctactatctagcagggatgcttttacttttattattttattcttttatacttagtaatcttaatagttttgttaatactagttag

SEQ ID NO: 1773 - DNA, 765 bp, A.fumigatus
ttcttttccatcttcggtgtagataaccccgcgctcaacacagtacccttgatcgtcatcgtggtcgcgacagctatcaaagacgccatcgaagattggcgccgtaccgtcctagacaacgagttgaataattctcccgtttatcgcctagtagagtggaacaatgtgaactcgactgaggacaaagtttctctctggcgtcgattcaagaaagcgtgtacccgtgccactatctccacataccgatggattcggcgtctgatgaagaaaaacaaggatgtaccgcaaatgtttcaagatgaacggcgcgcctcaattttgacgactgtaaccccgcgagcgtctgtgtattcgcaacgtggtgaccatggtatggaagaggacgcgattcagatgactcctgttccatctccctccgcggaggctcgcgcagattggccactacctgctggtgattcggatcaattccttcatccggacaagcgaaatagagacagtttacaagcggttacatcaccagtgacaccaccgcgaaaaggtggtagtgtggtggatccctcgaagcagacaatcggcaaggctagattcaagcgcgattattggaaaaatatccaggttggggattttgttcgactatacaacggagaccctattcctgccgatattgttgttctctcgacttcagatcccgatggtgcttgttacgtggagaccaaaaatctaggtcttcaccgcgggtctgaaagggtccgttctatggggaat

SEQ ID NO: 1774 - DNA, 594 bp, A.fumigatus
tatttcaagttattaaacacccccgaatccttcacttataaccaattacaaagcccggaccacccaaaggcagcggcaacccacagcccccacccaagttacaactgcgggaattcccgcaccgttccctgtctcagtagcaccagcagaaccagtagtcgtcgaagccacactagacgagcttcctgctttgacactcgtcttcatcgtctccgtcgcactggcagtcgtactcggcgcagcggtaatccgcagactactcgcctcgctcgacattgtggtcatcgcgtcccctgtagtcgacgcgctcgccgtcgcagcaagcgtaggtgtagacgcagccgcaccaggcccatacccagggagatagctcggctcgtaggtcgcggtaccggtgtacagctccgggcaagcgggattatcatgcttgggcggggcgcggccgccgccacagtcggggatgtcgcagatttcgcctgtgtcggggacgtaccagatcatgctggcttcgttccattggttgcgggtgagggaggagatacagcctctcaggtcggtgcgggcggagacggtggaggcgagagttgtcgctag

SEQ ID NO: 1775 - DNA, 624 bp, A.fumigatus
cgtactgctccgtacttcgcatctgatacccctcttctacgaaccctctccagcaaaatgagattcttcctccttctagcgacaactctcgcctccaccgtctccgcccgcaccgacctgagaggctgtatctcctccctcacccgcaaccaatggaacgaagccagcatgatctggtacgtccccgacacaggcgaaatctgcgacatccccgactgtggcggcggccgcgccccgcccaagcatgataatcccgcttgcccggagctgtacaccggtaccgcgacctacgagccgagctatctccctgggtatgggcctggtgcggctgcgtctacacctacgcttgctgcgacggcgagcgcgtcgactacaggggacgcgatgaccacaatgtcgagcgaggcgagtagtctgcggattaccgctgcgccgagtacgactgccagtgcgacggagacgatgaagacgagtgtcaaagcaggaagctcgtctagtgtggcttcgacgactactggttctgctggtgctactgagacagggaacggtgcgggaattcccgcagttgtaacttgggtgggggctgtgggttgccgctgcctttgggtggtccgggctttgtaa

SEQ ID NO: 1776 - DNA, 402 bp, A.fumigatus
cttcaggatgctccaaataggttgtacaaaagtttctcttgtagaacggtctctaccatagctgcttgctggtgcccggacgttcctccccctaccctctctggtcctccatggcgggaacggacaacttgtaacgccctttctgcccgcccaggtttctgcaggcttttttccctctgcctctcgtgtctgttctttcttctcctcttttcctccccctatttccccgtcatagcgcgaaacagaggactcagagaacagccggcgagaagaaagaaccccacgcaaggaaagacgaatcagtcgaccaactttccggggccaggtataagcaaaaagcaaaccagattgctgagattcatcaatacttgcccgttcctcggtgcaccatcagctgattag

SEQ ID NO: 1777 - DNA, 213 bp, A.fumigatus
ccgccttcttccgagcgctcattattctcactttctcgcggcaaagcgcaagacccagaaccggcacgcagacccatccattacctcgtcctgccctggaaccctctgtccggcgtatttacgcctggtggtagcttcgtgtcattattttacttttgttttaataatcctttaatttacctctttggagttccttggtatgtttttccctaa

SEQ ID NO: 1778 - DNA, 738 bp, A.fumigatus
agactcttcaccatgctgtcttccatttcaggcgtcataggccagaagggacaagccaactacgctggtggcaatgcattccaagacgcctttgcagagtatcgccgcgcattggggctgcccgccatcagtattgacctcggacccgtagaagacgtcggagtcattcacggtaacgaagacctccagaataggttcgacggtagcactctgctcagcatcaatgagggcctgctgcgccgaatctttgactactcaatccttcagcagcatccggatccacagcaccgtctgaacgtcacgagccaaggccagatgattaccagtatactcgttccccagcctgaagacagcgatctgctcagagattgccgctttcgaggcttgcgagcccttggagaacatagtccacgctcacggcgggaccctaccaaagataaagagatccagagcctcttgtttctggcccaatcccaggatcccgatcgtgcagccctgcgcgccgccgctatcacggtcgtgggtgcgcggctggcaaagcagcttcgcttaacggatgcagtcgacccggcacgtcccttgtcctactacgggttagactctctggcggctgtcgagctacggacctgggtgcgtatgacactggcgatagagctcaccactttggatgtgatgaatgcagccagcctgggagaattgtgtgagaaggtgattgggaaaatgggatttggcatgtag

SEQ ID NO: 1779 - DNA, 228 bp, A.fumigatus
gtagtcaaagattcggcgcagcaggccctcattgatgctgagcagagtgctaccgtcgaacctattctggaggtcttcgttaccgtgaatgactccgacgtcttctacgggtccgaggtcaatactgatggcgggcagccccaatgcgcggcgatactctgcaaaggcgtcttggaatgcattgccaccagcgtagttggcttgtcccttctggcctatgacgcctga

SEQ ID NO: 1780 - DNA, 204 bp, A.fumigatus
  unsure (11): Identity of nucleotide sequences at the above locations are unknown.
ggggggggggnagaattaaattcttccatgccgccgttaagacaagtcacgctgttcgtctcgtgggccgacagttccaagaaggagtacaatacccttgaatgccgcggcacctacggctgcgtcaagtacaagcgcccggttggatggaaggacggcagcttcaccgccaagccttaccgatacatccgcgttgtggactaa

SEQ ID NO: 1781 - DNA, 186 bp, A.fumigatus
gttagcaactttatccaatggcatgatgatcttatatctaaatatacccacaaatatgattaccagcgtgcaaaatataaggatccagaagtcatcaaccaatggtttaatcttgttaagaataccatagtaaaatatggcattcttaagcaggatatctataactttgatgagactggcttttaa

SEQ ID NO: 1782 - DNA, 1122 bp, A.fumigatus
aacgatggagagtcgtggtcgtcgcttcgatcgactgtgcagacaaggaagtttacacccttcttccttgcaagctgtattgagaaagacccagaatgcctgtctgagtgtaggcatttgatactgagcatgtggctgtcaagcttggtggcacgggtatcgatgttaaaattccagcatcgtctcacggaggcgctattaaacctggacaccatgaacccgttattgcacaacttaccgttctcaaaagatcggcagaatgatcggtattcgatttcgttggacgatctcggtcaacgaaggctgtcacttctctcgagtctactttcaaacatgcgagcacatgtgcagggtctggaagatacggaaagtcgggagctgtcaagtacgaggcgggactacagagaactgattcagcggatgatggcatccatgaaggcgaactaccaggagctgggcagtggaggagccagcgcacaaggagcttacgttgactttgtccatcggatcgttgggttcctgcaacaatacagcagggatatctgccctattgatccattcttcactgatcctacctctttcccactcccgtcggcggatccaacctacattgtcgccagactcaagagctacgaaccgaagctttgttctgagaaggtagtgaagaccttgattgtgtttgtccagggtgtatcggagagagcagctatcgatgggcagcaagtatatctggttgaccagctccatacgtccatggcagatatctacgaaactggagacccatgtaagcctactttgcgtgcagttctcctacaatgcgtgttttccgcctatatcgagtgcgctttcagcaatcctgccgcatggctcctcagtcgaccgattatacagacggtgtctctcgtcttcagagacttgctctttttcatggatatcacggatgcaatgtgtcggtcttccgtcttagctagtcttggtgctgtcttccggtcatcctaccaagcctttcagtatatcacggggtaccccctcatgcctaccgattctaccgtgattgccacacttactaattctgttgaaatggttacctctgccattccagttgtcgaatactttgatcca

SEQ ID NO: 1783 - DNA, 357 bp, A.fumigatus
acaggtcaacgcgatgcccttacctctcattactcacgagtccggacagcggctttggagcactgcgttaaacgccaaccgaatcaatcacaggaaaagactcgccgtgccctggctaatataacaatgcttctcatgcagaagtatctgaagccagatggtgtcgttggaatcgacaatactcgctggcaggcggaccccatattgttcctgtcagcaactcagtccgtctcgaccgtccaggagttaacaaaggtcagccaggccttctacgcccgttcagaatactctcagtaccctacagatctaccgccacccctaatttaccaaacacccctggtctgcacggcaccttga

SEQ ID NO: 1784 - DNA, 195 bp, A.fumigatus
aaaacgcctttcacattcaagcttggcaagggtgaggtcatcaagggctgggatattggtattgctggcatggctgtcggtggtgagcgtcgtatcacgattcctcctcacctggcgtacggcaagaaggctcttcccggcattcctgccaactcgaagttgatcttcgacgttaaactccttgagatcaaatag

SEQ ID NO: 1785 - DNA, 285 bp, A.fumigatus
gatgaaataggtgcggaggaaggcctgcttaagaattatctactatatatatatctagcagagtttatagacctgtataataatagtgaaacactgctaatagagtacctagtatatcttaaactctcagtgcttctagggctagttattattattactattaccatcctagccctaaagtcaggcaaaaagtatgttaaggctagtaatctttatctttattccagttataaagtgcaggttagatttcagaaagctattataaaatacctaagtaaaatctag

SEQ ID NO: 1786 - DNA, 732 bp, A.fumigatus
acagtttgcttacaccccgatagcggccctgtcatggtgaccgaggcgctcaagccatatggtgccgaggacatgacccttcattttgtctccaacattgatggcagccacattgccgaagctctcaagcactccgaccccgagaccacccttttcctgattgcttccaagacattcaccactgcagagaccaccaccaacgcaaactccgcgaagaagtggttccttgaatctgccaaggatgaagcccacattgctaagcactttgtcgctctctccaccaacgaggaggaggtcaccaagtttggtattgacaagaagaacatgttcggcttcgcgtcctgggtcggcggtcgctattccgtgtggagcgccattggtctctctgttgccctctacatcggcttcgacaacttccaccaattccttgctggtgctcacgccatggataagcacttccgcgagacgcccctcgagcagaacattcctgttctcggtggtctgctcagcgtctggtacagcgacttcttcggcgcccagacccacctcgtagcacctttcgaccagtacctgcatcgcttccctgcctacctgcagcagctctccatggagagcaacggcaaaggcatcacccgcacccggagaataccgtcaagtacaccaacgggccccatcctgtttccggtgagccttgccaccacggccaacacagtttttttcagctggtgcacc

SEQ ID NO: 1787 - DNA, 384 bp, A.fumigatus
  unsure (42),(78): Identity of nucleotide sequences at the above locations are unknown.
gaagttcaagcggtacctttgcccaccccggttgacaacacngagatctttttcgatttttccaagaatttcctcacngaggagacccttgccttcctggtaaagctcgccagagaagccggtgttgaggaactccgcgatgctatgttcaagggcgatcccatcaatttcaccgaggaccgtgcggtttaccacgttgctttgcgcaatgtcaccaacgagcccatgcaggtcaacggcaagagcgtcgttgaggatgtcaactccgtgcttgagcacatgaaggagttcacggagcaggttagaagcggcgaatggaagggttacacaggcaagaagattacgacaatcatcaacattggtatcggtggttctgatctgtaa

SEQ ID NO: 1788 - DNA, 642 bp, A.fumigatus
cggtattctccgggtgcgggtgatgcctttgccgttgctctccatggagagctgctgcaggtaggcagggaagcgatgcaggtactggtcgaaaggtgctacgaggtgggtctgggcgccgaagaagtcgctgtaccagacgctgagcagaccaccgagaacaggaatgttctgctcgaggggcgtctcgcggaagtgcttatccatggcgtgagcaccagcaaggaattggtggaagttgtcgaagccgatgtagagggcaacagagagaccaatggcgctccacacggaatagcgaccgccgacccaggacgcgaagccgaacatgttcttcttgtcaataccaaacttggtgacctcctcctcgttggtggagagagcgacaaagtgcttagcaatgtgggcttcatccttggcagattcaaggaaccacttcttcgcggagtttgcgttggtggtggtctctgcagtggtgaatgtcttggaagcaatcaggaaaagggtggtctcggggtcggagtgcttgagagcttcggcaatgtggctgccatcaatgttggagacaaaatgaagggtcatgtcctcggcaccatatggcttgagcgcctcggtcaccatgacagggccgctatcggggtgtaa

SEQ ID NO: 1789 - DNA, 432 bp, A.fumigatus
  unsure (316),(352),(399): Identity of nucleotide sequences at the above locations are unknown.
gtagcagacttacagatcagaaccaccgataccaatgttgatgattgtcgtaatcttcttgcctgtgtaacccttccattcgccgcttctaacctgctccgtgaactccttcatgtgctcaagcacggagttgacatcctcaacgacgctcttgccgttgacctgcatgggctcgttggtgacattgcgcaaagcaacgtggtaaaccgcacggtcctcggtgaaattgatgggatcgcccttgaacatagcatcgcggagttcctcaacaccggcttctctggcgagctttaccaggaaggcaagggtctcctcngtgaggaaattcttggaaaaatcgaaaaagatctcngtgttgtcaaccggggtgggcaaaggtaccgcttgaacttctcaaancgccgaagggtcctcctcaaaatattcctttga

SEQ ID NO: 1790 - DNA, 462 bp, A.fumigatus
  unsure (392),(418),(425): Identity of nucleotide sequences at the above locations are unknown.
ttaggcagtccttccgcgtcgttgttcacatcctttggcttcaaccaacccaattacaccagttcgcagctaatggtcattgactttcttttcaaattgcagtgcagcggcggaccaccaccatgtaattcttgcaagaccgcggatgccgaatgcgtcttcgatgagtccctagacctaaggcgaaaggtcgcggctaaacgaaacctcgaggagttgtcctattaccgaagcctgctatacgctctccttgagtcgcttcgcaattcagacgagaccgaattgaacgaaatcctggatcacatacgcggttccccatcgctcaacagcattgcggccatcgtggctaagccgaccatagacccaagcgatgtcagttccgaggacctcanaggtgggtctgaggagtccagctcgnaagctgnaaccgcggaacccgtatacctcgatatacactcttga

SEQ ID NO: 1791 - DNA, 225 bp, A.fumigatus
  unsure (68),(75),(101): Identity of nucleotide sequences at the above locations are unknown.
gaggatatcgcaaggtttctccatggttattcaagagtgtatatcgaggtatacgggttccgcggttncagcttncgagctggactcctcagacccacctntgaggtcctcggaactgacatcgcttgggtctatggtcggcttagccacgatggccgcaatgctgttgagcgatggggaaccgcgtatgtgatccaggatttcgttcaattcggtctcgtctga

SEQ ID NO: 1792 - DNA, 507 bp, A.fumigatus
actgaattcgacgaagtggccatggctagtaaagcgctcaatgagctttatggatataagctttccaacagtaccaagaccgggattcgcctgagtttctccaagaacccattgggtgtccgctccggtcagccgggtagcatgaacgcgtccaatcacctttccgcgcaaggctcgattcctggtggtagcagtctcggcggcatccacagtcatatgttctcgacggtaagcggtccaccgcctgggcttgctgcgccgccgggactggcgatgcccatggctttgagaaacaatggggccatgcacctgccagggaatccccacgcacctatgcccaccaacgggtcgtttaactcaaactctggtttggggatcagaggaaacaacatgaattcgttgatgtccccgactccgcccctcacggggggtgtaggcggcacttctaccggatcaaacgtgggaggcttcaattctttctatcctgactacatgctgggtcggtag

SEQ ID NO: 1793 - DNA, 228 bp, A.fumigatus
ctgcagcttcttgaggacacacaatataatctcatcggcggtcttgcaatgcttgatatccagtaccttggtctgtccgccggtatatatgaccctaataactggcgaatttgcgggcaaagcacccattgtcagtccatcaatgctggggttttgcctcagatgtacgccacctttgtggccatggctaccatcgctaggtgttcctgggtttcggccagaatttga

SEQ ID NO: 1794 - DNA, 1155 bp, A.fumigatus
acagtgctcgggaaagagggttatttcgctcatccttccactggcggctcaaattctggccgaaacccaggaacacctagcgatggtagccatggccacaaaggtggcgtacatctgaggcaaaaccccagcattgatggactgacaatgggtgctttgcccgcaaattcgccagttattagggtcatatataccggcggacagaccaaggtactggatatcaagcattgcaagaccgccgatgagattatattgtgtgtcctcaagaagctgcagctaccggagcaccagtatcgcaactattgcttctacgtgctggacggcttggaaccagatccttcgaactgtaggcgacttacggatcaggagctcatggagatttgcgaaggatcaagtaggtccgagcgcggacgtctcattctgcggaaaattcacgctggcgaaccggatactgatgagcttcgtcgtgcttcccagcttgcgttggatgagagccaaatgacacacatgaatgctctgagcagttcaaatgtgcgcaaccagattaaaatacagcaactcacaggtgaaccctggcatcacatcaaacaacctttgtcgcctgtatctgctcggcaacctcaggctcataatgaccatgaccagtctctccaaatgagcactgaacgtccctctgtggccaagttgcgatctttcttcggggctcgcccacctagcgaaatgattattcatgaacttacatcatattttcccggtcatcagcgtgaggatattgaaaagaccatgcgcatgtcgatccggagatctcaacgtctcagccgagcagcaagtcgcctgagcgtcctcagcaatacaagctatgcatcgagcttgagggatgcccccccgattccgagtatcgctgacacctggctcaatcctggagcaccatctactcgcgcctcgaggccgctctcggtttcccgattcaatctcccgcaaacatcatatagggattctatcgcctcaagctctcttcagcctcttcaagaggagtctcctattgagccgaatcgcaaatcatatgtttcctttgatagtggctcagatgatccgagtaactctcgccaaagccttcttgatgttttcaccaagggagccggacaccggcaagca

SEQ ID NO: 1795 - DNA, 450 bp, A.fumigatus
gtgtctacctttatcaaacgacgtgacgagatcaaaactcaatatgctcgacgatacaattatagtcgagctcaatgcgaggatccaaaggttatcaaagggtggtttaactgcctacaacagatccaaatgcaatacggcatctcctatgaagatatctacaactttgatgaaacaggcttcgcgatgggcttaattgcgactactaaggtagtaacaagagctaatatgcctgggaagcctcatctcattcagccaggcaatcgggaatgggttacaacaattgaatgcattaatactactggctgggtgcttccttcttgtataatcttcaaggggaaggttcatatcgagggatggtatcaagatcaggctttatcacctgattggagaattgaagtcagtcaaaatggatggacaacagatgagataggccttcgatggctttaa

SEQ ID NO: 1796 - DNA, 768 bp, A.fumigatus
gtttctacttgctttccctctgacctggttgtgttatgcattctgacagaggaccggtgttgtcatagaacatttgcattcgttgtaggattcagcacatttcttacgaattgcatcgactaccacaaggtccgtgggagcaagtcattgaatgatatattgatcaagcagtgtaccaccaagatgtcactgtcgtccacctttctgctctggttactcacgctgttttggattggaaaagccttccagtgcttgttggatatcacaaagctgaaacacatgcatgacttctattattacttgcttggagtctctgataccgacattcagactatatcatggcaagaaattgtcagtcgactcatgactataagggacgccaatcccgcgacagccggtgcggtgtctgcgagacaccgtaagttcatgggcagtcagtctaagcaacgaatggatgctcacgacattgccaatcgactgatgcgtaaggaaaattatcttatcgccttgatcaacaaagacatattggacttgacgcttcccatcccgtttctcaggaacaagcaactgttctctcggacgctggagtggaatatcaatctatgtataatggactatgtctttaacgaacaaggccaagttcggactctgttcttgaaggatactcaccgaaaggcgctgagcgagggcctgcgacgacgatttattttcgcgggcattatgaatatattcgtcttcacccacggggatgggcggatccgcgcttaa

SEQ ID NO: 1797 - DNA, 189 bp, A.fumigatus
acttccagcccccatgttgcggacaacaccgacaatagtcttgggctgcgcagcgtggctttggagtttctctatggcctggagacactgggagccatcttcgctcgccacatgaatatgactgagcgactatttgaaatcttcaaacaaatccgtcttcacgacgaggcgccggtaccgcgctatgtc

SEQ ID NO: 1798 - DNA, 759 bp, A.fumigatus
cagaccttgatccaggctgctcctgaggcagatccggaaacggggctctatcggctccgggatccatcactaagcccaacaggttccgatacaagcactgtcggtaaatcaggagctaagtctggtgtcagcccttcaccgtcgactcacagtctttcaaaaatgtcacggcccggtttaaggaggtcgagaagctctgctgcctcactgtctacccagtctcaatcagagcagccatctacctctccacccactagcgtcccggaaggaagagaaagcagcagcaatatttcgagtgctccaacaggtattgcaggcgaagtgggccagatggactcgcatgactttcaagtgtacaagatccctttgacactaaagaacaaggaacggtgggaagacaagcactctccagagattattgtgaaagcaaaatatatgccctaccgtgcgcttcgtcagcaattctggagacttatgctcaaacaatatgacgctgatgacagtggtcgaatcgacaaggtcgagttgacaacgatgcttgacactcttggctcgaccctgaaagagtctacgattgacagtttcttccggcggttcagttctggaaacgagccggttgagactgtggatttgagtttcgaccaagttgtgatgtgtctggaggatacactacaggcgctgcaaacagctcccgaagggccatggccaacattccgctttttaaccccttccttcattgtcgtccaaaaaactgactaa

SEQ ID NO: 1799 - DNA, 183 bp, A.fumigatus
gcaactttcattcggctcagcacacatccggaccgcgtgattctagacaactctgaagtggtgctgcgattattcactcatgagttttttctagaggagaacagtgtaaattattcagagtgcttctttccttctcccttgctacgcacgtgtttcagaatgctgccgctgagcaacatatga

SEQ ID NO: 1800 - DNA, 219 bp, A.fumigatus
tccctcttatccattttcctcctattctttttcatttccctcatcactgcaactctaatcctcgggctcaccctccctgtgtctcctcgaaatggtgccgatgctatggcttacggcctacatggccgttgcggtgctgacggcaatcttgctcaatgttgtttatcaataattctttcggctttggaacccaacagaaccgccaatggtctctcatag

SEQ ID NO: 1801 - DNA, 216 bp, A.fumigatus
  unsure (104): Identity of nucleotide sequences at the above locations are unknown.
ttctttcggctttggaacccaacagaaccgccaatggtctctcatagggtcccatttctgggtagtaccatcagttacgggattgatccctacaagttcttctntgcgtgcagagaaaaggcaagtctcaagatcgtagttagacattccatcctgcgcgcattgctggagtattgctttcttaaccggcagtatggcgatatcttccccttttaa

SEQ ID NO: 1802 - DNA, 534 bp, A.fumigatus
  unsure (12),(19): Identity of nucleotide sequences at the above locations are unknown.
tatgcatgtgtncgatcgnacggtcaagacgtcttagggtatatctccggcagtactcgcgtcgcaaatctcatcggtgcaacgcttgtggatgccgcgaagacttccgcgaaggtgaccatgggaggtgcggtcatcgtcggtctgttgaatatgatcgtcctctcgtctctgcgccattacattccccttttgttcacttcagatgaggaagtgatcaagctcgtagctggagtgctacctctctgcgcagcgtttcagctttctgacgccctcgcggctaactgcaatggtatcatgcgcggtattggaaggcaagaaattggaggttacgtccagctgttttcatactacgccattgcgatgccgatcagctttggcacaactttcggactgaattggggtctgtttggtctctggtccggagtcgctattgcgctttgtctcgtctcgatcatcgagatgatcttcctcactcgggcagattggaatagggctgtaactgatgcccttcgcagaaacgcaatggcataa

SEQ ID NO: 1803 - DNA, 492 bp, A.fumigatus
ggcgtaggcgatgatctggctccgcctggtgaagacatttctgccaagattgcctactggcgatacggcctaaatgtcgccggctcatggaagagaaaactccgccaacaagtgcccgattcatggacgaccgttgcggacaatctcgcacctccgcctcaagttgacggcctttatgccgtctatcaaggcttgaatagctcttggtggaatgatacgtctctaaccaaggatcctcgcagtttgattatgttgcagggtatcctccccgatacaccagcagtggatgccaaagttgcattggcaaccgcgcagaaggtctgggaagtctggacagatgacaaaatcagaggatggggaagacctgtgctcgccatcaacgctgctcgggttgggagcccggaaagggcaatagggcatttaaccgcctatgactattgggtcttccatgatgctggtatgtgtcctgcttccgccatagcacaaagctaa

SEQ ID NO: 1804 - DNA, 261 bp, A.fumigatus
tattacccgataggattcgcagttcgcggtggtgacggtaagactctccttccctgtgatctgttgagtccactgacgaatagtacgtatacaggcggcactccccctccctttatgccggggaacgcggggttcttgtatgccgtggcgtatatggctgctggctggcacggatcccacggcgacgctcctgtgttcccttctgatggcagctgggctgtgaaacatgaaggtctacgcaaggcgccgtacacactgtag

SEQ ID NO: 1805 - DNA, 450 bp, A.fumigatus
cccgctgatatgtattttggcggagaaacgggcattcagtgggttgcagaaccagggcggttcatcgttagcgaagctttctatctagtttgtcgcgtgcttggaactcggaaacgtctggtggaatatgtcgacgggcccaaccaaaaccattatttccatgcggagttatttgtgaatgatgggatctaccaaaactttctcaatgcgcttgtcgaaggatatattccgacgccaatccctcttgaccccagcgggcgcccatatgggctgccggagagggaggataaatcatactcatataccatctggggccagacctgttgcggcgcagacaaaatcaagtccaactgtcgtctacgttgtgaaatgcaggcaggggatctgctttgttttccatcgatgggaggtaggatttccgttgattgtatgcatatgattgactgctga

SEQ ID NO: 1806 - DNA, 516 bp, A.fumigatus
acctattattttccatcgcctggcgtcttaaacaaaactcaatcggttgctgtggcgagccaaagtctttcttattatctagctcagagccgtggacgttccttagtatctgttcgctcttttggacgcgtttctggcgtgattgcgacacattcctcggctggtcgatcgttgaaagtactgaccacgccaatttttcctccatacctgccttcaagaggattgtcgcgatctccggaacctgttagaatgccagccagtgctgttgcgccggacgacaccctccaggttgggattgtcccagaagcgaccaagtcaaacgacgagccattccaggattttccttcagaccctgagtcagatgatgaagttcctgttgaagcagaagagctccaggatgctctctcgcgtcccccacctgcaaatagtagctaccttccgctcccttggagaggccgattaggctatgtaagtcacgttgattcgcgcattctttcggatgctggccccctgtag

SEQ ID NO: 1807 - DNA, 441 bp, A.fumigatus
gcttgtttgaatacatatctacggaacgcgaaccagccagtgttctgctctcggacctgtcgcatcgcgtccattcttgaaaaccgacacccacttgcggatccttcgcagccgcctcatccgaccaagaaccgccctgatcgggatcggacgcctgatattgcccgcggccaggcttacgttgagtctttgggactggccaatgcgcgagatctgattaagatcctgcgctggaatgacaaatatggcatcaaattcatgcggctgagcagtgagatgtttcccttcgccagccataaagagtatggctataaacttgcctcgtttgcatcagaggtcctcgctgaggttggccgcgtggttgccgaactcggtcatcgagtgtccgtacatcctggccagtttactcagctgtcttcacgacgggctggaagagacacg

SEQ ID NO: 1808 - DNA, 189 bp, A.fumigatus
ccaaagtatgtgtcaagcagtatcaagattgaacccaacagccgcaacgacgagctgtgcaggagaagagctgtgtctgtggatggaaatggtaacaagaagaagacggaaggatattactcttccaagattacgcagggacctaagcggcttggatggtgggtgagacgaaaggaaacgagaaaatga

SEQ ID NO: 1809 - DNA, 603 bp, A.fumigatus
gcgttttttcctcaaactgggccccacagtttggccccggctgggcaaaattcggcggaaattgaaccaagaacggtttcattccttcggttccagcagcagcccaccggttttcatcccgcaaggtcagtttccaggtggcttgggtggcacagcccatggggttaccagccacagtcacaattgggcattcagcaacttcagcaacagcagactggcttccagggcttggcaccacacccgacaggctttgaaggctaccaccggcaactccagccacagcagccaatgccgacaggcattaactcgatacttcctccggctcttcaaccccaacctaccggcatgaacggtgcgagcagtatgccttatactgtaacctccccaccaccggtcccccctattccccaacagcccacagccgcacctttgcagccacagaagactggaccacctcctcccgtacgatttggggtcaagcatgatgctcccaagaagctgactccccagccaaccggtttgcgggctaaccttgcacaagctagtgagttctctccattgccaagacgtgccattctcccaccatttggtcaaggccactga

SEQ ID NO: 1810 - DNA, 513 bp, A.fumigatus
  unsure (90): Identity of nucleotide sequences at the above locations are unknown.
gaactttggaggctaacgctcgcacattcctattctttagtagtggccgccttcgccttccactggatccccgtcaaccacgacctcacngtcatccacacgcagcaaatgaactgggccagcatcttcctcttcgtgaccatcatcatctacgtagccttcttcgccgccggcgttgccccaatcgcatgggttggcacagagttcctcccgctagaagtgcgcgcactcggcacgatgatgaacacggtgacctgctggggatgcaacatcatcatctcgtcgacgtttctgtcgatgatgaaggccatgacgccgagcggggcgtttgggttctatgctgggatttgctttgttggatgggtgttcatcatcttctgttatgccgaggtgcataatatgccgctggagtcagtgcgagaggtgtatagacatggctttggtgttaagtatgctaaacagctgcagaggcagaggatacttcaggagaggcagaagccggtggatgcctag

SEQ ID NO: 1811 - DNA, 249 bp, A.fumigatus
gaacttgtgcagtgtcagcgtacggcgcactgtgcactgtgcacagtgcacaatttgcgtgagatggagtacaaccagaaagacactcagcctcgcggtttatccaacacagtcgatttcactattgacaatgccatggaaaaagacggtgaggacgagtttgcggtcagtcgactgttgatagtagtggctggctggaggttggatgagcaaggaaacgatttacattcctgggggtggattatctga

SEQ ID NO: 1812 - DNA, 183 bp, A.fumigatus
taccctcttaagtttatagtaatattccttgatttattacctgcagtattagtaatatactatatactttttatagtatattatatgctattcctaagatttaacttaggtctaatattccaagttctaatatatatatccttttaccccttatttaacctttttaagggtttacttatttag

SEQ ID NO: 1813 - DNA, 969 bp, A.fumigatus
cgcccgccggggtacccaagggttttgggatttcgcccttcggccgcattcttccaaccccttaatgggtttgtgctgggaggaaatgcatccaaccccttccgcccccgggcaggttcggttttgagcacccccaaccacttcggccccattggtgttggcggaggctggcaatccaaatacattgtttcgccatcagcgctttctcacccaactgccgtcttgtcatctattagacctaagaagaaactcaaggctcttcattgggacaaggtcgatactccacaggtaacagtatgggctattcgcgatcccactcctcaagcgaaggaacagaagtacagcgagttggcgaagaagggtgtcttggacgaagtcgagaggttattcatggcgaaggagaccaagatctttggggccggctccggtgcgaaacagcgcaaagacaagaaacagatcatctcaaacgacttgtcgaagaccttccagatcgcattggccaagttttcgcagtatcctatcgatgatgtcgtccgtatgattatccattgcgatccagaaattctggacaatatggtggtcatggactttttgcagcgagaggacatgtgcacgatacctgagaatgtctccaagctaatggcgccttacagcaaggattggacgggacctgatgctgctagttctgagcgggagcaagatccaaccgagcttacacgggaagaccagatctacctctacactgcgtttgagctgaatcattactggaaagcaagaatgagggctcttgcactgacacgatccttcgagccggattatgagcatctctcgacgaaaatccgcgaggtcgtgagagtcagtgagagcctgagagactcagtctccttgatgaatgttcttggactgatcctggatatcggtaacttcatgaacggtcttcaccacggggctggaaggagccgcgccatc

SEQ ID NO: 1814 - DNA, 189 bp, A.fumigatus
tgtaataacaatttggacaacgaactttcctataccatggcacgcatgcacacttgcgaaattttacccgtccttttcttgataaatcgctgctctcgttttgaacgacaagaatttgattggggttcgcggtgtggtgcctacagcgagttagaaaatgcaaggccttattctgtgattgacaagtga

SEQ ID NO: 1815 - DNA, 210 bp, A.fumigatus
cggactgctctagttggatggggccgcacacagacagaccctgccttcggcgcgacatacgacagcacaagtatcaaggccaaatccgtgaatctgatcgctagtgtccggaccgtgatgcgaagtaagctactctcaattttgccgtccatttttgcctgttctgttgcttcgttggatcggaagttgggctacatggggctgagctaa

SEQ ID NO: 1816 - DNA, 600 bp, A.fumigatus
caagcactccttgtctttccaaaatccgctcgtcgatttacttccaggagaagtaatttggttacacagttgatctgttggaaatatcgctccatactttcagggactcagaaaatagccagctctggaatcatgcgttactcgtggttgatcggcgccgtctgcgctgcaggtgctctcgccaagcctgtcgacaaacggtcttacgttaccgattggactatcgtgaccgtcacagagaccatcaccctcccttatcagcctcccccaacctcaactccggcctactcccccatccaggcggtccagctcactcagacagtcaccaccgtcgaccctgcccctgcccctgctcctgtggagcctgaaacttcatccgcctcccctatcccgaccactgaggctgtcaatacagctccggtcggtgtagtagaggaattgcctggggctgctgcttgggcttcggcttggacatcggcttggacatctgcttggacatctgcttggacctcatcggctcctgatgctgcgcaacccaccacccttgctacttcgacctctaccactgcccccgctagtgttcctaccgctgctggctcg

SEQ ID NO: 1817 - DNA, 480 bp, A.fumigatus
ccccattcaactaaactcatattttcgtcagatttctctgttcctggaaaatccaattcattcggatatgttccttcaaaggcgaactacattcgccctggaaagcgtccactgtcgtccatcacacccgccatcgtcacccgtccggatggaaagttatttttcctcgctggctccgctggtggtagccggattataacagccaccgtgcaaaatataattcgtgttattgaccaagggctgacggcagcgcaggcattggctcaaccccgtttgcacgatcagctgataccaaatcaggttagcttcgagtatacctatgataattcaaccgtcgatttcatgaagtctcgtggtcataatgtgacttgggtcgctccaggtcagagcacggcgcaggccatccgggttctcccgaatgggacatttgacgccgctggagagcccaggcagttagattcgggcggcttctcgatttga

SEQ ID NO: 1818 - DNA, 219 bp, A.fumigatus
tttcatttcccgtatatacatggttataaagtaatgaatgtaaactggctgaataacgaggtctactgtcacctgaactacatctatgccatgattcgtgagattgatttgcacagcaacaatcaaatcgagaagccgcccgaatctaactgcctgggctctccagcggcgtcaaatgtcccattcgggagaacccggatggcctgcgccgtgctctga

SEQ ID NO: 1819 - DNA, 375 bp, A.fumigatus
tcgatcgcctccttcaacggagatctttcctcattaaccgctcctcccttcattctttcgggcacctctttgacggaatactctgcttactgggctgaacatcccagtctctttgtggctgcggccaaagaagccgaccccgagaagcgagcgttggctgttctgaaatggtttctcagcacgctgcgtcaacagtactgctctcgcagtgagaagctgggcagtgagaagaagccactaaaccccttcctgggtgagcttttcctcggcaagtgggaaactgaccccgatgccggagagactactttgatcagcgagcaagtcaggttcgtttttccttggttggctcagcggcgacccgatactgacccataa

SEQ ID NO: 1820 - DNA, 507 bp, A.fumigatus
  unsure (340): Identity of nucleotide sequences at the above locations are unknown.
ctacaaggatacaatgcgcagaaggcatccttttccaacaccatccaaatcaagcaaatcggccatgccttgctgacaatcacccccccatccgcggacaagaacgacccggctcagaaggagcgctaccttatcacactcccatacctgcatgtcgagtccctcatctacggtacaccattcatggaattggaaagatcgaccatgatcgccagtagcacggggtacatcgccaaaatcaattactcccggcagggctggctcagcggcaagaaaaacactttcaacgccgtgctctaccacgaaaaacacggggagaggaaacctctatacaccgcanaaagacaatggtctgacacattccttatcaaagacgcccggaccaacaaggaagatcgaccgctacattggcaaagacttgaggaccaccccgttgaaccgttgccctctggaagaaccggatctattggagaagccggaaaacttggcgccaagtcgctatcgcct

SEQ ID NO: 1821 - DNA, 204 bp, A.fumigatus
ggatcctccatctatcattcttcagaggctggcatctttgttaattccattgcgtcgatatacagaggatgcaagattccttacaagttcgccaagctcttcccgcgtcctatcgtcaacagcattcccgatttggttccatcgaacgtcagtatcgacaagaaatcccttgtatattggtgtcgcagccgtaagtgccagtag

SEQ ID NO: 1822 - DNA, 441 bp, A.fumigatus
caaagatgccagcctctgaagaatgatagatggaggatccctaagtctcgatacgcgtccaactccacctacatctcccaggacccgaggctgcgtaaggagtacctggatcccgaactgatcgtggacgaagacatcaagaaacgacttatcgagggaggcatggatgatttgttagcgactcattttgcccaccttttcatccgtgaccccttggtcatcttctcggaggacctggacgagctggatttgaacaaggccgaccactttgagaacctacagtcgactaactggcaacacatgcgctttaagccgccgccacctgacaaggctgacattggctggcgtgtcgaatttcgttcaatggaaatccagatgacggactttgagaatccggctttcagtattcttcaccagcgcctggaaggatccacaatggtt

SEQ ID NO: 1823 - DNA, 537 bp, A.fumigatus
cgcggatccgcggcctctgtggagaagaccgacgaaggtgctaatccacatatcagattcccaacactggcagcaaatatcagatcgagaaggggtcgaaaggtcgagttgaatgtgcccatcttcgtggacaagaacaccccagtgcctttcaaggaccccaccgtggactatgatcttcacaactggcccgaggatgatgatgtgcgaaatggagcagcaaaggaaggccatgtctatatggatgcgatggcgtttggaatgggcagttgctgccttcagatcacatttcaagccaaaaacataacggaagggaggaaactgtatgaccagcttagcccactgggacccattctactggcacttacggctgcgacaccaatatacaagggatttcttgtcgatactgacgttcgatggaaccaaatcgggaatgctgttgacgataggacgcgggaagagcttggcgaacttgtaaggaatcttgcatcctctgtatatcgacgcaatggaattaacaaagatgccagcctctga

SEQ ID NO: 1824 - DNA, 768 bp, A.fumigatus
atgcggttcttccagcccctgggcgtgaagactaatcaagcgtctctgaccgcatttgtaatgtccagaagcatcgttcttcactttgcacctgccagcatacatcgtctgtcttgcctcgatccttttccactactcctgatcggcatgtccaacagagcgccgacttttcttcgactagtcggagttatgaccggcttggccggcgagcaagggagaagcttctcgatcgggtaccgtcacactgcaatacatggttatcagcactattggctaacgggttcattcttctcgcaattgcaggaattctttctgagcttgttgagctccgcaaccaccaagcgagaagccaaatcctatctggctcggttgaaggctcaacacccaaagtcacccgatgcgaacaaacccgaacccgagaaatcagctacagcacctaccttgccctccggtgtcaatctggggtcgttctacggagcctctagatccgtctacgagagtcccgtcttccgacagggtcccagcccttccgctccaccttcgctggagccagtcgaacgactgcatttggccttggtcagattgtccaccccgcaatcgcttgatgacaacattatcgacggcgtcgcaaagactctgtctcaattaaatcgcctgggcttgacctgctgtgttgtggttgatccagggacggagggagttgcaagtgctctgcggcaagttgctagtcttcaccacggggctggaaggatccgcggtggcgctttc

SEQ ID NO: 1825 - DNA, 213 bp, A.fumigatus
gctaggagtactactagtttactaaattcctgtaggagcttaagaactactactagcaatataccacaaaccaaccccctattattaagacctatgctactactactaaacctacctagtattcctagttaccctaaagctctagccctattactactaagtctactaaacaaccctggcgccctattattcagaggaatgagcatatgctag

SEQ ID NO: 1826 - DNA, 423 bp, A.fumigatus
acaacgctgttctggctttctctcctttccagtgcaactctccgatctacacccaagcttggtcctgagaaactgaaggaaatgcggtcgatcgcccacgtcgtctgggccctcacagggttcggaataccctcggctatgtcactcagcattccttctccgcagcagatcctcaagtcctggtctggcaccaacaacatctgccctctggcacccaaggtcgaagtgcctgaagatggactactttctgcacttcgatatgtccagaatgagactattcggctgcagcaggtcgaccgtctctcaagagccgtccagattcccaccactgtcaatgactacatgacggacccgtttgatgagggattcgctccctttgttgagttccaagaactcctggaatcgctgtttcctctgatgtag

SEQ ID NO: 1827 - DNA, 207 bp, A.fumigatus
ctggagagaaacccgtccagacagcgcagactcgcagcaacatatgccagagtaacgatagccgggggcttccacaaggcaatcaagcctatagtccacgccgctgttatcgtggctagtgaccagcgagccacaggctgggagaacactaacgggattgttttgcgggctcctgttgtgtctgccaccccgtcccggaagtcttga

SEQ ID NO: 1828 - DNA, 654 bp, A.fumigatus
tctgcaagacagacctcccctatgcctcgccaacggagcaagggccgcatcccctgcaagatccgccgaaagaaatgcgacgagagaaagccaacttgcgtcgcttgtgtacggaatgtccttctctgtgcgtgggactcggagtcacctccaagccaaccccacaactcaagtagcagaggtctcaaggctaagagcccacggctaggccgacatcaactagcgccaaagcgcatgagttcggacctagcgttgtctgcggcaccaaatctcatacatcctcaactcgcccaccccaagacaaacttcctctactcatttttctacgcccgagccgcacaaacgttgtcgatcagagacagggaaggaaaccccttcgtgcacgtcctgatgccaatggctgcgaccagtgacatcgtctttcaagccatgcttgccttcagtggagtggtctatgaacagcagcactccagtaatttggccacgacgacgtgggaacattatgcgcaggcgattcgcagtttgaagcatgcgcttacgctctatgtggaccaccaagtggaccgcggggctgaactggtcgcgactgtgcttcttctgctggccttggaggtaggcaggatatgccccttcgggagcggttggtcacgttga

SEQ ID NO: 1829 - DNA, 687 bp, A.fumigatus
gtcatgattgccgatgatcgggtcgtcatctgtggctctgccaatctgaatgatcgttcccagctcggggatcacgattcagagattgcggtcattatcgaagactacacccccgttcagtccaccatgaatggcaagccatggaccgccagtcgctttgccgcctctctgcgtcgacaactattccgcaagcacctcggcctcctgcccacccaagattaccaacgcccagatgccaactctgagcccgtgggcgttcccaatgacttcgactttgaggctccagagagtcaaatcgtggcagatcctctcgcggatacccttcagagcctctggaatacacgcgcaaggacaaacaccgagttcttccgcaaagtcttccatgctgttccagacgacaccgtgcgcaactgggcgacataccgggagttttacagctactatttccagaacgccgataaggcatcctacggcaaggacgagaaagtcaagcccccgcggtacgaatatggacatgttgtgcgggacgacttccctcctggaccagaaggcgttcgacaggtcaaggagctgctgagtcaggtcaaaggcacgctggtcgagatgccattgatgttcttgatcgaggaggatgttgcgaagtcgggattggctctcaatgacctgacggagcccctctacacttga

SEQ ID NO: 1830 - DNA, 189 bp, A.fumigatus
tgtggccctacttattgtacggtgtacaaaaagtccaagacgatgatgttcgcaatgatcaaggatcgtccacaaatggagactgccgaaatgaaagaggttctctttacgcagttggagatcctagagccgaatctcccattgttatcagaagagaatactcgctgtaggccgctggacattgactga

SEQ ID NO: 1831 - DNA, 912 bp, A.fumigatus
  unsure (766): Identity of nucleotide sequences at the above locations are unknown.
agatgcgagtactggcctttacgcaaactcgccacgattaccgattctgatattgaaagaatccttcaggcctactctgctgggaaagaaagtgccagcgacatgaataggactgcgctgttatctaagaagggaaagattgttttggctggctctggtcctggccatcccgatttgctcactcgcgcaacttatcatgcgatccagaatgcagacattatattggcggataagcttgtgcctgctccagtcttggacttgataccacgccggaccgaggtccatattgcgcgaaaattccccggaaacgcggatcaggcgcaagaagagtttatgcaaatgggaatcgaagccctgcgtcaggggcggtacgtactccggctgaagcagggggatccgtatctctatggtcgaggaggagaggaatttgagtacttccgaggcgaagggtttacccccttggttcttcccggaatcaccagcgcgctcagtgccccattgttcgcggatatccctgctacccatcgtggtgtttcggaccaggttctggtctgcaccggcactggaaggaaaggcgcagctccagagcctcctacttacgtaccgactcagacagtcgtcttcctgatggcgctgcatagactatctgcacttgtggaatcactgactacgctaccggtggcagatgatggctccccatccgagaacagcttggcccaaggatactccatgccccctcgtggaaccgggctcatgttacgattancgggtttattcgttcaactcttgaaaaacttctgctttacatttggaagcttaaggttctcccccctccccggtttgctccctggtccggagccacttggcctgtttctaccccgaaccgaacggccaaaattggaactggtttaa

SEQ ID NO: 1832 - DNA, 522 bp, A.fumigatus
tctatgcagcgccatcaggaagacgactgtctgagtcggtacgtaagtaggaggctctggagctgcgcctttccttccagtgccggtgcagaccagaacctggtccgaaacaccacgatgggtagcagggatatccgcgaacaatggggcactgagcgcgctggtgattccgggaagaaccaagggggtaaacccttcgcctcggaagtactcaaattcctctcctcctcgaccatagagatacggatccccctgcttcagccggagtacgtaccgcccctgacgcagggcttcgattcccatttgcataaactcttcttgcgcctgatccgcgtttccggggaattttcgcgcaatatggacctcggtccggcgtggtatcaagtccaagactggagcaggcacaagcttatccgccaatataatgtctgcattctggatcgcatgataagttgcgcgagtgagcaaatcgggatggccaggaccagagccagccaaaacaatctttcccttcttagataa

SEQ ID NO: 1833 - DNA, 192 bp, A.fumigatus
gtaggaggctctggagctgcgcctttccttccagtgccggtgcagaccagaacctggtccgaaacaccacgatgggtagcagggatatccgcgaacaatggggcactgagcgcgctggtgattccgggaagaaccaagggggtaaacccttcgcctcggaagtactcaaattcctctcctcctcgaccatag

SEQ ID NO: 1834 - DNA, 222 bp, A.fumigatus
atatttataattactctagaagatcttaaagctactctaaggattaggaaagctcagaaggaagatcctactaacctattacctaataaatttaaagactatgctaatattttctcccctaagaaggctaagcgcctactactatactacctctataactataatattaagctattagagggaaagacccccttatttagccctctatatactatgtcttaa

SEQ ID NO: 1835 - DNA, 648 bp, A.fumigatus
tttgaccagcgtcgtccttccagccccgtggtgaagacagtggcacctacagtattcatttacccaggtgtctacgaggaacagcttgtgctaaatcgttctgggaccacgatcctcatcggctactcaacctcaaccttcgactacaacagcaaccaggtcactatccagtataacgccgctgtcgatacccaggccgaccagtccaactcggatagtgccactgtttatgccactggcaactacttccaggctatcaatatcaactttgtcaacgactttggcaccaccaagaactatgcatcgctcggtttcgcagtcaagtcaagcaagtacgcctctctgtacggttgccaggtgaaagggaaccaagacgcactcttgatcaatggatacttcttcgctagcaacagctacattgaggggaacatcgatatgatctggggatcgggggctgggtacttcctcaagtcggccattgcacctaataaggacggcatcaatctgactgcccataagcggtccacaaatacaagtgcagctggatttgtctttgaccaatgtgctatcgttccctccactggtgccgggacaatgtccgatatctcactcggccgaccatggaactctttggctctcgtggcgtag

SEQ ID NO: 1836 - DNA, 354 bp, A.fumigatus
gtggattcgtaccttgattcgtgtgtgacggcagccggatgggagcagtggtcgtcgagtactccaaacaccgatgggttggtattcggtgagtacggcaactatgggcctggcgcgtcgactgctcagcgtgcctcgtttgcaactcagttggatggtagcggtgtttctcagttccagttgtcgagcttctttgcagtgacgtcttggatttatttcactcatgtcagtggaactccgttcgtccctggaaatataatcagcacaagtgtgcctgtgcagtcagcgacgccgacctcgagtaccgatggttccaccctttactgtgacaaccacaatgaccgtgacagataa

SEQ ID NO: 1837 - DNA, 267 bp, A.fumigatus
  unsure (187): Identity of nucleotide sequences at the above locations are unknown.
tcagcacaagtgtgcctgtgcagtcagcgacgccgacctcgagtaccgatggttccaccctttactgtgacaaccacaatgaccgtgacagataaggagactctgtacacaacattgacctctgctgataagacttccacgacgaagtataccgtcacggaagatgtgggtacaaccctaagtgcancccagtcgttcaagacaacgacccagaagaactacgtcacggacaccgtaattgtcactgagcccacagtgaacgagcac

SEQ ID NO: 1838 - DNA, 264 bp, A.fumigatus
ctatctcatgatgtgcactacatgcattctttcacattgaaagtattagacctcattttagagtggatctatcaggctatgtcattgacaagcatgttacctactagcaaattgctgtcttctctgaagaagggtaactctaaactatatacaaaactgcccacgaagatcgactccatggctctttcccagcttatcgcgagtatcacgaatgatctttctgcgtttggcaagtggagtcaggtaaacatgtatcacggatag

SEQ ID NO: 1839 - DNA, 192 bp, A.fumigatus
cttcttcccatagtcaaggaagctggacgcaagcccccgcccttccccttcattttcttcaagcccaacacctgcgtgcatgaccacggcgagcccgtggtgatcccgcggatcgcgcagaacgaccaagcggactacgagggcgaattggtctgtctcatcgcgttctttcttccatccacgatctcctaa

SEQ ID NO: 1840 - DNA, 255 bp, A.fumigatus
agactcgatggccgcatcctgcgcggcgagcccatcctgcccgcggagagcacgatcgatcttgggttcgtcaccgacgctgatcagctgcaagcccgcgttatccaaggccaggacatctacaatacgacaggcgagaccaaggtgacggatgagattgtgactgtgaaacagatcctctccccgctcgcccccagcgacgtacccattatacgctgcgtgggcctcaactacgctaagcacagtgcgttgtga

SEQ ID NO: 1841 - DNA, 234 bp, A.fumigatus
ccacggcgagcccgtggtgatcccgcggatcgcgcagaacgaccaagcggactacgagggcgaattggtctgtctcatcgcgttctttcttccatccacgatctcctaactaggctgcagtgcctcgtcatcggcaaggacgccaaggatgtccccgtggagcgtgcccttgagtatgtggcggcgtacacggccgccacgacattcttttcaccagccggccgcgatcaaaga

SEQ ID NO: 1842 - DNA, 369 bp, A.fumigatus
ctgtataggctggcgcaatggatcaccgacgataagccccgcgtgatcctcatcgaccggacctgggatttcatcggcaccgagggcaccaccacgggcaaatgctgcagcatgccctccacgacggtctgcagcggcggaacctccaagggtcaggcctggattcaggatcactgtgatggaggatcctgggtgtcgtgcaagtacgacaatgccgcgctgacgcccctggacgtgggctcgaacaagagcatcgtgggtgtcggcaacaagggtgtcatcaagggcaagggtctgcgagtgcgcaacggcaacaagaacgtgattatccagaatattcacattacggtgagcctctgcatcccttga

SEQ ID NO: 1843 - DNA, 399 bp, A.fumigatus
tcgaagcagaatctgaaccctcaatacgtctggggcggtgatgccatcaccctcgacaacgcggacaaggtctggatcgaccacaacaaggtacgtctacgtcttcctgcccccacggcaaagatgactctgacagaaactggcagatctccctcatcggccgccaattcatcgtcagcggctggggcaaagcgggccacgtcaccatctccaacaacgaattcgacggccgcacctcctggtccgccggctgcaatggcaagcactactggactctactcctcctcggcgagcaggactactacaccttccaaggcaactggctgcacgacgtgtccggccgcgccccgcacatgggaaccgaccacaccaagtcgcagatcttcttccacggcgtga

SEQ ID NO: 1844 - DNA, 540 bp, A.fumigatus
tgccatcaccctcgacaacgcggacaaggtctggatcgaccacaacaaggtacgtctacgtcttcctgcccccacggcaaagatgactctgacagaaactggcagatctccctcatcggccgccaattcatcgtcagcggctggggcaaagcgggccacgtcaccatctccaacaacgaattcgacggccgcacctcctggtccgccggctgcaatggcaagcactactggactctactcctcctcggcgagcaggactactacaccttccaaggcaactggctgcacgacgtgtccggccgcgccccgcacatgggaaccgaccacaccaagtcgcagatcttcttccacggcgtgaacaactacttccagaatgtcggcggacatgcctttgacgtcgacaccaacacctgggtgctgctcgagggcaactactttgagaacgtcaacacgccgctgaccgataccagcctgcgggccggcggcaagctgtacaccacctcgtcttcaccacgggactggcaggtccgagtatgttaa

SEQ ID NO: 1845 - DNA, 600 bp, A.fumigatus
ggtccctgcgtttggagctcaacgcaattcctgccgttgttctcggacatgttcttcgccgacaaggagagattcatcgacagtattgagaaagaccgactgctcaccattgcgcgctccgcgttcaacattgtgacagtattcctcgcatcgccggctctggtcacccctaacctccctatgttcatttacacaaccatctggtacggccttcttgttttatcaaagttgagcttgctttcggataccgcaacggaaagcaaggtagtttacaacaaagatgtcagcaacctcggccttgctgctatgcagaaaatggagacaatgtcacgcggagacaacgtttgggacaattgccgtgcagtgattggatctatgatctcatggttagagagcagtcgggggcaacctcaatcaatgcaagctccaggaaacactaaggacgccggggacgctcatatgttaccacaaccaacacccgaagatgcccctcgacccacagagtctgcagcggtggccgaagattgggatgctacagtgcggcagcagatgttgcaagatttgacctggataggactaccagtggagcagcagctttga

SEQ ID NO: 1846 - DNA, 681 bp, A.fumigatus
atcaatatccccaagatgattcgcgcatgtgaggaagcaaatctctggccagagctagtgttcttgtattgtcactacgacgagtgggacaacgccgctttggcaatgatggagcgtgccgcggatgcttgggagcaccattcattcaaggatatcattgtgaaggttgccaacctggagatctactatcgtgctctgaacttctatctgcaggagcagcctctgcttcttacggatctactccaggtcttgactcctcggatcgatgtaaaccgtgttgtacgcattttccagagctccgacaacattcctcttatcaagccgttcctcttgaacgtccagtctcagaacaagagggccgtcaatgatgccatcaacgacctcttgatcgaggaggaggattacaagactctacgtgactcggtggacaactatgataactttgatgcggtacagctggcgcagcgtcttgagaagcatgacctcatcttcttccgacagattgcggcgaacatctaccgtaacaacaagcgctgggagaaatcaatttcgctttccaagcaggacaagctgtacaaggatgccattgagaccgcggcgatttctggcaagtcggacgtggtcgaggagcttcttcgctacgtatgtttatccctcatcgatctctttttctcaccctga

SEQ ID NO: 1847 - DNA, 270 bp, A.fumigatus
acgcgatgcgctatgctgactctccaaagtacgaatatcggcaatgcaaagctcgcgggtctgcagaaggatctcaatatgaccaatgaccaatataacgacagcttgaccattttcttcatctcgtactcagtcttcgagccgatcaccaatgtcctgctcaagagatggagaccgagcaggttcatacctgctatcatgttcggatgggtagatgctacttgtacatgtagcaagttcgagctaatggaatctagggcctatgcatga

SEQ ID NO: 1848 - DNA, 354 bp, A.fumigatus
tggcggtgcgtggcttcctacagctccttcatcgatcaggctcctatgcctgttgtcatccgatatgatattaacaatcagcaggtcagatggtttctgggactcaccgaggccggtctcttcccaggggtcggctacttcctctcctgctggtacaagcgaacagaattcggtgtacgcatggccatctttttctctgcggctgcgctcgctgggtctttcggaggtcttctcgctgctgccattgctcaaatggatggagttggcggcaggccaggctggtcctggattttcatcctcgagggtctggctaccatcgttaattggcgtcctgtccctttggatagtccatga

SEQ ID NO: 1849 - DNA, 183 bp, A.fumigatus
ttggtcgagactctgctttattttgcagatttcaagctcactgccagtgctcaactgccttttaaagttcccaccgcttcgcccctagcccatcgccaacagaagagcgtcagccaacctcgcgccatcttcctcacaagacctaactgccaacagaatcgtatgaaaggctccctccagtaa

SEQ ID NO: 1850 - DNA, 747 bp, A.fumigatus
gacgcatactttcttatccggcggctaggaaatgatctgaatatgtgcggccctcacctactcaaccgcatatcacgcttcatcctaatctggaacgtgggttccttcatcatcaccatgatcgtcctcctcgccacaaacgaccacaagcagcccgctgcattcgttttctccgagttccaaaacttcaccggctggggtccagccatggccgctatcgtggggattctccagtcctgcttcgggatgtgctgctacgatgcacccgcacacatgaccgaggagatgaagtccgcctcaaaagaagcccccaaatccatcattctctccgtcgtactcggcgcagtcaccggcttcgcattcctcctcaccctctgcttttgcattggcgacattaacgaaacggccagcacatccaccggcgtgcccgtcattcagatcttctacgattccaccggcagtaaagtcggtgcgtgcttcctgtctagcatgatcgccgtcattgtcattgttgcggggaacaatttgctcgccgagggctcacgctcagtctacgcgttcgcccgcgaccacggcctgcccttctccaaggtctttgccaaagttgaaagcaagcgccaagtgcccgtcaacgccgtgctgctgacactagctgtacaactcgccctggatgctattgatttcggcaccacgactggcttcgaaactgtcattgcaatcgcaacagagggattctgtatgtcatga

SEQ ID NO: 1851 - DNA, 360 bp, A.fumigatus
tcctctatagatttatcatacgcaatggccctctttagccgtctccttggctatgtcactggttaccagagagaaatgaagggacctttttccctgccaccttggatctccatcaccctcaatgtcctggggcttctgtttctgctcttcgcatccatcactttcaatttaccgacgcaataccccgttaatagagactctatgaactatacttcagccgcgattggcgttgttgcgctgatcagtctggttacctggtttactaccggccagaaacacttcactggaccgggcggcatgagcgtgttgcatggacgagaggaggtggctcaatcggaggcagaggtagagaagaagtaa

SEQ ID NO: 1852 - DNA, 222 bp, A.fumigatus
ggtaaaatagctctctatctgaatccccaccatggagatccatccatgatcgacaatggcctgaggccggaacggctatttttcgaatcttacaatttccatgattgcgccgttcttgatatcgagtcagtcaattacagtgtaggtgctctagctctagttagagaggccatttctacctgtccatcttttgcaggcatcatctgtcatggtcttaggtga

SEQ ID NO: 1853 - DNA, 201 bp, A.fumigatus
actagtcgttattggagaccaagcattctgtggcggtgctccccaaaaacattaccaactatgtatgcactactccgcagatgggctaagaccctggcctatgtccttcacacaaaatctggccaaaagtatggatcctacctacaggcatacatagttagacagtttcttctgatgtatctcaatcactgtgtaaggtag

SEQ ID NO: 1854 - DNA, 213 bp, A.fumigatus
ggtactaacggtctcccagttgttcccaagaccgcagagaactttcgcgctctctgtacaggcgagaagggtgtgggaaaacaagggaaaccattgagctacaagggtacgacctccgtcctgtctcttcaggtgcgattcagagtcttacggttcgagcttaggatccattttccaccgtgtgatcaagcagtttatgatccagggtggtga

SEQ ID NO: 1855 - DNA, 231 bp, A.fumigatus
agcatcgcaaaaaagggctggtccagcccacttcgtccgtcaattcctcagcttttcctcactaacttctctcactttctgacacagcactttcactctgctactgtttgtctttactactcacttcttagcacgttcattcattattgcactacttccagcgcgcaatcatggctgagactcaacgtacgtactgccccgtccagtgtggggttctgggcctcaggatga

SEQ ID NO: 1856 - DNA, 582 bp, A.fumigatus
gctacaagggtacgacctccgtcctgtctcttcaggtgcgattcagagtcttacggttcgagcttaggatccattttccaccgtgtgatcaagcagtttatgatccagggtggtgactttaccaatttcaatggaaccggtggtgaatccatttacggcgagaaattccccgatgagaacttcgagctcaagcacgacagacctttcctcctctcaatggccaactccggtccaggcaccaatggcagccagtttttcatcaccactgtcccaacccctcacctcgatggcaagcacgtggtcttcggtgaggtgatcaacggaaagagtattgttcgcaagatcgagaacatgcctacccaagccgacaagcctaccaccgacgtgaccattgttgactgcggtgagctgtctggcgaggattacgagaacgccactaagcaggttgccgatgccactggagacccctacgaggattaccccgatgatcaccagggcgaggagctcaacgctcaggtctgcttcaagatcgcttccgagctgtcttcaccaaggggccgaaggtccgccaatggttggggc

SEQ ID NO: 1857 - DNA, 237 bp, A.fumigatus
agacggatggttcttagatgcacaaggcccaattcctttgctttcggcatagacgatggacaaccatgcttcgcccaagaggtcatggctatcctgcagaaggagaacattctggtgactttcttcgttgtcggatcaggactccgagatgaggagaccaacttcacacaagtgtaccgggaaatgctaaggagaggccatcaaattgccctccactctaatacacatcgaaagtga

SEQ ID NO: 1858 - DNA, 219 bp, A.fumigatus
ccttgtccgaagctttggcttaatatgccagctaagggttcagcagctcgctacttccggccaccatttggaaccattggctccagaacccgacaacggcttgcagtgtatacctctgatcctcagattgttaactggagtgtggacattgaggattggctttggggcgataccgaaactccggaaagacagctggaggctttctatcgagatgtgagg

SEQ ID NO: 1859 - DNA, 213 bp, A.fumigatus
acccttagctggcatattaagccaaagcttcggacaaggtcacctacactcaactcccaagaaactcccgaatgctcggatattcctgatgatttcgtcgtcgatgtcttcgatggcctccaaaccttccatccttccactattgtcagcgctggcaagaggtcttgtaagggagctcactttcgatgtgtattagagtggagggcaatttga

SEQ ID NO: 1860 - DNA, 609 bp, A.fumigatus
ttactgtcgaccagctttgggaaattcggttcacattacttgaagcgggaattctactttgatgttcacccgccactgggcaagatgcttgttggcttatccggtctccttgctggctacaacggatcctttgaattcaaatcaggagagaaatacccagaagatgtcaactttacattcatgcgtgttttcaacgccgccttcggtgtcgcgtgcgttcctcttgcttattacactgctcgagagctcggtttccgcaaggccactgtttggctaatcagtctgatggttttgttcgaaaactcttacgcgactatttcaaggttcatattgcttgactcgatgttactttgcttcacctttatgaccaccatgtgctgggctaagtttcatcggctacagcacgccagcttctcaggtcagtggttcacgtggctcttcctgacgggtataagtatcggctgcgtatgcagtgtcaaatgggtgggtcttttttgcacagcattagtgggactttatacaattgaagatttgtggaataaatttggcgatcttaggatgccgaaggtcagtactgaagggagttccagaagattgctgtgtacctga

SEQ ID NO: 1861 - DNA, 711 bp, A.fumigatus
ccttttgaacagacagtcctcgtcaatcacctattggctcgcgtggtcggattgattattataccagctgtggtatatatgctttccttttacgtccatttctggattcttgagaacagtggaccgggcgacgcgcagatgagctctctctttcaagccaacctaaagggcaccgaagttggaaaggacagccctctcgaaattgccgttggctctagggtcactttaaaaaatatgggttatggtggaggactgctgcattctcatgttcaaacttatcccgacggctccaatcagcagcaggtcacttgttaccaccacaaagacgcaaacaacgattggtttatttaccccaatcgccatgaacctgagtatgacgccagcggacctctgtcttttgttggtgatggcgatgttattcgtcttattcatgggcaaacgggccgaaaccttcattcgcatgccatcccagctcctatcaccaaatctcaatatgaagtctcctgctacggtaacatcactattggagacgataaagatcactgggcagtggaggtcgtggatgatgtcgcgtcaagggaccgaagcaggatccgaaccctgaacactgcattccgcctgagacacatcgttctgggctgctatctgcgtgccggcaacgtgaaactcccacagtgggggtttaagcagatcgagaccacatgcgtctaa

SEQ ID NO: 1862 - DNA, 669 bp, A.fumigatus
aagaaacaaggtcccccatattatacccctcctctctttggcaacgggatcacgatttattacgatcagttggcctcaaacatggaatcacccacaccgttcgaatccttctcttttcggggcaaccgtatcattgcctacctacagacgctagcaaaggccaagaaaggtttaccgcatggtgtacctgtctgcgtctcgccttcacataccatcaccaacactgagtctctactgactctggcttccttggtcggtcctcatgttgcgatcttccaagttcatgcagacatcatcgacgactggtccgacgagacggtccgtcaattgaccttgctggcgaagagacacgccttcttgatctgggaaagcggccgaatcctcaatgctaccgtcgacgttgttgggaaaacaacgaccgagtcaagagaagtgagaaatgagttggtggatttgataaggaaaaaatacaccaaaggtgtagtcaaagcagcctcgtgggctggcattgcgacggcctgggcctctggtgtcactgtcgggaaccaagaagccgatatcttgatcccaacattgaaagccgctgctcgagaagcggtcgctgacagtgtgcaaaccatccggacagagatcacggctgtcaatgctccgactgagtccttggtgaat

SEQ ID NO: 1863 - DNA, 891 bp, A.fumigatus
gacaaatgcgatggccttcgaccgtcttgttccgcctgccgagcctctggccagacatgttcatacgatccacatgccaagaaacgtggtctgccggaaggctacgttcgcggtcttgagaagctttgggctctgtcaatctgcaatatagatggcttcgaagatactatgctggcccttttgggcacaacacctgactctgctggccggagggataaacttttgagcatgtggatggacgatagtgcttcggaaacgttgcacgaatcctggaaaaccagccgcctctatggtacgttggagaaaatgttgtcacactccgatatgtcttcatcgcacggttcgagcaagaggccacgggacgacaatgataccggtgcattagattcgacgagcggatgggggttcagacttgattgcagttctacacctttggcgcatgatgcgccacgggtggtaagactttcctcttcccaaaatgtcaaacgacctcgactgtcacagttgggtgacggcgtgtcggtatcgcagaccaccggcagaccgcaacctctgaaacttcctcctcaaacatcgcagctgttggacacatatttcgccgtcacgcactcctggttcccgatcgtagcgaagcataatatccttcgagcatcctatctttatgcaagcgccccgctgtctgttgagagcatgtcacctggttccggcgaacacgccgcactatgggcagttcttagctacaccgtttctcactcgcgaaccaatgcaccggatggggcttttgatgctcttgccaccacaaacgaatattaccccattgctccgaggctgataccttccgaaaacggcactttacgaccttgggcctgtgcaggcgctgctggttgctga

SEQ ID NO: 1864 - DNA, 336 bp, A.fumigatus
gcctgcctttgtcctggtagaaggaagagaaaggataccacgtatgtcgaagagcgataccatcaccatgcgcacggaagcaaacccgaagggcgtacctggttaggcactcggccatccgcctcagaaggaggcgaaaagaagtccaagtggggaagtctggcgactattggcattatactcggcgctcttgcattgtgtctaggcttgaggcggcggaaggacgaagacgagaagagtgattacacttaccccagttcttattattattactccgactactacacaagcgcaagtatgtctcccttgctcctcagattagcagtcagtagctaa

SEQ ID NO: 1865 - DNA, 840 bp, A.fumigatus
  unsure (815): Identity of nucleotide sequences at the above locations are unknown.
tggcacggacccttccagccccgtgtgaagacggcacacgtccgctcgcgtctcgaagatctggacatcaaaacgattattccctatgttgtcggtcataccactcacgttgtccaaagcaagcgcaatacggccaaaggtctacaggcactggtgaacgggaaatacatagtacaagactcatacatcgatgcacttgtatatgcggcaactccgagtgatttggagacgttggagtcactgtcgcccctggaaactgatttcgacgctgcgtggccggacccgacggagcatcttccacccccgggaaaagaagccgtccctcggcccgccgaggcatttgtaccaagggccgaccgaatcaacatcttcgaggactatactttcgttttctgggatgcctcgcaattcagcaaccttcaggatccgatcagcaacgggcacggaaaagcactgctatatccgctagaaaatggggtaactactgctgaggagattgtccaatttatgaagaatgcagctgggcagaaaggccttggtggggagagggttggccgtggaggggtagtccttgtccgatttcgttccaagggcgaatgggagaaatggtcaattgaattaagcaaccaagtcgctctgatgactgatcagcgagttattgagcagaacgaattcctcgatgccattctggcaaatgatgcgtcctgcctgtgccagcctttgcccgaagcagagtcgagtcctgaggttgggcgaacaccaacatcacagcccccaacgacccccaatgaacacgttgaggtgattggtgattnccaagtgataaaggggggcgagtga

SEQ ID NO: 1866 - DNA, 276 bp, A.fumigatus
tgtgtattgcgaggagagtctgaaccccgcgttttcgcacatatgggtatgtttggatcatgcaactttctcaggccatgttctgacaatcaccagtgtatggcagtggagtgtgttgctgtttcgattgcaatgtactgcctgatccagttctattaccagatcaaggatgatatcagccagtattcaccactcctcaagatcgtctctatcaagctggtgattttcctttcattttggcagtccgtgagtcgagccctttcttccgattcgtga

SEQ ID NO: 1867 - DNA, 393 bp, A.fumigatus
agcagcgacagtatgatttccaccccccgcttctgcttacccctctacacgcgcttgggactaatgtctggtcctgtcttgtctagtattattcggatcttatggatgatccccatctactcccttgtcgcctggctgagcacctacttctacaaaaatgcggtctactacgagctgatcggcaacagctatgaagcgttcacgattgccgccttcttcgccttactctgccactacattgcgccggatctccacagtcagaaggaatattttcgcggaatcacgccgaagcaatggctctggcctataccctggcttcagaaatgctgcggcggggagaaagggatgtggagggtaccccgaagcgggctgacatggttcaacgtaagctga

SEQ ID NO: 1868 - DNA, 528 bp, A.fumigatus
acccctgtcacgagtgcctttgcgaatacttccacagtctctccattcggctcccttggcgcatcaaaatccaaggaagatgatggacctaccaaaccggcggctgtaacttctgcctctgccttcgcttcgtcaagcctggcagcattcgctgggtcagagcagtcgcctttcggctcgcttggagcgtccactccatctgtttttaagtcgccagccgcgtccgagactgagaaaccggcggccgcgggatttgcagctggggcaaatacctcgggctttgcggccttagggtctggcttttcagtgttcagcggtggattcggtacagctgctaaacccggggggctgactagcttcgcttctcccgctgcgcctagcccatttggcagcagcactaaggacaagccattcggagcagcagatgcagatgaagaagaggaggaagaggatgaggcagaaactggtcccaaagaattcgaggcagagaaacccgacgagaggttctttgagcggcagagtatgtga

SEQ ID NO: 1869 - DNA, 378 bp, A.fumigatus
tattgtgccctatggactgcttcagaactgacgccatttctttctaccacagttgagacaggcgaggaacaagagaagacgtacttcagcggcaaagcaaagctcttccagttcacgaataaggaatggaaggagcgcggcattggcacattcaaggtgaatgtgagagtaactgacggccaggaggacaaaaaagcggctcgcatgattatgcgagcggatggtgtcttgagagtcatgcttaacacgccccttttcaagggcatgaaggttggagatccgtcgggcaatgaacccaagtccaagcagattcatctggctggtggtcaaggacggccgtactgtccccctcctgctcagggtaaggcattcctctaa

SEQ ID NO: 1870 - DNA, 453 bp, A.fumigatus
atggcgtggactacagatgcacagcaatcagcggataccaacaacgcgatgggactgggcggaggttcgaatagccggtcgagcagccgaggcaggaagaggtcattcgatgacgatgaagcggaaagtgatggcgaggaacatggtcacagacgcaagaggtctcgcgactctacaagcgaaggcgacgaccagccaccacggagcgagaatgaccttccgaggaagatcttgagcccaaagaaaaagagaagtcgagacaagctcgatgaagacgggtccggagaacgtgctacggagaaggcggatacgaagatcgagaatatggaatctgaacagaagcccgagtctgaaggacagcctgagaagaagcggcaccgtgacaattctacggaaagaaagccggtaagagttgatcgtcacattgtatctttggctgggaaaggacgctga

SEQ ID NO: 1871 - DNA, 219 bp, A.fumigatus
  unsure (121),(193): Identity of nucleotide sequences at the above locations are unknown.
gaaaacgaatctgggacggtgcgaaaccacagtatcatctactatctgcttgctacctcagattccgctctgtgggttagagaaatgttgggcacagacaacaagtgtcaagatgatatanagtgcaagggagaagatcctgcccggtatccaaataggttattgaatccccgtggtggtccgggatatgtcnggcacgaggattctaatggcttccaa

SEQ ID NO: 1872 - DNA, 228 bp, A.fumigatus
actagaaagaggcttgaactagaaaacatcacactctgtcgatacggactgaattttatcgcatggttgattgacgtttctaagtcggccgaaattcatctaggcgctttctggcctggtgtgcctaaaacgcggcgggtggttttgaggtcatcacagtcaaatgtcaagcgtgaaagagatagcaaacctcagaatgttgaaagagcctgtggttattgcacatga

SEQ ID NO: 1873 - DNA, 285 bp, A.fumigatus
atggctgatactctggcgtactcgttcttctcaaccaatttcctttttcagtatactttcaattccggtaaatgtttggtatggatcatgtacctcactacttggcatagctgtatcatggcgcgaactccacctatgctctctttctctcacaataggttcttcagcatagatcctgcagcattagactcagcgagtagctcaggagacaacatgaagcatgacacggatgtggagtcgctggtttccagcctcacttccatccttgcctttggctctccatga

SEQ ID NO: 1874 - DNA, 222 bp, A.fumigatus
gtacttaagcacatgttggcgaatcaaaagccactgctgagattatcaaaagcttgcttagacatgtctaaggtaggcttcaaaacctacgagcccagaaggtctatgattaacgccgtctattatcgctatttccgcgtcatgctcaagccactgctagggcgatccaaatcccacaatgaatatcgcctaatgcaacaaggcgggcatgtctcactctag

SEQ ID NO: 1875 - DNA, 201 bp, A.fumigatus
atgattccctgggattcttgcaagtactcttgtctaaggggtcttcttgtagcagctggcagattgggctcaagcgcctataaatgtaattctgtaccattctcccaggtcggttttgcttctctagaagccagtcttgatagtatgaccttgttctattctaagtcttggggcagctcattgacacaaagcatggtgtaa

SEQ ID NO: 1876 - DNA, 438 bp, A.fumigatus
ggacactataggttgatcccagatgccttccctctgtctaccatgatcctcttgggccttgccacaactgctttcgacgcggaacctgattcagctcggccagacaatgcggatcagatgacgtctcacaacctggcgcagacctgttggcggaggccggaggttgcccgcgcaggcaacccagaatcatccagtgcctataactcggcttgtgcaatggtgcttctgcgacagaaaattcaacatgtgtcttttaactaccgagaggaccttttgcgctttgagcatctggtagacagagctgtaagcttcagctttctcaaccaacgcacatctcatagtcctcttggcgaagtgcagactgatctcatcctcaatttcctcccaggcgagccctctagtcaccaaaatttggaggatatcgtcttcagccgttga

SEQ ID NO: 1877 - DNA, 591 bp, A.fumigatus
  unsure (16): Identity of nucleotide sequences at the above locations are unknown.
cgacgtttgatagagngcgctcgaacccgcggtgaagactttgaggttatcaacccgctgttcctgctcacggccaagcccgttgtctatcttgtcaacctcagcgagaaggactacatccgtcagaagaacgagtacctgcccaaggtctttgagtggatccagaagaactcccccggtgatcctctgatccccatctccgtctccttcgaggagcgcttggctgccttcggcgatgacgccagggcagctgaggagtgcaaggccttaaacaccaagtccgctctgcccaaggttattgtcactatgcgccaagtcctcaacttggccagtttcttcaccactggttcagacgaagtccgtcaatggactatccgcaagggcaccaaggcgcccgcggctgctggtgtgattcacactgactttgagaagaccttcattcaggccattgtgtacaactacaccaccctgcgggagtatggcgacgaagccgctgtgaaagccgccggcaagatcatgaccaagggcaaggactatgtagtggaagatggtgacattctcctcatcaaggccggtgccgctaagggctaa

SEQ ID NO: 1878 - DNA, 435 bp, A.fumigatus
gtcggtactgccatctcgtattggcgcttgaagcttgccaacggcatgcccttcggtcatagactctggtgcgatgttcaggtacgcgactccatggccgcgtccaccaagctggaaccagtaggagaggcccctcgcgcgcccgagcaacaggcagaggcggctccggtcgatgacactgaacgcacgggaagtcaaatgatcttccctaccctggacaaggagtcaccggtcgggagcgcccaccaggcaatggttgaagctcctttgactgccccttccgtgtccaatccatccgagcacgatatccttgaggacgtcgagactctaaccttggacgacaccaacaccgagaccgggttcctgactgatgaagagtacgatgtcttggatgccagcgaccaagactacctggaggctcagtcacgggtctga

SEQ ID NO: 1879 - DNA, 645 bp, A.fumigatus
  unsure (221): Identity of nucleotide sequences at the above locations are unknown.
tcatcgtgggcaccgaagaaaggaggcattaatcctggtcatcggtacgatcgagcgggggccaaggctggcactgaccaacgtctcgcgtacggtggccatgcggcgccggtcatgtggactgctttccatcccgcgaagggcccggttgatctaggcgatctgatgttaagctctagtctcgactggagcgtcaagttgtggcgtgtgcggccacctgntaccaccgcccccgcaacctcggctgccattgcaaccacgcaagtcgtctcacctatcttcgatctgaaccgggaggatgttgtttacgacgcccggtggtcgcctcaccgccccggagtcttctctctcgtcgatggagctggcaatctggaggtctgggatctctgctcggacaccgaagtcccagtcgtgcggaccacgccaactcgaggccgtggcggtatcttgacgcgaagccttaacaaggtggcatgggaagaacgcgagggcaaacacctagcaacaggtggattggatggtgtaatcacggtctttgaggtaggaaagggcctgagtggtactcctgaggaggtgccctcggacgaatggacggcaatgaaacggctggttgggaaattggagcagagagatcgtgtgaactga

SEQ ID NO: 1880 - DNA, 516 bp, A.fumigatus
agacccgagagtggcaaggaagaatcagtcgagaggatcaaggaagaaccggccgacgatgacgctgacgtggatatggagcgatcgtacaatgatattgaagacgaagaagacctcaaggagcgcatcaaaagggaagattctcagctccagcaaatctccggaaccggactggaggaagaaactacattggatcaagggcttggtgccacgttgaatatgctcaagcaacgcggcctggtcaagccatccgatgctgttgagcacaacgcactcctgcgggctcgtcagcgtttcctgcacgagaagattcaccttgaaacggaggccgagaaacgcgctcggcaacagcgtgaacgcgaccgagcctctggtaaacttgatcggatgtcggcccgtgagcgtgaagaatacgcacggtgggaaaacaagcaacgtgaccaacaaagatgcacgacacatggcggaagtcttcaacaaggaatacaagcccgatgtacaactcaagtacgttga

SEQ ID NO: 1881 - DNA, 528 bp, A.fumigatus
atatgctcaagcaacgcggcctggtcaagccatccgatgctgttgagcacaacgcactcctgcgggctcgtcagcgtttcctgcacgagaagattcaccttgaaacggaggccgagaaacgcgctcggcaacagcgtgaacgcgaccgagcctctggtaaacttgatcggatgtcggcccgtgagcgtgaagaatacgcacggtgggaaaacaagcaacgtgaccaacaaagatgcacgacacatggcggaagtcttcaacaaggaatacaagcccgatgtacaactcaagtacgttgacgaatttggtcgtttgatgaaccaaaaggaagctttcaagcatcttagtcaccagttccacggcaagggtagcggcaagatgaagactgagaaacggttgaagaagattgaagaggagaagaaacgcgaagccatgagcgctttggacagcagtcaacacactggcatgaacaatgctatgggggccacggctcggaaaaaccgtcaagctggtgtgagattgggatga

SEQ ID NO: 1882 - DNA, 219 bp, A.fumigatus
  unsure (186): Identity of nucleotide sequences at the above locations are unknown.
ggagctgattctttagtcaatcccgcttcggatcggatactgaggagcttatttgttaaggtttctggcgaggcaaatagcgtgaatcataaccctcactatggaagactggactccaagcttaaagttgttacccctcatcagcaatggcaggagcggatgctgactgtgtctatcagcttggantacgaaacccatcacacaagatgttgtctatga

SEQ ID NO: 1883 - DNA, 576 bp, A.fumigatus
gctacatggtcatgtccttcagtcgtccttctttttgttgctgacagagccaggccccggtcaagccctatggaggtagtcaacggcgttgagatgccctcgttccgcggtgacaacatcaatggcttcgctgccaccgcagaatctcgcaggccagacccatctcggcttgtttccgcgtactttcactccgctgccacgctcaactacatgcgcgcctcactctcatctggtctcgcggatcttcattccccactggattggggactcggtcacgtcattgagccctcaatcaaagagaagtacgagcgcatcgtcaaccgagtcaaagacgcgctgcgttttatgcacaccgtcggaatcgacacagaccgaggcgtcgagaccgtcgacgtttttaccagccaccaaggtcttctccttgaattcgaacagagttttaacccgctttttgtgcaacccacctaccacaactttcacaacccacaaggaagcttattacgccaccttccggaaactttcctttgggatcgggggaacgcaccgcgcccaacttcaacgggggcccattgttaa

SEQ ID NO: 1884 - DNA, 207 bp, A.fumigatus
gcttccttgtgggttgtgaaagttgtggtaggtgggttgcacaaaaagcgggttaaaactctgttcgaattcaaggagaagaccttggtggctggtaaaaacgtcgacggtctcgacgcctcggtctgtgtcgattccgacggtgtgcataaaacgcagcgcgtctttgactcggttgacgatgcgctcgtacttctctttgattga

SEQ ID NO: 1885 - DNA, 294 bp, A.fumigatus
  unsure (285): Identity of nucleotide sequences at the above locations are unknown.
gcaaggccatttaaatattctttgatctcgttgtttcttcctattgatacccatttcctctgcactaccaccgtcctcatcataatggcttcgtggcttcagattcccaagaactcgcccttttctctggcgaatattccctttggaatcatttcctctgcaaagatcacatcccctgtggctgcagttgcggtcggtgactatgcgctgaacctgagcatcttcgcctcgtcgggcggtttctcgcaacttcccgtcatccagccccatctcggcgtattcagncagccaact

SEQ ID NO: 1886 - DNA, 297 bp, A.fumigatus
acctctaggacggaagccgtcaaaggtgccctcccggttgggcagaactcccctcagaaggcaccctacggactttacgctgagaagctctctggaaccgcttttactgctccaaggcatgagaacaagcagacctgggtctacagaatcctccctgctgctgcgcatgagaacttcaaggccgaagatgccgactcctatcacaccagcatgactacggagacgcacaagatacatcatattcccaaccaggtcagagtgttcacctcggatagaccgagcggcttagctaagaag

SEQ ID NO: 1887 - DNA, 237 bp, A.fumigatus
cggcttcttgcattttcatgctcacgaagtatttggttcttaagaaggcccgatagtccctctcagccggacctgatcgtagtgtaccttcctttcaacgtgcccgtaaatttgcagatattcgacatcatgcctgtcacacagttctctcaccccgatccctactcataccagactggcttcgactcctatcatgagtatgagcgaaaatcacttgcatcgatttatcggagctga

SEQ ID NO: 1888 - DNA, 261 bp, A.fumigatus
agcgacaacacgagtagttgggtggaacgcacattcagcggcaagagagcccaggattcatcggtcaaggagtggctttgtggacctgatggactcatcgagaccatgactatcggtaactggtacaagctcctcacatggtcgacacctgtgtttcagcttgtcgaaggtttctgcagcttgctggtcatacaagcggcagggcagatcacccgttggctcgttaaccgcggcggacgaagtgatagctggatggtatga

SEQ ID NO: 1889 - DNA, 591 bp, A.fumigatus
  unsure (547),(590): Identity of nucleotide sequences at the above locations are unknown.
atggatgctaacttgcacttgcagattgcccttttagtactgtccgcctctatcatatcaagctctgtgtactttctttggcgcgttcttcaatttccggagatatcgaatgtcgatgctgctttgatcggtgtatcgattacgtgtgctgtgattctgtgcgcctggggtattggcagtggccgtggcaaccctgtcgaaagctcacttctattcgcctacgtcgtgttgtgcatttatcagatcttcaccgactaccagccgtcgttcccagttgagcagggctcttcgccctctcagaccggcgatttcccaccccttccgcctatcatcatggcatcctactccacactcatgcatgctttgtcttccttgccttccatcatacatgcagctttcaacgtaattactgccgtcttcagcgctgtaacaccctccgtcctgatttcgctcgcataccgtatcttcgtcctgtatgcatccactcgaataatcccagctgttcgggaatctggggcacgtgcactttctcaagaagcttctttanatgataccgatgctgccggttcattcttgggatttttgagttna

SEQ ID NO: 1890 - DNA, 900 bp, A.fumigatus
tacttgaccaacgcggaaatagaagtgttgcagaccccactccaagaagattgtggaacgcggtccccgagaacgcacaattattggagctgggtagtgggtatgatctctcctgaagaatgctctgacggttctgtatctaatcatccgtgcaggaaccttcgtaagatcaagatccttcttcaagagttcgagcggacaggaaagcacgtcgactactatgcgttggatctatccctgtcagagctacagcggacctttgtcgaggtatcatctgacgagtactctcacgttgatctccacggtcttcacgggacctatgatgatgcccttgcctggctgagcaatccccagaacctacagcgtcccactgtggttatgtctatgggatcctcaattgggaatttcagtcgtgaaggtgcagcagagtttcttgcccaatttgctcggctgctcaagccatccgatctgatgatcattgggctagatgcttgtacagacccggacaaggtctacaaggcatacaacgattcaaagggcattactcagaggttctacgagaatgggctattacatgcgaatgcagtccttggatacgaggcattccaactttcggaatgggaggtggtgacagactacgacgttgccgggggccgacatcgagcattctactcaccgaagcagaatgttacaatcgatggcgtgcttctgcaaaaaggcgagaaattggtttttgaagaggcaacaaagtatagccctcaacaacgggagcaactctggcgggatgcaaacctcgtcctttgtgaggagcttggaaatagctctgaggaataccgtaagttggtccttgcctcccgcagcgctgttgtagcagagatgtatgggagaagcgtcgactaa

SEQ ID NO: 1891 - DNA, 801 bp, A.fumigatus
gaccgggggtgtgggtttcctggggcaatgccctcaaaacaaaccaccgcgtcgggcaacgggggcaagcaaatcccctgggcgcaaataacttctttccccgaagacacagacagcgacgtcatcagactcgatttcaccttttcgtaccacccctggtccatcggccagcaattgtacctttgcttcccagacctcagtatttggcaatcccaccccatgacgccctgcagcgtcctaacacccggccgcgagcaaacacacacatacatcatccgcgcgaaggccggcctgacgcgccagctcgctcttctggcccgaagcgaccagccctcaacatccatcgtgctggccggaccatacggccagtccatcctaagcactgaactcctgcaaaaggacgtcaacatcctctgcatcgcaggcggcacaggcgtgactttcgtcctgcccgtcctacttcaactatcccgccagacaggcttcgcgtcccgaaggggtctagtcgaattcatctgggtcatccgccgcaaggcagatatggagtggctccagtccgagatggacgagctggtggctgccgcggagctgtgcgccaatttccggagtagggtgtttgtcacgcgtgagggcgacgccagcacccaggccaaagcgcaggacttggagaagaaagtcctcgtcagcgacgccatgcagcggactgagtctactgcctcccaagacggggaggcgccatttaccgtgcaatgcatgggctccaactccggtgacggcggctttgccaggggtgtattacac

SEQ ID NO: 1892 - DNA, 237 bp, A.fumigatus
tccccccaacattacgcggactttgcccctcgtgagacacgtaaggacagtccaaaaaccagcgggattctccgagcagcttctaggccaattctctgcaacgctggctggtaccattctagtgctcctgcgggtgtttacgaccagacggatacggataccaccgaagactacatctggtgtgaaggagctgaacaagagattggcgtagcattcattccgcaaggaagtggctag

SEQ ID NO: 1893 - DNA, 480 bp, A.fumigatus
cacgccgcttgcgtacgctgctgtcactggccagacgcagatggtcaacatccttgttgcgcagccgggtgtagatgtatccccattgacggttggggaatgacgccactgcactacgccgctgagaatggacatcggaatatcgtgagaataatcctcgatagccccgggactaacgcatggcacaccagcatatacgataagaccccgctggcgcttgcggctgaaagaggacaccttgatatcgtgaaatttttgctggactcgaggcagcaggtccccggggatgcagtgtggaaggctttgagccctgcgagtagtgcaagggcgaagtttcagcttgggttggagactttgcagagccggggtgaggggatttcagtcaaagaaaggttgctgagggacacatattcgcggcgtttgaacgaggtgcgtgatatattattattattctgtgattatttggagcgtgggaattag

SEQ ID NO: 1894 - DNA, 1107 bp, A.fumigatus
ggcgcggctccttccagccccgtggtgaagactaagaccatgaagcctaacttcaagttcgtcaagaccgtgcgagatgacgaggtccctacccatctcacagtgcctcagaagtacgttattctcagaggctacgagaatgccatgcctgctcttctcgagtttgtgacgaaatatgtcgaaggcgaaaaggagaatccaaatcagcgcccattcaaggcaattgtctatttcaactcaaccgtgcagactaatctggtctatgagacattccgcaacatagtcgagcagcgtcatcatccgctacgccgtgtccgtgtctacgaaatccattcccagctgactcaggctcggaggacacgctcctctgactttttccgggctgctaagtctgccatccttttctcgtccgatgtgacagcgcggggcatggacttccctgatgtaactcacgtgatccaagtcagtattcccagggaccgagccacatacattcaccgtctgggtcgtacggcacgggcgaacaagactggcgagggctgggttctcacccaccgcggagagctgcctgagttcctcaagcaactagaaggcattccgctcaacctagacaaggagaccttcgcgacggctacggtcgatatgaccaagcctgaactggaccccaagtcccccgcaactagattcatccaggagattaaggatgctgtgagagaagttcccgaaagtctgaaaaggcgagcatacacgtccctattgggccccttgagaggttattttgctcgcaagcaggatctgatccaggccatcaacaactgtgtcgtgcacggctatggcctgcccgtacctccccaactgagtccgaccttagcccgtaatttgggacttgatcgagtacctggtgttcgtattgcgaactaccgcggttccagcgacaacatgtcgaccagacctgattatcgcggaggcgatcgcgatatgtgggccagtaactctcgccgtggccgcgagttcaattctgaccgccgtgagtcaaggtttggcaatcaccgcaacgccgatgatttcttcggaggccgccggcgtgcctacagagacgactactag

SEQ ID NO: 1895 - DNA, 192 bp, A.fumigatus
agctcatctgcacatgctgacggctgcagctggcccgacatatcggcacagctcctgcgatatgttgccgaccgcaccgggatcctctcttttgccaatgtacctctattatggttgttcgcaggcaggaataacataatttatctggcctaccggatggaagcttttcgaacctttaacatttttccaatc

SEQ ID NO: 1896 - DNA, 198 bp, A.fumigatus
  unsure (144): Identity of nucleotide sequences at the above locations are unknown.
gcgagctgtcatcatggctgtcaacgtttcccgtcattcttcaacatagctgaagcatatctacaagatagcagctgcgatgaaaagcgtactgagtctcacttttgctgcactggctcttgccaggtcgaattccttctgtcngtgcagaccccacgagcccttgtggcccttctcacaagaatggaatgcccttaa

SEQ ID NO: 1897 - DNA, 237 bp, A.fumigatus
gaagcaattactatcactaaattaggggatccatacagacaagtcgaatggccggtggcgtcgatggtatacgttagccgctggatacacagatacgcagtatcgcagatgatccttgcctgtgtctctgacatggttggcatttggacactcatgggactagaaacacttgtggatgccattctgaccctactgtacaaataccgccgcacaaacttgggatacccttgcggatga

SEQ ID NO: 1898 - DNA, 486 bp, A.fumigatus
actgttgacgcaactgaggaagttcagagtactctgtatatagcttcatcatctcagtggttccctctccctttagccttgggaatatctccccgcgcgtacaagatcaaacagacaagcatgacatcgccggcatatagccatcacttctccatcaacaatctcccctttggagttgcatcctcatcgcagcatcctcaaccgcaatgcgtcactcgcctcggcaacaccgtcatcttcctcggagacctgcagcgagctggtctgttccgcgaggtcaccagtctcccaagaggagtattcgacaaccgcactctgaacgccttcgcagccctcgataagcaagtccacaagcatgtgcgacaagcgctgcaatctgccttgcaagattccggagtcaagaaactgccgataggaagtacggaaccgatcactgccgtccggatgcatcttcccgtctcaatcccagcatttactggtaagtaa

SEQ ID NO: 1899 - DNA, 423 bp, A.fumigatus
catctcgcagacttctcttgcagcctcaatcacgtcaaaaacgcaggcagggcaatcctgaacgacgacaccccgccaccgggtttcttccacttccccatcggctacggcggccgcgcaagcacaatcgtcccctcagggacccccattacccgacccctaggccacttctatgatcgatccgcagggatcgagaaaaagaccgtggcctacgggccctcacaggcaatggactacgagctcgagatcggtgttgtagtcggtacgccggtgccagcgcaccgcggtctagacgccacagacgcagacgagcatatcttcgggctggtgcttctgaacgattggagcggtgagccaccacctccgtttcggagatatgtattcaccacggggctggaaggatccgcggtggtgcaaatggga

SEQ ID NO: 1900 - DNA, 1029 bp, A.fumigatus
tcgactacgcagactcctccctctgtctcgactcgcatacaatcccgtgtagatccggcagcgcagaaggcttcgaatccacaatctttgacatctacggcgcaaaatcaattgaataaatcaaatacaaccatggagaacacctccggttcggcgacacccaagcccagagcggatccgtcagacaagccaaatcggccagtccaggtggcatcgcctaccgatcagaatggatctcagggtgataaaaagaggaagttgcccgcggaggagaatgcgtccgaaaaatcgcagcctgctccagaccgccccgtgtccaagcggaagcgcatggaagaacgacaccaaaagctgcggaagcgcggtagaacacctccttcggcgtactctcgccgtgacgcagaagagacatcatcagctgccgatcgcaatggtccaacttgccgatgtacctcaccccttccgcctccacggtctcatacaccagaggaccaacctcggcagcgcaagcggcccggtggtggggctcggatgggactggtagatcgggagactttgcgccggagacaagaagaaagagagcgtgcgcaggttgaagaggcgatgcgggcgtcccagagccgcggggtggcagatgttgttcgtcaacactacaacgcagtgccacagcgcggaagggagtggcggaagacggaaagtaagatcaagggcctgcggagcttcaacaactgggtcaagagtacccttatccaaaagttttctccggacgaggaatttcttgcgcggttcaacggcaccaaggaatgggctgaagacggcggcgtgcctccggtagaggaaaagcgacttcttgtggtcgacttgggctgtggcaagggtggtgacctcgggaagtggcagctggctcctcagccggttgatttgtatgtcggtcttgacccggcagaggtatcaatcgttcaagctcgcgaacgctacaatgggatgaatcttcaccaccgggctgcaaggagacgcgtacagggggaa

SEQ ID NO: 1901 - DNA, 684 bp, A.fumigatus
aatgttcaggtctccttcaattatgtctctgcatcatcaaaggcagccgcagatgctctcgtccaggaacttcgcaatgaaaacaaagaggccctcgccatccaagcagatatgactgatatagatgcccctagtcgtattgtccaggcgactctggccgaattcaaaacagaacaaattgatatcctggtcaacaacgccggagcgggggacaaccggccgctggaggaggtgacggtcgatgtctatcaaaatctgatggatgtgaatgtccgcgcggtgattttcatgacgaaagccattctttcgtatattcctcgtaatggccgcattattaacctgtcctccatctcggctcggggtgggtatgccacacagtcggtctacgcggccaccaaagcggctgttgagggcctcactcgagtctgggctaccgagctggggcacaagtacggggtcacggtgaatgctatcaatccaggaccggtggacacggacatgtacagagcagcagggccagtgcacctggcgcgcatggaggagcagaataaaaaggttcctgctgggcagcgatgtggcacggttgatgatattgcagatattgtgacttttcttgcgcaggagagatctagatgggtaacaggagacgtaatttgtgcgaatgggggcatgttatatatctga

SEQ ID NO: 1902 - DNA, 270 bp, A.fumigatus
gaagacaccactatgtcgctccaagggaaagtcgctattgtcaccgggggggcccgaggcattggagcaggaatagttcgcagtctgagcaaggaaggggcaaaggtgagacattcgtctgactgttacggccgcaatatcaagctcactgataaaatgttcaggtctccttcaattatgtctctgcatcatcaaaggcagccgcagatgctctcgtccaggaacttcgcaatgaaaacaaagaggccctcgccatccaagcagatatga

SEQ ID NO: 1903 - DNA, 627 bp, A.fumigatus
attgactctgagcctgtgaaaaaggcagagaaacacaggaaaggatcaacctcaaatgactcaactgcaggaaaagcgctcaaacgtaaacgggacggggataacacccagaaggatccccagttacaagagtatctttccgtaatagaacgtccctcgaagactaagacgtgggccaatggtgatgactttctcaacacaattcagaaccagccagcgacaagtgaactgcgggaagagcagcgcgatgataccagtgaaaaagttgaggagcattctcacaagcagcggaagaagccaagagtagatgatgtaccaaaggcggcccatgatcgagaacctgaaccaatggtcttggacaagactgaagaagagcatgagagagcaaatgcagatggtcaggttgaagctattccccccacacaagaagaggcagagccagtgtcggatgccgattggcttcgttcgaagacgagtcgtcttctaggtctacttgacgaggacgagcaggctgagttcgactctacagcccagcgaaaacccgatccgtcgtcagagccagagactgtttcgaaacccggtgctcaacacttcttacacgccgggcatggaaggacacgcgctccc

SEQ ID NO: 1904 - DNA, 369 bp, A.fumigatus
gacacaatcatggagaacacaagagtgttcgtgtctggccttccgccgacatttacgaatgatcaattgaggaagcatttttcaagccgcttccagatcacagacgctcatgtacttcccaagcgcaggattggtttcgtcggcttcaaaagctccgaggcagcccaacaagcggcttcttacttcaataaaacatatgtcaagatgtccaagatctcagtagagattgctaagccggtatgtcattttttgcgaacaaccttgatattggttcccatgttcttctgtcattttcatcttcacccgctgacttgctgcaaagttggtcttgagactgaccataatggtagattgactctgagcctgtga

SEQ ID NO: 1905 - DNA, 225 bp, A.fumigatus
tcccaaagaacgaatataaaagcgttcagaataacatgtcccggttctccccccgcccaacaaacggtgccttgcacggtccgcgattccaacccgcccacttggtcccccccgccgtcaatggcaaacccaatactgtcctctctgcaggaaggcttcggaaaatccgtgaaccccggccaaagaacttccaaaaagcttgggcaggagaccaacctgcctaac

SEQ ID NO: 1906 - DNA, 861 bp, A.fumigatus
ctgttacgaaggacgttttgcccacgattgtttcacctgcagactccccaacttgatttgttgttcaagtcagtttggattggcttggcgggaattgaccggaagattttcggagcgtctctcataccaaagatttgcgagtgcttgggcttgacggagaagaacattcggctgacaaacgacgtggatctgctggtggccgctgcgacttcccaccgcgactgttcatctgcagtcgtcgtcattgctggaaccggcagcgtcgccatgcgatacaaccgaagtgtcgatggcagtgagtactctcgagtcgctcgatccggcggctggggtcacttcttgggtgacgaaggaggcggatatgccatcggattggaggcgatcaaatacaccttgactgttctcgaggaaatgagactcggcatatgtactgaaccattggggctgttggagcaggcagttctaaaacgactgggatgtgccagctgcggaccaaagcagattgatcttctcagtgagatcctggttcaacagcacaaacagacgatcaaagctcgtattgcaggtatggccgaagtggtgctcagcctgaacggacagaacgacacgtcctcggccattgtcagccgacaacttgactacttggcaagtcggactgtaggacgtttgttggatcctgcttgtgctggatacattcctacagaacattccggtctgattctttccggcagtatcctcaacaatcaagcttatcaggatcaatttctcaatgtgcttgcgaagagcggggccaagttcgcctatgtggagagagtatctgatgcaggcctcctgggcgtacggcatctgacatcgccttga

SEQ ID NO: 1907 - DNA, 291 bp, A.fumigatus
ccagctatacaaagcccaaggtccaccctcctcttcagccagggagcacaccttggagaggaaatcgacggtatctctgtatatcttgactttgagcatcagccgagtaacaatgcactgactgagctaggtttgaacctgaccggctgtgtgtggacagttgatcaggagactcataatacggtgaccgtggaattctatgaccgagaactacaccgtgactttcacttcaccgacccctatctctatgaccgcgcatgtctcagtatggaacattatccagctgtgtag

SEQ ID NO: 1908 - DNA, 195 bp, A.fumigatus
cgattcctagacgagaacggaactttgttttcgaataacccgaccgatggcagtcccgctactatattctaccgccctcatgagacctggacaacgcgtgcggattggcgaacacagttacctcaaggagagttgatcagaggtaggcactgtgagcccgactcattcaaagactggcggctgacggagatatag

SEQ ID NO: 1909 - DNA, 405 bp, A.fumigatus
gttcctattcgcggtgctcggcgcctgtggagaagacaggccgggaatgtcctgtccgagaatggccgggtcgtcattacttatggcggtgggcacaccatgagcaatcatcgccgggagagggtgatggaggatgtccgtcgccaatcgcaacacttcgttggagatggggcatacttcgaccatgaccgccttttcaatcacctcgtcgatgagggttgggtgcttgtacaaggagaacccatggccgatgcggcgggagttgaagagaatggcgtccaccaaattgtagtcggtcgagttcccgtctcccagggtctcaccggcgtggaaaaagaaggggatagtcaggttcaggtactcagtctgctcccggaaccagatcagttcgggggccaggtctga

SEQ ID NO: 1910 - DNA, 384 bp, A.fumigatus
  unsure (241): Identity of nucleotide sequences at the above locations are unknown.
cgagattgggggaggattcccaggggtgtttggtccggcaggtaccctgatcagttaggagccgatcggggggactttaaaccaggaattgttggaaggttaagccgaggacggcatcaaacgggtggaaatccgcagcggtggttccagcgcaaaatggttcacaccggccaggaggacattgatcccaatctcgagttctggtggaatgtgatgatcgaggagattgagaagttccagnccaccgagaaggggaagaatttctggggtgcccgcgtcatctggtccgacactcgaagcaagaaccgggagaagatcacccagagtaagtctgctttccgagtcactatacggggaaacctgactaaccggtctcaggcatga

SEQ ID NO: 1911 - DNA, 510 bp, A.fumigatus
ccggtctcaggcatgaagattgccctcgagcgcaagcaaaggttcccggagctgttcagcggctacgatctggtcgcgcaggaagatctgggccgtccgttgtcagacctggcccccgaactgatctggttccgggagcagactgagtacctgaacctgactatccccttctttttccacgccggtgagaccctgggagacgggaactcgaccgactacaatttggtggacgccattctcttcaactcccgccgcatcggccatgggttctccttgtacaagcacccaaccctcatcgacgaggtgattgaaaaggcggtcatggtcgaagtatgccccatctccaacgaagtgttgcgattggcgacggacatcctccatcaccctctcccggcgatgattgctcatggtgtgcccaccgccataagtaatgacgacccggccattctcggacaggacattcccggcctgtcttctccacaggcgccgagcaccgcgaataggaactca

SEQ ID NO: 1912 - DNA, 408 bp, A.fumigatus
agacctcatgaagatcgcgcgcgaccatgcccgcctcgacccaaacatagattcccacctccgcaccggccgcttcagctacctgaaccgcacgctcgaggacctcgttgcggaggtcctccgccaggatacctcgagcacctcccccgtccccgaaacagcgccacaggcggaggccgaagcagacaggagattcgacgtcgtgaccctcttcgaggtcctcgagcatgtcgattcaagcgcgggttcctcccccctggccttcctaacagactgcctgcgtctcgtaagaccgggcggctggctgatcgggtcaacgatagcgcgcaccctgccctcgtggctggtgaaccaggtgattgccgaggcgccgtggccgattggcgtcgtgccgcgcggcacgcatga

SEQ ID NO: 1913 - DNA, 672 bp, A.fumigatus
ttgccttacgtaagggcggatcctggcagctcccgtggtgaagacctcatgaagatcgcgcgcgaccatgcccgcctcgacccaaacatagattcccacctccgcaccggccgcttcagctacctgaaccgcacgctcgaggacctcgttgcggaggtcctccgccaggatacctcgagcacctcccccgtccccgaaacagcgccacaggcggaggccgaagcagacaggagattcgacgtcgtgaccctcttcgaggtcctcgagcatgtcgattcaagcgcgggttcctcccccctggccttcctaacagactgcctgcgtctcgtaagaccgggcggctggctgatcgggtcaacgatagcgcgcaccctgccctcgtggctggtgaaccaggtgattgccgaggcgccgtggccgattggcgtcgtgccgcgcggcacgcatgaatggagcaagttcgtgaatccagatgaactggaggggtggatgcaggaggggttgatgaggagttcggatggggctgcggcgcgtgcgggcagtgaggcgctgcagggtatgaagtggaaatgcacgggtgtcatgtacttccccggcctggggtggaagttgattcccgggtcggagagctggggcaactacttctgggctgtgcggaagggtggatactga

SEQ ID NO: 1914 - DNA, 465 bp, A.fumigatus
cacccgtgcatttccacttcataccctgcagcgcctcactgcccgcacgcgccgcagccccatccgaactcctcatcaacccctcctgcatccacccctccagttcatctggattcacgaacttgctccattcatgcgtgccgcgcggcacgacgccaatcggccacggcgcctcggcaatcacctggttcaccagccacgagggcagggtgcgcgctatcgttgacccgatcagccagccgcccggtcttacgagacgcaggcagtctgttaggaaggccaggggggaggaacccgcgcttgaatcgacatgctcgaggacctcgaagagggtcacgacgtcgaatctcctgtctgcttcggcctccgcctgtggcgctgtttcggggacgggggaggtgctcgaggtatcctggcggaggacctccgcaacgaggtcctcgagcgtgcggttcaggtagctga

SEQ ID NO: 1915 - DNA, 1014 bp, A.fumigatus
  unsure (998): Identity of nucleotide sequences at the above locations are unknown.
ataccttcacctgctgaatctcttcccatcgctgtccgtatgtcgtccctctcccagggagattcgccctcattgactgccaccgcatcctcgtcctcatctagctcgacatcaggatctcgcactccgaaagcgaacaattccttcaatcaatcggccgcatcctacttctcctaccccgtcacacacgtcgtctcaggactctaccgccgcttgacagaaccaaacatcaccaaagcatcgcgcaaagacagcaacagtcccaataggaaaatgaacgccagaaacaaccgcgactcatccacaacgtccccagatatcttcgtccctatccgcaccgcatcgcccttccaaccaccgcccctcaccccgctaactctcacccccggccctggtgtcccccaacaacaactcctcacccgtgctctcgccgaagaaatccgcctactggtcccagcccgcctccagctcgtcgatacctggcgtctagcctacagcctcgaccgcgatggcgcttccctctcaacgctttacgaacactgccgcgatttctcgcatcgcagcccgcgggcgggctacgtgctcatcgtccgcgactcctcccccgccggtgccgtctttggcgcatacatgaccgaccccccacacccagactcgcactacttcggcacaggcgagtgcttcctctggcgcgcgagcgtcctgccatcgccgtcgaacctactgaatatcaacggcccgcagtccgaggagatgctcgagcgcgccggcctgcccttgccccccagtgcggacacaacacatgcgggccgctcgacaacactacgtggtgactcgcgaggtcacggcgatggccgcctcgcggcaccgcgggccaatggcgggactggcgccggggcggcgagtggtgccagcacgccggagaggatccggttcaaggcttttccctatagcggcgtgaatgactacatgatgttttgcgagactggcttccttancttgggtggggggtga

SEQ ID NO: 1916 - DNA, 420 bp, A.fumigatus
gcgaaagcgtcacgggaggtggcagtaaacaagcctctccgcaggcaggtcactgccctacgagagctaaaaaccaagcacgcggacaaggcgtcgacctggccgattcttctaggcaacaacttcctctgtttgctggccgtcgacgcctaccaaacaatcgcagaggacttcgccgatctcatccacccgtttcggtttaaccaggcacagcaagcggccatcacgcgtctccgcgcgctccctggtggcgttggtatcatccaggggcccccagggaccagaaagacctatggacagtgcgaccatccctcctgtttctcccttccaacaactgtcatactgactggcggccaccatcatatcatgctaacccgcgccgtcgaccgaggtcgttcacgatctcccggtcgcgattga

SEQ ID NO: 1917 - DNA, 684 bp, A.fumigatus
ttccctagattcaagcgcggatcggcccatccccgtggtgaagactcgtcgtccgggtgtgttgattctcccaactcgccgccttccgaaatccttgaaaatatgagtcttcacgggggatcgagccctaaagagaatatgccggcgttcattcagcccaacttttccttgcctccatcggcgtttactttcacgcctcctgcgtctccccgacagagtcttggaaaccagccatcgcccgctcagagtcgccgctcactcacgcccagtagcgaggatgaaatgctgcctttgtcaccctccaagcgccccctcgagaagatcgttgaagaaccgagcctgcctttcacttcgagtgccgacccatacaccgatattgctgcctccaccgcggagctgtcttctccacatacggctcccaccttggctgattcgtctcacggctccgacctcgatattttcatcagcacggatagctccgccaatttcaagcatgaatttcccgatctgagtgaccccgacatggccgctttccccgactatgtcaatgggtctaccttcgaacccggaatggatctgttctcgagcaagacattctctgccggtacctcgatgaacgaggacttcttttcactccaattccaggttgatgatatgaccaaagaattcttcatggactgctag

SEQ ID NO: 1918 - DNA, 285 bp, A.fumigatus
aagatcaggctcctccccgttttatcttctccaggttctccctcattgtggaattccctttcccttgaccttcctgttgtcatcctacagagtatcgccatggccgtctcaagggatctcgaggctcctaccgtcgttaacgacccaaccgctgatgatgctgtggttgaaaagaaggaatatgctgatgggacgccggcaaatgacccgtttggaaatgaagaatgcggagaaggtcttcaccacggggttgaaaggatccgagggggcgcaataggggttcaa

SEQ ID NO: 1919 - DNA, 966 bp, A.fumigatus
tatactgactcttgtcctagcgaggtccttcggtccagccgacaaggctataccaaagccgtagatctgtggtccctaggctgtgtgacgaccgtgctcctgaccggggaacctcctttcaacactccatcacctaagtgtgaaaccagtcagggcaatagacagggtgctctcgacagcctcgaggcaaatttgacctgcaacatgattggtaagcgggcgaaagactttgttcttcgtctcctggtcttcgatgaggcaaagcgcatggatgtgaagcaggcattgggccattgttggttcaccaaccctgttcataaggaggcatttgaagcgctctacaagcgatccattagggactggaagcctcgagcaccgaaggagccactaatggtcgacctcgatctgattcaagtccggaagacaaacggagatgtcgctcagacacattcccaagagagtttgccaagtaagctttttaaatcagctgttccaagggcaaatggctctaaagagtcaatattagaggaatcatcatcgcctgaactacgcagagatctctctccgacactctccgaccccgaactaccgccacacggccaactagacgacaatccacatcaagcttatgatctgggaaacgaccctgccgaaattgaatcagaagcagggaagttagatgccctcgagcagagactggaatcttcagagcaatctgaagtactcagaagtgaaagcgaagaattcaaccagtatgagtgggcaatcccacctataatcccaaatttttcgacggccaataccgcactcttgaagaacattaacaatagctcaacaagaaagaagcgtgctagtaacacctgggaggaattcgggaatgaggtctacgaggaagtcaaaaatagtatcactgggaagcgacatcgcttgttatatggcgcaaactttgtcgcaaactggagttga

SEQ ID NO: 1920 - DNA, 234 bp, A.fumigatus
gcagatgttattttggttttgccccaatggcttgctgtaaatcaaggcagccccgcataccgcggtgacaagcttatcgccggcgcttatcatctggctggaaagcctggaacctcaggaatccaggatcagctcatcattcattccatcgatctcagtccccagattaattgcaggtcccaacactcgtcctatccaatcgtgtatgcgacagtcaatgtctcctttcccctt

SEQ ID NO: 1921 - DNA, 495 bp, A.fumigatus
tatacgcatagcgcggaaccttccagccccgtggtgaagacagtggaaattgaccgcattccattcattttgacgttgcagtccctgatcaactggaaggctgaaacacatattggagtcccaagcgatcaattgcttaaatgcgctcaatgtggcccaagctcctcatatgcgaaatcaaacttcctgcacctcttgctgcttcttatccaaccgcacatgggacaatccgtttgcgaatctgctcatcctcattgggtctcgattcaggctttcatagatcgcttcgagatctgtaccaataccaagctcctccgccgtcttgagactacgcgcatccaagaagggggccatggaaggccaaacgcattgtacgttgttaagaaagatatcgacaccaaggtcacccagtcctttgatccccttgatcaaatctctggtccttttgcggtcgttcccagcttttttcagaagattattaaggtcgccgtctag

SEQ ID NO: 1922 - DNA, 453 bp, A.fumigatus
aggatggggggtataatcggtatcgagagcaaggtgctacaaacctgggcgatttggcggacttcgtcaatggacagtacggtacgcatcccttccttgagatcagtctggttctgtcagtatgttcaccacggtctagacggcgaccttaataatcttctgaaaaaagctgggaacgaccgcaaaaggaccagagatttgatcaaggggatcaaaggactgggtgaccttggtgtcgatatctttcttaacaacgtacaatgcgtttggccttccatggcccccttcttggatgcgcgtagtctcaagacggcggaggagcttggtattggtacagatctcgaagcgatctatgaaagcctgaatcgagacccaatgaggatgagcagattcgcaaacggattgtcccatgtgcggttggataagaagcagcaagaggtgcaggaagtttga

SEQ ID NO: 1923 - DNA, 804 bp, A.fumigatus
accatttgtggccctagcgaaaaaaaatgctcttttgaaaggggaaatcgcaacaccatgaagcacagttctcccgctgtagaagattacgaaaccgacggcaccccagtcccagtgcccgaaaagcgccagcgagaccaaaaaatacacgagacatcggatcgcgacgactcagagcagcctccaaacaaagtatcgaagtcagccagtgaagaatctagctctaaaaatgagaacaaagcggatcctaacctcaacagcaagggatggaataaggacaacaaaggcaaacaaggcctaggggtgaaaacggccgcaaaacaaaaccaaaaacatgatgaagaagacggtttggagggtgctgaagggcaattcgaagatgaggagcatgctaaaccctcggaatcaccaaaagtgcacaagattatcgaggagtttggccggcagccactagagggcacttcccttgcgaaggggccgctcattgcgtctccggagacggtgcttgcgatggtgcttgacgcgatgttgaagtcgcggccgatttcgcatgatctttcgcagcgtgcggtgaccgagctcattgacgaaggttatcatgacatcaaaaagctgggggaaagtagttgggaggaacggacgatggtgctaaaggatggggggtataatcggtatcgagagcaaggtgctacaaacctgggcgatttggcggacttcgtcaatggacagtacggtacgcatcccttccttgagatcagtctggttctgtcagtatgttcaccacggtctagacggcgaccttaa

SEQ ID NO: 1924 - DNA, 255 bp, A.fumigatus
ggaggggatctcattaccgtggtcgaagatgtgtatattgttgtcatttgtgatatattctttttcgttctttcacttcccgctctctcccctctccaacctccaactcacaactcaatcgctccccccctttcgtcgctgtatttttcccccactactttgtactggctttgttttccacttaccaacctaactctttttttccctgctccgcgtcacaaaaccctgtatttttccctctgcgtgtctgcgtga

SEQ ID NO: 1925 - DNA, 243 bp, A.fumigatus
gagcgcgtgatttttcagccccgtcgtgaggacaaaacgagggtgtgggtttcacattattccgataacgtgacggtgactgtggtgtggtttagcttaactctcccctctcaagcacaagcacagcgggagcgtccctctcccaccggccttttgcatccagcgggggacgaaggacaatataattcagacttcctgtttttactacttaactccatggagactccagattccagtatctga

SEQ ID NO: 1926 - DNA, 252 bp, A.fumigatus
tccagctccaacatgaaacccctcacctacctcgccctcctcctcggcatctccgcaaccaccgccttcgccgccctccgcccagacgcaacccccgatgaggtcgccgcggcggaagctgagtgcggatccctgggcgtgatgaggatcgacccagcagagctgcctgagggcatcacaatgagtgacgtccgcatgtgcgccaaccatccactcggccccggggcgtacccaggtttgggtcctggggct

SEQ ID NO: 1927 - DNA, 540 bp, A.fumigatus
cagcaccaaggcatccatccacccaatctcaagcttctctatcaagactcttcccttcacaaagcctcccgtcctctcaaaatgaagttcaccacacccatctctctcatctccctcttcgtctcctccgctctcgcggccccgacgccagagaacgaggccagagatgcgattcctgtctccgtgtcctacgacccgcgctatgacaatgccggtacctcgatgaacgacgtttcctgctccaacggcgtcaacggccttgtgaccaagtggcctacctttggcagcgtgcccggcttcgctcgcatcggtggcgcccccacaatccccggctggaacagccccaactgcggaaaatgctacaagctgcagtatgaacaaaacaccatctacgttacggcaattgatgccgcacctggcggcttcaacattgcaacgagtgccatggaccagttgacgaacggcatggcggtggagttgggcagggtgcaggcaacgtatgaagaggccgacccatcccactgtgcctctggtgtatag

SEQ ID NO: 1928 - DNA, 204 bp, A.fumigatus
ggatccttgctgaatgggccgaccaatagcaccggtctcggctgggacggtgtacggcccgaagcagagaagcgcgggctacggccaaccacctggcaggactgggaacgcatcgacaaggcagagcgggagcgaggccagcagaaggggaaagctcgagataagtttggacgagtggaagagatgttggaggttatatcttga

SEQ ID NO: 1929 - DNA, 537 bp, A.fumigatus
gtgcacgtacacttccacccccgtggtgaagactgtgtcattcattcttgtacttgtctgttccctggcctgctcattcgcacactctatctcgaacccatctctgttagaggaaagatggctgaatttaaatatccagttcgctctgctcatttgaatcggaaagctgccggagtcttcgaggttccacatctgccaccttgggcacaaagccacgttcagcacgcacagaatctccttgagtgctcagatgaacctatcgagtacgatcacgacgacgaagactactcggacaactgcttctttttccccgaggactgttcctggtctccgcctccgaattgggttattgaagacgacaggtccgaagacgacattgcggacggaactgactctgagcacgactacgacaacacaatgattccgggacttccggacattcgaatgctcgatgcagaggccctcagcgatttgctagaggacaacctctcacctccggagatcactacgatcatgtatgctgatgtcattccttga

SEQ ID NO: 1930 - DNA, 690 bp, A.fumigatus
cattttccgactcatagggtgtttgccacaaacggcgccatcttcgcctatgcttcgtcactttcgtctcggcagttgcgcaacttgagtgcgacgtacggagctgcctatacgtgctacgcaaagaacgcctcgagcgggaatcttacaggcgtgaacccagccagtcacccgtcgtcatatgtcacggcacaatcggtgtcgctaggtgacgtaggctcgattgtctttgagcttgacgactcggtggccgtcgtgaccaggatagcggacaaagtcctgctggccgctgtggggccgtcgaaatctgacaccgacgaggccgattctgctgacggaacgccagttcatcaaaacggcttcgcgaaattggggacagaggcgacgtcggcaacggagtcgaatgcacaccggcccaccaccaacagtacacacaccaaccaagcgccatccaccacgacctcgaccccaacaagcatctctcgcaacgagagcaaagctgacgtacaagcagacgctgatctagagacgcagtacgagattgaccggaacagcaacctcgctcgcctagccagcttgaatctgtctgcatcgccgtcgacgctcttagcgctcgagtcaaaggctgccgctctgggaaggtttctcagtcagaagttggccgactttgagagccccgacgatttttag

SEQ ID NO: 1931 - DNA, 357 bp, A.fumigatus
  unsure (252): Identity of nucleotide sequences at the above locations are unknown.
gactccttctcctcaccctccggccacagcatccgccgggtggccacagcccagattgtccctacgccgacacacaaccagatagccacctgggccatcgtcaaccctgacccaacccacagaatcgcagacgactgcagcacctgtccaatccggatagtggcaagcacgaaccccgtgttcggaaagaccatgctccaatatggaagcgacatgcgcagcgccccggtgcccgccaacacgcgacacttngccaggacgcctgacaaccgcaatgcacagggcaaaaagctggccttgtccccaacgaaggaagccccacccacgcggcggagtccaaggcaaaggcttccgggg

SEQ ID NO: 1932 - DNA, 360 bp, A.fumigatus
  unsure (105): Identity of nucleotide sequences at the above locations are unknown.
cccggaagcctttgccttggactccgccgcgtgggtggggcttccttcgttggggacaaggccagctttttgccctgtgcattgcggttgtcaggcgtcctggcnaagtgtcgcgtgttggcgggcaccggggcgctgcgcatgtcgcttccatattggagcatggtctttccgaacacggggttcgtgcttgccactatccggattggacaggtgctgcagtcgtctgcgattctgtgggttgggtcagggttgacgatggcccaggtggctatctggttgtgtgtcggcgtagggacaatctgggctgtggccacccggcggatgctgtggccggagggtgaggagaaggagtcttaa

SEQ ID NO: 1933 - DNA, 552 bp, A.fumigatus
  unsure (29): Identity of nucleotide sequences at the above locations are unknown.
agtaatgggttgcgaacaggactaggtanatgcccacatgcaagcaaagaaaaagccactgacggctcccagtcattgtattctgatcaggccatggccgcgcagagcatccgctttctgagtgtgaatcaagtccaacgtttacatgggctctggatcagcccaactgcccagccggtgcagctccctctgttggaatctgccatcaactctccgatgaatctcaagcactatgggaaccaaggcgatgtctttcagctcgctgccaacctttctgagaaaatcatgaagaaccacgcctatcaggatggcaacaagcggactgcacttctggccgctgatatattccttaaaatcaacgggtatagacttcagaaagtgccgttcgcggacgatccgattaataaaggcctggctaacgcccatgtcgccgtcgttaccaatcaatggactgtcgaccagctgggaaatttctaccgatcagtggcgaagccattggaacagttcacaccagatattgaggaattcagaaaggccgctattgagtattag

SEQ ID NO: 1934 - DNA, 279 bp, A.fumigatus
gtgaccgctcattctattcttgggaagcaagagctgagagacccaggatggaattctctgtatcttgaaaatcatgaccaatcccggtgtgtgtcacgatttggcaaccctgatccgcgatacagagccgtgtcagccaagatgttggctacaattcagctctctctaagaggaaccccttttatctatcagggccaggaattgggcaccccacatccccagaactggaagattgaagattataacgatgttgagacgcatggatactacaacgcgtag

SEQ ID NO: 1935 - DNA, 336 bp, A.fumigatus
gcgattcttggccaatctccccttggtttattatttactgacgcattttacagtcagtacaaagctcgcaaagaaaaagatccctccaaggagcctgacatgtccgatgtgatggatgtcattcgcctcaaaggacgggacaatgcgcgtagccctatcatgtggaataatgcgcccaatgcagggttcacttccccagatgccaaaccttggctccgaatgaacgatgaatatgccaatatcaacgtccaggctcagactcgtgatcccgactcggtcctgaactactacaagaagctgttgcatatccgcaaacagcatccgctgatggtatga

SEQ ID NO: 1936 - DNA, 207 bp, A.fumigatus
gaaatgccgtgtggtgtggacgaatacgagtccagtcagtatgtggccaaggagcgtcaggagctatctatggtcttccagtttcaccatatggatctggatggtgaaaatggagacaaatggaaacctcgcaagtgggaactctgggaatttgagaaagtgttcaggatttggcagcagcatatgctgggcaacaacggtaggtga

SEQ ID NO: 1937 - DNA, 636 bp, A.fumigatus
gttgctatactaaactctgtcttaggcttctttggatattcccacttcacagggggctttgccggtgggctgtcggaatttgttcgcgtcccatatggtgacgtgaacctccttaatctgcctgatgacgtccccgatgaaaaaggactctatctttctgatgtcttgggaacgtcttggaatgctgttgtcgacactggggttaaggaaggcaacactgtggcaatctggggagctggcccagttggacaaatggcagctgaatacagcttcttccatggtgctaagagggttatcctaattgacggcggccaggggaaatggcgactagactttatcaagaaaattctgcccaaactggagacaattgactttgcaaacctcccaaagggtgaatcagtgccctcgactttaaagaaaatgtgcgatggccacggacctgatgtggcaattgagtgcgctgctggtgagtatgaaaaaggctgggcccattactttcagagattactcggcatggaaacagatacatctgaactggtcaatgaaatgcttatgtctgtccgtgggtttggacactgtggtatcacaggcgtatatgctggttatgttcgtggtaccttttttatggtgagataa

SEQ ID NO: 1938 - DNA, 306 bp, A.fumigatus
gataagtccgctgacgacataattcagtgtaatcacttcgacatcggcgccttaatggagtgtgggatcaagctccatggtaatggacaagctcctgtgcaaaaatattggaaagagctgttgaggtatattcaagaggacaagatccaccccctggatatggtcacccacaggttcaagctcgaggacatggagaaagtatatgatttatttgataagcgggaacagggcatgcagaaagttttcatacagacaagattttctgcacctccatccccaggatcacgcccactaactgtgctttga

SEQ ID NO: 1939 - DNA, 1149 bp, A.fumigatus
agacccggtgctggtggcatgctcatggacccagccgccatcgatgctctgacgaaagatcaacgggcgctgttcaagcagcaactggagatcattgcgcgctacttgaagatggacctgcgtgcgggccagaaggcattcattgcttcccaagaaactcaaaatgcgctgcaagcacagcttgatctctggcaagcagaacatggtgacgtgtacgcgtctggtattgagccagctttcgattcactaaaggctcgcgtctatgattcgtcttggaactgggctcgtcaggatgctttgagcatgtattacgacattatctttggaaggctcaaggtcgtggaccgtgaaatcgtcagccagtgtatccgtatcatgaaccgctccaatcctctcctacttgattttatgcagtatcacatcgacaactgtcctactgagcgtggtgaaacgtatcaactcgccaaggagctgggacagcaacttatcgagaattgcaaggaggttctcggagttgccccggtctataaggacgttgcgatccccaccgggccccagacaacaatcgacgcccgaggcaatattgcctataaggaggtgcctcgggcgagcgccaggaaattggagcattacgtcaagcagatggctgagggcggtcccatctccgaatacagtaaccgcaccaaagtgcagaatgacctcaagaatgtctacaaactgattcgaaagcaacatcgcatgtccaagtcatcccagcttcagttcaatgcgctttacaaggaagtcattcgcgctcttagcatgaacgagaaccaaatcatgccacaggagaatggccactccaagaaagctggtcggaacggtgtcaagcgcaatggcagccctagagctggtaaggtggaaactatacctttcttacacctcaaaaagaagcatgagcacgggtgggaatacaacaagaagctcacaggtatctacttggacgtgctcgagtccgctgctcggtcggggctgaccttccagggcaagaatgtcctgatgaccggtgctggtgctggttctatcggaactgaggttctgcaacgtctgattaccggtggtgccaaagtgattgtaacaacaagccgattctcccgggaagtcaccgaa

SEQ ID NO: 1940 - DNA, 318 bp, A.fumigatus
gctgctgttgtcgtcgatgtcagtctctcgccctcaaagtcgtcacttgcctctttaccacttaaccagccaacttacaacgtctggactcaactaatggatccaaattctagtaccgacatgcattcctcaaattctagtactcaccagagtacccctgcatctcttcagtcccagacgggatctatagtcgtagttggtgaggcaggtattcgtctatcaattgtgccggatggccacccacagggtgggaatgattgtacgatcctagagagaaaaaccggtgcatcacttttgacggacctgattgtctctgcc

SEQ ID NO: 1941 - DNA, 639 bp, A.fumigatus
gatctcccggatcttcctactgctacttcaccgttggacagtgcgattaatggcctgaaattcttctcgaaactacagcttccaccggggaattggggctgcgaatatggcgggccaatgttcttgctccccggggtggtgattgcgtgggtggtgacggagacgcccattccgcaggcctatgcgatagagatcaaaaattatctgatggcgcgcgcgaacccggtcgatggaggatggggtctccattccgaaggcgacagctctgtgtttggcacgtccctgaactacaccgtgttgcgccttcttggggtggacagtgagcacccggtcatggtgcaggcgcgaggtcttctccaccggctcggaggcgctctgaatgcgccgcactggtcgaagttctggctggcagttctaggggtgtgtgactgggaggttgtcaatccggttcctccaaaagcatggctgctgccacactgggtaccagtggccccatgggagatggtgggtgcatatccggcaagtccttcctcccgatgtcgtggatctggtctaaaaaggtggaaggccgccggaaacggaactttgttaaggggccctgctaacgggaacctttttgttcccccccttgggattaac

SEQ ID NO: 1942 - DNA, 360 bp, A.fumigatus
aaaaaaaaggtgcgggatcgaagaataaccgagaatatagtcaagtacgaggatactcgcgaagatggcatcaaaggcgagacggcggaaatgcctgccgaatttggcatgtgttatgagaaaacagagctcaacggctggtcattttttaaccagctcacgaataagcaagaaatggccatctcccctgcggcacttgatcgatatcgtaccaagaataagctctctgacattgagaataccgaagcagcgctgaagggcaaatcgcttacgggtctaaagcttcgggcggctgccacaaccatcctgcatgaaatgacccatttctacagcttatttggggcgggaaaaacaggttag

SEQ ID NO: 1943 - DNA, 372 bp, A.fumigatus
gtacggcttcaacccctttccattcattcggagtgtactaactgtcttttgatgcacagtgatgatgttctccgcgctgtgaaatcccttgggcctcttgggtctggtttctccattgtgcaagtcgggagcaagcaatacattcgctcgatccccaaagagttgaacaccgatcaggccacagtcctcgaggcaattcaaatactgggctatgtcagcttgtccatgttgcagttgaacctgaactggacaaaggcccgcgcacaaactgtcattgatgaccttgttgcagacggcctagtttgggtggacacacagggcgaagagaatgaatactggtcgccccaaaatctccttgatgacagcggatga

SEQ ID NO: 1944 - DNA, 456 bp, A.fumigatus
gccaaccatggcgggaatcttcgctctgcgcaccttgagtccctccaaacacaactgtccgtattccagtcgttgcttcacaccttcgcactagaacatggttcaacaataaagtcgaatccgacatttcgagctgaatttgctcgcatgtgcaatgctatcggagtggatcctcttgcagcaagtaatgtgaaagggaaaaatggccggagaggagaacgtgctagcttctggacgcagattatgggcggtgatatgaatgacttctattttgaggttgctgtccgagttgtggagctctgcagatccacaaggagcgataatggaggcttactaggtgttgaggagtgtcgaaaaaaggttggcaaaggcaaagccattgggagcggcttggaggtcactgagtacggcttcaacccctttccattcattcggagtgtactaactgtcttttga

SEQ ID NO: 1945 - DNA, 210 bp, A.fumigatus
ttcaacagagggcttagacatagtggttggtcgcagcatggccatggtcaccagccattcccagccgggaatcgtgcctcatgttcaggtttgcattatatatcctctctaagagagttcccggagttgattgagaatatggaggtgcagttgcaattcgaaaagtacaacgttcggcgaggtgctcctgattaccacttcccagagtag

SEQ ID NO: 1946 - DNA, 240 bp, A.fumigatus
gaaggacaaatgtcccaaagaccaacatcctcccatgactcctccgccccgcaccacatcccagtagacgactgcctaacctacgacacaggataccgcccgaacctccccggccaacgcacctggtgggtcttttgccctgtgacgggggctttcgacaacagctacgccctcctcggcgcgatgatcgagtgcgtcgcgcgcgggaaggccacgctgggcaccgggctggggacgtaa

SEQ ID NO: 1947 - DNA, 213 bp, A.fumigatus
ttggaggttcgatatttcgaacaaggtagagtagagaagcgagaagagagaagagcaggatatccaaaggataatggtgatggtgagaagaatgtccattttgagcagacttcgtatgaaatttatatctgtcgtgagcagagaaatgagacacactctgtcgatataagacattatttcggtacatcgcgacaagacggtgatgtcttgtag

SEQ ID NO: 1948 - DNA, 279 bp, A.fumigatus
ccgacctgcaaggccaaaaaatggcccaactttgtcagtatcggactgcgcaatgagcttcgccagccctccacaagcaacacgcagtacccgtacaactgggggacatggtacacacaggtgacgacagcagcgaaaagggtcaacgcagccaatcctgatgcgctgatctttctgtctggcctgaactacgataccacgctcgcgccccatcccgacagcatcggatctcggcaacggggtgaggttccgtctctccgacttcagctttgcgaataa

SEQ ID NO: 1949 - DNA, 459 bp, A.fumigatus
ggtggagacgccaccgtccagaactcgctgatctacgcgctgggatcaacgaacgggactaaggttttcgatcagatccgcaaggtgaacccccagatcaagtcgacgacgacccgtcttgaagtctttgatatggtggccgcggagtgcaataaacaaggactctatatccatttggataatcacatctccaaggctatgtggtgttgttcccagaccgacggctatgcctggtttggcgatacctacttcgacgttgccaagtggatgcgaggactggagtatatggtttctcatgtaagtcacctcccacaaccagacgcacgacatgctgaccgacctgcaaggccaaaaaatggcccaactttgtcagtatcggactgcgcaatgagcttcgccagccctccacaagcaacacgcagtacccgtacaactgggggacatggtacacacaggtga

SEQ ID NO: 1950 - DNA, 429 bp, A.fumigatus
actacgataccacgctcgcgccccatcccgacagcatcggatctcggcaacggggtgaggttccgtctctccgacttcagctttgcgaataagctggtcctggagcttcacaactatgacaccggtgcgaccagctgcagcgcgctgtctggtgcgctatggaacgccggtttcaaggcccagaactcgtctgacccgtcgattgtgaacccgatgcccgtcgttctgaccgaatttgggttcctgcaggacagtaccacctggaagaatgtgtatgccagctgtctgcggacatggattcccgagcagcgcgcaggttggaccacctgggttattgccgggagctactacattcggcaaggcacgcaggatatggatgagacatggggtaagagccattccaaaggtgttgctgtgttaaaatgctaa

SEQ ID NO: 1951 - DNA, 1083 bp, A.fumigatus
gacaagcatgatatacttcgaacggcattccgtcagtctgaagataatgcgcaaatcttgcctcggacgacaggatccggggactgcgcggccctttgggcagttttgactctggcgtccatgcaagagaggtcgatcgcggccacgcgtcagatgggagcttctccaaaccggccacgctctagccagctatacgccacggccagagcattgatacctgccgagaagggcattcatgagattgggcatgtgcaggctttgctgattctgtccttggtgaaactcggacaacaggaatggaaagatgcgtgggtgctggtagggcaagcaattcgaattgcacggtggctgggtttgggttctccactgacaggctcggctgaaaatgagaagggctcggcacggtcaaagcatgtctttttagggtgcttcgtactggaaacactgatttctagcaagactggccaggcaccgtcgctacgcaaagaggatctcgtcaagaccggcccgatcaatgaggatggcttggaggaatggcatccttgggaagatcagactggtctgcgagccccagaatcgtcgcgtggttcctctcaccgtggaccccttcatgccctgagcacattcaaccggatggtgtccttgatgtgcatcttgaacgacgcttgttgcacaaagcgattggagaacaatccggcaccacagctcgaggcgctggaacgacagttacaacattgggtgtcggccctccctggaagctaccgtgttgacttgcagagtcccactaggcttgcctcacctcacatctttggattggaaatgatgtttgaaagcagcgtcaccgccttatctttggacacgatacgccagggggataaacgtctgtcagacctgagaaagactcgtgcgattgagagcttaaagaggctcatgctgctgttgcaaaagtacatggaaacttatagcctggcggcgacaagtccaatctttggaatgctattgacgtttggtatctcctcgggggaggggcaaggcgcgcgaggggaatttgaacttgatataggcctcaagaacaaacttgaa

SEQ ID NO: 1952 - DNA, 381 bp, A.fumigatus
  unsure (175): Identity of nucleotide sequences at the above locations are unknown.
agacccgatcttggcgctctttgcatcgccatcgaagaaaaattcactgataagctttccggttccgggagcgttctggataccccagcaggtgtgtccagcagcaaggtacagccctttagtgccagtgtggccgatcaagggacctccccgtacgctgacgttgggcaagtancaagcttgccgtgcgcaaacctgtccgtcccgaagctcatcggatatgctgcccacttgatcgatgatgtcctggcaccgcctctggtccacttcaacatctgctgtggtctttggaagcgggacaacctggtcaccctcgccacaagcgtataccgtctcatcggggcgggcgtaaatctcaggggacacgactgtggggcgtga

SEQ ID NO: 1953 - DNA, 192 bp, A.fumigatus
ggtttctacttttcttccgatgcattcctagagatgcatttcccgaacttaccttttcttctcgcgccctttctctacaatgtcgtggtctccggttggcaggcctccgccgcagacgatttatctgtcctggccaccgagacagcgaacgccgtcttcacccatcgggactggccggatcagcggcattgt

SEQ ID NO: 1954 - DNA, 585 bp, A.fumigatus
  unsure (12),(68),(585): Identity of nucleotide sequences at the above locations are unknown.
ctgatcagaggntatgagagcatgagcgaccccggcgagaccgcccaagtccacccttacgtgttcantacatcaatcgcaaagcttgccgaggagaaaggcgcagagatcaagttgggatcagtgacaaaaattggttacgcaggggatgctgtggaatcagttacatacaatgataaggaatccggagagtcgcgcacaatttcggcgacggacgtcatcattgccgctggtccctggacacgaacggtcatgccggaagctcccatatcggcaatgcgcgctcacagtgttgtcatccgaccgaccaagccggtgagcgctcatactctatttacgaacattgaaatacctgccaacttcgatccatcgaagccctcacgccccacagtcgtgtcccctgagatttacgcccgccccgatgagacggtatacgcttgtggcgagggtgaccaggttgtcccgcttccaaagaccacagcagatgttgaagtggaccagaggcggtgccaggacatcatcgatcaagtgggcagcatatccgatgagcttcgggacggacaggtttgcgcacggcaagcttgn

SEQ ID NO: 1955 - DNA, 198 bp, A.fumigatus
tacttgcccaacgtcagcgtacggggaggtcccttgatcggccacactggcactaaagggctgtaccttgctgctggacacacctgctggggtatccagaacgctcccggaaccggaaagcttatcagtgaatttttcttcgatggcgatgcaaagagcgccaagatcgggtctctagatccgaggaactttctctga

SEQ ID NO: 1956 - DNA, 243 bp, A.fumigatus
ttcgcagtcctccctcggaaatcggtcggggatgacacctaccactacggaggtaagcggtggccaaaaaacgcggctggtgtggagaacccacgggccgtgttttatgatggcggaagggagaacacaatttcccgaacgggccatggtgctgaaataaaaggggcccttctaaaccatttcatgggtaatgggggtttgcgaccaacattggaaaaacgggcctttcttgggagaagcgcg

SEQ ID NO: 1957 - DNA, 195 bp, A.fumigatus
cggagcacaacgataacagccggtgataagacttttttagtcaactcacggaccaggattgataacgcgggcagcttccggccgtggaggtctaacatgggttacctcctcccaatgacactagctacttttgagaccgccatccgtcatacacttacttcctcatgcatcgggtttctgcagacctcctcctga

SEQ ID NO: 1958 - DNA, 681 bp, A.fumigatus
gacagcgaagcgaatgtcgacgaatacggcgagttcctccacatccctggacagaagttttacgacttcaacaagattcgtgaggagattgtgcgggaaactgaacagaaagtcggtcgcaatgctggtatctctccagcgcctatcaacttgcgaatctactcccccaatgtcctgactctcacactggtcgatttgcccggtctcaccaaggtcccagtcggcgaccagcccaaagatattgaacggcagatcagggatatggttctcaagtacatcagcaagcccaacgcgatcatcttggccgttacctctgccaaccaggaccttgccaactcggacgggttgaagctggcgcgcgaggtggaccccgagggtcagcgcactatcggagtgctaaccaaggtcgatctgatggacgagggtacggatgtggtggatattcttgcgggcaggattatccctttgcggctgggttacgtccctgtggtcaaccgtggccagcgtgatattgagaacaagcgtcccatctcatacgcactagagcacgagaagaacttcttcgagagccacaaggcttatcggaacaaggcttcgtactgcggaacaccgtaccttgccagaaagctgaacttggtatgtattattggccgaatcatatcaccgtggagccttagctga

SEQ ID NO: 1959 - DNA, 303 bp, A.fumigatus
  unsure (92): Identity of nucleotide sequences at the above locations are unknown.
tccaaatgctcaccagcaaaccattcacgtcgagccaatgcctcccaaactccgcagctcgatttcgaagagcctatcgcggccctcggacnatggactgatcttctactgtccatcctgctcgatctggagacgaaacctggcaacgcgtccccgcggcaatctcactccgcgacgagaccagcaacacctcccatcatcgcccttgataccctcggtgaatgtgtgtcgccgtcaacttgcaacaccgtctctggtcagctctcggaagaacgtaccagaacggttccgggggctgtatga

SEQ ID NO: 1960 - DNA, 981 bp, A.fumigatus
  unsure (919): Identity of nucleotide sequences at the above locations are unknown.
caacctgcgtggtatgagcttcgtgaggatgccttgtcccaacccgatcgaactgaccccattgagctagatgacacctttatgcactgcctcaatgtctccgggtcaaaattcatcatttccaccccagacctgtcgcaatttgtatgtgtagacctgccacatattgcgctgaaccttgggtcatttgatggcatttccgtcggcgcgatagagctggttaccgcagctgatctgcagcaatactctcccactggcttgatcccagccaagcgatcggtccgtgatctgtgtgtactcatctacacctccggcacaacaggcaaccccaaggcatgtgctattcgcaacatgatgaacatggtcacgtcgaatcctctgagcacggatgtcagaaaccccgccaaatactacccactgcgcacctattcctctcttccactcttccatggcaccgcatattttacgggtctatgctactcggtcggcaatgcaggcaccctgtgtttgcgccgcaagttctccgcctcccaattctggaaagatgttcatgactcgaaagccacccgtatcctgtatatcggtgagctctgtcggtatctgctcgccacacctccatctccatacgaccaagaccacgcctgcattgtcgcgtcaggcaacggattacggggtgagatctgggagcggttccggcaaaggttcaacgtccccgagatccgcgaattctatcggtccaccgaaggcgtggccaagttcgacaatcacggcgtgggcgcatggggcgcaggcaaaatagggttctcgggacccatccgacgaatccttggaggaagaccgtcttcatcgtggaagattgatcccggataccgagataggccggcccgggacccaaaggaccgggttcctggttcaaagngccaacttggcccaagaaggaaaaggcccatggcccgaatcaagggaccggaactttgttga

SEQ ID NO: 1961 - DNA, 480 bp, A.fumigatus
acagcgtccgttccaatccgagtcaacatggtgtccgaatttgagaagcaccgccagtccccttctttgcacagcgttacacaaatagagctgggggactgcggatcctcgagcaccgtctgccagtcacgatatcaacgatggacccggagcttcaagaccttagaaacccggggaattgagcctgtttcaccagatgatcgtcagaagcccaccacgtcggacttgttccacatgctcttgatatggttcagcatgggaatggcagtaaatcacatggttgtcggttcgataggaactctggtcatgaatctgaacttcacggacgccgccctctgcgccgtatttggaaacctgattgggggtttggcggtcggctatatgagtacctggggtcctaggagcgggaatcgcacacttgtatggccatttacgatcagttccctcctgtgttcacgacgggtggaagataacgcgtcc

SEQ ID NO: 1962 - DNA, 240 bp, A.fumigatus
agtagaggtaggaagaaaagggcgatggtggaaggagcaggaggcagaggccttttcagagggaatcaacgtgatctaactgcccgtgatattggcttcacatcacttttgaatggaccaagtgaattcagctttaccaagtacgttatacctgccccaacactattgaccggacttcccacagcattccccgattaccaccccgggagaatacgccttcacctggcgaatgccgaacaa

SEQ ID NO: 1963 - DNA, 201 bp, A.fumigatus
ccgcttcccgacgccgcagagccggatggcttatgtaaacaacccctgaagggtgcgccgtacgcccagattctcccctatatcaagaagggaatttgcacccttaacgactaccaagacatcctggacatcctggagcgcgcctttggtgaccctaaccgcgtgaacaatgcccgaaacgagctattcagcctgcgctag

SEQ ID NO: 1964 - DNA, 219 bp, A.fumigatus
cccccacctagtaccttccagcggcgtcttttaaaacagattgctgtagccggtctgagtgtcaactacctcgttaactatttctgtttacctgtgatccagtaccttgacacctcccttggagttgacactgtcagaatgcccacccctctgcccccattcctgcctggtgaccccgaagagttctccgagcacgttgctagccatagtactgaatag

SEQ ID NO: 1965 - DNA, 237 bp, A.fumigatus
  unsure (82),(117): Identity of nucleotide sequences at the above locations are unknown.
gtatattttgcttttacatggccttttataattaagttcttaagatgggttagtatgttcgcctgtgacaatcgaacccctntacggaatattgaatatagatttttcccgtcactntaccccgagttcagacattgtgatttgaagcgctcggcagatatcgcttgggccaaacaggcgctggtcaagtctcaaaaatacagcagcttgtgcatcgtgcagcattctatggattaa

SEQ ID NO: 1966 - DNA, 183 bp, A.fumigatus
acggataaccttaagatctggagtctcacgcgctaccaattacgccacagccccgaatgtatatactttgtgctgatttatgtagctaagtgtgctaatagctcccgtaaagccagctctctgctactggtgcacaaattgttacatatgcaatcatgcaacaaacatgaggtgccttgttga

SEQ ID NO: 1967 - DNA, 225 bp, A.fumigatus
ctaagtgtgctaatagctcccgtaaagccagctctctgctactggtgcacaaattgttacatatgcaatcatgcaacaaacatgaggtgccttgttgaccaacttcctgattacttctccttgtcaaaccatgtttactattatataagagacacggagtcatatatgagcaattatgattttagatcattcagcacccgaaccagcaagtctagttttatctga

SEQ ID NO: 1968 - DNA, 477 bp, A.fumigatus
caatgccgcaattataagaactatccgaccacatccattatgaacactgagctccatcaggtcctgaatgtttgggaccgtatccgtgttaacagcccaatatacgcgttccttctcaacgacgttgaaatctatagcgcgcaaaaagggaaaattaatgctcgcgttcgtgttacttctcatcatttgaattccaaaaacacactgcacggtgctttttccgcatgtgtcactgattgggctggtgggcttgccatcgcgtcctgtggccatgactctacaggtgtgagcaccgacatccatgtcaattacatgtcaacggccacgacaggggattggcttgagatcgaaggatgtgcagataaggttgggaagacacttgctttcacgacagtaatcatttccaaaaaatcagaggaagggaagatgactatcgttgccaaaggttcacatacgaaatacctcagaaccacctga

SEQ ID NO: 1969 - DNA, 648 bp, A.fumigatus
ccaagcaggtcgagggcgtcatcgacgacctcatctccaagaaggacaagttcgtcgccgccaacgccggtggcactgtctacgaggacctcaaggcccagtacaccgctgccgacagcctggccaaggccatctccgccaaggtccctgagtccctctccgacatcgccgctcagctgtccgctggcattaccgccgccattcagaagggtatcgacgcctacaaggacgccgccagctctaccggcactgcttcctcttctgcccctgccactgagaccgcgaccgccaccgagacctccactgccactggcaccgtcaccgagacggccacttccacccctgtcatccccaccggtaccgcgtctggcagcgcctccgctaccccctccaccaccgctacccccaccacgggcggctccggctccggctccggctccagcactggtactgccactgcctccaccagcaccaacctcctctccactggcgccgccagcaaggagcacttcagctactccctcggcggtgccgtcgtcgcggccgccatcgccgtcgctctctaagcgccctctttctgactttgcctattggctctctgagtcaaacacaagtcggacggcggacggcggaaaagcaccccaatga

SEQ ID NO: 1970 - DNA, 396 bp, A.fumigatus
gaccgcgaccgccaccgagacctccactgccactggcaccgtcaccgagacggccacttccacccctgtcatccccaccggtaccgcgtctggcagcgcctccgctaccccctccaccaccgctacccccaccacgggcggctccggctccggctccggctccagcactggtactgccactgcctccaccagcaccaacctcctctccactggcgccgccagcaaggagcacttcagctactccctcggcggtgccgtcgtcgcggccgccatcgccgtcgctctctaagcgccctctttctgactttgcctattggctctctgagtcaaacacaagtcggacggcggacggcggaaaagcaccccaatgatgcgaatggaaccttgatgaccaat

SEQ ID NO: 1971 - DNA, 876 bp, A.fumigatus
tactacccttcgttggtcaaaatgcgtttctctgccctcctcgtcactctcggcctcaccggtgccctggccacgcccaccctggtctctcgtgaggcccctgccgtcggtgtcatctccgacatctcggcccagacctctgctctggcctccgccgtctcctcctacaacggtggtgacccctccgccgtcaagtccgcctctgagaagcttgtcagcaccatcaactccggtgtcgacaccgtcaagagcggccctgccctcagcaccgctgatgctctggctctgacctctcccgtccaggacctgaccaagcaggtcgagggcgtcatcgacgacctcatctccaagaaggacaagttcgtcgccgccaacgccggtggcactgtctacgaggacctcaaggcccagtacaccgctgccgacagcctggccaaggccatctccgccaaggtccctgagtccctctccgacatcgccgctcagctgtccgctggcattaccgccgccattcagaagggtatcgacgcctacaaggacgccgccagctctaccggcactgcttcctcttctgcccctgccactgagaccgcgaccgccaccgagacctccactgccactggcaccgtcaccgagacggccacttccacccctgtcatccccaccggtaccgcgtctggcagcgcctccgctaccccctccaccaccgctacccccaccacgggcggctccggctccggctccggctccagcactggtactgccactgcctccaccagcaccaacctcctctccactggcgccgccagcaaggagcacttcagctactccctcggcggtgccgtcgtcgcggccgccatcgccgtcgctctctaa

SEQ ID NO: 1972 - DNA, 918 bp, A.fumigatus
gcaaagtcagaaagagggcgcttagagagcgacggcgatggcggccgcgacgacggcaccgccgagggagtagctgaagtgctccttgctggcggcgccagtggagaggaggttggtgctggtggaggcagtggcagtaccagtgctggagccggagccggagccggagccgcccgtggtgggggtagcggtggtggagggggtagcggaggcgctgccagacgcggtaccggtggggatgacaggggtggaagtggccgtctcggtgacggtgccagtggcagtggaggtctcggtggcggtcgcggtctcagtggcaggggcagaagaggaagcagtgccggtagagctggcggcgtccttgtaggcgtcgatacccttctgaatggcggcggtaatgccagcggacagctgagcggcgatgtcggagagggactcagggaccttggcggagatggccttggccaggctgtcggcagcggtgtactgggccttgaggtcctcgtagacagtgccaccggcgttggcggcgacgaacttgtccttcttggagatgaggtcgtcgatgacgccctcgacctgcttggtcaggtcctggacgggagaggtcagagccagagcatcagcggtgctgagggcagggccgctcttgacggtgtcgacaccggagttgatggtgctgacaagcttctcagaggcggacttgacggcggaggggtcaccaccgttgtaggaggagacggcggaggccagagcagaggtctgggccgagatgtcggagatgacaccgacggcaggggcctcacgagagaccagggtgggcgtggccagggcaccggtgaggccgagagtgacgaggagggcagagaaacgcattttgaccaacgaagggtagtattagagattagttgtatctaa

SEQ ID NO: 1973 - DNA, 543 bp, A.fumigatus
agacagatgcccattttcgccatcacgcattggtacgccttctcctggcacgactacgcggatcccaccatttccgccgctcggctgccggttgtgtatgcgcttcgagatgcctttggagccaaagatctggtggaagacacgaagatgactcttcggggtgagaactacgagtacaggcgatttgattccggggatcatatcatcccgcatgctgagtctaaatctcgagttaaacgcgtcatggacggaatgcggtacgagcgaggcggaaaggcaaagtactggattcccaagccaggagaggtcaacagtcgaactcctttactggctgatgcagaatcaagtaaccggagtcgaagaagcagcgctctggagcgcttccgttcaaatagcgacatggaagaaaccactctggatccagacgacgaggatttgttcaccaaagctcgcgcgttagagtttggagattggaatgtaagtcttgcccacattgacgacgaagaacgaagtggagagctgattttttccagtacccggtaa

SEQ ID NO: 1974 - DNA, 498 bp, A.fumigatus
cctgtacctcctgatatcattgatagatgcatctacttccgcgcgtttcaaaggccacttcaaggctcgaaggccaaatatcttcatcggtttctgtgtcgttctaggctcaataaccttcttcaagttcgcaagggtggaaatgcatctttccagatcgtcgaagagcgaccgggacacagcaagtttcgagccatttgggccttcaaggagctgcttaagcgcggtaagtactcctgtaagtgcattggtctcttgttgaaggttgacgatatctttcctagcaactttcactttattaacgtattctccacatattttcacgatgctcccagccagctggataacactgataacactggctgcactggaaagagggtctataatcagaggggttgcagggtgcaagaccgttcgatcccttgccaaggaaatgatgggaaaagtgctaatgaagtattgatggagatatttgaaagaaagaggggcaggtgctga

SEQ ID NO: 1975 - DNA, 363 bp, A.fumigatus
cttctgcatttctttaggggatttacaactcatatcgaccacagcattagtttgagcagattacggactgcaaaaggagccgcatttaattcttatgagaaccagcatgatgaatgcctcctggggactcggactaaactgctcagcgatattgagaagtgggcaatatcaccacagggaaaatgcatattctggctgtatgggatggccggaactgggaagtctacaatttccagaacagttgcacaccgtctgaaaaagaaagggccatttacggcgagtttcttcttcaaaaaaggcgaaaaggatcaaaggagcgcccaaaaccccctttccattaatgataaccattccccgatctga

SEQ ID NO: 1976 - DNA, 435 bp, A.fumigatus
acggtgtcctcgtctcgtggatcaacgagtggtccggcgaggctaagacctccgacgctcccgtctctcaggctactcccgtcagcaacgctgtggctgccgccgccgccgcttctactccggagcccagctcttcccactccgacagttcttcatcctccggcgtctccgccgactggaccaacacccctgccgaaggcgagtactgcactgacggattcggtggcaggaccgagcccagcggctccggtatcttctacaagggcaacgttggtaaaccctggggcagcaacatcatcgaggtctcccccgagaacgccaagaagtacaagcacgtcgctcagtttgttggcagcgacactgacccctggaccgttgtcctcgtggacacaaggttttcacactcgccgaatggccggatcaacgctagtaggt

SEQ ID NO: 1977 - DNA, 603 bp, A.fumigatus
atcacacaagtccatcctttcttcgcaatgcagctcaagaattcgatgctcctactcacggcgctggccgctggctcttcggtcgcccgtttgcacggccacgagcgccgccacctccaccatgcgggtgagaagcgcgaggtcggcgacactgtctacgctactataaacggtgtcctcgtctcgtggatcaacgagtggtccggcgaggctaagacctccgacgctcccgtctctcaggctactcccgtcagcaacgctgtggctgccgccgccgccgcttctactccggagcccagctcttcccactccgacagttcttcatcctccggcgtctccgccgactggaccaacacccctgccgaaggcgagtactgcactgacggattcggtggcaggaccgagcccagcggctccggtatcttctacaagggcaacgttggtaaaccctggggcagcaacatcatcgaggtctcccccgagaacgccaagaagtacaagcacgtcgctcagtttgttggcagcgacactgacccctggaccgttgtcctcgtggacacaaggttttcacactcgccgaatggccggatcaacgctagtagg

SEQ ID NO: 1978 - DNA, 207 bp, A.fumigatus
atcatctgccctatacagactcgcataccccacaccgcatccagcatcctcaaccatcaaagctgtacccttttgctttcttttccattcttatttattattatcatagaaaagattaattcttatcaggtccaatacaatatagtctttaatttctgtcaacaagaaataattaacattgtgattcctatatcagggaatatctag

SEQ ID NO: 1979 - DNA, 249 bp, A.fumigatus
actcggccaccgggctgcgaggtcgatggcgtgggaatcgtgaccatcattgacaagccaactggcccggaattgcttctgcaaaagcagtacaggccgcctattgacaaagtggtcattgaagtcccagcgggtcttattgacgccggtgagaccgttgaggaatgtgcggtgcgcgagctcaaggaagagactggttatgtgggagtagcagagcagacaagcactctcatgtttaatggtgagtga

SEQ ID NO: 1980 - DNA, 366 bp, A.fumigatus
cagagcagacaagcactctcatgtttaatggtgagtgatgcattgatactacacgcaattttccgtgatcaagccccggtccaaccctctgaggcgtggtgcaagacactgattgagggcatcacagatccggggatgtgtaacactaatctgaacatggttcatgtgcgtgtggatctgtcacttcctgaaaatcaggatccgaaaccgcaactcgaggacaatgagtgtatcgaatgcttcactctgcccttgagtacattgttttccgagttgaagagactcgaagctgatggatatgccattgatgcccgcgtgggaacattagcagagggcatcgaactggcgaacaaactgaagctttga

SEQ ID NO: 1981 - DNA, 831 bp, A.fumigatus
  unsure (9),(36),(71),(75),(76),(78),(82),(83),(84),(86),(89),(90),(115),(123),(138),(147),(148),(291): Identity of nucleotide sequences at the above locations are unknown.
caaaaaccnaaaaacccccccccaaacaaaccaaancaacccccccaaaccccccaaacccccccccaaanccannanaaannncnttnnccctttacacattccctcccgcaanccatcatncacgccatctcctcntcgacgcgnnaaatggtcgcctgcctcatgatgacacccgcgagggttctaaagcagaacgcgcaggttaccaacgtgaacaccggcaagggcggccagaacgcaaagagcgccatgacgcaggttatcgctcggttcaagcatcggccatgnaagctgtggagcgggtacacggcgctggtggggcgcaatctgccctttacggggctgaatttccccctgtttgagcttttcagatcgcatctcgtggagtggaggaagaggcgcaaggaggacgatgcgatgcagacgcgggagtggggtccggtggtggagagggcggcgctgacggggatggcggcctccatgtccgggatgatcgcgtcggtcgtgacgaccccgatcgatgtgatcaagacgagaatgatgctttcagccagttgtcataacaatgatgacagcaataagagcacgaagaagaagatggctggctggggaacgcttagggtgggtaaggagatctatcgcaatgaagggatcagaggtctcttcaagggcggcgcaattcgcgctgcgtggacggctgcatcgcttagtatgtatctgagcatttacgaggggggaaggttctatctggagaatagacggcgggagaaacacgggttgaacacacgggttgaggtagatggctcgaaagaagaggctgccatctag

SEQ ID NO: 1982 - DNA, 384 bp, A.fumigatus
gacatgaggaccagccggttgaccgtcgcccttctggaggagcaagatttatgggagagccggagagcttggcgcgacgtcgcatccgccatcgagcgcggtgacatggacgccacctccgtggccaaatcgaagattgagaacgctcaacgcgagctccgcaaagtcgaaaaggccgaaaaccgggaatgggagcgccggttcttcaagcgcgtcgatgaaacagccgacgaggagttccagcgtctggctcggatggtcggcctgacttcactcgagagtgataagaccggtggcgtctggcgtttcgacaaggagcgcgccgcaaatgccaagcctccctatcaccagattggtggcgagggactcggagtgtccgagtaa

SEQ ID NO: 1983 - DNA, 429 bp, A.fumigatus
  unsure (328),(414),(422): Identity of nucleotide sequences at the above locations are unknown.
aatcgtcgactacgacccctcctggccaaccaccttcgcctccatcgcccagcgcatccgatccgccctcggcgccaccgccctcagtgtcagccacgtcggctcaacgagtgtccccggcctgcccgccaaagccatcatcgacgtcgacctcgtcgtcccagaccccaccgccgaggacgagtatgccccggccttggaggccgccgggttccagttcctcttccgcgagccgaactggtacgagcatcgcttctttgggctggcggagccatatgccaatgtgcatgtgtttgggccgggggcggcggacctgatccgccaccancggtttcgggagtggttggtgtcgcatccggcagatcgggaactgtatgtgcacggcgaaaaaggaaggtgccccggaaaaaccangaaaaacnggctagt

SEQ ID NO: 1984 - DNA, 678 bp, A.fumigatus
  unsure (576),(662),(670): Identity of nucleotide sequences at the above locations are unknown.
gacatgcatgcagtagtgcgtgcagataacctcacaataccccaaataggccatgccacctcgtattcgcaatctgaccccagcaccttaaatttggatgactcacagtctggctacataagccttctgcctctcactctattcgaaccaccagccatccatccgtttaccagcatgaccatgtccacagacaaatccgccagacactacatcgaaacaatctccacccgcccccagaaacccattgaaatcgtcgactacgacccctcctggccaaccaccttcgcctccatcgcccagcgcatccgatccgccctcggcgccaccgccctcagtgtcagccacgtcggctcaacgagtgtccccggcctgcccgccaaagccatcatcgacgtcgacctcgtcgtcccagaccccaccgccgaggacgagtatgccccggccttggaggccgccgggttccagttcctcttccgcgagccgaactggtacgagcatcgcttctttgggctggcggagccatatgccaatgtgcatgtgtttgggccgggggcggcggacctgatccgccaccancggtttcgggagtggttggtgtcgcatccggcagatcgggaactgtatgtgcacggcgaaaaaggaaggtgccccggaaaaaccangaaaaacnggctagtc

SEQ ID NO: 1985 - DNA, 240 bp, A.fumigatus
acgacaagtcccctttatcaggtaggcgacgaactctacgtgaacattgctctagactttcggctgatgttgtgcgtctcagactgcaagttcaacaaagacgcacccaacgtggtacatatgacagtcaagcctcaagaaattgtcgacgaagaagacgccaaggcagccaaagctccgtatagccgggaacgcgaggccagtgaacgcagtcctggatgtcgttgtatcatccaatga

SEQ ID NO: 1986 - DNA, 237 bp, A.fumigatus
  unsure (40): Identity of nucleotide sequences at the above locations are unknown.
gaaccacttactaaagtcaatccaagacccaaccaaaccntggaacaccaaccccatgatatcagtgactacgctagatttgcaaacacaatggaattcaactcgagtgggaggcaatatgagaataagaagtatgcgctaaacttctgttccagaacagtagggactgcgtggcaagaagatcttgacctaggctgtctaggccaatctactagacctccggttgaacgtccttag

SEQ ID NO: 1987 - DNA, 210 bp, A.fumigatus
acggagcttccttggtctgtaaagatgcatgatcatattccagttgaattagtctttttacagactaatgggtggaacttctgtcatattcagttgcctatttctcatgctggtgactacgacaaaaagcaggatttaggtgatgtaactgaagttactatatgcacttatttccaatctatctataatagtgacccgggaagctcttaa

SEQ ID NO: 1988 - DNA, 261 bp, A.fumigatus
tggaaatacattcataagccaggctactctccgaacaacctaaatcttagtgatcttcaatccagtcgcttgctccggtccatgacatgtgtcaaggtgcgcttctgtaacgcagatgaccctaactgtcatggcgcgcatattcattttcgcccgaaccctgcgcacgtcggcgctactctatacatgtgccaaggctggcacaaatttatcacccagggcatacggtacattccatgtagctatgacatgcaagaataa

SEQ ID NO: 1989 - DNA, 414 bp, A.fumigatus
gcttgttctgaggctatcattaacacctgttcaagcggctcatggccaaagacctggataattgggaacaaaaacgagtccagagatttaagggggaacccgatggaaaactttaagcttttaatagctgaacaacgcctttcaaatacaggcgctgctcttactggtttccagaaggaaatttttgactccccttatgttagctgtggcagccataagggaaccacatctgatgatgacatgaatttgaaacctaattctcttcctggtgagaggccttcttttttaactcttgcatgtctgataagcctagagctaacccaacccaataaagtatatccatttgtcctagaactcaagctaagcaagccaaatcgcctcatttgccatggtatcttagacctccatttataa

SEQ ID NO: 1990 - DNA, 348 bp, A.fumigatus
tggtcagccttcaatatgcctgtttttcaggcaaaaccattccggcgggcgacaacagcctcatcgtcgctaggagaacggatcggcgcagcatatagaggaaacctccaaaagcatccttttctgctctttggtcttccattcatcatgatcattgttgccgggtctttcgccttgactccagccgccgctttaagatatgaaagatatgaccgaaaagtgaagcaactcacacaagaggaagctatggagttggggctcaaaggggcagatggggaagagggaatcagaaggaatccgcgcagaagagtcctcggagatgagagggaggaatattatgtgagttga

SEQ ID NO: 1991 - DNA, 186 bp, A.fumigatus
catctcactgatctcatgactatatatcttgccctgcgggtaaacttcggccttgacaatgtggattgcatctatatcttcgttccttactggtggacattggcatggcattgcaacaatgtcattcatgatatctctaggtctgacatgcctctacggaatgtagggccgacttccccgggatga

SEQ ID NO: 1992 - DNA, 183 bp, A.fumigatus
atggatagcttcatatgctcgtattcccgcaccaatcgaaggggtcctattggtgcatgtatccctcttcttactgtagatctaactgacaagtacagcacagatgagaagtggtcatcagacaagcttatctcaatcgatacaaacagggacgtcttcaccacggggctggaaggatccgcg

SEQ ID NO: 1993 - DNA, 279 bp, A.fumigatus
gataatgcggtaaacggcttgaatgtaatccatgtcagcggcacgaaggggaagggtagcacctgcgcttttacacgcagcttccttcgtgcacatagcgtgaggacagggctccccaagaagattgggctctatacggggccacatttgcaatgcgttcgcgaacgaatacagattgatgaccatccagtcgcggaagaattgtttacccgatatttcttcgaagtgtgggatcgcattatgcctgcggatatagaactggatgcgggagtcgcaaag

SEQ ID NO: 1994 - DNA, 327 bp, A.fumigatus
ctttgcgactcccgcatccagttctatatccgcaggcataatgcgatcccacacttcgaagaaatatcgggtaaacaattcttccgcgactggatggtcatcaatctgtattcgttcgcgaacgcattgcaaatgtggccccgtatagagcccaatcttcttggggagccctgtcctcacgctatgtgcacgaaggaagctgcgtgtaaaagcgcaggtgctacccttccccttcgtgccgctgacatggattacattcaagccgtttaccgcattatcctagaacaagtcagtcgccgctgtgtcgctgttcataattcgtactga

SEQ ID NO: 1995 - DNA, 438 bp, A.fumigatus
ctgcaggccacgcagcatcccaatcttccagcatccgcagcaactcttttcaaagccaaggcccagaagaagctcagcttcgagcaaatcgcccaacatatcggccgcaatgaagtcgccacagcagccctcttctacggccaggcaaaggcctcccctgaagacatccagaaactgtcagagctgctcaatatctcacctcaggttctagaggagcagctgagcggctttccggaccgcggtcgctccgttgagatgccgccgaaggagcccttgatctaccggttgtatgagattgtgcagaactacgggtacgcgtacaaggctgttctcaatgagaagtttggggatgggattatgagcgctatttccttttcgaccaaagtggagaaggagacggaacccgatgccaaaaaaagggggcggttaaaattctga

SEQ ID NO: 1996 - DNA, 243 bp, A.fumigatus
tgtggtcagttgggtcgattccagaagatctttgcgtgggggattatacgctatgtttaccgatacttccaatcgttagaagagaaaggtgaggattgttcttctattagtggagcgacgtcagccttttataaagtgatgcgggacatcttctctaatactgagatcaccctgtgcggggagagaaaggtaaggcaattgtcactgataggtaatcttctcttaccatccgccctcagtcgc

SEQ ID NO: 1997 - DNA, 393 bp, A.fumigatus
aggggttcacggagtcagggacggcggcggatatgggcaagtggtagaatctggcgacattcgacctcatcggagatgtggcctttggcgagccgtttggagggttggatggcgacgatggttgagtttgtgtctgcgtactcatctcccaggaatttccaccaagccgaccgatctatccctgagcgatggctgccccaggtgatcgagaaccctgcctcgcccttctttttggataatcgcgccgtctttcagccattctcgatcaggccacggaattgcctcggcaggaacctggcgtacactgagatgcggatgatccttgcacgggggctttggacttttggctgctctgtgaagagagtcgtgactggacggataggggcccattga

SEQ ID NO: 1998 - DNA, 267 bp, A.fumigatus
ttcatcaccgcccaagcatggaaggatatttacggccatggccaccttcagctcccgaaagtgcaaatctccaccatcaacggcaagaacatcttcgccaccaatgacgtagaccatgctcgtttccggaaggcgctctcccacgcgttctcagccaaagggctgcaggcacaggagtgcctcgtcacacggtacatcgataaacggatcgagcgactgaaggggttcacggagtcagggacggcggcggatatgggcaagtggtag

SEQ ID NO: 1999 - DNA, 1068 bp, A.fumigatus
  unsure (13),(116): Identity of nucleotide sequences at the above locations are unknown.
gcatcagggcggntggcccgcttcgagttcgaggttggaaaaggaaatgatggcactaagattctcatgatcgaatgggatgacgaggactcgggccgctcgtcgaattgcctggnaggctcatggcacgtttcatgggagggcaagacgacggtcctcccagccgatgagcgaacaagcgaaaacactcgccgcttctacttccttttgccgcctcatgctaccattcctcccgtggtgaccttatcctacgagcctcccgccacatgttcgacatcttcgacaccgacacagaagaccagttcgcttcaactgaacccgctacctgctatctttcctccggagttaggtgccactggtcgctcggccggaaagaagggtgttttgcatacgatctgggcaaagaagcggctgcaggtcttggacaaggagatacgggaggaatgcatgaacaatgcggaaggtgttgcgctgcacatggcgctgcaggagaaggaatggattgagagcaatttcggagtgggatccaagtcggaagcccagacgcagagcatgcaagattcgcaatatccgatgggtcccgctacgccagtgtctcccactagcggaggtaagctgggcgagaagctcaagggactcaagttgcagaccagtcagcgggaactgtccccaaaggcggatggtatgggctcgtcgcgttcctccagttcgatgccaactaacggggtagtagcatcctcgaacgcgcgccatctcctttccccccagtcgcctgacgtggccgtctcttcgttcaactccttccacacaatgcaacccatgtccaacgttttgcatccctcccccgcgccagataccagtcttcggacggtggtgcactatccgccggaatccatccaagcacaacaaaacagcagtgagcacaacagcgggtttgcatccatgactacaattacgcgcacatcaagcgccgactccggcgaggacctgttcgccaaagcgctgagtcccagatcgcccgacctgccgcggagtccattctcgtttgcccccgagacagtgatctga

SEQ ID NO: 2000 - DNA, 201 bp, A.fumigatus
cgatctctcagatttgcaaccattgcaattcatcaacccacacttctcaaggacaagatattcatttttcgtatcattctttgccatctgaagtacagcttcgcactttttattgttgctatctataacactcaccaaagaagttccccaactatcatatttctgcaacgttgcgggctggcacccaccaaaagaccctga

SEQ ID NO: 2001 - DNA, 927 bp, A.fumigatus
  unsure (740),(743): Identity of nucleotide sequences at the above locations are unknown.
ttttcctgcgaccacaagatactccccacagaacggaaatatctaactcgcagaatgtactacccaggcattaactcactactactatggcttctatgctttgctcccccagggctcgcatacggcagatcttcagaatcgccgcccgggccaaatgccatactcctctcgcgagtacagtcgctgactctacgcgccaatcgtctcacgtcctctcgccgtgtttccccgattccacagctgaaatgcgtgggaccctcaaagaccatctgtgacaagtacaagatagagactatgcgatgcacgaatgctggatacgactacgacgaagaagatgtccagtggacgtgcactgcacagcttccggaggagttcatgttgggcgcaacagatgtgatctgcgagggataccgaaatgccgatgacaagtgggtgttgaagggcagctgcggtgttgagtaccggctactgttgacggagcgcggggagagccgatttggcagaatacaagaggatgatatgcggtccatcccgcttgcgacaaaaggatggcgccgagggatggacgctctagtggacctcattttcttaggattctgggctgcggttctcgttatgattttctggcctatggtccgctcctgttttgggctgcgaggtcgtcgaggcaggaccaatgttggacgaggttggggcggattttggggaggaggaggtggtggtggtggtgatcggggacnccntcactctcggccctcccctgggccgcctcctccctttcttgcgctccccttatcttcttccctctccgcctccctctgtgtgtccgccgggctttttggtcccgtgctgccgttggtggcttttgtcctgctcccatatgggttcgccacgccttccgcttgccccttcgtccctccctcctag

SEQ ID NO: 2002 - DNA, 423 bp, A.fumigatus
  unsure (1),(4): Identity of nucleotide sequences at the above locations are unknown.
nggngtccccgatcaccaccaccaccacctcctcctccccaaaatccgccccaacctcgtccaacattggtcctgcctcgacgacctcgcagcccaaaacaggagcggaccataggccagaaaatcataacgagaaccgcagcccagaatcctaagaaaatgaggtccactagagcgtccatccctcggcgccatccttttgtcgcaagcgggatggaccgcatatcatcctcttgtattctgccaaatcggctctccccgcgctccgtcaacagtagccggtactcaacaccgcagctgcccttcaacacccacttgtcatcggcatttcggtatccctcgcagatcacatctgttgcgcccaacatgaactcctccggaagctgtgcagtgcacgtccactggacatcttcttcgtcgtag

SEQ ID NO: 2003 - DNA, 450 bp, A.fumigatus
tatgacagctctgatccttccacccccgtggtgaagactccccccgaccaccgcgacagagaaggattcaagttcgagaacccgtcgacagactgcaaatacgtctcgcagatgcacatttgggactcgttcaaagatctggaaaaggatatgaacaaactcttcactctcatccacaagaacgtgagtttcaccgtggtcggacaccatcccatcgccggtcactacaacgacctgctgcatttctatgtcaatgccctgcgacgagtcagcgtgctgttcctcgaccatgcagataaattcgagatccacccccaagcgatccatggaggctgtaatgagcgatggtcggttcaggaggtcaatttccggggggtaatgaattcaggtgaagtcacagctgtcatctcagtgaacggtgctgatattagaacaatacacaggagatga

SEQ ID NO: 2004 - DNA, 270 bp, A.fumigatus
acggtgctgatattagaacaatacacaggagatgactttgacattgtcaacgtctgggtaactcgatgggatcgggggcagatggtggaaatccgcacatatatcgattctgccaggatcatggaagcgctccacaagaacgagatctggtggaatggaaccaccttccgagacaatatccactacatgcctggtcctgcaggcatgcccgacctgaagaaattagaggatctcatgggctatccagatggacggaagtatgaggattga

SEQ ID NO: 2005 - DNA, 348 bp, A.fumigatus
aatagagcggctctttccagccccgtggtgaagactgccacccagtctgaaacacaccatagcggcctgtcgacgccgtccaagcgcaaaagcgcacgccttgcgaaacgtaagcattcagaaaccgaagataatatggaattgagcgcaccagaccgagcatctgatggtggcgatggagacctctttatccaaggcatgtgcgatattgtcatggtcagaattgacaatttgcgcccgactgaactacagttcaatgaacaagatttccttgatgatgagcttagtggtgacgaagactggaatggtaatgactttgacgctactgcggcagggcatgcatggtaa

SEQ ID NO: 2006 - DNA, 201 bp, A.fumigatus
cttatcgatgcaggtcactttcaatgggacggtgtcgacttctctcattctgcccaggatgttcacttcgccatcgaaggaggtggccaggttcccgtcctccgggctcagttggcaaatcaggacggcgaattccaagatgctgacgtgaatctgtctgagcgtattgaaaatatcaatggcgaattcgttttccactga

SEQ ID NO: 2007 - DNA, 432 bp, A.fumigatus
caatatgcaaatacagagtcaatgacagatgaacaacctcaagcaaggctacaatgtataccgtgtggaagaactaaagaacctgacggtaaagacgctgtgccaaatcctgcgccgtgggatgatcgaagatgttgcagatgggcacctccagcccaacccgtttcaactgacggctcaaccgccaggcctggatcgagtcgccgccggcctcgaagaaagagacggagcaggggaactcatccagcgagacgcccagacaggtcgccatctcacgctgcagaatgcccaccagccggcggtagaagttccaatccaccttggtcctggccgtcttgtgcatggcgttcaggcgctcgtggatggcggcgcgagagagccgatccgccagcccttcgaggacacatcggatgctgtcctcgatggtggtga

SEQ ID NO: 2008 - DNA, 1038 bp, A.fumigatus
tccttccagcccggtggtgaagaccaggaacggaagttctggtcgaagtatctcgagggggctccccagcgtctggacatcccgcggtatcccggccaaatgacgtttgaaggccgctcgcgcgtgtccgagttcaaaggcgacctcgttcgacgcgccgtcactctggggcaggaacatgggttgagtcagcaccagctggtgtgtgccgccgtcgcgcagaccctccagtggctcgccggctcgaacgacgtcgttctcggctctccgtgggccaaccgcgggcacaccgtggagcaagagtcgatgggtctgttcctcgatcgcctgcctcttcgcttcaaaacccctgtgaatgcagactgcgccaccatcctgcagtctacgcgtgcagcgagccaggcagccgtctgcaattccattccattcgagcaggtcctgaacctcctccacctgccgcggaccatccagcaacacccgctgttcgaagccatggtcacctttcatctcaagggggcagtggaagattgtctcgccatcgaggggctggaggtgaaacgcgagatgtgctttgcgtccggggccaagttcctgctcatgttcgaatggaccgagatcgaggcggatcactggaccctgcgcatcgagtatgacgaccaccagctcgacgacgcgaccgtcaccaccatcgaggacagcatccgatgtgtcctcgaagggctggcggatcggctctctcgcgccgccatccacgagcgcctgaacgccatgcacaagacggccaggaccaaggtggattggaacttctaccgccggctggtgggcattctgcagcgtgagatggcgacctgtctgggcgtctcgctggatgagttcccctgctccgtctctttcttcgaggccggcggcgactcgatccaggcctggcggttgagccgtcagttgaaacgggttgggctggaggtgcccatctgcaacatcttcgatcatcccacggcgcaggatttggcacagcgtctttaccgtcaggttctttag

SEQ ID NO: 2009 - DNA, 1065 bp, A.fumigatus
agacccgaggagggcaaggacttcgagaccgtcatcgattgcgggcaagaccagctggacatggttgttcctcagggtctcactgtccgagctgtggcggagctttacggtcctgaggagagagtcgaagtcattgacgtcaaatcgcagcagggcgaggacaaaaggtggaacatgcagaagtgggctgactattatgagagtaccggctccaaggtcgttcgcaatgtgatcagtttggaggtctcacaaagtaaattgggcaaactgatacgccgaccaaaaattgtgcgtgatcttgacttgcaggatgcggtatggcctgaagagctcaaggccatcggcgattatccaaaagttcaattttactgcctgatgtctgtcgctgactgctataccgattttcacatcgatttcggcggttcttcggtctactatcacattctaaaaggcaaaaagacttttttcttcatcccacctaaagacaagcatctgaagaaatatgaagactggtgcaactctcccgcgcaagactccacgttccttggcgaccagaccaaagagtgttaccgcgtcgatctgtccgaaggcgataccatgttgattccatctggctggatccacgccgtctggactcccacgaacagcctggtcattggcggtaatttcttgacgcgtctcaattatggtatgcagatcaaggttgccaagatcgaaaaagataccaaggttcctaggaagtttcggtatccgttcttccagaggatccaatggtacaccgcgttgaaatacctggaggacgatcctatcccccaaagtgtgctcaacgcattcgctgaggatgaaaactaccggtttcacagagcctatcctatctactacgaattcggggagcgggaaaataaggcgcctgccggggatccatatcacaattctcgattttactcccaggccgaactcgaggggcttccagatcttgccaagtacctgcttcggacagcattaattgccagtggctacatcgttgaggggggtcttcacaacgccgggcgaaggaccaagtaa

SEQ ID NO: 2010 - DNA, 591 bp, A.fumigatus
  unsure (60),(96): Identity of nucleotide sequences at the above locations are unknown.
tctttcctttctggaaatttacagcccagaatgtcggcccagcgacaagcctcatttgcntcacagaccccacacttttcaccagcagaactttcntacctttacacttcgcttgcgcttcccgacagtcccattcgaccagacgggcgctctcccacacagttccgacccttaacagcggagaccgacatcctcccgggcaccaatggcagcgcgcgggtcggattcgcagacggcactcaagccatcgtcggagtgaaagcggaggtggagaagacagccctggcggcagatgccctgaaggtctcacaattgtcatcgggggatgattacacggctgatcaaggcgcggacggcaaggaagggatgggcgcagcgggcgggcacgaatcgtgggtgcagatctccattgagattcctggttttcgggacgatgatgccttgcctgttttcctgtcggagatgatgcgggagccgctgattgagtcggtgtcaagtgcgcagggaggggatgtggagatggctggcggtctgaagggaaggctggtcatttcttcacccacggaggctggaaggacccgcgtccaaaaa

SEQ ID NO: 2011 - DNA, 300 bp, A.fumigatus
tgccgtggtgaatgcgttggaacgcaggataatgtgctgtggggttccggtttcactggaaaccctgacttctggcttgactcctgtcccgacctgcgggagattggaaagtcggtatgcgtcacggcctacaccgtgatcgtgtggacgtcgctcagagtcgatgccaagggctcgaagatgtgcgccacgacgtctggggacacaaccagaacaaccaggttgaacaagtcaatgattcctgagcctcgctgtgtgctccacagtacgacagttcaactccgttcggagtcggcgtga

SEQ ID NO: 2012 - DNA, 246 bp, A.fumigatus
ccgaggtttgggtacaccagctcgaacccgctatggatcacgacgatcaatctcccagcaggaacgacgttccaatacaagtttatcaaaaaggagactgacgggcgcgtcatctgggagagtgatccaaaccgcagctacactgttcccaccggatgctcaagtaccaacggtacagcaaccggtaggttggcgggagaattaggaaggggtatgggaaaatgctgggttgacttcctttcttaa

SEQ ID NO: 2013 - DNA, 489 bp, A.fumigatus
ctggagcaagtagtggacgaagatttcccgcctctggggactccgctcaaggacaagcgccccgtcgacagctttggcttcctccttcgatctcatcttccaaatgacactcaagggaccactcgcgccggaaccccgacacttccccccggtctccctttgccgcacgctcatccggcatcgtcgttgttccagagtcctttgaatccgtcgagcccgtctctatcgatatctatgccaccgcctggcctcaacatcacacgttctaagcctggaacaccgtctcagaacttctccgagattgaatctcagcggccgtctccagagcctcgagaaactcccgaaagcgttcctcctagcaagttcaagaacatttcggagatttccctgggttcccctttgccaaagtccgcacagatagctcggacacaggctaaacccgagctctcagcaagtgtcttcaccacgggcgcgaaggacacgcataag

SEQ ID NO: 2014 - DNA, 216 bp, A.fumigatus
acgcttagcgcgggtccttcgacccccgtggtgaagacgaagcaagcccgaagcttattgcatccggtcgaacgccagcagcacgcaaacaagctaccgaagcggcggaaggccaggaggaagccaatctggaggtggaaaaccgaaaccgtatcaccatggcggccgtgctcgatcctcgtccgaaggcgaggatgcgctgggagcgcaagatga

SEQ ID NO: 2015 - DNA, 795 bp, A.fumigatus
cgcgggtccttcgacccccgtggtgaagacgaagcaagcccgaagcttattgcatccggtcgaacgccagcagcacgcaaacaagctaccgaagcggcggaaggccaggaggaagccaatctggaggtggaaaaccgaaaccgtatcaccatggcggccgtgctcgatcctcgtccgaaggcgaggatgcgctgggagcgcaagatgattgttcgggaagtacgtcgtcggggccgtctgacgaagaccgagcggatcatgcgaacggagcgcgagtcactatccaagtcccattggttcaagacgtccgtgaagaagctgggacctcttgcacgtcagatcgcaggaaagaatatcgacgaggctatgttacagatgcgcttcagtaagaagaaggtcgccaaagacgtccttgaacacctcgagcacgccaagaacgttgccattgttcggtcaggtatgggtctgggcaacgccgcagatcagaagccgatcaccattactctcaaaaatggtgaacggaaaacgatcaccaacccttcatcaatttacattgcccaggcttgggtcaaccgaggtccatacggagtcgactacgaccatcgcgctcgaggccagattaatcggctgcggcccccttacacttccctgagcgtcttgctcaaggaagagcatacccggatcagagagtggcgggaccgtgaggctgaggcactgcgcaagcggaaagcccaactctggacccagcttccggaccggaagatcaccgcgcagaaccagtactatagctggtga

SEQ ID NO: 2016 - DNA, 297 bp, A.fumigatus
  unsure (37): Identity of nucleotide sequences at the above locations are unknown.
tcatccaggactttcacggtgcagaatttcggcaagntgtaccgcgcctgcggcaactgcagcaagcagttcaagcgcaccgtcgagatcagcggcgtcaaggcttccagcggcaaggccttcgtcggcatcaactccaactacggcgatactgcgactatctctggctgtgccagcagcgtcaaggagatctgtgtggagtatgagggtaccgacaacaacaagaaggagcctgcgaagaagagctccggtccgagcaacgcttgcaagtacaaggagcctctcgcttcgtgctaa

SEQ ID NO: 2017 - DNA, 234 bp, A.fumigatus
ctgaagtggcatattagcctttctatccctatatctgtccttcagttcttcaatcacaactgcaacaacttgagccatctgcaaaccaccgcaaacaagacacaccacaatgtcctcctttgctacaccttccccacactccccacggccattcttcaagagacccgcctaccccagcttcaaagtagggagggtcggaaaactgtaagtctctgcatggctatccagggataa

SEQ ID NO: 2018 - DNA, 195 bp, A.fumigatus
atctcttcaacgcaactgacaagaccaggattcggcatcgccaattacctcaatgacttccaagcccaacaagcccggtaccaactccaagaggaagagcggatccgacaaaatcaaaaactgatggacgcgtacggggacaaggacagtctgcatgatgtccagcatgcgctggaggcctacgagattcagtaa

SEQ ID NO: 2019 - DNA, 1179 bp, A.fumigatus
agagtataccgcccaacgccggtggaccaaaatcataaactcaccatgagtcgcctaccgtctgtttccagtctcatgtcaccccctgaatccaaaccgttcgagaatttcaatacctcattttcaccttactcgacatcgcaggattattgctcatttgttcatggcatgagactcccccccatttctggcgaaaggaagcgaacgcagtcagaaatggatttaccatcgccgcctgtcactccgtacactggaaataagaaaagaaaatcagaagtttcagaagaaatcgagcgagatgtcgtgctcggttcctcgagagatcctgttctgttccctcatcacgattccttgacagatgttgccactgatgagcccttatttgggcagattcttcccgccccagcagaggctctaatggagcaacatatcgattctcacatggcaagatttgataacaaagtgaataagccaacacgtgatgagtatatcctagcgctctcctgtgtgccagtggtttctgcccagtataaccggaatcctgctgcctgggcgaaagaagaacgcgagacacttgagcgtcaactgttcatgatgaatcgtcatcgacctcaatctatggatgcaaacttaaagaagattgcgcccgcacggagcaaacgggcggttgtcacacagcctcgcgcacagcgaacaccacgggccaagcgttcccccagatctacgccgcatcagaaggggcatgaattctttgacttacatactcagacgagtgccagggctcccagaggcataggaacaaatcgggatgacacagattatacttccatccaagatttctcaccctcaccagaaacacttggcggcaacgcgaaggcattgaaggcagactggaaaggacagatgttagattttagccaggatccagaccggcaccttttgagcccggcagagctcagccttgcctccaccttgaggctctcatgcgcaacatacttatgcagcaaacgccgcatcttcgaggctcgtgtgagagctttaaggattggcaaagagttccgcaaaacagatgcacagcaagcttgcaagattgatgtcaacaaagcgagcaagttgtggactgcttatgatcgtgtcggctggttcgattcggaacactttcggcagtatgtagagtga

SEQ ID NO: 2020 - DNA, 183 bp, A.fumigatus
aaggttatccatataaagaaagcctcaaggcaactcatcacccaatgtcagttcaacaacctgttaattagccctgcctatcgtactatgacgatggctgactaccaacaaacccaaacccgatcatccaacaaatccaacgcattctgcccttccctcgccttcagcttcaaccacgcctga

SEQ ID NO: 2021 - DNA, 330 bp, A.fumigatus
agtcacctgaaccacctgaaccccctgaacccgaatattcttcacccagtgaaccccgatcatcccctgaccgatgacatgccctcttccagactctcctattgcactatgttacttttgattgcatctatctttgccaaggtccaggtcagagagttcactgcaaaacggggccatcgcatcattcagcccaccttatctaagaagttgttccgggttcaagattcctcattggttacgcctggccctattgaaaacaaaaatgtcgacaatgtttcggaatctgcaatgctttggtcttcaccacggggctggaaagagcgctgccaa

SEQ ID NO: 2022 - DNA, 579 bp, A.fumigatus
  unsure (406): Identity of nucleotide sequences at the above locations are unknown.
tcgaccctgccggacgaggtccccgcaacatatcacaattccacaaccaccagcggtgcaacctccgacggaatgacttcggcatacagcaaggtcaaagagctgaccacagcatcgagtgctcaggttctgacggtctcgggctacctcagtgcctttctactatctttcacaatcaatcgcgccttcttagcctccgcactccttcccctctaccttctgagccttgcatatagggtcttgcccacgatattccggaacgcaccgcggctactattgccaaactggtggaaaacgcttgtgagagatgcggagcaataccgacagcgagtagatgccctagctcaatcgccgctggagggaacgtacagattccaagatgacgagattctccggaccgatcganagggcaaaggttggatggctgatatgccatggaaggacaatgtggaggaatccaccgtgtgcggcgcgaacgcccgatatgtccatctgaaaccgagttatcccagcatccgcacggaatataatgcctccccccgaacgatcgtccttcctgcatgggaatccccgccggga

SEQ ID NO: 2023 - DNA, 777 bp, A.fumigatus
  unsure (48),(56),(59): Identity of nucleotide sequences at the above locations are unknown.
caaacggaattagttgcggtaagaagcccagaaaaggttctaaccatnttcttttnttntagcaaaccaatggaatgtttctggctaccggaaaaggagttttctttccaattcatgacccttccttttttttccaagatttccttcatcacgccggatatgggcatggtgtatgctggaatggttccggactaccgggtactagtagacaaggctcgcaaggtctctcacactggatacaaacgcatctataatgagtaccctccaactcggatactggtgcaagacgttgcacgtgtcgtgcaggaagcaacgcaatctggtggtgtccgaccgtacggtgtcagcttgctgatcgctggctgggatgagggtattgagcccgaaacaggtgaatctcaacgcggtgatgaggagggtgacctcaagaaggctacggtagctactggtaaaactggtggtatcctgaagggcggtcccagcctgtaccaagtcgaccccagcggcagttactatccttggaaggccacggccattgggaagcatgcaacaagcgccaagacgttcctggagaagcgctacacagaagggttggagcttgaagatgccatccacatcgccctccttactctgaaagagactatcgagggcgagatgaacggagacacaatagaaatcggtgggtgctacttatctaaatctaacgtcgccacgaaacacgaaactgacttacgcaggtattgtcggccctcctgcggatcatcttctgggttatga

SEQ ID NO: 2024 - DNA, 792 bp, A.fumigatus
cgaaccatcgtagctggcgttggcgctgtcatgtgttcctacaatcaaatcaacaacagctacggttgtcaaaacagtcaaactctcaacaagctcctcaaggctgagctgggcttccaaggcttcgtcatgagtgactggagcgctcaccacagcggtgtcggcgctgccctcgctgggttggatatgtcgatgcccggagacatttccttcgacgacggactctccttctggggcacgaacctaactgtcagtgttcttaacggcaccgttccagcctggcgtgtcgatgacatggctgttcgtatcatgaccgcgtactacaaggttggtcgtgaccgtcttcgtattccccctaacttcagctcctggacccgggatgagtacggctgggagcattctgctgtctccgagggagcctggaccaaggtgaacgacttcgtcaatgtgcagcgcagtcactctcagatcatccgtgagattggtgccgctagtacagtgctcttgaagaacacgggtgctcttcctttgaccggcaaggaggttaaagtgggtgttctcggtgaagacgctggttccaacccgtggggtgctaacggctgccccgaccgcggctgtgataacggcactcttgctatggcctggggtagtggtactgccaacttcccttaccttgtcacccccgagcaggctatccagcgagaggtcatcagcaacggcggcaatgtctttgctgtgactgataacggggctctcagccagatggcagatgttgcatctcaatccaggtga

SEQ ID NO: 2025 - DNA, 414 bp, A.fumigatus
agttttttaaccattgcgaacagcgtgtctttggtgtttgtcaacgccgactctggagagggtttcatcagtgtcgacggcaacgagggtgaccgcaaaaatctcactctgtggaagaacggcgaggccgtcattgacactgttgtcagccactgcaacaacacgattgtggttattcacagtgttgggcccgtcttgatcgaccggtggtatgataaccccaacgtcactgccatcatctgggccggcttgcccggtcaggagagtggcaactccctggtcgacgtgctctatggccgggtcaaccccaacgccaagaccccgttcaccttggggcaagacttcgggagtcttacgggggctcccttgcttaccgaacctaaacaatgggcaatggtggcttccccaggatga

SEQ ID NO: 2026 - DNA, 375 bp, A.fumigatus
agacgtactaatgtcgccgcgacatgggacaagacactcgcctaccttcgtggcaaggccatgggtgaggaattcaacgacaagggcgtggacattttgctggggcctgctgctggtcctctcggcaaatacccggacggcggcagaatctgggaaggcttctctcctgatccggttctcactggtgtacttttcgccgaaactatcaagggtatccaagacgcgggtgtgattgctactgccaagcattacattctgaatgaacaggagcatttccgacaggttggcgaggcccagggatatggttacaacatcacggagacgatcagctccaacgtggatgacaagaccatgcacgagttgtacctttggtga

SEQ ID NO: 2027 - DNA, 207 bp, A.fumigatus
tgcttggcagtagcaatcacacccgcgtcttggatacccttgatagtttcggcgaaaagtacaccagtgagaaccggatcaggagagaagccttcccagattctgccgccgtccgggtatttgccgagaggaccagcagcaggccccagcaaaatgtccacgcccttgtcgttgaattcctcacccatggccttgccacgaaggtag

SEQ ID NO: 2028 - DNA, 258 bp, A.fumigatus
tcgcagtggccggctgacgggcgtagcgtcatccatcgcgcggattatcaccggattctcctcgacaaggcgagagacctgggagtggcgattcgtctaggcgcgctggtcgagaaggtcctggtcgacgacactgcagttattgtgggtagtgagaccatcgccggcgacgtgatcattggtgctgatggttcgttttccctctccaattctcatctcgtcttcaccacggggctggaaggatccacgggggatcta

SEQ ID NO: 2029 - DNA, 438 bp, A.fumigatus
  unsure (391): Identity of nucleotide sequences at the above locations are unknown.
cgacattccttttttctacattttgttattttgatttttgtttccattgtgaccttgacctggctcggcgcggcagcagccctcgtgctctccacatggccaactgcagcctctgcaaacccgggcttccgcaaagcggccagcccgaggtaccgcagcagtgtctcggcctgccctgagcgctacagcgacgctggccccaacacaggaaactggtctgtgtacgcggacttcaagctgatccacaagtgcaaagagaacatgttctaccacttctccctgttcgacgatgtcgatgaccaggaacgaccccaccgcctttcaagcttgctcctcctatggggccaaactttggcagtctccctgcctccactgcgccggattgcttccngccgagtttggttgatgttgaatttgaactccggctggtgggtatga

SEQ ID NO: 2030 - DNA, 387 bp, A.fumigatus
cccggagtgggaggtttcgttgatgagattggtggcgtcatcggagtccagaagatcaacgtcgatcagttgcgggcagatgttaagaagtacattgataatatcaaaaatgtgcaagcaagcctagatgctggcaatttaagcgatcccaagaagttccatccacaggaccgcgtgagtcaaatcgtccagcgaagtatgaaagatgccagaagaaaggcggagcaaatgcagctgtatctggaggagatggtcaagacgtacgacgacatcatggtcttctatggagaagacaatacagatgaaggagctcggcgggacttctttgcgaagctggcttcgttcttggtggagtggaaggtgagtttctgtgtccgttcgttgtga

SEQ ID NO: 2031 - DNA, 729 bp, A.fumigatus
agacagacagttgccagtgcggcattgctgttggcccaagtaaactgcgtgcttaccaggcctcagggtacgaacatcctcaaagtttcaacgtccgatgttgttcagcctggtgggctggctaatatctacctcgattggcgtgaatcttactctggtatcatcgaggctatttacgcgtcctgtctgagccctgatacgtcttcaacgcagatcatcggccgctttactgtcgacggccatcccccccagcgacttgcctgggcagtttccgacgatgctcccacggataactgtatctatgtccatggcacccagtcagacaggttagaaccaaatctcttggggaagagtgagcccgtccgactgagtcaaatggtgaagaaaagatctgtcgccgatgcaaacgttccccttctcaaagacttcgactcactcggggcctggttcgacggggttgccgccatcaaacaaaagactgcaacacacggtggcgtcgcatccagccactcgtccaaggacagcaagatcgccatcgtgggtgctggtatctcaggcctcgccacaggcctaatgctcgacagcgttggcgtccacaactgggaaatcatcgaagccagcgatcgcgtcggagggcggttccgaacgcggtatgttgctgggacgcaagagtgggcggagatggggccgatgcggttgcccctattctgtcacctacaagcacagtaa

SEQ ID NO: 2032 - DNA, 969 bp, A.fumigatus
  unsure (921): Identity of nucleotide sequences at the above locations are unknown.
agcgcgtgtccttccagccccgtggtgaagatgtctcgtcagatagacagcatcaacgagagtcttgctgatttcagcttggggcaaaaattcagaatgccatcattctatgagcacagccggggtatcctactatatggacctaaggggacagggaaatctgcccttctacaccagatacaagctgcaggttggaaaaagacgtttagtctcggttcatccatgttcagccggaacatcagtgattcggaaactaaggttcgcaatgtctttcaagaggcggtacgttgccagccaagtgccatcataattgaccagctcgacttcattgctcctaaacgagcgtcgctagattctcaatctttaacatcagtactatgtgaatgtctagatatggccaaaagtgctcttgtgctggttgtggcagcaactcgccatcctaacgacgtcgacgatgcactcaggacaccccaccgtctagcaatcgagattgaaatgcaggtacccacagcgcaagaccgagctgaaatcttgcgggctatttgtggaagctcaacacgccaattgagcgaggagctcatcgaaacgattgcagagaaaacgcacggctatgtcggagccgatttgtttgcgttacttcagcttgtatgccgcaaggcgcggcagaggcagttatgtcaatctcattcgccgaccaggctctgcgacgttacatcaagccctgacctggtggcaggtgttgagcacatcgaggagaatatggtcgttgatctggatatcgaggagtcggatgttatgtcagctctacaggaaactcgtcctactgccatgcgagaagtcttcttagaaacaccaaaagtcaggtggactgatattggcgggcagcatgatatcaagaagcgtctccaaaaggctgtgganaggcctcttaaagtgagtagtggccccttagcactcttgactcgctga

SEQ ID NO: 2033 - DNA, 396 bp, A.fumigatus
caccccgtggatccttccagccccgtggtgaagaccatcatttcagacaatattcgacgccaattctctcgtacgttattcgactcctctttcatctaccagcaacagcgttttggcgctcctatcaagtattcggataaggagcctctgcaggatctatataatatccggcctggccgaacatttgacccaccgccaaccccacgtgctcgaatggcatacattctgatcgacatgctatttgagctcgcatcagcctcccagcccaaccgaatgaatgaataccatttgccgccccaaaaaaagagacaagtgatacggagcaaacgacagcccgtgttctgctctcgcgcgctgtctccccgtatctcatactccgatgcgccatgtccctga

SEQ ID NO: 2034 - DNA, 474 bp, A.fumigatus
ctacttatactgttgaagccattacttatcacacgtgttatgtttacagtgaccatggccagtttagggcaagaagaaggaggggcccgcactctttccccccctccgccgcctccgccccctccaccatcggatgctcactcaaaaatatctccctatgttctgaagctcaggagcgcgcctcccaattatttctacaagccccagataaagccggaacacacggacccctttgctgcacccactggtccttacttcttttatggcacattgacagatccgttaatgatcgcggagattctcgagctgaacgaggaaccaaagctgcgacctgcacatattaatgggtttgaatgtaaaatgttgggggccattttccagcttgggctgattggtccaaattcggggggtggaaagacccaccgtacctgttccgctctacgccggatgccaaataggctcgctgcgttttaa

SEQ ID NO: 2035 - DNA, 315 bp, A.fumigatus
ggactctcatttcctcatctcatcattgagcattttgttgttgacgctttaacctaccagcttgtctccctatcggacaaggcatcaagccctcgaggatatagaacttcgagtcgtctgacctacgaatttgaacgagtacggatcatcattttgcagcttgtccaacgtgacaaatgcagcggcccagtcatgcggaaggtcgatatgtgcatcgccaacattaagacacgaggacagctgcaccttggccactggagtggcgacaacaacaacaacaacaacatggcatggccgtttcggcgcagcagatga

SEQ ID NO: 2036 - DNA, 267 bp, A.fumigatus
agacctctttccgctgctttgtctgatggaaaatcagcatatatttacccgaacgacgagcaggaattggatcgattggacatgcagcaccatatgatcaaactggtcaacgatggacgactgttctttgctcccatacatagccctaaacggatcctcgatatcggtactggatctggcatatggcccatagaaatgggtgcgtcttcctcctgtcattccatcactcactccacgcagattcttaccgtcccattgctcctgtag

SEQ ID NO: 2037 - DNA, 774 bp, A.fumigatus
caccttataacggattccatttcaggggggataataagggatgcggagaatgctgatgctcagcttctcctcgcctggcgtcgggcttggttcgctcaggggtttaggccagtcgtactcggccgtggcgaggcgatgaacaaccagctctacgagatggtacagaccttgaaaatcaacaaagatcttgagtatgatttgttcaggtggcttgcctggggtcatatgggcaccggattactcgccgattggcgctgtttcccaatggcgcgatatgatgatcctctgctgtcttactttcgccggggagtagatcctgcgcagattacaagattcgaccacatcggcagtgctcttttcgctggcgagaagacacgtatcaacgatgtgctcaagaatgtggtacagaatgccctcaagagtgtggacgacaaggcgaggtccatgctggacatcatccccggcgagattttcaaggtcgaacagccgagcgctctggctttctacacctctgcgaccatcaccactcactatccgacactcgcagagaagatcgtttcatcgccgaccgccggcagactggcgctcctcgagctggtcaactcgcatctacataacacattccagaactccttccaggccggcattgctgttttgaagcccttccctgagcatacgaccgccctcgtggaacccgccctgcgccttgccaaagctctcggccaatgcccgagctcgcccatccccgaatcttgccctccaaatctaccatag

SEQ ID NO: 2038 - DNA, 216 bp, A.fumigatus
tccggtgcccatatgaccccaggcaagccacctgaacaaatcatactcaagatctttgttgattttcaaggtctgtaccatctcgtagagctggttgttcatcgcctcgccacggccgagtacgactggcctaaacccctgagcgaaccaagcccgacgccaggcgaggagaagctgagcatcagcattctccgcatcccttattatcccccctga

SEQ ID NO: 2039 - DNA, 339 bp, A.fumigatus
ggacgcttgtccttccagcccggtggtgaagaacggggcaatatgagccagaaaatcggcatcttcccagcctccggcggcctaggaacaagcatcatcaaccatctcgtcaagctcgtcccggcctcacaactcatcctcatcgcccgcaaccccgaaaagctagcctcgttctcccgcgacggcgcaacaattcgccgagcagactacgatgaccgcgcatccctcgagcgcgtcttcgacggcgtcggcgtcctgatgctaatctcctacgcctccttcgagatccagcaccgagtagaggtactcttcaatcttgtccttcagtccgaaccctaa

SEQ ID NO: 2040 - DNA, 669 bp, A.fumigatus
atcttcaaagtaacgaaacaaccaggcccacaaagccgccatcgacgccgcccgccgcagcggcgtcaaacacatcttctactcctccctcgccttcgccggcgacctgggcgagtccagcctcgcgcacgtcatgggcgcccacctcgcaacggaaaagtacctcgccgaactccccggccacttcacctacaccgccatccgcgaaggcctctactccgagtccttcccgatctacaccgcgtggttcgacccgcaccagcccgtcgaggagatcaccatcccgcacccggggacggggcccggggtggcgtgggcgaaacgcgacgagctgggcgaggccaccgccaagatgatatatgcgtatgcgaagaacccggcgggcttcccgtatctgaaccgggtggtgctgctttcgggaccgagggaggtgagtctggcggagacggcggaggtgctggggcgggcggtggggaagcctgtgcggatccgggagatctcggtggacgagtatgtggcgctgccgcagattggggacaagcatacgtaccacggggtgaatctgtcgagggagtgggcgacagcgtgggcggcgatccgggcgggggagacggccgtcgtgtcgcctcttctgggggacattctggggagggagccggaggattttga

SEQ ID NO: 2041 - DNA, 804 bp, A.fumigatus
cgaaacaaccaggcccacaaagccgccatcgacgccgcccgccgcagcggcgtcaaacacatcttctactcctccctcgccttcgccggcgacctgggcgagtccagcctcgcgcacgtcatgggcgcccacctcgcaacggaaaagtacctcgccgaactccccggccacttcacctacaccgccatccgcgaaggcctctactccgagtccttcccgatctacaccgcgtggttcgacccgcaccagcccgtcgaggagatcaccatcccgcacccggggacggggcccggggtggcgtgggcgaaacgcgacgagctgggcgaggccaccgccaagatgatatatgcgtatgcgaagaacccggcgggcttcccgtatctgaaccgggtggtgctgctttcgggaccgagggaggtgagtctggcggagacggcggaggtgctggggcgggcggtggggaagcctgtgcggatccgggagatctcggtggacgagtatgtggcgctgccgcagattggggacaagcatacgtaccacggggtgaatctgtcgagggagtgggcgacagcgtgggcggcgatccgggcgggggagacggccgtcgtgtcgcctcttctgggggacattctggggagggagccggaggattttgagactacgatccgggccttggttggggcgaggtactcgcctgcatggatcggtagatgtagattccctgctactggcctttcgtcggggacctcgttcccgacggttatgctgggttcaatatcatattccgtttgtcctcgtttataa

SEQ ID NO: 2042 - DNA, 414 bp, A.fumigatus
gaacagcgccaagagggattgatctgcaccagccgtgaccgaaagttccgtttctcctccggtatgaagcatcaaaagcgccgtccttttccccaccggcttcctgataagagcgatccgcccatatcagtgcgcatgctcccgtccggaaatacatccccgtgcttcaaccactgcagcctaactggtctgatgaagggtgctttctgtgatattaccacttgcattcccatcaggcaaaaagacgaaacagcaatgaatgacaagatgctcaacactcagtcgcctgagttgtcacagaagaacggtatgtggactgctataagaactcaatactatatgcttatcactttgacttcaacaagaactctcggatggatattcgtcaagtcgagtctgcgccatttatgttga

SEQ ID NO: 2043 - DNA, 216 bp, A.fumigatus
cttcaacaagaactctcggatggatattcgtcaagtcgagtctgcgccatttatgttgacaacccttcagcatacccgacggaccatgcgggcgtctcgggcctcccggcccctaagacgccatcccggtcggggcttatgcgggtcctgcttggcatctgggagttcgcgatggaccagtggttcctgatcgttatcggcctcctgattgcgtag

SEQ ID NO: 2044 - DNA, 489 bp, A.fumigatus
atcgttggtccttccagccgccgtggtcgaagatctggcatcgagacactctctttctcctctccgccattgacccttctcgctgctggctcggtcgacggctcaatcgcgctgttcgatgccgcgcaccggttcgctgtacgtcggcatatcaaggaggcccacgagggagctgcggtcgtcaaggtggagttccttcagacgaacctggccgctctcgcaagtcgccccgctgccgcggctacccagggacgcccgtggcttctcacctccgtcggcatggacggcgtcgtcagacgttgggatgctcggggcggaaccgcagctgcagcggaggggttgttgaaagagtggaagggtcatttgggcctcgtggagaacggagaaggggagcagtcgggaggcattatgggctttgttcaagggtttgatgggaagcgggttgtcaccgctggtgacgatggtgttgcattggtctttgaggaataa

SEQ ID NO: 2045 - DNA, 813 bp, A.fumigatus
  unsure (71),(102): Identity of nucleotide sequences at the above locations are unknown.
ggaatcgaatgcggcccggacaggacgaacccagacactgcaatttttcccatgttcagcaagcccatcancacctttagcggggctggcgcgggggctcgnataatacataccttggatgagtactggcgcagcttcgtgccggggcatatgtggtctgccttgctgacaggggagcatatcagcaccgacatagcggtggacgcggggagggcagtctggtttgcgcatacgaagggagtggccggtccggacaagacatgggagtactgggaagtcaatacgcccgtcgagccttcgctagagaaatatatcactgattttgtggaaccacatctcgcgggatacaccggcatgatgaatgtcgaaacgatcggaggcaaaatcatcgaggtgcatctgcgtttctcgcctcagtggccgaacatgtatggatcgtggttcattgcttctcttgtggacctttattgcgggaagggatggacagggccgtcggcctcgaagattgcctcaccagttgggtatagtgttccactgtgggatgatgagaaatatgctgagaccggtacgactctcacggaaaacgctgtgcggcggctggaaagcatgttcaatgtcgaaagcatcgtcgaaagcaccactatgcagtatggtcaggagaagccattggaaagtaccccaagggcgtctggtggctttaggattgcttgggtcaacggctatgaccttgcgaggtgcaagttggccaggagtgcgttgcaggcatacctctatcagttggatgatacagacaagggataccaggtactttga

SEQ ID NO: 2046 - DNA, 231 bp, A.fumigatus
gttgagtttagcccatggtcatctcgattggttcgcgcgagcattaatctaggtaatatccctcccacccacattctccagcgaaacgtgggcattcccctctgcaacatcttggtttcgccaatcctccctgccaaccaagagctaagactacctaacttttgcaatttcacccgggttccagattttttctcttgtcgggtcccaggattccagacaaggaccgactag

SEQ ID NO: 2047 - DNA, 276 bp, A.fumigatus
aaacgtgggtggaatgctctgtattgggaaaaccatgatcagccgcggtcgatcgatcgatacacccaggcaaaggaggagcatcgcctggtagcatccaagctcctggctactatcctaacgctacaggctggcacgccattcatctaccagggccaagaactaggcatgagaaacgtgccagtggaatggggaatcgaggagtataaggatattgactgcctcaaccattggcatgagtatgtattcaccctacctgttcatgaacatgactga

SEQ ID NO: 2048 - DNA, 645 bp, A.fumigatus
gaaacgtgccagtggaatggggaatcgaggagtataaggatattgactgcctcaaccattggcatgagtatgtattcaccctacctgttcatgaacatgactgacgcacacaggctgctaaaaacaaagcaattcgacactaaagcacagcagattgccaaacaggagtatcagaaaaaatcacgagacaacgcgcgcacgccagttcaatggagttcaggaccgaatggcggcttcacagggccaaatgtgaagccctggatgtcagtcaatccggactatgtgcgcatcaacgccgaagcagaggtcaacgatccgaactcgacgtaccactactgggcgtctgtgttgggccttcgcaagaaatacctggatatattcgtctatggtaatttcgagatggtggacggcgacagccaggaggtcttcgcgtatactcgacaatatgaaaatcagaaggcgttagtagtgggtaatttcacggacaagacactggagtggagtcctgctgccaatgggatcaagggtgtgagggaggtgctgctcaacacttatgaagaggcaaagaaagcgtcaccgagatttgctggagagaagtggtctcttcaaccgtatgaagcggttgcggtaattgtgcaggagtaa

SEQ ID NO: 2049 - DNA, 204 bp, A.fumigatus
acaatattgatggtattagtgagccttctgagcctgtttgccgcagtcttctactactatattactgttgctccaagctgctataattctaacagtaacaacaacacaccacacctgctagaagctgatatattgggaactattgctgtgcaagagaatatgctcatatgtttacttgccaataccatacatatgacgttctga

SEQ ID NO: 2050 - DNA, 213 bp, A.fumigatus
  unsure (74): Identity of nucleotide sequences at the above locations are unknown.
atggaacagcggcaatggatcgctggctatcccatcgaggctacacctttcgttcggatgttggttgaccgtgnaagaatggagaaggacctgctttttgtaactgtcactcattattcgtcctgttatgaaccaatggaagcaatgaatgcaattcaatgccctaagctagtatacatgatctggcttgcattctcaccactacactcgtaa

SEQ ID NO: 2051 - DNA, 252 bp, A.fumigatus
cggatatcgactacgtcgcgagcacgtaaggatttgcactccgtattgatccagcgattaacaaggccatgttataggaataatgtccccaaagggtactccttcgtcggtctgacccagaatcttgagacgaaactgtccgccatcagctccatccccgccgtctacaactggacgcgtaccaacaccactgagttcaagggtgcgacaacaacactacggcgtaaatgtgttccagctgatcacctgtag

SEQ ID NO: 2052 - DNA, 351 bp, A.fumigatus
tcacctgtaggaaacatttgctttgacttcatgaccaacgatgtcaaaggtgactcgacttcatcttcgtcgcgtgagctcatgctgtggctgcagtatgaaggcggccaactgcccatcggctggaccaatgggccagctgccactattgacaacctcttcgggacctcgtggacgctgtacgaagatatcaataccgacacggggataacagtcagcaccctgatgcctactaagcaatttgaaggctctttctctggcgatctgaagaactggctgctcgccatggccgatctgggcaggtttaccgagtcgacatatgtcaatgtcggcaatgctgggtatttatga

SEQ ID NO: 2053 - DNA, 678 bp, A.fumigatus
aatgtcgatttctgcgcctttcagctcccagctgtaagcagcaggcaaaatggattcatacgttctcatcgccattgccggtgtcctcagccatgtcgtctactttcgacgtggggagcatcagctctacagccatatctacctggtcctctttgttatttccgccgccgtcgtcaccgtactcgtccactacagctatatcctggtgtatctcgccagcctctataccagcatcctcgtataccgtctcctcctccatccgctgcgctcttttcccggcccgctcgccgcccgcgtctcgggtctctggtacatccacccaaagcacaatgcatatctgagcctccaggccttacacagccaatatggcccaatcgtgcgcaccggcccctccgacctctccatcatctacccgtccgccgtgcccgccatctacggcgcccaatccgcctgcacgaaaggcccctggtacgacctgtcgtacccgtctcgtcccctgcaacactgccgcaacgccaaggagcaccacgcccgccggcggacctggacccccgcgttcagcgacaggatggtccgcggctacgagcagcgcatccaaacctaccagcagcagctcatcgcccagctgacggcgcgccagaccgtcgagtattcgcccggcgctggaagacggaaggg

SEQ ID NO: 2054 - DNA, 639 bp, A.fumigatus
gcagcaggcaaaatggattcatacgttctcatcgccattgccggtgtcctcagccatgtcgtctactttcgacgtggggagcatcagctctacagccatatctacctggtcctctttgttatttccgccgccgtcgtcaccgtactcgtccactacagctatatcctggtgtatctcgccagcctctataccagcatcctcgtataccgtctcctcctccatccgctgcgctcttttcccggcccgctcgccgcccgcgtctcgggtctctggtacatccacccaaagcacaatgcatatctgagcctccaggccttacacagccaatatggcccaatcgtgcgcaccggcccctccgacctctccatcatctacccgtccgccgtgcccgccatctacggcgcccaatccgcctgcacgaaaggcccctggtacgacctgtcgtacccgtctcgtcccctgcaacactgccgcaacgccaaggagcaccacgcccgccggcggacctggacccccgcgttcagcgacaggatggtccgcggctacgagcagcgcatccaaacctaccagcagcagctcatcgcccagctgacggcgcgccagaccgtcgagtattcgcccggcgctggaagacggaag

SEQ ID NO: 2055 - DNA, 501 bp, A.fumigatus
cctgattcatgctctatccaggtcgtcgacgctattaaagatctcgtacaggactgcaacttcgactgcaatgactctggaattgcccttcaggcgatggacaactctcacgtcgctctagtttccatgcttctcaaggcggagggcttctcgccctaccgctgtgaccgcaatattgcccttggtatcaacctggtttccttgaccaaggttctgcgtgccgctcagaacgaagacatcctcacactcaaggcggatgactcgcccgatgccgtgaacctcatgtttgagagcgccgagaccgaccgaataagcgagtatgatatcaagctgatggacattgaccaagagcacctggccattccagagacagagtatgccgctacggtggagatgccgtcggcagaattccagcggatctgcagagatctgaatgcgctgtctgagtctggtgagttatggaattctgtcattggcaattttcttactgaaccgtgttag

SEQ ID NO: 2056 - DNA, 1497 bp, A.fumigatus
  unsure (1236),(1298),(1340),(1360),(1366),(1371),(1395),(1404),(1427),(1450),(1470): Identity of nucleotide sequences at the above locations are unknown.
tacgatgcgcccacacccaggcggactttcttccaagctttcatgtcgcttttgcagttccatctcaagaaagagaatttgcaagacttcaacggcgtgtgcgatgagtcaatccagttatccattcgcaaatggctccagctgccgaaaaatattacaaatgctcatattccgatattgcagcatttccaacttctcgttgagcttcatgatgccagccacatctgtgcaagtttgtctcaaactaatgagagaaacctggataccaagtctgctgagttgaagctgctgcttgggacatggcgagatcgtcttcccaatctctgggacgatattaacgcctggcaggatcttgtcacctggcgccagcatattttccagctcatcaacgcgacgtacctaagtctcctgcccccgcagacgaacaacgtggcgagcaattcctacgcctatcgcggctaccacgagacagcatggatcatcaacaggttcgcccatgttgctcgaaagcaccaaatgcccgaagtctgcatcaaccagctcagccggatttataccctacccaacattgaaatccaagaggctttcctgaagctgcgagaacaggcaaaatgtcattatcaaaatcccaaggaactcaacagtggattggacgtaatcaacaacacaaatctcaactacttcggcgcacaacaaaaggcagagttctacaccctcaaaggcatgttcctggctaagctcaaccatgtcaatgaggccaacgaggcatttggggtcgctttgtactacgacttgagactcgcgaaggcctggtctgagtggggccagtacagtgaccaacgcttcaaggccgatccatcggactatgaactggccagcaatgcggtcagctgttaccttgaggctgccggcctttacaagaatgcgaagtctaggaaacttctcagccgtattctatggcttctcagcttggacaatgaagagggacgaattgctggagccttcgagaacttcaagggagacacccctgtttggtactggattactttcataccgcagcttcttacgagcttgtcacaccgcgaagcacgcctttgcaaggcagtcttggtgaagatagcgaagctgtaccctcaggcactcttcttcctgctccgtacgaaccgggaggacatgctcagtatcaagaaacagcatgaccagaaacaggagaaattgaatcgtgctaggcagcancaggcgtcgccccacaccaagccttctccagcgacggccgacagttctcctgcacagggtantcaacctgctaattcaaatactcctgctcaaggtcaggctanccaaccacctcaaggtcaancacaancccantcacaaagtttgccccaaggtcanaaccccaanccacggcccaaatcaaggcccancaaaccaccccctcaaaaccaanctcaacccccacggaacaancctcaacccccccggttccggctcctc

SEQ ID NO: 2057 - DNA, 264 bp, A.fumigatus
gacaaatgcggtacttacgttgacgtcctcacgtgtagtccaactggcggcggctcggcttatttctttgaaggcgactctagcctccaacccttccactccagaccccttgtcaatcgtctcaccaatggttacaagcgcattgaccaagcggctcagccgactagggtcacgctttccattcttggcggtgacaaggcgcaggaaatcgtcgtaaatcccaccgccactcgcccagccttggaccttgcgttccggtccctc

SEQ ID NO: 2058 - DNA, 690 bp, A.fumigatus
  unsure (288),(427),(464),(544),(641): Identity of nucleotide sequences at the above locations are unknown.
ccagtcggattggccagcctacgcaagtctccggttttttccctatacaacaactctgtccctgagggtagatctatccttgcctcgttcaagacggggtggaagcagagaagcagagaaggagagaaagaccagaaagtaacgcaatacagcgaaagcagatgcacgtatccttgtcctggctccgcgtctgtgtttccttccttccgagggcttaaagtctttcttgtaaccatcgcacaagtatcgcattcatccacaatgtctggtggagtgcgcgaaatccangaggaaggagtcgcgccctcctgttcttccaacggcggcgggaatgttattcaataccatgtcgagaagccggcagaggcatcctcaggctcagatccttctgctctggaagctcaaaaggccatgacccttgaggcanaacgggaaaccgatggtggagctcattcggcctttancaagaaagagaaacgcttcatcgtcttcatgatctccatggcgtcgttcttttctcctctctctgcccagatctatttcnctgtcatgccaacgcttgtggaaaattaccatcttactacggccttgatcaatctcaccatcactacctacctgatcttgcaaagtctggctccgancttcattggcacttttgccgactcgggaggtcgtcgtccggcatacatc

SEQ ID NO: 2059 - DNA, 426 bp, A.fumigatus
gagggaccggaacgcaaggtccaaggctgggcgagtggcggtgggatttacgacgatttcctgcgccttgtcaccgccaagaatggaaagcgtgaccctagtcggctgagccgcttggtcaatgcgcttgtaaccattggtgagacgattgacaaggggtctggagtggaagggttggaggctagagtcgccttcaaagaaataagccgagccgccgccagttggactacacgtgaggacgtcaacgtaagtaccgcatttgtctcaacgctactgttgtctctcaattcaaatataactgacgaacaacaggcaatcgagttgtcctctgtgctgaacctacctctcactggcgatgctcgcatcatgcagacagcagagatgagtcggaggtactacagtactatcatggctggaggttattag

SEQ ID NO: 2060 - DNA, 372 bp, A.fumigatus
agtatcatcctctaccttcttctgttctggttgacagtcctcaagatgggtgcaccaaacttctaccgctctggacttgtgtcccttctgttcgtgtcactgtgcgtcagcagcctcgcaaacgctgactacaatcgattctgtcccgataaaacatcgcagatccaagtcgactcaaccttctacaccgttgcctgcgatacatcctacatatcccccgctcctaaaaaggtcagagagggcgcatcgccccaggactgcgctcggctgtgtaccgggggagccagcataccatgccatagtgtggtatcttggaaaccgttgggcggcccaaaaaaccaacgccggctaatcccggttccgggcgcctga

SEQ ID NO: 2061 - DNA, 297 bp, A.fumigatus
tcaggaatcggctcggcatgcatgtccaatgacggcaccaacaagccccaattcactcctacattccctggcacctgccccttcatcaccgcagttggtggtactcagtcctatgctcctgaagttgcttgggacggcagttccggcggattcagcaactacttcagccgtccctggtaccagtctttcgcggtggacaactacctcaacaaccacattaccaaggataccaagaagtactattcgcagtacaccaacttcaagggccgtggattccctgatgtttccgccccatag

SEQ ID NO: 2062 - DNA, 318 bp, A.fumigatus
aacgccaacctgatcgcccccgacagcctagtggagatgtacaacctcggcgactacaaacctgatgcatcttcgggaagtcgagtcggcttcggtagcttcttgaatgagtcggccaactatgcagatttggctgcgtatgagcaactcttcaacatcccaccccagaatttctcagtcgaattgatcaacagaggcgtcaatgatcagaattgggccactgcttccctcggcgaggccaatctggacgtggagttgattgtagccgtcagccaccccctgccagtagtggagtttatcactggcggttcaccgtaa

SEQ ID NO: 2063 - DNA, 186 bp, A.fumigatus
attagtccgtttgttcccaatgccgacgagccaaccgctgcggacaaccagaatgagccctacctccagtactacgagtacttgctctccaaacccaactcccatcttcctcaggtgatttccaactcgtatggtgacgatgaacaggtgagcatcctcatgattctgttgtataatagacactaa

SEQ ID NO: 2064 - DNA, 783 bp, A.fumigatus
caccgcatcgcggtcttccggaccgtggtgaagacggtgaccggcgccagcgatggaataggtttcgggtttgcccaggaactctgcaagcgtggattcaacgttttcctacacggtcggaaccacgacaagttactacgaaaacgcgatgagctgctggccgagttccccaaccgaaagattcggatcatagtctttgacgcgtttaaaagctctgaagatctcagatggattgcacaagagattggtgacgcccgtctcactgttctggtcaacaatgctggaggggaggtgaagttgttcgagcgactggccgatttaatacatgaagacgtgcaggcaaccatcagccttaattctacttttacggcgcaaatcacgcgcgtcctgttgccggtcctggagaggaatagcccgagtctcattctcgccgtctcttcggcagcagcttatgtgatgccgaccctcacagtatacagtgcttccaagggattcgtggaatccttcacccggtcgttgcaagccgaaatgacgctcgacggaaaagacgtggaggttctcgggctacgcgtgggaaatactaagagtcaagggaatgatgtggccgtgggcctattcaccccaagctctcgcacgctggcttccgcggccttgaatcgtgtcggatgcggcaaaccggttgtctgggcatattggcctcacttcctccagggtctgagctttcatctaattccaggcaagatgctgatgctgatcttaggggaccctttatcaatgccttga

SEQ ID NO: 2065 - DNA, 879 bp, A.fumigatus
ctctggtgcaattccgttttgctgacaaagccctacaggcaagagtcgctcgcggaagctacgctgatgccgatgggcaaagggtttgctatcacctcggatctcaatcttcgtaacatcctgcttcatggttatgataagcacaccagacgtcctgacgaggacgagccgtcgagcaagcgccggaaactctttgcactacctaaactgaagatcgccgctatcacgaatgatgccgtcgctacgcttgcgtctctagcttactccgtcaagtctctgcccaacagtcgtgtcgcaatgggtatcattgtaggcacaggctgcaacgccactattcctatgaagcttgagtctctacatgaatctaaagcggaacatgtcaagtcaaagatcccggaagcaaaagaaaccattgtcaacactgaatggaccatttcgggcgcctctcctcctttgaaagagctcaatatcataaccaagtgggacgaagagctagacaaagcatgtgcacgtcctgggtttcagccctttgagtacatgaccggtggacggtacatcggagaactcattcggctgatactctttgactaccttacaaacattgttggactggagaagaaacagcttcccgcaacgctcgtccaggaatatgcactgaccacatcatacatctcagacaaagtcgctcgaccacaacgtgacgaagatcttgctgcggaattgaaccaatcgttacctccacccgagagttgcgaatggtgctgggattctttgactgcgggcgcttttcggaagatcgctcgagttgtacagactcgatctgccgggctgatcgagtctggtcttcaccgcggtcataaggatcgaggggggtcattc

SEQ ID NO: 2066 - DNA, 201 bp, A.fumigatus
taccgaaaagatactggaaataccgataccataacagtaattactgttatgcctggggcttcagtgaccaacattgaccactcgtgtattagctgtatcagcatcacatgcttttactccgcactcttctgctgtcaaggaagctctgataacaacccaggcagtacttttaagctccattgccatcgtagactctcatga

SEQ ID NO: 2067 - DNA, 456 bp, A.fumigatus
aagcatgtgatgctgatacagctaatacacgagtggtcaatgttggtcactgaagccccaggcataacagtaattactgttatggtatcggtatttccagtatcttttcggtactattacatcacagcattcagttgtcaccctcaagggccgaaaacgatctctatcatactaccacgagatcaacacatatgggacgggaggaacatgcctgaatatgatcatgacaaggtccccgattttccttgggaacttggtgtctacgatgcccattgccaccccacggacgccatgtcgtcaatatctgatattccagggatgaaagcagcgacgctcacagtcatggccacaagagcggaagatcaggacctcgtatttcagatagctaaagaccttaacaatgcaaaattgactgttcaggacgccgagacggatcgcgtaccgccatccttcgga

SEQ ID NO: 2068 - DNA, 984 bp, A.fumigatus
gaccttccagtaaactctgtacatcagcacggaaaactgatcgcggctctccttccacagttagacgacactcctggcgattttctggctcgcctcagggacgccgaagcggctgtgaaaacagagtctcttgttgaactcatcgatgtcaccgaaaagctttattattctctgtatgcgagactggttatggagatcgccaacgttgagctctgtagtcacttcgaccttaacctgcgccgcatgctcgttaaggaaacgttcacccttcctgaaactagtcatctccgcgacatattcataacattcaaggatatcctggatgccccagaaatttgcagtggccttgattacgaccttgttaaacagcaccaggattcgatcattcgcaatgctaccgacaagcttgccatcaccggcttctctgcgcacgatcttatcggttatcgtacatccaccttaaagattgtctccgacgagactcatccgttcgttctcaagtggagaggtctcgtttacctgtatcagatgccaggcgttgaaaccatcaccgcgatgtcggagaagtacctgactatcatgccgcaggtctcggctaccgaagaatttccagcgattgaacttccttttatcgaccgcgattcaattcagccagagatttggcagcgcgagaacgtcctcgacaaccgtcaggcgaccttagcgaaactcgagggcaggagcgtcggagacatgagacgtgacgacagcagacgccgccttcttgatttcgtcaaagagaaaaaatgcatctgccgttcatcttgcagttgcgcgacagactgcacaatgggagtcgtgctgccctgcccttgctctgagcgcatcttgtgcatcgcgcacggcaaacgctatgagcgtgctggcgaacaaggatttccggcccaatatgcgggagccttggcgaagagcctcctttggaagggctgggcaattggtcggtcc

SEQ ID NO: 2069 - DNA, 411 bp, A.fumigatus
atcccccgcacgcggtttcttctagccccatggcgtgattataaagaggactcacccaggggcgcaatggcaagacgtcacctcaagagtcgcgcagataccgcgtccaactcgacagcgccccaagtcgacgttggcgccattgtcaagggtgtgatcgacgacattcgcgccaatggagatacggcagttcgcaagtactcggagaggtttgacaaatggtcgcctgcctcgttcaggctctcccgggaagagattgaggcatccattgcagcctgccctccacagacaatcgaggatattgaacaggtccagaggaatgtgcgggcctttgcaaaagcgcaacgtgactcgatcaaagatttcgagtatgaaattcagccagtaagtctgaccctcggcgccttttaa

SEQ ID NO: 2070 - DNA, 195 bp, A.fumigatus
actgacaataacagctacatcccaggcggacgataccccctccttgcctccgcccatatgaccattctcacagccaaagaagctggcgtccccaaggtcattggctgtactcctcctatcgcaggcaagattcctcaggccacaattgcagccgttttcaccacgccgaaggaaggaaagatcgtccctgagaag

SEQ ID NO: 2071 - DNA, 486 bp, A.fumigatus
  unsure (370): Identity of nucleotide sequences at the above locations are unknown.
gttagtcttggtccggccaaatatgttcgacggatgacataccgaaatggtcaggtaatcacagccagccaactccgtgatctcgccggtgttacggaaggaagctcccatgacgatggtcttgtacccatgcttcttgtagtagttgaaaatgctctgaacggacttgacaccgggatcctcctcggggctgaagtcgcgcttgtgcgcagccttgtaccagtccaggatacggccgacgaagggggagatgaggaaagcaccagcctcagcagcagcaatggcctggacaagggagaacatgatggtcaggttgcagttgatgccgtgctgagactgcaggatgtgggcggccttgataccctcccangtggaggcgatcttgataagaataccgtccttggaagatgccttgttgctcgtaaagctgcgcgagtcagctatgtttcgttatctgctgattccatcaagtctggcgtaccttga

SEQ ID NO: 2072 - DNA, 615 bp, A.fumigatus
  unsure (81): Identity of nucleotide sequences at the above locations are unknown.
cgaaacatagctgactcgcgcagctttacgagcaacaaggcatcttccaaggacggtattcttatcaagatcgcctccacntgggagggtatcaaggccgcccacatcctgcagtctcagcacggcatcaactgcaacctgaccatcatgttctcccttgtccaggccattgctgctgctgaggctggtgctttcctcatctcccccttcgtcggccgtatcctggactggtacaaggctgcgcacaagcgcgacttcagccccgaggaggatcccggtgtcaagtccgttcagagcattttcaactactacaagaagcatgggtacaagaccatcgtcatgggagcttccttccgtaacaccggcgagatcacggagttggctggctgtgattacctgaccatttcggtatgtcatccgtcgaacatatttggccggaccaagactaacctagaggtagcccaacctactcgaggagttgtacaactcgacagcctccgtccccaagaagctcgatgccgccagcgccgccagcctcgacatccccaaacgcagctacatcaacgacgaggctgccttccgcttcgacttcaacgaggaggctatggccgttga

SEQ ID NO: 2073 - DNA, 237 bp, A.fumigatus
cccaacctactcgaggagttgtacaactcgacagcctccgtccccaagaagctcgatgccgccagcgccgccagcctcgacatccccaaacgcagctacatcaacgacgaggctgccttccgcttcgacttcaacgaggaggctatggccgttgagaagctgcgtgaaggtatctccaagttcgcggctgacgccgtcaccctcaaggagctcctcaagcagaagatccaggcttag

SEQ ID NO: 2074 - DNA, 687 bp, A.fumigatus
gacggtactatgcagccagcgcaagagaaccacgagaacgacgatcatcagccaggcaccccgccccgcccgccttattccccagtgactccagttctgtcgcatctcgccccggcgaacgactccgccatgagaaacggagcttcccattcttttgaaccaccagctacatcgctctcacctactactccagctcttccctatgcatcactctcgaacttcccagacacgcaaggccaggctgtctttggtcaagagcccgcgccagtaccggtatcggaaagtgagaaccccgatgcgatcgcattgcggtccgccatttctatcctgcaactacagaaacaacagagtatacgagatatacagacattggagaagttgaaaaaagtcgcttctgcggatccggaggggtttgctcgcgaattggccgccgggaatctcaccacagcaaaagatcagggggcttacatcaatttcacacataaagacgacaaagcggttagcgacacgacaggagaatcaaccagtgaggcgttggccgacataggaccgattccagcgccccaaaatgttgtccgaatgccaccgatcaactgggccaagtatcaagtcgtaggtgaaccgctggatcgcatgcatgaagatcaattgcgacatccgtctcctggggagccgagacgtccataa

SEQ ID NO: 2075 - DNA, 591 bp, A.fumigatus
acaagcgtcaccaacctagaagccgataaacgcagagcaggaaaaaatcaagcggcagcgcttccggccgggcagcgagcagcagcggccagggagaccagcggaagcaacccgcacaggaacaggctcgatcaaccggtttcaggcccagccagtcatccggcacgctacaacgccgcggcggctcttcatccaccgactcgggctacttggaacgctccgccagtcgcaccgcgaacgaagtggacaactaccagacccccgccgcctcgcccaaccagaaccgccaactcagcgtcaactacggcaatctcggccgtgaaccgtccaccggccgccgcagggcaggtgccagcaccaccgaccagcaagttgcccagccgtcccccaccgcaggcggagtccccatcatcgcagagcccgtgccccctcttcctcgccagcagccgccggcagcccctgcatcacaggggatcccctcggagtacccctcgtatcccagcatgtccaactacgaaggtagtctctacggatctcatagccaggagacggcgtacgatccggagcaggcgctcgagctcccgtcggtga

SEQ ID NO: 2076 - DNA, 684 bp, A.fumigatus
acgcagagcaggaaaaaatcaagcggcagcgcttccggccgggcagcgagcagcagcggccagggagaccagcggaagcaacccgcacaggaacaggctcgatcaaccggtttcaggcccagccagtcatccggcacgctacaacgccgcggcggctcttcatccaccgactcgggctacttggaacgctccgccagtcgcaccgcgaacgaagtggacaactaccagacccccgccgcctcgcccaaccagaaccgccaactcagcgtcaactacggcaatctcggccgtgaaccgtccaccggccgccgcagggcaggtgccagcaccaccgaccagcaagttgcccagccgtcccccaccgcaggcggagtccccatcatcgcagagcccgtgccccctcttcctcgccagcagccgccggcagcccctgcatcacaggggatcccctcggagtacccctcgtatcccagcatgtccaactacgaaggtagtctctacggatctcatagccaggagacggcgtacgatccggagcaggcgctcgagctcccgtcggtgacagagcactccgagtctgacccttaccgaaggttcccgggttcgccgggggtgcaacagcgctaccccgatgaccattccaggaactggaatcagtctcggccgccctacggaggccaataa

SEQ ID NO: 2077 - DNA, 336 bp, A.fumigatus
tatgagcactgcaggatccttcaccagagccctagcaagcgcaacacgctgcttctggccaccgctgatcagccggccactggagcccacaactgtaccgtatccgtgctgcaggacactgatgaagccgtccgcatccgcaagcgacgcagctttggtgaccaaaccgactatttcagcgacatttggaccccgcgcctctgctgcagcggtcaaatccttgccgcccctgacttcactggcgaggtcggccaggtcagtgctcaacagggttgccttcaggtgtgcatggctcggatggttcgagttgatcagcccatgagcaatgttctctag

SEQ ID NO: 2078 - DNA, 495 bp, A.fumigatus
ttgccttgttccacgatatggcccttgtgcatgacaatgatgttgtccgcactggtaattgtcgataagcgatgggcgatcgtgatgatagtcctgccagaggcaatgttagagattgcccgctggatgcgctgttcactccgtgaatccagagacgccgtagcttcatctagtatgagcactgcaggatccttcaccagagccctagcaagcgcaacacgctgcttctggccaccgctgatcagccggccactggagcccacaactgtaccgtatccgtgctgcaggacactgatgaagccgtccgcatccgcaagcgacgcagctttggtgaccaaaccgactatttcagcgacatttggaccccgcgcctctgctgcagcggtcaaatccttgccgcccctgacttcactggcgaggtcggccaggtcagtgctcaacagggttgccttcaggtgtgcatggctcggatggttcgagttgatcagcccatga

SEQ ID NO: 2079 - DNA, 1509 bp, A.fumigatus
  unsure (22): Identity of nucleotide sequences at the above locations are unknown.
tggcaagtcgaccattgcgggnttggtgacacgactttacgatcccacgcagggccaattcttttcgacggccacgacctgcgtgatgtcaaccctcgggacttgagaagctttctgagcctagttcagcaggagccctctctcctggaccggtcgcttctagagaacattgctcatgggctgatcaactcgaaccatccgagccatgcacacctgaaggcaaccctgttgagcactgacctggccgacctcgccagtgaagtcaggggcggcaaggatttgaccgctgcagcagaggcgcggggtccaaatgtcgctgaaatagtcggtttggtcaccaaagctgcgtcgcttgcggatgcggacggcttcatcagtgtcctgcagcacggatacggtacagttgtgggctccagtggccggctgatcagcggtggccagaagcagcgtgttgcgcttgctagggctctggtgaaggatcctgcagtgctcatactagatgaagctacggcgtctctggattcacggagtgaacagcgcatccagcgggcaatctctaacattgcctctggcaggactatcatcacgatcgcccatcgcttatcgacaattaccagtgcggacaacatcattgtcatgcacaagggccatatcgtggaacaaggcaatcatgcgaccctcatggctaagaatggcacctacgctgagcttgtcaaactgcagactcttgcaagcaaggatgagacaacaatcaacatcgacgccgccagcaagtctgaccagacatcttcaagcgaggctgacattgagaaaagtgccattctcctcgacgactttggcgacgccgagaagattccagtttcgaccaccgcagctcctgtagccgacgcggcagaggaagcagaagaaccggagactccgaaaaagtccctctgggcgctggccaaaggctacgcaccagcactacgaccacatctactgtttattttcctcgcactccttggctcaagtgtggttggcggcgccttctccggagaggctgtcatcttcggaaacaccgtgggcagtctgaatccctgccatagcgcagacagcatccggtcaagaggaaacttcttcgggttgatgttctttatcctcgctattattgaattcttcgccaacgtggtcagctggtctgggtttggctgggtgtcggagaagatcgtttacgcggttcgggtcttgtcattccggtcactcttcgagcaggacttgcaatggcatcagtccgagggccgcacaccagccttgcttttgtcctatatcaccagggatggcaatgccttggctggcttgagcggttcggtgattggcacgttgttttccattagtgtcaacctcatcgcggcaatcattctgactcacatcatcgcctggaggatcgcattagtctgcctggcgctggtgccacttctgcttggagctggactgatggagctccatgtgctcgggaagtttgaggagcgt

SEQ ID NO: 2080 - DNA, 402 bp, A.fumigatus
  unsure (24),(247),(318): Identity of nucleotide sequences at the above locations are unknown.
tggcccattttaaaggagaacagngaccttgttcctttattcaagtgggccccttcttccacttcttgttcgcagcgttgccttctttccagaagttggggggggaatattgaccgcgagccgttgatgaccagtacgagcggttccgaacatcgggttacccaggcggagggcggttttgaattcaaggacgtttcgttcaagtatccttcgcgccctgagatcacggtgctcgacaacatcattnttagcatcccggccaacaagcatactgccattgtcggtctatcgggtagtggcaagtcgaccattgcgggnttggtgacacgactttacgatcccacgcagggccaattcttttcgacggccacgacctgcgtgatgtcaaccctcgggacttga

SEQ ID NO: 2081 - DNA, 315 bp, A.fumigatus
gtttcggttatcgaacatgttctaatgtttgcaccaggtactgtcgctctgcgtgaaatccgtcgctaccagaagtcgactgagctcctgatccgcaagctgcctttccagcgtctggtccgtgaaattgctcaggatttcaagtccgacctccgcttccagtcctctgccatcggtgctcttcaggagtccgttgaggcctacctcgtctccctcttcgaggacaccaacctgtgcgccatccacgccaagcgtgtcaccatccagtccaaggacatccagctcgcccgtcgtcttcgtggtgagcgctcttag

SEQ ID NO: 2082 - DNA, 684 bp, A.fumigatus
gcacttatttacttccatcgcggcgttaagacagcgggatgcgagagaaagtacccaaaatctgtagtgatctttagtgcgcccacctcattagtcgcaacagttggtcatcaaacgcatcgcatgcgccggaagttactaaataacttcttctcaaggcggtcaattgagaatattgagccagttatccacaattcactctcaagattcctagacggtcttactacagcctacaaagaaggcagcgtagtagagttgatcgacagactacaagggttgacaggcgatgtgataacagaatatgcgtatggagagaactatgggctccaagatcctgagaactatggcaaaggcattgtcaaggttgtccaagaaggaacggaccagattcacttctttaggtttttccctcttgtttcgcaactcttgcgaattataccctcatggtttatgggtcaggtcttcccggcccgagcggcaatatatcagctgctggatggcgtacggaagcaatcaatcctcgcgcttcagcagaagaatgtttccacggctccccagaggatgaccattttccaagctcttacggctccagaggtaccgcccgaggaaagaaatctgcagcgcctccaggatgaaggactggttttgtttgctgccggcacagaaaacacggcgaccacttag

SEQ ID NO: 2083 - DNA, 624 bp, A.fumigatus
aatgcatggatggcacatactcagactccggtgatttttaaccaccatgagccctatgtcgtgaatgacagcagtattatcaatgtcgacctcaacggcattcagtcgacccgtgcagctaaggagaacaaggagcgggtgctgatcctcactcctctaagagatgccgctccccatctggaaaaatacttcgatctcctctacaacatcacttacccccatgaactcattgatctggccttccttgtcggcgactctcaggatgacacgctcgccgttctcgccagggagctgaaacgaattcaggatcaagtggaagacaaaattgctttccgcagcgcgacaattattcaaaaggaatttggagctgaaactggcatgaatgtcgaggatcgacactcctttgcggcccaggggccccgtcgcaaggctatcgcccgagctcgcaattacctcctctactccgctctgaagcctgatcactcctgggtctactggagagacgtggatatcgttgacagccctccaactattctggaagatttcatttcccacaatagggacatccttgttcccagtatgtcgaaactcttctattccagttgcctcagcgctaacgtatga

SEQ ID NO: 2084 - DNA, 1107 bp, A.fumigatus
gtaataggcgcccttaggccattgtgtttttccgcccctcggtccagttcgggtctggatcagttattctcttcagcggggttatgggcaaccgcgggagcatcagaaacttcccagttctggaagcttcgtgaggagctcaaccgcaccgacgcggacgtttctatcttcttcgtcaatgccaacagcgttatgtacgagtatcccaccgatgacccgattttcagcgcccacgtgtcggcgctcagccagctccgcaagatgggaatgaacacctccatcgccgaatttgacgactggtactcggcggacaccctcacgaccattttcggctgcatcgaccagttccagatctgcaatgcgcggacagaagtctgctccgatctgcaaggtatccaagcatgggctagtctagacggaatgctagccttcattgacgcctacgacctaagcccgctccaggccgacacactctcggtactcgtgaactacctggtgctgaacaatatgtactacagtatctacgggcggtcatcgtacgcattgcgcgcccaggagacgctgtcgaacctgaaccaggttgcgcagctgccgagcaaccagtggcagattgaggtgcaatcgtggttcgagaccaacctggccaagctgcaggagcgcagcgtacagtttgccacggggcctcgcagctcccgtgagggaaaacagcgagtggccctgacggatcagacccccctgtgcaaggcgcagaaggtgcgctgccccgcagggatgacttccttctctgtattgggcgtgtcctgtcttcttgcagttggcggcttgattatactctccaacttgtcgctcgactctatcatggcacgggttggccccaagtggttcccaggtagcgcatatcggcacctgaactgggcgctggacgacaagctgcagctccagcgcaaggccttcgaaggggccggagtcggccattggcatgggcaaaccgcggctgtgccggtcacagatacgggggagacgttcctcgcgtgggccaataatgaagatcctgctccaaagagtgatcatcttgatacatcggacgaccacgctacacgtgaatga

SEQ ID NO: 2085 - DNA, 396 bp, A.fumigatus
tcaagccgccaactgcaagaagacaggacacgcccaatacagagaaggaagtcatccctgcggggcagcgcaccttctgcgccttgcacaggggggtctgatccgtcagggccactcgctgttttccctcacgggagctgcgaggccccgtggcaaactgtacgctgcgctcctgcagcttggccaggttggtctcgaaccacgattgcacctcaatctgccactggttgctcggcagctgcgcaacctggttcaggttcgacagcgtctcctgggcgcgcaatgcgtacgatgaccgcccgtagatactgtagtacatattgttcagcaccaggtagttcacgagtaccgagagtgtgtcggcctggagcgggcttaggtcgtaggcgtcaatga

SEQ ID NO: 2086 - DNA, 210 bp, A.fumigatus
ctctggtggagcaagtcagatagcggaaacagcgtgattgacatcaacatctctcacttccggacggagtatatcgctttcttcccccacaagtatcagaaatcagcttatctattttctcatcgacatcctcgcacattcttcaaccggcgtttttcgtcctcacgtgtatattactggcaatggtgtagcaccaccgagcgcaactag

SEQ ID NO: 2087 - DNA, 489 bp, A.fumigatus
aacattgaaggtgggtggttattgtcctatgaatggcggtggtcgcttgctgactttgatcgtgattttggaatgcagtggtcccttgtacatacctttcgcaacgaagacgatggcgagacaatccgaaccctgtcgtggggctctcccgatgagctactcctgggcaattcgcacctcacactgtggttcttgaatgacgtgccgcgccttatatggaagcagaagctcgccaacccggtaaagttcgcgcagttctctcccgattcgaccctggtggccactacgggacaatatgatcgcatggtcaaggtttggcggcggctctccttcggggcagatgatgtgcggttcgaggtttcatatcttccacaccaggcggttgttacagggatacattggcgtaagccaattcatcgagaacaatccttggacaatgtgttctacaccctgagtgcagataataagatcagggtctgggctgcgatc

SEQ ID NO: 2088 - DNA, 375 bp, A.fumigatus
gtgtacatttccgggcatgcgcttgttatcctcaccggtccgcagaccctccttcagaccatctatgtggacgagaccaagacactcgaggctgtgacgattgatgaagcttctgggaaaattgctgtgtgtggtggaccggacgttttcatctaccagccgtacggtatccagcatgaaacattgaaggtgggtggttattgtcctatgaatggcggtggtcgcttgctgactttgatcgtgattttggaatgcagtggtcccttgtacatacctttcgcaacgaagacgatggcgagacaatccgaaccctgtcgtggggctctcccgatgagctactcctgggcaattcgcacctcacactgtggttcttga

SEQ ID NO: 2089 - DNA, 435 bp, A.fumigatus
caagacaatagggtgtatgttggctatccaaacatcgcacaaggcgacatcaatgattccacattggaaatcaaggagatgatcatctccgaccccaagccggattcgttctacttggaccagacacaggtcatcggctcgcacagcatgttccatccgacgatctatgccttcgatgctgctgtcagcttgctgggcgctgcaacgttcgcaaccgtcaaggttccacaggtgaaagccaatgacggcactgtagtccatatcagccagaccctggacctgagcgatgtgggtgcctttggaggatttgctacagcggtcatgcagaatgaggagattaaattaaacatctatggcaagcccgacctgaagcagggcggcctgcctaaaatcgatgtgacgtacaacaagactgttactatgaagggtgagtga

SEQ ID NO: 2090 - DNA, 231 bp, A.fumigatus
tcagggctcggtcagactcatggcgttcggacacagctgattatgcaaactctagctctcaacaagctcgaaggtttcgccattacggaaatgcatgccttgtctggtaagtcggcgaatggcgccaattttggtggaaccgtgtatatccccaacccatctccgatgaccatcagcatggtatgttgcttttcggtccctgaatggtaccggtcacctggatggacctaa

SEQ ID NO: 2091 - DNA, 285 bp, A.fumigatus
cgtcttgagttgcctgcaattgctgatcatcagtccagtgatataaactatctagtgatggattaccttattaccaatggctacccagctgctgcaaagaaatttgcagttgaggcaaacatacaacccagggcggacattgagtccatccaggaaagagtagagatccgcactgcgattcattctggcaacattcaagctgcaatcgagaagatcaatgatctcaacccacaggtatgcatatttttctattcttgccctcctgccctaccacctatcctttga

SEQ ID NO: 2092 - DNA, 195 bp, A.fumigatus
gtaaatcattcttgttattctagatggaccacttataatttgcatctaagtgctgtcaagaccgactgctcgggactccaggctggctactttgtctgcatcggagtggctggctcaacgaccacgacgacatctaacccgcactctcctcagcagactgggattgctgcaaactgtacggttgccattgactaa

SEQ ID NO: 2093 - DNA, 258 bp, A.fumigatus
gtgaagggactggatcgctgcaatgtcgcgatgtccgctcactctcaaactatctctacaatccgtttcgccgtacttcacacctccgctaacctagtgatacctcttcccacctttcgattcattagcttcccctatttccatcttcctcttattctcactcctctcctccttacttcacttctccatttttccactctcatcttcactcccatttctcctccttccctttcattccttcccaccctcttttcaacc

SEQ ID NO: 2094 - DNA, 336 bp, A.fumigatus
agcatcaattcatataaagaccacagattcacggcgcctggtaagacagtcatcaaactactcaaccgcgtcaacatcaacatcccccccaagctacaaccaaccatccccgaaacaagcagcaaccagaccaccctgccccctctatttgccagttttccaagacaccttctccaccctcccatcatcctccagcttgttatacgcccgatcatggcgattctcgatctcgtcattatgccgcctcacttcctcgggtacatctggacgcaggttcccgtcctcgtcgatgttgggcgactgccctctgctgatggtcggccgggcgttgtttga

SEQ ID NO: 2095 - DNA, 483 bp, A.fumigatus
ccccagaaatgccggacgttttccaagcataaagagtctacacaaacatcatcatcgatcacatcaaggtctcccatccgaacgccgacctttctctcctctgcgaccagcgcaatctcgtccagtaccaccttctcaacctcccctccgcccgccatcttcccacctggttccccaccccccatcatcaaaagatctacgaaacctgccgtctcgccgccctcatctacgccgtcggcgtcaccttccccctcccattccaatgctcgcctctcccccgtctcgcaaacctcctccaagaaaccctacagcagacccccgacgcaacccccctctggacccacccgcacgcacaaatcgccctcctctgggccctcaccctcggcggcatcgcggccgagaaccgcccagaacgggcttggttcgtacataccctcgcccaagcggcttccagtaatgggatctacttctggccgaagctga

SEQ ID NO: 2096 - DNA, 498 bp, A.fumigatus
  unsure (22): Identity of nucleotide sequences at the above locations are unknown.
cttggagttcgggttcggccgnttgtgtcagatcggcttaaccccagaaatgccggacgttttccaagcataaagagtctacacaaacatcatcatcgatcacatcaaggtctcccatccgaacgccgacctttctctcctctgcgaccagcgcaatctcgtccagtaccaccttctcaacctcccctccgcccgccatcttcccacctggttccccaccccccatcatcaaaagatctacgaaacctgccgtctcgccgccctcatctacgccgtcggcgtcaccttccccctcccattccaatgctcgcctctcccccgtctcgcaaacctcctccaagaaaccctacagcagacccccgacgcaacccccctctggacccacccgcacgcacaaatcgccctcctctgggccctcaccctcggcggcatcgcggccgagaaccgcccagaacgggcttggttcgtacataccctcgcccaagcggcttccagtaa

SEQ ID NO: 2097 - DNA, 540 bp, A.fumigatus
agagtctacacaaacatcatcatcgatcacatcaaggtctcccatccgaacgccgacctttctctcctctgcgaccagcgcaatctcgtccagtaccaccttctcaacctcccctccgcccgccatcttcccacctggttccccaccccccatcatcaaaagatctacgaaacctgccgtctcgccgccctcatctacgccgtcggcgtcaccttccccctcccattccaatgctcgcctctcccccgtctcgcaaacctcctccaagaaaccctacagcagacccccgacgcaacccccctctggacccacccgcacgcacaaatcgccctcctctgggccctcaccctcggcggcatcgcggccgagaaccgcccagaacgggcttggttcgtacataccctcgcccaagcggcttccagtaatgggatctacttctggccgaagctgaagagcgtcctggagttcatgctctggtatgatgctgcgtgtgacgaggcggggtattccctctggctggaagtcgcggggcttttgtga

SEQ ID NO: 2098 - DNA, 531 bp, A.fumigatus
agactccttgttgggtttctcgataacaaatctaccggaaagacagcagatacgaatgggtcagctaccgaagggtcagaagaagattcgcggccagtgtatgcttcgacaggcatgtcgagcgaagaggacctgtccgtcgaaacagacatcgtcaaggattatcaaaccttcaagtttctagacctcaacaaaccattgcttcttcaactctggaatagtggcttcagcaaagagttctacctacagcagatccaccggccgcgccactataagggaggggagtcggcccccctatttgggaacttcctggagcccttgagcaagaccgcgtggtatgtggttcctttgctctggcttcctccagtcacctatggaagttttgttggatttgctggactgggaaatgtccctacagcagcctcctactggctgtttggtcttttcctttggaccttgattgaatatctcatgcacagatttctttttcacattgacgggtacgtaatctactgctgtctgcccttctaa

SEQ ID NO: 2099 - DNA, 282 bp, A.fumigatus
cgggtacgtaatctactgctgtctgcccttctaacttcacctgacgttttggccttcctcagatatctccctgataatcgagtcggcatcaccctccatttccttcttcacggaatccaccattatctgccaatggataaataccggcttgtgatgccaccagctttgttcgtgattctggccacgcccttctggaaactggctcacacagttttcttctataactggtacgctgcggtcacagttttctgtggtggcgtatttggatatatctggttatga

SEQ ID NO: 2100 - DNA, 630 bp, A.fumigatus
caagtacgtgtttgcctttcacattttccgtgccaccggcctggtctttcaagtgctggactaacaacattaccagtctctccatcggcttcccatgtcatcgtctgctcacggtccatgtcaatgcgaatctatgccttaacacccttcgacgaaacctccagaacggttgaaacatctcttcttcgaactttgaagccgcacaccggacctgtcgtgacatctacagtcgacccaactagcacactactcgcaaccggagctgcagatggctcgatcaaggtctgggacattaggggaggctatatcacacataccttccatgttcatggcggtgttatatcagccctgtgctttttccagtccccagttcaggatggtgacacaaagtcttcaaaaaagaagcagtcaaagaagatgtctgtggatctggacggtgacgacgacatggctgaatctgacttcgcggtgggctttcgacttgcctcaggagacgaagagggcaaggttcgagtgtgggatctgaacaagagaaagtcagtgacaacgcttgagtctcacgtctctgtagtacgaagcttgtcatattcttccttcggagaatgcattgctatctgctgctcgagataa

SEQ ID NO: 2101 - DNA, 552 bp, A.fumigatus
tacgaagcttgtcatattcttccttcggagaatgcattgctatctgctgctcgagataagaccgttattgtctgggacgtgaggaccttcaaaacgcggcgaatcatacccgtgctcgaaagtgtggaagctgctacatttgtcgccgaaagtgggctgtgcatggtggcaggtgaaaacggcaaattgcgcgtatgggactgcaaccgcggaggagaggtgaccaaagagcaagaagctgggcctgaattcgaggcagttgtggccatccactacttccctggtatgaagttcgctatgaccgttcatgcagaccagaccctgaggcttcattcactcgagtccttgtccgcctttaagccgggctccacactggatcctttgacagttgtcaggcgcatatcaggcaatgacgatgatattatcgatttagcatatgtcggtcccgatagatcaatgctggcgcttgccaccaacacggatagcattcgcattatatcagtcgctccgtctgaggaccgtccgtcgacccaagaccgtgaatatttcggt

SEQ ID NO: 2102 - DNA, 495 bp, A.fumigatus
tctgttaaacgcctgactgtatatccagagcgacccgccatgcagccccaatttcgcgtagaggtcgttagtgacgacgacttccccgagctgtaccgcgctctctgggaagcctttgagaatccctaccagggcatcgtccgcttattcttccccatccacaacgatgatcgcgaaggcagtctgaaggcgtgcgtcaagtctcaactggaagagtaccacaaagagcagccgcatgtcacctggatcaaagtcgtggatacagaagccaacaagatcgccgccgcggccaaatggtacttttaccccgagaacccctttgcgaaaaaggagggcccgatcgtggcggactggttccccgagggagtgacgagggagtgggcgacgcaagcagtcaggcagtttgagcatccgcgggagagcatggcccgacgaccccatgcttgtcagtttggccatttgcatccccggggtagatggggaaaactctgctga

SEQ ID NO: 2103 - DNA, 240 bp, A.fumigatus
gtatcagcggtcaagcacaaccatatcatgagcgtcaacagtcagggcaagtacttatctgaggatcctggatctcaatatgaggaaaccatttacgaatctacggtcagatctcccattgaccttatcatgccatatgagacatataacctgaggcaaattgccacccagcagtcggagaagtcgcgcatactgtcatatgcatgcgctccatatgtgaccacgcgcactatagcggat

SEQ ID NO: 2104 - DNA, 687 bp, A.fumigatus
  unsure (67): Identity of nucleotide sequences at the above locations are unknown.
ccgtcttctaacattatcttctcacttacgtcggccaatgtcgttacaggctcagagactggccatntacacatcctgaacccagctaccctgaaacccgagctcgtcactccagtcacgcctgggtcacctctcgtcactgttctctggcatgaaaggctcaatcagatccttactggttctgccaacgctgagacacatgttctgtacaatcccaatatgtcgaccaagggagctgccttggtcatgtccagggcgcctaaacgtcgccatatcgacgatgacccgtcgcttaccatggacctgtctgctggtatctcgggcgactccgttgtggtcggatcgaacggagtacctcactacagctcggctacctggtctgcccgccatcctaccgtcgggctcacggcttcgggtcgttccagggacccgcgacgaccacatctgccggcaactactccttttgcaaaatcgcagccggatgaacggcatatccgcgaaaatattcctcttagctccatgcgagacgaagaccctcgcgaggcgctgctgaagtatgccgagaaggcagagaaagatcccatcttcaccaaggcatggaaagaaacacagccagttccgatattcagagagctgagcgatgacgaggaagagcaagaacccaataagaagagggccaagcggtga

SEQ ID NO: 2105 - DNA, 381 bp, A.fumigatus
cgtaagttccctgatcccgaattgatccggtgggcaaatgacatgtcccgcaaaggaggcagaacttcgtcaatacgcagctttaaggaccaaactatcggcacgggaattttccttcttgatgttctgaacgggatgaagagtagctatgttgactacgacctcgtcacacccggccgatcagacgaggaagcgtatgctaatgccaaattgagcattagcatagcaagaaagttaggcgcgactatttggttggtccctgaggatatttgtcaagtgcggtctcgcttggtcaccacattcattggtaagttgggttcttctccacaaagatcatgcctaataactcattcaaataggttctctgatggccacatatga

SEQ ID NO: 2106 - DNA, 216 bp, A.fumigatus
cgtccatctagcaacctcaatcgcatactcttaaagcgaagggtgctcgattacttccaattcctcgttaatcggaccgtcgaacgagcaaagaaagcgagtcaaggtgcagagcatttccacgttcacattagccataacggtccgctgctgcccaatggcgatttcaagggtaagaattacgcaaacgccgagcgactttcttcaatggcctaa

SEQ ID NO: 2107 - DNA, 507 bp, A.fumigatus
tcctcccaccaccccacagaaaacggctcaacgctctcaccatccaactcctccaaatcgccctcctcgccgcgcactcgcgcgccgttatgtcctcttggccctcctactaataccagcaaaacagggacatccccgacctccgcgcgctcctcctcaatcacacccttgacccgtccaaccgcagccagaaactccttgagacttttcacgtcattccgcgactcgggcgaacctgcacctgcacctgcacctgcatccgtccccgtaccagcgcccgcaggtaaactcgcactcctatcctccagattccgaatacagatcaccagcgccccgatcgcgtcgcggacaacccgtgcgtcttcgcctgagaactcgacagcccattgcgcgggtgagggcggggccgcgctttccccttctcctgctgtctgtgtgcgtgtgcgttcatctgtcgccgtctggagagggatctcgtcaacccatatcgggatgtcggcggtgtag

SEQ ID NO: 2108 - DNA, 891 bp, A.fumigatus
  unsure (36): Identity of nucleotide sequences at the above locations are unknown.
gggctcatgaaaaagctgcagtacacccataacatngacgctcatgttcgcgcccttggtcagaaatacatgggtatccgtcccaatgttcaccaggagctcctggaggaaaactcgctcaatgatatgagtcgccacgacgtcttggttgataacttcttgaacgcacaatgtaaggcatcagagctgagcagcagtagtatcctgcagtattcactaacactcttaatagacttctccgagatttcacttggcactcccccgcagaagttcaaggttgtcctagacactggtagctcgaacctgtgggtccctggctcagactgtagctctatcgcctgctttctgcacaacaagtacgattcttctgcttcgtccacctacaaggcgaatggcaccgagtttgccatcaagtacggatccggcgagctcagcgggtttgtgtctcaggacactctccaaattggtgatttgaaggttgtgaagcaggactttgctgaggccaccaatgagcctggtcttgcttttgcctttggccggtttgacggtattctcggattgggctacgacaccatctccgtcaacaagattgttcctcctttctataacatgctggaccagggacttctcgacgagcccgtcttcgctttctacctgggagacacgaacaaggaaggcgacaactccgaggcctccttcggcggtgttgacaagaaccactacaccggtgaattgaccaagattcctctccgccgaaaggcttactgggaagttgatttcgatgccattgctcttggtgacaacgtcgctgagcttgagaacaccggcatcattctcgacaccggcacttctcttattgccctcccgtccactcttgctgacctgctgtaa

SEQ ID NO: 2109 - DNA, 330 bp, A.fumigatus
cgtgactccttgcccgacctcactttcactctggctggtcacaactttcccattggtccctatgactatactctagaggttcaggggctcttgccatcagctccctttaatggggcttggacttccccgatccccgttggtcccccttgcctattttgggggaagacgctttcctgccgaaaagttggtacgcgttttaccaatctttgggtaaccacccctgttgggtctggcttaagggcccaaattaatgttttctctgcctggcagccaccgctgtttatacccaattgtgattgccacgaacgattgcgtttgttcccttccttg

SEQ ID NO: 2110 - DNA, 393 bp, A.fumigatus
cacattcacgcaccccaattcactgacccttggacttctgcacacacgtcttcccactcgactcctccagtgtacgcaacttccatgggaatcaatcatacgaagccagaggaagtgagcagacctacgttgtccatgccatactcgagcgttcctgtctccgcaccctcgatggtcacaagcggtaacttctcaacagcccccacgggctactccggggcggaggtgataggtctgcagcatgatatgcctcgcacaactttcgaacaagctcctacctacaccacagcctcgtcaatgagcagtttcacgcctgcaacttatgcgccgatcagctatgctccccctctcgctcatcctcacccagacagtcgccgtgtttcacatgtgtaa

SEQ ID NO: 2111 - DNA, 588 bp, A.fumigatus
aagcacaagccgctaacaagttccttccattccagcgatcctcgtggtaaccattcacagcctccgtcgggccctacatttggtgatgctcttgatgctagtcgtggaatggtcgcgctcagccaggatttgacacctcgcaacatctatgctcctcgtgcccgggggtctggggactcgtacggatttcttgcggcccattcgtccgggtcatccatctcctcggggggaaattacccctactacagtgcatctgttgcttcagttgagtcgtctgtcacggattacagttccacaacatcagagtcgtatgagaatggtcatctgtcgcgaacactacctcgcccgtcgaacctcttgtctgggagtgctcctcccggcccacaatctatgatgagccaattcagctcgaagatgccatccaacacacagaagaagcacaagtgcaaggtgtgcgataagcggttcacgcgcccatcgtcactacaaacgcatatgtacagtcacactggggaaaaacgtaagtactttgtgatatttctcgttgaagccttcggtactgactttgaaactagcgtttgcatgtga

SEQ ID NO: 2112 - DNA, 408 bp, A.fumigatus
  unsure (159): Identity of nucleotide sequences at the above locations are unknown.
tatttctcgttgaagccttcggtactgactttgaaactagcgtttgcatgtgacgttgaaaggtgtggaaggcacttctctgttgtctcgaatctccgtcggcacaaaaaagtccacaagggtgaaaaaaaaaacgtatctggtggcgaagacgagtanaaagcccgttctctactctgcacccgaagaacgatgcctttcccctttctgtgccatttgatggatgccagatcattcagtgcttgggttatcgcgctgagcggacgtccaaaccaccttcccaccaatttggtgggctctcgtcccttgtacaataaattcatccctcgctgcttttgctactttttcccgttttttctttttcttttttacatttcccttctgatctctgctaggccagagaattga

SEQ ID NO: 2113 - DNA, 978 bp, A.fumigatus
  unsure (795),(938): Identity of nucleotide sequences at the above locations are unknown.
tgggttccggttggagcgctggttttcactgaaccgtgtcgatccttccagccccgtggtgaagactcagctgtttatgtctgcgctttgaagtttgtggatattggccctgcctcgcagtcggtgcgacgtccggatgctggccgtctcgagagcaccgcgctccgacttctgattgagtccttgccccatgcaactatctcgacgatccaggccggactacttcttatggagaagtccaccatcgcgactcatgcattgaatgcccagctggtcaccgctgggttcgagcttgggctgcaccaggactgcagtggctggaacatggagacctgggaaaaggggttgcggaaacggctggcgtgggccctgtatatgcaggacaaatggtcggcgctgattcacgggcggccctcccacatcttcgccttcaactggaccgtcaaggacttggtagaacaggatttcaccgaggccttccacacggacaacgcgcagcaggacgatgcagacgtcggccacggtccgctctttttctgccacatggtggcgctgaccaccatcctgtctgacattctcgaccgattctacactcttcaagcgatcgaggagttcaaagcggctggcgcgaaccgaacacgcatgatcctggagcgggccaaaccggcccagatccgactgaaggaatggtttgcatcgctgccgccgcaactgaagatggactcgagcatagacctcttcgacacggtcactgaagacaccgcccgcaacgggcccctccacctttcctacttngcaacccgaaatcaccctccaccgctgcatcattcggtccttctccccggacacgggcgacgccctaccttttccacatttgccgctccggcgcaaaagacgcgccttaattttaaccatggactttgtcaaccggctgcgtnaagcttacctccgttatttttgcccggcggcttcccggat

SEQ ID NO: 2114 - DNA, 480 bp, A.fumigatus
ccttgcggatttccggccgtggtgcaagtatgtcaaccagcgcgagaggggtttgatccctcgtcaactgcaattcgtcaaacggactccagagctggaaaaccgatagatgccgatgcatgccagaacttcaaagacaacgtcctcttccagtcatggcaaacgcggtctgatgtactgaacttctgcgctggggtggcgaccagtcccgatcccgacgatccggatcttattcttcgacaggaagagtcggcaaaggaacgggaaaagattgttgatgaaagattggatccatactctgctcgatatttcccgaaagagctgaggacagagtcgcttgcgaacttggttcggaaccaaagaacagtggaagacatcataagagcgcgaacctggagcgtagttactgagaggtgcagtgattcggcctacacctgggaggaggctttgaataactggcgccagacgaaacaacggtga

SEQ ID NO: 2115 - DNA, 204 bp, A.fumigatus
  unsure (40),(56): Identity of nucleotide sequences at the above locations are unknown.
cgaccggtacactttgaattgacagatctcagggacacantggaacccaaggtctntggcggctcgcccagccaggttgctgctatcaaccacggaaactactttctacacgctgccatggaaagcctcttgaaagaacgacaccaacatccatgccggcaatcagggaggaccctttctggtccttctgattatgagaaatga

SEQ ID NO: 2116 - DNA, 273 bp, A.fumigatus
aaaatatcccgggggttgtggtattcggcccgattcgttattgtcggacatctggacgatcgatcgtccgccaaaattccctgttatgtccagcgaggcagaaaaaatggatttcgctgtcgtagaagaattagattctgttccaatggcctttttttgtggagtgctcacaacagttcaggcgctccctttgataccggcacatcatacagacctggtgcaaggttcggcccgagtggcatcagacaaggttctcgccgtcttaatctctag

SEQ ID NO: 2117 - DNA, 291 bp, A.fumigatus
tattccggtgacgtcgtatgtctcttatctctcaaaaatatttttgaccgtgctaactggtctagatacgacaatgcttgggccatccagcagattgaagaaggacataacagcctgctgatgcgcaagcctttcaccgatgcggatgcggaaggactgtccagggccggaaagactctgccgcggattatcactctggggggtgatcataccatcacactgccgttgctgcgcagtatcaacaaggcttacgggcccgtgactgtgatccatttcgacagtcatctgtag

SEQ ID NO: 2118 - DNA, 198 bp, A.fumigatus
ccatggatagttgcaccggcaaccggtacccccgagactggaggctggtcgacccgtgagctccgcaccatcatccgtggccttgacggcctcaacttcatcggtgcggatatcgtcgaggttgctccagcttatgacacaaatgcagagctttctaccatgtatgttccctgcctgtttgatttgaaatgtaattga

SEQ ID NO: 2119 - DNA, 243 bp, A.fumigatus
ctacccatgcttacgatggtggtttggcaaggctcacgcaaattggggtttagcggtggctacaatgtaccgctggaagcgaatccattcgtcagtgagctcaaggttttggattgtggtgatattccggtgacgtcgtatgtctcttatctctcaaaaatatttttgaccgtgctaactggtctagatacgacaatgcttgggccatccagcagattgaagaaggacataacagcctgctga

SEQ ID NO: 2120 - DNA, 186 bp, A.fumigatus
ttaattttagtagtgtggggaaacaaacctaccgcgtgtaggcatggccaaggaacatttcgacgctcaattcattgtcatatgagaactccacctatttgtcttatactaaagctccaagtcaaacagctagctataaataattttcttttacctctatccttccttctaccctttcaagaataa

SEQ ID NO: 2121 - DNA, 426 bp, A.fumigatus
  unsure (373),(375): Identity of nucleotide sequences at the above locations are unknown.
ataattttcttttacctctatccttccttctaccctttcaagaataagcataccggtgtttaccaaatcatggagaacagttcctcatctgaaggaagagatccgtcagccttccttggtgaaataattggtgctccagttacagtaaagctaaactcaggtgttgtctacaaaggtttctatataatctccattctttgcatatctatattcgtgctgataatctccacaggcgaactccaatcagtagatggttacatgaatattgccctggagagatccgaagaatttgtggatggcaaattaaagcgaagttatggagatgctttcattcgaaggaaaataatggttcgttcatgcaatcagtcatttntngaccctccgtctatactaatgaacctagtgctttatatctcagcgcaatga

SEQ ID NO: 2122 - DNA, 804 bp, A.fumigatus
actctcgaaagacaaaccatatcttcagtattctctgtcattcattctgctgatctactagtcttccagccgccgcgatgtccgagtctcctccgcccccgccgtcatggagcatcgctgccatggctaacaatgccgttcattttcttcgattaccagttttggcatcttccggtctcgccgttgttgccagtggtctcttatactttaagcaaaagtgcggccctgacccttagattgacaatattccagtcgcttgtatggctggaaactgatcgcgtgtccagtgagctgatctaccctcgcaatgtccccgccgatgcccgcaccaatgttcccagtccgcgacaattcggcatcagcgattatgaggatctccaaattcccacgccggacggagagtcattacatgccttcttcatccgtcccgcaaacaagcaacatgctcggaacataactgtgttgatgtttcacgggaatgcgggcaatattggccaccgtgtcccaatcgccaaggtgctccaagagatcctgggctgcaatgtgttgatgttggagtaccgtggctatggtctttcgacaggtgttccagatgaggcagggcttaagatcgatgcgcaaaccggcttcgactacttacgacaacgggcagagacgaggaacacgacgattattgtgtatgggcaaagcctgggtggtgcagtagccattaatttggttgctgagaaccaagccagtggtgatgttggcggtttaatactagagaatacattcttaagtatccgcaagttaatcccaacgtaa

SEQ ID NO: 2123 - DNA, 666 bp, A.fumigatus
tacggcagaagtggattaaagaatcccagggagccgaaatggatttcaggtctagatcaaagatatcaatctgcggttgtcggaagcacagtatttgaggcagttcgtctccatgctttgactgatattagatcccatggttggccctatcttgatttgaaagtggccttttctgggcccctcctttccggctattgcattctttcccttttccccttttttctcttcttcatgcttccatccatttctaccttctcttcccttcccgtttccctctcattttctgatcccttctcatctcccgtcttttcttcccccccctctcttgactatgtatttgctccttctccctcttacccccgcatttcctattttttgctctctccttgtgttcttctccctttttcctcccccctccttcctctcttcttgtccctggactccctacctcttcttttctctccattcttacactttctcctccccttatttcttattccgtccttcccctctctcactctttctcttggcatctcctgtcttttctctatctactgtgtcttatcccatgtgttctcttcattcctttcttctcttcttctctcctctttcaatttctcttttcgtccctacttcttcttcgtcacccttcttgcatcttttcct

SEQ ID NO: 2124 - DNA, 507 bp, A.fumigatus
aagtggccttttctgggcccctcctttccggctattgcattctttcccttttccccttttttctcttcttcatgcttccatccatttctaccttctcttcccttcccgtttccctctcattttctgatcccttctcatctcccgtcttttcttcccccccctctcttgactatgtatttgctccttctccctcttacccccgcatttcctattttttgctctctccttgtgttcttctccctttttcctcccccctccttcctctcttcttgtccctggactccctacctcttcttttctctccattcttacactttctcctccccttatttcttattccgtccttcccctctctcactctttctcttggcatctcctgtcttttctctatctactgtgtcttatcccatgtgttctcttcattcctttcttctcttcttctctcctctttcaatttctcttttcgtccctacttcttcttcgtcacccttcttgcatcttttcctc

SEQ ID NO: 2125 - DNA, 429 bp, A.fumigatus
  unsure (12): Identity of nucleotide sequences at the above locations are unknown.
gcggggtttttncgtgagaccgccccttccagccccgtggtgaagaccatcattcagggaatcccggcttttgcactggcctgcgggatctggtttatgcccttctcgcctcggtggctggtcaaagtcggacgagaccaggaggctcagtccacgctcgcctggatgaggaaattgccgatcgaacatgatcttgtccagatggaatatctcgagatcaaagccgaagccttgtttgagaagagagccttccccaacacggcggaaaagggaatcctgaagaaccaatgggcgcagtatgccaactgcttctccaccatggacaacttcaagcgggtttgcaccgcctggctggtgatgttcttccagcagtggagtggaattgatgccagtatgtcggtcaactctgtgttccttgctctgagctga

SEQ ID NO: 2126 - DNA, 249 bp, A.fumigatus
agactgaaagtgccagtattcgagcagaccgaggaaaagaatgaggccatgacgcgtgacgtcgaggagagcgtgagggagttcactcgcagtctcgaagatagcctcaaggaagagggtgaaacttcgacacgtgagcatgaacggcgtcgatgggaggatgctttgggggtcgaggacgtcattcgggacttcatctacgacctgcaacgaggcagccgaacggcacacatccgtaaggaagagtaa

SEQ ID NO: 2127 - DNA, 447 bp, A.fumigatus
gacccacaccctaccatttttgcttcaaggtacatttggctaacgatgctctcactcgcctgcagaatggaagctcagaagcgtgaggaggaactcctcaaggagaaagaggcgcaagaagctcgtctccgtgcactggaggagcaagtcaggcaaggcaagatccggaagcaagaggagaaacgtcgcaaagaagaagccgaacggttggccaaggaaaaggaagccgcacttgcagctcagcgcgctgagatcgagagggccaaggaacgagagcggcagcttcaactagaattggaacgtctcgatgaggagagctcatctgatgatgaagggccagtgaacatcacgcctgaggacagcacaccgacccagagccaattactccccacagtgacccctccggcccctgttttctaccccagggggcccgaagtaaccgcgcaa

SEQ ID NO: 2128 - DNA, 213 bp, A.fumigatus
gaccgtccccggcgacctccgcggcaaatacgacgtagtccacctccgcctgttagtcctcgtcgtgcagaacagcgaccctctcccgatcatcaaccaggcgtaccagctgctcaagccgggcggctacatccagtgggacgacctgaactaccccgacggcgcggtcgtcaaggccaatgccctgcgcgacgtggccactcccgctcatga

SEQ ID NO: 2129 - DNA, 729 bp, A.fumigatus
  unsure (178): Identity of nucleotide sequences at the above locations are unknown.
gagtccactcccgtccgcatcgcggatctggccacgggcacagcgatctggcttttggacctcttccgagatcctgcagtggcacggtacaagtccatccgactggatggctttgacatcgatctggcaaacgcccttcttcccgaatggcttcccacgccgattacgctccgccagntgagcctctttgagaccgtccccggcgacctccgcggcaaatacgacgtagtccacctccgcctgttagtcctcgtcgtgcagaacagcgaccctctcccgatcatcaaccaggcgtaccagctgctcaagccgggcggctacatccagtgggacgacctgaactaccccgacggcgcggtcgtcaaggccaatgccctgcgcgacgtggccactcccgctcatgatgcgtttctgcgatttgcacggtccaatgggcgcaatgactgggtcctcgatcttccgcatcatctgatgtcgcgccatggtgggtttgaggatgcgcatatatgcaactacacggaccgcgtggagttgcgcaaggcaaacggcgaccaatacattctggtcatggaggagttttcagctcgcctgaaacgtgcaggcaaaatggaagacgcgcataatattgatttgatgataaggggattggcggaggagtcacggcggggggtgggcttgtccatgccgaaagctgtgtgtgttgctcggaagaagggtgatcgagcctag

SEQ ID NO: 2130 - DNA, 993 bp, A.fumigatus
gccggcattccgatttttattcggctggaagtgcccaattccattgcagcatttcccagaagcgtcgaaaatggggcgatccctcaactaggaggcagtctctccttgaacggccgagactccaaattccacatcacggactatgatgtgggtggattcaatctcatctactcttctgcagaagtcttcacttgggcgaagggagacaacaagaagcgcgttctcgtgctatatggaggagcaggggaactacatgagttcgcgctgcccaaacatcttccgcggccaaccgttgttgaggggtcctacgtcaagattgccaaacagggaagtgcctgggtcgtacagtgggaggtagctgctcaaagacgggatttacgtgcaggaaagcttgagatccacctcctctggcgtaacgacgcctaccagcactgggtcttggaactaccagcaaaacaacccattgctaactatagctcgccatccaaagagacggtgattgtgaagggaggatatttgcttcgaagcgcgtggattactgacaatgacctgcatttgactggtgatgtgaacgtaacaactcccttggaggtgatttcggcgccgaagcgatttgatgggattgtcttcaacggccagtccttgaaatcaacacgatctaagattggcaatctcgctgcaacagttcactatcaaccaccagctatctctctgccagatctaaagcgtcttgactggaaatacatcgattctctcccagagatctccacggaatataacgacgagggctggacaccactgacgaacacatacaccagtaacaccagagagttcactggccctacatgtctgtacgccgatgactacggctatcacgggggctcactgatctaccggggccacttcacggccaacggagacgagtcatgggttttcctcaacacctctggcggtgtatgcttcgccaattcggtatggctaaaccaaacattc

SEQ ID NO: 2131 - DNA, 480 bp, A.fumigatus
  unsure (420): Identity of nucleotide sequences at the above locations are unknown.
gtgatctttacaataatgaacgtctgtggagcaaatgctaacctttgcatagtccctggtattggccacagagtcaagtcccggaacaaccccgatctgcgtgtcgagttggtcaaggagttcgctaagaagcacttccccagcaccaagcttctcgactatgccatcgctgttgaaactgtcaccacctccaagaatgacaacctcattctgaacgtcgatggttgcgttgctgtctgtttcgttgacttgatgcgcaactgcggtgctttctcgcccgaggaagttgaagactacatgaagatgggagttctcaacggtctcttcgtccttggccgcagcattggtctcattgctcactacttcgaccagaagagactgcgcactggtctctacagacacccttgggatgatatcacntacctgctccccactctgcagaagggtggtgccgagggtcgtgttgaggttaacatttaa

SEQ ID NO: 2132 - DNA, 249 bp, A.fumigatus
cgcggttctttccagccccgtggtgaagaccacggtccggccgtgtctggtgccatgaacaccattatcactacgcgtgccggcaaggatctgatcagcgccctggtctctggtctcctgaccatcggatctcgctttggtggtgctcttgacggtgctgctgaggagtttaccaaggccttcgacaagggcatgagcccccgtgactttgttgacactatgagaaaggagaacaagctgagtaagtga

SEQ ID NO: 2133 - DNA, 312 bp, A.fumigatus
tgggtccgagctccgtccgctatcataagtttatcaagattgcgactcaaaaatgacgagatatcctataccaattttaaatctcaagactcctcgacattcgagctcagcataagaaccgtcttccaattaccgcaacgaaagaaaaatacgctttctcgaagacttggatatccaagggactttaataacgcataccaacttggtcccgcttcaaaaatcgttacctcctcatcgaagtcctctaaccattatcgttcctcttggcccacctcctcaacaaacaaaaagaaattggccttcgcaggctga

SEQ ID NO: 2134 - DNA, 675 bp, A.fumigatus
gtcaggatacctagagcaattagatatgattcgaacgtgaaagaaaaggcaggccctacccttaagaggcccatgagcagcctccttgatcgccgccacgatctcctcataggtcgcactcttctcaatccggcacgtcaaatcaatgacggagacatccgaggttggcacccgcatagccatgccagtgaccttaccctgcagctccgggatcaccttaccaaccgccttcgcggcaccagtactgctgggtatgatattctccgcgggtgcacgcccacccctccagtccttggacgaaggcccatcaaccagcttctgcgtcgcggtgtacgcatggatagcagtcatacgcccctccacgaagccgaacttctcatcgacaaccttgaccaagggagcgatagcgttcgtggtgcacgatgcgttggacaccacgtccgccgtgccgtcgtatttctcctcgttgacccccatcacgtacatcggggcatcagcggacggagccgagctgacgacttttttggctccgccgcgaagatgtgctttggctttgtcgaccgtcgtgaagacgccggtggactcgatgatgtactcggctccagtttcgtgccagggaatgcgggcggggtctttcatcggcgtagaacttcaccttgcgcccttggatggtga

SEQ ID NO: 2135 - DNA, 654 bp, A.fumigatus
  unsure (577),(630),(633): Identity of nucleotide sequences at the above locations are unknown.
gtcgcactcttctcaatccggcacgtcaaatcaatgacggagacatccgaggttggcacccgcatagccatgccagtgaccttaccctgcagctccgggatcaccttaccaaccgccttcgcggcaccagtactgctgggtatgatattctccgcgggtgcacgcccacccctccagtccttggacgaaggcccatcaaccagcttctgcgtcgcggtgtacgcatggatagcagtcatacgcccctccacgaagccgaacttctcatcgacaaccttgaccaagggagcgatagcgttcgtggtgcacgatgcgttggacaccacgtccgccgtgccgtcgtatttctcctcgttgacccccatcacgtacatcggggcatcagcggacggagccgagctgacgacttttttggctccgccgcgaagatgtgctttggctttgtcgaccgtcgtgaagacgccggtggactcgatgatgtactcggctccagtttcgtgccagggaatgcgggcggggtctttcatcggcgtagaacttcaccttgcgcccttggatggtgagagagccttcgtcntgggagatttcgtgctcgaagcggccgtgggtggactcctatttgagcatgtntanagcgccgcagcggtgagcgtg

SEQ ID NO: 2136 - DNA, 330 bp, A.fumigatus
cgtgccggattgagaagagtgcgacctatgaggagatcgtggcggcgatcaaggaggctgctcatgggcctcttaagggtagggcctgccttttctttcacgttcgaatcatatctaattgctctaggtatcctgacctataccgaggatgatattgtatccaaggacataatcggaaacccacactcgtccatcttcgatatcaaggctggtatctcgctgaatgccaatttcgtgaagttggtgagctggtacgacaatgagtggggatatagtcgtcgagtgctggatctggtggcccatatcgccagtgtcgatgctcgagagtga

SEQ ID NO: 2137 - DNA, 234 bp, A.fumigatus
  unsure (39): Identity of nucleotide sequences at the above locations are unknown.
gagtccacccacggccgcttcgagcacgaaatctcccangacgaaggctctctcaccatccaagggcgcaaggtgaagttctacgccgatgaaagaccccgcccgcattccctggcacgaaactggagccgagtacatcatcgagtccaccggcgtcttcacgacggtcgacaaagccaaagcacatcttcgcggcggagccaaaaaagtcgtcagctcggctccgtccgctga

SEQ ID NO: 2138 - DNA, 666 bp, A.fumigatus
agttctacgccgatgaaagaccccgcccgcattccctggcacgaaactggagccgagtacatcatcgagtccaccggcgtcttcacgacggtcgacaaagccaaagcacatcttcgcggcggagccaaaaaagtcgtcagctcggctccgtccgctgatgccccgatgtacgtgatgggggtcaacgaggagaaatacgacggcacggcggacgtggtgtccaacgcatcgtgcaccacgaacgctatcgctcccttggtcaaggttgtcgatgagaagttcggcttcgtggaggggcgtatgactgctatccatgcgtacaccgcgacgcagaagctggttgatgggccttcgtccaaggactggaggggtgggcgtgcacccgcggagaatatcatacccagcagtactggtgccgcgaaggcggttggtaaggtgatcccggagctgcagggtaaggtcactggcatggctatgcgggtgccaacctcggatgtctccgtcattgatttgacgtgccggattgagaagagtgcgacctatgaggagatcgtggcggcgatcaaggaggctgctcatgggcctcttaagggtagggcctgccttttctttcacgttcgaatcatatctaattgctctaggtatcctgacctataccgaggatga

SEQ ID NO: 2139 - DNA, 666 bp, A.fumigatus
tttgcgctaatcgcggcatccttccagccccgtggtgaagatctccagcctctgaaaatatacaagatggccaccgcagagaaaacaaaagaacagcaaaaagagcccatcctccagcaagacgattattcagatgactactcggacgactactccgacgaagactacgaaaccgatgactacgaggtctccggtgatgaagcagaagcagaggatcccaagaatcaggtgaaacatcgtcagcgccaacaacaacaacaacaacgaagcagacaaccagacgccgtagaagaagcagatgacgaggactactccgacgaagatgactattactctgatgaatacgatgacgaggatgaagactacgacaaccaagtcgcctctggcaaggcaatgcagccataccaacctgccggcggcaaccagtccctctctcagaacggatcaatgaacgtgataccgcaggagaagcaggggtcgagtctggacgacgaagaagggatgaagctcaagttggagctgaatctcgagatcgaggtcgagctcaaggctcatatccacggtgatctgactctggctttgatgtatgttactcccttgttgccacctgacattccgttcacccgctcaattcgaataggagttgaccctcgatgcagtgcataa

SEQ ID NO: 2140 - DNA, 186 bp, A.fumigatus
ccgttggccaagaacattctttcagatattaagtggagcccaaatacagtacctcctcagtacacggatcatgccgaccagttcatcgaaaagggacccagtttacggctcaaaatcctcggtgtcaagcctgacgtagctgccatcaatgctattggaaccatcaaagaagattatcttgggtga

SEQ ID NO: 2141 - DNA, 207 bp, A.fumigatus
gtacaccacaacctctacatcgtcaagcaccgccagtcaaagtcatatcactttcatccccgtaaactaaacacctgtacaaaattgcccatcgagaacaactcgaacgccccgccctgccctccacaaccacaatctccacccagcaccaaccctaagactccctgcaccactgccacagatactgcaaggccgtcaccccaataa

SEQ ID NO: 2142 - DNA, 288 bp, A.fumigatus
gaaatgtgctgttggcttggaaacaagaacaaccacagacatctcagtccccttatatgctattttctcctatacatcttcagcaaccaacagactctaatccaccttcacgaccatgacaacacagccactggctacaaatgcactgactgtgccacagcacagtatgcgtctcaaaatatccaaagccaatggtgcttaacctcatgtggaaaggcaccaaggcatccaagtttgaaaccctgctcgttaaaatggacaagccaatgtttttgggccaaaagttaa

SEQ ID NO: 2143 - DNA, 216 bp, A.fumigatus
gcgcgggacccgccagctcccgtggtgaagactttcaactcgacactgaagaattactctgttccctcttgtttccatggaccgacatgcgtagccttcatctatgctcaactggtggggtgccaggatcaggccgtcagctataaagatggacgtcaaaacggtcaaatattatatggtagctccattctgtttatttgttatatcacctggtag

SEQ ID NO: 2144 - DNA, 273 bp, A.fumigatus
ataaccaaagacatgctactatttaatagggctacttatttatatgacagggaagatgcctccccattatattttaagctattattaataaacctacaggcacagccgcacatggcatgtggtcttatacactcaacacctgcagaagaaaggttttgggataagattcctattagactggctgacccaacccgcaatatgggtgggtttggaatgggcctgacccaactcacttgggtatgggttattaacatcaaacctatatgggtatag

SEQ ID NO: 2145 - DNA, 363 bp, A.fumigatus
ctgttgtttactgaccgacctagcgtctccaatcttggtggtacattccctcggtactttatcctcaaactcgtcgactttttcaccgtggccacatgtattcccccagccgtcccgcctgcagctgagaagctgaagggtgatttggtcacatctgcgttctcttgcgccttggagcctgacaagaaccgctgcgtcaacggcggtggagtttgcgaaactagtcgcgacggctactacatcaccaatattctgtgtgtgttggttggaacagtcacctttatcatgttcatccagcctgcggtcctgaagctccagagtctgccactaagggcatggagattgagcaatggagatcggtag

SEQ ID NO: 2146 - DNA, 510 bp, A.fumigatus
  unsure (4),(12),(67): Identity of nucleotide sequences at the above locations are unknown.
aganagaagacnagacaagggagcgggaacagcatcaccgatgtttaccagagtatgtgggacatcntgaaactcaaggacatccaaaccatcattgttattcatcttatcgccaagattggtttccaggccaatgatgccgtcaccagcctgaagctgttggacaagggattcggcacggacaacatggcgcttgtcgtcctgatcgactttccttttgagattggtcttggctactatgctggaaaatggtcgacagaatatactcccatgcggctgtggtgctgggcgtttattggacgactggctgcagccgtcctggctcaagctaccgttatgatctacccatccagcgaggccgttcctttctggtacattctggttgtgattggggagcacgtattgtcgacattcatgaatacagtcatgttcgttgcagtatctgctttccatgctcgcattgccgatcccgctattggcggaacgtacatgactatgttggcaacgtag

SEQ ID NO: 2147 - DNA, 510 bp, A.fumigatus
gagatttgccaaaccccaggtcatctcatcatccttgcaattaccactcctcgctatggacgcttcgatgaaccgctaaggtgccaattgtatgcgccctctttccccccctcttttgcaggccctttgtctctccatgcaacgtcctctgtcagacacgagaaaaaagaaaagaaagaaaaagaaaagaaaagaaaagaaaagaaaaaaaggaaacagaaaagaaagaaagaaagaaagaaagaaagaaagaaagaaagaaagaaagagagggaccaaaagaaatatcgatatagtctgcgaaactgtttcaagcacctgagcccgattcatccgacaataaaccggcaaatcatgaggaatggccttggccaagcgagatctcagacgtctcgtctccctctttgctcaagtgcttcgatggacagttcgtccggacatcgccggatcctccagcttgtattgacctgtcacttctcactcgccgtgcaatttacgacagccagctga

SEQ ID NO: 2148 - DNA, 1590 bp, A.fumigatus
  unsure (147): Identity of nucleotide sequences at the above locations are unknown.
aggattaagaattttcataactttttcaggaattcgtttcattattccaggctttttattgaaggccaacgcctggttgactccttttccctaaaaaatgcaacgtttctcagtcaatccatctatctcacagtagatgtaccccgncggttatacccaatgatatgctttcaaggccagacaggttcagacttctcttcgttggatatagtccagctagtggcgagctccacatgctcggttcttgttcctgttctctctccaaccttgaacacatcggttaagggtgcatatcaccctcgagatacatgttcgcctctcgccagatggtggctttatacttgggtcagtccactggtgagagtcggctacgaacggaacggctccatcaacaaggaagatctctatcctcagaaaaacgaggcctcggtagagacttggcaacaagcctatgcaagttgtgactcggaatctttgcctttcaagtctattctctggaaattgtttcgaatgaggttagctacgatggctctattttcaggcctgtgtggcttcttcgagcttgtggggacaatcggcctgcatcagcttctactttcccttcaaagtccatctgtagccaggctccaaccctggttctccgtcacattatttgcagtatcgccgattattcgtggtctatgcatgcaaacctttgagtattttgctacccatacaataggagactggaaggctcttattgtcgccgctgtatatcggaaaatgatgattctcgaggcagatgcagacattaatattgggcaattacagagcattatatcagtcgatattgacaggttgggtacacttcgatacaccgcgatgacggcattcatgatccccgtcgaattcgtcacggcctccattctcttatacagggctatgggatggtactatatccccagcctgctatttcttcttgtcactagatatcctatttcccgattcataatatcagaacaaaccaaatcgcagtcagcgatcgttcaggcaaccgataagcggataacacgaacaagtgaaagcatacgggctctactaatgatcaagatacttggaaacgcacagacttttataagaaggattttggatgagaggaagcaagagttagacgctatctggctgaagatgcgtgtcatcattctctcagaaagcctttcctcttcatgctcctttctggcaatggttttcagtctatgccttttcatatccgcaggggaaaagcctttagcgccggatattgtctttacacttgtcgctgtgttcaacataatcaagagtatgcttacattaagtgtacttggtgttgggcaatacgcgcaagcgatggtgagcttgcaacgactaagcgactttatggaccgaaagacttccccggtggtcacagacaaaacccagcatacaatgcaggcacaaagattagaccagcgagttccctcatcctctacagcgcaggtcctcggggagttcagtcacactcaagtcaggcttgatgtcaagtttgccaggggcggactcaatgtgaccacgatattcaggccaaggggctgg

SEQ ID NO: 2149 - DNA, 594 bp, A.fumigatus
  unsure (109): Identity of nucleotide sequences at the above locations are unknown.
tgcagatggccggatctcctcttcgcgcgaatgcaaaaataccgcccaacctcgtcattcgccttcgtcaaccaagccgccggcggcaaccgcatcctcgcagacgggntaggccccaacgtcctcagccggcttgaccgcgatgtcctcgcgcactcgggcgtgcgatacgccatgatcttcgagggggtgaatgacatcggcgtggcgagcgctgaccccgcagcccagcagcgcatcggggatgaactgctggtggcgttcaggcagatcgcgacgagggtgcaggcggctgggataccgatcttcggggcgacgatcacgccgtttgggacgccggtggggtcgaactatacgcagccgtattcgagcgatgagcgggagcagacgaggcagcgggtgaatgacttcattcgcagcagtggggttttcgatgcggtgctggattttgataaggtattgagagatccgagggcgccgggggtgttggctgaggagtttgattcgggagatcatttgcatccgaatgttagggggtatcaggcgctggcggatcactttcccttggaggtttttgatcgctttcattggtag

SEQ ID NO: 2150 - DNA, 1419 bp, A.fumigatus
tgggaggaggatggtatggaatccgtggaaggagaaatctgcattgttggcctagttctggcatgggggtatttccatgatccagagcgcacaaacagcgcttttgtcgaatggaacggggtcagaatctacaaaaccggggactatggcaggcggaccaagcatgggctacagttttgcggtcgcagggacagtgtggtcaagaacaggggcttcctgatcaacctcgaagcagatgtcgagcctgctctactgtcctacgacaaagttgacagtgcatcagcgttcatgtctcaggggcaactcatcgcttttgtcacacctacatctgccaaagagggactccgcgaatatcttgagaatacggtatcgtcgttcctcgtccccgatacgatatattcgctagacgaatttcccagaacaagcaacggaaaagtcgaccgacgaagcctaatgcgtatgcatgagctagagcaaggatcagatacggccagtcttgagagaggccttggtgcagtggaatccgttcgtcgaggattatctcatgtcctccgcctgccagaatcgcaaattcttccggcttcgtcttttcgccatctaggtggccattcactagcagcagtcatgttagtttcggttctgaggagaatgggcttcggtatcagtgtcgccgaggtgcttttgttggatacagtcgaaaatatagctgccgctgtcgtggagttgagcgatatcccgcatgccctttctgcccaggaagatttgatagaacgactaaggcacgatatctcaacaacccggccgcttgatgaaggtgtgacaattgcacctatgaccgacatgcaaaccagattgctcggtgctagtgttgctactccaggtctttcatttatcaagacatcatttaccttggatcatccagagaaagaagaccttacatctactctccgtgctgcttgggttcgtcttcatcagacgcacgagatcctgaggactgcatttgtcttgactgcatcaaatggggcccaaataatctcccaagaaccggacttttcgtggaaggagaaattcgtcacagaatcggagtgggagtcagtttgtcgacgcgaagagcatctggacgtggccgacttccccgactttgacgcagagaaccgagcttcgttgtcaagagttgtcttgattatcgctccgaggagacgaacccggtttgtctggacggttcatcacagcttgattgacggatggtcgatggcaactctgatgcgagatttcgcctcttgtctcgatggtaaacccatcccggcaccaccccaatttgctcaagttgcgcaagcaataggtcagcttaaggctgagtcctcggatagagccgtttcattttgcagagcgtacttagatgtttacacgacggcctga

SEQ ID NO: 2151 - DNA, 1164 bp, A.fumigatus
tgtcaatatgttttgcggcacaatagcattttccaactaccatggcagcgcatcatcaatgccaccgaagccgttgccgcatcacacgaaacattcgcgcagaaaattgacgaggacgtggagcgccctttaagagaatacagcagcaagaaccgagaattagcatcgatgcctggcatccaaagtgatctcgccgctttggctaagagcttcgaagcgaaccagaagaaggttgagaaggccagggagaaagggccgaagggggcggagaaactggccgctgccatttccgccgcagaggagcttagagaacaatgggattcaagggcaccgtttgtgtttgagcaacttcaggcagcggacgaaggccgagtaaatcatctccgcgacacgctaactcaattgcaaacgcatgaatcggaccaggtggaacggtgtcgccaggctgccgagagctgcctaaatgtgcttctcaatgttgagactgcggatgagatcaagacatttgccgccaaagttaatggaggcaggcctgttgctcccaggaggcaagaatcgataccctctggcgggccaggagcacctcttgctcctccgccacgcattcaggacgatgctgctagtcaacgctcggagacttcgggccctgtccggacacctcctggtaagtcttcactccatcattcacatagaatgtttgccaaccatggctgtgtcgtagctccagagccccgtaccactgccctaggtggactcaagcgactaggaactgtcatgggcagaaggaagagtgtagtacacacccctggaggatggccactcttcggatacaagaagcatcgcaacccgtttgcttcattcaagcggggagattcacgcgagatgcagatacccgaatcccctacgggtacggatcgtcccggtaccgctctgactactcaggatatccatggcgaatccgcaccgatcccaagtgagatccacgagcgagggcttcctggttcactgccgacgagcccaaaacctctgcaaacaccagcgaccacgaatgggggagtagctcaggaggttcacaatgagccgacaccggctgctgctgtgactgcgaccgaagtatgtgtggacgacaatgaacatctggattggactaatgatgacgcatag

SEQ ID NO: 2152 - DNA, 186 bp, A.fumigatus
gaaccgttccgagtcgactcgcggctatgcgtcatcattagtccaatccagatgttcattgtcgtccacacatacttcggtcgcagtcacagcagcagccggtgtcggctcattgtgaacctcctgagctactcccccattcgtggtcgctggtgtttgcagaggttttgggctcgtcggcagtga

SEQ ID NO: 2153 - DNA, 213 bp, A.fumigatus
gtttatgctgcaatgcattctctattcaagctgactgttcccagtgccggtattgggggtatggctgctgcattggcattgggccaacgaggacatcgtgtcattgtactcgaatcagcccccaaagtatgcttcaccaataacttgaaaactggacagaagtttggcgtgaccttgattaaccccatgaaatccgtgcccggttatccaagg

SEQ ID NO: 2154 - DNA, 384 bp, A.fumigatus
tggcgcaccggtgagacggtcgcatgcttcgatattatcatgccggaggtcagcgaagtcgcgggcggatcactccgtgaacaccgcctgcccaacatcatccagaacatgcgcgatcacgggctgatcaagcagcgcttatatcctgcggctggtgctggagagacgccgacgacccagacggcccctgagcagccgttatacccccatctccagccgtatgaggacttggggcatctgcagtggtacgcggatctgcgacggtgggggagcgcaccgcatggaggattcgggcttgggttcgaccggtttatcagttatctagctggagtttcgagtgtgcgggatgtggtggcttttaccccgatactttggccgggctga

SEQ ID NO: 2155 - DNA, 885 bp, A.fumigatus
  unsure (867): Identity of nucleotide sequences at the above locations are unknown.
caacacgaattccacttccatgacctcttcgatcaccttgatagtagaggatacgttatactgatccggatgcgccggcaactcaccaagagagcatgtgatgagtgtatatctcgcaaggtgaagtgtaacggctcctcgccttgtgatacttgcctgaagacgtctaaggaggcggactgcacgtacctcaagccaccaggacggatgggaccaaaagccaagcgatataccagcaagagcaggtccgcctgcgatggatcgattggccatgctcatacggaggaagctgcggcaagaacccagtcggtcgagaatcgtccggcaattcccgctgacgttcatgctgatactgagcgggatgagtccctgtcttcgtgcatttccaagacggtactggtctatattgtgcgcctgtaccagactttctcgtatagtgtttggccggtggtcgacgcagatgcggttttgcaacagttggggaacggcacctgcgatgcgcagacactttgcttagtgctggcgctgtgtgccgcgacgatggcacagttgcagcttgctcccatggctggcgatgatggtcacatggtggacagtagccagctcaaatcggcgtgtatgcagcttcgggagcggagtgattaccgagagaacctcgacgtcaagggtgtacttgtttcattctttctgcatgtgtatcatgcaaagattaaccaacgaaagtcagctatgctgttcatacaggaggccatcgcaagcgcgagactattagggttggacacgaacgaacggaatgctgtcgttacggatggtgttgttgcaaacagggagattgtgtttgtgttgctgtgggtgtctgagaggtangtgaccgtaaacctgtaa

SEQ ID NO: 2156 - DNA, 279 bp, A.fumigatus
gctcgggcttggcttgtgcttttgactgtctccctcctctccaagtacggagtagcaatttcagtagttggtcaagtgcttactgctgccattatttgcccctggtacctgcggcgaccgagccatgtgcagaactgcagaggatgtcatacaagtattttgactttctctttttttcttcctaccgaaagtttgattctcgaagcattttatagtatggaaatcattagacggaaagcaccgccgtgtcttcaccaagggggcggcggtccggagtaa

SEQ ID NO: 2157 - DNA, 504 bp, A.fumigatus
ttgcaggaccgccatgttcgcatgcgacaaatctacgagaccatcgatagacaaggatatcaatggattgtcgtcttcgtggccggggtcggcttctttctcgatggatatacagtaagtcagcccggatacttacaatggactcggactcggactcaacggcgacagctcttcgcgagtaacatggccctccctatggtcagctacgtctactggcaaaacaacctctcgtccaagaaactcacctacatcaatatcgcgactctggccggcacgctcttcggacaggtcctctttggctatctggcggaccgcaacgggcggaagaagatgtacggggtggagctgatgctgatgatcacgtcaacgctgggtgtcgtcatgtcctcgaccggagagaatgggagcatggatgtgtttgcctggttggtttggtggagactggtggtgggagttggggtcggggcggattatcccctcagtgctgtcatcacctcggagtaa

SEQ ID NO: 2158 - DNA, 342 bp, A.fumigatus
tcacgtcaacgctgggtgtcgtcatgtcctcgaccggagagaatgggagcatggatgtgtttgcctggttggtttggtggagactggtggtgggagttggggtcggggcggattatcccctcagtgctgtcatcacctcggagtaaggctatgcattcggcctacagaagcccaaggctaataattggtgttagattcgctccggccaagcatcgcgcccgcatgatggccagcgtcttcttcatgcagccactgggacaaatcgcgggaaacatcgtcaccctgatcgtggtggccgtcggcaagaaccagcagcacgacgacgtcatccgcacgtcttca

SEQ ID NO: 2159 - DNA, 195 bp, A.fumigatus
aagtgcaacgtgcctcaaaatgatcgcaggatcaagagagcttcaaagagcgttgattgtccaccacccccagccaataagaagatcggcaacggagcgctggtgggttcaaggaatagtgctacagagtatctagtgttcatggaatccttatttattgatcatatcatcagttttgaggcgcacggatattaa

SEQ ID NO: 2160 - DNA, 483 bp, A.fumigatus
gtcaagggtctcttcttccttggcatgagggtccgtcacttccatatcttctcgtccaacagcctcaccttcatcctcgggggcttcttcgtcttcttcattctcttcttcctcaccctcctgctctgcatccttgtcacacttctcctgggtcctttcttcctgcgctgcggtttgctcatcggattcagctgctcccttgccttgttcgttctctgtctctttctgcttctcatcatggtcgccatcccacatcttctcatccactgcggtgtcgtcgaggtcgttgacgctgcctacttcctcatcgacatctttttttttttccgagccgctggcgtcttcatcttcctcttcgtcctttgcctcgcgatcaacctcctcgccttgcatctcttcgtgatccatgttaactgcctctgcagaagcctccatgtcctcagacggcttctcattctgttcttgctgagcaagctcagataa

SEQ ID NO: 2161 - DNA, 1059 bp, A.fumigatus
gaaggtgttgaggatattagcaaagacgtcggggatgacgaggacttatctgagcttgctcagcaagaacagaatgagaagccgtctgaggacatggaggcttctgcagaggcagttaacatggatcacgaagagatgcaaggcgaggaggttgatcgcgaggcaaaggacgaagaggaagatgaagacgccagcggctcggaaaaaaaaaaagatgtcgatgaggaagtaggcagcgtcaacgacctcgacgacaccgcagtggatgagaagatgtgggatggcgaccatgatgagaagcagaaagagacagagaacgaacaaggcaagggagcagctgaatccgatgagcaaaccgcagcgcaggaagaaaggacccaggagaagtgtgacaaggatgcagagcaggagggtgaggaagaagagaatgaagaagacgaagaagcccccgaggatgaaggtgaggctgttggacgagaagatatggaagtgacggaccctcatgccaaggaagaagagacccttgacctacctgaggagatgcaactggacggcgaggaaaaggaagatgacggtgccgaaagtgacgacggcatggacgatatgtcggatttcggtcctgcgcctgcggaggacgagcaacaggctgaaggaaacgaagacaatgctgaaaatccggatatggatgatccgactgacgagcaagaacctgatcgggtagatgaagaggccatggaggaccaagaagccaacgaggccgagggagccgatgaagccaatgcagctgaggaggaagaattggaggctcggcaagaagagttcttgactcagcatgatgacaatgaagctggtggtgaggaagttgcccctagcgaagctgttaacggtggtctgggcacagatgaagaccaaaacaaagagcaaggcgcagccggcaatgctcaacaggaagatggctccactgatccggccacagacgcggaaaagccaactggcggtgccaaagaaggagaggacagccagcgcaagaaggatgcgggcggtgctgatgacgtgagc

SEQ ID NO: 2162 - DNA, 240 bp, A.fumigatus
tcacttgaatccaagatgacgctcccctccaatgtccatgtttcctcccatccctgcctccaggccaagctctcccagctccggtcgcattccacctctcctcgcgagactcgcagcctggtgcatgatattgcaaccattttaggggttgaggcctttgctgccgggttgaaggctgccagtgggggaaaggtggttattcttcctgatcaggagctccaataccgtaaaccaatctaa

SEQ ID NO: 2163 - DNA, 408 bp, A.fumigatus
tccgtgtcagagaaaatgacaagctcggtagcaagcgattaccctcaaccaatatcgtcccctcccccggtctatcttcgatcatctcccccgctttcgccgtctcagagtcaatcaacccccagatcgataccccaacagcgcgccacacaacacattgcacggaaggctttgcctggctctcaatctgaaaatggatatcctccagttccgccagtctatattcacacagacatgaatttgtcgcaatcgtccaacatgacacacgaagatactcgaaacggtcatgtcgcgaattctatgcccaccactgctttagccaatatgtcgcttgaggatcaatcgcagaatccccagaacagcaatgggccgtttccaccacgccgagactcttacgcccctccacca

SEQ ID NO: 2164 - DNA, 357 bp, A.fumigatus
tccgaccatcttttacgattactgcatattcactggaccaagtctcgatgccgtcagatctctaaggcctctccatcttcaatcaccctcgctccagatcaatttgacagtcttttgaacagacggcaatacaggaatcctgtctcctgtcgttgccgccacttaatccgtgtcagagaaaatgacaagctcggtagcaagcgattaccctcaaccaatatcgtcccctcccccggtctatcttcgatcatctcccccgctttcgccgtctcagagtcaatcaacccccagatcgataccccaacagcgcgccacacaacacattgcacggaaggctttgcctggctctcaatctga

SEQ ID NO: 2165 - DNA, 1122 bp, A.fumigatus
  unsure (1110),(1113): Identity of nucleotide sequences at the above locations are unknown.
agacgacgggcaaagattgaggcgctgcagaaccgtcgtctggagggacccgtcatatcttactggagcggcatcgctacatgggtcaatggccgtttgacgcgtgtgggcaaggttgacattacacccaaaccagagaaggaggagactacgcgcaagaagagcaagaagacggagaaggaagagaagagtactgcagagaagcctgctcaaaatgctcttgcagggcctgctacttcgcagaccgcttctctaggatcttctacacctcaagaaacacctgctcaagaagattctgcgaaggcccctcagaaaacagaggagacaaagtccgttgctcaggagcaagacacagacaaagccactacggcatctgagcctacacaggctacctccgccccagaaaattcaacaatcccagagggctctgcagcttcagcagaatcttcaaatcccgccccaccagttgaatcaacgacaatacccagtgaggcaagcacagagaaggttcctgattcagagctgccaaaaataaaagcggactcgtctaaagaaccagttaaggtcgaaagtaaaactactggtgaggcccaacaggaaaacgagacggctgcagccggctcaaaatcgccgggtgaagaaccgaaggatccgacacagactgcagcgcaagtatcggaagagagacccacgccgaatgccgaccagtcgaagccggaagcgccgctgtccggagtccatccggatggtgcttctagaacaacggatgctgaagcacccacgaacgagaaaccctcgtctgaatctaaagtggctcctcctgctacttctccgccagctacccaaattcctatcgccgagcctacgcagataggccagcaagaggaaccaaaagtgtcggcatcgaccgagcagaagcaagtagcgccggaaatacatgcggatcagcctgacttctcaagtgacggcgcaccacaaccccaaatccctgctccacctccggtggtcgagcaaacgggacgatgtctgacgattctcgagaactttgatgaggagactgcacagagccgcgagtgtcttcaccaagggcccgaaggaccgcgcatgcgntangaaagggca

SEQ ID NO: 2166 - DNA, 426 bp, A.fumigatus
tactattatcgattactccaagaaagaaaccccaccttgatcatgtcgcgtccttttccctatacctatatttcctgtccatgtgcggatacccctgttcctgatcgttccagaaaacgaagatcgcgagagtcccccgccaaaaagccagaacagggagaccgttcaacagctgcggataccgaagaggaggaggagcagacattcgaccctcgagctccgcgttccaacttctctctgtaccccccggaacagctgctgtactgtgaggactgccatcagataaagtgtccgcgatgcatcacagaggagattgtgtgctggtattgtccgaattgtctgttcgagacgccgagcagcatggtccgaagtgagggtaataggtgggtaccattaggttctgtttcgcaagtagttccccgctga

SEQ ID NO: 2167 - DNA, 696 bp, A.fumigatus
cacccccgcggatccttccagcccgtggtgaagacgaaacaaaaatcaatcaaggatcaatccgtcgagatagccgcttcggcaggcatctcaaccgaatccctcgcgtcagtcatttcgttattctcctccactctgtgctgttcttctccctcggactgttgctcgtgctcgcgcgcagcacgctcacgttcctcctcctcctcctgctccaccttctcctcctcttcttcccagttatccgcaacctcagccgcaggcggcgtggagagattcttcttcgcggctcctacgccggaccgaagaacaagcttctctttcctaggaagaccccagctcccgctgtcactgccagcaagggccgcgaacttcgagccggaccacgggctaggactcgcaacgggcgtcgtgcttcgtgtcgagcttacgccgttgctccgacgggacgcggcgacctgggcccagccgctgtcgccggcggtatcggcggactgctgcgctttggcagcttccttgagtgccttggcttcggcggcggcgaggcgttgcgcttcgcgctctttaagacgttggcgttcgcggagcttgacgcattcgccgacactcttgccgccgatgcctatcgagttctcgggaccgaccccgaggagtggtggggtccaggtggtgggcttcaggacgaagacgtggcggtga

SEQ ID NO: 2168 - DNA, 900 bp, A.fumigatus
agaccgaccaccacagctgcttcgaatctctctcccagcacccttccttattcaacagagaccctggacttgtatgtccagctttcttccacttcccccctctccacgctacagacgtacgaatcgaccctccattccctagcaatcagcaccactcagcgatccgtacgcttccagcccgccaaatccccactccgtgcattcatccactctctcgccgccgactggggcttcgccagcgagagcttcgacccagaacctcaccgccacgtcttcgtcctgaagcccaccacctggaccccaccactcctcggggtcggtcccgagaactcgataggcatcggcggcaagagtgtcggcgaatgcgtcaagctccgcgaacgccaacgtcttaaagagcgcgaagcgcaacgcctcgccgccgccgaagccaaggcactcaaggaagctgccaaagcgcagcagtccgccgataccgccggcgacagcggctgggcccaggtcgccgcgtcccgtcggagcaacggcgtaagctcgacacgaagcacgacgcccgttgcgagtcctagcccgtggtccggctcgaagttcgcggcccttgctggcagtgacagcgggagctggggtcttcctaggaaagagaagcttgttcttcggtccggcgtaggagccgcgaagaagaatctctccacgccgcctgcggctgaggttgcggataactgggaagaagaggaggagaaggtggagcaggaggaggaggaggaacgtgagcgtgctgcgcgcgagcacgagcaacagtccgagggagaagaacagcacagagtggaggagaataacgaaatgactgacgcgagggattcggttgagatgcctgccgaagcggctatctcgacggattga

SEQ ID NO: 2169 - DNA, 1086 bp, A.fumigatus
aaatatccctttccccagattttttccgggtccatgggccccggccaattgcgcatgaattggaattttggaaaaagttccaaaaatagggccgtttttctgaagcggtttttccatgcaagtagctttccttcgttgtgtcgccatatggtgaaaaaggttcctcccaagttcaccacctgctggttcataggggcttccgaagtcgaagttccatcgcaaatgacccgttcgaattcctccttctccttgattggacttgatgcttccatcgcaaatgcttcccgtcggattctgatggctgaagtaccaaccttggccatcgagtatgtgttcgttcacaacaacacttccgttatacaggacgaagttctcgcttcgcgattgggtctgatcccgttgaaaggctcagtagagggtctcaactggatgcgctggtttaagaagcccacagaggacgatccggaatctggcagtacccctgcggactacaacaccatcgttttacgcttggatgttgagtgtaccgagaaccccaatgctgccccgggcgaggatgaccctcgcaaactttacaagaacgcgcatgtgtatgccaaggatatcaccttccaccccgtcggacgtcaggaacaattcttcactggcgacggtgcagttcagcccgtcaatccagatattctgatcgccaagctacgtccaggacagaagatcgatatggagttgcactgcatcaaaggcatcggagctgatcatgccaaattctcgcccgtggctaccgcaacataccgcctcatgccagacatcaagattctccgccctatcatcggtgaagacgccaagaaattcgccaaatgcttccccaagggagttattgagctggagcccgttacgtcgagggaagctgcgcagaaaggaagcgaatatgagggtcgtgcaggcgagatgaaggccgtcgttcgtgaccctttcaaggataccgtcagcagagagtgcctgcgacacgaagaattccaaggcaaggtgaagctgggccgcattcgcgatcatttcatgttcaacgttgagagcactgtttcagtttga

SEQ ID NO: 2170 - DNA, 423 bp, A.fumigatus
  unsure (2),(127): Identity of nucleotide sequences at the above locations are unknown.
antacaatcccatggaccacaacccggggattctggccggttgattttgcctcggggattgtggatggcaagacgattgcgcggtcgggcaacaaggctattgctgatacggggacgccgctagcgntggttgatgatgagacgtgtcaggcaatttatgatgctattcctggggcgcattacgacgacgagagtcaggggtatattttcccgtccaccacgacagcggacaaacttcctgtcgtctcgcttgctgtgggagacaaacaattcgtcgtgcaaagggaggatctgggcttcgccgaggccaagtcggggtatgtctatggaggcatccaaagcagaggcagcatggccatggatatccttgggagcacattcctcaagggaatctacccagtgcgtctttctgatcattgttga

SEQ ID NO: 2171 - DNA, 612 bp, A.fumigatus
  unsure (507),(573): Identity of nucleotide sequences at the above locations are unknown.
aagtctgaaacattctgcttctgtctcagtagactccaaccgacagatataaatctcggaacagtaccatggagtgcatcttcttatcatcatcaaccacctctcctcaacatctcttctttctcactccttgcaaactactgctataaatcccttgctacaattgttacgagatctacaatggctcgtcaataccctgcccttttgcaccaaagaatgctaactcatatccagcatctcccgcttgagctgcgcgagaaactcgcactcctccccgagtctccctcgcgtgaagagatctatgtcctgtggacgcacctcctacagaggtatttccccttccgtctccatggctccctccccaacctggtcgatcttcctgacgagaccgcggtgaagtacgctctaggctatcaccaggaatccgagagctcacatatcgccctcgccgtcggccgtgattacggtccgttcgaccggctcagtttccttcacgtctcctgccangcggagaagaaagagaaatggcacctggaagagatgcaggacaagtggaaggacgagatgatgaanttctctcattgtgaaaatgcaccgggggcgcgggaatga

SEQ ID NO: 2172 - DNA, 663 bp, A.fumigatus
  unsure (94): Identity of nucleotide sequences at the above locations are unknown.
ggcatcttcttcctgttggaaaaaggagtggacgcctggcatacattcgcaatcccccgcctgggaatcccctcaatccgcacaccgacgggcnccaacggcgcccgcggcacacgctacttaacgggcgttccctctgcctgtctcccctgcgggaccgcactcggcgcaaccttcgacagggacctgattttctccctgggccagctcctcgctgccgagtgcagagccaaaggcgcacacgtcctcctcggcccgaccatcaatatccagcggggtcccctgggcgggcgcgggttcgagtcgttctccgaggacccggtcctctcggggctcgcggcggcgagctattgctctggtgtccaggatggcggggttgtgccgacgctgaagcatctggtgtgcaatgaccaggagcatgagcgtgtggcggtcagtgcgctggtgacgccgcgtgcactgcgggagatttacctgctgccgttccagcttgcgatccagggcgcgaggccgggggctgtgatgacttcgtataacaaggttaacgggctgcatgcgagcgagaatccgggattgatacgggatattctgcgcggggagtgggggtatgagggggctgtgatcagtgactggtttgttcgcctgtttaccatgatgctttga

SEQ ID NO: 2173 - DNA, 348 bp, A.fumigatus
  unsure (342): Identity of nucleotide sequences at the above locations are unknown.
caaaagccgcaaatgttgactacaatcattttatacggacgaccgacccggcgcacaaggaagctgttcaatacttctgggttcgttggaaatgctgctagctatttggcccgcatgctgacaatgggaaaggaaatgctgaaccaccggggctatatttacactgcaaagcacgagggatgtattctgtccagcgacgaaacgttctatcctcctacacaagtgcagaactccttagaaccctctactggaaggaagaatatggtatttggtcctagaaaccgaatgttatcaggtggtacaatcgctcactatgctaggtttcagttgaaaagggaaaanaagtaa

SEQ ID NO: 2174 - DNA, 402 bp, A.fumigatus
caaggtaatcagggcttgattggttcgctgcggtttagcctatggatcccagtgagccagtattcttacatggagctatcgacggctgcctttgaacacgtgcacggtctcagtctcgatttccacttgggaaagaagaccggtgaggtgctgtctgccctgagcaaaggcagctctatcaataccttcctggaacaggttacgtttcaggttgtgccaatgctggtagatctctgtgtcgccatcggatacttgcttatcgcccttgacgcttattatgcactcgttgttactatcgtcaccttttgctacctttatgttactgtacgcatggcccagtggagagcagagatcagacggcagatggtcaacgcgtcgaggcaagaggatgccgtgaagtaa

SEQ ID NO: 2175 - DNA, 918 bp, A.fumigatus
  unsure (858): Identity of nucleotide sequences at the above locations are unknown.
aggttgacatggtggatcaggaacgattctatggtctcatatgagactgtcaagtacttcaacgcagaggagtacgaatttaacagatatcgaggcgccgtttcggactatcaaaaagccgaataccatgttctcttctctttgaccctgatgaatacctcccaaaataccgttttcatgctgggtttactgatcgcatgtttcattgccgcctatcaagtctctctcggccagcgtgatgtcggccaatttgtctcccttctcacgtacatggcacagcttcaaggaccactcaattttttcggcaccttttaccgttcgatccagtcggccttgataaactcggaacgaatgctagaattattcagggagcagcccactgtggttgataagcctggcgcaatgcctctggccgtatgcaaaggtgacatcaagttcgaggacgttgagttcgcgtacgatacccgcaagcctgctctaaatggccttacgttccattgcgaaccgggcacgagcacagcacttgttggcgagtcaggcggtggcaagtcaaccgtttttcgtctcctgttccgattctacaatgcgaggaatggacacatccggatcgacggacacgacgtggaggacattacgattgactcgctccgaagacacatcggcgttgtgccgcaagacacggttcttttcaacgaaacgttgatgtacaacctgaaatatgccaaccagaacgctacggatgaagaagtttacgaagcttgccgtgctgccagcattcatgataaaatcatgtccttccctgatggctacaacaccaaggtgggcgagcgtggtctccgactcagtggaagagagaancaacgggtggcgattgctcgaaacatcttaaaagacccccggaatcatcctcttggatga

SEQ ID NO: 2176 - DNA, 450 bp, A.fumigatus
  unsure (318): Identity of nucleotide sequences at the above locations are unknown.
acaagggcagttaattatctgacgatgttgctaatctggtctacgtctacagctgcacaactggccgagtacgaaaaagaagtgcgccgtctccgatcgcaaaccaacacacacacaccccggacgggctccgcatcgtccacattatccactccgtcgaatgagagcgagcattcgcgatcctcgccgccgcaggcccagcaacaaagtcgcctatcgacgctgacgtcgcttcttccttaccgtcgtccgagcaccgcatctccgacccagaccatggcccagccagcacaaccggtcccttctcctgatcaggtnacaacagagcttcagactgcgctcgagcgagaacagagcttacgcaaggcggcggagaagcagctcacccatgccagttcggaactggaggaactaacaccgcaactgttcagtccagcgaacgagatggtc

SEQ ID NO: 2177 - DNA, 246 bp, A.fumigatus
  unsure (123),(150),(151),(152),(153),(154),(156),(157),(160),(161),(162),(163),(164),(165),(238): Identity of nucleotide sequences at the above locations are unknown.
gaaatccatattattgtaaactacggaattagtccgtcgttagtatcaggagtggatgtatcagaaacccccttctgtgctgaaaagcttaaagctcctgcttttttctttgtttgggggaanaagacgattatccggggagagtttgannnnntnnttnnnnnnagggaggttaaaggtcattgcttccgggaccgtgtaccaaagaacctcccccgaagatattggaattttgacnaaatttga

SEQ ID NO: 2178 - DNA, 201 bp, A.fumigatus
  unsure (24),(97),(98),(99),(100),(101),(102),(105),(106),(108),(109),(110),(111),(112),(139): Identity of nucleotide sequences at the above locations are unknown.
aaaggtgtgctcaactcaaatttngtcaaaattccaatatcttcgggggaggttctttggtacacggtcccggaagcaatgacctttaacctccctnnnnnnaannannnnntcaaactctccccggataatcgtcttnttcccccaaacaaagaaaaaagcaggagctttaagcttttcagcacagaagggggtttctga

SEQ ID NO: 2179 - DNA, 303 bp, A.fumigatus
ttcgcagagtcaattgcgatcattgctgtttacaacttgactgttgtcgatcacgggataactgccctcagaccgacttcctcgaatgtcgaagacacgagcttgaaagaagaagaaaaaaaaaatccccgttctcgaggttacgttattagcatcctctcagttccaggccctacgcaggtctcccctggcattgttgacggttctccatactatgcgtttggtggcttcgactatgttgagtttctccctacaaatggagtgtcccactacagcgtttttaacaaagccgagaagaccgac

SEQ ID NO: 2180 - DNA, 333 bp, A.fumigatus
accaacaagggcgatgcggcgggaatcagacgaccggaagcgcagagaacgggaactgccgcgaaccctaccatgtacccaaccagccccatgacgatggacaagccattgaaagcaatactccactgcagaggtcggggaatgccgtggtttgaggagaacaacacggatggctgttgggagtggccaatctgccatcggtttcgctgtgcgatatgtccctccagcgacgacggtaccaaccccaactgcaacggttccagcacctgcatcgtgcgataccctaaggccctgcaacattccaacgagagctgcccaattcttcccgaataa

SEQ ID NO: 2181 - DNA, 843 bp, A.fumigatus
  unsure (19),(252): Identity of nucleotide sequences at the above locations are unknown.
gattgggcccggaccaagngatattccgggggccagcccagcatggtgggcccgtgggagtccagagaaagattccctgatctggcgcgggcatcgcatcgggcggttgcaacccgagccaccaactggacgggggtcccagcgccatcgcctattagccatgttgaacggaccttcgtttcgcggccgccgaacggaaccattccccaatttggtgaatttccggctccccagttaaggaggagtaccacntggccgcgggccaacaccgggccgcttcccggagttggttggaggaccatgcggacgctggcttcatccacttcgtgtgcttcccctgcgtcccgggacagccctgggggtacgatcgcaccgacccgcaatggggcctacacggaaccatacttcgccttgttccccgccatgcccatggaccagcagtacgacggctacaaatacctgccggacatcgacggcaactcctttagcggccggtaccgcggcttcttattgtcgacgtctctgcccatcaaagccaccatctacgacgaatggcatgactcccgtctcatcccctgggcccatttcgtgcccatggactcgacgttccccgacgtatacggcctcatggagtactttatcgggtacggcgggcggggccatgacgaggccgcgcgcacgattgccctggacggcaaggcgtgggcggagaaggtgcttcgccgggaagacatgcagatctacatgtatcggttgttgctggagtatgcccggatctgtgatgatcgccgggatactctggggtataccgcggatatcttacgagtcgggcaacggacatga

SEQ ID NO: 2182 - DNA, 609 bp, A.fumigatus
  unsure (14): Identity of nucleotide sequences at the above locations are unknown.
ggaggagtaccacntggccgcgggccaacaccgggccgcttcccggagttggttggaggaccatgcggacgctggcttcatccacttcgtgtgcttcccctgcgtcccgggacagccctgggggtacgatcgcaccgacccgcaatggggcctacacggaaccatacttcgccttgttccccgccatgcccatggaccagcagtacgacggctacaaatacctgccggacatcgacggcaactcctttagcggccggtaccgcggcttcttattgtcgacgtctctgcccatcaaagccaccatctacgacgaatggcatgactcccgtctcatcccctgggcccatttcgtgcccatggactcgacgttccccgacgtatacggcctcatggagtactttatcgggtacggcgggcggggccatgacgaggccgcgcgcacgattgccctggacggcaaggcgtgggcggagaaggtgcttcgccgggaagacatgcagatctacatgtatcggttgttgctggagtatgcccggatctgtgatgatcgccgggatactctggggtataccgcggatatcttacgagtcgggcaacggacatgaatag

SEQ ID NO: 2183 - DNA, 1317 bp, A.fumigatus
aggcttggagggaaacacaacgttcgagaattggggagggccttcggcgccgtttggggctgcaatatcctctgtgaagaacccgcggggccatgtcggttgggggatggcctggctgtttataaagcactgtcgccaggccctcgcgccagcggggcaaaaggcatggcatcatcgtcctccccttcgtcgtccggcggggccaagatattctccatcggccacgtcctccggtacagcccgcataacatcatcgtccgcaagctcctcctcctcgaccgcgtcatcggcgacatcgtctccctggagcacaccgagccggtaggctggtggcatttcgcacacagctacgtccggggtaactggcggcgcgcgacggcccttggcgacggctatctgcttaccaagtcctgccatgatatcgacttcatcatgtggttactctcatccccgccggagtatgtgcaggggaagggggagggaagcacgcagccgcagccgcagccgcaccaccaccaccacccgcgcagcatcacctccaccggtacgctgactcaattccggcgcgcccgcaaaccacctgccgccggcccagcaacaaactgtctctcctgcccggccgagcgggaatgcatctacagtgctgtgcgcatctaccgcgacctgcacctgtcccgcggcgacaccgggtggcccgtgaagatcgtggtgccggatatcgaggatgtgttgcgctcggccgccggggacagcgaggccgcaacggcggaagccgaggcgcatctcctggcccgcctgcgcgaggactactcccgcggggcgatgagcgacgaggaaatcgctcggcggccatggtacggccggtgtgtctacgaggcggacaataacgtctgcgacgatcaggtcgtgacgattacgtgggatgatgaggatgaggacgaggacgaggacaaggacgaggccaacccgcacgcggcgaggcgacgcgccaaaaccgccgtcttccatatgatttctccaaccgagaaacagtgcgagcgccgcgggagggtctacgggacgcgcggcgagatcacctacgacagccggaccatctccatctatgatttcgcgacccgctcaacgaccaccatcgaggtgcccaagcagccgccggaggaggaggaggcgcacggcggaggcgactacgggctggcgcgcagctttgtgcgtgctgtcgatgccgtcgagaacgagggctgggatgtgctgcgcgcccaagctcatttggtggtcttcaccacatggctacaagggccggcgcttagcgtgaatgag

SEQ ID NO: 2184 - DNA, 699 bp, A.fumigatus
cacttaccaggctttgcatgcggttgttggagattaggaacgctcagaaggacaactgccagaatggcacacaacggcatttctcggagtcagcggcttaccaggctgatgaagcagaagcatcgaactcgtcacgagggagtcgaaccagccagccgaccagggaaaaagcccgcaggctcgttgatctccagcatgaaaaagccgcacgtcctggaccacaataagcatcatgggtcgccaggggaggtatcgcacgacgactcggcctattcgctaggaaagcgtcaggattcctctgccattcctccaggatcccagacggaggcgctggccaccgcggtaaccagtgttgacgaagcacctgcagacaccggtgccgctcttccaacggtcatatcggatcctgcttccagtcaacctgccgtctctgttcctgtcgagaccctccctgcggccgtgccgtcgaccacttcgttaaatgagattcccgtcccgtcgcctgacccgacttctttcacaacggacctttcagctactaccaccgctgacgatttgacgagcatacccaccacctctgtctttttgtcattagacttatcggtttcactgtccgtttcggttccaacgtctatcgctatcattaactccgcgagtagcacccagtcgtccgctttaatacctagtgctcaatcctca

SEQ ID NO: 2185 - DNA, 219 bp, A.fumigatus
tggttgacaactgacagcggacgcctcgagctcagggacacagacaagaatgtattatcgcagcttaatggcaagaaagcttcgggatacggaacttttgatggggccactgtacagacgacatcctatctacctaactgcgtaaacttctgtctagtgttcacagggagacaggatctgtcatccaaccaagggatagatcgaagctttgccctgtga

SEQ ID NO: 2186 - DNA, 342 bp, A.fumigatus
  unsure (32),(157),(165),(181): Identity of nucleotide sequences at the above locations are unknown.
acggcggaaaacccatcgtttccccaaagggngtctatcgtcatggaatacgtacatttagtagaacacacgatatatggaagtacctggaactggaaccactggttgcaatgttcattaatgccttggtttagattctcatacactttagcggacnggttctcnatctactcttcttctnttccaaccatcgttcatgcgcccaaggatagcgtgcaactctctgaaattactctcattattgacagagttcgactattccgcccgtacattgaaattggcgaaagggcaaatttctccctgcattcgagtgaggcccactactgtgtcaggaacatatga

SEQ ID NO: 2187 - DNA, 684 bp, A.fumigatus
ggtgcgcggcccttccagccccgtggtgaagacttaatacatagcccatctcagtccttggaaggccggttcgcattgatatccttcagaatctcccctgcaccagcctcgagcagtcttcccgcaagttcctctccgagcgcgtctgcttcgtcgatcgcctcgactctcgcagtaatgcgatcctcgacgcttcgggtgccatccagactcacaacgatcgcatccatcctcaagtcccccgacgacatccactccgtctcaaccccaataggaacactgcacccaccctcaagggtcctcatcagagacctctcagcaaggcaagccagtgtggatttccgatccgccagttggcccagcaattcctgcattttccggtctcccttgcggatctccaagcccagagcgccctgcccaacggcatacaggatgcccccgtccctcgagcccaggtactggctgatgcgatgcttgaggccgacccgctcaaggcccgcggcagacatgaccatgcacatgtactcgctgtgcgggtcgtctaccttcgcgagacgcgtctcgacattgccgcggaggttagcgaagcggagatgcgggtacagacggcggagctgggctgagcgccgcacagatgatgtcccgacgacggcgccctcaaggaggctcttcaagcttgtgtag

SEQ ID NO: 2188 - DNA, 531 bp, A.fumigatus
  unsure (444),(522): Identity of nucleotide sequences at the above locations are unknown.
tttagcgtcagttgtggtctgtttttcaatctgtcttttgtgggtatgtcgttggatgataaatacatccccattttctatggtctctgtaggaatccctcccctctcaactttcagcccccctcatcatccgataatatggtggaaacatctccaacgccccagctgccgctacggatcggtacccgacggtccaacctggccatggtccagacggaaggcatccgggaccgcctacagaagattggcccggatcgaacctacgagatcgaagccctccgcacagcgggcgatcgagaccaactaacagcgctgtacgacttcggcgccaagagtctctggaagaccgagctggaagaaaagctcacctccggtgaactggatgtcattgtgcatgttctgaaaggtaatactcgaattccgtcccgttcatcttttgatganttgcagtgccgagtttgcacacgacacagatatgccgaccacgctccccgacacttgcgagttggcagctatcccgcnccgcgatga

SEQ ID NO: 2189 - DNA, 798 bp, A.fumigatus
  unsure (41),(119): Identity of nucleotide sequences at the above locations are unknown.
aaggtaatactcgaattccgtcccgttcatcttttgatganttgcagtgccgagtttgcacacgacacagatatgccgaccacgctccccgacacttgcgagttggcagctatcccgcnccgcgatgatccgcgggacgcactgatcatcaaggccgggctgccctacacaagcttgaagagcctccttgagggcgccgtcgtcgggacatcatctgtgcggcgctcagcccagctccgccgtctgtacccgcatctccgcttcgctaacctccgcggcaatgtcgagacgcgtctcgcgaaggtagacgacccgcacagcgagtacatgtgcatggtcatgtctgccgcgggccttgagcgggtcggcctcaagcatcgcatcagccagtacctgggctcgagggacgggggcatcctgtatgccgttgggcagggcgctctgggcttggagatccgcaagggagaccggaaaatgcaggaattgctgggccaactggcggatcggaaatccacactggcttgccttgctgagaggtctctgatgaggacccttgagggtgggtgcagtgttcctattggggttgagacggagtggatgtcgtcgggggacttgaggatggatgcgatcgttgtgagtctggatggcacccgaagcgtcgaggatcgcattactgcgagagtcgaggcgatcgacgaagcagacgcgctcggagaggaacttgcgggaagactgctcgaggctggtgcaggggagattctgaaggatatcaatgcgaaccggccttccaaggactga

SEQ ID NO: 2190 - DNA, 735 bp, A.fumigatus
  unsure (14): Identity of nucleotide sequences at the above locations are unknown.
gaacaatcaaatcnttctttcccccgaaaactacctcccgacatcttatctcttcctgggcttagataccccgccatggcaaccccgcaggaactcgtgcctcaaacagaatccatagctgaggtctacgctacggacgacgcctctggtacttctgctgcccctgagcaccagtcacggttcaatggattagttgctcatttcaacaaattatacggccatcgtccagatttcgtggcccgcagtcctggccgtgtcaacatcattggagagcatatcgactacaacctatatgacgtcctcccaacagctgtaagtgttgacgtaataatcgccgtcaaggttgttcctcctactggctcagaaccgtttgtcaaaatctccaatgtttcgcccgagaagttcccctctcgtgaattcactgtgcctcgggataccgatatcgagattgaccccaagaagcacgagtgggtcaactacttcaaggctggtcttctgggcgcgttgaagtttctgcgcaagcagaaggccgacggctcgtttacaccagcaagctttgaggtcttggtggatggtaatgttcccccaggcggtggtatctccagcagcgccgcctttgtctgcgcaagtgcattggccgtcatgaaggccaacggccacaatgtttcgaagcaggacctgctcgacctggctgttgtttcggagagagccgttggtgtctactcaggagggtaa

SEQ ID NO: 2191 - DNA, 432 bp, A.fumigatus
gttgatcactgcagcggcatatggtattgtgcgctgaccagtttatgctgtatgatggaccaagcagcgtccatcttctctcgtcgcggatatctcctctatacccagttctaccccaactttgcctttcagcatgtcccaattccccaaggcccgatgaaggacatcactttcctcatggcccagagcttcgtcacgtcaaacaaggctgaaacggcaccccgtcactacaacctgcgttgtcccgaatgcactctcgccgttgtggtcctcgtcgcgcaacacggtatcaccttgaccaaagacaacaactccctgggatacagtctgcgcaactttcacgaggaacttatgcgccaggaggcccggcttcggggacccactggaataccggaaccactccgggattcagtccaccatgggaactcttga

SEQ ID NO: 2192 - DNA, 543 bp, A.fumigatus
actgaatcgcaaagctccccgagtagtaatccgcctgccgtccacagccgatcgcatcccatcgccccgtgcgcatcccctcctccctctccctttcctccccctcggcagataaccacgggccatcccccgaccacccacccccgagataaaacccatccagcaccgcaaaatccgcatccatttctggtcggacctcctcgtatgggacgttcgccaccagcacaagcgccaggttcgcaaacacgcggaaccaccgccaattgttcaccggcatgtccttgccgtgcaggccgcgcagccacgcaacgatgtggttctgcatggcctcgtcctggcggcgaaagaaggcgtccggcgcgaacaggagcgcgcaagcgagcacctctgcttcgaccatgcgctggtcgccgtgggcgatggcgccccatatttccgggatggccggggtctgtgccggcccggatgccctcgatccacggctgggggacaatggtgatggccgtccatggggccggggccgaggtaaatggcaaggcatga

SEQ ID NO: 2193 - DNA, 861 bp, A.fumigatus
agaagggcgccgccttcctcaagggatttggcccgtccatttgggtcatcgggaccctccttcatgccttgccatttacctcggccccggccccatggacggccatcaccattgtcccccagccgtggatcgagggcatccgggccggcacagaccccggccatcccggaaatatggggcgccatcgcccacggcgaccagcgcatggtcgaagcagaggtgctcgcttgcgcgctcctgttcgcgccggacgccttctttcgccgccaggacgaggccatgcagaaccacatcgttgcgtggctgcgcggcctgcacggcaaggacatgccggtgaacaattggcggtggttccgcgtgtttgcgaacctggcgcttgtgctggtggcgaacgtcccatacgaggaggtccgaccagaaatggatgcggattttgcggtgctggatgggttttatctcgggggtgggtggtcgggggatggcccgtggttatctgccgagggggaggaaagggagagggaggaggggatgcgcacggggcgatgggatgcgatcggctgtggacggcaggcggattactactcggggagctttgcgattcagtttagccagttgctttatgtcaagtttgcgagccatttggacccggagcgagcggagaggtatcgcgcccaggcgagggagtttggggccagtttctggcggtattttgacaagaacggtacgcctggtgatctcgggacaggtgcgacgagttcagctgacgggagtaggaggcgccatcccctttggacgctccctgacgtatcgcttcgcgtgtggagcgttcttcgctgcgctggctgtcgccgacatccctga

SEQ ID NO: 2194 - DNA, 669 bp, A.fumigatus
acaattggcggtggttccgcgtgtttgcgaacctggcgcttgtgctggtggcgaacgtcccatacgaggaggtccgaccagaaatggatgcggattttgcggtgctggatgggttttatctcgggggtgggtggtcgggggatggcccgtggttatctgccgagggggaggaaagggagagggaggaggggatgcgcacggggcgatgggatgcgatcggctgtggacggcaggcggattactactcggggagctttgcgattcagtttagccagttgctttatgtcaagtttgcgagccatttggacccggagcgagcggagaggtatcgcgcccaggcgagggagtttggggccagtttctggcggtattttgacaagaacggtacgcctggtgatctcgggacaggtgcgacgagttcagctgacgggagtaggaggcgccatcccctttggacgctccctgacgtatcgcttcgcgtgtggagcgttcttcgctgcgctggctgtcgccgacatccctgacatgccggacccgctagcgtcgatgggcgccgtcaaaggcttccttctgagacatctacgctggtgggcagctcactcgaccgatgtgttttatgccgatggtcttcaccacggggctggaaggatccgcgggtggtgtcaaata

SEQ ID NO: 2195 - DNA, 471 bp, A.fumigatus
gaagaccatacatcatcggacagtatgaccggtcatccagccttgcagcctttggacgctagcggacagcaagagatgagggctatgttctccacaccgaactcgttcttgacaagctcctggacaaggacgccgaacgttgaagacaacgttactctatccctcccgacacctgctagagccgctggaccttcgcatcacgcctcccaactacaaatccccgcccaaagaccccattcttcgatttcttccgctccgaaactcatcaatgacggcagcacaataccagacataccatcaccctttcccgtaaacaccccccagtaccagcagacgtatagcgatccaaatctgcacctcggaccatttatggatattgaaagatacgcatcattacgccgaccgcgaatcgcgccagaccttgatgcattgtttgacgagctggcctcgttggacggtaccgagaagtga

SEQ ID NO: 2196 - DNA, 471 bp, A.fumigatus
aaaaattcccccatggggaaattcaattcctcttatataaggggcccccaattgaaccctcttgggccaccggttagccccattatttatggcaacccaaccattgccgaagttgaaacctcctcaaaagcccacgcgaagtcattaggcgccacttgggccactttcaagtcaaaacccgagggcgcaatcatcgttcgcatccagccgcccgccggcaacgtcgacggcatcatcatcattcccggggcttttacgcatacgtctgtggcgattcgggatgcgctgctcggtgtgggaatcccattcatcgagctgcacgtgagcaatgtgcatgcgcgcgagccctggaggcaccatagctatttcagtgataaggcggcggggattatcgttgggttgggagtatatggatacaaggttgctgtggaacatgtggcgttgaacttcaaggagagggcggctttgtag

SEQ ID NO: 2197 - DNA, 501 bp, A.fumigatus
  unsure (195),(312): Identity of nucleotide sequences at the above locations are unknown.
ctgccatctctccctagtgactgcattgtgctgatgccgctttttcagtcttggacccgtcctccatcgcgacggatttacctcaccctcgtctccccggtcattgggcttcttctggtttaccttttcttcgcctttgacacggacgccttcactcccaaggtcgtcgtcaccccgatctcacttacacaaaanacagctacctgccccccacttcgaggcattgaggatgtgctggttatctttgaaactggcgtcacagaagcactagagaaagtgccggttcactttcaaacaaccctgcgatgcatncccgattacgtactattctcggactttgaggaggaaatcaacggaacccgcgtgaacgatggtcttggcaccgtcaacgagactattaaacgtacccgcgcagactttgacctctacaaccgcattcatgaacatggacgccagggacttacgccggccgacctgagccggtccccaacctgcatttgg

SEQ ID NO: 2198 - DNA, 621 bp, A.fumigatus
aggaacgttctagcgtggagctttctggttggggcccgtatcagcttcgtgttccacgaactgtactcgaacggtatcaaggccgtggatccattcgaccaggtgaaggatattgacattcgaacaatcctttacaactcttctggctcgtctcctgcgcttttcgtcggaacgactgccttcgagttgattgtcaagcagcagatcaagagattggaggaccccagtttgaagtgcatctcgctggtgtacgacgaacttgtgcgcattctaggtcagcttctcaacaagcagctcttccggagataccccatgctcaaggagaagttccatgctgttgtcattaactttttcaagaagtgcatggagccgacaaacaagcttgtccacgatttgatctcgatggaggcctgctacatcaacactggacaccccgatttcctcaacgggcatcgtgtaagtgacgtttggtcccaatttcttttgtcaacgatcctgacagaatgcaggctatggcaattgtcaatgaacgccagcaagcgagcaagcctacacaggtggacccgaagacgggcaaacctctgcctcctcgtgcaaacagcccgtcggtcgatgccgtag

SEQ ID NO: 2199 - DNA, 309 bp, A.fumigatus
cgtttggtcccaatttcttttgtcaacgatcctgacagaatgcaggctatggcaattgtcaatgaacgccagcaagcgagcaagcctacacaggtggacccgaagacgggcaaacctctgcctcctcgtgcaaacagcccgtcggtcgatgccgtagccgccacagagaacagtggttctggattctttggcagtttctgggcatctaagaacaagaagaagatggctgccatggagcctcccccacccactctcaagggatcggccgtcttcacctacgggagctgccaggacccgcgcttaatgtaa

SEQ ID NO: 2200 - DNA, 702 bp, A.fumigatus
tcctcttttctgcaatccttctctctgtcgatcttcttccctgtgctgttctttctgacatctccacaacaaaaagagaccatcacaatgcgtgcctcgttcctcctccctgtcgccatctatgttctgacagcctatgccgacgacaagaccactacggtcggctacttcattccctcctggtccgtcaccctgttaagctacggcgtttggactagcactggcgccagcgttgcaggaatcaacgccgccgcaacaacctaccacctgggctgtctgaaagatgcgcccaagaccgactgcaacatcaagaactcctggacgatcatccaaggcccagagacagtcagtgccacaggcgtgtacaccgcctcgacgtcaggcaaggaaaccagctacgacatcaccgtcacggagtcctacgagtgcaagattcggtcccgcacggagtccgccagttgcacgatgagtgttggcatgacggggtcggtgggtggtgccgctatcacgtcgtcaacatcgactagcgcgacgtattcgcccgcgacgagctcctactacgagttggttgtcacggcgggagtggacaagttcactgtccccgaggcgacgaagacgcctggggttgctgctgccgggccggcgggggcgttgatcacggctggtcctgttgtcgcggctgcggttgctgctcttctttga

SEQ ID NO: 2201 - DNA, 1458 bp, A.fumigatus
aaatcgggaggacggcacagccaatcgacaacggaccatagtctcgattttcactcgcgtgataagattctgggcattgttctcagccagatgaaacagcctatcccggcggttctgtcatcctttccctcggcccagcttctcgacagcctgatcagatattacctaacggccccattctccaccgcaaacacgtggatccatcgggccacttttcgccctcgacaggtgtgtccagagctgcttctcgccatggcagcatctggggccgtcttgacgccggatccctcgctacgcaaacttggattcgccatgcaggaggtcgtacggttgcagctgccttcggtgttcgagaggaacaacactaccatccgtgatcttcacctgcatcaagcatacttgctatacctagagattgggttgtggagtggcaatagccggaaaatcgaaatctcagaggccttccgccaaccgctgttgaccatggttcgccgcggcggcaattttcaccattcagcctatccgccactgccggcgcggttagaagaatctggtcggagcttggaagatacatggcgtgcctgggtgtacaaagaggcatacaagcggctggtgtaccgcttgtttcgactggaagcgcaagtctccatggctctcttcaccagccctttggttacgtacgtcgaaatgggccctcctctacctgcccctgcgtatctgtgggaagcgagttccgcgtctcaatggaaggacgcctatcattcatctcctctgccctccaccggtcgaattcgcacgctcaacgagtgcgtggcgaatttagatcttctggaaaccagtcgtcgtgttgcggacatccgtctcgcttgcggcgccgtcatgcactgtatatggggcctcgtatgggagttccgccagctgagttctcttctcaacggacacagccgctactgggataatgatctgctcatggtcgctcggcatggacagctgagcaggatcctcgaatgtttccgaattggatatcgcgacgaagtcccagtgcagctgcactttgtcatgatgcacatgtacgtgtcactggaggaggtggagacattggctacctcggacgatgccggtcgcgcctgggagcaacctgctctgagtgactggttcaagagcgaacattgccgacacgccatatggcatgcgggccaggtcgttcgaggtatcaaatgtcttccgttgcaaggtctacgagatttcatggcgattgcgctataccatgccagtctcactttgtgggcctacggagtggtattcttccataacatggataaccaaagtcagcagctggctggtccaacactgcagcagaaggtctggctggatggactagagtgtgaggatatacagcgtttcatcactctgcatcgcggaataccagtcctgcagggccttggtcatgcagaagag

SEQ ID NO: 2202 - DNA, 648 bp, A.fumigatus
tggtccatagcgttggagttggccaaggaatatcagatgtacgattgggttcgcgctctgctggatcccacggagatccctcaaacgccaaagaagcagatcacacctcctccaaagtttgaactcccgcccattgaagctccgacccagctctctgccccatcgcagcgtacgagaaggggccggtctgcttcgccgagcaagagagccaccctctcccctcgcaaaccgaggaagactcgcgcagccaaggaggcgagtgtggaggaggccagtgcagctagcgctagtcttcagaacgctttggacatgaccgcgtctaacgctgatgctggatcagccaatggaactgtcgagtctagtgtggaggaacatgttgaagagaaagtagtcaccgtcacaggagacacgaccaagccggcttccaggaagaaggtcgccgccattcctgaagagaatgaggtcgaagaagaaaaagttaaggttgacgtcaagacgactgccgacaccgtggatgacgttcgaaccacccagacgacgatctcggtcgagatgcctgttagccttcccgaggcaccttctgcggaggacaccgacaagtgcctcgggtggcatagttgctcaccgcgccgcatgaaggacatatgt

SEQ ID NO: 2203 - DNA, 219 bp, A.fumigatus
ctcgtcagggattttcacaagcttacaacacagctgcgagactcccaagctccgacgcaatccgatatttcgggatctaagaatagccttgactatctattgactatgaagacggagtatgcttctttttatcacgggatcgaacaaatagacccaactgcccctgtctttgctcatattaggctttttcgcaaaaaaaaaatggcttgcagctcgtga

SEQ ID NO: 2204 - DNA, 681 bp, A.fumigatus
agagggctagtcagacagatggtgcggtttctggtaatgccaggaagaaggagaaagagccggcggagcgttagtagagagagatcatttgcgcgtattgcgaccaatgctgactatgagacaacagagtcctgggcgccgcaagcctcgttgattccccattcgaccgcgcctttagctagtcgtgtatccgtacctcctcttgcctctgcactgccgccaccacttcatcccacaccccttcgtgaacttaacaccgacgcgcaggaagcagtgatcttggaagatctactgtttgtgttcatgggattcgaaggccgatatatccattaccatcatacgtttgacccgacagcggagaaagaccgcttggctggtccggcctttcaactgccgtccgggctggacccgacgctgagagacctgacttcttccatgctgaagatggcgacgcattacagtgcattggagtccttcgtggaagtacagagtcgcgctgaatacggggccgtgaaccatgcattgtgcgctacgattcgacggatattaaaggactatctaatcctcgtcgctcaacttgagacacagctgctcaaccactcgaactttacactacatatgctgcttttgcacaccgtgccaacaaggtcttctccacagggcccacggaccgcgcatgag

SEQ ID NO: 2205 - DNA, 279 bp, A.fumigatus
gaggtcgtcaccgaccctagggacctcggtctgacagaatccaagatcagtggcgaccaacagaacggagctgatgtcttgagcccacaagccaaaaatcgcaagttcatggaaattactatggaaactcctctgagcgtcctcaaccgcttctttgaatggaacagcgccgccattgttactgagagggacgagcatggaacgatgaggccccttgcggtcgcgaccaaggtcgatctgctcacctggatgctccaccacaatgagaattcttcttaa

SEQ ID NO: 2206 - DNA, 837 bp, A.fumigatus
attgtggtcttttggggctcccagtctggcactgccgaaggctttgcgcaccggctggcccgcgaagtctcgctgcggttcggtcaggaggctatgacagccgacttgtcagattatgatccagactctgtcagtaggatcccaaactccaaactggcgatcttcattctctcgacctacggtgagggtgatcccagcgacaacaccgccgagttctgggattggatccataagtcccagaacgtgtctctgtccaacctccgctacgctgctttcggcttgggcaacagcaactacaagttctacaaccgcgtcgttgatgtcgtcgtggaagctctggatcggtttggggctaagtcgttgatgcccgtcggcaaggcgaacgatgctgaaggcacaacacaagaggatttcatgagttggaaggagaatttgtttgccacgttcaaacagcagctgggttttcaggaagccgaggtcaagtatatgccgacgctgtccgtccaggaagacgagtcgcttgcgcccatcgaccttcaccatggagaaccggacattcgccgagactcggtcaaatccgctgctcaatgctcgcccgtacgggcagttgacatcagcagctccagggagctcttcgcctcctccgatcgccactgtcttcacatcgaacttgatctcagcagtcaacccgagttcacgtacaagaccggtgatcatctggccgtctgggcgggcaatccagatgccgaagtggacatcctcgtcaacgccctggggcttcctccgtctcgccacgaaatacccatcagcatcacatcgctcgacccagcaactaaa

SEQ ID NO: 2207 - DNA, 672 bp, A.fumigatus
cggacgttgttcgcaatgtctcgtctcaggaagcttgggtacgacctctccccttcctccctcccctcttccttctccggcttcaagcatcgccggaccctgacggttccttgcaagtctttcgtgtcagactgttcgcccatccgttcagctggcgcctcttctttcgccgaggtacgtagaggtacatatctttccactcggtctttccgtgcttctgcaactgcccctgctcctgctcctgcacgttccgcaccttcccttccggctccttctactcgctttgttcgtgcacctgttccagctcgcactgggacaggtgccactctcacccgcagccttccttcgcagagtcgaggagctgctcaacaggacggaccccttgacgtcgtccattccattatggagagagctcgactccgatctcaagcccttcgttcccgctatggtctcccagagagactgcgatttgaccctagaacccaaacccgggtcgaacaatcttccacttctcttgatccgactaccagacccacccgtttcgccgagcgcatccgcattctcgccgaagaagcagccgctagttctgccaaccgccgcgccactctttcgaaattcgctgccttcgatgaagttgtcgcccgtgtcagagcacgaaaacagtcgacgtct

SEQ ID NO: 2208 - DNA, 489 bp, A.fumigatus
attatcggtacaaagtgtgccaatctacgccaacgccgtagtagtaacaagcacgcggcggggaccgtcttctcacggcaaagtgcgcatctcaggttgcaaggactggcgctctccagagccaggaggaatataaataccacatgtcctcctgtattacaacgactatcattccaacagaggcatcaactagccctcgactgtacagagtggtcccgcggcgctatcatgcacatccgctcccttctcactatccccgtcctgctcgggcccctgacccacgcagcggcaatcccagcaggaagctcttccactgagagtatacagtctcgccaggcagcgaatggccctggctactggctagagtccatctcgcaccagggtatcgcacccctgggaccttccggatatagggtgttccgtaacgtcaaggactttggcgcaaaatgtgagtcgcacccgcagtgggcgaccattcgccctatactg

SEQ ID NO: 2209 - DNA, 999 bp, A.fumigatus
ccccgccccccatccctacgacgttcttgccccccgcgtgaagacgccagaggaaaagagagaagttatgtagcatccttggaggggtactgtgagcgacttgaaaaacagattgcaagcctgcggtatcgcaaggaatcttcatcaacggatgaaagagggactgtccgggaaagctctatcacttcggcttcatcttcggattgtgtcgctcaatcacatcgcaaagaggtttccgacattgacgacttagttggggattttggctttttgtccgttcatgttcgatctgccgtcgttgtttcgttgctgaccagctgttctaggtcggtcaatgccacctcacgagatttccacggtattacttcgagcacgtctttcgcaaatcttctactatcattggcaattgccgagccgctgccaaaattatcatcgcagtcattaccctcacgccatgaaataacacctctcttgcgccattatttcgacaacctatacacacagctgcctttcttcgtcgagacaagtttttggacgtctgtagatgctgtatatcagtccggtggtcgtttcgccaagccatttgatcattggattttacgtcttgtcttagccatctcgtctgcttcgacgtcgtatcagcctggcgacagagatcatcaaagggcattatctttgatttccggggcgctgaaatacgccgaagaagttcttcgcccaggatccgtggttggcattcaggggatactgttgcttgcccagtattcctttttcgaccctaaccactttcgtagttggtatcttgtaggaacggccgtccgagcaatggtcgaccttggcttgcatcaagaccctcctttggaagagctgtctactcctgatcgtttagatattcgtcggattgtttatcattgcgtctactgcttggataggtttgtgtctccacttcattctgatacgagctcaattttactgatttggttgagaaaaggggtgtaa

SEQ ID NO: 2210 - DNA, 435 bp, A.fumigatus
tcacctgccccagaatgtccggatctcaagaagtattccagtccatttctgtggccgaaatggcgcaagtccatgatgacatggatctcctgtgcagttacagcattggctggttactcagctggcgaaatcagtccgtcgtcggctgaactgaccaaggaatggggaattagccaggttgtctataacctgggcatcactttgttctgcattggatttgcgttggcgccgatggtattggctccgttttcagaaatcaacgggaggaggccaatcttcattgctagtgggattctctttgtcggtatggttcgcctcatgaatgatagacagtcgttccccaatgctaatctgcgatcaaagcctgcatcattgcctgtgggggcactcactcttttggaggaatgcttgttgcacgattcttccagggcgtag

SEQ ID NO: 2211 - DNA, 465 bp, A.fumigatus
gcggatgtatgtcaatcctctcatagacactcctgtcatcgcagcttactgacagctgcagcgacattctcaaccatggtgggaggtgtgatcagcgatatttaccatgcggaagaccggaatacccccatggcactgttctctggtgctgctcttttcggtactgggctggctccgatgctcgccggcgccgttgtgcaacacactacatggcgatgggtctggtactctcatgctatcgtctcagccgtcttcgttattatcatctatttcttcttcaaagaaacccgaggcagtgtgcttctgagtcggaaggcaaaagcactcaatacatactatgaaaaattggagagtgctgggcattacggagtcatcatgtctgataaggagacggtcaaacgcatccggtggaaggtgaagagcgatgaggagtcttcaccaagggccggacatccgcgcaagcga

SEQ ID NO: 2212 - DNA, 321 bp, A.fumigatus
agaacttcttcagcgtacattctcttctcgctggagcatccctgtgaagagacattcgagcgcttgaaggtcgctctgcccgtcagtatctcaaatagcgtcaagctttggcctgcagtcactgcctttagctttgtgtacgtgtctccgcctttccggagcatcttcgctggtgtcatcgccgtcggctggcagacctatctcagttggttaaaccagaaggctgccagagaggtcgaggcagaaatggccgagtcggaccgttcgtctcatgtgctggtttctggcagtatcagcccttcgacaacgataaaagcatga

SEQ ID NO: 2213 - DNA, 390 bp, A.fumigatus
tatgaatttattaccatcatcacgggcatgtcctgccctccgacatcctatattgtaatgtcagacgatctcgacgattgcagcgactacggatccgactttaccccggatgaagaagagctgctgaacgatctgctcgccaaagtcgccacagaatacgcgaccgcccaggcttctgctaccgcgacggcaacaacaacgacagcctcgaaaaccgtgcaggcgaccgtcacgaccggcgctgatattgaagattatgctgaaagtccagcaagtcaacgagtgcctaaggtactgggtcgtgaaaagcccgattttctatggcagaagcgcatggttcagcaggtcacggatctgtcggtattcgccacaaggctggaaggaccgcgt

SEQ ID NO: 2214 - DNA, 189 bp, A.fumigatus
cttcatcaagttgaattgataggatacattggacgctgcctgtcagcatcccaatcgccaaattggacccttggcccgtacatcatgcagagcacattgttgctggtagcgcctgcgctatttgctgccagtatatacatggagttgggccgaatgtcttcaccacggggctggaaggagccgcgccat

SEQ ID NO: 2215 - DNA, 228 bp, A.fumigatus
acgcattggtcgttgatacagaagggggtgaaagtgacggggtcgaatattgggtctccggatgatatccgggcgatgctgcagctggctgcggagaaggaggtgttgccgtggatccaggagcggccaatgcacgatattaacgccgctctggctgatatggatgcgaataaagcgaggtaccgatatgtgctgtccaatgagatgggggcacagtcgaagttgtaa

SEQ ID NO: 2216 - DNA, 189 bp, A.fumigatus
atcatcgccatgttgttaaagcgagggtatgaaggctgggtagcctatgagtactatccctccatggcggcaggagtaatattcgtcgtcctcttcggcattgtcaccctgctacacaccttccatctcttccgaacaagaacatggttttgtatatctttggtcataggaggctactgtacgttttga

SEQ ID NO: 2217 - DNA, 570 bp, A.fumigatus
caatcccatataggttggaccactcgcatcttcgctcctatcttcgcactcggagctttctatggcataatgcatagcagagggaaggactctgcgtttgatatgtctacagcttatacatccttgtcactctttgcactactagcagatccactgctttctcttgtcatggctctaatgacgttcgttggctctattggttctttcagccgtattcaagaattcctcgagaaagacgaccacgttgattgccggcttaagccgttacacgcttcctatgagagctttgagtcaaaagctatggttcttgtggatgattctgacgccactgaaactgcttcggatcggtcgatccatcgtgggaaatctgtgtatcacgatgcgctgacagtaaagaatgcaacgttcgcctggaatgtcgagaaagagcctgtactaaagggtttaacaatctcaatagcgcggggaagcttcactatgattgttgggccctccggctgcggcaagtcaacattgctgaaggctattctcggtctttaccacagacgacgcaaatcaacgctatcctta

SEQ ID NO: 2218 - DNA, 339 bp, A.fumigatus
gtaagacagctttttcaacagtcttcgcagacaaaatcgccagtctcagttcacacagcaacgcaaagcaaaatgaagtatctcagtctcgccgttgccttcctccccctgctagccgccgcggccccggccgcagatcccgaagtcgaggcggacggcgagctggacctggaaaagcgcgcgtccgcgcagacctgcaagatcgtcaatgtcgatacctatgtcaactgccggtacgatgccaagttagacgcgggcgcgatctttgggttccccaagggagagaaactcacctttgcgtgctggaagcacggcgattgctacaacggggtttggtga

SEQ ID NO: 2219 - DNA, 447 bp, A.fumigatus
caatcggtgacaaatcgcaacgagctgcttggtcgacgaccacaccacgcagcgactcctgagaacccatatgcccaatcttccctcccccaatcttcgtctttcgcaaacacttcatcatcccgctcagggctcagcttcggagcttcgccagcggattacaccagggagacgcatgcactccgagagcaatctttttttgccaacacgaactcgcaacttgatgaatttctcgatagaggccgcgctgttctagcagaccttgggcaacaacgcgaggtgctgaaaggcacgcagcgccggctatacagcgttgcgaataccctgggtgtgagtggtgacacgattcgaaaagtcgaacgaagagcaaagcaggacaagtggatattttggggtggccttctcgtttgtcttcctcttttgctggttgggtattacactttttga

SEQ ID NO: 2220 - DNA, 195 bp, A.fumigatus
aacagcttcgatcagcagtccgaccccaaggttgaagatggtcttgctaatactactaagggccatatctatcttgtgaagcagaaattttcaagaagtaatatcctgctgaatgaaagatctaactcaactatcataagattcccaatttacaacaatactccaagtctccaactgccagactatggtaagtaa

SEQ ID NO: 2221 - DNA, 873 bp, A.fumigatus
cacctcgcggtgaacactgtccttgtccacgccttcataccatttgccattcactgggcctatgtcgtctatacaggtcgcaacataaccccagtcgccgctttcattttctacagcacggcgttcaaggcgattggcattcatgaattgcatatcctccgtcgcctcggccaccgacttgggttcttcgacggcgacaagcatgagcgagacggtgtgcctgacgttggtgtcgcaaaagtcgttcagtcgctactttcgacgtccaccttccgtccgatgttcacagtcttcctgagctaccagaccaacctaccaccttcttctatcaactggctttggctaccacttgaaattggtctttatggcatcgttctggacttttggttctattggtaccaccgtctcatgcacgatatcggcagcctctggaaataccaccgtactcatcacctcaccaagcacccgaatccacttttgacgctttatgcggatagtgagcaggagttcttcgacattgcgggcattcctgtaatgacctatttcagcctcaagctcatgggccttcctatgggcttctatgagtggtggttttgccaccagtatgtggtattttcggagcttgccgggcacagcggggtccgccttcatacattcacaccatcgacactgacttggcttctgaggcttgtcaatgcggatttggttatcgaggatcatgatcttcaccaccgctatggatggaagagtagttacaattatggcaagcagacccgcctttgggaccgcatcttcggcacatgccgtgagcgcgtcgaatccagaccagacaatattgactacaacaataaagttacgctgcctctgtggtga

SEQ ID NO: 2222 - DNA, 600 bp, A.fumigatus
gcggccccccccccccccccccccttttttttttccccgccttccaacggacaaaatctcacaagaccaggcggcagcggcgcagaccactgcggcgaaatcgacttcaagtacggctgtcctctgccggaaggatcccatcacatggacctctccgatattgccatgggccgactccagggaaacggcagtctcgccgacggtgtgattcccatccgctaccggcgtgtcccctgtcccaagccggggaacatctacatctggcttcatgatggggcgggaccgtattattttgcgctgagcgcggtcaataccaacggccccggctccgtaatcagtatcgaagtccaggctggtggctccgggccatgggttgccctcgagcacgatccgaactacaccagtagccggccgcaggagcggtatggctcttgggtcctcccgcagggcaagggacccattactgtgcctgtttcgatgaggctgacggcgcccaatgggcagcaggtggttaaggagggcgccattaccagctataccccgccggcgactgcggtcgagggcttttggtatattgatctgggagtgcagttcacctag

SEQ ID NO: 2223 - DNA, 339 bp, A.fumigatus
cgcgtcgatccttccagccccgtggtgaagacggagaaggagcgcgacttctactttgctaagctccgggatatcgaactgctgctacagaatgccatcgaggccgacccggaactggagaaggatgaagactccctggtgaagcatatccagggcatcctgtactcgacagaggtacgtgtttgtgacgctttgcctctcttctttgcttctggtgctaattctttgtataggaagggtttgagatcccagctgaagcggaggtcggcgatgagctggagacattctacgttcatggcaaaagacgtcttttcgttaataatacccctttatcactag

SEQ ID NO: 2224 - DNA, 1221 bp, A.fumigatus
ccatggcgcggctccttccagccccgtggtgaagaccctcccgcgacttcgggcccggaattctctaatcagacacctcatacctctcatgttgattcgcatgcacatctagcgaccagcggatatgccccaaatgataatcagttagctggcttggtagaagccgcaacagcagcggccggtcaggacgtctcggaatgggccgcagcggcggcggtggctgcagcggccggagctgccggtcatcaacatcacttggatagttatgggccggagatacacattgaagatgacggcttcggagatggaagttttggggcaggaatgagcgcaggtagacagctacgcggatcagggtcggcttcagtcaacgaccagggccagtcctcaggattgtcaagatcggtctccaagaaacggaaaagaggagaggatgcacttgatccggcgttgactgccgccggtggagtaggccttcctggtggtccgcagcaatcacagcaacagcaacaacaccatcttcagccgccttctcaccattatgacggagacaacctggatattagagctgttccacctcagtctctgtctgacgctcgcgccgccggcgttcattccgcggctgcacttttccgccaaccttccagtaacaagaaacacacccgtccgccaatgtcgaaactcttcgcctctctagaattgtcgccggaaaacttcttgcatttgcaagcagccgcgaaagcatatatgctcgatcctaaacatcctgagagacgggaatgcgtcggccagcgaggcaaaggtgataccgaaatggttaagttaaggctatggaattgcgtgcgacacttcctggaggtcgaaggaaatggagaacggttcttcagtgagaatgtcgtcaacgaaggcatgggtccgaggtcatacatctggccgcgcgaccagcagaaaattatttctttggtgattccgcttatccggagaatggtcactaatgaacgccagcgacaatatgctgttgaaacgcggaaaggaggcggcgctgatgagcgaaggagacggaagacgaatgaaagcttccagacctttaccaccagcgcaagtccgccgagattttcctctgacgggcagcttcagatgcaccctcatcaccatatgccagaagagtattcatcatatcaggtccccagtcttcaccacgggggtcgaaggatccgaacg

SEQ ID NO: 2225 - DNA, 372 bp, A.fumigatus
gaagagcgcaagctgctgttcaagctggacacggcaatattaacttttgcctcccttggtagtacatcaaccgtgaatcttgtagccaagctgacagtgatgcaagggtatttcatcaagtacctcgatcaggtcaacattaataatgcgtttgtctccgggatgtacgtctgccttgccgacattgatatcgatccactgacagggtacaggaaagaggacctcaacctctacggcaaccagctcaattacatgcagacctgctggacggtgggctacgtcattggcgagataccaagcaacctgctcctgacgcgcatccggccgcggtattggattccggcgatggaggtatccgcagatttcttctag

SEQ ID NO: 2226 - DNA, 231 bp, A.fumigatus
tgtcccgtggttggcagggggagggtagtaacagccacaggcctcgccgaaagcacattctaccccggcatgcagtacatcatcggctcatggtaccgcaaggatgagctggcgaagcggtcatgcattttccatacgagtggtgggatcgccagtatgttttctgggtacttgatggcgggcgtatatcatcttggaggcaggggtgggttcaaggggtggcagtggtag

SEQ ID NO: 2227 - DNA, 525 bp, A.fumigatus
tatgccgttgaatcccagataaggcatcacaatctcgacccaaaggatgccatggtccttatagagccagaagaccttgatcggcccattttagacacaaaatatatcctccgagtaatcgatgagaatgcgcatagcactgctctgatcctcctacccgcaattcagttctataccgggcaatacttcgatattcaaaggatcactgctcacgcccagtctaaaggtatcctcgttggctgggattgtgcccacgcagcaggcaatgttgacctgcgactgcatgattggaacgtcgatttcgctgcctggtgcacttacaagtacctcaacgccggaccgggagggatggcagctttgtttgtccatgagaggcatggccgggtggacattgaacaggccgcatctgggaaggaagctttccatccgcggttttctggctggtggggaggggataagcaaactcgtttcttgatgaacacccgtatgttatctcgccgattcagactgtgttttttatattga

SEQ ID NO: 2228 - DNA, 444 bp, A.fumigatus
agtgttatactttcactattgctcacgcaaagtttacgcagaatgggttctcggctacatgttcaggtaatccacggcggaccccctcttccttacaaagatgatatcagggcatttggcaaagaatatgcagagcaactagatgcacaagaccctttgcgtcgcttcagagacgagtttatcattccgtcgaaaaaggacctaaaaagaaagactctgttcccaaacgatggtatgtattcgtgtggacaccccatttgcttcgctaatacaagctgtgcctgcgtccatgctgcagaaactgaagagacatccgatgaaaaatgtatctacctctgcggcaactcgcttggccttcaaccccgtagcacccggaaatacatcgaccactaccttcggacatgggcaacccaaaggcgtaaccggtcattttgttccgcatga

SEQ ID NO: 2229 - DNA, 492 bp, A.fumigatus
aaagaaagactctgttcccaaacgatggtatgtattcgtgtggacaccccatttgcttcgctaatacaagctgtgcctgcgtccatgctgcagaaactgaagagacatccgatgaaaaatgtatctacctctgcggcaactcgcttggccttcaaccccgtagcacccggaaatacatcgaccactaccttcggacatgggcaacccaaaggcgtaaccggtcattttgttccgcatgaggcccagctgctccctccatttgttgatgttgacgaggctggagccaaactcatggccccaattgtgggtgcactaaaaagcgaagtagcagtgatgggcacgttaacggccaacctacacctcctgatggccagcttctatcgaccgaccccggaaagaaataagatcatcatcgaaggcaaggcatttccgagtgaccacgtacgttttatggacttgatttcttcttcaaagttatgtggccaaagctaa

SEQ ID NO: 2230 - DNA, 1197 bp, A.fumigatus
ctgttctaccggtacctgcggcgggcgatccagtgggggtgcgagtacatcgacgtggagctgtggctgcccgaggagatccggcggcggctggccgagcaaaagggccacagcgtgatcatgtcggcgttccatgacttctcgggcacgtggaagtggacgtcgcccgaggcggcgcgcatcttcgcggagagcgcccggtacgcggatatcgtcaagatgatcgccatggtccacacgatcgaggccaactacgagctggagtacttccggtcgacggtcaaggcgcgcggggcgggcgactcgtccccgctgctgtcggcggtcaacatgggccagatgggtcagctgtcgcgcgcgctcaacacggtcttctcgcccatcacgcacccgctgctgccgatgattgcggccccggggcagctgaccgcggccgagatcaacgaggcgatgcacatcatgggcgccctgccgaagcgcgatctctacgtgatcgggtcgttccgggcgacgccgcagtccatgttcatggagaagtgttttaacgagctgagcctgccgcacacgctgacgtccatcgaccgcggccccaagggcacgatcgaaggcgtgatcatgcagcccagcttcggcggcgcctcggtcaacccgcccatctcggccgcgacgccgtacattcccgccgtcagcgaggccgcgcgggcgatcgggttggtggataccattgtcgtgggggagtcacagtcgcagtcacagtcgcagtcgcaatcgcaatcacaatcgcaatcgcaatcgcacccgcacggaccaccaacggcgagaacgttaattggggagaacgccacgtggaagggaattcgggcgacgctcacacgcgactacgtgccgtcagcctaccgaggccgggcggcgatcatcctagcagggtcggaaagcgatgcatcggcggcgatctatgcgctgcgcagtctcggggtgggctcgatctacactgtgggattccgggcgaccggaccgctggcggcgggactggagccctttacctcgatccagtcggtcaagctggtcgagcagccatttgtgatggtgtccgcgctgccgccggagaagtcgctcctggtgcagccgctgctgcgacactaccgcagcaacgggcgcacatccgtcttcaccaggggctggaaggagccgctctat

SEQ ID NO: 2231 - DNA, 219 bp, A.fumigatus
ttcactaatttccttatagctgagcagttgcctacagttacactagactttagtacaagggattctggttcaacacaggaggctgctaactgtattagtactactacatttactaggcaaatagggatgcattcagacatggttagtattagtattatagatagtaggattagccatacctataactatttaatgaatagtacagtcagtcagttctag

SEQ ID NO: 2232 - DNA, 219 bp, A.fumigatus
ctaaataacccactagtaagtaaccttttattacctactataataaatagacactggaaaactaaagagcttagttacttctggcctaatatattagaagatactagtattaagcagtataacacaagcctgttctataagaatatgaatatatttactaactatataaaagatataattaattataaaggtaaaccttttgtcaaagcaaacttataa

SEQ ID NO: 2233 - DNA, 273 bp, A.fumigatus
  unsure (187),(244): Identity of nucleotide sequences at the above locations are unknown.
aaactgaggctaattaatatacatgagatgactctgatagcctactccattcttcttttctcccccttgtatattatttcgtatattattgcatattctcttcgatggtttcctcacggcgggcggttcccctccttggtcttgcctttttcgtcatctttctctacacagtcaatagtctctcganacaatggcggcggacgccaaaaggcgtggggtctggcaaattggtcccttcacctancccgataccatcccggttttcgaacataa

SEQ ID NO: 2234 - DNA, 351 bp, A.fumigatus
actgacggacccttccagccccgtggtgaagacgacgccggacgcaaggttttccccggcctgggggtatactcggccagcaagttcttcgtggaggcgacgctgcagtcgctgcgcttggagaccgccgggatggggctgcgtgtgaccgccgtccagccggggaacactgccaccgatttgctggggatgtcgacggacgcggaggcgatcaaaaagtacggcgagccgtcgggggcgaagatcttggacccggaggatgtggccaattcgattgtatatgcgctgcgccagccggcgcatgtggcggtgaatgaggtcttgattgaaccaagagatgagcctatttag

SEQ ID NO: 2235 - DNA, 558 bp, A.fumigatus
aagattatcaggcctgtgttctacgtgaattctagcataattaccaccccgcttctagaaaaatggctgcggatcttggagctgttgcccagctccttgaagcaagcttggacccaaggcaaaacaaacaaggtatgggaaattaggattgtccggcttgtatgtctattttgcgatggattgtctgatgtttttgcagctgaggctactcttcgccaggaggaacagaaacccggcttttctttgcagctcctccagatcacggcatctacttcctacccctacaacacccgcctcgccagtgctttatgcttcaagaactttattaagcgaaactggactgatgaggatggcaactacaaacttcagctggacgaggttgcgacaatcaagcgggagctgatcagcttgatgatttctgttccggcaggtatccagtctcagttaggtgaagctgtcagtgtgattgcagatagtgacttctgggagcgatgggacacccttgtggatgtgagtagtacaaataaatactttttcgtcgtcctgtacttgtactaa

SEQ ID NO: 2236 - DNA, 1215 bp, A.fumigatus
gtgaaaccccgattctcctttttgctacataaacctacagatgatagtgtggagattgccgtcggtctgaccagggaagttggtcagcacttggaagaaatgagccctcccatcgctctggctgtctttgatcagttcaggaatatcttgcacgaggccgacatcgataaacgagttcaatacatgatcgaggtcctgttccaggttcgcaaggacagatacaaggacaaccccgcgatcaaggacgaactcgacctagttgaggaggaagatcagatcacacatcgtatcggtctggacgatgaaattgatactcaggatggcctcaatgtcttcaaatatgatcctcagtgggaggagcatgaagaggcgtacaagaagctcaaggctgaaatcctaggcgagggtagcgatgatgatgaagaagatgaggacgaaacggacgagagttctgatgaggaagaggaggaacgacagatggaaatcaaggatcagagcaatacagatctcgtcaatctccggcgaacaatctacttgactattatgtccagtatcgactttgaagaatgttgtcacaaacttatgaagatctcgttgccgcctggcctggagccagaactcccctcgatgatcatcgaatgttgttcccaggagcgaacatactcgaaattctacggcttgattggagagcgatttgcgaaaataaaccgtttatggtctgatctttttgaagccgccttcgccaagtattacgatacaatccatcgatacgaaactaatcgtttacgcaatatagcccgtttctttggccatatgctgagtacagacgccatcggctggcatgtcatgtctgtcattcaccttaatgaagacgagacgacctctagcagtcgtatctttatcaaaatcttgttccaggatctaggagaacatcttggccttgcgaagttgcaggagcgcatgagggatgaaattttgcgacccagcttcgagggacttttccccctggacaaccctcgcaacacccgcttttccatcaattacttcacgagcattggctttggtattctgacggaagacatgcgggaacacttgaagaatcttcccaaaccgactgttcctgccctgcctgcacgtgacgcaaagtcggactcggagtctgtcagttcgcattcgacctgctccacatgcacaggttcttctcggtctcgctcg

SEQ ID NO: 2237 - DNA, 726 bp, A.fumigatus
atgtatcaaaatcaattccagaagtacaatccggaactttttgtcgaggcagatgtccctccccatgtcatgaatgacgaggggccagttgtggcgccttgggtctgcaaagccgctttgcaacgctcagtcgccaagattttttatcataccgggtttgaggagtatcagccgtcggctctggacgtggtcaccgatattgcttcggattttttcttgaagatcggcgagaccatgaaatcatatatcgaagctccgaaagtcccaccaactgaaacctcgtcctcgacttcacaatggaagcgggcctatactgaaccggagattgtcttacacactctctcctcagttggaacagacgtggaatccctcgagtcctacatcaaggatgatgtcgaacgacttggaacgaaattggcgactgtgcatgagcgcatgcggtccctgctttcggaactcttgcgtcctgcccttgcggacggcggtgaagatggctcgaaggcatttgcagatggaagtgagcagttcatcggcggtgatttcgctgaggacatcgacgaagactttttcggattcaaggagttggggctggatagagaatttggcctggcaacgctcagcgttccccttcatcttcttcaaaacaggatgtataatgccgctcaggcccagaacccaaggtatgtcacttttctgtatacattgacagcggaacactggagctaa

SEQ ID NO: 2238 - DNA, 768 bp, A.fumigatus
ccagcgaaccctcgcgttcccaaggcgagcgggaagcgagttaaggtgttgcatctgtccgactttcatctggatccgcggtactcggtcagctctgagggtaattgttcgtccggattgtgctgtagtaacaacaacttcaattctgctgcaaaggaccaggtcctcatctctgccccggcgtacgggacttttaagtgtgacaccccgtatgatcttggccttgctgcccttcaggcgattgggcccttgaccgggaccgggaagggaaaggatcaggactctctggcttggtctctttacactggcgatcttgtgtcgcatgatccagtgcaggcaatgtctcgagaatatgtcgagtacacggagactagcatctatggcatcttcaaagaatacctgaccgggcctgtctttgctgcgctggggaaccacgatacaagccctgagaacatcaatgctcctcacaatctcccagggcctctgggcgaacagcagagctggaaatacgagcatgttgccggactctggaaacatgaaggatggatcgacgagaaggctgatcaggaggcgcgcacacactatggtggatactctgtcaagactcactacggtctgcgcattattgcgtttaatactggtaagtacctggatatcggcaattatgcgaggactgaccctatcagatttctggtacgcgaaaaactacttcaacaacatcaactctaccaatccagacaactccggcgtcttttcctggatcattga

SEQ ID NO: 2239 - DNA, 192 bp, A.fumigatus
cgagcttcaaaaggccgaagatgccggcgagcgtgtctggatcatcggccatgttatacagcggatgggagggctccaattccctccctgattctaccaatctattctaccaaattgttggaacgctactccccccatgtcattgccaattatcttctttccggccttcccccaaagaaccctttcctgatt

SEQ ID NO: 2240 - DNA, 456 bp, A.fumigatus
ccgggcctgtctttgctgcgctggggaaccacgatacaagccctgagaacatcaatgctcctcacaatctcccagggcctctgggcgaacagcagagctggaaatacgagcatgttgccggactctggaaacatgaaggatggatcgacgagaaggctgatcaggaggcgcgcacacactatggtggatactctgtcaagactcactacggtctgcgcattattgcgtttaatactggtaagtacctggatatcggcaattatgcgaggactgaccctatcagatttctggtacgcgaaaaactacttcaacaacatcaactctaccaatccagacaactccggcgtcttttcctggatcattgacgagcttcaaaaggccgaagatgccggcgagcgtgtctggatcatcggccatgttatacagcggatgggagggctccaattccctccctga

SEQ ID NO: 2241 - DNA, 993 bp, A.fumigatus
ttcatccaatttgtcgagcgtcctcacatgcagaagctttacggcagaagcctgcgacgagatgctgggctgacaaagagtttgaagcgatccctgcttccttcgttacaacagcttcatggaagtgttgacaagatctttgatgagtctttcgaattcattgaagaactcattgacaccgctcgtccgaagctcgcggcgggcgtcaacacgtttgtcaaagacacgtcagctctgttccaaaaatatcccgctcgtgtgactatctctcgtattgatgaagacctggctggctatgatttacgtgactattccttggagattgagggcactgattcattgtcacccaatgacaacgatcaaagcggtagggagggtgctaatgctcgtatgccccttgacagacgcggcgacttgaagaacttggtcttcgagtatggttcacccatcaaggttaagtggactgctccgctcaatcacagcaagaaggattggattggcctatatcgagtcaccgacaacacttctcgggaggttacacgcgtctcatctcaagggagatggattgcagtcaacgagggctcgtatgacaatttgacttgcgagaagggtatcgtgagcagcgatattctcatacccgcctcacaacgcaaggacaacgaaaaccgcgatcttgcttccggcgaagtcatcttctctggtgataagctattctggactcagggcgtctttgagttccgctaccatcacaatggcaaacacaatgttatggctatttcaagaccattcgagattcgtatcagccggtttgatgaggacgagatcccactgatgaaccctacatcagtcgagctaagcttgtttcccgttgtgcgtaactgccttgatcgagatccccagatcgcgccggagaccgtggatgagccgtttggcggccttgttgaacgtgacggaaagtatgccaagagagttgtgttcgcggttcatcaaatg

SEQ ID NO: 2242 - DNA, 462 bp, A.fumigatus
gtcagctcaaaaacgaaaatgaagctagcggtcttcagcgccaaatcctacgacaagctcttcctcgacagctcccttgagaaagactacgcatccttctgcgaaatcgtctaccactcattcgctctatcctctgagacagtctcactggccaaaggaagcgatgcagtctgcgcctttgtaaacgacacactggacgcgccagtcctcaaatctctccaccgctacggcattcgcgcaatccttctgcgctgcgctggtttcaacaacgtcgacctgcaagttgcagaggagctgggcttctttgttgccaacgtcccctcctactcccctgaagctgtggccgaattcgccgtggcgctgatccagactctgaaccgcaagacgcaccgcgcgtataaccgcgtgcgggaggggaacttcaacctcgaggggttcctgggacatacgctgcacgggaag

SEQ ID NO: 2243 - DNA, 330 bp, A.fumigatus
tctggcggtccagttgctaatttcaaatctgcgactagaatctcggatcagatacagtcgatgttgcgagaggccgggttgaaagttgcgacgcagaagtacgagtacacttcttctggtatcacgcatgagggacagaatgtctacgctatcatccatgcgccgcggggcgacgcgacagaggcgattgtactggtggctgcttggaagactgctgatggagagttgaacctgaatggagtcagccttgccctgacgctggcaagatactttaaacgtgggtcgatacttgtcacaatggtggaggaggggtctttcaagccatgctga

SEQ ID NO: 2244 - DNA, 624 bp, A.fumigatus
cgacgatcatctctaggttggtctctgtggtccaaagatatcatctttttgtttccaccagacagcaaatccggaacacaggcgtggatcgatgcgtatcacgacatgcaaacgtcctcagtccagcctctgccactgaagagcggtgccctacagggaggactcgttatagaataccccttcgaccatcgattcgagtctttacatatcgtctacgatggtgtcaacgggcaactgcccaatttggatttattcaacacagcgatttcgatcgccggggggcagatgggaattggaaccagcctgcaggaaatgtgggagcatgacgatagctatcaaaagcggctgcagacaatcatcaggggtatggtcaagcagggcctcggacacgctactggggcacatagtagcttcatgccgtaccacattgatgcaatcactctgcaaacgaagggagatggctggcaagacgagatggctctgggccgaactgtggagagtctctgtcgcagtcttaacaacctgctcgaacaccttcaccagagtttcttcttctatttgctgatgcataccaatcgcttcgtcagtatagtcttcacgccggggccggaaggaaacgcgtac

SEQ ID NO: 2245 - DNA, 273 bp, A.fumigatus
agtggaaaccaaggcattcaaagttttgccttttggtctcgactcgactgtgaatatgagagacctcgatcctgcaggtatgcattacgatattttttttttttttttttttttttttttttttttttcatttggcttttgtctaactttacttcagacatggataaactagtaagcattaagggcttagtcattcgaacgacacccatcattcctgatatgaaagaaggtacgatacatctccttgatatccatctaatcagattatcgtaa

SEQ ID NO: 2246 - DNA, 516 bp, A.fumigatus
tcaacggaaggaaccggaatacatcagcatgttgagcaccatgggcaattggaagtaaccagcttgaacttggatgcaaagaacctgaaggcatacccatcaacactcaagctatggcatcagttgcatgcttatcctcaagagatcattccattgatggatcagacagtgaaggatgtgatggtggagcttgcgatcaaggagatggagcgcctgcgggctcagaaccaacgaaaccagaatcataacagaggcctgagctctggtcccgctgttcccagctctgacgcgctgagtgaaactggcagaatgccacagaacgagatccccgaccttgtcggtgaagtggaaaccaaggcattcaaagttttgccttttggtctcgactcgactgtgaatatgagagacctcgatcctgcaggtatgcattacgatattttttttttttttttttttttttttttttttttttcatttggcttttgtctaactttacttcagacatggataaactag

SEQ ID NO: 2247 - DNA, 300 bp, A.fumigatus
ctcatctttccagctttcttccgttgccaagtctgcaaccatggtgttcaggtcgacattgatcgtggaaagattgcggaacccactgagtgcccacgtccagtgtgtaaggaacgaaactcgatgcaactcatccataaccgctgtgtatttgccgacaagcaggtcatcaagttgcaggaaacacctgacagcattcctgatggccagactcctcactcggtttccctttgtgtgtatgatgagctggtggatgtgtcttcaccacggggctggaaagagccgctcaatgggcattca

SEQ ID NO: 2248 - DNA, 369 bp, A.fumigatus
caaggcctcgtgaagatgccagtcacagcatatcctatttaccttcacttatgtggcagcatccatttcgagttactcgtactggaacgaaggcaaaaggaccagctcgcggggatcgagaaccaggtactgaagacactgtggatggtcctgatgtgctattttatatttttccacatcctatgctttctggtcgttgtcttgtggatatggctgaccccagtgttcggccaatccgtcatggtggatggtgtcaaaactttcaggtgggaattattcactgctggttcatctttcaaggtcctaggatacacactgacgccggatacaatggtctcgtttaaaaatgctgccttcccctcgacttga

SEQ ID NO: 2249 - DNA, 972 bp, A.fumigatus
  unsure (828): Identity of nucleotide sequences at the above locations are unknown.
ctcggcaaacgcactcttctctattcaactgccgaggtcttgactacgcccgtttttgaaaacaggcttacgctcgtgctctgggttcctaccggagaatctggcgagtttgcaatcaagggagccaagtcagggaaggttgaaaatggcgatggctgctcaggaatcaaatttaagcgtgagaaggactatctcgtcgtgaacttctctcaggccaaaggattgagcgtcttgcggctcgataatggagtacgcgtggttctgctcgacaaggccgccgcctaccgcttctgggctcctgcattgacagatgatcctaatgtgcaagagaccgaaactggtgagtgcacttcatacagagtacattgtcgtttcatactaatggtcacagtcctcgtccacggcccgtaccttgttcgctccgccagcatttccaagaccacattggcactccgaggagactcggttgagaaaaccacgctagaaatatttgcgcctcacagcgtgaggaagattacctggaacgggaaagaggtccagacctctcacaccccatacggcagtctcaaagcgactctcgccgcaccaccagacatcaagttgcccgctcttacctcctggagatccaacgacagcttgccggagcggcttccatcgtacgatgattccggcccagcctggattggtaggttagatccaatctataagacctggccaaatctaatacgttccacagaggcaaaccacatgaccacatctaaccctagtccacctgcaacctttccagtcctgtacgcagacgaatacggtatgtcaacccctgtctcncctatatatcactggtttaatccgcatacaagcttccacaacggcgtccgcctctggcgcggctacttcaacggctcagcttcgggagtctccctcaacaatccaaggaggaagcgccttggtacgtcactctccccatcctaa

SEQ ID NO: 2250 - DNA, 183 bp, A.fumigatus
acaggtaagctattctcaacccatctattggactttactgacattatccagggtctcgccgacgtacgtggtctgtctccccgtgagcgtgctcgtgtcatcatcaagcagtgcgcccaccccgactaccagcccatccttacagactacctggaccgcgctgaatacgagtgcctgaagaag

SEQ ID NO: 2251 - DNA, 957 bp, A.fumigatus
agacacatcaccatgtcggaggttcctcctcgccggaagccttacctgatcatgcagcccgaggaccgcattggaactccacatatccccgtcgacccggagaaggtcgtcgccattgtcgagtcggactacccggatcagacgcagcccaacgctcccgaggatgcaacctcgcaggccattgccagcaaccttattgagtttctgaagcacgaggtcaggcatggccgtctgccccagaacctgctccccatccagtccggtattggaaacatcgccaacgcggtcattggtggcctgagcaagggcggtgccgactttaccaacctcaaggtgtggactgaggtgctgcaagattccttcctggatctttttgactctggaaacttggactttgccacggccacctccatccggttctcccccgacggattcaagcggttctacgataactgggagcactatgccggcaagcttctgctgcgttctcagcaggtttccaactcgcctgagatcatccgccgtatcggatgtatcggcatgaacactcccgtcgaggtggatatctatgcccatgccaacagcacctgtgtcatgggctctcggatgctcaatggtctgggaagatctgccgacttcctccgcaattccaagtacagtatcatgcacacccccagtacccgccccagcaaggttgatcctaccggtgtcagctgcattgtgcctttctgcactcacattgatcagactgagcacgatctggatgtggttgtgactgaacaggtaagctattctcaacccatctattggactttactgacattatccagggtctcgccgacgtacgtggtctgtctccccgtgagcgtgctcgtgtcatcatcaagcagtgcgcccaccccgactaccagcccatccttacagactacctggaccgcgctgaatacgagtgcctga

SEQ ID NO: 2252 - DNA, 846 bp, A.fumigatus
agtccaatagatgggttgagaatagcttacctgttcagtcacaaccacatccagatcgtgctcagtctgatcaatgtgagtgcagaaaggcacaatgcagctgacaccggtaggatcaaccttgctggggcgggtactgggggtgtgcatgatactgtacttggaattgcggaggaagtcggcagatcttcccagaccattgagcatccgagagcccatgacacaggtgctgttggcatgggcatagatatccacctcgacgggagtgttcatgccgatacatccgatacggcggatgatctcaggcgagttggaaacctgctgagaacgcagcagaagcttgccggcatagtgctcccagttatcgtagaaccgcttgaatccgtcgggggagaaccggatggaggtggccgtggcaaagtccaagtttccagagtcaaaaagatccaggaaggaatcttgcagcacctcagtccacaccttgaggttggtaaagtcggcaccgcccttgctcaggccaccaatgaccgcgttggcgatgtttccaataccggactggatggggagcaggttctggggcagacggccatgcctgacctcgtgcttcagaaactcaataaggttgctggcaatggcctgcgaggttgcatcctcgggagcgttgggctgcgtctgatccgggtagtccgactcgacaatggcgacgaccttctccgggtcgacggggatatgtggagttccaatgcggtcctcgggctgcatgatcaggtaaggcttccggcgaggaggaacctccgacatggtgatgtgtcttcacccggggctggaaggaccgctgcatgcgca

SEQ ID NO: 2253 - DNA, 249 bp, A.fumigatus
cctccatggcgagatgctgacggtgattacggtcagaagtccggtcaaccgcagcgttatttctgccagaaatctgctgttagtgcacatatcgtctgcgaccacatttttgaaggatcaaaaggtgggaaaatggtatgtgtccttgccctaattattaaccaagacgttgacaccggtgctatcaaggcaattaagaaaacccggctacatatcatcggtcttcaccgggggctaaagggcactcag

SEQ ID NO: 2254 - DNA, 438 bp, A.fumigatus
tgtcctccaggagccgttgactacatcttcggtgacgcctcggcctggttcggcgaatgcgaactcgtgtccgtcggccccggctacattaccgccatgtcgcgcacgacggcggacgagaccacctggtacgcgatcgaccactgcaacatctacgggaagcccggcgtcgatcttaccagcgcggtgtaccttggtcggccttggcgtgtgcttgcccgtgtcatcttccaaaattcccagttgtcgaacatcatcaaccccaagggctggagccccatggcaacgggggccacaccgctttactatgagtacaataacaagggtgctggagcggatacctcgaagagagagtacgagtctcccatctctggtgctgttagcatcgccacggttcttggcggcggttggaacagctgggttgataccacgtattaa

SEQ ID NO: 2255 - DNA, 564 bp, A.fumigatus
ccccccccccccccccccccctttcccggtctcttggaggatgaacagtcatttgtcaggacatccagaagaccggaacagccacactgtcgactcctgacttcaggcaccagaatgtatcttccctctctcgtcctcggccttcttgggtttggcctcacggcttctacaagccccatcgaagaacggtcgaatcgcagtaaagccccagccggatgccttacagtcggctcatcgggtacgtacgcgaccattggcgctgcgttgagcgctctcggcagctccacgtccgacgcctgcatcttcattggtgctggaacgtaccaggagcagatcaccatcgactacaagggcaaactcaccatgtacggcgagacgaccgacacgagttcatacaagcagaacctggtcactatcacccatagcatttcctctcctgaggcgggatcgcttgacaagagcgccacggtcaatgtccggtcggacgggttcaagatgtataacatcaatgttatcaacggttacggcaagggcgcacaggctgttacgtatgttgtcctctga

SEQ ID NO: 2256 - DNA, 678 bp, A.fumigatus
cccctccgtcggagggtagctgacagggatatgttaggctcgtcgccaatgccgacaaacttggcttctacggatgcagttttgtcggctaccaagacactctctacgccaaggccggtcgtcaatactactctaactgctacatcgagggtcggttcttttccacctccatccatccacgcctcacccgcatatgctaatgtcctccaggagccgttgactacatcttcggtgacgcctcggcctggttcggcgaatgcgaactcgtgtccgtcggccccggctacattaccgccatgtcgcgcacgacggcggacgagaccacctggtacgcgatcgaccactgcaacatctacgggaagcccggcgtcgatcttaccagcgcggtgtaccttggtcggccttggcgtgtgcttgcccgtgtcatcttccaaaattcccagttgtcgaacatcatcaaccccaagggctggagccccatggcaacgggggccacaccgctttactatgagtacaataacaagggtgctggagcggatacctcgaagagagagtacgagtctcccatctctggtgctgttagcatcgccacggttcttggcggcggttggaacagctgggttgataccacgtattaagagtcgttggtgggcgggacgctttgcacatggttgttga

SEQ ID NO: 2257 - DNA, 207 bp, A.fumigatus
cctaaaccagtccgctggtcgaggcctcctggcgaggacctccatgatccatccgactttagtgacacacacttcgtgtcggtgaatacgatcgtgttctatgtaaagatcaattcataccgttggactcaaccatgtatgaaacggcccagggctctagccatctggtcagagtcttcaccacggggctggaaggagacgcgccat

SEQ ID NO: 2258 - DNA, 876 bp, A.fumigatus
  unsure (752),(780),(788): Identity of nucleotide sequences at the above locations are unknown.
gtgtgtaactccgtagggagccgtttttcaagtcatggtattctgtcagtagatctagctctggctagttccgtagtaagtctaatcataagaatatgcgtacagatcgagcatacgtctggctcatttacacgattgaaatcacaatcacagcgcaccgagctccttcagcttgccgatcagaccgtcaacatcctccaccttaccgccgccctggcgcgcaggaggttctgtcatggtcagcatccgctctgcattacaacaagggaaaaaagaagaaaacctaccagtaaccttaattgtcttcaaccgccgcttatcctcaaccccgaaatcctccagcttcttcttctcaagcggcttcttcttcgccttcatgatgttcggcagactagcataccgaggctcgttcaaccgcagatccgtcgtaataaccatgggcaactgagcacgcagcgtctcaacacccccatccacctcgtgagtcacctccaccgtgcccttgtcgtccttgatctcgaccttgctcgcctgcgtcgcctgcggccaccccagcagacccggcagcatctggcccgtctgcccttggtcaccgtcaatcgcctgcttcccccagagcaccaggttgatgttctcttgcttcaccactgcctgcagcatcttaaccacggtcagcggctccatgcccccgtcattgctatcggggacctcgacgtggaaaggcccggtccgcgcccattgcccatgctggncggagcgtatcaacgcacttggcttcgncaacgganaagtgccaagatttttttcgactttcaggggggcccttgcgcctcgcgggaggcgggacggccttccttgatcgagagacttaattaa

SEQ ID NO: 2259 - DNA, 225 bp, A.fumigatus
ttccgtagtaagtctaatcataagaatatgcgtacagatcgagcatacgtctggctcatttacacgattgaaatcacaatcacagcgcaccgagctccttcagcttgccgatcagaccgtcaacatcctccaccttaccgccgccctggcgcgcaggaggttctgtcatggtcagcatccgctctgcattacaacaagggaaaaaagaagaaaacctaccagtaa

SEQ ID NO: 2260 - DNA, 750 bp, A.fumigatus
  unsure (110),(118),(146): Identity of nucleotide sequences at the above locations are unknown.
caagcctttccctcaacccctttaattaagtctctcgatcaaggaaggccgtcccgcctcccgcgaggcgcaagggcccccctgaaagtcgaaaaaaatcttggcacttntccgttgncgaagccaagtgcgttgatacgctccgnccagcatgggcaatgggcgcggaccgggcctttccacgtcgaggtccccgatagcaatgacgggggcatggagccgctgaccgtggttaagatgctgcaggcagtggtgaagcaagagaacatcaacctggtgctctgggggaagcaggcgattgacggtgaccaagggcagacgggccagatgctgccgggtctgctggggtggccgcaggcgacgcaggcgagcaaggtcgagatcaaggacgacaagggcacggtggaggtgactcacgaggtggatgggggtgttgagacgctgcgtgctcagttgcccatggttattacgacggatctgcggttgaacgagcctcggtatgctagtctgccgaacatcatgaaggcgaagaagaagccgcttgagaagaagaagctggaggatttcggggttgaggataagcggcggttgaagacaattaaggttactggtaggttttcttcttttttcccttgttgtaatgcagagcggatgctgaccatgacagaacctcctgcgcgccagggcggcggtaaggtggaggatgttgacggtctgatcggcaagctgaaggagctcggtgcgctgtga

SEQ ID NO: 2261 - DNA, 183 bp, A.fumigatus
aaggtagggtggatttgtctatataattttagtaagtataaggtatatatctacttccctataatagtaataatttcaaacagcctgttgtatttattattgagtttcttatatagatattatattcttaagttttttaataagagtagcaccttttctctaatagaaaataagatgtcctag

SEQ ID NO: 2262 - DNA, 261 bp, A.fumigatus
gagactctaattactaagtataatactagggccatcatagcattacataatgagatagaggtaataataggctttatacctaagtataatataggtagggttattcatgctctgcagttaattaattataacttatttaagctttatatcaccacaaacatgattataagacacccaacccccgcccctaaggatgagactatggtgtttcagaactttactagggttgctactaaatctagtaataagggtaagaagtag

SEQ ID NO: 2263 - DNA, 558 bp, A.fumigatus
ataaaaatgtcgcacatagccaggacagcagtgcatcgtacgacgctggctgtccgactgcaatggccgctcatccgatcgcgtttctcaacctcggcgcgtcggccactgatggaattgacgggcttcactgaagaacaactcactgtccgtgacgccatctcagcgatcacttctaaatttcccaacacctactggcaggaatgtgatcagaatgagcgcgatcccaaagagttccatgccgcgctcgccaaggacggatggttaggaattgctctgccggagcacttgggaggtgctggactgggtcagtatatccatgtttcaactttgtcagatactgcaatactgaccctgaacaggaatctcagaagctacaatgatgatgcagaccatcactcaatctggtgcaggaatggccggtgctcaggccatccatgccaacgtgtatgccacacaaccgctggccaaattcggcaccaaggagcagctcgaggagacgattcccaagatcatcaatgggacatggcggacctgcttcggcgtcacagagcctaa

SEQ ID NO: 2264 - DNA, 783 bp, A.fumigatus
acaggaatctcagaagctacaatgatgatgcagaccatcactcaatctggtgcaggaatggccggtgctcaggccatccatgccaacgtgtatgccacacaaccgctggccaaattcggcaccaaggagcagctcgaggagacgattcccaagatcatcaatgggacatggcggacctgcttcggcgtcacagagcctaacacaggcctagagaccttgaagctcaaaaccaccgccaccaaaaacgcttcaggtgattcctactctgttaccgggcaaaagatctggatcacctgtgcacaagtcgcgtccaagatgatcctgctcgcacgtacgacccccatcgaagaaatcaagcgatctacacacggtctatcaatgttctgcattgaccttgaccgcgacaaacccggtctggacatgcgcaagatcaagaaaatgggcggtcgcgctgtcgacgccaacgaggtcttcttcgacaattaccagatccctacaaacacgttagtaggagaagaaaatgaagggttcaagatcatcctccacgggatgaatgcggaacgctgtttgctggccggtgaggcgttaggtctgggttatgcagcactggagcgcgcgacgcaatacgcgaacgatcgcgttgtctttggacgtcccatcggtcagaatcagggcatcgctcatcctctggcagatgcctacatgaagatagaagcgtccaaggggcagacccacgtattctccataggagacgcgactccagcagttattgaaccccccgat

SEQ ID NO: 2265 - DNA, 189 bp, A.fumigatus
catgctcttgtctgcagcgctaccattgcttccaccttcggtgttgctgctggcgccttcgccctcttcttcttcggtgaagtgccccgtgtgcgcaacgacatcctgcgcaaggttcccttccttgacgagtacttcgaccgcagcatccctgccgaggacaacgtacgtacctttgaatcatgctag

SEQ ID NO: 2266 - DNA, 216 bp, A.fumigatus
tccatcttatgcctaaatcaagagcagacggagtattgtggcagcctggcttgtcctcgctggtctagacctgccggcaataatctagggcttccaccagtaaagcctagccctgccctcgagaattctctagccaaaggactcaatcgcctatctttcttacttgcaggcgattttcgcgttaagtttagaattttcgctttcaccttagaatga

SEQ ID NO: 2267 - DNA, 186 bp, A.fumigatus
gccagctggcgaaatgttcggaatttgaatcaccaacccgttgtggaatcccgaattgccgaccctaagaactcggatagtgccccaggtattccggttaaaggaatacatgctgccttgaacccggcaaactccgttgcccagtatttttggatgaagaccctgaacgaattagaatttccaggg

SEQ ID NO: 2268 - DNA, 1194 bp, A.fumigatus
agacacgcgaacatggatgagattcgtgtgaccatcgaccgcgagtcgggcgagatcagtgtttggaacaatggtcgcggtattcccatcgagattcatgcaaaagaaggcatttacgtccccgaattgatcttcggccatctcctcacctcatccaactacgatgacacccagaagaaggtgaccggtggtcgtaacggtttcggtgctaagctttgcaacgtcttctccaccgaattcacgatcgaaactcaagactcgcgtcagaagaagaagtacaagcagacctggaccaacaatatgtccaagatgggcaaggccaagatcaccgatgccaagggcgaggattacacaaaagttaccttcaagcccgactacgccaaattcggaatggagggtatggacgacgattttgaagctctcgtcaaacgtcgtgtgtacgatttggcaggaactaccaaggtcgctgtcaagctgaatggtagtcgcatcccagtgcgcaacttcaagaagtacatggaaatgtacaccaaggccatccgccgagaacggggcgaagaggacaccaacgccaaggacgaaattatcacctgcagtccagaccctcgctgggaaattggatttgcagtctcggacggctcgttccatcaggtgtccttcgtgaactccattgctaccacctcgggaggaactcacgttaactacattgctgatcaaatctgcgccaggttggccgaccaagtcaagaaaaagaacaagaacggagcgacgctgaagcctgcccaaattcgaaaccatatcttcatttttgtgaacgctctgatcgtgaacccagcattcacctcccagaccaaggagcagctgacaacaaagtcgagccagttcggcagcaaatgtgttcttgaagaggacttctacaagaagatcctcaggactgaagtcatgaacaacatcctgcacttcgctcaagccaaggcggatcagttgttgaaaaaaacggatggtgggcgccgcacccgaatgaacaacccgaagttggtcgatgccaacaaggctggtaccaaggatggtcatcactgcaccctcattttgaccgaaggtgactcggctaaaggccttgccatggctgggcgagcggtcgtcggacccgaccttcttaaccgccgggatgaaaggacatgcgctcccgggaaa

SEQ ID NO: 2269 - DNA, 1131 bp, A.fumigatus
acaaccaggaacggctcccctccctatgtgctctctcaggtcgagaaggcgtctgcgtccgcaaccgagttctcgaccgctttcaacaatttcatcgccgacggccccaacagtccccatgccgagattatccgcactgtgtctatcttctctggttctattgcggatgtgttgagcaatactaagggtctcactcgtttcgccaacgatgataagagtgcagatcagttgctcaatgcggcgcgcaagtcggcccaggcgacggtgcgcttcttccgcggactgcaatccttccgtcttgagggtctagagcctctgcagaagaccgatgttgtgatcaacaacaacttggaggttcagaaagatcttcagtcgttgtcgaaactggttgacgcgtttgcccccaaaagcaccaagatcagtaccagcggcgacctgggcgatctggtggacaaagagcttagcaaggccgccgatgctatcgaagctgcagcagcacgtttggccaagcttaagacgaagcctcgcgaaagcttctcgacatatgagcttcgcatcaacgatgtgatcttggctgctgctattgccgttaccaacgcgattgccgagctgatcaaggctgcgacggaatctcaacaggaaatcgtacgtgagggccgcggcagctcgtcgcgaacggctttctataagaagaataaccggtggacggagggcctgatttcggccgccaaggctgttgccacctcgaccaacactctgatcgagaccgcagacggtgtgatctccggccgcaactctcccgagcagttgatcgtggccagtaacgatgtggccgccagcactgctcagctggtggctgctagtcgagtcaaagctactttcatgagcaagacgcaggatcgcctcgaggccgctagcaaggcggtcggtgccgcttgccgcgctctggtgcgacaagtgcaagacatcattgccgaacgcaatcgggatgaaggggagaccgtcgactatgcgaagctcagctcgcacgagttcaaggtgcgagaaatggagcaacaggtatgtctgattttgtcggatctgttacattgcttttcgcgtgcgtctctttccaagttgctgactcgctga

SEQ ID NO: 2270 - DNA, 444 bp, A.fumigatus
  unsure (11),(12),(13),(17),(18),(19),(20),(21),(26),(27),(28),(29),(30),(31),(32),(33),(35),(36),(41),(42),(43),(44),(46),(47),(53),(54),(55),(56),(62),(63),(64),(65),(66),(67),(68),(69),(75),(76),(77: Identity of nucleotide sequences at the above locations are unknown.
ccccccccccnnncccnnnnnccccnnnnnnnncnnccccnnnncnncccccnnnncccccnnnnnnnncccccnnnccccccnnnnnnnncncnnncccccccccccccccccnnnnnccnnnnccccccnnnncccnnnnnnnnnnnnnnnccnnnnnnnnnnnnnnnnnnnccccccccccccccccccccaccaatggtaatcggggaatgggctttagtcttcctggtacgaaattttgcgcatctctccaaggcgttgacgtgcccgggccagactgttctcgagttgaaggatttcgacctattcaccagaaatcagcgagtcagcaacttggaaagagacgcacgcgaaaagcaatgtaacagatccgacaaaatcagacatacctgttgctccatttctcgcaccttgaactcgtgcgagctgagcttcgcatag

SEQ ID NO: 2271 - DNA, 339 bp, A.fumigatus
atgaagctcatgagatccttccagccccgtggtgaagacaccaacattccgaccattggcgaaaagggctatggctgggagaaactggtgaaatgggccagctgtgtggaagaattgaccgagagcgagaggcaagccactcgactcttggctggtctcatggagctggacccttacaaacgattgagtgccagggaagctttgcagcacgagttcttcaccaaccctattgagcacgatgtggagtggggcggacttcctgaggatagcgcagataccggggaggatgaagaaggcgacagagatgatgacgaggcggatgaagtagcgatggtgtag

SEQ ID NO: 2272 - DNA, 753 bp, A.fumigatus
agcgcgataccttccagccccggcgctatgacaacggcgcaggatgaggatgatggaaaagtgtctctaacgcgcaaggcccatgagggtgtgtcggatgatcctcccgagattgcttcacccgagcattcgggcacttttgtgttgcgcatcatgcctgacgataactcctgtctgtttcgcgcggtagggagtgcaatcatgggaggaatggacactatgaccgagcttcgttcgattgtcgcccagactattcaagcgaaccctgacgtctactcagaggcagtgctagagaaaaaagcagacgactattgccgttggattcagcaggaaaattcatggggcggagcaatcgagctcagcattttgagcaaacatttcgatattgagatctgctcaattgatgtgcaaacgctgcgggtggatcgtttcaatgaaggtccgcccacacggtgtgtcctggtgtattctgggattcactatgataccattgctttgtcgccgtcggatccaccgtatacacacgcttatgcccctccggagtttgataccaaggtctttgatgcagccgatccggtagttctggagaaagcgctggcgttatgtgagattctccagaggaaacattactatacagataccgcaggctttcgcattcgttgcaatacttgcggcggtattttcattggcgaaaaaggagccaccacgcatgcgacgcagacaggacattataatttcggcgaagcaagctga

SEQ ID NO: 2273 - DNA, 207 bp, A.fumigatus
tttcgttttttccataatgattattttcttctcatacggcttggttccatagaagtatcaagccttttctattcacttatgttttttttccctttttttcttttttataaaaaccacattaatattctttttttatttattttattttatttttttttaatctttaacttccgtcttcaccacgaggctgccggatccgcaataagt

SEQ ID NO: 2274 - DNA, 843 bp, A.fumigatus
  unsure (634),(757),(819): Identity of nucleotide sequences at the above locations are unknown.
gttttctgctgttttccagcccttgaacgcctgcatgcgttgaaaagagccggatcccagatcgccatcaactcccgtgaggctgtccgcttcctcgatcgagtcacttccggcaaagataatattcctgccgatagcatcgttctccaaggccccatggagcagtacgagaattgggaagaggcggagaagttctttctgccggagtttgaggaggaacccgaggcgcctaacggagatgacacggaggagcagtcgccccgggagacgccagccgagaagatgaagagcagcaccaagaaaaatggcgcggccccggatgatctgtcgcagatgcttcttaacaagctcaacttcaagaccgaatccgacgccgcgtcgattccctccgcgggtacgcacagcaatcctgcctcatcgccctcgtcgagaagttcgcgcacaagccccgaggactccaatctgcgcacggctgcagacaatagagtaacaaatgaggccactttaaagattgagagcggacatcggcgcactgcctcggggtctgtggttcctacagtcccggtagtactccgtccgcttctcagtgccattctatggcgcctgcacagtggtcccgatgccactaatgcancgaaagcttgtattctcgtcacaaatgataaggtaacgggattgtgggctcaaaagttcggtattgccgtcaagaacatccatcaactacaaacttcgatccagtatgaagaacgagagttcnagaaacgttgcaagttcgttgagaagaatcaggtgtctgaaccgaaatcgttgctcctcgtncgaaggaccaaagccacaaggatg

SEQ ID NO: 2275 - DNA, 231 bp, A.fumigatus
agatcattgagagccatgtcagccggacgcaaggtcttccattgtgccgtggatgaaacggccctaaccaccaacatcagcgaaatcaaaagatggaccacaagcggcgccattaccctcatcgtccctctttacagtaagtacattgatttccgagacgccattcctccgtcccgctcgctcattaggttttctgctgttttccagcccttgaacgcctgcatgcgttga

SEQ ID NO: 2276 - DNA, 462 bp, A.fumigatus
caaggagacccgccgactgcagaagatctacgggcgcgaggagcagcaggtgcgcgccagcagcgtgaaccttgcgcgtcctcctgcgcagccgccgcgtcctccagcacctcctcggcagcagcaaccgcatccccctccgcggccgaatgcgcgatactactaccatcagcaggcaccgtccatgttgcatctgacgccgggcccggttgcgactccgcctcgaccgcactcgacggtgcattccctgcagccgccgcagccccaggaccagggtcagcagccgccgacaaaagagtagtttctttgggttccgacggtcgtcggacgattcgaaggtgcataaaaagcgcagctcgatgttttgatatgatacccgtgcattactggagtgttggcgtaaggcataccgatagcactattgatactactatactcatgaggctcacgcatgtacgctaa

SEQ ID NO: 2277 - DNA, 669 bp, A.fumigatus
cccccacgcttgattttccagccggctggtgaagatgggaaggaacctgtggctgatccgacaggcagtcctgtcaatgttagtgctagcccaacggtacagagtggtgcggccctgcagaatcagaagcctgcggcggtcgccccgaatgcaaaggccaacgacaagcagcctgcatcctcgcgcccagcagagactcaagtcacgaagccaagcccaacgccagcgcccgcccaagccccagctccaacgcagcagcagaagacgaagaagaagcaagaactgtcgcgcaaggaggaggaaaaacggaccaagaaaagactggaagaagaggagaaggctcgtcgcaagcgccaggccgagattgacaaggagacccgccgactgcagaagatctacgggcgcgaggagcagcaggtgcgcgccagcagcgtgaaccttgcgcgtcctcctgcgcagccgccgcgtcctccagcacctcctcggcagcagcaaccgcatccccctccgcggccgaatgcgcgatactactaccatcagcaggcaccgtccatgttgcatctgacgccgggcccggttgcgactccgcctcgaccgcactcgacggtgcattccctgcagccgccgcagccccaggaccagggtcagcagccgccgacaaaagagtag

SEQ ID NO: 2278 - DNA, 423 bp, A.fumigatus
ttttccagccggctggtgaagatgggaaggaacctgtggctgatccgacaggcagtcctgtcaatgttagtgctagcccaacggtacagagtggtgcggccctgcagaatcagaagcctgcggcggtcgccccgaatgcaaaggccaacgacaagcagcctgcatcctcgcgcccagcagagactcaagtcacgaagccaagcccaacgccagcgcccgcccaagccccagctccaacgcagcagcagaagacgaagaagaagcaagaactgtcgcgcaaggaggaggaaaaacggaccaagaaaagactggaagaagaggagaaggctcgtcgcaagcgccaggccgagattgacaaggagacccgccgactgcagaagatctacgggcgcgaggagcagcaggtgcgcgccagcagcgtga

SEQ ID NO: 2279 - DNA, 549 bp, A.fumigatus
tgcacgggtatcatatcaaaacatcgagctgcgctttttatgcaccttcgaatcgtccgacgaccgtcggaacccaaagaaactactcttttgtcggcggctgctgaccctggtcctggggctgcggcggctgcagggaatgcaccgtcgagtgcggtcgaggcggagtcgcaaccgggcccggcgtcagatgcaacatggacggtgcctgctgatggtagtagtatcgcgcattcggccgcggagggggatgcggttgctgctgccgaggaggtgctggaggacgcggcggctgcgcaggaggacgcgcaaggttcacgctgctggcgcgcacctgctgctcctcgcgcccgtagatcttctgcagtcggcgggtctccttgtcaatctcggcctggcgcttgcgacgagccttctcctcttcttccagtcttttcttggtccgtttttcctcctccttgcgcgacagttcttgcttcttcttcgtcttctgctgctgcgttggagctggggcttgggcgggcgctggcgttgggcttggcttcgtga

SEQ ID NO: 2280 - DNA, 297 bp, A.fumigatus
  unsure (217),(223),(249): Identity of nucleotide sequences at the above locations are unknown.
ctaacctggtcgttttcaggcgctccgctcatgtccgatcccgcaatccaggagatggctaagaaatacggtgtttcgcctgccacagtacttatcagctaccatgtcaaccgaggcgttgttgtactgcccaagtctactcaagagaatcgaatcctgagcaaccgccaagtcatccctctctctcccgaggatatggatgtgctgaatggcctgnctgcancaaggaaggcgaagcgtatcaatacncctctgtttggatgggatctcggtttcgatgactggtaccaacagtaa

SEQ ID NO: 2281 - DNA, 366 bp, A.fumigatus
aagcgctggaccttccagccgcgtggtgaatacgagacgagcgagctgctaccggtcaatcccgatggcacacgatccgtcgaccgatcctgggatcagagtgagacctggcgccagatggaggagatctacaaggccggcaaagtgaaggcgattggcgtggccaactggtcgattccctatctcgaggagctcaaaaagaagtggaccgtggttcctgcggtcaaccaagtcgagttacaccctttccttcctcagcatgcactgaaggagtggtgcgacaagcatggcattctcctcgaggcctattcaccgcttggctccgaaggtgaatgcccctggacacgctatgtgcggttcccatga

SEQ ID NO: 2282 - DNA, 1146 bp, A.fumigatus
  unsure (1),(2),(3),(77),(1126): Identity of nucleotide sequences at the above locations are unknown.
nnngatcgcttcaaggagatcacttcttccgcaatatacaacccaagcgccaaacggtttgcttcccagatgacccngacccccaaaggaatccccattaaaaagcccagacagagtgccctttcccgcgcgcaaccagtggaggtgtccgttacatcattacaagacattcaagattaccagatgagggtcaaagtggagagaatgttgaaagtgatgccgcagaaatcggtccaagcttgcatgcaagctcttgtgttcaagcggggaaattatgaggatgcattggatcatctggcaaatacggaggaacgggatgcacctggttcatcggacgatgaattgattacagctcaacaagctgaacagatcgcaccagcgaagcaaaacattaaagctcgagggacaatccaggataagtggtcggccatgaacttgcagaagaacctggcaagccagaaggtccaatcgcagtcgcaaccacaaccgctgaacgaggaagaagcaaagccacggagacgcctgatgagaggaccaaagagtcgtggtatttccccaagtcctgctcgttccgagactcctcccaagaaaaagcctggacgactggtacagggacggaagcagccttcgcccgcacgttcggaatcacctgaagcacctttgatcatgactgacgactctgattctggtgttggcgacgcattggaaaatgtggaatccgagatcaaggttttgaggttcatcaacacgtgtcaggctgtagagcttgcagatctggctgcaacgacagaggatgttgcccaagtcatcatctcccaccgtccatttaggtccctagacgaggcccgcgctgtacccgctccatcaacggagcaaaacacaaaaccaaggggcgccaggggcaggaagacgccgaagccaattggcgacaagatcgtggacaaatgtctcgatatgtgggtgggttatgaagcggtggattctttggtcgctaaatgcgaagcgcttggacgccccgttgcagcagaaatgaagaactggggtgttgatatctttggaaagcgggaacgtgaattggatctggtatcgattaaccaagagtcgcacgattctggcattggggacnccgctagttcggcgttctga

SEQ ID NO: 2283 - DNA, 195 bp, A.fumigatus
cttagcaattaccccattcttttgggtctcttctttggctctttctcgaagcactttacgcaaaatttttccaaaggggttcttacgaatggcgtcgacaaaaactaccccaccagttattctcttgatcgcagacactttgccatccatgaaagcgacaatgtcgttcgcggcagcgtggtgccctggctttag

SEQ ID NO: 2284 - DNA, 282 bp, A.fumigatus
atcgaccacaaaatgagacccaaggctaacgctagttacctgaataggaatgacgacgagcgtcctcgagcgtatattgtgctaaagccagggcaccacgctgccgcgaacgacattgtcgctttcatggatggcaaagtgtctgcgatcaagagaataactggtggggtagtttttgtcgacgccattcgtaagaacccctttggaaaaattttgcgtaaagtgcttcgagaaagagccaaagaagagacccaaaagaatggggtaattgctaagctatag

SEQ ID NO: 2285 - DNA, 360 bp, A.fumigatus
gctaattattatgtctctaacagaaccacctgttcgatattgggctggaacccaagtgaaaagagctatagtgcgtcggttggagagttaaacgcgaactgtgaagcgaaaatcatggccgacgacggagtaacagagtatggacacaaccaacgcggcgagctctgggtgcgagcccccaatatcatgaaaggctactggaagaaccctcaagcaaccgaggaaaccaagacggccgacggatggctgaaaacaggggatattgcatacgtggacgacaacgggaggttccatgtcgtcgaccgcaagaaggttagcccaaacttccccacagaacccatgctgaatgactttggctga

SEQ ID NO: 2286 - DNA, 723 bp, A.fumigatus
  unsure (302),(437): Identity of nucleotide sequences at the above locations are unknown.
tatcgtgacaggttgtcattcgcaagattgatacttaatcacttaactctggttcataatctcttctgggaggaatatacatacgatgcctatcaccgggtagatgtgtctcgagttctggttctagccactaacgctaactcctcatgcagagtcttcttcattcccgcaaacccaaatgcctctacagctctcgcgaccatcacagaacggttgcactccgccgtcgcagaggagcctgttgcaataggccgatgggcattggagcataagttgatgagggatactccctcctgcgtgcntgggtcagggccccagcgacacgctcaccctcgatacatgcaatttctatcgttatcctactaccccaatcacgggttcatctacacctctcagcctcccgagaagacggcgcaatctcccgccccgaatgctgntactccccaaactggactcacccctgctttgggttcagccactccaagcaatgccgcggcagcgggcggttccggcatggttatgatcaccgtgcctctgccttcttccggagctctgttcaagcactttgtttacgcctgccaaccattctggtgccatcgacatacagtagctgtaccggggggcatggtctatgatgttggcgatttccgagtgcgtattggcgacgtgcggcagacgcagcgtcttcaccacggagactggcaggatccgagcttaaggtaa

SEQ ID NO: 2287 - DNA, 957 bp, A.fumigatus
agactcaccaactacagcagtgctgtttttcagcaaaccgactttgcggcagactttactgaatacgacatcatccagaccagtatcaccaccggagtgtcgatactcccatggacgagtgccaaccgctctttcgttcccatcacgatcaaggatccggattctgatgctctgtacggggccaacacgctgggtatcggagcggacctggcatgtgaagagttgtctatcgctgatagtctggttgtgaatccccagaatggatctgcttattgggaatatcagacatttgacgatcccagcaggcactgtaaagtcgacatgagcatgctgcagcatccacatgagaacattacactttccattcactttttgtctcctgtggttaccgaagacgacacgtatgattgtcagacatccactgtggtggttctgggtcggtggaattacactgccgggtcgcccataaccgacaaaaacactattgctctgcactgcgaacccagaatcaagttggaaaactactcgatcactttcgatacgaaaggccaaatccaagatttgagccctattgccggtacagccatcacatctggccccatgtacgacaatgcgaccatcagcgtgggacagttcaacaaggtctttgccgccatcccgcagagctacatcagcaattcgacttatgatcgcaagacatacatcacgtcgtatgactgggccggtgtcctagttgcacgtttgtacaggcgtcgagatccggggtttatggctctaaaccctgatgacctgatggacatgtccagaatcgtctatcagggggtctatagcactttattttaccaatctggaggggggattaaccttcagcccgttggacaaaccggaggctggttcggaactctaagggggatcttcgacccatgggaccatgggaaccggcattcccctctttaa

SEQ ID NO: 2288 - DNA, 1116 bp, A.fumigatus
  unsure (1116): Identity of nucleotide sequences at the above locations are unknown.
tataggataccaaacaacccgggggaacaccaaccagccagtgggattaccggtgaagccggaattggacccatgggaatcggtacaaaaaattctggggaactggccaggcagcatattgatgagcaagccacctctgccattccaggctaccgagcgggcaccagggttgccaagcggcgcaccgcagctctcggacaacggcttcccatttcttcaatactaggacaagatttaccgccgacggagattatgtactcgttgcttgaggactactttgatgctgtccattggttttctctggctatttatgaacctacctttcgcaggaaactcctgtccgtagccgacgggtttgcctatccctcccagaaatcattcttgctgctccttgcagttgtactgggtatgggggcgtggtatcgatctcaaaggaggacgactgactcgaccgacaatggcgattggcaacaattgagtgcaaacctcttgaagatcgtcgagtcgcatgttgttgagttgatggaccaaccttccgtcacagcggcccagatatgcatccttttcggatcacaccacgtctatcacgggcgtccgaatctctctttctccttacttggtgcgactatcaagatatcccaggcggcagggctgcaccgggaactcccgaggggcaactttgaggatattgaagaaaggaaacgtgtatggtggacgatttacacgtgggatcgatttgcgtcgatcacatacggccgaccactaggaatcaacgacaaggactgcaatctcaacatgccggcggatacattcgaaaatccctactttgttgcaccgagatcagagcagggatataccgtctgttactctacttatcaaagggagttgaatcgtctctaccttatggcgtccactgccctggaggtaattttcggctcgcggacatccggctcgtccgaggagctggcgggggacgcatacgttgcgctcgtcaaagaagcgactcaaaaccttcggagatggcgggatgaattaccggagcacctagtcctagacctcgagagggatttcccgcctgacaggtcttcaccacggggctggaaggatcgacggtgn

SEQ ID NO: 2289 - DNA, 189 bp, A.fumigatus
agatacaggcctctatctaacttttttataaagagtactagtattactataaggctagataattccctaatctaccccttcttaagtattttattaaggtatttacacagagcctctagctctagctataatatagtaaatagggggctatatagtagcaacttcctattaagtagctatatcttataa

SEQ ID NO: 2290 - DNA, 198 bp, A.fumigatus
ttgattatctcttcccctgccaagcacgttgtgtgggacaccctccgctcttcagggacaccgtctgatcatagttccgcacctaagtgggcttgcgaccaggaggtatctgtgactaaggctccccctcaccgctccgcgttgagggtgagccacagcgaaaccaccaaccacaccgaatccaccatttttcgatag

SEQ ID NO: 2291 - DNA, 732 bp, A.fumigatus
gacgccaagaaacgtttgtgtggcatccagccattcggttttgtagctgctgaacgcattgaggaactcctggatcccgatcacggcgatctgatcgtcatccaagcccgtgaaagagcccccttcaccggtggctccactccaatcggcgaccttcgccgtgcactccacaccgctgcagtctcgtccggattcaagcccgctcccacggggttcgacttcctatgggtggtggacttccccctattctcgccctctagtgattcggaaccaggccaaggcggtgcagctggcatttcatccacacaccacccctttacggcccctaagaccgccgcagacgtcgaccagctcctgacagatcccacaaaggcggtggccgaccactacgacctcgtcgtgaacggagtcgaattgggcggtggcagtcgccgtatccacgacgcagccgtgcaggaattcatcctccgagatatcctccaaatgaagcccgaaaggctggccgacttttcccatctgctggatgccttgcgggcgggatgtccgccgcatgctggactggcgctcggcttcgaccggctcgtcgctgtcatgctgggcaaggagtcggtgcgggacgtcattgcattccccaagacgggtaagggtggcgatgatgccatggtcaaggctcctagcatgatgacgaaagaagcattagaaacctaccatcttcgtttaaaggatgaatga

SEQ ID NO: 2292 - DNA, 237 bp, A.fumigatus
gaagtcgaaccccgtgggagcgggcttgaatccggacgagactgcagcggtgtggagtgcacggcgaaggtcgccgattggagtggagccaccggtgaagggggctctttcacgggcttggatgacgatcagatcgccgtgatcgggatccaggagttcctcaatgcgttcagcagctacaaaaccgaatggctggatgccacacaaacgtttcttggcgtcctacacgaagacacc

SEQ ID NO: 2293 - DNA, 492 bp, A.fumigatus
ctgggtggcattctctttgcatggcagtttcctcatttcaatgctttgtcctacatgatccgtgaagagtacaaggcagccgggtacaggatgctcgcttggactaatcccgccgcaaatgcccgtgtcgcactacgatattctcttctcatgtttccattctccgtcggtctctggtgggtaggagttgtcggtaatggtttcctggttggaagcacggtggccaatggctggctagtcaaagaggcctacaaattctggcggcaccaaggcgccaacggcagtgctcgacgcctcttctgggccagtatttggcagctgccaatcctccttgtcggtggtctggtcacgaagaaaggtctctgggatggtgtctggaacaatgttttcggtcagcctgtggaagacgaggatgactatctctgggaggatgaggatgaagtggcagaggcggagcgcaggatgatacctgcgaagacgagtagctcgtga

SEQ ID NO: 2294 - DNA, 195 bp, A.fumigatus
  unsure (66): Identity of nucleotide sequences at the above locations are unknown.
gttctgtatcacaatctacttgcacttacccaagactatatcggtgtttctatgagacaactattnacagatcgccccaaaaaagcccgtgagaagagattgggtatcatgtctatcctaatgtacaattcagctgagcggcctgcggcaactgcatcttcatacactcattcatcctttaaacgaagatggtag

SEQ ID NO: 2295 - DNA, 318 bp, A.fumigatus
gtttctaatgcttctttcgtcatcatgctaggagccttgaccatggcatcatcgccacccttacccgtcttggggaatgcaatgacgtcccgcaccgactccttgcccagcatgacagcgacgagccggtcgaagccgagcgccagtccagcatgcggcggacatcccgcccgcaaggcatccagcagatgggaaaagtcggccagcctttcgggcttcatttggaggatatctcggaggatgaattcctgcacggctgcgtcgtggatacggcgactgccaccgcccaattcgactccgttcacgacgaggtcgtag

SEQ ID NO: 2296 - DNA, 783 bp, A.fumigatus
gcccagtctcctcagactgcagccgccgcgaacccacaatttacatatcctgcaccctatgcaggaaccggctctccatttccccaggcggcaagccccgtgtatccaaatttctcaccaggtgcacaagcacagtaccctattcagcatacacctactggatacactccgcagccatatccggttggtactgctccgcaagctaccccaccctatgggacaacgccgcctccttttccgctaccaccgcatcaacaagcttccccctcacacacagtccctcaaactgcgccggcattcccacaacgttctggtagcttgccggccgcacctagcctcccacagcgccccgctttccaacccccgccagttaatgcctatcaaatgcaacaaatacacatgggccaccctcttccgaatgctggagtgcatactgctgttccggatggcggaagggcaccaggagcggaagctgcatcgatatcatcttcagtcaatgaccttgtctctggggcagcgaaggaagctgaccaggccacggccaaagctgcagctagtgcaggtgcaaccactgaagagaagccgtcgaagaaggacaagggcaaaccgacacgcttggtatactctgataatgaaaccagtccggaggaaaagatggctagattgtcaaggtacgcatttgttcctgaccgcagaggagaaacgacacttgaagagctccctgctgctgtagtagtggggactatccgggagtcagacaagattttcgattctgcacagtga

SEQ ID NO: 2297 - DNA, 198 bp, A.fumigatus
gatgcatgtaacatgattatcaacgcccggccaaataacgacttatgcaccgagtctatgcccaagttctccgatatcaacaacactgggtatcttgccatgtttctattactgaccagtacgcaaacagatagctcagcacagtcgtgggtatcgaatgtgtgcggcaatctgatcaggcgacggaatatcttttga

SEQ ID NO: 2298 - DNA, 618 bp, A.fumigatus
cgcggtcgggcagctcccgtggtgaaaaccatggacaaaaatatacttgacggtcttctcgacctggaagatgaattctaccaagagggctataacttgggtgcaactgacggtgcccaggctggttacactgaaggaagcgtgtttgccgttgagaaaggcttcgaaaagtttcttgaattgggaagactatatggcaaagcactcgtctgggcccagaggctcgcagactctgaaatctctcggaattcgtcacaggagagtgacggaacagatacccgcaaatctcagccatataatgagggtgatcttctcttggaaccattcgtatgcaaggagatgctgcctctcccctccagttcacggctggccaaaaacctcgagattctactcgaattagttgatccagcttcgttgcctatggagaacacggaagaagctgtcacagatgttgatgagcgtcttaagggcgctgcaatcaaggccaagcttatccagcgagcgcttggagagcgggagggcgcatcagacatccatcctgacgtcaaggatacccaggtagccggtgatggaacagggagcattgaagatattagttcactgaaggttcgccattag

SEQ ID NO: 2299 - DNA, 1068 bp, A.fumigatus
tatccccgcgatggtcttttaggccgtggtgaagagcaaaaagagtccgctgaagccagaaccgagctcggtctgaccgggaggaagacgatcgtgttctgtgatgagatccatcgcttctcaaagtcacagcaggatgtgttcttaggccctgtagaaagtgggcaaatcacactcattggcgccacgacggagaatccgtctttcaaagtccagaatgctctcctttcgagatgcaggaccttcacattgtcaaaattgagcgacgaggacgtcaagtctatccttgaccgagctttgagagttgagggtcccaactattcaccgtcctcgctcgtagatgatgagttgattgaataccttgctcgcttttctgatggagacgctcgaacatctctcaaccttttggagctggctatggacttgtcgaaacgtcccagcatgaccaaagaagaattgaagcgatcccttaccaagactttggtgtacgaccgcgcaggggatcaacattatgacacaatctcggccttccacaaatcgatccggggcagtgacccagatgctgctctatactaccttgcacgcatgctgcagtctggcgaagaccctttgtatattgcgcggcgtctagttgttgtggcttcagaagatatcggcttggcagacaacagcatgctgccacttgccattgctactcactcggctgtcgaaaagatcgggcttccagaagcacgtatcaacctcgcacacgctacagtagccatggcgctctctaagaagagtactcgagtgtatcgcgccttgaacaatacttttgcagcgttggcggagccgggggttgcgggattgcctgtaccaatccatctgaggaacgcccccactcgactcatgaaagagttgggatatggaaaagagtacaagtacaacccgaattacctcgatggtcaggtagtgcaagactaccttccagagaaactacttggccggaaatttcttgaagaccgagacctgggcactaagattgaccctgatctgatagctcaggatgaacggcacctggagccttga

SEQ ID NO: 2300 - DNA, 786 bp, A.fumigatus
cacaatgataaggtccaagagatatctatagattattcagaatgcgcagaaaaggccccttcttacccagtctcaattgccgaccgagttaagtcatcattcaagtcatcgactggacagtctaccccgacatgggagcgtcgtatagagaacgggactaccatttgtcgattgagtttcgaagtaccggacgatttagggcctcccgttttcctgtactatcgccttaccaacttttaccagaaccatcggcgatacgtgaagtcattggatatagatcagttgaaaggcaaagctgtggacaataagaccatcgacggtggctcatgtgatcctcttaaacttgaccctactggaaaggcctattacccgtgcggactcattgcgaactcacaattcaatgacacaatacacagccctgaactcctcagcgacttaaacccgacggtgtacttcatgactaacaagggcatcgcctgggatagtgataaggaacttattaaaaccacacaatacaagccatgggaagttgtgccgccaccgaattggcatgatcgttatccgaatgggtatattgacggtatccccgaccttcatgaagatgaagacttcatggtttggatgaagaccgctgcgctaccggctttcagcaaactgtcccgcagaaatgacagcgcgcctatgaaagctggctcttatcgcctggatattgaagatcgttcgttcgcgctatgcaatacaccttatcaactggctaattgggctctaagggtttccggttactga

SEQ ID NO: 2301 - DNA, 198 bp, A.fumigatus
acatctcatgccctgaaaaccctcctgattcaacgactaaacaacctgagtctagcacctgtagatgccttatctacagctgaccctcacttaactcgcagtggctcgggtttggtccctaacctaggaattacactggttttggtttcagttagcctactggttatctgcaccagccagctgaaaggacaagcgtgg

SEQ ID NO: 2302 - DNA, 549 bp, A.fumigatus
tggtgcggcaccttccagccccgtggtgaagacgaaccccgcgcctgtcggaggctcgcacacagacgcaaatactcacccattgctagcacacagatctctgaaccgcaccgcctcttcgggaggaagatcgaccatgatgaacccattgacaccggcctccttacaatccttgagcatacgctcctcaccgtaccgcaagacagggttatagtagcccatcagaagcaacggggccttgaggcctctgcttctagcttgacggaccatgttcagcactgtggtgaccgtgacgccattggccagagcctgggtgttggccctctgaatggtggggccatctgcgatgggatctgtgaagggaatgcccagttcgatgatatctgtcgaaatccaacggattgcgttagcattgaggcttcctggtccggggtccgggagtgcgaatgtgagggtgcgcggcggggtaaggagccatacctgcgcctccattttctagccccagaagaatgtcaactgtctcctcgacggtgggatagccggctgtga

SEQ ID NO: 2303 - DNA, 240 bp, A.fumigatus
gctgtttcccgctccccattcacacacgccatggaaggaatcaagagcacttttgccaggtgccaagaacagaagcgcgcagcactcgtagcgtacatcacagccggctatcccaccgtcgaggagacagttgacattcttctggggctagaaaatggaggcgcaggtatggctccttaccccgccgcgcaccctcacattcgcactcccggaccccggaccaggaagcctcaatgctaa

SEQ ID NO: 2304 - DNA, 420 bp, A.fumigatus
aaaatggaggcgcaggtatggctccttaccccgccgcgcaccctcacattcgcactcccggaccccggaccaggaagcctcaatgctaacgcaatccgttggatttcgacagatatcatcgaactgggcattcccttcacagatcccatcgcagatggccccaccattcagagggccaacacccaggctctggccaatggcgtcacggtcaccacagtgctgaacatggtccgtcaagctagaagcagaggcctcaaggccccgttgcttctgatgggctactataaccctgtcttgcggtacggtgaggagcgtatgctcaaggattgtaaggaggccggtgtcaatgggttcatcatggtcgatcttcctcccgaagaggcggtgcggttcagagatctgtgtgctagcaatgggtga

SEQ ID NO: 2305 - DNA, 192 bp, A.fumigatus
ctctgtgataccccctccccccccctccctatcagtcgccatatccacccccccaccatgtctgacctttacgccactatcgaaactccccagggcaaatatgagcagcccttgggtttgtatgttttccccctgcattcaatcgtcacttactctattcttcatgtcgttctaattgcttctcgttcctag

SEQ ID NO: 2306 - DNA, 660 bp, A.fumigatus
ttgcttctcgttcctaggttcatcaacaatgagtttgtgaagggtgttgaaggcaagaccttcgagaccatcaaccccgccaccgagcagcccattgttgctgtccacgaagccactgagaaggatgtcgacattgccgttgccgctgctcgcaaggcattcgagggtccctggagacaggttactccctcggaccgtggccgtatgcttaacaagctggccgatctgatggagcgcgaaatcgagaccctcgctgccattgaggcccttgacaacggcaaggccttcagcatcgccaagctggacatggccggtgctgctggctgcattcgctactatgctggctgggctgacaagatccacggccagaccattgacgtcaaccctgagacactcacctacactcgccacgaacccatcggtgtctgcggtcagatcattccttggaacttccccatgctgatgtggtcgtggaagatcggtcctgccgtcgccactggtaacactgttgtcctcaagaccgctgagcagactcctctgtccgccctctatgccgccaagttgatcaaggaagctggcttcccccctggcgtcatcaacattatttccggcttcggacgtactgctggagctgctattgctagccatatggacgtcgac

SEQ ID NO: 2307 - DNA, 336 bp, A.fumigatus
cgaatgcagccagcagcaccggccatgtccagcttggcgatgctgaaggccttgccgttgtcaagggcctcaatggcagcgagggtctcgatttcgcgctccatcagatcggccagcttgttaagcatacggccacggtccgagggagtaacctgtctccagggaccctcgaatgccttgcgagcagcggcaacggcaatgtcgacatccttctcagtggcttcgtggacagcaacaatgggctgctcggtggcggggttgatggtctcgaaggtcttgccttcaacacccttcacaaactcattgttgatgaacctaggaacgagaagcaattag

SEQ ID NO: 2308 - DNA, 681 bp, A.fumigatus
gtcgacgtccatatggctagcaatagcagctccagcagtacgtccgaagccggaaataatgttgatgacgccaggggggaagccagcttccttgatcaacttggcggcatagagggcggacagaggagtctgctcagcggtcttgaggacaacagtgttaccagtggcgacggcaggaccgatcttccacgaccacatcagcatggggaagttccaaggaatgatctgaccgcagacaccgatgggttcgtggcgagtgtaggtgagtgtctcagggttgacgtcaatggtctggccgtggatcttgtcagcccagccagcatagtagcgaatgcagccagcagcaccggccatgtccagcttggcgatgctgaaggccttgccgttgtcaagggcctcaatggcagcgagggtctcgatttcgcgctccatcagatcggccagcttgttaagcatacggccacggtccgagggagtaacctgtctccagggaccctcgaatgccttgcgagcagcggcaacggcaatgtcgacatccttctcagtggcttcgtggacagcaacaatgggctgctcggtggcggggttgatggtctcgaaggtcttgccttcaacacccttcacaaactcattgttgatgaacctaggaacgagaagcaattagaacgacatgaagaatag

SEQ ID NO: 2309 - DNA, 546 bp, A.fumigatus
  unsure (333): Identity of nucleotide sequences at the above locations are unknown.
cagtcaaagacgcccacgaccaaagtcctcgatgtcaatctcacgggctgtctctacgttgctcgtatcgccagcgtgtacttgcgccagaaccgcccggaaaatgcagatcggtcaattactctcatctcctcggtcgctggattcaaggaatctcccgggatgtttgtctaccaagcctccaatcatggagtgcttgggctgatgcgttcgctgcgtctgtacctgtcgtccccaactcatcatatccgagtcaacgccatctgcccatggatgaccaccacggccatggtcaaaggtgtgcaagaagcttggatgaaggcaaaactaccntgcaacacccccgctgacgttgcgtacattatcgccggtgtcctggcggattcagcgctcaacggcaaatccatgtacgttgaaggtggccgagcttgggaaattgaagcgaacattgatcgactagaacctcagtggttgggtgaagaacagtcacgatctctggcgcaggggcaggcagtgctcggtagtggcatggattgggctcaatag

SEQ ID NO: 2310 - DNA, 567 bp, A.fumigatus
tgggaagctctcttctggctcatatccgacggtgcctcggttctacccgtcaacacttccaagatggcgacaggaggctcgtcagctggcggcaatctggcttccatcatcacacataaagccctcaccctctcgccacccgtacgctttcacgctcagctgctctccgttcccgtcatggacaacacagcgaccgtagacaacaacgagtcctatcgcctgtatgagcacaccccggctctccctgccgccaagatgatctggtatcgcaaccattacctcccgaacatagcagatcgcgccaatcccgaagccagccctctcttttatgatgatgactggtcgcaactgccgccggccttaatcatggtgggagaactggacgtcctgcgcacagagggggagcagtatgcggcgaagctgaggaagacgggcgtgaaggtggatctgcaggtgatgaaggggatgccgcatccgtttctcgccatggatgcggttctcaaggaggggaggcgatctatcaccttgatgtgcgacacgttaaagaggattttttgggagtcatga

SEQ ID NO: 2311 - DNA, 747 bp, A.fumigatus
aaagctgttgaccagcggacattggagaggtatcagagggaggctgaaaagattggcaaaggatcttttgcccttgcatgggtacttgatcagggtaccgaggagagagctcgcggtgtcacgattgacattgcgatgaacaagttcgagacggagaatactgtcttcacgattgtggatgccccgggacatagagatttcgttccgaacatgattgcaggagccagccaggcagactttgccgtgctcgttatcgactccggaaccggaaatttcgagtcgggcttgagaggccagaccaaggaacacgccctgttggtacgaagtatgggtgtgcaaagaattattattgccgtgaacaagatggacgcggtggaatggagccgggaccggtatgaggagattgaacaacagatctcgtcatttttgacgactgccgggtttcaggcgaagaatatcgccttcgttccctgctcgggcttcagaggagacaatgtcactcgacgcagcgatgacccgaatgcgtcatggtacacgggccgtactctggttgaagagctggaggcaaccgaaccttacagctatgcgttggacaagccattgcgcatgacgatcagcgatgtcttccgtggcggcgtgcagaatcctctttcgatttctggtcggatcgatgccggcagcttgcaagtgggcgaccaaattctgactatgcctagcggggagacggctaccattcgaagcctataa

SEQ ID NO: 2312 - DNA, 483 bp, A.fumigatus
  unsure (207),(229),(292): Identity of nucleotide sequences at the above locations are unknown.
acacccccaactattaaccaaaaccagatccgcaaattctccccctcgggacttgtccccctgctcgaatgtcactctctgagctcgaccatgcgcattaatgactcactcgccatctgcgagtttctcgcagagtcaaatccccatctcagcctgtggccgcctgacgcattcttcagaaccatggcgcgcagtcccgcggccganatgcactttggattcgcggcantgcgatacacataccccacaaactttatagtgcagtatacaggcaatatccccgtgcctgagnccgcgaagaaagatatccagcgtctatttacaatttgggataatgcgcgacaggcagcgaagacgcggttggctgagctgggcgagaaggacgacgggttcttgtttggggggttcagtattgcggatgcgttcttctggccggtgctctgggtacgtgcgaactcgcttgtttattgtgtttgctattga

SEQ ID NO: 2313 - DNA, 234 bp, A.fumigatus
cgcttccgcacgtacaatctccctctcgaaggcgccagcgctgatgtggtgaagtggatcgagaccatgtggaatgaccctaccatgcagaagttggcgcacaagtattaccgccaggcggagcttccggagtctcatatggagcggtatgagaatatcttccctgatcgtgatgatatccagtatgcaaggtttccggaggattggaagtttactgttcctggaaagttgtga

SEQ ID NO: 2314 - DNA, 831 bp, A.fumigatus
  unsure (17): Identity of nucleotide sequences at the above locations are unknown.
tcttatacgaagctgcngactcatggccaagtaaatattgattcagaccaccacccttccctgatcgggcttcttcttagcggaccattcttccggcgccaaagtactggaggccacatcctattgtttccgagcgttgagttgtcgcatgaaggtcaccatcaccaaaagggaccatttacacgagtcaaggagtatctggggcaacgccgtagtcgtgtgacaagctgtatcgcaagcgggtgggagaagagcacaaccgcagtgtacagtcgacttccgagccgtatacagaagcccgtgtctgtttgtgctcgcggtatcaagacgttcttccgtggcctatgggacttcatgaaccctccgctgtgggccatgctagtgtcgattatcgtggcatccgtgccgtccctacagcacttgttcttcgacgaagatacgttcgtgaacaattcggtcacccgagctatcaaccagaatgctcaagttgctgtaccgttgattctggtcgtcctaggagccaatctcgcacgaaacactttgtcccaggaagctctcgaagacatgccgcatcccaaggaagagaataaactcattattgcctcgctcgtggcacgcatgctgctcccaaccttggttatggcacccttccttgctctgctcgctaaacacgtccctatcagtatcttgggcgatccgatcttcataatcgtctgcttcttacttactggagctccgtccgctctgcaactggcacagatctgccagatcaataatgtatacgtctcagccatgtcgaagcttctgttccagagctatgttgtttggtaa

SEQ ID NO: 2315 - DNA, 267 bp, A.fumigatus
ctggtgcgcaatcgcacagagatctttggaacggatggcactaagccactccggaacgtctatatggtcggggacaaccccgagtccgatatccgaggcgcaaacagctaccgtagcggaaatggcagcaactggcattcaattcttgtgcgcactggtgtctacagaggaggagagcccgcttggactccaaaagtcatcgttgacgatgtaaaaaaggctgtcgaatggggaataaagtcttctgggtggaaactcacagagtga

SEQ ID NO: 2316 - DNA, 330 bp, A.fumigatus
gatcctttcgactcaccccgccaacccatactagccgtgagccctaggaggggctcctttagagtcacgtgcctgtactcctgtgccttaggtatcagcttatacggttgtcttggaaaggcgaacgaaatgtacttgaaccggttctataataatgctacatgttccgagagcaattcaatacagaaagtccgtggtatctcagatatggacctattaaaacgcaggtctgccaacactacctatatacatgctttgctttcttccacgggcataaaccctaatgcaatgcagtcagttcgctctatagaaaatgaactgtccagttga

SEQ ID NO: 2317 - DNA, 255 bp, A.fumigatus
ttcggggttgaggactatactatctggactatctatcagtccaggcctgctattaatgtcttttctggtttcccgcctccctctctcttccttgtctgcgatttattattgtccgcttctctggctgatgaccccgttagtctcattgtcttctttcaccactccccccccctgttgactatttatttgttttcagttttccaccagttcatttctctctgtcatcggaccacaccatacttttctgactattaa

SEQ ID NO: 2318 - DNA, 540 bp, A.fumigatus
ccggtcacgttcagtccaggctgttttgcgttagatcggattttaggtccaccttcaaaaagccgcctgctttctccccacatcactcgacctgctctctctccccttctccttctacgcctctgcccttcaatctttcctgctggctgctcttcatgccttctcacagcttccctgcagataattctggcacttattcttctgttcatggccgacacttgtattgtgtgcttaggagaccttggcgaaagcgccagcgattctcttgccatcgccgccgaggccgtgccaagacctgaccttcaagtagaaggcaagtcaagtgacgcttctaccaaaacaggcggcgttgatgacaatgaggacgcaggtcaaatcgcccagctacttccttgcggtcatattctacacaataattgtctgaaaccatgggtcgaaagagccaacagctgtcccatatgtcgtcgcagcttcaacctagtggagctgagtgaccgtctcggaggtatgtcctttcacttccacctcaccctcacttga

SEQ ID NO: 2319 - DNA, 288 bp, A.fumigatus
actcccttctccagcacgacgattgtccgaatcctcactatccactatgtacatcaaaccttcccctacatatacacatcgcgattgaccaacctcatacacagggccgtcttctccctcatcatcatcaacaaagccggtggcttaatctaccagcgcgaattccagccgggcctacgcaaactttctacaaacgactacctcgtcctagcagggacgtttcacgggtacgttgcctctaattaccgccgtgccacgggagaatcactttttgaaagcaattgctaa

SEQ ID NO: 2320 - DNA, 207 bp, A.fumigatus
agaaaggtgaagccgagggcagtgaaatatggcctcgatcactggaagaagttctatttgcctgactcgcagctctatgaagctgtaaagctgctccacaaagggtccctgatcagtgcggacaatatcgatatgcctgagctcctggatacttggtttatgtcaaggctgggggtcgaggagggaagggactgttcagtatggtag

SEQ ID NO: 2321 - DNA, 228 bp, A.fumigatus
atgtcttactttctaaaccgacgagtaactctgcagaagaactttgtcgcagatagcactgtctttgatgttggttccttgatcggtgttgttagactgagaggtgtattcacttggacaatgcagaggacaagttggttgacagcaacggttcctcagcaaactttcgttgaaattggcctaattaacatgagtctgtgtgagaaatgctgcaaaactcggtattga

SEQ ID NO: 2322 - DNA, 435 bp, A.fumigatus
  unsure (424): Identity of nucleotide sequences at the above locations are unknown.
aagcaattgctaacagcaaccgtcgtacacagcgtccacgccatcacccgctccatcacccccaaaatccccatctcttctcccctcccaacgacacccgcttcctcgaacgtcgccctctcgtcgccctcaggcacatccaccccgacaccggcggcgtcggcatacagccttcctaatcccggcgcaccagtgacgggcctggagtcgctcgagacggataagttccggttaacgtgtttccagacgttgacggggaccaagttccttttgttcacggatccgctcatggcgaatattgatgcggtgatgaagaagatctacgagttatattcggactatgtgatgaagaatcctttttatcagctggagatgcctgtccggtgtgaggcgtttgatcgacatctaggtggttggttgcggnggaggacatga

SEQ ID NO: 2323 - DNA, 636 bp, A.fumigatus
atagatttgttcggcatccagcaaccgcaatcatacctctacaccagccgatcgaaatgttttgacgtccctggtgttgatgattctgctgagttccgcgatactttgaatgccatgaacgtgattggcatgacggagggtgagcaggatgaagtcttccgtatgctggctgcgatcttgtggatcggcaatgttcaatttgcagaagacgattctgggaacgccgttattacggatcagtcagttgttgactatgttgcgtacctcctggaggtggacgctgctcaggtgaacaaagcctttaccattcgggtgatggaaactgctcgtggaggtcgcagagggtcggtctatgaggttccactcaatacggtccaagctcttgctgtccgtgacgcgttggccaaggcaatctacttcaacctgtttgattggattgtgcagcgtgtcaacgcctccctaactgccagaggggaagttgcgaactcgattggtattctggatatttatggcttcgagatcttcgaaaaaaactccttcgagcaactctgtatcaactatgtcaacgagaagttgcagcaaatcttcattcaattgactctcaaggctgagcaggatgaatacgagtcttcaccg

SEQ ID NO: 2324 - DNA, 1146 bp, A.fumigatus
  unsure (2): Identity of nucleotide sequences at the above locations are unknown.
tngactgtttactccaggatttgggcctgtttcttcctcctcgcgctacagtcaggcatcagtggcaatggcatcaacaacgcctacagcggattcatgtcggctcctcagatcagtactgccaacatcctgtccagtattatcggcggtgtgctcaagcttcccattgcaaagatactgaatctatggggtcgtgccgagggtttcctggtcttcgtcggggtctacaccattggcctcatcatcctggcagcgtgcaacgggcccgactcctacgccgcaggttatgttctcttttggattgggtacgacgcaatctacctgattctcgatgtttttgtagcagacacgtccggcttgaggaacagagctttcactttcgctttcgccagcaccccgttcatctgcactgcgttcaccgcgccgctggctgcttcgtcctttctccgcatgacgacttggcgatgggcgtatggagcctttgcgatcattatgcctgttgcactagcgccgctcgcagtcgtcttcaaacggtaccagctcaaggctgagaagatggggttatatgtccgccagccgagcggtcgcacatgggcacagtccgtggcccactatattcatgagtttgatagtatgtcgaaccagcatcctgtcctcagcataaacgagcttcagctaacatcgttaccagtcatcggcgccttcctgttgatggccgcttgggtgctgctgctgctgcccttcagcttggccagtaacggtcgcgcagaatacaagagcgcggcctttatcgcaatggtcatcatcgggttctgcttgttctttgctttcgccgcctgggagaagtggtttgcccgcgtccatttcatcaattacgagctgctgaagcagcgcacggttctgggcgcctgtgtcatggccgccacactctacttcagtttctactgctgggatctttacttttataacttctgcacggtcgtttacaacctcaacgccgccatgactggctatatgacccagatctacaacgtagggtcatgcttctggggtgtcgtcttcggcctctgggtgcggtggacaaagcactttaagcacacctgtctgttcttcggcttgccgctgatgatcctgggtgcgggtttg

SEQ ID NO: 2325 - DNA, 237 bp, A.fumigatus
agacaggttcctcctggtgctgtggccaatgctccagagggtacaccgaaaggacccgaaacaaacgatcaacctgacatggattcatcaagactgagtctggaggcccgtaatgagaaggagatcgagcaacatccgaatcaggtcaccgcggatgctcatctgggtgttcagaaagtcgaagcggctgcgctggtctggagcaagaaggcagtctgggcaacctacgcctggtaa

SEQ ID NO: 2326 - DNA, 324 bp, A.fumigatus
  unsure (321): Identity of nucleotide sequences at the above locations are unknown.
aatgcaccctcaggacctgagactcaccatcgcttccatcatttccgacagcgaaagaaagttcttcaccgtctatgcccacaatggcaccgtcagcgtggtcgagcccgagaacagcctcttcgatccccaaatgtgagctactccaaaatcccgttcgcggtcagagaacattggcttattgttattgaccctagtatcttcctgtacttcttcctcctggcttgtttcgctggtaccgtctacttcctctacaccatctggattgcgccctacttccctcagatgcgcaaggctggaaatgctgccgacttctcccantaa

SEQ ID NO: 2327 - DNA, 435 bp, A.fumigatus
gacactaccgagaatacgcaggacatccccgaggttcaaaagctcgctgtatcggcggaggcttccttcccagcttccgagatcttcggcgttaagcttgtcaatggtcacccgacccaggcattgatcacttttaccaatgaagaagctgctcctgtgaccgtcaacttcgtcggaggatctttgtcgactctcgatgaaaagagccagattgttcgtaacctgactgccactagatatggcattgagatccccgctggccagaaggagagtgttagctacagcttcgccactgaaatgcaccctcaggacctgagactcaccatcgcttccatcatttccgacagcgaaagaaagttcttcaccgtctatgcccacaatggcaccgtcagcgtggtcgagcccgagaacagcctcttcgatccccaaatgtga

SEQ ID NO: 2328 - DNA, 192 bp, A.fumigatus
aacagctggatgcgtatgcaggggcatttcctactcccgtgtacgtgggtgctcacaaacgccaccatcttgggattcctgtgcgcaatcgccacagcgaacccggttctcgcgcgtgctcagggaacagctagtgggaaggtggcattggatcgtttatatgcgcctatggcgccgataggctggcgctga

SEQ ID NO: 2329 - DNA, 513 bp, A.fumigatus
taccacaacttcccagcgcgacttacagagcgtgggtatgaaatcaaatatgaggaaggccttcaaatcggatacagacatcctcagtcccagcgcactgcgcagtggcaattcggccacgggttgtcttacactaccttcgaatactcgggactcaccgtcagtggccagaagatgacggaggaggccggcgattctgacctgaaaatctcggtcagggtcaagaacactggtatctaccccggccatgaggttgtccagctctatatatctcctccagacagcacgaaggtgtggcgtcctgctcgcgagctgaagggttatgcgaaagtatggatacttcccggggagtcagaaacagtgacgatctccctgaataagaaacatgcattcagctactgggatgaggatgccaaacaatggcggctggagcctggaacatatcgccttcttgtaggaccgttttcgaccccctttgagattgagcacagtttagtgtggtctggacggtag

SEQ ID NO: 2330 - DNA, 1065 bp, A.fumigatus
gaaccatttggactgaacactgggcgaactttgtatgcgccattcaagaaagttggaccctgcccccaaggaagggcaccccaggaggagagcaatatccgggactgccccgcaggagggtgcctcggacacaatggggacgtgggcgcagacttcctcccatacacgtcagccgttgggtacgatacagcttacacccttcgagaacacttgaaagaactcctccttgatgtcgccaactacatacgagaacgagcaatcgccgccggcgcaagcgaggcggataccccacacatggtgcttcgattcacaggaggatgggtgagggacaagctgcttggagtcgacagtcatgatatcgatgtaggaatcagctccatgactggttaccagtttggcatggccctcaaagattatcttgacattcctgaaaatttggaaaagtacaagcgcaaccaccctaatgggcacatgaaggaggctatcgtcagcctgcacaaaattgaagcaaatccggaaaagtccaaacacctggaaaccgtaacaaccaagatctttggtttcgatatcgatctggttaatcttcgaaaggagatgtacacggatgatagccggaacccacagatggagttcggcaccgccgaagaagatgctttgcgtcgcgatgcaacgattaatgctcttttctacaatctaaacgaatccaaggtggaagacttgactggacgggggttttcagacatgagggacaagattatccggactccaatggagccataccagaccttcaaagacgaccctttacgtgtgctacgactgatacggttcgccagtcgcctgggctataaaatcgatccaaacactgaaagggcgatgcagaacagtgatattagtgtggcactaaaactcaagatcagtagggaacgcgtggggacagagttggagaagatgctcaaaggtctgcaaaatccagttaggtttgaaacagagccgcatgttaactttgggtcaggacccgatcctcgaggcgcgctgcaactcattgtgtccatccccaggggctga

SEQ ID NO: 2331 - DNA, 717 bp, A.fumigatus
gctaaaggtcctgaaggtccacctttggggcctaaaggttcttccccccttggcaggcaagtcccgggaacccagttcatcgacgttgctaccaaagctcttgttggccgcgatgtgctgaagcccgtggatctcatgactgagaagcgtgactacctcgctacgaaggtgccccagttcagctggactcgtcttgccggtgccgatcctttcctcggtgttgagatggccagcaccggtgagattgcttgcttcggcaaggatctggttgaggcctactgggcttctctccagtccaccatgaacttccgcgtgcccgagcccggcgagggtatcctgctcggcggtgacatcaacaacccggctttggctcagattgttgactacctcaaccctctcggctacaagttctttgctgctagccctgaggtccaggctcacctacagtccgctaccaaggacaaggtctccgtgcaggtgatcgagttccccaaggaggacaagagagctctccgtgaggtgttccagaagtacgacattcgcggttgcttcaaccttgccaagacacgtggcaagaccctcctggatgaggactatgttatgagacgtaacgccgttgacttcggcgtccctctgttcatggagaccaaggtatgtggcagttcacttccttcaaccacgtgcacctgtatcatgtgtactaatcgtctatattag

SEQ ID NO: 2332 - DNA, 594 bp, A.fumigatus
  unsure (581): Identity of nucleotide sequences at the above locations are unknown.
ggcagtcacatcctcactagccttctcgaaaatcctgctatagctcgtgtggatacaatctcccgtcgcactccatctgctgctgctgcggcaccacagacaaaacttaccactttcgtatctgatgatacatcccgttgggctgctcaactctcttctctcaccccaactccatccatcttcatatccgcctttggcactactcgggcggcggctggtggattcgagaatcaatacaaggtagagcatggcctgaatgtagaaatggctcgcgcagcgcgcgacgccggcacgaaagtctatgtcctgatttcatcaggcggggctaataaggcgtcgtctttcgcgtatcctcgtatgaaaggggagattgaagaagacgtgaaggccctggggtttgaaagaacggtgattttgcgccctggtctgatatccggccaacggcaggagagtcgaccagcggaagcagcactccggttcattgctggcattgccgggaaagttcactcgggattgaaagatgggtgggctcaagatgcagacgttattgctcgcagcagcggtcaatgcaggtctcaaanctctgggacgtga

SEQ ID NO: 2333 - DNA, 393 bp, A.fumigatus
  unsure (26): Identity of nucleotide sequences at the above locations are unknown.
agatggctggaacgaactcaccaccngagaagaccaacttcttcgttcagttcatgggttatttccgtggtcctattctctatggtatgttaccaatttgtccagggtggaggaggactgccctttccgagagacaatgctgatgatcgtcattgtccagttatggaattggctgttcttttggctgctggtcttcgtgactggattgatctgggtgtcatttgtggtattcttctgctcaacgctgtcgtcggttggtaccaggagaagcaggctgccgacgtcgtcgccagtcttaagggtgatattgctatgaaggctgttgttatccgtgatggtcaggagcaggaaatccttgctcgtgagctggtcactggtgatattgtgagttga

SEQ ID NO: 2334 - DNA, 657 bp, A.fumigatus
ttcccccttccattacagatcgttgttgaggaaggtaccgtcattcccgccgatattcgcctgatctgcgactacgacaagcccgagatgttcgaaacctacaaggagtacctcgccactgccaacgatgacaccctcaaggagaaggatgatgacgacgaagacggtggcatcgaggcccgtgttggtgtctccctcattgctgttgatcagtccgccatcactggtgaatctctcgctgtcgacaagtacatggccgacacttgctactacaccactggttgcaagcgtggtaaggcctacgccatcgttaccgccaccgctaagcagtccttcgtcggcaagaccgctgctctcgtacagggtgccaaggaccagggtcacttcaaggcgctcatggacgacctcggtagtagtctggtagttatcgtcatgttctggattctcgccgcttggattggtggtttctaccgtcacctcaagatcgatactcatgagcacgaggacaacaacctgctccactacaccctcattctcctgatcatcggtgttcccgtcggtttgcccgtagtcactaccaccaccctcgctgtcggtgccgcttaccttgccgagcagaattttcaccacgggggggcacggctccgcgctcagaga

SEQ ID NO: 2335 - DNA, 666 bp, A.fumigatus
gggagtcgtatcctaggccattgcctggtaagatcgtcgtcagccatggtgatctcaacgaagtatatatttgccctttgcgtcctcttgctgaccttctcactctctagcgcctacgaagatcccctcgtcgagctcgactatgggcagttccagggcaaatatgactctacgtataatctctcatacttccgcaagatcccctttgcggcgcctccaacgggggagaaccggtttagagcccctcagccacctctaaggatcacgcatggcgtctatgacactgatcaggactttgacatgtgcccgcaacgcacggtcaatggctccgaagactgcctctaccttggcctgttctcacgaccgtgggatgctacagtggctccctcgtctgcttctagaccagtcctggtagtcttctacggtggtggcttcatccaaggcagcgcttcgtttacactacctccgtcctcatatccaatcctgaacgtcaccgagctgaatgactatgtggtcatctaccccaactaccgggtcaatgcatttggtttccttccgggcaaggcgatcaagcgatctccaacgtctgatctcaaccccggcctcttggaccagcagtacgttatacaagtggtgagttttgccccacggggccgaaatccggtg

SEQ ID NO: 2336 - DNA, 915 bp, A.fumigatus
agcgcggatccttcgagccccgtggtgaagaatttctgctccctctcactccaacccttctcgcatccggtttgcacaccatcaggaaccatattcgacctaaccagcattctgccctggattaagaaacacggtacaaatcctgtggacgggtcgccgttgaagagctccgacctcatcaagcttaatatcgcgaaaaacgagtcgggcgagtatgtcgatccggtcacgtacaaggtcttgacggacaacacgcacatcgtcgctttgcgcaacacaggcaatgtttttgcatgggatactgtcgagcggttaaacatcaaggggaagctgtggcgcgatcttgttacggatgaggagttcagccgcaaggatataatcacgctacaagacccgcagaatatcgagtcgaggaatctgagtacgttcaattatttgaaggagggagagagtgcgttgactgagcaacaaatacgggaacgagaggatccgtcgaataatgtcaatttcaatgcgttgggaaatgcggcgaagatcctgaaggcgaaggaagctgtagcgaaggctcgtgccgagagggctcagcgcgccgagtcgggtgccgcgtcaaagggtttgacaaagccgggtatgagtgccacagctgcgtcgcaaaagaccgtttcacaccaggctgggaaacctattccgtacaatgcggcaaggcatactactggtctggccgctgcgtcgtttacaagcactggtatgacgccgcatacgtcggccgagcttgcacttctttcagatgaagagtacatgttaaaacgagggcgagttaagcaaaaaggttatgctcgaatctcgactacgctaggcgacgtgaatctggagttgcacactgagtatgcgcctaaagccgtgggaatttcgtct

SEQ ID NO: 2337 - DNA, 756 bp, A.fumigatus
cccggggctgttgttgaagaggatattgttctcgggcctcccaaaactgcttttgcatctgcatctcgcacaccgggtagcaaaagctcggtagatttcacggaccgttcctcccgtcaggtcgagtctgatgaggcatcgaacgagcgcttcaacctgcgagacaagttcttcaaggacagggagaccggagatagagactttgatcgccgtgatggtaaaccaacgccgttcaacggtcgccgtggggaaagagaagaatggaacaacggacggccgcgtcgtacctttggccaagaggatcaagacagaaagcccagacgcaatgtagaatttgaccgttggaaccgtgatcaaagggagcagaatcctgatcgaggagtgaccgagaaagaagctcaatttacccctcggaaagatggtacgccgggtcgagccaggcatgaaggaagctggtttcgcaatgacaacgtccaagacggaccagagacagaagacgagaaactttcagtgcggaacagagattggcgtcgagatagacatggtgcagatcgcgactggaatcggggagccaaatttgaacaggatcctgagtggatggacacgaatgacagagacgagtcgcgtaaggtgcatacgcaagaagattttgagcgatggaaagagcgaatgaaggctggctcttcgcaagcacaactggaggagaagaaagaagctccctccgatcttcaccgccgggcaagaagaacaagcgct

SEQ ID NO: 2338 - DNA, 282 bp, A.fumigatus
  unsure (45),(170): Identity of nucleotide sequences at the above locations are unknown.
gccaccaacagagagcctgacaggtcactggctaacgtccccagntgggaagcaatgaaccatccggaccgtccgaaacaccccctgatcgttcggaatggaaagctggagcccgcatcctgggacgaggccatgtcgctgatcgtgcaccacacgaaagacgttcaaanacgcctgaccaaccatggaatcggtttctacaccaccggacagctgttcctggaggaatactatgtccttgctatgattggcaaggccggcctgaatacactgcacatgtag

SEQ ID NO: 2339 - DNA, 1098 bp, A.fumigatus
  unsure (491),(547),(744): Identity of nucleotide sequences at the above locations are unknown.
agggacggcaacactcgcctctgcacggcaatggcagctgccagtatgcgcgagtcctttggcagtgacggccagccgggatcatatacagacatcgacttcaccgattgcatcttcatggtcggacataacatggcaaacacccagacagtgctgtggtcccgtgtgttggatcgcctggcaggacccgatcccccaaagctagtggttgtggatcctcgagaatcggagacggccaggcacgcgacagttcacttggcgccaaagggtgggaccaatgtcgcgctactcaatggattgcagcacttgctgttcgagaacggctggttgaatgaggagtgggtggaacaacacacagttgggcgacaggagttggaaaagacagtggccaaatatacccccgaatatgtggagaacataacgggcgttcctgccgatatgctgaaagacgccgccgagatcatcggcaccagtggtagtctcctgtccantgccttacagggagtttatcaatcaaaccaggccaccggggccgcttgccagatcnacaacatcaacttcttgctggaacacattggcaagcccggcagtggtattctccaaatgaacggccagccgactgcgcaaaacaatcgcgagacaggatgcaacggcgagtatccagggttccgcaatttccagaacgagaaacacatgaaggagatcgccgacgtgtggaagattgacttcgtgcagacgccacantggaaccagcccacccacattcaaaatatgctcaactatatcgaggatggcagcatccagatgttctgggtgtctggcactaaccccttcgtcagcctgccccatctttaccgcgtccgagagctcctcaccaagccagagctgttcttggtggtgcaagatatcttcgtgaccgagacggccgccattgcagatgtcgttctccctgccgcacaatggggcgagaagacgggctgtttcaccaacgtcgaccggaccatgcatttatcgttgaaggccgtagacccaccaggggaggctcgagctgaccttgacatttgtcttcaaccacgggggctggaaggaaccgcgctc

SEQ ID NO: 2340 - DNA, 483 bp, A.fumigatus
ggggctgtcgggggacgtataactcgtagtccatatagaagtagctggtctcctcgccaaaggctcacaccacgctccatatcgcatcttccaattgactatggagatagaaagcaaaaggacagcgtcgtgttccaaaccgcacgacaatggacccctggaaatcgaactggccaccggccaggtcatcatgggcctgccggacatgcccatgaagcgcaagttcagcatcctcagcatcatcgccgtgggctacaacatctccaacagctgggtcgccatcgccgccagttttgctattgccgtgcagtctggaggggcggtgtcgttgctctacggcatcgtcgccgtcactattgccatgctgtgcactggcgtcacgctggcggagctggccagcgtctatcccacggcaggcggacagtaccatttcacctctattctggcatccgagcgatggagccgccatctgtcgtactttag

SEQ ID NO: 2341 - DNA, 609 bp, A.fumigatus
ctcgtagtccatatagaagtagctggtctcctcgccaaaggctcacaccacgctccatatcgcatcttccaattgactatggagatagaaagcaaaaggacagcgtcgtgttccaaaccgcacgacaatggacccctggaaatcgaactggccaccggccaggtcatcatgggcctgccggacatgcccatgaagcgcaagttcagcatcctcagcatcatcgccgtgggctacaacatctccaacagctgggtcgccatcgccgccagttttgctattgccgtgcagtctggaggggcggtgtcgttgctctacggcatcgtcgccgtcactattgccatgctgtgcactggcgtcacgctggcggagctggccagcgtctatcccacggcaggcggacagtaccatttcacctctattctggcatccgagcgatggagccgccatctgtcgtactttagtggtctcgcggccgtgttctcgtggattacactcgcggcgtcgatcgcagtggcttcgacgcaggcgctgatggcggtggttatccgctgggcagccagagtatgtgcctcaggcgtggcattacttcctggtgtatcagctctttaa

SEQ ID NO: 2342 - DNA, 183 bp, A.fumigatus
tggcggtggttatccgctgggcagccagagtatgtgcctcaggcgtggcattacttcctggtgtatcagctctttaacatcgccatggttgtccacaacatctttctcaccaacagaaccctctgggtgtataatgtcggctgtaagttcccctccgttctgacctcgccattcgtcgactag

SEQ ID NO: 2343 - DNA, 549 bp, A.fumigatus
acttttgccatactgacattgcatccaacagttctcctctccctcggaaccttcctcaccatcaccgtcacctgtcccgcccgctcccacaccacggtcgactccttcgccatctggacgcagttcatcaacggctccggcggctggcccaacggcatctccttcctgaccggcctctccacgccgcagttcatgctctccggtctcgacgccaccctccacctagcagaagagtgtctcgagccggagcgtatcgtccccaaggccgtgctggtaaccgttgtagtcggctttctcaccgcgttccctttttccattgctatcatctacagctaccgcgacgtggagtcgtccctgtcctcgccgacagggtgcgtcgcttcccttttcctgcataattacaattacagccacttactccgtcttagattccccatctacttcatctgggaaaaagccacccgctccccaacagcggccacagttttcatggccgccctcgtcgtcattttttgttttcaccacgggccggaaggaccgcgaatgcgc

SEQ ID NO: 2344 - DNA, 249 bp, A.fumigatus
ttgcatctctggcatgggaaatactccgtcgctgtcaagaacgtcggcatacaagcgttccgcttcctcaaggcaagaagacgccagagttggctttccaaccctgagccagaggtcagccgcaaggatgctccacatcccagccttcctgcgacgaccgccccatctaactccggtcagtggtggcctaaaagcataacacgccgagattctttcgctgaaaaggatctgccctatcccgccgactag

SEQ ID NO: 2345 - DNA, 1041 bp, A.fumigatus
ccgataccagaaccacttgttgagcttgacaccgaatatcgcccatacctctttgactcggacgtgatggctatccgggttttcgttcgggagttagtcgatcagtcaatcgttccgtacatggaaaatagagttgccgtttggaatgatcaggtggcatctcgaaggcgcggtattagtggccgtttcatgtcgatgtcgcggaaatgggcagggttcggttatagctcgcgatctggcattaatggctccggtggtgggaactatgattttgcgcgcggattttacaaaccagacacgcctgaagcgatattgcgaaagatggctgactttgctttcatgcttcgtgactggaagctatcagcatccacgtatgagctcctacgttccgactataccaacgataaggcttggagatatcatgccggtgctcatgagatgtgcgcagtgagtacgctgctgaacccaatggccatgccagcgaaaccgagactcgaagccatcgatcagatgttggaaacggcttgctattcgtacctcacgaggtgctctgatgcccccaacgctctgcgttgcctatgcttagcgatggaattgctgaagtctcgtggcgggtttgcaactgaaagcgcggctaaatgggccatgcgggccatggacctaggtctagtcggcgggatagggcagatccttttcagcgaaagaatctcggcgtgttatgcttttaggccaccactgaccggagttagatggggcggtcgtcgcaggaaggctgggatgtggagcatccttgcggctgacctctggctcagggttggaaagccaactctggcgtcttcttgccttgaggaagcggaacgcttgtatgccgacgttcttgacagcgacggagtatttcccatgccagagatgcaatcattcgttgataatctacgacatacggtgaaagtcgaatatcttggtgctcggggcttaggccctcaggaggaagtatctacgactgagcagcttgagcagctggaacctgaagacacaagcgaa

SEQ ID NO: 2346 - DNA, 720 bp, A.fumigatus
  unsure (180),(221): Identity of nucleotide sequences at the above locations are unknown.
gcccattctttgcgttggcccaagggcagtaacaaccagtcccatttagccagtggcattaccaacagtttgcagaatacagcccgtttcctcaattcagccttctttggcactcagcaggacaaggcggctatcttctccatcatccaccgctaccatgcccgagtcagggcagaggantacgacgcaaatgacccggagctgcacaaatggaccgccgntaccctgttcgtcgctgtcgtaatcgtccacgaaaccttcttcggggagttgccccgggacaagatggaagcactttaccgagagtctgcggtatttggcacttccctgcggatgcctcccgagatgtggccaaccactcttgccgagttctgggagtactggaaccacaacatcgagacattggaggtcaccgatatggcacggaaactgagtcgcgatctcctctatccggtccatctccctatgtggatgagagtattggccccattgtcgcggcttttgactatctattttctcccggaacgactggccaaggagtacgatctgcaaccgacaatgctgagtcggatccagtttcaggccactgttcgtgtcatgcgcattgcataccctagtatgccgcaacacctgcgacagacactacataggcaatacatggaagatctcgggaaggcagtggacaggataagaaagactggacactgggcgggagtatag

SEQ ID NO: 2347 - DNA, 291 bp, A.fumigatus
caacagccagagcttgcggtcaacatggaacaacacctggattggaaacctgatttaccgttgcccagtattgaggatttcattgacccgaggatccttgaagatcgcacatgggagccgaacttcgagctcgccgaaaccaagtctacttcgtcagctggcagccaggatgtcctgtctttaagctcggattttgagactgatccgaaatatgagatgctcagatctgaagattcggaaatagatgactactctctatcggattatgtgagtgcggatgctagccgttaa

SEQ ID NO: 2348 - DNA, 309 bp, A.fumigatus
aaaccaggtgacttgccagacaaaccgcacgatatccctccccctaaatcgccagcaactgtgaacgatcatcctctaggcctcaatgcagatggcacattctcgaaaactggaacgaaatcgggacagcaggtcgaaggatccgcatttcactcgcttattttctcctttacgatgatcgtggtctccgagattggcgataagacttttttggtggctgccctcatggccatgcgtcatccacgcttgcttgttttctcggcggcattctctgctgtcttcaccacggggatggaaagagccgctcca

SEQ ID NO: 2349 - DNA, 651 bp, A.fumigatus
agacgccaggaatttctcatcataaccatagcccatactgcgccccgggacacccacagcaagctcgtccaggcagctgctaaggctggtgttccctatatcatgcccaatgggtacgctggcgacattgaccacatcaaacttggcgaggacacgctgctggggcccgtggccaaggctaatcgggatgagattgaggggctcggcatgcagtggatcacggtgtgctgtgggttttggtacgattacagcttggcgggcggagagtcgcgcttcgggttcaactttggcaagcgttccctgacaatttacgacgatggcaacaccaagatctctacttcaacgttatcgcaggttgggcgcgctctggcaaaggtgctgagcctgaacgagctgcctgaggacgaaaatgacaagagtcttactctgtcgacatttctcaacaagggcctgtaccttgagagctttgtcgtcagccaaaatgacatgtttgagagcgttaagcgcgtcactggcaccagtgacgctgactggacgataactcatgaggaacccaagaaaccatatgaagatggcctggcgttagtcaaacgtggtaacatggcaggttttagtaagctgctataccccagggcgttttacccgggatga

SEQ ID NO: 2350 - DNA, 453 bp, A.fumigatus
ctttttatgcaacagccaataatctccaactccaagactggagaccttctgagactccatccagttgaacccgatctcctggacctcctcggaggtatctctacatacaagatcgagtacacgtcggtcgacccggacgactctactgtctctgccaccgcatttgttgcctttccatttgtccagcgaggtagcccattcaatattgtcgcttttgcacatggaacgtccagcatatttcgaagttgcgctccatcaacctcctcgagcctccatgattatgataccgtgattcctttgctatcttcaggatatgttgttgtcgggactgattacgcttgccttggaaacaactacacgagcctagaatatacatccgctagggctaatggtattaagtgtaaaatctgtagatgttgtttctatgacgccatacgctcaggacggcgctga

SEQ ID NO: 2351 - DNA, 288 bp, A.fumigatus
cacccggatctcgcccgtagtacgagggaagagcctcctaagcttggattcctgctcatcaccatcagatacctttccgctctcagtggcaacatcatcctgaacgccagcgtcacttccatcctccatccgtttaatatgtactctacctctagcttcgtccgcaccgataatcatgccctccacaaattcaaagtcgcggcagaaagcctcgaccgcttcttccgtgacactttgaacgaaactggcgctctgcaggtgcttcaagttatccgtagcatccattag

SEQ ID NO: 2352 - DNA, 315 bp, A.fumigatus
tcttctgccggcatgtgcgcactgttgcatctcgtgcaactggacatcattcatgagattttgcacatcatggatgaatatactgtcgtcttgcaaattccgggcattgattgcaccttccaagcattgttgcaaatcatgatcgagctgctgaattgctgggtcaatgcgcctgttttcgtctgttggtcgattctccataattttaccggaaatgtattcgggaagcatggtccgaaaatctgttataacattttcaagtcgagcggtcactggatctgcgaatacagccgtatcaagactcgaaggtggtaa

SEQ ID NO: 2353 - DNA, 771 bp, A.fumigatus
agtacgttgttgatggttacttcgatgtatgtggcgatggctaattcgttgaaacagaacgaccaagcagaaaatggcccggccgaggcaggtcacgcagatgaggctaccgaggaaaacaaacctgccgaaggacatgcgacggaagagccccagatcccccaacccgcggatgaagggatgcctcaggcacaaggcccgacaccgatgttccccaatgccatgggattcaacatgggacccagcgcgtttccaaatatggcttggaacaacgccagcggcgatttcaatcccatggcccagtttatggctaacggcatgttcaacttccccaacccaatgggtaggtccctcctcatctgtctctcaaaacatccaaacactgacatgatgacttcagcaatgtctggtatgggaatggacccaatggccgcgaatcagggtatgcttggaggctacgggatgaacatgaatggcatgaacagtggcatgaatatgggaatgaatttcgacgctagtcaagggatgtatgggggatgggacggctctcaaaacaatatgtggaatggaggccaagataaattcaatccaaatgctttcgcaaatggtatgggcccgcagtatgagggcccttctggatttggcggatataatatgtctcaacccaacggagttcatgctcaaatgcagcaacaacagttccctagccaagattttcagaacgggtactatggccccggttatggcagaagcaatttccgaggccgcggc

SEQ ID NO: 2354 - DNA, 882 bp, A.fumigatus
aaggggttggttcccagacccttaagcgaaaaacaaccgccaattcgggttgaaaccggccggcacaccttgcaaacgattctccgccaaaaaaaacaatctcggaagtccctgtatctgatcaaacccggcggtattcaaggctacgtcggagcagtagcgtcctatagatcttacaccgacgtcgttgctaagacggacgtctatgttggctttctcccacgggcgtccttggagcgcatcgcggagcggtatccgatcgctctgctgacgcttgcgaagaggctgacaagtatccttccacgcctgctcctccacatagattttgctctcgaatgggtacaggtgaatgccggccaagttatctaccgccaaggcgacgagagcgacgcaatttatcttgttttgaatggacgattacggtcagtccttgaaagtccaggcaacaaattagccgtcgttggcgaatacggccaaggagaaagcgtgggtgagctcgaagtgatgaccgagtccactcggccggctactcttcatgcgatccgtgataccgagttggccaagttcccacgatcgctcttcaacagccttgcccaggaacacccaggaattaccattcaggtctctaaactgattgcgcaacggatgcgggatctagtcgaacgcccggtgactgagaaaggcgtcgaacgaagcaacgctggcagtgtgcaaaccgcaacctcgaccgtcaatctccggaccgtgggcattctgcctgtgacagctggcgttccagtggtcgaattcggtaatcgactattgcacgctcttcatcaagttggagtgacggatggggttacagtcttcaccacgggggtggaagtatcagcagtgatcagt

SEQ ID NO: 2355 - DNA, 216 bp, A.fumigatus
  unsure (38),(113),(117),(144),(147),(158),(208): Identity of nucleotide sequences at the above locations are unknown.
ggctttctcaattgcaacgagttgttagcttttcaggngaagaacactggacttccaattggcaatcttgtcgtccaggcgggaatttttttagtctacccagagctcccccntggnattaacgcggttgcgaagtttcttgcnagntacgtgatttntaaccaaccgatcgcgaacatgaccttcaagacatgtagctcggttactnatcagtag

SEQ ID NO: 2356 - DNA, 258 bp, A.fumigatus
tactggcgccttcatcccgccaattggagatcctcttcaactaacctttgcttacataactgggtttctgttgtggacgtcattgcggccccagcgcacacagctgcgtctgatgaatctatatcagacaagtttcacggccggcaaataaattcgaataatgagatttttggagagaagtacatgcttctcttagagccaagttacaacaaaattaaccacgcaaaatatccactcccgcaaatttgcactccatga

SEQ ID NO: 2357 - DNA, 228 bp, A.fumigatus
cttacattaggagcactcgcaaagccgcgcgatggctcttggcccttactgtacaacactgtcgctgcgataggtgcatttgtcggtggaacaaaagcgaccaactgcgacattccgctatacaaagaagcctgcaaacaccttacgatggatgtccttgagaagggatccctgagttatgtgcaggccatagtcctgatggccaactatctgcaaaagcggaattaa

SEQ ID NO: 2358 - DNA, 303 bp, A.fumigatus
cgcaatcatcggccaaaccaaagtattaaagaaacacaaggcacatcggtcctcaacttgcgcagtagaatggcccctcggaaacgcaagaccgcagcgatcccaagcagcgatgatggcaccacacaacaaccgagcaaacgcgaaaagctggacctgtcacgtccgcatcccaatgcgcaacaggccgagaactttggcatcgtgctgcgagaattctatccgccggaaatgagcaacgagcggtgccaggcctacaacgatggaaggctggaacgaccgatcgagacgctccaacgggcc

SEQ ID NO: 2359 - DNA, 672 bp, A.fumigatus
  unsure (14),(137),(265),(339),(346),(422): Identity of nucleotide sequences at the above locations are unknown.
tccacctgcccttntcgaccacaatcttcatccaccaagaatagcagcgaaatacccaacagccacgcggagatggtggcgttcctgaacctctgcttccgcgctttggccgaactgggacagtctttcgagaacgntaaacgtacccgcgatttttttgtcagcctacaacgcaggtggcaggcccacctgcgtcggtctggttccggcaaaaagcgccaagtcagcaaattactcccgcagcaatctgccggatcgggacccngaccatccaccgagtccgatccctcgagaaaaaaatcccggatatccgcgccgcggaaccataagcaatcctcntatcctntcccgccagcaccttcatcaagcatgccttctacccacaatctctttcagctgcggccccactccaactcacagtntcaacaccccccacaccagtccctaagccaatcccaatcccagcgtttcggcgcctgccaaccgggcgacctagactggatccgggactcggacttccaactcctcgccgagaacctaggggatggccgactggcgcagatggggacgggcaatcagttcgaaggggagaatgtcttgcccagtctatctgatatcgagccgtggtgggactcgcccaatggacatactttcgggggttcttcattatag

SEQ ID NO: 2360 - DNA, 357 bp, A.fumigatus
tgggggggggacacgcttagcgcggcaccttcgacccccgtggtgtcgatggccagcatgcaaatggctatctctgcatataaaaatcaaaaaattaaatcaaaatcaaaggctgctgagatatttggggtgcctgaatctacccttcataagtggcttagtggggttaaaccatatatagaaacatgcgtaaatagccacagaatgacagttatagaagagaaatctcttattaagcatctcctagatacagataagcaggggttcttaattcagcctaagtttttacatagaatagcacagattctgctgcaagcgcatacttataatcctactactacccttgatgttaactag

SEQ ID NO: 2361 - DNA, 222 bp, A.fumigatus
aagcttactaatagcgcaaatagctggacaacagataagataggccttaagtggctaaaggaggtctttaaccctttttctcacctacatttaactggtgcaaagcaattacttatacttaatagccattcaagctatcaaactgctgagtttgatgatttctataaggagaatataattatctgtctttatatgcctccgcatacatcttatcttctttaa

SEQ ID NO: 2362 - DNA, 384 bp, A.fumigatus
  unsure (361): Identity of nucleotide sequences at the above locations are unknown.
cagctgctcctcgccattccacacggcacattcatcttccaaaagccccccgtctacgggtggtatctctccgtgagcgctgtcgggctcaacgtctcctggagcctgcacaatgtcattgcctggatgaaaagcaagccgttctatagtcgcaatgtctccatggcatatatcgctagtgtggtcgcggtacaaccatactggctgctggagatctatgccaactttgcatatttcaacaatatcaaccgcgtattcgaagtgacgcgggcaatggaacccgtcctcccgtccgtaatgaacccgaattctgcaattcctggtcccaattcctgttattttgaagaatcgaccaacgcanaaggacggagccctgttcccaat

SEQ ID NO: 2363 - DNA, 447 bp, A.fumigatus
ggaatctccagtcatcgatgtcgcccgcccgacgcagcgccagtatcagtaccacggccactgctaccatcgccatcgttactcaagccgccatttccgggtccaccacggtcaccgtggtcgccgtcgctatcgtcatcactcgacccatcgtcgccggatatggagccattggaggcactgctgtcgggatcatcatcaccatcaccatcatccatcgcgtccgtctcgtcatgtccggtcaacagacacagcagcgcaagcccggtaagtcttctctcttactcccccgcccggcaccactatcctttgttgcggctaataatacatcagagaacacggccacactcaggcgttcgatgcgcccacggaagcaggtccggtacaagttttgatcagaggggggggggggggggtggaggggggttggccgctaccattgtttga

SEQ ID NO: 2364 - DNA, 480 bp, A.fumigatus
gagggaataaaagaaatcaagcaacggatcacacatagcagtgcaatacagaaaatggacggtcagaagacaatgaacgggctaaggaatctccagtcatcgatgtcgcccgcccgacgcagcgccagtatcagtaccacggccactgctaccatcgccatcgttactcaagccgccatttccgggtccaccacggtcaccgtggtcgccgtcgctatcgtcatcactcgacccatcgtcgccggatatggagccattggaggcactgctgtcgggatcatcatcaccatcaccatcatccatcgcgtccgtctcgtcatgtccggtcaacagacacagcagcgcaagcccggtaagtcttctctcttactcccccgcccggcaccactatcctttgttgcggctaataatacatcagagaacacggccacactcaggcgttcgatgcgcccacggaagcaggtccggtacaagttttga

SEQ ID NO: 2365 - DNA, 1200 bp, A.fumigatus
tgccattactcctcactctctgtaccagctgataccctctcaactgcaaatatgagcttccaggtaccttatggatcgagtccgtcgacaccagacaaatctcggagctttctcagcgacatctcggcaactcctggaggtgctcctccttccgcaaccaagtccttcactcctcgaggccctcctccatccaccatattcggaagctctcagatgagctcaagatcgcagctagattctccccagtcccttttcaccaaatccggagggatcgatttcaatgacagcatcttcaattcctcggtgggatccttccatcagccagcaccgcgagccaaaaatgctgcctcagggaaaccctccgcgcagtcgcagtctcttttcagtatgacgaacaatactcgatttggcgaatcgacccgtttcggaatgtcgaatggctttaattcacaaatgaatgcagagaccaaggctgatgacgaacaaatgatacccgaagaggaagacgatgtccaggaggaggatgaaatggacatgggtaacgccgcacaccgattgagcttcttagactcgcagtttggcaattccacacaggcgcagcttacgtcgcatgttcaacgaaagtcaatttactcaaacccgggcaatgccaaacggccgaagctcgacgaaaaatgggctcaacaatcaccgctgcgcaagggtaaattgtctccaaagaaggactccccaattccctcgatcgtagggaacttcgcctctcgagctgggcccgcgtcggtcaacgagccaagtgacgtgatcatcagcaccgaagacgaaatgtgtcgaatgtacgacgaagtaagacaatctgagtttacgaatagagacattcaaattattctctccgaggtgtgcagcagactcacaaattcatggaagccatccatggagggaagccttgtccccaaagcacctggcgcagggacggacattggacctggggatcgtgctcctgatgttgccaaggccagctttctcggttctttactgcttcaactccatcatccgcctctgtcgacccccaagcaagggagcctcagcaataatttaggatttgcggctccccggagtttagtcgtcacggcctcaaaatcggatacgcctacgccaagacccaaggtcgtctttacacaggggtcgaaggagccgcgctaa

SEQ ID NO: 2366 - DNA, 264 bp, A.fumigatus
atgtgtgtatctccacgtgtgataagtctagatagctgcatatgcagatgcaagtgtagatcgtatgcacctaaccttaagcacagtcgcagcgcaactgagccggctacatactatgtattctgtacggagtactctgagggtgactccaccatttcaaatcaggagcggcgatccacctgcccagtggaacagtgcccaaactctatttccggacttgagttcggccccgctgcactgaatccactaacctattgtagttag

SEQ ID NO: 2367 - DNA, 312 bp, A.fumigatus
gtcagcatcatcgctttgaaggacaaccagatccgtgtcgtccaggcaagcatgctgggcagtatcctgtcgaacatcctgcttgtgctcggatgctgtttcttcattggtgggctccggttttccgagcagactttcaacagtactgtcgcgtccaccatgtcctccatgatgacggttgcctctgcttcgttgatcattccggccaccctctacgcctctctgtcaccatcccactccaaaactacgacggataacaatatcctgattctatcgcacggtattcaccacggggtgccagggccgtgcatt

SEQ ID NO: 2368 - DNA, 717 bp, A.fumigatus
ttccggttaaatcccgaacatttcttttttcccattttccaaagtcttttccttggcctctttccccatacaaaggcggcacttctttttcatttcttgcccatcaattccgccggaaaaatattgaggcgaatcttgttaagaacctggcttattggattcggtcgattcctgatccagcagcggcaggggattttccgttcagccttccgcaggcactcgtggggtcccaaaaaaagcagtatgaccgggttctcttcttctccaaacggggctggggagcccagtgagcgggatgctttgatcaatgatatcccccgcatcaattcaggcatgagccaacatcggcgccacaaacgtggaccacgctggctgaacatcccagcgcaggtcatgcacttgacctgggagaccctcgtgcgggattacgtcaacgtgctgctcgtgtttgtgcctcttggtatcatctccggtgcgcttcactgggacagcacggttgtcttctcgttgaacttcctggcgatcatcccattggcgtcgctgctgagctttgcgactgaggaactggcggctactatgggacaggcgttggggggactgatgaatgctacattcgggaacgcggtcgagctgattgtgggtttatccgttcgagtcgtttcgtgtttaacgatagctgacttggaggacaatggtaggtcagcatcatcgctttga

SEQ ID NO: 2369 - DNA, 648 bp, A.fumigatus
ccgggtcaaaagtgctggatcagtgaggagtatgaagccgtccgtctgtggacacattacatctggattttcctggccgaattcggcacggtctgtctgtacgccgtcatgtggttccagttacgcgcgcaaatcaagcaatccgcgattctgggaagcaaccacacggccagtctgaagcgtctccgtcgagtcatcgggtacatggttatctacccaatcgcctacattgtgctttcacttccgctggcggccggccgaatggctaccgctcggggcaacacacctagtctggcttatttctgtgtcgccggagcgatcatcaccagttccggtctggtcgacgtgctgctctatactctgacgcgtcggaacctcatcctcgaatccgagccgagcgaagaccacagctacaaccgcttcgccagcagcaagaaccgaaggaacgacaaccacctgaccaccatcaccgccgatcccaagcacacccgcacagacatcagcgtcttgcgcacccggagaggccacgacgaggaggaagatcacgtcgactcgccgacgcgcgacgggtcaacagacaacatcgtccaaccgggcgtcgaactggcccccatggttttcaccaggggtggcgagcaacgtcggcga

SEQ ID NO: 2370 - DNA, 765 bp, A.fumigatus
ggtccgggcatgcgcggttgctggtactacgtcaagctgcgacctgggctcgagtcgttcttgcagaatgtctcggagcttttcgagttgcacatttacaccatgggtactagagcctacgcacaacatatagctggcattatagatccggaccgtaagctttttggtgatcgcatcctcagccgcgacgaaagcggcagcctgacggctaagaatctccagcgattatttccggtagatacaaagatggttgtcatcatcgacgaccgtggagatgtctggcgatggagccctaatctgatcaaggtttctccctacgattttttcgttgggattggagatatcaactccagtttccttccgaagaagcaggagttaggaggagtcgtccagcctgcagaacaggacgccaaaggaacgaaggagctaccgatgcaacaacctcccccaaatcgtgcgatcgcaaagcctgcagccgaggtttcgacgctggagcaactagtgaccatgggcggtggggacaatccaaggttactgcgagaacagtgcgtcgcgcaagaagaaacgatcatgcaccaggtcgaggaccgcccattgctgcagaagcagaaagagctggatgcggaggatgaggcggcagaaagcggtgattctgcctcgagcgtggaagacactcaagattcaaccaaacacccgacatcatttattggaggacaacgatcgggaactcttcgtactggaagaacgactggagcagatacataa

SEQ ID NO: 2371 - DNA, 225 bp, A.fumigatus
tcgctggagattcttagccgtcaggctgccgctttcgtcgcggctgaggatgcgatcaccaaaaagcttacggtccggatctataatgccagctatatgttgtgcgtaggctctagtacccatggtgtaaatgtgcaactcgaaaagctccgagacattctgcaagaacgactcgagcccaggtcgcagcttgacgtagtaccagcaaccgcgcatgcccggacc

SEQ ID NO: 2372 - DNA, 207 bp, A.fumigatus
taccgaaaatcatgtgcaggttggataatcatactcaatactcgagagatatatattggtgactctttccgaagaatgtgcatggcttcttacaatgactccttgaatattggcacgcatcccaatactgctaatacttctgggtatccggttaaccaaaattatagggattactggaatacatggaccaatcgtcattgggtatga

SEQ ID NO: 2373 - DNA, 864 bp, A.fumigatus
cctgtgcaatctttcttgcaactagaaatcatttccgcctacaacctcctggtgcacctggtgcaccaggcctccaacccggatattttcctctcccgcatttgcacctacctcgccaaacctatcaccacctcgcctcagtttggccccaccctcgccatctccatcctgaccaccatcttcaacactctcgctcccaccgactccagccgtttccacgtcctcctggccatcgtcgccgtcattcgccagtccggctcttcgtacgccttcgaggctctgaagccgcagctggccgctcagctgcccacctggttgtctgcctgggagttggatgacgaggatgctcagaagctgcaccttgctattgccgatgccgctcaggcttcgggcgatcttgaattggcacagacccatgtggtgcaggccctgcagacaatccccgccaacgagtcctccagcaaggaagcgcgcgacctggccgtccgtgccttgacctccgccctgaagagccccgccgttttcgatttcacttcgttgaccgctgccgatgccatccaggctcttcgctccagcgacagcaccctgttcgagttgctggagatcttcaccgctgacactctggacgcctacgaggatttcatcgcggccacccctctcgaaaccatctctggcggtgttctggtcgatggcgccgaggctctgcagaccaagatgcgcctgttgaccctggcttcgcttgcggcttcgactccctctcgctccctcccctatactaccatcgcctcggcgctgcgcgtgcccgttgaagatgtggagaagtgggtcttcaccacggggctccaaggatccgcgacaatgcgc

SEQ ID NO: 2374 - DNA, 843 bp, A.fumigatus
gcgcattgtcgcggatccttggagccccgtggtgaagacccacttctccacatcttcaacgggcacgcgcagcgccgaggcgatggtagtataggggagggagcgagagggagtcgaagccgcaagcgaagccagggtcaacaggcgcatcttggtctgcagagcctcggcgccatcgaccagaacaccgccagagatggtttcgagaggggtggccgcgatgaaatcctcgtaggcgtccagagtgtcagcggtgaagatctccagcaactcgaacagggtgctgtcgctggagcgaagagcctggatggcatcggcagcggtcaacgaagtgaaatcgaaaacggcggggctcttcagggcggaggtcaaggcacggacggccaggtcgcgcgcttccttgctggaggactcgttggcggggattgtctgcagggcctgcaccacatgggtctgtgccaattcaagatcgcccgaagcctgagcggcatcggcaatagcaaggtgcagcttctgagcatcctcgtcatccaactcccaggcagacaaccaggtgggcagctgagcggccagctgcggcttcagagcctcgaaggcgtacgaagagccggactggcgaatgacggcgacgatggccaggaggacgtggaaacggctggagtcggtgggagcgagagtgttgaagatggtggtcaggatggagatggcgagggtggggccaaactgaggcgaggtggtgataggtttggcgaggtaggtgcaaatgcgggagaggaaaatatccgggttggaggcctggtgcaccaggtgcaccaggaggttgtaggcggaaatgatttctag

SEQ ID NO: 2375 - DNA, 228 bp, A.fumigatus
  unsure (110): Identity of nucleotide sequences at the above locations are unknown.
accatgacactttccacaccaggaggaaaagcagcagccatgacactcggtccattactgccgattgtgctccggcatctgggccctttgtatgtcttctggaccttgtntatctcgttgttttctaatgcaattaccaatcgattttgtccgtcaactgctatctccgcgttctccagtcaactctacaccaacaccgagattgattgccacgaaccaccgggctga

SEQ ID NO: 2376 - DNA, 195 bp, A.fumigatus
agtatgatccctatgtttgccaccttcatcaatgcagctcatgcccagtatgaccccataaggctttgctcctatttctccgtcagctccgatgggaagttccttttacatggacaatgcggaacccaggctgtgcaattctgcgcagggttggtggctggtgttgcttttcctgagagaatcctgttaatgtga

SEQ ID NO: 2377 - DNA, 975 bp, A.fumigatus
  unsure (137): Identity of nucleotide sequences at the above locations are unknown.
cagggatatacaactccacccagatgtgacttcgacacggttcgaatcaacctcactgtgacctttagaggtcgacaatatgatcgattagcgatcatgtaccttggggatgcagaggtattccgtacatcgacagntgaaccaaccacgaatgggattgtctggacatacattaaggagatgtctcactacaatgcactgtggaaagaaccgcaaaagctaatctttgatctgggtaatctgatatccgatgcctacactggcagtttcaatgcaacacttactgccgtcttctcccaacggggcactactattagaacagcggacatgattttgccaatatcagcgcgcaaatcagcagctaatgcatcgagtgccctgattgtgccttcagacaatgtagagatagcctaccgattgccctccaacacttcccgtgctattgtgtcgatttctgcttgtggacagtccacagaggagttctggtggtctaacgtgttctcacccgacacagaatcatttgtcaacacggttggcgaactctacgggtattccccctttcgtgaaattcagctctatatcgacggtctgcttgccggggtcatctggccatttccaattatcttcacagggggagtttcgcccggcttctggcgcccaatagttggaattgatgcttttgacctgcgacagcccgagatagacatctcaccatttcttcctcttctgactgatgggcaaaaacattcttttgaaataaagatcgtgggcttggaacttcaagcgaacggaactgtcagactttctgattccgtcggcacttactgggtggtcacgggaaatatctttttgtacctcgaggaggatgcatcgcattcaagaactgatcaatcgagcgtgcctcaaataaccgcgccgacaccacagttcacaattacacggcttctcaccaaaaatgcgacaggcgctaacgat

SEQ ID NO: 2378 - DNA, 285 bp, A.fumigatus
cataccggacttctagactatgctgccccggaagtactgcaaggcaagtcttacagaggcaaggagcaggatatttgggcactcggtattcttctctacaccatcgtctacaaagaaaacccattctacaacatcgatgagatcctggaccatccgctccgaataccatttttgccgttctcggaggaatgcattgatctgatcaaaaagatgcttgatcgcgatgttgacaaccgcttgacgatcacagaagttatggagcatccatggatgctttacaactga

SEQ ID NO: 2379 - DNA, 225 bp, A.fumigatus
gctacaacgcttcctgcacttccgactcgcgacgagattcttttcttttggataacagctgggacaaacctaggaattaagagttctatataccgacattttttcgctggaagaaatatggcgacatgctcttattacggttttctttttatgaaccactcatccacaacccttgcgtctaacccacctatggtttttgtttcttttcgtctgcgctcttgttag

SEQ ID NO: 2380 - DNA, 528 bp, A.fumigatus
gaagtcaaactcgctcgcttaaagaagaacccgtccaagaaggtcgttttgaagtacgtcacaaagaagcggattctggtggacacctggactcgcgaccgtcggctggggacagtgcctctggagatccacgttctcgactaccttcggcgtgacggcctgaagcacccgaatattgtcgagatggaggggttctttgaagatgatgtcaactactatatcgaaatgatgccccacggtcttccgggaatggatcttttcgattacatcgaactcaaggtgaatatggatgaggtcgagtgcaggaacatcttccgacaggtggtggatgctatccatcatcttcatacgaaagcgctggttgttcatcgggatatcaaagacgagaatgtgattctggacggcgaaggcaggatcaaaatcatcgactttggaagcgctgcctatatcaagaatgggccttttgatgtctttgtaggaactattggtaagtccatcaccatgctgctcctaacggttatcgtctag

SEQ ID NO: 2381 - DNA, 798 bp, A.fumigatus
  unsure (32),(40): Identity of nucleotide sequences at the above locations are unknown.
ccctcctatgcgttgatggcgggcgcctggcnggatgaanacgcagggggtgccgcgtccaagtcgtccttgatcactcgcgacgtgcccaccaaaaccattacctgcgaagtcaaaagtgacgatgagatctatgaatggattgacaaaatctacgagcgttgccctggcatgggaggtgtgagcaatccaacaaatttcagccaccgtgtccatgtcggctttgatccgcaaaccggcgcctttgtcggcttaccccctgagtgggagaagctgctgaccgcgtcggccatcaccaaggaggactataagaagaaccctcaggcggtgattgaggttctagagttctactccgatatcaagatgcgcgaacagaacccgcagtactacgctggattggccggtcctccgtccggtcagcagtcgaagcccaacaacaacaacaacaacaacaactcggtaggcagcttgattgctcctccgaggccgccgcctcctggccctgctcagcgattagacaacggtcactcgcagacgagtcgctcggcaaattcgtcaccttcgcagagggcggagtctgatcgtgctttggaccagcagcagcagctcgagagaatgaaggagatggcagaacaggagcgtcgacgcgtggaagacgagacccgccgggctcgtcagcgcgaagatgaacagaacaaacttgatcaggaagcgtacaatgcctccatccctaagactcgtgttcccctggccaagcaggagcttgggcggttacggcggcgacgcttcgatggctga

SEQ ID NO: 2382 - DNA, 516 bp, A.fumigatus
actgttcagcgcccagctcccgctccccctaatacttccagcaatggcagcgcaaagaattcgcccaacgctcgttacgctccaaatgatccacgttctcaggcggctcgcgcccatggcaatggcaccaaaacggcacagggaccccctccatccaagcttcccgcgcccgtgcaggctgtgaaaccgttgaacattgcgaacaagcagacgacacaaaaaggcaatgttccggacagtgttcgtcaggccgaagctgcactgaccaagaaggctgaaccacgccacaaggaggtccgcatgtcggcaatgtctgaaaatgaggtcatggatcgactgaggtccgttgtctccaaggataatccgaacgagtcatacagcaagcaacgaaagattggacaaggagcgtcagggtcggtgtatgtcgcgcgtgttaaggagcacgctgtctcccctgtcgcacgggagctctaccggcaatatggtcttcaccacggggctggaaggaaccgcgct

SEQ ID NO: 2383 - DNA, 198 bp, A.fumigatus
agtctcgacaacagtctagacaagatcagcaagccacttctgcccactttgtaccggctgctgtccaagtcccgtactcatatggcttcagataacaatgctaagtgccccatcgtctgcactgaggaggcagcacagtatgatgtccaccctacagttcctgtgcctaatgggcgtgcacgccagggaaacaattaa

SEQ ID NO: 2384 - DNA, 945 bp, A.fumigatus
ggcttgggtgatagcgtcgatgcatatcgcaaattcagcgggcgcgctcatctcagtacccgcaacgtcgtctcgaataaaatggggacagtgttcaagacagcctatatgctcacaataccggagcttctatattccatcaaacgagcctggtccgggggcgtcaacatggtcgtcctgcgcgggtacacctattctggcaattatcacaatacgacatggcctggatatgcggccttcaattttgaggtcagcgagatgtggaatcaattccaaccggcttggattcatatgaaggactacctggactacatctcgcggaatcaatacgtattgcagcaaggccgtccacaggtcgatttggcgctgtacctttacgagaccccgtggagcgccgtagacctgcttcattcgaacaacataactgctgctggtaggctctcattgatgtgtttcaagatggagctgacgttgatgacaggctacacttacgattatgttgcgccggataacctcgtttcaccgcaggctactgttcgagcaaaagtccttgctccagacggaccaaactataaggccctggtttttgcgtcgcccgaatataatatatctactttcaatcttgttcgggaagatgtggcggcacgagtggtcaagtttgcgcaaaaaggactacccgtggtatttgttggcggcctcccgcaggtgacatcaaatagtcaggctgggcagattgtggaggacgggtggcgtaggctacgaaacttgccatccgtccaatttatttcctcacttgcagatctccccggtgacctgagtaaggcaggagtcaggccagatgttttgccaagctgtactacgggtacactgcgcgtggtgaagcggtccaggcccgacgacgaggtggactacgtctttgtgcataacgatcagctgtataagcag

SEQ ID NO: 2385 - DNA, 891 bp, A.fumigatus
  unsure (845): Identity of nucleotide sequences at the above locations are unknown.
catacttggcaatcttaccgggatcggtatttgaaaagacttcgtggaaagtcacgtccagggggcgagtcagcgtccacaggtcaggctcccgctgagccggggagcactacgagacagttccaagtccctggccctgccccggcaaagtcgcatgagagatgtgagaatgcacctgcgactacgaagaagatagacgccaggaaaagaaaaagaagtcttgatggcgacgaaccagaccggaccgaaggtcaacgaacagatgatcgaccaaagaaaaggccagtaccagcaactctacctgagaaaagcaccactgctgcccgtcatagggtacatgaggagcatcccacccataccgagccagaggtagctacagcttcgaaacgtacagatcaacaaagaaaggaagaaccgaagccaaaagataagggaggtaccactgtggtacaagtccacaaaactcaacagctaagtgaagccccagatagcatccctgacaatttcctgtttgagctaccgttcttcccctcaagtccggagtctcaagaagagccccctcaagagcaagacatcgacacatggatcgacgaccgtctgcgaacaggcagggcagataacgaagagcaagtgattgaggctctacagtgcaccagcatggacccacgcttagccgacaaggtcctagaatatcttgctgcaggaaaaggcattcctgaggacatgcctggagtttggacacccgaagatgatgaatgtgtggaagtgggcgacagccgagccattgaacgagtcttgaagaagcatggatcagaagcgttcgaagcacggtggaattatcttancatggccagggccgcaagcctttctggaggaggtatgggcgactga

SEQ ID NO: 2386 - DNA, 357 bp, A.fumigatus
gtgggcgataagcgcggatccttgccgccttcgtggttgaagacggttcagagcctgggagtccatccgttactgaatcagattcgcatccggttcatcgacctcgactcggcctgtcccctgctgaatccgtactttcagctttcggggaatttatgcaccggcctctggagcgaccggattctgtatgcgctgaatgagttccggccacaggcgcgattcgtcgagctccgagacggcatctacccgcagtacgggccgaactcgcagatcgtcggggccgtcctgcctcgcgcacggcccctgagtatacatgcctgcgcgtacaggatcattgcggatgctgggaagccttga

SEQ ID NO: 2387 - DNA, 246 bp, A.fumigatus
  unsure (32): Identity of nucleotide sequences at the above locations are unknown.
ccccaaacagcaccttcgtgtatctattccgntgcggggggcgccccgcaccggcgtttggatcgttcgcttttcatccggcagatgctcccggtcggtgttcgtcatccccgctcgtacctggggaagaagagtttggctgggacgatgctcgcgcagacatttgcgtttgtgacttttaacaaggtttgtaccagccaggtgcgttcctttttcgttgtccatcttccgattgagacatgctga

SEQ ID NO: 2388 - DNA, 255 bp, A.fumigatus
ggtgttcgccagggtaacatgatcaggagtggatccaggtggattttcacacccaagttgttcggtgccgccacagagggtggcaccaatgtgttggaggtcaagtacttcaagcgcaacgcgtatttggcgcagagcccccaattgtacaaacagatgtgcattgcgggtgacatggagagcgttttcgagattgctcctgtcttccgtgctgaggacagcaacactcacagacacctgactgaggtatgctaa

SEQ ID NO: 2389 - DNA, 693 bp, A.fumigatus
tccttctttttaaagttcgccggtctcgatttcgagaagacattccgcagccattaccacgaggtcttggagtttgccgagaacctcctcgtcttcattctcagccaactcaaggagcgctacaaggatcagattgccattatccagaagtcgtaccccaaggctggcgacttcaagcttcccaaggatggcaaggcgctgagacttaactacatggacggtgtggctctgcttaaggaagccggagtcgatgtttctgagcaggagcgattcgagaacgatctgaccaccgcaatggagaagcagttgggtcagatcattcgcgataagtacgacaccgatttttacgtgctggacaagttccctatggccgtccggcccttttacactaaggcctgtccccaggaccccaggttctcgaactcttatgatttcttcatgcgtggcgaggaaatcatgtctggagcgcagcgtatcaatgacatcaaggagctcgaggagtcgatgatcgcgaagggcctcgatcccaagcaggagggcttcgaagattacctggctgctttccgccagggctgtcctccccacgcgggtggtggcttgggcttgaaccgtatcgtcatgttcttcctgggcctgcctaatgttcgtttggcaagtctgttccctcgcgacccccagcgcctgcgcccttaa

SEQ ID NO: 2390 - DNA, 261 bp, A.fumigatus
gccactcctcgtcgtactatttcctgccgtcaactgacctccgtttctctgtctcagcaagtggaagagactgcattccagaccgtggaggcactggctaccttcgttgcgcgcatagtcaccgtgcagtttgccaacgaacgagtcacagtgagggtcgagaaacccagcgccctgtcgtttgtggagagatctggaatagaaatcacccgctcccaggcattcttcgagaaatcagatctggaaggaggaagggtatag

SEQ ID NO: 2391 - DNA, 387 bp, A.fumigatus
ctgggctctgttgcacagaggagacttccctgggaatcaacaactcaggcgtctgccactcttgctctagtcaaccctgtgctgtggtatctcattgaccgcacaaaggcaggcttccttttgtcgaccgtggtgggactagccggaacaggtgtggtgctggggctcaagccggagttggtcccagcgtccgcagacactcctgcgactaccattcctctgttgaatggcactgtcctggaatatgggctgccgacgggcctcacacaagagggtgtttcggtccgcatatggctcgcaagtgttctcttctgcgcctgcgtctgctttggcaacgtcggccgacaacttgccattggaggaacaggcagagatcgactcggttaa

SEQ ID NO: 2392 - DNA, 219 bp, A.fumigatus
  unsure (12),(136),(139): Identity of nucleotide sequences at the above locations are unknown.
ggttccaaatanccgcagtacatgattaacgcgctgatcaagaaaccggaaactttggaggcttccgtcaaggtagagaaaagcgctccgatggcaccgaacaatgccgtcatgaactacatggcgcatctgtcancanaaagtatattccatacaaaagttgatattagaatcaagtgcaatcaagccaagacttaccatagtaacccacaagaatga

SEQ ID NO: 2393 - DNA, 1185 bp, A.fumigatus
  unsure (105),(238),(977): Identity of nucleotide sequences at the above locations are unknown.
ttcatgacggcattgttcggtgccatcggagcgcttttctctaccttgacggaagcctccaaagtttccggtttcttgatcagcgcgttaatcatgtactgcggntatttggaaccttaccatgcgatgcacccatggttcatctggatatattggattaatcccttggcatatgccttagacgcgttgctctccatcgagttccacaacaagatcattccatgcgttggcaataacntggtgcctttcggacctggatatgacgatactacgttccagtcttgcgctggtgtaggtggtgcggtccgtggaatgacctatgtgactggcgatcaatacttggcttcccttacatactcttactcgcatgtctggaggaactttggtattctctgggcctggtgggcgcttttcgtcgcggtgaccatcatcgctacgtcgcgttggaagtctgccgcggaagctggcaactcgctactgatcccccgtgaaacggtggcgaaacaccacgctgtggtccgcaaggacgaggaagcacagcttaatgagaaggctggccacaaaggcaccagcaccgactctgaagcccaaagcaatgtcgatcagcatctggttcggaacacgtcggtctttacatggaagaatcttacgtatactgtcaagactccgtcaggcgatcgtgttctgctggacaacgtttacggttgggtcaagcccggcatgttgggcgctctgatgggatcctccggtgccggcaaaaccacccttttggatgtcttggctcagcgtaaaaccgacggtactattcgaggatcgatcatggttgacgggcgcccgttgcccgtttccttccagagatccgcaggttactgtgagcaactcgacgtgcatgaacctttcgctactgttcgggaggccctggagttctcggccttgcttcgtcaaccgcgccatatcccaagagaggagaagttganatacgtggacgtcatcatcgatctacttgagtggcacgaccttgagcacactcttattggccgagtgggtgcaagattaagcgtcgagcagcgcaagcgagtcaccattggtgtggagctcgtctcaaagccgagcattctaattttcctggatgaacctacttctggcctcgaccgttcatcccccttcaacactgtccgtttctta

SEQ ID NO: 2394 - DNA, 696 bp, A.fumigatus
  unsure (212),(224): Identity of nucleotide sequences at the above locations are unknown.
atttcccggggaattaggtgccttgggaagaatcgtttctgcaatcgatactggtgggtcgaacgccacgggatgccgtatggcggcatgcccaacagctcaacagcggaggctcattatgcaaatgttcgcttttgggtccagggccctgatgagatggagcgcgtgggatttatcgacgtgccggacgatcagcggaaacagtatcaganagaatttcacantacccctgcagagcggaagaagaacgaggaagggcctaccaggctttccactgcccacgaatggggctattatgatgatccagacgtgattgacaaattgatcgactggttggatccacgaggtaatcgcgagtccagactacgcaaggagctccagctgcagcgcgaccatatagtcaaatacatgaagtgccggaagaagtacctggagcagacagccgaacgagcagaatctgaggagctgcagacaaagcgaatgacaacgcggaacaagacctacgtggacgaccacaagcatcgctgcttgaaatggcggaacacgacagccctgtcggagaacggccatctacatgttgacccttcacggccctcaaaacgggccaagagagtgacggacgaatctaaggagattaaggcgacaagtcggcagggcaagccgctgactcggcaaggtacgcgctacaatttctga

SEQ ID NO: 2395 - DNA, 207 bp, A.fumigatus
agcgcaacatgtatttacaaatatccaaataatccccccaccttccccaatacaatcaattcgttcacccgtgctctagatgcgatgctcttccggagtggttatatcaaaatgaacccaaattttcatggtctcgtcgctaaagtgtgtagaagaaagcgtaatgcgaaaacgcttgttgctcttccaatgcctactcgaaaatag

SEQ ID NO: 2396 - DNA, 609 bp, A.fumigatus
aggaactgtaccacaacgagtcacatgcagggggccgtgatccttttgatagtaaggcttagacttagatgctttacaatcgacaatgtgctgatcttgccagtcactcgaatctgtgaggtggaccacctgtgtttctcacaaactctcgagattcagaagtatataaataaacctggcacttgggctgctcttggtgttccggaagccgtccggaatttttccattgaatccaccgaagttgcttccgcgttcgagactactactgatctgtacagcaacgttatgaaagatatcaaatacacattggaacatggagtggacgttttgatatacaatgggaacttggaccttgcatgcaacaccgcgggtaacttaaggtgggcggaggctttacgttggaatggacaggcaccgttcacttcagaaaaactgaaaccttggtactcgaatgtaaggggtagcagagtcaaggccgggagtttcaaggaagtcttcgcctcaatcccaaatggggtctctggcaaacagcgcttcgcgtttgtcacggtagataaatctggacatatggtgagtgcaagtgtgatagcagctgagtacggaagctaa

SEQ ID NO: 2397 - DNA, 357 bp, A.fumigatus
gcgaactactccccgttgttcttcatatttttctgcgtctttgacacaggtgataaattgaaatttcgagaccttttgccccctaaacccgatgaccccccacgagtctcccacgcagtaacccccacgcgaagtggaatcatctggtcgggaaaagagctcaaccagtcatgctttgattgcacgacgctacctgtccccaagtatgtccaaatggtccaatacatcttctccagtccgtgtaactccacatatccccatcactcttccccgcaggatggcaaattctatggtgttaaccagctactacagtttcatccggttgagctaaacgctacgtaccgacattctcatcac

SEQ ID NO: 2398 - DNA, 456 bp, A.fumigatus
gtcctcggtattgccctcaccgatacattcggtaccccggctttcctcgacgccttccgcaagccgatccctcaccataccagcgcaggtgtcggcgccgtcgccacaattgcatcgggagcgagcacaacaagcgagtcgcagcctcagagtgaggccgaaaccaaacccccagtcaccgctcccctccatgaaaacgactcccagcactctccgaagacatatgcgcaggtctacacgggcgtccgtcaggactccggcgacccaacctacttcgtcaagatggtccgcgacttttacgacaatgaggggatcaaagagaagaagactgtcgtgttttcagattcgctcaacatcgagcactgcctcgagtacaagaccattgccgaggaggctggcttcgcccccatcttcggtgtcgggactttcttcaccagtgagttctatcccgtctag

SEQ ID NO: 2399 - DNA, 744 bp, A.fumigatus
cgcagacaagccactcatcatcatactaggtcctcggtattgccctcaccgatacattcggtaccccggctttcctcgacgccttccgcaagccgatccctcaccataccagcgcaggtgtcggcgccgtcgccacaattgcatcgggagcgagcacaacaagcgagtcgcagcctcagagtgaggccgaaaccaaacccccagtcaccgctcccctccatgaaaacgactcccagcactctccgaagacatatgcgcaggtctacacgggcgtccgtcaggactccggcgacccaacctacttcgtcaagatggtccgcgacttttacgacaatgaggggatcaaagagaagaagactgtcgtgttttcagattcgctcaacatcgagcactgcctcgagtacaagaccattgccgaggaggctggcttcgcccccatcttcggtgtcgggactttcttcaccagtgagttctatcccgtctagtccccagtctacagtttcactaaccgttctacttgcagacgattttacgaataaatctgacggcaagaaatccaagccactcaacatcgtcatcaagatcgctacggctaacggccgcccggccgtcaagctgagcgacaacatgggcaagaacacgggcgacaaaaatatggtgcaagaggtgaagaagaggctaggatacatcgagcactactgggaagaaggcgatgagagcaatcgctgggctaagcacggatag

SEQ ID NO: 2400 - DNA, 345 bp, A.fumigatus
aaactaagcgctggatcctgccggcctcgtctggtagaagacgagtggttcgtggccatcgctgccatcacggatgattacgagaatgcgaacgagctggctctccgctactggctcggatgtttcggcgaaggggtacgtatcagttccctcttagatgacgcagacaagccactcatcatcatactaggtcctcggtattgccctcaccgatacattcggtaccccggctttcctcgacgccttccgcaagccgatccctcaccataccagcgcaggtgtcggcgccgtcgccacaattgcatcgggagcgagcacaacaagcgagtcgcagcctcagagtga

SEQ ID NO: 2401 - DNA, 213 bp, A.fumigatus
atgcttcgagaacgggggaagggcacatatacagtgccgtttccctctccaaggagaataaacgcggtttctaacagcactgcctatgtgtacgacgtcatggagcgcttttatttccgcttgggaacccttgatgaacactctgacgtcctcccgcagctgtcagcacagctacacgacctgatcaagcggatggtgcttgtggcatgctga

SEQ ID NO: 2402 - DNA, 939 bp, A.fumigatus
  unsure (328),(450): Identity of nucleotide sequences at the above locations are unknown.
gggtatgtcaccaccatgatcgccagatttcccgcatcgagacctgcgtatgttgatgacgtattgttcttaacaacaaaaggtatcggccacccgacaactgtgtccccaagctcctatgtgacgccgtacacccccctggtgtcggacgctcaagaggctgagaccaccctcaaggccggcgagatcgtcaagatccaactcggtgctcagatcgatggatttggtaccattgtttgcgacatggttgtcgttgccgacaaggagtcgcccaaggatgttgtgactggtcgcgaggctgacctcatccacgctacccactacgcanacgagcttctgctgagactcatggtgcccccaggtcttctggctagcggtaccgaggaggagaagaaaaaggccgctgccgagaagccccctacccagagccagatctccgccctcatcganaaggtagccaaggcttatgactgtaatgtcgttgagaacactaccagttggttgattgagcgcaacgaaattgaaggtgggaagaagatcatccttgcccccggctctggcgtgaagggtgagggtgttcccgacgttggcgaagtctggggtgttgaagttggtctctcccttggttccggaaaggtcaagacccttcctcaccgcgctaccttgcatcgccgtaccactaccacctacatccttaagagacccagctccagacagactctgtccgagatcgtcaagaaatttggcacattccccttcagtttgcgacagctggaggacgagaagtctgccaaggtcggtgttgtggagtgtgtccgtggcggtgtcttgagacagtatgagcccgctggtgatgccgataacgctcctgtttcccgtctgttgaccaccattggtatgttcatcacttgttcaacggaatattcccgctttcgctaa

SEQ ID NO: 2403 - DNA, 201 bp, A.fumigatus
cgaggattaatagccatcacgaagaacggtatcaccagattggccgcgcctaaccctcctgatctgtccaagttccagacggacaagaagatcgaggatgaggagatcctgaagattctggagcgtcctttggccagaaacactggcaataagaacaagaagaagaagaagcctactaaggattccaaggatgaggaatag

SEQ ID NO: 2404 - DNA, 468 bp, A.fumigatus
ttacatgcagctggtgtctacctgaagaatagaatcaaccgcggatggtcgcccgtcgaagacagccccctgcgcgcaccgattccagaggctgaaaagcccggcttccgagagaggctaatcccagcgctcgcatcaactcctcccaatgtccgcgcacagcttgttcctctcctccaaaagatacttcagcatgatttccctgagcagtggccgggctttctggatattacacttcagttgctgggcaccaacaatgcgaactccgtctacgctggtctacaatgtctgctggccatctgccgtgtttacagattcaaggctggagaaaagagggaggaattcgacaagattgtcgagcactcatttccccagcttctgaacattgggttgaaactgggtgacgaggaaagcctggaggcagccgaaatgctccggattgtggtccagtcctacaaaccttgctaa

SEQ ID NO: 2405 - DNA, 384 bp, A.fumigatus
  unsure (307): Identity of nucleotide sequences at the above locations are unknown.
agaccgaaattcgcattcaatttccgggatgtcacatctggtattttcaaggatatccctcgtaacgagttgtttatccgagtgcagcccaacgagtcggtgtacatcaagatgaactccaagttgcctggcttgtccatgcagaccgtcatgactgagctggatctcacctatcgccgccgtttctctgacttgaagattcccgaagcctacgaatcgctcatcctggacgctctgaagggtgaccactctaattttgtgcgtgacgatgagctcgacgcaagctggaagattttcacgcctctcntacactaccttgacgacaacaaggagatcatccccatggaatacccctacggtatgtgccataacatactcttctaa

SEQ ID NO: 2406 - DNA, 741 bp, A.fumigatus
  unsure (659),(736): Identity of nucleotide sequences at the above locations are unknown.
tcggctgacgtttttgactgcagtgatattgaacacatctggcaaatggcctggcgactcggattctaccgcggagggccggtcttcatgtccgccatctccggcatctacattgcactctgggatctcaagggccgccggctcggcgtccccgtccatcagctccttggaggaaaagtcaggaacaagctctccgtctatgcctggatcggcggagaccgtccaggcgacgtcgaagccgcgggcaaagcacgactagcgcaggggttcaaagcgatcaagatgaacgctacagaagacatcaactggctggattcaccaagtgtgctcgactcatgcgtcgagcgcctcaaggccgtcaaggcgctcggcctcgatgccgccctcgacttccacggccggctgcacaagcccatggcgaaacagctcgccaaggccctcgaacctcaccggccgctgttccttgaggaacctctcctctccgagcacccggagggcatcaagcagctcgcggatcaggtctcctgccccatcgcgctaggcgagcgactctacaaccgttgggacgtgaagcggttcctcgaggacgcgagcgtcgacatcctccagccggatatcagccattgcggtgggatttccgagctgcggcgcattgcctncatggcggaaacgtatgatgttgccattgcacctcatttgtccctggggcccgattgccttggcggcatgcatgcangttga

SEQ ID NO: 2407 - DNA, 282 bp, A.fumigatus
ccttcaagcgtactctccccccagccatattggccctcttcctccacaatcttgaacaacaaccatcctggtacggacccggaaattttcgatcctcctgatcttgggccctggtgtccaattcctgcaggaaattgccggggaaattttggcattatggaactgccccctccctcccttaatttaaccaaaattcggcctggctggaacaacaattggaatgggcccaagtttaacccaattatccctttactctgtcccaagggatccatttttttttaa

SEQ ID NO: 2408 - DNA, 726 bp, A.fumigatus
  unsure (603): Identity of nucleotide sequences at the above locations are unknown.
gtctggcgcatcaaccgtgagcgtgctgttgactacctcaacactcgtaaccgcatctatgttattgatggttatgccggctgggatgaaagataccgcatcagtgtccgtgtcgtctgcgcacgcgcctaccatgctctcttcatgcgcaacatgctgatccgcccctcgcccgaggagttggagcacttccaccctgactatgttatctacaacgccggttctttccctgccaaccgtttcaccgagggcatgacctcagctacatcggtagctatcaacttcgccgagaaggagatggttatcctgggtaccgagtacgccggtgagatgaagaagggtgttttcaccattctcttttacgaaatgcctgtgaagcacaatgtcctgaccctgcactcctcggctaacgagggtgagaacggcgatgtgactgtgttcttcggtctgtccggcactggcaagacaactctgtctgctgaccccaagcgtgcactgattggtgatgatgagcactgctggactgaccgcggagtcttcaacatcgaaggtggttgctacgcgaagtgcattggcctctccgccgagaaaggacccgatatnttcaacgccatccgcttcggatccgtgctcgagaacgtcgtcttcgaacctatcagccgtgtgggtcactacgatgattcaccctcactgagaacaaccgctgcgcctaccccattgagttaa

SEQ ID NO: 2409 - DNA, 423 bp, A.fumigatus
  unsure (79): Identity of nucleotide sequences at the above locations are unknown.
atcatcgtagtgacccacacggctgataggttcgaagacgacgttctcgagcacggatccgaagcggatggcgttgaanatatcgggtcctttctcggcggagaggccaatgcacttcgcgtagcaaccaccttcgatgttgaagactccgcggtcagtccagcagtgctcatcatcaccaatcagtgcacgcttggggtcagcagacagagttgtcttgccagtgccggacagaccgaagaacacagtcacatcgccgttctcaccctcgttagccgaggagtgcagggtcaggacattgtgcttcacaggcatttcgtaaaagagaatggtgaaaacacccttcttcatctcaccggcgtactcggtacccaggataaccatctccttctcggcgaagttgatagctaccgatgtagctga

SEQ ID NO: 2410 - DNA, 270 bp, A.fumigatus
ttccccatagcgccaccgtcggatccttccagccccgtggtgaagacaattgtctacctggaggctcaaaaaactcggttgattgaagacaatgacgagccggctccctttaggtatgagatcgcgtctttccctgaactccattatcctgaactccacagcagttggaagaatagatttgacatatcgcattcaatattagacaacgtcgaccattcttctacctatctggatgtcctctaccggactcttgtctggtttacgatctga

SEQ ID NO: 2411 - DNA, 789 bp, A.fumigatus
  unsure (759): Identity of nucleotide sequences at the above locations are unknown.
catatcgcattcaatattagacaacgtcgaccattcttctacctatctggatgtcctctaccggactcttgtctggtttacgatctgagtgaggaccaacttactctgttcattcctccagttgacccggaggatgtgatctggtccggtctccccatgtctactgaggaggctcaaaaccaatacgacgtcgatcgcgtgttggtgactactgaactcaatagcacgctcgcgtcaattgtttccagccatggtggtaaggccattgcttttaccattgcagatcaagtctccgaaagcacgcaattccacggtttctccgaggtgaaccactccgtgctgaagggagtcatcgagcagtctcgcgtggtcaaggatgagtatgaagtggcgttactgaggaaagcaaatgatatttccgccaaggcgcacattgcagctattaaggcatctcaaactgccgtgaatgagcgtgaaatcgagggcgcttttattgcaacctgtatcgctaatggggctcgagagcagtcctatcaccctatcgtcgcttgtggcgagaatggtgccactcttcactatgggaagaatgatgataccctaatcgaccccgtgacaaatcagaagaaacgcaacgtacttattgatgccggtggagagtatcgcacctactgtgcagacatcactcgcgttatccccgtagggggggaaattcactggcaaaaacgcggcagaactacgaaattggcccggcaaatgcanaacagaatgtattggcaagctttagggagc

SEQ ID NO: 2412 - DNA, 414 bp, A.fumigatus
aaaaccttcacacctgtcaatgaggttattcccaaaacgttaatgttcccgccttggaacaacaagggaatctctccttcctggggacaaaggcaaaccgtttattcccgcgattccccggcgcagaaaaaagaattcaaccggaaaaccaaaatcggcgcgcgaaaacggatcaggaagtcgcgccttcttaaggattacgatcctaacaaggttcccgatccggaacgctggttgccgttccgcgaccggtccacgtatcggcccaaggggcgaaagggcaagcagcgtgctgttaagagaatgcagggtggtgttgtcacgagaaaggcggaggacacgctggctcccacacagccaaaagctcaaggtggaggcgccagttccaagaagaagaagaagggaaagcggtag

SEQ ID NO: 2413 - DNA, 483 bp, A.fumigatus
  unsure (475),(476),(478): Identity of nucleotide sequences at the above locations are unknown.
ctcacgcatctacagtcagatgaaacaaaaatttgcgtggtcatggttggtcttccagccaggggcaagagcctcatagctggaaagggtaggtacactctcattcgtttgaatatccacgatagggggctgacgatactatatctagcgatgcggtatcttgcttgggttggtattccagcgaaagtgttcaatgtcggcacctatcgtcgccagggaactccacagccaacagctaccttttttgacccccataacaccgaaggggagagaatgaggagagccgctgcagaggccgcaatgtcagacatgctcaactggttcaaagccggcaaaggcgttgtagctattcttgatgcgaccaactccacaaaatcgcgacgtcagtggatctatgagacttgtcgcgatgctgatattgagactctgtttgtcgagtcttcacccggggctgaaaggcagtcagttcaaaaannanccccc

SEQ ID NO: 2414 - DNA, 1302 bp, A.fumigatus
  unsure (69),(106),(109),(110): Identity of nucleotide sequences at the above locations are unknown.
aattcaaatgaacagttacccagcaatccggacgcaagcaattccggtgggagccttgttcccccaggntgggtgaacacgcccgccaagccaatggtccgttctngannggaggttcatttggacgatgtcgtgcgccattccctttttgaccagtacatcttgttcacgggcggcttcggtttcattggcagtcacacaacattggaactgctcaagaccaattataatgtgattgtgatcgacaatatcagcaactcctttcagatcgtcttcgaccgcatcaagctgttagcctcccagtaccatgagcggcaggggaccaagatgccgtcgctgcacttgcatgcacacgactatcgtgacactgctgctctcaaggcacttttagaacagcaccagacccagacccgatggggtacgaccaagtccaagatatctggtgtcattcacttcgctgcctacaaggcagtggaggagagcatccgcaacccactcaagtactatgccaacaacgtcagcggcctcatcgactttgccacgaccctgggtgactatggcatcaagacttttatcttctcctcgtcggccacagtgtacggcaccttggcaacctccggtctccccctgaaggaagagctgtgcacgcacaaagaggagatctataccgaccacgacgggagtgaacgcattgtccagcccggctgtacaggcatcaccaacccctatggccgtaccaaatggatctgcgaggccatcctggcggacctcgccgcctccgacccagaatggactatcgtcgctctgcggtacttcaaccccatcggatgtgacgagtccggcctcctcggagaagaccccagacagactcccacaaacttacttcctgtcgtcgtcaaagtcatgacaggcgagtaccgggagttgcagatgttcggaactgactggaatactgaggacgggacggccgtccgggacttcatccacgtcaccgaccttgcgcgcggccacatcgcggctctcagcgcagccaacgaaggcaaactggccgagaacttccgcacgttcaacatgggaaccggtcgcggacactccgtcaaggaagtagtcgagaccatggaggaagtttcctccaagcacatcccccgaagggcggctgatcgccgcgcgggggatgtgggctcctgcgtcgccgtggccacgcgatcgcagcaggagctcaactggaagacggaaaagtcactcaaggatgcttgtgtgagcttgtgcaatttccttggaagcagagggttatctacttag

SEQ ID NO: 2415 - DNA, 537 bp, A.fumigatus
  unsure (4),(54): Identity of nucleotide sequences at the above locations are unknown.
cgcngagtttttcacggcgcaacaaagcctttttcgcccagtcgcatccgtgcnatggagacgggcggatgtccgcacgccgcgttccgcgaggacatcagcgcgaacctactcgccctgcagaccctccagaaacagttccagacggatctgctgctcattgagtctgggggggataacctcgctgcgaactactcacgcgagctggcggatttcatcatctatgtgattgatgtagcgggcggtgataaggtgccccgtaagggcgggcctgggattacgggctcggatctgctagttgtgaacaagattgatcttgccgaggcagtgggcgcggatttgaaggttatggagcgcgatgcggcgaagatgagggaggggggcccgacggtgttcgccgtggtcaagcaggggaagggggtggatcatattgtgaatttgattctgagtgcgtggaaggcgagcggggggtatgaggttagtctggagaggtggaagaatggggcgccgaagaattcggggagtgtggatgaatag

SEQ ID NO: 2416 - DNA, 204 bp, A.fumigatus
tccacccccttcccctgcttgaccacggcgaacaccgtcgggcccccctccctcatcttcgccgcatcgcgctccataaccttcaaatccgcgcccactgcctcggcaagatcaatcttgttcacaactagcagatccgagcccgtaatcccaggcccgcccttacggggcaccttatcaccgcccgctacatcaatcacatag

SEQ ID NO: 2417 - DNA, 210 bp, A.fumigatus
agggtcttgcccaccctccatgtttgcagcgtggcttattggttacacagaccgcacctatgcccaagtcttgctgctaatttagactcttgggcgctctgtctgcaattgaatctgaacctgccacgcttcgagttacaaacaatgggcggcataaaatccttcaaggagcccagaacccctttttcctactggaaacaaatcaaagtg

SEQ ID NO: 2418 - DNA, 933 bp, A.fumigatus
ggaacaatggtggtagcggcatcacatctcgcccttattgatgaggaaatccatcagttgatgcacgctgctcgatgcggggacatagtccagcttagatcgcttctttatggcgtatcccccgacatcagagacagtacgggccgaaccgccttctcctgggcggcttcatacgatttgacccaatcaccggagacatacaacaattgcaaccttgtgttgcaattcctcctcgatcgaggagctaaccccgatcttgcggattaccatggtgaaacaccgcttcattgggctgttaaagggggcgactaccgcatggtcgatttgctattgcagaaaaatgtcgaatcggacttgccagactcgcgaagccgcacgccattgtcgagggcggcagagcgaggttatgatcgggtggtggaggtcctattaaccaaaggtaaagcggatgcggactacaaggatgcacgaggtcggacgccactctcgtgggctgcggagaattggcatctggagacagcaaccattctggtgaatcatggtgccagcgtggacattcatgatagagagggacagctacccttatggtggtttatcagtaacacaatcaagcgaacagcgatggagcagcagtatcagcccgggaaaggagattatcttcaaaaatggctcactctattgggacccaagcacggcgtcgagcctatgacgaaagctcggaggacattcctctcctgggcttgcgagaaaggcgatcaagaacttgtcaagcattttttgcagaccgcctgggctgaccctaactccatcgaccggtataggaagacacccttgatctacgcgctagaatggaaccactacgagatcgcagacatgctgatctctggggttaagacggggacactcttccaaaggtattcaccaagcgggccc

SEQ ID NO: 2419 - DNA, 1161 bp, A.fumigatus
cacagaagggaaaatgatgacgtcgaagcacgtcaagaatcgaacccatcggagagcagccctgcgccaagcgagcctaggagaatcttctctccaaagtcctggacgaacgacaacgccaaggtaccgtttttgggccattcgcgcgtcaagaaattgcgcgaggagacagtggatctttccgctgtgcttcgtggggaggaaacccctcggcacattcgtcgctattatggtcaaagcagccctgctgaaaagagtgcgaacggagattcaccgcagcaacaacgatcaaatcccgattttccggaagagaatgcggaagatcatgggctcgaagacgaccagggctcacgcatctatctggattcaagccctaacagggcttcggatgatgacacatttcagatcgaccctactacaaggcatgagagcgaaatgcaacgtgcagaccagatggcggaggagatcgagaacgagcatattccagctaccgcgctagccgacaaacgttccgtctacgaagaaaatagtactcctcctgctcagaatcgacagtttggtggagatggtcaggcatcaacctggtttcagaagattactagtcttactcccggttggttgaaagctccagttcgcaagtcattcgcaccacccagtcctgggtatggagaaggctcagaagaggagcctgacgtcagatcggccaacgcacagacgcttcttgacaaccaactgtatcccgaagagacggatgaaacatcaaggcagggtctgcagtcaccggagcagaataacacgcagccggactcgcctacgtcaagtgccgctcgacccgtcgaagatgtcagagtcgagacctacgaacctcactttccgctcgctgtctcaggatatttcacagacaatcactacgttctcctgcgacggctttatcgattggcaaaacgtcacccagaacggtttccttactatccagcacctggccgctctgacatcattggcgattggatttggacatcggacggtgagcatggggtgcgtgttactgaaacccagtttgccatcattgaccgatttgtgcaagagctggctcgtggcgacctgcaggcgggtggaacggcccagattgtcttcaccacgaaggcgcgaggatccggctaa

SEQ ID NO: 2420 - DNA, 243 bp, A.fumigatus
ttgagtgaagtagatgaaggcggctgcgtgtctccaaggtttgacgtgttgcacaaaagccttgcagagtacaaggttctggagcgtggacctaaacttaaatcaggcaacgcgagtcaacccagcatcactttcttcgacccttccagcttcagtacaggaaccggaatcgttgccgtaatacaagatacttttaagaaacggcaccaaacccctcgctgccaaaggtccacccatttgtga

SEQ ID NO: 2421 - DNA, 312 bp, A.fumigatus
agctctacaatttactatggagtgttcacctcctggtcatgctctgcgaatctaattccattatggcgcaaaccacttgtcttccaaaagctctgctgcggaaggtcagtctcttgggtcaatctttatattattttcaaaacaaactccttgtcctccttggatatctcctcttctgaaatctgggagaaaagctttctcctttcaggggaaataccttgcatgatatatgtaaagacttccaacttctccagagggcatatttcgcgatatgtcaaaggaaagggccctaagaactcacattacctctga

SEQ ID NO: 2422 - DNA, 366 bp, A.fumigatus
acaactccctgtcaagttcaaccgtccaattcttccacccagcctgttgcaacatttcaaatgcactcctggatcgatatcccccttcgtgatggaaaagacgcggatgagtgggaattaactgaatccaaagccatcgccaacatcgaccagtggtatcaagaaggacgactgctcttcccccgcgattccctccaggaagtgcgcgaccagctgcggaagccgcttaaaaagggcgactccatttatgtgaaagggttcgatgggtcgatgtatgaatggcctgtgaaaaccggcaacatcaaaacgcattgggaggctgacaataacacgggagaggagaaacaggtggattggatgctgtga

SEQ ID NO: 2423 - DNA, 225 bp, A.fumigatus
aattcagcccaattaaagacccgaatcatcacttcattgcgccgattaccagatagaaggtacaacaacccaatctatgctcgaccaactcgcatcgcctcttacaccgtagtagacagcgtcggactatattccgtctctctacccgacgaagtcgctcatagtataaaacagccgcacaaggatcccactcctcacaatatctatgtggcaggtttcaaatga

SEQ ID NO: 2424 - DNA, 996 bp, A.fumigatus
tacccaaccacgggggggtcggtacgatggcattctgggggtgatggcagcgctggaagtgctacgaacaatgaaggagaacggatatcagacctattacgacgtaggaattgtcaattggacaaagtgagaccctgccctagtcctctcgtatttcttctaactcgttgcagtgaagaaggagctcgattccctaagtcaatgtgctcctctggggtctgggctggagccattccgatcgagaaagcctgggatcttcgtgatatacatgattcaaatgtcacactaaaatcagagctcgagagacacggatttctcggccaactcgagtgctctcacactgcttatcccctcgcagcgcattttgagctgcatatcgaacagggccccatcttacaagagaccgggcgttccattggcgttgtccagggcgcacaaggatacaggtggcttacttttacagtcaagggacgcgatacgcacacaggcacgacgcccttgagtgcccgccaggatcccctacttgcagcctcgcggatgattgcagcgtcgaatgacatcgctcgaaagcacaatgctcttgcttcgactgggatattcgaaataccttccaacgcatcgactaatacggttgcatccgaggtttctttcacgcttgatatccgacaaccgcaggatggggtggtccataccgtgcaggaagaatgtctccaggcattctcagccattgccgctcaggacggaaagggagtcaccttcgactggacgttggacaccgattccccggctgtgaagtttgatcaggggtgcctcgagtccattcaggcagcggccaaccatctcgtgggtcccgaccagtggatgaacatatccagcggcgctggccacgatagcgtgtataccagccatcactgtccgaccgccatgatttttgtgccctgccacgaccgcgttagtcaccatccaacggaatacttgtgtcccgaacactggtaa

SEQ ID NO: 2425 - DNA, 345 bp, A.fumigatus
agactagagctcatcataaacagggacccgacggacactgggatggctcgtctcacgctggacgataacgatgcctctgtgcggcgatggttcgccgccgaagtcgacaaactcggatgttcactgtccatagatcagatggggaacatgtttgcacgccagcaaggtaagttgcagacatctgcccccatggttgctatgggaagccatcttgatacccaaccacgggggggtcggtacgatggcattctgggggtgatggcagcgctggaagtgctacgaacaatgaaggagaacggatatcagacctattacgacgtaggaattgtcaattggacaaagtga

SEQ ID NO: 2426 - DNA, 420 bp, A.fumigatus
gaccaaatttggaaggggtatggaaaccaagccgtggttgtgagtgttgatcccaagcgagtttatgtcacaagcccggatgacactgagcaccatacgatcaaaacgaagtacccgtacgccagcggccagagttattgctggtatcagtgtacaattaagggtggcagagagagtcgtgatattgacgtccgacagctggtgaaggctgttgaagccatgggtgctggcgaaattttactgaactgtatcgacaaggatggaagtaacagtggatttgacctggagttaatcaacgatgtcaaggctgctagcaagatccctgtcattgcttcaagcggtgctggtgtcccaaagcattttgaagatgtcttccgatatacaacaaccgatgcggcattaggtgctggaatggtatga

SEQ ID NO: 2427 - DNA, 276 bp, A.fumigatus
atcgcttgtccgcgaatctcttatctaccatcattattacccaggttaagagccttcttctcaccatcactaattgaacccaactcgcaaccccacgagggctggttctccttcgaaggagtcccgctgaaatggcacctccccgtcgggttgctgtatgacctttacgcgggcgcagaccccgcatccaaggggacaagagtagacgaaacagaccatcccaccagcagcgtcttcaccacggggctggaaggatccgacgcgggcgctatagcg

SEQ ID NO: 2428 - DNA, 759 bp, A.fumigatus
  unsure (32),(182): Identity of nucleotide sequences at the above locations are unknown.
agaagaatgttgaaacctttatccacaacccncggtccgaagaagcgcaactcctcgggcagttcgagcggaaaaaggcagccattgcaacggaacaagaggaccgggaacaagagaagttgcggcagctcatggaacgcttgttcaccgagcccaaaacttacttttactcctcaccaatngacggccccttccaaggcaaaatcccctccaccacccgtcaaggcacccgggtacccgggtccaggcattgcctctcctcaaatgtcaccacactttgcgcctggtgttgctggccaacagcatggcatccctctctcccattcccccgcaccttatggtcaatatgtcgctccgccaagcggcgtctcttacatgcaggggcagccgttccaacagggcgctgcggcaccgttgtcagagggctacaacccaatggcatatccggcgcctacttcaatctctcctccccctagtcagcaatactattcgtccacgcccgctccctacagcggatactcgaatccggcaccgccaaacgctccgtcacagttcatgccacagggttacgtgccccctccaccaccgccacggccgcagcaaccatcctacccaccctctacaggcccatacccgtccggtcctgggggatacgcacaaagcaggccgtacggaacgagccagcaccacaagacgccctcacagtctcagtcatcctcctcaactgacccatgggcgggcctcaacgcgtggaaatga

SEQ ID NO: 2429 - DNA, 246 bp, A.fumigatus
caagcaccaggcaagtatgtttatccccctcaccccttcctccgccttgaccccaactaccccaggcaaggactgaccaaagggctaatggaagggatagctgatcgacctagcaaaagtgtccagggctattatggtgtcttgattacatcggagggattggactactcagtggtcgtgaatcatacaattaaatccgcgacgcccagacagatctataccgctctccagaggattgatcattga

SEQ ID NO: 2430 - DNA, 336 bp, A.fumigatus
cagggaggacagctcaactatctgaccaagtacctcgaacttctcgataccgtcttcctgttcctcaagaagaagcccttgaccttccttcatacctaccaccatggtgccaccgcccttctgtgctacactcagcttatcggtttgactgctgtccaatgggttgtcattgatatcaatctgcttgttcacgttgtcatgtactggtactacttccagagtgctcgtggcattcgaatctggtggaaggagtggatcacccgtctccagattatccagtttgtcatcgaccttggtacgtactccgaaaatacacctttgtcacgcgcgtgctaa

SEQ ID NO: 2431 - DNA, 348 bp, A.fumigatus
acatcaggctttgtttacttcgcttcttacacctacttctcctctacctacttcccctgggctcccaacatgggcaagtgtgccggagaggagtttgccgctttctcgggcatagctatcatcagctcttacctctttttgttcatctccttctacattgccacctacaagaagactgccaagactggtcgccctcgtcgcaatactggaaagcagtccctggttgacatgaagaactttgaggtcccctccgtcactcctgctgccaatagcaaggccacatcaaacggagcggcagtggcaagtggccgggccaatggtcccgtcactcgttctcgcaaggcttag

SEQ ID NO: 2432 - DNA, 546 bp, A.fumigatus
cgccaattatccaaactccttttctctttcgacatggcggctccaggtgggcctagcccacagcagattgctgccatgcagcagcagttcgccgcggaagcagcgagacgaggattgacccccgaggaatttgcaagacagcagcgcgaacaactgaatgccgaggccgcgaagcacggcatgacgaccgaacaatacgtccatcaattgaggatgcgagctatggccgcgcaccagcagcagatggcccagcaacaggctcaagcagcgcagcagcagggacaagcagggccccagcagcagcaacagcaacagcaacaacaggggcagtctggacagccctctccacctcagcaacagatgcagcaagtccccgtgaacccgtcgaatcctccagaccctagagcgatcgcggttgcccagttcctacgctcccagaacctcaagtctcgcacgtgtatcctagacggacaaagaaaggacatgtttaagggtactttttctcccatacttctaacgagtctccgactcagtactgatgagtag

SEQ ID NO: 2433 - DNA, 234 bp, A.fumigatus
  unsure (165),(179): Identity of nucleotide sequences at the above locations are unknown.
cgagtctccgactcagtactgatgagtagcatagtcaaacgcgccatccgcgccctcgaatcccccgcctacgccaaagccgccgccaaaaagaactctctcctcccccccgtcaccgaccgcgcctccgccgaaaacgtcttcaaactctccctttttcccttnttgccctgcgcgtntccaaagtcgacccgcatgctggccacaaccatgccaaaccaaagacccgcgtaa

SEQ ID NO: 2434 - DNA, 309 bp, A.fumigatus
attactcacacgccctctcactgtcactatatctactgctacttctactctcctctctcactttccctcctacaacctcctttatcatcgtgcgcctcctatttctcctccagcctccatacttttcccctcactgtacagaacaactcactactttctcgacaatttacctctccaacaacaaacatggcatccccagaaaaagccaaacccgagggtatcttgggcctctccgccgccgaagccaagatcctcatcctaggctttctctgcattacagaccaatacaaggtacacacccgcccatga

SEQ ID NO: 2435 - DNA, 396 bp, A.fumigatus
atcgactacgaaaagctcgccagcaagggcggctacacagctggctccgcgaacgtcatgttcaacaaagccaaacgcaagctcaccgagctcaaccccgacaacagcaccgagaatggctcgtccgctgccggcgaagcctcgtcctcgaagtctgcaacggctacacccaagaaaggacaggctaagcgtaagaaggctgccggtgctacagatgcggaggatggtggtgccgatggcgaagaagctgcaacgccgaccaagcccaagcggcagagaaaggcgcctgtgaagaaggggacggatgctaaggctggtgctgacagtgtcgaaaatgggtatgttacttgggtcttccgctctatcttgttcgattaccacattggagattgctaa

SEQ ID NO: 2436 - DNA, 225 bp, A.fumigatus
aagaacatctctgatcttggcgatctcgctgccgctatcaaacaacgacaagccaaccgcatggaatcgctcatggaaaaatggcagacagaggcggacacgctcgagggaggcaacggcaagcgcactaaacggaagactctttttgaggagccgcccgaggaagcgtttgctgccaccgctgctcgccaggcttccaagaagacgaagaagtcgaaagcgtga

SEQ ID NO: 2437 - DNA, 351 bp, A.fumigatus
cactccgcgaagtttgtgcacgaatccgatacccctattcagatacttgagccgttcctccttcttggtctattagcgaactacaataagttcgagtttcagaacccgtatcaattgcggctcgacgattttgtcaacgagtcaagcattcaaaagatcgtcaaaggtgtcggtctttcgtgcgccgccttaagaaacggttatattgctgtacaggatgatgcacctgagggctggacactcagcagcactctggtcttcttcggactcggaagacttgctccaggcacgagaaataaaactcaagcgccaacggctgaggaagcgaaggaggtgtttgcaactctgtaa

SEQ ID NO: 2438 - DNA, 447 bp, A.fumigatus
tttacatattcccgttggttgactggaatcaggccgtctcaagaagccgccattcttctgtccacctatgactttgcaaatgcgaataagctctttgggtatcacctcattaactctatgccagagaaagacagcgaggagtctccctttgcgagctttctctctattacaagctacatgttgcagcacgcttacagatcccctcgtgttgcacactatgcggagctcaacctcttcactcttcgcatcctttctgaagattcagcgctgtgtaaacagctttgcagcgagggggagaaaagaaaagtgcgcctttgccggcaaaggcagccgtatctcccgctcgtctcaggggacagggttctcgcaactgttatcttcgacattatgattgataccatttcccataatctccggcggcgccttgatgccaacatatacaggtaa

SEQ ID NO: 2439 - DNA, 231 bp, A.fumigatus
catgattcttccagccctgtggtgaagacctcaatcgaatctcaaggaaaaacagattacctcgtcatttacaaggtagcgactagactatcgtcgcaaaccgtaggcgcaatgatattgtgcgcgcataccagtttgccgttgcttaacaacgtataccacacatccaagtacttcatcgtgttcttcatgacaaatggcacaacagtcgctctgtctgacttcgtatga

SEQ ID NO: 2440 - DNA, 210 bp, A.fumigatus
cctgcctataggttaataatcccacccttctatattaaggtctcttctagtttaacaggtatggcttctagtagattctattaccccctagcttcctttattaaatatttagcttcttattatctatctaggagttattaccatagctcttttacttcctctatagtgcattcatatgttgtcccagagacctttcccctgtccctgtga

SEQ ID NO: 2441 - DNA, 315 bp, A.fumigatus
cccttccccaaggttcctccgggaaaaggaactttgacccaccagcactttgatgatatgctcaatttccacagcacggaagaggacaaggtaacaggacgtctggttacgaaattcctcgacttcaagaaacccacgcgcgacatcaggaccaggctgatgggcaaacacgccaaaggaatgacggatggcgaggcaaaggaactggcgctgtttgtggatctattggaacggtgcctgagtctcaacccggagaagcggtgcacaccggctgaagcgttgaggcatccgtttattgcgcggcccaaggcatag

SEQ ID NO: 2442 - DNA, 222 bp, A.fumigatus
acatcaccgacctccctgaggcatcttgatgccgatgcggtccggatctgcaaggagcacacggagggtgtcaatgtcatcgagacgaccctcgacaagcgcgactgcaggtttggcaactctcttggttgcagtgttggcggatactgctacaagtcctgtgcccagcccggctctggacactggtgctggacagcacataacaatggatttagggactga

SEQ ID NO: 2443 - DNA, 300 bp, A.fumigatus
tgcgcttgcctactccaacccgccctgtttcaatcttcagcgctgaaggctcgacagatggccttcaatgagtttgaggtcacggctgcgccaaaggtcgcagagggcgagggcaagatgttaaccgatgagcttgtccaggtaaacgacaacggttcttctcctacctcgaacgatctggactgcgagaaacatggagctagccgtcaatcgaatccactgcccgatctcaagcggaagttgaagagcaggcatctacaaatgattgccattggtgagtcatacttcgattcgaacatc

SEQ ID NO: 2444 - DNA, 1086 bp, A.fumigatus
ttgttcggtggcttccccaagtctaccgccccttctcgcggaatctccgtcgccgctgcgccctaccgcgttttttacagccgcaagaacttcctgttccccgaccgccagcggggccctcaccgcagctggagagatgaagtgcggactatggataagctcttcctcaacggcagcgcctacatgattggcaagatgaatggcgagcactggtacttgtacctgactgaacctcataccatgctcaccccgccaacgagcccgggagccaagaccgagtttacggaaacggagaccaaggtcctcagtgtaccccagggcgctgctctgcagactgattcggaggatgagactttggaagtcttgatgaccgacttggatgaggagaacgccaagcagttctacctcgagaatgccactgccgttgcggagaaccgttatcgcaactcaaattcggagaagagtgaccacgttgatgttttcagcaacacttcctccgatatcagcgattttgactccgacggaagccaggttctgcctccagagttgactaccgagggtcacgcgctcggaaccgtggtctctgaagcctgtggactttcctctgtgtatcctaaggagaagtatcccgattcgcgcatcgatgcctacctgtttacaccatgcggcttctccgccaacggcgtgattccgcctcctgagggaaaagctggaacccactacttcacagtacacgtcactccagagccgcactgttcatatgcgtcctttgagaccaacgtaccgcactcgcagaacggccagactaccgctggaatcatcaagcaagtggtcgacatcttcaagcctggtcgcttcagcgtgactctcttcgaggccaagccagcgctgagccaggtcgaagacgagtggaaggaagccaagtacctggccgctcgtcggaccgccaaaatggaacatgtggagggatatcgccgagtggaccggattgtccacgacctcgacggctatgagcttgtcttccgctattatgaacgcctggactggaaagggggggcccctcggctgggagaagagagatcttga

SEQ ID NO: 2445 - DNA, 513 bp, A.fumigatus
cctcgagccccttgttcaattgtcgctcaactttgcacctttgtcataaacaggatccaatttttgaaccatatcagcaatcatcacaccaagccaaacatgggttccattgctcagacagtacgagagcttgatgcctcgaccgtcaaggtaactcggtccaccaacctgcgtctggttcctgaacccggttctccggaggaactcagtcactcgcactgtacagaccacatggtcaccgtcagatggaccgtgaacaatggatgggagaccccagaaatcaaaccatacgagaatctcagcattcccccgaccgccggctgcctgcactatgctacggaatgcttcgagggcattaaagtgtaccggggatacgacggcaaattgcgtctgttccgtccagactgcaacggcgagagacttgtcatgagtgcccagagaacttctttgcccactttccggttcgaggagctcaaggtgcttatcgccaagttgatgcagatagatgggccc

SEQ ID NO: 2446 - DNA, 303 bp, A.fumigatus
gaatgtctggattgcagcctctccaacggtgctaccggcattgatgccagtggaatctctggctcgctgacggtcatcgattccagcggtaattcgctcggcaacatgatcgtctcgtccaatgctggtggtagtgctcagaactcgatcatcttggagaatgtgcagtgcaccaacagcggcagcaccgtctcgcttaacaacaatgcggtcctctccggctccgtgacaagcacctgggtgcatggaaacatggtgagtcgaatccctggcttgttacacctgcctgctcaccggatgtag

SEQ ID NO: 2447 - DNA, 645 bp, A.fumigatus
tactccggcggagctaccacgcctacacatgcacaaggctcgcaggtcaccacccctcgtgccaatgttctgctaggagccaactccaagtactttaccatggcaccaccgacatacgcccaatactcgtccagccagttcatcaacgtcaagaccgtgagcggtctgccggtcatgggagatggcgccaccgacgacacggcgaacatcaacgccatcttggcccagtatgccggctgcaagattatctacttcccggccggcacgtacattgtgacggggacgatctttgtccctgctggttcgatcattgtcggcgatgcgtatgcctcggccatcagtgctacgggctccaacttttggaatcctaacgctccgacgacaatggtcaaggtcgggaacgcaggcgacgtgggggtcgcccagttcacagatatgatgttcacagtagccgatgtgctccagggctgcaaattagtaggtcaacccccgttccgtttggacgctaccactaactgtaaggcaggtcgaagtcaacattgccggtgcagctcctggcgacgtgggattctggaacacgcatttccgcatcggcggtgccgtcggctccaaactcttcaccacaatgagcaggagccggcatag

SEQ ID NO: 2448 - DNA, 183 bp, A.fumigatus
agagcgaaactacccgtgcagcccgactatggggatggcaagtctgacgaggacgtcagctggatgtacatgagtgtgattgactacatacgttactacaatgatctggatgaacgactggtggttcgattcgtattcgcggccgccagacagaccagcgagaatgttgctgcgacggcatga

SEQ ID NO: 2449 - DNA, 207 bp, A.fumigatus
ttggctggttcgttttgggtgagtgttgcaaggaactggcttggctcgactctccctctgcagccctactcaactctcgctaacacgatcctagttgcctcgcttgtgctgccatttttccatcgactatatcctaacagccactacttgcaccgactgatggtgctttttctcacattctcacccacctttataatcctcaccatt

SEQ ID NO: 2450 - DNA, 465 bp, A.fumigatus
agacatgagcccatcaagaggtctggcgctctattcgctactgcgctggaggggctgcgctatctgcaaacatatgactggctcttcctccgaaccatcatcacctttggatacctaggctggatcgcatatgcactgacgacagttattgatctgcatgttttgcacagaacctcagattcaaaacggaccgtgggcagtactattttcttcacgtctattcttgctgcgctgttttcggttctcttatatcagaagtcttcatggcaatactatgtctacggagcttttccaatctttttctgggaagaggtttttgcacgtaggaaggcattgatcgctggccgcgagatccttttgggtcatgttcgttcttttggtggctacatcgcctccggatttcaattagtagcctttgttgcagttttggaagctcttgtatgttacgatacattgacttattga

SEQ ID NO: 2451 - DNA, 270 bp, A.fumigatus
cgtccgcaactatcgaggctaatttacagatggtgctctaacgatcgtttgtgcagaacttatggtgcactgctgatgttctttaccgggttgttctatctacttttcgaggacaccatcttgaaacatagtaaatcttcaggacatgcgccaggggctatctctagcttggggtcgcgagtcatcatgggcatgcaggtacagtttttcgtccttttcatcttctcttgcggtcttcaagactatgtggcggctgtgtccctgccttag

SEQ ID NO: 2452 - DNA, 222 bp, A.fumigatus
ctacttaataggaagttactactatatagccccctatttgccatgtcacagctagagctagaggctctgtgtaaataccttaataaaatacttaagaaggggtggattagggaattatctagcctagtagcagcactagtactctttataaagaagctagatagaggcctatatctctgcattaactaccaggggctaaatactattatagttaagaattaa

SEQ ID NO: 2453 - DNA, 408 bp, A.fumigatus
cgaggtctgaaatacgttcactcagcaggcgtcgtccaccgtgatctcaaacccagcaacattcttatcaacgaaaactgcgatttgaaaatctgcgattttggccttgctcgtatccaagaccctcagatgaccggctatgtttcaacgagatactaccgagcccctgaaatcatgcttacatggcagaaatatgacgtggaagtcgacatctggagtgcaggctgtatttttgccgagatgctggaaggaaagcctttatttcctggaaaggaccatgtcaaccagttctctatcatcacagaactgcttgggactccgccggacgatgtgattcaaactatctgcagtgagaatgtgagtgggagaccggcattccgcctgctactgattgcgaactcttgctaa

SEQ ID NO: 2454 - DNA, 222 bp, A.fumigatus
tacgtatcgcgcgacgctagctctgcaagagatcaattgacaggccaacccgtggctgtaaagaagatcatgaagcctttcagcactcctgttttgtcgaagagaacataccgtgagctgaaactgttgaagcacttacggcacgagaacgtttgtggccacccaactgcaaacattctaccacctttgtgttctgattcccttggtagatcattagcttaa

SEQ ID NO: 2455 - DNA, 195 bp, A.fumigatus
cagctggacagttactttgtcacagagctccttgggacagacctccaccgacttctaacttcgagaccattgggagaaacaattcattcaatacttcctatatcagattttggtatgcctcgacttcttcccccgttcagacagtacttgaaccagtacttgaacgctaaccatgtattctgtagcgaggtctga

SEQ ID NO: 2456 - DNA, 249 bp, A.fumigatus
  unsure (157),(176): Identity of nucleotide sequences at the above locations are unknown.
catgatgcaccaagcaacggggtaacaataaagccaagatcttattcacgacaagatggccacacgctggtggcttgcgtcggcaagcttccctgtggtttcggtactttccctagaattcccggtttaaaacaagatctgacggacgaagccctanggggtcctatgtgcattanccataatgttcaatatatgcgctgtatcccaaggatggcgggaggtaatataccccgaccgaagcgtaagcat

SEQ ID NO: 2457 - DNA, 210 bp, A.fumigatus
gtagaggtagacactagggctaacatactcctactagatatttccggacaaattattgctttctcaacaagcacagaggatgcaaagattcttcagccgggtttcctttgtgacaatagctggcgaatgaagacagagatggactatggatctgacggaccaatgattggcaggacaatctctcagtggacaggtaaggtcaatcaatga

SEQ ID NO: 2458 - DNA, 249 bp, A.fumigatus
gactcgtctatattccagcattcactacatatgctgtctctagccactcctttccattcgttcttatttggtaataagattactccctttcttctcagtcttttcactatacatgaagcgttgtcattgagaccttcgattttcttctcgactctcttttgcaacgttgatggttgctatttcttaaacaaatctagctatttgaatggctcttgcttgagaccatacgagaagcaatttgtaccatga

SEQ ID NO: 2459 - DNA, 195 bp, A.fumigatus
  unsure (35): Identity of nucleotide sequences at the above locations are unknown.
acaattcaagtcatccaaggaagagactggggtancatcatcgcccgcgtcatggcaacgctctacccccagcacatcaaagccgtccatcttcacttcgcccccgtggctcctccctacccatggggccacccatggatctttgtgcaaatcaattctgaatcttcccttctcctcgcggaacaatgcctttga

SEQ ID NO: 2460 - DNA, 342 bp, A.fumigatus
agtatccccgactcccaactggatcttttgcaccaaaagcttcaggccgctaccttccctgatgaactagacgctgcaggctgggacctgggagtcccactggacgagatcaaacgactgaccgcatactggcgcgatggattcgactggcgcgcaaaggagaaggagttgaacggcaaactgcaccagttcatggtctctgtctctgtttcgggctttgtgcagctcgatattcattgcgtgcatcagaggagtcctatgccgggtgctattccgctactcttcctacatggctgtaatgtaccatatgtgcggttggctttgcagatgaaggtctgttga

SEQ ID NO: 2461 - DNA, 204 bp, A.fumigatus
  unsure (93),(128): Identity of nucleotide sequences at the above locations are unknown.
atggtttgtggaatatcttcccggcggttaacttggccaacaaaaccaggaaccagttgccttccaagattggataagttcattccctttttnaagaactccagctggcgggaggataccgataccantgacggcggcacacaggtgatctttttaatgggacccaacgctgtagatgaaaatggaactgtgtttctacattaa

SEQ ID NO: 2462 - DNA, 456 bp, A.fumigatus
agaacggccaaggacggagctcgctcatcgtatggggtgttctggggtcataacaacgtgctgaacaccgctgtacctgttgagggagagggaaaccacacaaaccaggtagccgagttacgagcttgcatgagagcattgctggacgttgtgcacgtcagatctctctttgaggaccaagggatcattcttagtgcggttgtcatcaagtccgactcggagtatctggtccgcggcgtcaccgaatggctccccaaatggaagaggaacggatggaagaactctaggggattggatgtggctaactgggaacatttcaaggcaattgagcgtctcactgaggatttggagagacataagttaaccatcaagttctggcatgtacctaggaggaataatcgtgacgcagataccatggcaaaggccgtcttgaggggcgcctggaaccggggattg

SEQ ID NO: 2463 - DNA, 345 bp, A.fumigatus
gtgccgtgcgccacggcgcgatcaggtcctgctaacagtctcttcccagacccaattgccacgcagataacaagcactgccctgggccctcgtccgaaatggacgttttgctcgggaaatacagccatgcctccgacagcagactgtcccccgacatcgcagccggttcattcagatgccgactttgatcacccaacacacccctttgcctatgtgatcaacatccctttgatcgaaatgaccccggagaacggatctacagagatctggctcggaacacacatcgactcgggcctacatatccaggaaggaatgcacggtgaccgagcaagcggacgcatctag

SEQ ID NO: 2464 - DNA, 987 bp, A.fumigatus
atatcgcccgcgcggatccttccagcccctggtgaagacaattggcccacagacttggtggacgtgaagccctacttgcagcgcccagacgtggtccaagccttgaacattaaccccgagaagaagtctggatgggaggaatgctctggcgcggtgagcagtaccttcaacgcagcgaactcgctgccttcggttcaactactaccggagcttctcgagtccggcattcccatcctgctgttcagcggcgacaaggaccttatttgcaaccatgtcggtacggaacaactgatcaacaatatgaagtggaacggtggaactggctttgaaacttcccctggagtttgggctccacgtcacgattggacatttgaaggtgaaccggccggtatctaccagtatgcccggaacttgacatacgtcctcttctacaatgcaagccatatggtaccctacgatctacctcgccagagtcgtgacatgcttgaccgtttcatgaaggtcgatattgccaatatcggcggcaagccggcggattcacggatcgatggcgagaagctaccgcagacctccgtaggcggccacccgaacagcacagcagccgagcagcaagcgaaggagaagatcaaagagacagaatggaaggcctacgccaagtcgggcgaggcggctctgatcgtcgtgataatcggtgtgacggtctggggtttattcatttggcgcagtcgacgacgcaaccgcggctatcaaggagtctaccaaagggacattggtagtggctatattatggagcgcttccacaacaaacgctctgggcctgccgatgtggaagcgggcgacttcgacgagtccgagctcgacaacattcattcaccaggcctggaacaagaacattatgctgtcggggacgacagtgatgaagagagtccgaatcaccagcctgccgccccgccgagctccacgaagccaggaggcgctcaaccatag

SEQ ID NO: 2465 - DNA, 369 bp, A.fumigatus
aatcaatcccatacaaaatctcctcatccaattactcgccatactcaaatttaccatacagatccagcagcggcaattgctgtaccaatggcgtcaattttacaagcaatcaggtatagccatggcaagttagccatcattgaccagctacagcttccatacgtggaaaagtttattacaatccggacatctgaagacgcctggcatgcaatcaaggaaatgagagtcaggggcgcaccagccattgcaatagttgcagccctcgcactcgcctcggagttgaatacactcataatccacgataaactatcatcgagagcagaagaggtgaaactttttatccgggaaaagttggattacctagtgagc

SEQ ID NO: 2466 - DNA, 246 bp, A.fumigatus
caggaaatcaaggttcttcgcgctaaaaataagcagaaaatgaagaagaaggcaagaaaatatacttccttagggaataacctatttatatctatgcaggaaggtcgtgactatattcagcaggttaatgagcaggttgatgagcaggttagtaagtctacacctatatcttgtcagcgtgctccgccgcgctgtagtggatgctggactattagacatactagaagaagttgccctaataaatag

SEQ ID NO: 2467 - DNA, 666 bp, A.fumigatus
ccgcaaacgctcaataacgcgacctcgctcttcaacggcggagataaaggctggggccgacagacctgggacatcgcagtgcatatcagcaacagcattacattcgtgctgttcgataacaggtggaatgggttccctgggatcttcgcctcgtgcgtgacgcacacggttacgccgtatgagtggcggattgccttcggggttacgccgttgctcaaggcaggcccaattaattttagtcagcaagttttctttaatcttgatgggtttaggggtaatgccagcaccagcgatgctagtgatagtacggtgcttaatcataggccgaggcttccttcttccgggatgcgtttcgatgttgatgagtgggagattccgacaggcgatatgaagagtaatagggaggggaaggagtttgacttttggtctgcggataagtttattggcgacgaggttcagaagggtaatgctggatctgatgtgacttacgtgctctcccataaaccgttgggcgacaaggaagacgaacctgtggcaatcctctcctcgaagccatctggtgtcaccatggagctttacacggaccaggacgctctccatgttcacacgtggaacagtgacttgggtaacatgacattcttctgtagtggttggagtcgcaactga

SEQ ID NO: 2468 - DNA, 1083 bp, A.fumigatus
  unsure (1060): Identity of nucleotide sequences at the above locations are unknown.
gcaatcatgcctcccaaatccgtccgtcgaggcgcagcagcagcagcagcagcaggacgaggaggaggaggagaaggaacagctccgcgacaaaccaccagcgaagccgcatcaaatactcctactggatccgccgcatccacaccccaaccgtccactgcagtcggtacaccgtccacacgagcacccgtgcagcgcctgcagactctgaaaaagcgcacaccctccggaagcatcggaccccccgcgagaactcccgctgcgacaacgccaggaaatggagagccgacgaaaccgatactgaagtacaagcctcgcgctgtgggacggcgcagcaaagaggagcgagatgcgattgagaagctggaggcggagcggaatcgggagcgattggctgaggtggcggccatgagccggggacggggaaatctgcagcgaggcagaggaggccccgggcgaggacgcggggttccgcttggaggcgggcgacgaggccgtggtgggcggtttgagccggattcgcgagcgtcgtctatgtcgcggagtcggtcggttatcgatatagctagtggttccgctagtcgccatgtatcatcggacgagagtgatacggagactatacttcccattgaccagatcgaggtcgatagcgatgaggagttggatgatgtcgcggatagcaagaagggaaagcttcccttgcggtatgcgaaccgagagaagggccttcggccagttcgtgttgagcgccgcgagcacgaggaacgggtggtcagtgtcaacatggagtcgagcacgagtaaaccggccgaagctgaaacaaaggctgaggatgaagtggaggaagttggtgcaaagaaaacgagacccgaagacgattctctcttcgtgcgggacgatgatgtgattgagccacaggtgaaggaggaacctattgatgacgaccatccaatgactgatgtcgttccccatgtcggcgaagcaacgcacgatgatggctttcttccagcgcaaaaggtcaaagtccgcagacgactaagtcccaagattcccgatcatntagccgccgccatggaagattaa

SEQ ID NO: 2469 - DNA, 1125 bp, A.fumigatus
tcgggaatcttgggacttagtcgtctgcggactttgaccttttgcgctggaagaaagccatcatcgtgcgttgcttcgccgacatggggaacgacatcagtcattggatggtcgtcatcaataggttcctccttcacctgtggctcaatcacatcatcgtcccgcacgaagagagaatcgtcttcgggtctcgttttctttgcaccaacttcctccacttcatcctcagcctttgtttcagcttcggccggtttactcgtgctcgactccatgttgacactgaccacccgttcctcgtgctcgcggcgctcaacacgaactggccgaaggcccttctctcggttcgcataccgcaagggaagctttcccttcttgctatccgcgacatcatccaactcctcatcgctatcgacctcgatctggtcaatgggaagtatagtctccgtatcactctcgtccgatgatacatggcgactagcggaaccactagctatatcgataaccgaccgactccgcgacatagacgacgctcgcgaatccggctcaaaccgcccaccacggcctcgtcgcccgcctccaagcggaaccccgcgtcctcgcccggggcctcctctgcctcgctgcagatttccccgtccccggctcatggccgccacctcagccaatcgctcccgattccgctccgcctccagcttctcaatcgcatctcgctcctctttgctgcgccgtcccacagcgcgaggcttgtacttcagtatcggtttcgtcggctctccatttcctggcgttgtcgcagcgggagttctcgcggggggtccgatgcttccggagggtgtgcgctttttcagagtctgcaggcgctgcacgggtgctcgtgtggacggtgtaccgactgcagtggacggttggggtgtggatgcggcggatccagtaggagtatttgatgcggcttcgctggtggtttgtcgcggagctgttccttctcctcctcctcctcgtcctgctgctgctgctgctgctgcgcctcgacggacggatttgggaggcatgattgctcagcggatctgggcgcgcacgaggtgtgtgcttcaacggagggagagaacggaggaatcagtacattga

SEQ ID NO: 2470 - DNA, 222 bp, A.fumigatus
cctgacttcctcaccggcatgtctctgcgctctctcttcgtagctggcttggccaccctggcattggcggtgcctgccccccagattcaggcccgccaaggcatgagctctaacgagctcgagagcgggccttgtcgtgatgtgacttttatctttgctcgaggatcgaccgagcagggcaacatggtatgtttctcgaccaggagttcactgagtacgtga

SEQ ID NO: 2471 - DNA, 237 bp, A.fumigatus
gggttgatcgtgggacctggagtctgcagctcgctgaaaaaagatctcggctccgacaaggtcgcctgtcagggcgtagggggcgcatataccgctcaattggccccgaacttcctttctcaaaacaccaatcaggcatccatcaatgcggccacggatatgttcgatctggctaacaccaagtgtccgaatacgaagatcgtggccggtggatacaggtatattatctgcatctga

SEQ ID NO: 2472 - DNA, 225 bp, A.fumigatus
cggtcccccttgtacgacttcacttcatccgcggtgaagactgaggccctgcaaggcttccgaatatgcatacttcggagatgtatccaagttacggacattctgaagggatataaagcgcgtgctgcgcatgatgttgaatgcagtaccaacagcatcttcttcttccaggtcgtcaagactgcttccattcattctggcattccagatcaaaccctagcctga

SEQ ID NO: 2473 - DNA, 276 bp, A.fumigatus
aataacagccaaggttctgctgtcatcgataacacaattcaggcgcttggcagtgatctgaaagctaaggtcaagggagtggttctttttggattcacccggaacgtggctgacaagggtcaaattccgggttaccccaaggaccagaccaagatttattgcgctgtcggtgatatggtttgtgttaatacactgatcattacccctgcccacttgacctatggggccgacgcaggtgatgctgctaaatttcttgcttcgaaggtccacgaataa

SEQ ID NO: 2474 - DNA, 258 bp, A.fumigatus
ccgcttttgatggtacctagtcacacaatggtacacaggtacaccgcatctctatcatcacttcccagagacgagttgcttgctttcccctttttccctattggtgctcttcctccttttccatacatgtaccaaacaaagggaatcaagaagtgcattgcatttaaaacaaaggaggaatacctgcatggatctctcgctttcctttcaggaaatgttgagaatgcaggatcgcagaggttgacatgcatgtcatga

SEQ ID NO: 2475 - DNA, 186 bp, A.fumigatus
tccgggattactcctgatgacccagacacgtcgattgatggtaagggcacgcactacatcgctggtatcaactctagcacgtcgcctttttctcgtgtacccatactacaggctcggttctctctggatcccctgcatcaagctaacaacggcatgaccgatttgagaaacttttctatatcctag

SEQ ID NO: 2476 - DNA, 459 bp, A.fumigatus
cgccaggcagagaatacacagcccgcgttcatacagaaacttagaaaccagtatggagatatgtctggtcgccttgaaaggcccgttgcgcgacctcgcttagcaaagaaagatgacgaggacgatgacgagcccacatacgttgatgaaggaagtaacgaggtgatatcaaaggaagaatatgaggcactattgcgcggtgaagaaaagcaacaggagtcatccgaacaacaatcaggtcatgagtcgaggcaagacactgaaaaacccgacaccgaggtagcatcctcaaagcagaatttggctggaataggaggcccaaagaagcggaaacaggcgaaagtcgttgcagacgatagtgctgaagccgaaaataccacgcagcaagagagaactggacctcagaaagcaaaagagaagcaaaagaagaagaagatcaagctatccttcgatgaatga

SEQ ID NO: 2477 - DNA, 348 bp, A.fumigatus
cgattttatgaagtgcaaggccgaggcgaatggccggggcgagctggagtgtctgaaaaaaggccggaaggtcacccgttgtgcggcgagtgtgtacgtttttctcttccgtcatgcttgcgttcagattctatgcgggttgtgcaggagtcggttccgaggctaatcgaggcatatcgtggtaacaggatcaaggacatcaacacccactgcttgaagcagttcaacgctcactgggaatgccttgagaacaacaaccagaatctatgggagtgccggaagcccgagatggagctcaacagctgtgtttttgagaagctggtacgtccgcgacgcgtcttcggctga

SEQ ID NO: 2478 - DNA, 333 bp, A.fumigatus
tttctgccccgtggtgcagaccaatctcccaggttcaaccagcatgtcctcgtggacaccaccccgatgcccagcgacatccccaaggtggaggagattggagcgacgtctgcgccgctactgagcgcatcctactttattggcgaccgctgcaaggcgttcaatgacgattttatgaagtgcaaggccgaggcgaatggccggggcgagctggagtgtctgaaaaaaggccggaaggtcacccgttgtgcggcgagtgtgtacgtttttctcttccgtcatgcttgcgttcagattctatgcgggttgtgcaggagtcggttccgaggctaa

SEQ ID NO: 2479 - DNA, 249 bp, A.fumigatus
  unsure (45): Identity of nucleotide sequences at the above locations are unknown.
atggaaaacataagaaattcaacacaatatgtactagagaaaaanaaaagtatgccgaccgtccccgtcaattcccaaccatatctaatcccaggaaaccgtcccacggaattaaatttgggccaatccggtcttcccctcccgaacaccccaactttgaaactccccttccaaatcctccggtcgccccttgaatccccatccagattaaggaccatgccccaagaatggcacgattccaaaaaataa

SEQ ID NO: 2480 - DNA, 192 bp, A.fumigatus
atcgttctaggttatgaccggtcctggacggctagaacgggaggatcaggccaacatgactgccatgcagcagcagcaatgggctgggattatggcatgctattgcaccatgtcttggagggcgccaaacccctagttcaattcctcgaccactactgcccatttagcatcggacctttggccataaaataa

SEQ ID NO: 2481 - DNA, 489 bp, A.fumigatus
aaccatagcggatcctcgcgcctttgtagaagactcatcgaggagggtaaggtgatctggcaggaatggcagggtcttgctattagccaggaccgtgtctttgagactgtctctatcgcccttgtcggcaagtacaccactttgcatgattcatatatgagcgtgagcaaggcgctcgagcactctgccatgcattgcaagaagaagcttgacctcatttgggtcgagtcctctcacctggaggacgagcacaaggagaccaacccagccgagtactacaaggcgtggcactcagtttcaaccgccaacggaattctggttcctgtacgtttttctccgcatacgctttgtgaattgactctaatattatgttcagggtggttttggcgagcgtggtaccgagggcatgatcaagagtgcccaatgggctcgtacgaacaatgttccttacctgggtgtgtgcctgggtatgcaggtggccgttattga

SEQ ID NO: 2482 - DNA, 633 bp, A.fumigatus
tattatgttcagggtggttttggcgagcgtggtaccgagggcatgatcaagagtgcccaatgggctcgtacgaacaatgttccttacctgggtgtgtgcctgggtatgcaggtggccgttattgagtacgctcgcaacgtgtgcgggttgactggagctggtagtgaggagttccacgagaattgcgagcattctgcgatcgtctacatgcctgagattgacaagaccaagatgggaggcaccatgcgactcggcaagcgggccactcacttccagcccggcaccgaatggtcccgcctgcggaagctgtacggagacaagcaggagatctgggagcgacaccgtcaccgttacgaggttaaccccgaactcgtcgaccagctcgaacaggctgggttgagctttgtcggtaaggatgacagcggcaagcgtatggagattatcgaactcaaggaccacaagtggttcgtcggcgtgcaattccaccccgagtatctcagccgagtgcttgcgcccagcaagaccttccttggcttcttcgctgcgtctgccggctgcctcgaggagatcaccgaggtgttcaaggatcgccacgacctgagccaccgcgagttgaagatccccctccactag

SEQ ID NO: 2483 - DNA, 876 bp, A.fumigatus
gattccacccagaaacctcaaacacccaatgttcagaattttgaaatactcccccagtcaaaacaggagccgggaacgatcgcgacgagtcgaccgccccctggtggagtatctagtcctagtatcgcggtagtcttgcctcctccaggcgcagcttctactcctcatcagccaaattcgagtcctgcagtacgaccaatgaaccagcctcctccgaaccacactccagcaccgcggtcaagtggccagtacccgccattccaaagccagtctccttcaatacagtcacgtccacagcaacacgggtctccggcctactatcgtcctgctcctcccccacctcctagggtgggctacaagtcggttgtctttgagtttacctcaccattaacgccctacggaagtagcacttcaggtcacgcaggctcaggagaccggtatttgtttccggagtactctattttggaatggcttcctggcggaaacacggttctagcgtccttcttgctcattcggaaggtggaccccaacacaccgtttcccatagaagatgcttcagtgacaagcacatcccgagccaagggcaagtcgacctccaagtcgaagaaagcggacaagaacaaagacaaggcagcggaaggcggggaaggcaaagagaaagacaagaaagagaacggcaagtccgatgagggcgccaaggagaaggataatgctcagttatctaacaatcaggattccgctacggccgctactgactcggctaaaggatcagacaataaaggcaatcagaaggctcaggcggaaactccgagcaaacccgactccaacaaatccaaggtcttcacacggggctcgaaggatccgcgctatgcgtaa

SEQ ID NO: 2484 - DNA, 255 bp, A.fumigatus
atactcttagcgcggatccgtcggccccctgtggtgaagacctcaaatggcctaaggctgaatagccctccctgtaagaaattccttggcagactggtgtacaaagtacacagtttctttacggattgtcgagacggagccacagaggcttactttgcttccttgcacagccagtggctgaccagctgcaacacacagaccttcggattgttttacttgggaagctcgagcttgtctggagtcggcagcaattga

SEQ ID NO: 2485 - DNA, 210 bp, A.fumigatus
cttagttcaattgctgccgactccagacaagctcgagcttcccaagtaaaacaatccgaaggtctgtgtgttgcagctggtcagccactggctgtgcaaggaagcaaagtaagcctctgtggctccgtctcgacaatccgtaaagaaactgtgtactttgtacaccagtctgccaaggaatttcttacagggagggctattcagccttag

SEQ ID NO: 2486 - DNA, 279 bp, A.fumigatus
tggtacccggagattgagcaccatgcccccaatgttcccatcatccttgttggtaccaaactcgatctgagagacgatcccgcgacagcagaatccctccggcagagaaagatggagcctgtctcgtacgagcaagcactggccgtcgccaaagagatccgagcgcacaagtatctcgaatgttctgccctcacgcagcgcaacctcaaaagcgtctttgatgaagccattcggtatgtttggcattgtccccgaagtgatgttgttcctcgatgctaa

SEQ ID NO: 2487 - DNA, 354 bp, A.fumigatus
aatatgatagacatgcctcctcatctcgtatacgaccaatgcattccccggagaatacatccctaccgtgtccgtggcttcctcccttgcgctgattctcattcggagcctgttgttgactcgacttccagatttgacaactatacggctagtgtgatggtagatggtaggcccatcagcttgggactgtgggatactgctgggcaagaagattatgaccgactgagaccgctgtcctaccctcaaaccgacgtcttcctcatctgcttctccattgtcagccctccttcgtttgacaacgtcaaggcaaaggtgcttaactcccctgtcagctgctgtgcgctcacagcttag

SEQ ID NO: 2488 - DNA, 246 bp, A.fumigatus
ccagacgaagtggaggattttataactaacaaatattgcagggccggcggcggcggtaaatctgagcatcgtagagccaaaatcgaagccaagaacaagaagctcaatgaggagagacaacgtcaagctaagaatatccaaaaggagaagacgaagtcgaagaacactcattctaaagagaacgaggagcagggcgccgatcagtgggctggtattcaccccagccgaagagcccgtatggcgtaa

SEQ ID NO: 2489 - DNA, 756 bp, A.fumigatus
ccgatgcacaatcttgttcttcaagaacgagaagggattttttcaataatccccacttggtatgagagtcgcacgaaggaattacacaaagtgcggcaagagcgtgatcgcttggtggaagctacactttcgtctgagcagagactcgagaagcagaaggaagataatataaaattaaaggatgagcgcattcagttacgacatgagctcgaaaaggcacgggaagctttaaaggccggaggaggaagcatggcagagttggaaagagcacaggaggagatccgtcggctgaccaaagccaatgcttccctggagcgaaaagcagaatacgaggcaaaacaggccgagtacacacgcgaacagtaccagaccgcatccaacgtggctgcacagtctgggaacgagatcctgcagctcaaagaggagaatgagtcgttgaagcgcaaggttgcgggtgatgccagccgtctcagagaactcaacatccaaagtgatgaacagcgacatcttgcgcgcgtcaaagagttggaagctatgctcgcatctcgcgaagatctgctgcgtagaaaggaggatgagctgcgagaattccgaaagaaccgaccttcgaccagatcaacaagcacgcagccacgaagcccgaagtggacagcggcaaatagccgtccaaccagcccagggatcaataatcacaacggttccgggtactcaggacgaggcagtggattgcgatttagctctgaggtgcccctgtaa

SEQ ID NO: 2490 - DNA, 222 bp, A.fumigatus
tttataccagctttccacctccctataaatttaatatctcacactatttacttagcaatattctctaatagcactagactagcttactatgctatcttcatccctactagtaatataggtaagataggaaagcttatttatataactagaaccaccaccacaggattcttccttaaatttaagtataactataactttaatctcacacagagaaagtactag

SEQ ID NO: 2491 - DNA, 714 bp, A.fumigatus
  unsure (638),(671): Identity of nucleotide sequences at the above locations are unknown.
cgaaccaaacatggccggcgcgaacagcggaaatgccgcgctcatactcgtgcgcaggattgtctgcgctgcgaacccgctggccgcgtagctgagatagctatctgcgagatagccggtcaggacggagccaaactcggttgctgcgtagccgatcgccacgagggcgacggtcgagaccatccagtggacggatgtgattgccgggggaatggtccaggcgaagagccacaggcccagggcgaagaccggggagccgatcatgaagccgagaagtttgtcttcgggacgcagggggaggcgctggcggtggtgggagacgatgagtttgtagtcgtggatgcgggtgagcatgccaagcatgcagccgaggccaaggccgaggaaggggagacaggagtgggtgggggtcatgccgaaggattggtagattggtgggagggcctcggtgaacatgtagatgagggtgaaagggatggcgctgatgatggataccaggaagataatgggttcggtgaagaagaggtagatggggcgaaagagggccatggtgaagaaggtgcggaggtcagggatacggtctgggttgaggctctgcaccaccgtctgggtctccttgccgaggccttgcacaggcngcaagacttcttgtccaagaagaagggaagtcncgaatcacggattccgaacaggaaacacgcgataagcccgtga

SEQ ID NO: 2492 - DNA, 843 bp, A.fumigatus
  unsure (5),(38): Identity of nucleotide sequences at the above locations are unknown.
ttcgngacttcccttcttcttggacaagaagtcttgcngcctgtgcaaggcctcggcaaggagacccagacggtggtgcagagcctcaacccagaccgtatccctgacctccgcaccttcttcaccatggccctctttcgccccatctacctcttcttcaccgaacccattatcttcctggtatccatcatcagcgccatccctttcaccctcatctacatgttcaccgaggccctcccaccaatctaccaatccttcggcatgacccccacccactcctgtctccccttcctcggccttggcctcggctgcatgcttggcatgctcacccgcatccacgactacaaactcatcgtctcccaccaccgccagcgcctccccctgcgtcccgaagacaaacttctcggcttcatgatcggctccccggtcttcgccctgggcctgtggctcttcgcctggaccattcccccggcaatcacatccgtccactggatggtctcgaccgtcgccctcgtggcgatcggctacgcagcaaccgagtttggctccgtcctgaccggctatctcgcagatagctatctcagctacgcggccagcgggttcgcagcgcagacaatcctgcgcacgagtatgagcgcggcatttccgctgttcgcgccggccatgtttggttcgctaggtgccaatgtggcggtcagtgtgctggcggcgattgcgacggtgttttgtcttgtgccgcctctctttgcacggtttggggaaaggattcgtgcgaaaagtcggtttgcgagatatagtttggatgtgtataatcggattacggttgaggaggagggtttctag

SEQ ID NO: 2493 - DNA, 468 bp, A.fumigatus
cctccgcaccttcttcaccatggccctctttcgccccatctacctcttcttcaccgaacccattatcttcctggtatccatcatcagcgccatccctttcaccctcatctacatgttcaccgaggccctcccaccaatctaccaatccttcggcatgacccccacccactcctgtctccccttcctcggccttggcctcggctgcatgcttggcatgctcacccgcatccacgactacaaactcatcgtctcccaccaccgccagcgcctccccctgcgtcccgaagacaaacttctcggcttcatgatcggctccccggtcttcgccctgggcctgtggctcttcgcctggaccattcccccggcaatcacatccgtccactggatggtctcgaccgtcgccctcgtggcgatcggctacgcagcaaccgagtttggctccgtcctgaccggctatctcgcagatag

SEQ ID NO: 2494 - DNA, 231 bp, A.fumigatus
  unsure (99): Identity of nucleotide sequences at the above locations are unknown.
tatcgctgttattccccgatggctttcataactgtggtcgtggagttgtatagcagtcaagctatgcttcatatgtttgcattcataatctcgtgcacntatcttgcgaacctcgagcgcctttatgatcaaactcaatttgtagttaatactcgggatggctccactggtaagtttcacatagcagcagccggaggtcataacacaagggaagtgctttcacccccatga

SEQ ID NO: 2495 - DNA, 186 bp, A.fumigatus
tccgagggttttagcaagagccttttcatcctcgccatcgcaacgggagaagatgataatagttcgccttctccaactgacctagatactaagttgcaacgcaaaatgttgtgctcttcctcaattcggacactgatgggtaagatcaactaccctaaaaagactggttggagagacagcgactga

SEQ ID NO: 2496 - DNA, 459 bp, A.fumigatus
acttgggttttctacttcgggacccccttctttcaaaagcttgggaaaccatcacggacccctttcctgatcagcatgttccccaccatcgtcaatgtttgctccactcccatttccttttacaccatggaaaagctcggtcgtcgtactcttctcctttggggtgctctgggcatggttgtctgccagttcattgtcgccattgtcggaactgtcgacggcagcaacaagagtgccgtcagcgcggaaatctccttcatctgcatttacatctttttcttcgccagcacctggggtcctggtgcctgggtcgtcatcggcgagatctaccctctgcccatccgttcccgtggtgttgctctgtccaccgcctctaactggctctggaactgcgtaagtttctcctcgacacggatgccaaaaaaaaaaaaaaaaaaaaaaaaaaaaaaaaaaaaatag

SEQ ID NO: 2497 - DNA, 288 bp, A.fumigatus
atcatcgctgtcatcaccccctacatggtcgacactgacaagggtaacctcaaggccaaggtcttcttcatctggggatctctctgcgcctgtgcctttgtctacacctacttcctcatccctgagaccaagggtctcaccctcgagcaggtcgacaagatgatggaggagaccactccccgtacctctgccaagtggaagcctcacggcaccttcgccgccgagatgggtctcactgacaaggatatggctgagaagaccgccgaggttgtccaccaggaggtttaa

SEQ ID NO: 2498 - DNA, 750 bp, A.fumigatus
cgatgtacaaccagccccgtctacggcgtcatcttcctcttcaaatggatccgcgaacccccctcaacaaacaccacccaacccctcgacggcacctacatcacctccctccccgagaacctcttcttcgccgcccaaaccatccaaaacgcctgcggcacgcaggccatcctctccgtcatcctaaaccaggactcccccgcctcaaccccctaccccatcaacatcgggcccgagctccgctccttcaaggaattcacggccggcttcccgcccgacctccgcggcgaggccctctccaactcggagaccatccgtaccgcgcacaacgccttcgcgcgcgcctcgcccttcgtcgacgagacggtgcgcacgacgcaggatgaggaggcggatgtctaccatttcattgcgtatacgcctgtcaacggggtgctgtatgagcttgatgggttgcagccgtatccgattagtcatggcgagtgcaatgctgagacgttccctgagaaggtgattgaggtcttgcagcggcgtattgcacggtatcctgaaggggagacgcgatttaatcttatggcggtggtgagggatttgaggttccgcgctcgggagacgggggatgtggagttgttggagcgggaggcgaggaagaggcgcgcgtgggcgtgggagaataccctgcgccgttggaactttgtaggattcattggggagatgtcttcaccacggggctggaaggtaccgcgctgc

SEQ ID NO: 2499 - DNA, 207 bp, A.fumigatus
cagatgagccaagacgaggccaaatcgctcttgttggctaacaccgatcgcgcattcaagtccggtgcctttgggcttccctggttcgagtgcaccaaccccaagggtgagacagaagggttctgggggattgaccatgtgggccaagtcgccgagttcttggggttggatcgcagcctggatcaaggtttccgggcggtgctttag

SEQ ID NO: 2500 - DNA, 222 bp, A.fumigatus
  unsure (190),(221): Identity of nucleotide sequences at the above locations are unknown.
aacagtcccacacaccccgggttcccttcaagggccgaaaaaccttgtagcattccactttttcttttgccccgttccttccccaaacgatctggcggttccgtttggctccataagacatcgtctgagatttcgggtgcagataactccttgctgatcacttcccagcactatcttgggcttgtttctngacggtcggagaggctttacgttccacaatna

SEQ ID NO: 2501 - DNA, 534 bp, A.fumigatus
atactgttaataccagggtcgatctgtttcgttttctccatcatgatgacgagcctgtgccggaagtattaccaagccattctcgcccaagggatcctcggcggcttaagcaccggcgtcatcttcactccgtcccttgcggccattggccactatttccagaagagacggggacttgccatgggcatctgtgctgcgggttcttccttgggtggtctcctgttccccatcgctttgagacatgctctctatagccggcgattagggtttggttggggcgttcgcgtggtcgggttcgtggttttgggccttttggctatcgcctgcaccgtagtcagagagaggctaccaccacgcaagggccggttcttcctgctccgcgcgtttgtgcaaccatcatactccttcctagtggccgccgtcttcctcagtttctgggggatgtgggtgccgtgtttattcatcgtctcgttcgcaatccagaagaaacacatgggcgggaacctagcattctacacgctgtcgatagtctgt

SEQ ID NO: 2502 - DNA, 402 bp, A.fumigatus
ttgtcagccatccaattccagactctgtgccgcctaccgttgccaaaaagcgatgattggccactccccccgcctcgacggatgtgttggacgggattaaacaaggaaatgagagattccgatgtggcttactatggccgactgttcaatcagtggtgccacggaacaggcatgccgacgatcgatcacccagctgacgagtactttgtgcaagtcgcccgattcgacccatcaaagggaacaattgacgtcttggactcgtatcccatgttccgtactcacctgacacagactaagccagacagaagaccccaaaacgagtcatctgcagacatgggtctgacgatgatccagacgcaagtgaaatgcccgacatggctgtggatcttattcatgaagtaa

SEQ ID NO: 2503 - DNA, 339 bp, A.fumigatus
agtggcaggcgcagatgccatcgctctcaccagcgcacaagctctatgcccaatctggcacgtaatcaatgtgttctaatattcagtcatctccctcaaagttctgaaggtgagagcttcgacgcgtttaatttaggtacgatcgaaagtacaggaacgcctgaattgcaggaatgtgatactttcactagcagtgccctatccactgatacctacaaaagtaagatgcaatcgcttcggaatccgtcggccatctggcatttcagcctgttgcccaaatcctattctaatgcagcccaggccactattgccttttcaacaccttaccctcacgaataa

SEQ ID NO: 2504 - DNA, 474 bp, A.fumigatus
atcctacagaaatgcagccaatcaattggcgtctctttcattaaccccttaattttgatcttcacagtccagagacaccaagcggctattgcgacatccatcaccatgacaggcttcgatctgaagaaccccatgaaagaatcagtcaacgtctcggtcatgtccacagacgtggagaaacctcccccgcaattgtgtcaagatgcttcacatctcccctttgcggcagtcccaaagcggaagcccgtccctgtcggcgccacaaaggcttcttcggacgcgcaagcagccattgcgacgaaagaacctagcgcatatctccccaccaaaggtgcttggtggaacttgaacaggaattggcaacaattctcgagaaagaagcgcgtggtcattgctgcaattgcagtcgcggtcgtctgcctccttgcgcttgtcatcggccttgctgtgggattgaccaggggaaaagggtga

SEQ ID NO: 2505 - DNA, 285 bp, A.fumigatus
agtcatggtcgagtccactactccgtactaactgaccccttgcatgggcatggcctgcggggagcctccttttctcttctcctctcgtccttttattcgccggttgctatcccccacctggcctatttgtttggcactttggtctcaaatttcgaatccatgttgatcactgtagcccatgtctctgactatgatattgcatattatagtagtattattagtacgggtaaagcagatcggagaatgacgctatttgcaaccgtctgcctcagaacaaggatatag

SEQ ID NO: 2506 - DNA, 216 bp, A.fumigatus
agactcaacaatttggagcgccagacctccgttcctaaggtctatgtcatcctcggcctggtcggaatctacaccttcctggttttcttcaacattgctggcgagttcctcgtcaactttgccggtttcctgattcctggctactactctctcaatgccttgttcacctctggcaaggcagatgatactcaggtgagtcttttcccgcttaattga

SEQ ID NO: 2507 - DNA, 204 bp, A.fumigatus
attaaagcccttttaaacgggtttttttttccaaccataggccgccatttcccagaagtgtgcgcttgggaattccaaaaggtttctaaggaacaattggccaacaccccctcgttcaccgatatttcaagaagttcctttggttcaattccctgggacgaagactccgacccacggttcgatgataatctggagataatatga

SEQ ID NO: 2508 - DNA, 636 bp, A.fumigatus
acgatcgcagaccggaaagccgcttcaaaggacgtcaagcgtatgttccgccgcgaacaggaaatctccaattctgacctcgatccagcagccaagaaagagaaactagctgctctcgcaggaaagatccacgctgcacaggtgaatcacaactacaccatctattacccacttacgcagaaatacgtcgcgctctacgcagagcagaagaagaaaaagaaggagtctagtgcacaatcggaaaaaccgagcgagcccgaagcggaagttgccagcaaactcatatatgacactacgggtgagagaccgcccatgtggcgtgtagttgagaagtgcatggaagacggcacgctggatcttctccgtgaagggaaattggacggtagtgaaggcgagaagagctcacaagcgcccgagcaaaagaagtcgaagaaaagtacggatgacgatcagtatgcgcgcaacaaatccagtacggagaaggtctccgacaagcctagcggaaagtcgagaaaatcaggggggaagcaagacaggaaaccaaaacggtccgcggcaatggagggcgcatactggagtgctaatgagcacgatgacgatgataatgagagtgacggtggtttcttcgaggcgtga

SEQ ID NO: 2509 - DNA, 768 bp, A.fumigatus
  unsure (640),(697),(705),(724),(732),(749): Identity of nucleotide sequences at the above locations are unknown.
actcagcgcttcaccttctacacctccttctttgctatttatactgtaacagtctctcaaatatgggttggttttgggcagatccgcaggcaaagccaacgcctgtggcaccaaaccctctggcgtcctccgatgcgtcccctccagttagtacaagatcctgttggcatatctcacagaaacagtttcattgacgtcgtacagccaggatgtcccatgcatgcttccaacgctcctccagccttgtcttcgctgtctgctcggtctgatacttccagctcctgccctgttcggtccccagactctccgttctatgtgcggccgaaaactaccatgacggactctcctcagcctcccgctcccgaaaccaaatctgctttgtcaaaattgaaccctcttaactacatgttctcctccatttctcaggagcgagcaccgaatcagacggtagacctgccggtggaacgagagccttcctccatacctagaggggatgcagacggcaactgggagtatccttccccccagcaaatgtacaacgccatgctccgtaaaggttacaccgatacaccacaggatgctgtcgaagccatggtagcggtccacaatttcctgaatgaaaggtgctgggctgaaatanttggatgggaacgcctctttgctaaagggctgggacaagcatgggagaagtgccganagggaaancaaggcattgctcgaaaancaatgaancaggagatgaaccgganatgtggatccagcctgtga

SEQ ID NO: 2510 - DNA, 426 bp, A.fumigatus
aagctcggttccttccagccccgtggtgaagacatgctgctcgccggaatgggctctacgagttctcgcgacccttcactgaatcggcagaggaacaggcgcgagagcggatcaactgccccgaccacgacgaacatcaccgatcgcacgcacaataccgtcccaacctcgattgacggggatcatgaaacttccatgatcgaaggtaatggtgtcggccagcagctgagcctgaagaatgagcgagctctatccaacatgagcagcgctgcagcaacgccgttgtctgaagttacttcggcaggagcctacggctcctgtatagcgaagtcggaaggtgatgcaaggcgatctaaaccaagcgtgtctgcgcttgagctacagattccaggccactacccacccgcaaatcatatacctgcgtga

SEQ ID NO: 2511 - DNA, 327 bp, A.fumigatus
agacggaaattcagcagtggaagttctgtcaatctgctagtcccccaggatcacttccaccttgtaaaagggaccacaaaggaacacaatgtgactcatgagagcggcatgcatatgactctccacttctgtgaggcctgtggctgtttgctgtacaagacagcagatcggaaggattttgagggtggtgtgattgtgctggctgggacgctggacgatcctcacgctctggatgatgccaaacctgaggcggaattcttcgtcaaggatcgagcttcgtggtggccggcgctgggtgatgtgaagcagttgcagggatttgactga

SEQ ID NO: 2512 - DNA, 216 bp, A.fumigatus
  unsure (33),(91),(100),(141): Identity of nucleotide sequences at the above locations are unknown.
agaagttggaggtgccgatataaagttaatacnaaacagaagaatgcatctcccgggttcatcatcgaagcgaatacatctaagatagtancttggtatnttcttctgctaaaagttggggctaggctaataggtaacatntctgggagtcatctacgctctgggcgacaaccgcgtcgaatggctggtctctccatgaatgaaggaccatcttaa

SEQ ID NO: 2513 - DNA, 687 bp, A.fumigatus
ttccaacagctcaccctgatctatacttccgcgagcagcgatcaagcaatcaaccagctctgcgaccaaatccactctctaaacaacggctccacagcgatcaaagttcaagccgacctccgacagtcagacgccccggcccaaatcctcgcagccacgttcgacgcattccccaatgccaataacaagatcgacatcctagtcaacaacgctggcgtatccctatgcaagaacctcgctgacacaactgaccacgacatctcctccgtcttcgacatcaacgtctacggcttgataagcatgaccagagcggtgatcccgcatctccgcgccccaggccgaatcatcaacctcagctctgtagcggctcggcgcggatcgcccggtttctcggtgtactccgcctccaaggcagcggtggaggggttcacgaggtcgctggcgtgtgaattaggccctgtggggtgtacggttaatgcggttcagcctggggcggtggagtccgatatgttgcgccgggaggtgcctgagcagttaatcgcctatattcaggagaatacgccgttaggccatcggattgccctcccggaagacacagcgagggttgtgacgttcctagcgggggagggggccgggtgggtaacggggcagagtatttgcgttagtggggggttgcatatgaattag

SEQ ID NO: 2514 - DNA, 1740 bp, A.fumigatus
ccaattccacatattatttggcccgaagggttattgccaaatatggtcggcagatttcaacccccaaatgcggtgaaaacccgccaagagttcttaccctttcaagcacaggcattgcagcgaatcaatgcgcatcgccgtggacagagtctcgaccaacgacctttgcacgatgggaccgtttccattactaacgcaacagcaaatcagcagcaccaaatccttgctggaggagaacagcatccccaattctcgcaatcggcacatttcccccagcactcctctcccatgcccgtgatgcctgaatgcccgtctttgacctcagaagacttgcaagcattatccaattctaccagcaatgcgaatcatccgggcatggcttacatgaattcgagcttcattgctatgggaaatccgagcttgggacttcgaccaatggataacaatctgaatctgatgcaacagcaacagcagcaaaatgcccacgtctcatgcgtcaatagccttgagggccaaatcctcgacaacggtgcctggaatttctaccagcaaggccagctccctacgacgcttcggtctcaagtcaacaatctttcggccgatgggagacgacagtctgttcagtcagatatcaccccctcgcaacgaccacatacccccaagcaagcaaatacgcgtaagttatccattcagtcatcttggtcatttttctcccggccactgacaaccgatccagactactttcccataacgccagcgacaactccgtttaagaaaccggcggaacttgctcagtatagtacggacatgcagtccacccccaccaaggagacaggccgctctgcacccgcatcagcccagtcggtatacatgcaacgagccaaatccctccaaggagttgcggggtctaccttttccaactccaaaatcgagatgccctcccccccgaacacggcttcatttgaaattgacaattttgatgcgtttagcagtcagcagggttccagtttcgagatttccgagtcagagaatttatcgcagagtcactatgcctcgtcgtcagcaacctcgtcctttcaatcctccccagagctagccgccatgccaagccccgaagacaatcacgagaaggctcataagctgcccatcttccctgccgcgtccaatcggccagcgcacaggaaggcgctgagtaccagctccagttccaccttgacgaaaccccggctctctccaagagtggcttcaattgatagccctaaccttgatgctagggttcatgcttctatcaaagagactgggatcaccatcgatgagatcgcctcctacatctctggccctgacccggaggatggcaagtgggtttgccttcaccccggctgcgagcggcggttcggaagaaaagcaaatatcaagtcccacgtccaaacccaccttggtgatcgccaatataagtgtgatcatcgcaacaagtgcttcgttcgtggacatgacctgaagcgtcacgccaagattcacactggagacaaaccatatgaatgtctttgtggcaatgtattcgctaggcacgatgctctgactcggcacagacaacgaggaatgtgcatcggcggttacaagggtattgtgcgcaagacaaccaagcgtggccgtccaaagaaacatcgaccagagttggaggagagacaggataaggcagccaagacacgctcttcaccacggggctggaaggacacgcgc

SEQ ID NO: 2515 - DNA, 375 bp, A.fumigatus
caagggccggtgggcgtgggcagtccactcggccgtggtttccggtcggcgctttcggtagcggtggaaatagcgaaagaggtagtgttcgattacaagtggaaaaaggccgtcgcgttcagtgtccggcattcttttgtggcggccggtacacttttcatcgtgttcgtgagtcgaggaggcagcaatgcactgctggtaggtttcctggcagacaaaaaagggcatggtctgcatgtacggggacacgtgggcctcggtaccgttgctgcaaacgcaagagaattggagagtgtcctatacatttatcgcattagttcggtgagcagtgagaacggtgggttccttaagttcaaaacatacggaatcacatga

SEQ ID NO: 2516 - DNA, 477 bp, A.fumigatus
agatacggtgacctcatccgcacatatatcaaagagggcaagatcgtgcccatggagatcacggtggcgctactgtcgaacgccatggccgaggcgttggcggcgggggctggcgcgaccgctgagggcgggaagaagaaggcccggttcctgatcgacgggttcccgcggaagctcgatcaggccgtgttcttcgaggatacggtctgcccgtccgagatgactctgttcctggactgtcccgaggaggtgatggagaagcggctgctcaagcgcggcgagacctcggggcgtgacgacgataatgccgagtcaatccgcaagcggttccgcgtgtttgttgagactagtatgcccgttgtccgggcgttcgaggaacagcagaaggtcttgtccgtctccgccacggggacggtcgatgaagtgtatgccaggattcgggagggactcgaaaagaagggtgtccagcctatctga

SEQ ID NO: 2517 - DNA, 489 bp, A.fumigatus
catgcgaagattgtcagtgtcgacacgaccgccgcattgaatatccctggagtctatgactatgtggaccatagggaccttcctaaccccaaagcgaattggtggggtgctccaaagtgcgatgaagtattctttgcggtggatgaagtcaccactgctggccagcccattggcatgatacttgcaagctctgctaaaattgccgaggaagcttccagagctgtgaagattgagtatgaagaactgcccgcaattctcacaattgaggaggcaatcgaggccgaatcatattttgaccacttccgctttatcaagtgtggcgacacggataaagctttcgaggaggcggatcatgtatttcatggagtatcaagaatgggtggtcaagagcatttctatctggaaactcaggcttgcgtagcgattccgaaaccagaggatggggagatggaggtctggagtagtactcagaatcccacagaaacgtga

SEQ ID NO: 2518 - DNA, 318 bp, A.fumigatus
cttcggaatagccaaacatatgttgctcaagtcactggtgtggcagctaacaaggttgtgtctcgagttaaacgacttggcggcggctttggtggcaaagagacgcggtcggtgcaactagcaggcatttgtgccacagcagccgcaaagacgaaacgaccagttagatgcatgttgaatcgggatgaagacatcgttacctctggccagcgccacccattcctctgtcattggaaggttggcgtgacaaaagaagggaaactcctcgcacttgatgccgacgtatatgccaacggaggtcacacgcgggatctctct

SEQ ID NO: 2519 - DNA, 240 bp, A.fumigatus
tccttctatcacctaatttttggccttcattgcacagaaagactgacaattatcgttcgtagatttaacgacctggcatggacagattacgaggacaactcaaggggggtgatcgctggtgcactggagatcggctccttggatctatgggatgcggacaagctgatcaacggttcgaggttcgtccgtagacaaaaccccccggccatgatgaattggctgacagattacaagcagtga

SEQ ID NO: 2520 - DNA, 279 bp, A.fumigatus
ggctcactactgcagctctacatctccgatctcaacaatatcacgaacccgtaccgactcggaagcgccgctgcccgcgctgacgatattgaatgcttggactggaataagaaggtcgcacacatcctggtcacgggtagcagtgctggctttgtcactgtctgggatgtcaagacgaggaaggagagcttgaccctgaacaacatgggccggaaagctgttagcgcagtggcgtgggatccggagaaggtgagactgaacaaaatcaacagtagctga

SEQ ID NO: 2521 - DNA, 192 bp, A.fumigatus
acaaaatcaacagtagctgattttatctctgactttgggcagcccacaaaactcattacttcaacaccactggagtccgatcctcttatctacgtttgggatctccgcaattcccatgccccagaacgggtgagctccgagttcccctattcctccataggcaatagtaccaatatgattaacactatctag

SEQ ID NO: 2522 - DNA, 192 bp, A.fumigatus
ttgaccccttggcggcaggcgtacctgtatgacaatgaggaccgcttctttgtcggctggcggctgggcgagtcctggatttattgcaccgtcagctggtgcgtgagtcttttctgtgcggtggccatgatacttgcggggaatagtcttccctccgaggggggatatgagttgattccggatcatttttaa

SEQ ID NO: 2523 - DNA, 723 bp, A.fumigatus
gagcgcgtttccttccagctccgtcggtgtaagacggttcaatctctcgctatgatcaccaaggccggtgttcctgccagcaaaatcctggtgggaatggcgctgtatgggcggagctttcaaatgaccgaggcaggttgctatacggccgattgcacatataccggtccaatgtccggcgccacgccaggcgagtgcaccgacaccgctggctatctctccaactacgagatcgaacagatcattgctggtggcggtgttcagcagtattcgtcggacgatggcgatattcttgtctacaatcagacccagtgggtctcgtggataaatccttcaacctactgggatcgtctcgcatgggtccaggggttgaactttggaggtacatctgactgggccatggacttgaatcagacgtttgcagacgccgatgccagcaatattgtgtacatcagccctgacatttggtccgaacctgatccgacagtggcttgctatccgccatgcacgtttgttttccctccttggtccttgtcaactccaaccacaatctctcggcctccagtgacgatgaccctagaggagacatggcccctaatcgaatcgctgaacggcaacatcacgacaacagggtataccactggaacgacggtcaccactattaccttgcctcccgtgacgacggatctgtcttcacccacggggctcgaaggatccgagcta

SEQ ID NO: 2524 - DNA, 1179 bp, A.fumigatus
ttggaggggcttatttcgcaaagcacttttccgggatgggttttttcaacatttggagggaatggccaagaatcggaagctcaggagttgggcagcggggattatttggcggaagggtcggagtttccggagaaaagagatttttgccaagccccaatggtaaaaattcacaaggggggaccgccagacagcggagctgttccaacgcttcaagggaacagatctcggaggcataaggacgacaatgtttctaacgcaatcgaaggttgggcctattcttctgtcaagccagttgtaaaggagcagctggcgaaggattctgctttcctgaaggaattgatcaaggtgctaaaagccagtatcgccgacgcatcggtgctgtatggtggcctgatgatcattttgaatctcacacagtttctaccctcgatgacagaagaacagaagaagatgtctcaactcaaagcgtacgcagacgcttcaggcgcgacagcacaagctgggccgcacccactggacgacgacgagcacgtcatcgcccgttgcaacgcggtagttcaggccggggtcatgcctcttttcatcgaatgcaacaagagcagtctgccttccgcgcaggggctagtaagcaaaattctgctctctttgtcccgagaccgcaaatctagaggaatccttgcgcaacaaggcgcggttaagctactcctcagcctgggttctgctagacaaggcacgtcgggctcgatctctgacgaggcaatgcagagcgcttcacatgcactcgcccgtatacttatctctgtcaacccgtctctcgttttcccatcctccggagttcctcagatcacctcagccgttcgacctctgaccaatctgttggcgacgcccgaagtaggcaacttgactgcggaacagccgcgcgatttgctacccgtgtttgagagccttcttgctctcactaatctcgcatcctacccggatccgtctgcagcagaggccatagttcgccatgcatggactgttgtcgaagacctcctactctcaagcagccctatgattcaacgagcatcatgcgaactggtttgcaatctgatgacgtgcgagtctggcgttgcaaagtttgctgatggctccaagcgggcaggtgtccacacacggcggctagaaggaacagcgctc

SEQ ID NO: 2525 - DNA, 1185 bp, A.fumigatus
  unsure (1074),(1153): Identity of nucleotide sequences at the above locations are unknown.
gaatacaggtggaacacgagcctcacctccaacgacgtccaccgtcgtctccccgcagacggcggcctctggcacaatgaagaacccgtcaccacccccttcttcggcatctgggaccgctccgcggggaagatcggcaccctgatcgccttcctaccgaccgacaagccgtcgcccaccgcgcaagtcgacatgtcctccgtcggcgccttcgcctaccgcgtcgaagccaccgagtcgctcagccgcgtgacgaccttcttcctccagcagcgcatcaaccaccgcgaccgccaggagatgggaagctggctgatgcggttcaaggagctggatctccgcctggtcagctggaagatgtccctcccgcagaaatggaaggacaccaatatctcgcggcagccgacggtcgtgacgatggatccgaatctcacgctggcgcatatcacgcacaacacgtcgatgatcctgctgcatcagcggattgcgtatccgccgccggagtggttggaggtggtcaagttgcccacgctgtccagtgccgagacgtgcgaggcggcagcggccgagacggccaatatcaccgagaagtatctggggaattgtccgagggacggggtcgtggatagtcagtttgcgttttgtgtgtttgtcagtgccagggttctccttggtgagttttcttcctctggacctagccggggcttctcacagcggaccctcgaggtagtgcattggcgatattacggcacgcccttgtcgccagattactggaccctgatgaaatgcctcgatgccatggccacacgctggtcgggccgtgtccaggccagtcgtcagaactcagcggcccggtattttggccagctcaacgccatccaccgggcgtgtcagagcgacgagaacttcaagctggatgtcctgggatactccaacgagattgaatggacgggagagaagcagacaacagcaccggcagccgtaccagcaccggacaccaccactggactgtcccaggtggcctttccggcagacctaccgccgatgctgcagtcgagcccggcgaggatgagntacaacaccggcagcccggacgaattgacgacggtgacctccatcctgctcgatcaacagtactcggagctggacggtnttcaccacggaagcgaaggtccgcgcatgcgc

SEQ ID NO: 2526 - DNA, 591 bp, A.fumigatus
  unsure (43): Identity of nucleotide sequences at the above locations are unknown.
gcctaccgcaactgttcgggagtctctccgttctttggggttntgcggcagcccaaagaagtccccattcaggagaaatatgactattgtgagaagatcatcgacctacttgagatgcgcccaatggccggtgcaacggtgggctcaggaggggctggcctgaacccagaacaacgcaagcggcttaccattgcagtagagctggcaagtaagcctgagcttctactctttctggatgaacctacaagtggcctcgactcgcttgccgcgttcaacattgtccggttccttcgacggcttgcggacgctggacaagcgattctgtgcacgattcaccagccatccgcggttctcttcgaagagtttgatgacctcctgctgttgcaaagtggaggtagggttgtgtacaatggagagctgggacatgactcgaatgctctcatcgagtatttcgagtcgaacggtgctaagaagtgtccgcctcatgcgaatcctgccgaagtacgtcttgtgcctcatctgtttaagcctaaactaacaaagttcccagtatatgctcgaggtcatcggcgccggaaacccggactataa

SEQ ID NO: 2527 - DNA, 270 bp, A.fumigatus
caacagggcaaattcctccttcatatcttcactggactctttaacacgtttacattctggcatctgggaaatagctacatcgatatgcaatcgcggctcttctcgatcttcatgactctcaccatttcgccgccctttgatccaacagctccagcccaggttcctgcactttccgggaacctcctactaatcacgagtaggccccctccaaaaatcttttcttggcaccgccgatggtctcccaccgccatcctccccccaactggccta

SEQ ID NO: 2528 - DNA, 420 bp, A.fumigatus
caaagttcccagtatatgctcgaggtcatcggcgccggaaacccggactataagggaaaggactggggagatgtctgggcccagtctcctcaatgcaaacaactggccgaagagattgacaaaatcatcagctcccgccgcaatcgcgaaatcaggaagaacaaagacgaacaccgggaatacgcgatgccaatctggacccagatcgtgactgtcaccaagcgggcgtttgttgcatactggagatccccacagtatactctcgtgagtgtgcagtttcgtcatcggggagttgaagctaatagcaacagggcaaattcctccttcatatcttcactggactctttaacacgtttacattctggcatctgggaaatagctacatcgatatgcaatcgcggctcttctcgatcttcatga

SEQ ID NO: 2529 - DNA, 1110 bp, A.fumigatus
tggcgcgtctgcttgcagcctcgtggtgaagacgaacacgtgatcaacttcttctactatgtggctaatgagatgcgtgctatcatggccaagctcggcatccgcacggtcaacgagatggttggacgtgctgagttgctcagggtcagagaggacattcgcagcgccaagcaggagagaattgacctctccctcatcctgactcccgctcattccctccgtcctggcgtggctacttacaatgtccgcaagcaggaccaccgtctgcacgtccgccttgacaacaagctcatcgcggagtccgaattggcgctggagaagggtttgccttgcagaattgagtgtgacattgtcaatactgaccgtgccttgggcgctactctgtcttaccaggtcagtcgccgctacggtggagcaggccttcctcaagacaccatccacgccaacatcaagggctctgctggccagtcctttggtgctttccttgctcctggtattactctcgaacttgagggtgacgccaacgattatgtgggcaagggtctttctggcggccgtctcattgtctatccgcctcgcggtgctgcctacaaggcagaggagaacatcatcatcggcaacacttgtctctacggtgctacccggggtacctgctacttccgcggtgtggctgctgaacgttttgctgttcgtaactctggtgctactgccgttgttgaaggtgttggtgaccacggttgtgagtacatgaccggtggtcgtgtgctcattcttggctcgaccggtcgtaatttcgctgctggtatgtccggtggtatcgcctatgtcttagacatgaaccaggatttcctctccaaggttaatatggagatggtggaggtctcgggcctggaggatcctgctgagatcgcctttgttcgaggtttaatcgaggaccaccaccactacacaggctcagaactggctgctcgtatcctcctggacttcactcgcgctcttccccactttgtcaaggtgttgcctactgattacaagcgcattctggaggaggaagctgccaaggcagcagctgctagtcttcaccacggccggctggaaggacaaaagtcc

SEQ ID NO: 2530 - DNA, 828 bp, A.fumigatus
gacataggcgataccaccggacataccagcagcgaaattacgaccggtcgagccaagaatgagcacacgaccaccggtcatgtactcacaaccgtggtcaccaacaccttcaacaacggcagtagcaccagagttacgaacagcaaaacgttcagcagccacaccgcggaagtagcaggtaccccgggtagcaccgtagagacaagtgttgccgatgatgatgttctcctctgccttgtaggcagcaccgcgaggcggatagacaatgagacggccgccagaaagacccttgcccacataatcgttggcgtcaccctcaagttcgagagtaataccaggagcaaggaaagcaccaaaggactggccagcagagcccttgatgttggcgtggatggtgtcttgaggaaggcctgctccaccgtagcggcgactgacctggtaagacagagtagcgcccaaggcacggtcagtattgacaatgtcacactcaattctgcaaggcaaacccttctccagcgccaattcggactccgcgatgagcttgttgtcaaggcggacgtgcagacggtggtcctgcttgcggacattgtaagtagccacgccaggacggagggaatgagcgggagtcaggatgagggagaggtcaattctctcctgcttggcgctgcgaatgtcctctctgaccctgagcaactcagcacgtccaaccatctcgttgaccgtgcggatgccgagcttggccatgatagcacgcatctcattagccacatagtagaagaagttgatcacgtgttcgtcttcaccacgaggctgcaagcagacgcgcca

SEQ ID NO: 2531 - DNA, 276 bp, A.fumigatus
tgtgtacatccagatggcgcgcacgaacggaattactacaggccttcgccatgggacgctggtgatgcattgctgcaagactgcactagctacgggcatgttggcaacaagaatgacctgtcagcagctacgattgaggaatacatcattgtgagtcgtggactgaacacgactgaacacacgcaagcctcatttgttgtggttggtgactctagatcacatgttattgatatagaccagcgcaccagccaagctcgggctccctcaacccgctga

SEQ ID NO: 2532 - DNA, 213 bp, A.fumigatus
gggaacatcatcaacaagaagaagaatccgcccaaggaagaggagaagaagaaagacaaggaagagaaaaaggagaaggagaaagaaaaggaaaaggaaaaggaaaaggaaaaagaggagaaaaaggagatcgatcaccataagactacgtggatcaaggtaagtgatctggattcagaggaccgaagccattgcatgaggtgtctaacataa

SEQ ID NO: 2533 - DNA, 210 bp, A.fumigatus
ctcgacggcaactacattatcatcaagcaatggatctctgaagatttgcaggaagagctcttcgcccacactcggcgactacgcgaagggaagctcgtcaccgagacctcaagcaccctgaccgaactgaaagtcaatgatcgcaagaaagacaggatgtaccttgtgcgcaagaagagccctaaccggagggcatggattttcacataa

SEQ ID NO: 2534 - DNA, 657 bp, A.fumigatus
  unsure (284),(381),(585): Identity of nucleotide sequences at the above locations are unknown.
ctccccgccggggggggaaattcccgaactttgtcttgtgggcaccccaattttcccaaggggggattttacccaccgggtcctttgcaaggaaagtgggggttttggggagaagccagttccccggctcaaggaacgttaggaatcggattatttaggcgtatcccagtattaaccgggcagggcgcgatattcttcgtaacaggaaggtgtacggggcctgttatcaggattttgggcgaatggcagcgcgagatgcccgtaatgttggactttatgttctnttttaacgagcaattgaagcggggtctagctttagttgcgagctcagagcagtcagagcagccactcaaatcgacttcgtcttcgtccatcaacttngtgtctggtggattggctgccgggctggccacggcaatcactaaccttttgagtgccgtcaagacccgtctgcagcttatgcctggcaagtacgggaacatgatacgtgccgtccgcttgatgattcgcgaggatggcgttcgaagtctgtttggcggcttgggacttcgcattaccagaaaggcactcagctcagcacttgcntggaccgtctatgaggagttgattctgcgggctgaagctcgctgggctgaaaaggacaagatcgacttatga

SEQ ID NO: 2535 - DNA, 417 bp, A.fumigatus
aaatatcaagtccgaggcctcgcgtacccaagaggaattgcgcgacctgagatattcgagttcaactccgtcaacgaccactgcgaccggccagcccctgacatgtatgtcatgcaatatcaagtcaaggcaacaacctcagaagacagagctaatgatcgcatagactatcattccttgctttacagactcctaagcgtgagttatctcctggtctggtctcaatcttatatatctgctgacatgcaccagtgggagcaacccagagctactgccgtttccttcgtgagcgtcatcgcctttatctttgccgcccgttacttgccccttcttcgttggttcttcaagtttacgtatctggctttgggatgtgagttgctattggttggtgcgtttttgcgatcgctggctgattga

SEQ ID NO: 2536 - DNA, 570 bp, A.fumigatus
gtttccctttctcggggatgctcacatcggattgtgattgtccttcatccaaagagtgaaccaacctcccccggacccaaaccgcctttacattccgatcatcccccgtccacacccatttatgcaccttctccgtccacgactcccatccaaacacatccaccaccccatgctcagctgtcggggatgacgatgtatgcgaatgacccaaccgcaccatttgtgcatcaaaactcatcccgacctcgaaacccccaatctccccagccagatccacaaccgccgcgccgccccgcgtcgcaaggtacagaccctcctcgacactcagcacctcctcaccgtcgtccccatcaccaggatcatcagtcccgctatgccgcaaaagcctcgaaacaagacatccctgccgcacagcctcgagcacactacagttatacccgccgcttacatccgtccctaggcccacctccacaccagcctctagcagcttcctcacggcgcagagcccgcttcccagcgcggagttggacgcggggcaatgcgataccttggcgcctcgcgcggcgatga

SEQ ID NO: 2537 - DNA, 270 bp, A.fumigatus
cgatgtatgcgaatgacccaaccgcaccatttgtgcatcaaaactcatcccgacctcgaaacccccaatctccccagccagatccacaaccgccgcgccgccccgcgtcgcaaggtacagaccctcctcgacactcagcacctcctcaccgtcgtccccatcaccaggatcatcagtcccgctatgccgcaaaagcctcgaaacaagacatccctgccgcacagcctcgagcacactacagttatacccgccgcttacatccgtccctag

SEQ ID NO: 2538 - DNA, 453 bp, A.fumigatus
cccaaccgcaccatttgtgcatcaaaactcatcccgacctcgaaacccccaatctccccagccagatccacaaccgccgcgccgccccgcgtcgcaaggtacagaccctcctcgacactcagcacctcctcaccgtcgtccccatcaccaggatcatcagtcccgctatgccgcaaaagcctcgaaacaagacatccctgccgcacagcctcgagcacactacagttatacccgccgcttacatccgtccctaggcccacctccacaccagcctctagcagcttcctcacggcgcagagcccgcttcccagcgcggagttggacgcggggcaatgcgataccttggcgcctcgcgcggcgatgagttcccgctcggacggcgacagatgcacggcgtgcgcgaggatcgtgcgcggcgtgaggagtccgaagtcgtcatacacagacgtgtag

SEQ ID NO: 2539 - DNA, 1068 bp, A.fumigatus
tcggccggggggggcatggacaacccctctttgtgcccggactactatctggactcctctcccgaatcttcagtcagcaaatccaaggaaacaattgcccacatccattccatggaccccgccggcacgctcatccaccccatcctcaccccgcgctttgcgccaacctgctccccgcctgccttccacggcctcgcccagctagcgcagtcgtacaaccccccgctccacatccaaacccacctctccgagaatacaggcgagatatcgctcgtccgcgagcttttcccccagagcaaagactacacgtctgtgtatgacgacttcggactcctcacgccgcgcacgatcctcgcgcacgccgtgcatctgtcgccgtccgagcgggaactcatcgccgcgcgaggcgccaaggtatcgcattgccccgcgtccaactccgcgctgggaagcgggctctgcgccgtgaggaagctgctagaggctggtgtggaggtgggcctagggacggatgtaagcggcgggtataactgtagtgtgctcgaggctgtgcggcagggatgtcttgtttcgaggcttttgcggcatagcgggactgatgatcctggtgatggggacgacggtgaggaggtgctgagtgtcgaggagggtctgtaccttgcgacgcggggcggcgcggcggttgtggatctggctggggagattgggggtttcgaggtcgggatgagttttgatgcacaaatggtgcggttgggtcattcgcatacatcgtcatccccgacagctgagcatggggtggtggatgtgtttggatgggagtcgtggacggagaaggtgcataaatgggtgtggacgggggatgatcggaatgtaaaggcggtttgggtccgggggaggttggttcactctttggatgaaggacaatcacaatccgatgtgagcatccccgagaaagggaaacctacgtggatatgggcacgcacaggggcggcctgggaatcgaagtggtggttgtgtggattggggttcgtgagtgcttggtttatttttgatagagtcatgcggtaa

SEQ ID NO: 2540 - DNA, 582 bp, A.fumigatus
acgaatggaggcgacaaatggaagaagggtctggatggcttactgaacaccacgttccagcggttctttccctttcaaaatggcatggtcatgtctgaaattgcctgtgagccgaacatgaagtgtgatcgcaaccaggactgtttcaagggcttcctttcctcctggttaacttttatgaccaccattgtcccgtatacgtcgtccgaggttgtcccaaggatccagcagtcggcacttgcggcagccaaacagtgttctggcggtcagaatcgcactctctgcgggcggcgttggcatcaggatacctttgatgggacgagttcattagaggagcagatgagcgctttgagcgtcttttcgtcctcgatgattgcgcataggatgcaggctcaggcgccgttgaccgtagacactggaggtacgagcaagagtaacgcgagcgcgggcacagggtcagagcaagccgcccctcaaccgcagccagtcacaacgggtgatcgtgctggtgcaggaattgtgactgtagtcttcctcagcggttggatcgcagcagtgacctggatggtgtacgggagataa

SEQ ID NO: 2541 - DNA, 225 bp, A.fumigatus
gtccggcatggaagtatgatgagcatacagacgaatggtgtaagtcttccagacatagggtttacccaaatgatagaaggctcatcaataacagatatgcatctgttctcgccatctcagccagacctgaactgggacaatcctgaggtgcggaatgcagttttcgacgttattgatttctggggacaaaaaggaacagacggcttccgggtatatcagccatga

SEQ ID NO: 2542 - DNA, 237 bp, A.fumigatus
  unsure (116),(120): Identity of nucleotide sequences at the above locations are unknown.
aaaaccttgggggcggatatgttgtggttgacaccaatttatgaatcacccttcgaagatcaaggttacgacattgcaaattacaagggtatcaatccaatatatgggaccatganagantgggaagaccttgctgcagaaattcataggagaggaatgaagataatgatggacatggtgttcaaccacaccagctctcaggtgagcggatctaatgccgaaacatcattatgctaa

SEQ ID NO: 2543 - DNA, 765 bp, A.fumigatus
aaactaggccgccagtccacatgggagcagtcggccgacatccccgacgaggacactagcctcactgtctttaaccgtggcaacgtcatgccatcaaccaaaatcctcacattctaccgcaagcagcctttcgatttggaggctcgctacgctaagcccgacatgcttcctggcaagatcaacccttggattggccgcttctccgtcaagggtgtcaaggctgatgccaacgacgacttcatgatctgcaagctcaaggctagactgaatctgcacggtattctgaacgtcgagtctggttactacgttgaggatgtggaggttgaggaacccgttgacgaggacaagatggacactgatgctcccgagggcgagcagcccaagaagacgcgcaaggtcaagaagcaggtccgcaagggtgacctgcccatctccaccggcaccaacagtgttgatcagaccgtcaaggagacctggatcgagcgtgagaatgctatgtacatggaggacaagttgattgccgagaccgacgagaagaagaacgagctcgagtcgaccatctacgagcttcgtgacaagatcgacggcgtctatgccgagtttgccagtgaggaggagaaggacaagctgcgtgccaagctgaccgatatggaggtgagtacaatgtcttgtccacatacaggacgcaggaactcgaagctaacgcgctacgtaggactggctctacgaagaaggcgaagacactacccagtccgtctacgttgc

SEQ ID NO: 2544 - DNA, 840 bp, A.fumigatus
cccctttttgcaggactcctcgacatggtggccgaccagaagtattgccctaacatatccaatttcctgttcaacgaccccgacggcaacataacgggttttgtgccacacctcacccccctagcaccgccagtgcttgcgctatcccgtcttgccatttctcctgccaaacccatcccaccggctgaatccaatcaggcccttgtacttaaccccgtaccccctagcgctcggtggatccatcacagcaaaacacaagggcgtcgtctttataacctccttgcccaatggaacgtcctttatgttggtctcttcaaccgacccgcgatcactctcctagccccctggggcaacggcgaagccatttcgcagccaagtatcaaccagttcgacctcttccccaggctgaacacgaacttttacggcccctcaatcgccaatatcactgcaatgcgccagccccgcgcccagggcgtgcaggcgaaccgtgtctccactatcactgtattcaacacgaaagacaacaccgatgcgttcacgggactattcacaggagacgcacatgacacgattctacacccagacatccgaggaaatctgaccgcgccccagcatttctcggtcatgaaagtcccgcatcatggcagcaagcacagcgaatcccaggaattctattatcagtataccgcagacgtgtacttgatatcgtctcggttttccattcatgggtattttcattctccgtgcacgctaccatctcttcgaatgccaacggatactgactgtgagggcaacaggcttccaaccttgaagatcacgaaggagcgttttcaccacagg

SEQ ID NO: 2545 - DNA, 423 bp, A.fumigatus
tctcatcccaccaattctagccagagcgtcgggggtcgtgctagatgtcggcccggggacaggcacgcagatgccgctgctccgcgggcgcgcacaagccatcaaaacgatttacggtgcggagccgtgccgcggtctgcatgcggagctgcgcgcgcgcgcggaagaggaggggttgggggagaagtaccaagttctgtcctgtggtgctgcggcgcgggagctggtgccggagttgcagcgggaagggctgcttcctgccggggatgtggagggagttctggcaagcacggacggggtcttcgatacgattgtgtgtgtgcgggttttgtgctctgtgccggagttggagaggacggcgcaggagttgtatgcgctgttgcggccaggggggcagttgcttgttgtggagcatgtggttaa

SEQ ID NO: 2546 - DNA, 609 bp, A.fumigatus
acgcgcccagccgcccgcccaacaagcacccaacaacaaaaccaagaccaagaccaagaccaagaccaaaagcaaacgccgctccagccacctcagatccagaactcaactgatctcatcccaccaattctagccagagcgtcgggggtcgtgctagatgtcggcccggggacaggcacgcagatgccgctgctccgcgggcgcgcacaagccatcaaaacgatttacggtgcggagccgtgccgcggtctgcatgcggagctgcgcgcgcgcgcggaagaggaggggttgggggagaagtaccaagttctgtcctgtggtgctgcggcgcgggagctggtgccggagttgcagcgggaagggctgcttcctgccggggatgtggagggagttctggcaagcacggacggggtcttcgatacgattgtgtgtgtgcgggttttgtgctctgtgccggagttggagaggacggcgcaggagttgtatgcgctgttgcggccaggggggcagttgcttgttgtggagcatgtggttaatccgtggcggactgcgaagggggcgcttggtcttcacttcggaatagccaaatcggcacttattcctaaaata

SEQ ID NO: 2547 - DNA, 372 bp, A.fumigatus
cccttccttttctgttttccgaaagaccagagacacatggcgctcctttctccggggagtcaggaattcgaacatttgctcaaatggctagtctccagacagacatctgagttgggtgaagaggagtcggacgaggaagttgatggctcacctgaccagagtgatagtttgcatcgagacacaagcaacctcgctctcaatgataagattgccgtgcttcctaatctagccccgccaacagaggaatctctactttgggcagggttcaatgggcgctgcaacaaatatgcggatacatgttactcgctttggaactccggtacgctcgtagtaagtatttaccggttttgcgatgttgaacactactcatag

SEQ ID NO: 2548 - DNA, 645 bp, A.fumigatus
  unsure (360): Identity of nucleotide sequences at the above locations are unknown.
ggacactatgtatggattttcctttccgaatttggcaccatccttctgtacggcatcatgtttttctacctccggcgtcagatgaaacaagcggcggcccttcgacagaaccaccaggaaagcctcaaccgcttgaaccgagtcgtggtgtacatggttatctatcctctggtatacgttcttctctccctgcctctggctgaagggcgaatgtcgacggcccgacatgtcgttcccagcaaggaatactttgccgccgccggtgccctcatggctctatccggacttgtggatgtcgtcgtgtacaccttgacccggcggcatctgctcctggacaccgaggtcagcacgtcggatcgntactacgcgcacacgggctcgaacctgtacaacacgcacgtcagcaccaccgtggcgggccccgagagcaagaagtctcgggtcaagtctcgcctccgccgcgggatgcagagcatcaacgatacggtgctcgatgaccgcggcgactcgacagaagacattgtgccgaaaggcccgaaaggcgccgccatggagctgggccatatggcccacggcgtgtaccaagaaacgactatcgagatcacgcacgaaccggtcttcacgactgggctagaagcaacgcgt

SEQ ID NO: 2549 - DNA, 792 bp, A.fumigatus
gggaaacggccccaatcaaattattgtccgccagacttgggggacgtaaaaggacgttcagatggcttcatttctcctgaacatcgtcatccgtcggggactgaggacgagcacggcaagaacccactctatctcatcaaggaagagatcgccatcatgaagaagctgaatcacaacaacctggtgtctttgattgaagttttagatgaccccacagaggactccctatatatggtaatggaaatgtgtaaaaagggtgtgatcatgaaggttggactggaagaaagggctgacccttacagcgatgaacaatgtcgctgctggttccgcgacttgattttgggaattgaatatttacatggccagggtatcgtgcatcgagatatcaagccagacaactgtttattgacgaatgatgacgttctcaagattgttgattttggagtatccgagatgttcgagaaggattcggatatgttcacagccaaatcggctggctcgcctgcctttcttccaccggagctgtgtgtggtaaagcatggcgatgtctcgggaagagcagcagatatctggtctatgggcgttactctctactgtctccgctatggtaggctgccatttgagaagcaaagcatcttcgaactctatgaagccatcagaaacgaccccgtggtatgcgaagaggaaacggatgataatttcaaagacttgatattgcggatactggagaaggatccaagcaaaagaatcacaatgagtgtcttaacgccggagcgagataagcgtagggag

SEQ ID NO: 2550 - DNA, 216 bp, A.fumigatus
  unsure (7): Identity of nucleotide sequences at the above locations are unknown.
ggtaatnatgtactccccaaggcatcgtacgctagaatggagattaatagcgatatacaaggaaagctcatcttagtttcatatgttcgtaagggacaggttactcgactccagcgccacggtgaggttgagcttttcgctggagacctggagggcatctactacaacagccaggcacgtagttatccagccggtatctttctagaggtcatatga

SEQ ID NO: 2551 - DNA, 846 bp, A.fumigatus
gacctccacccaactgcaacacgtgatctgacgagcccagccatatcaattggatggaacacattcgagaaactggaccagagctgcgttgagtatggcatttccagtaatgcactcacctccagggcatgttcgtcgatatcaacaacgtatgcgacttcgcgcacatactccaacgtggttgtgttgacgggcctgacccccgccacgacctactactacaagatcgtctcgggcaactcgacagtcaaccatttcctcagtcctcggactccaggtgatactactccgttcagcatggatgttgtcattgaccttggcgtgtacggcaaggacgggtacaccgttgcttcgaaaaagatcaaaaagtccgacgttccctacatccaacctgagctcaaccacaccaccatcggacgactagcccgcacaatcgatgattacgagctcgttatccatcctggagatacagcatatgctgatgactggtatctgcgtgtcgataacctcctgaccggcaaggattcgtatcagtcaatcctggagcagttctacaaccagctcgccccaatcgccggccgcaagccctacatggccagccccggcaaccacgaggccgactgcacggaaataccgttcacgtccggcctctgccctgaaggccagcgcaacttcaccgacttcatgcaccgcttcgccaacaccatgcccagagccttcgcctcatcctcctccagctcaaccgcccagtccctcgccgccaaggccatatccctctccaacccgcccttctggtactccttcgaatacggcatggcccacatcgtcctgatcgacaccgagacc

SEQ ID NO: 2552 - DNA, 594 bp, A.fumigatus
tgcaaaaggcaatattgttggattagcttccgagaatattggtctctggcagccccaacagggatactatgtacgtatttccgatcgggcttcctccgtcttcttgactgttgccctgacagttcgtcaaaggaacaatcaacaaacgatatctggcgatgcatatgcctgtctgttcagcgcgctatcagccagcataacatcgacccgactactatccgcggaattgggttcgacgcgacgtgctcactggctgttttctccacggttacagacgagcccgtatctgtcaccgggccgaactttgattctgaccgcaacgtgatcctttggctggaccatcggccagtaaaagaaacggaaaagatcaatgctaccaagcacaacttgctgcgatatgtcggaggaaagatgtcgattgagatggaaattcccaaggttctgtggctaaagaacaatatgccaaaggagctatttgaccagtgcaaattctacgacttggccgatgctctgacgcatattgctaccggtaatgaaaagcgaagcttctgtagcttgtatacacagcccggggatggaagtaaagcgcttcgg

SEQ ID NO: 2553 - DNA, 522 bp, A.fumigatus
cctggctacggcttgcttatgccctctggtgacattccacccagcatggcttcgctgccgtatcgttcatttaggcagccctccaggcagtcttctcgacaggcttcaatggacactcgagacgacattcagatccaccaggatcattacatcggaatagatgttggcactggtagtgcccgcgcttgtattattgatgcaaaaggcaatattgttggattagcttccgagaatattggtctctggcagccccaacagggatactatgtacgtatttccgatcgggcttcctccgtcttcttgactgttgccctgacagttcgtcaaaggaacaatcaacaaacgatatctggcgatgcatatgcctgtctgttcagcgcgctatcagccagcataacatcgacccgactactatccgcggaattgggttcgacgcgacgtgctcactggctgttttctccacggttacagacgagcccgtatctgtcaccgggccgaactttgattctgaccgcaacgtga

SEQ ID NO: 2554 - DNA, 270 bp, A.fumigatus
tgtggcgcccctcttcctcgcgctgatcaacgggttcacgtgttcttcccttccgagtggtccgcgagtaacttcttcaccgcgtacattggcattcccgccttcctggtgctgtatttcggtcaccggttgatcttctggagcgacccgtgggcgtggcgcagcgaggaggtggatatgcagactgggctggcggagattattgccgccgagaagccgccccgggtgagggatacctggtggaagaagttgatggcggttgttgagtga

SEQ ID NO: 2555 - DNA, 297 bp, A.fumigatus
  unsure (241): Identity of nucleotide sequences at the above locations are unknown.
ttccctttcgcagcatctgcaccaatcggctcaggaatagaggttatccgaccgaacgagccaaaacgcaagtccgcccagaaccgtttcgtctcctctatatacctcgtctcctccagtgggatcgcccagtcccgactatgggattctgctatctcaagatacggcgtcacggcccgcgtcaaattggctttggggggttcccggaaagtgaacgaggagatcaccagggggacacctnggagatgcaacggagtcttagggtcgaggtctaccccgttcggatgtctcatgtag

SEQ ID NO: 2556 - DNA, 609 bp, A.fumigatus
  unsure (18),(20): Identity of nucleotide sequences at the above locations are unknown.
ccaagatttgcttctcananttcatccccccggcgcatccgtcaacgccagagacccttcctcaatatgtcaagctggcctcgatcagcatgggcaacacggttgtcgtgcacaccttcccgctcgccccatcaccgccctccagccgcaccccacggtacgtgctggtcatgcccggcgagtcggagatctggaccaacttcgccagcggctttgcagccctgctctccattatcaccgtctgcatcctcctccaggccttcacggagatcagaggcctcatgcccccgtacctgggggcctccgcgtggcttcccccggatatccgcgcggccattgcgcgcccgtaccaccccctcccgcctcaccctctcccaaccgcatccgcgctctcggcccataccgattccccaaagcagaccctccgagatctccttcatgcccgtcatgccgccggggccaacgatgccgatgcggccccggacgctgacgcaacgactccagctaactcggtctttgtccgatgtctgcctgaatccaacaacatctacatcgagagctctgacgctcattcctcccgctcatcttcgtcatctcctgaagaggtag

SEQ ID NO: 2557 - DNA, 834 bp, A.fumigatus
  unsure (96),(169),(171): Identity of nucleotide sequences at the above locations are unknown.
agaatcccggagggccagcagcagaccattatggcggtatttggtagcgaccagtccatcgaggtcttggcagttgagttcagtgcaagaaagggntacggcaaactccggcggtatacaaccttacgagacgtccacccgttttcgatgaccaagatttgcttctcananttcatccccccggcgcatccgtcaacgccagagacccttcctcaatatgtcaagctggcctcgatcagcatgggcaacacggttgtcgtgcacaccttcccgctcgccccatcaccgccctccagccgcaccccacggtacgtgctggtcatgcccggcgagtcggagatctggaccaacttcgccagcggctttgcagccctgctctccattatcaccgtctgcatcctcctccaggccttcacggagatcagaggcctcatgcccccgtacctgggggcctccgcgtggcttcccccggatatccgcgcggccattgcgcgcccgtaccaccccctcccgcctcaccctctcccaaccgcatccgcgctctcggcccataccgattccccaaagcagaccctccgagatctccttcatgcccgtcatgccgccggggccaacgatgccgatgcggccccggacgctgacgcaacgactccagctaactcggtctttgtccgatgtctgcctgaatccaacaacatctacatcgagagctctgacgctcattcctcccgctcatcttcgtcatctcctgaagaggtagaagagcagccatcccgatcctgggatgacctcgacgaggaggagcgttctgcctggaaccagcgcttgatcgat

SEQ ID NO: 2558 - DNA, 873 bp, A.fumigatus
gagcatactattgcggatccggctgctcccttagtgaagacatcgcctgtcaaaatggctagctttcttgccgtcgcagcatatctgactgtgattgctgcggcccatccactgtcgaccaggctgtaccctaccgttctacggagggataccacggccaccagcgttgagcctgtgtcagcaatctctctttactatcaagcagcagccaactcgagctcaatcggcgctctcatccaagcggacttgcagctcccctccatcgtcctcgaagatgtcaacgatgtatcaagcgtgacctgttcggtcgacagcctgacggtgacgttcaactccacgaccaccttcaaccaagcatactcctcctggcctcgctcacaccttctcctcgtaaccaaccacctagggaactgcgacgcggaagccgaccgcggactctaccgcgccgcctctctcctcttccacccctcaaccctcaccatcactgcctccacacgcaaaaccaacctccagcaacaagccaaaaccatcaccatcgtcttcggccaccctgacccatcccaacacaagcgcgagctcgccaccagcatcgacctcgcctggtcaggcgacctcatccgcaccaacggcctaaccatccacgccaaccacgccaccctcgacgccgcaatctccatcgacgggatcatcgcgtaccacgtcgagacaaggacagcaacgaccctcagcctcgacatcgccgtcgcgctggattcgagtctcggcctctctgtctcagccgcaggggtcgttcctgcgcaacgtctacacataccgatggagcccccgtcgaaggcggggggcttctccatccccggggatcttgacagtggg

SEQ ID NO: 2559 - DNA, 378 bp, A.fumigatus
gtctttggtattacgtacattttggccagcttcaaccaacgtctctggcactttgctttaacccaggacgtgctgctcggcatcggggccagcatggtatatgtatccaccatttctgttgccctgacgtggttcgatcagcgtcgtgggttggccatggggatcttcatctccgggagtggcgtcgggggcattcattgtcaagcgtcgacgccttatttatcgtcttatcattctctatggatctttcgccagcgcatacatctcgcgtttccctgcgtctctgatcgaactgttcggcgtgcagtacttgaccagcgtgaacggggtccttgtacctcattcgggggatgggagcgtcgatcgggacgccgttga

SEQ ID NO: 2560 - DNA, 408 bp, A.fumigatus
cgtggttcgatcagcgtcgtgggttggccatggggatcttcatctccgggagtggcgtcgggggcattcattgtcaagcgtcgacgccttatttatcgtcttatcattctctatggatctttcgccagcgcatacatctcgcgtttccctgcgtctctgatcgaactgttcggcgtgcagtacttgaccagcgtgaacggggtccttgtacctcattcgggggatgggagcgtcgatcgggacgccgttgactggaatgctgattcctcagtcaccgcattggtctcttcaattgtctacgaccgggtagggatcgactgcggtgttctcctctttgcagccaccctggcctgcgttccggtgagaattgatgcaaccctgggcgaggtcgggaggtggaaagcttga

SEQ ID NO: 2561 - DNA, 207 bp, A.fumigatus
  unsure (106): Identity of nucleotide sequences at the above locations are unknown.
ctgggtaaccgcgtattcgtggccggccacagcagcctgttcacaaccggcggcatgcactcagctaccatccgcttgatggccgcagttccccaagaagtatccntcgcatcgttcggatccgacattcgagaaccgttttaccaattctcttgcccccggccttgggcaaacccttcttccaacgccttcgcccaaaacccccgt

SEQ ID NO: 2562 - DNA, 639 bp, A.fumigatus
  unsure (119),(141): Identity of nucleotide sequences at the above locations are unknown.
agttcaaatgatgacctctctcgccgcgggccaggaaacccccttcaaagggttccattgtcaagtgtacgccctgtccaagcatccggacgtgcaaacgcgctcccgcaagaaagtgngtaccccacttcctcccatttngccggagcaccccgaacccctttcgcaagccacactggactccctcccttacctaaacgccttctgcaacgaggtcttccgcttcacccttctgttccaggcaccgtgcgtgacgcagccaaagacactacacttctcggataccctatccccaagggcacgaggatactcgtctctccggaagtcatcaaccacagtaaggaattgtggggtcctgacgcggaccagtttaatgttgagcggtggttgggtcccgggcgagcgaataccggcggtgccagtagtaattactcgtttctgacatttttgcatggcccgcggagttgtatcggccaggggtttgcaaaggcagagttggcctgtctcgtggcggctattgtgggacggttccagatggaattgaaggacgcggatgccaagcttgaagtgagacggtcggccacagttgctccaaaggacggcgtgctcgctaggtttaccccgttggaggggtggtaa

SEQ ID NO: 2563 - DNA, 759 bp, A.fumigatus
cgcatagctcggattttcgtccgccgtggtgaggacccgcgtcgaattgacttgagcagggcactcgaccggatgattgccgttctcccagacgaaatgcgcatgcaaagcctcctgcgtcctctcgaagcaaccggtggggaacgactccgtgatctgggcctccgaacccgcgatttctgggcattgtttgaggcgtgggaaaccgtgcatctggtgccaaccgatgatggtctatacatccgcgacgacattatccagtacctgaaacgacatccggaggtggcagagagtatggtgagaaacacagcggacattatccgctcctatgagtcgtatcgctcgctcattacccaactatcaacactgctcttcccgtggaccgcaccgcatttcccggaccatattcatctccacacacagattcatagtggcggtcgggggctggtcttttcagccggggacaaccaagcaccttttctactcgcttcgattccggctatccgccagttggggtgcgacctgccaatcgaagtcatgtatctgggcgatcgggacctgagccaggatatgcgtgaacagttggaggcgctacccggtgtgactacacgagatctgagtgtgatggtgaacgacaatggctggacattggctggatgggccggaaaaccgtttgcgattctattttcgagttttagggaagccatttttattgatgcccgattcgctgttcctgcagaacccggaagacttgtgtga

SEQ ID NO: 2564 - DNA, 183 bp, A.fumigatus
caaaacagtgaacgcctcatcaaccctgctctccgacgcttcgatatccctttcaagcccattagtcgcatgactaccggtttcgtcgccatagcatttgccattgccattgcggctatcatccaacaacgtacgtcccttttcgggcatttcggaggacgttctaatgccagaatgcagtaa

SEQ ID NO: 2565 - DNA, 369 bp, A.fumigatus
tgccagaatgcagtaatatatcgacgaccgccgtctcacgttagcatcttcctccagatcccagtctacgcactcataggactttccgagttcttctccagcctgtcagcgatggaatacgcctacaccaaagctccaaggtcgatgcggagtatcgtctccgcgctcttccttctcacctgcaccatcggttccacggtgggaattactctgtcgcctgtatccgttgatccaaagctgctggtggagtatgtgtctctcagcatcgtcatgtttgccacaggtgtcgtgttctacttttgcttccgcaaatacaaccagatggaagagagcatgaatatgataggagagacagcgggaaagcagtga

SEQ ID NO: 2566 - DNA, 474 bp, A.fumigatus
catacagatcttcacccagggaacttattcgtcagcaatggccgcatttcatgtatgatagactggcagggaatctgggcggcacctttactattaagggcgcgccacccacacctcattaattaccaaggggacatcatcctgaagcctctggtaaactttaacaatcttgatacagaagagaagaaaataatcagggacaagatgagcaagtcaattgtcatctatctttatgaaaagcagattgccaaggaagtgcctcttctaaacagagtcatccatctcaaccatagtcaaacgcgatgcgaccctatacagttcattggtgacacttgggacgatgatatcatacctttaagggagtccctaattcaattggaaaggcaagtacaagtaccatgccgtagagtctttattaagcagcggtctaactacacgttttctaccacagaggccggcaggccccgcgaataa

SEQ ID NO: 2567 - DNA, 990 bp, A.fumigatus
  unsure (716): Identity of nucleotide sequences at the above locations are unknown.
aacatcaaaggttggaacaactttattctctttgcattgggtactacccttcccgtgtcccggactcacaaattattctcttggcagtcacgcatgaaagagctgtatctccatcgagccgtcgaagtgcaaccctgtttcaatcgagatgtcttgcgtgatctttcagaccgagcaacaacagcccgcctagaactcgaagcatgggcggaaggcgaaaatattcagtttgatacagttcgtccagctgaccgggttggtccgccttttggaaccgacgaggaagatctcgatgcgcaaatcctgcaatctgccactaccggcagtctgcaaaccctacgcgagtggactgccaaacttcatactgcccccgatgcccgggatcgtgcgactcgggcctttctcgcagcaatcaacgaatactccgatgaagtgcttgcagttctcctggagagtggattagttgatatcaatgccgaagatgatatcaatgaacgaaattgcttacatgaagccgccatttcagggcgggactttgttttcaagacaggtatctcagcaggggtggatgtgtccagatcagatgtgtacggcaggatacctctgcattatgcttgtatgcatggtcgcgttgatatggtgcgggagctgttggctgttggccctgatacggtagacactgcggatcacaacaattttacaccgttgattcatancatcgtcaaggatcaattggcatgtgctgagcagcttctccagcacaatgctcgcattggaccggcatcagaatcagaccatattcctctcaacctcgcttgccagcacggatcaataccgatagtcagaatgcttctcgaacggaacgcccagctgcttccggacgctgagggaatcttaccacagcacatggttgcacgtgcttcccaaccccccagaactgttgcctcctcctcaaacagcacggagcttgatttgaaaccgagggatttg

SEQ ID NO: 2568 - DNA, 183 bp, A.fumigatus
agaatactggaattggaccgcattcacgaatttatcatcctgaggaagattgagaatgactacagtttgcgtcgcggagccataggcagcatatctgagagcaccagcagagaggacaacaatggtaatgaggaccataacaccggcaaggacgcctggaaaccgacgaggttccttcattga

SEQ ID NO: 2569 - DNA, 1131 bp, A.fumigatus
aaaagactccgcttttgctccgaccagaaactcctgccgaaaggaagcgtaaaccaaaaccgcgcggtggaatggggaaccaacacaatgacaggagctgctctacttctactcaaatcgtttgtcggcacgggtgtcctcttcttgccaagagctttcctgaatggtgggatgttattcagcagtttggttttgcttgctgtatccatactcagcttctactgcttcatccttctggtcaacacccgattgaagatcgaaggctccttcggtgacattggtggtgctctctttggaaaacatatgcgacgggtcatcctcgggtccattgttctcagtcaactgggatttgtctcggcgtacatcgtcttcactgctgagaacctccaggcgttcgtcttggctgtcagcaaatgcaagtcgttcatcgacatcaagttcatggtgctgatgcaattggtcatatttctgcctctttccctaattcgtgacattggcaagttgggtttcaccgcacttgtggccgatgtgtttattctactggggctcatctacctctattactacgacgttactactatcgtttcacaaggtggcgtttcggatatcaaggcattcaacccatccacatggactcttttcattggcactgccattttcacctatgaagggattggtttgattattccaattcaggagtcaatgaaggaacctcgtcggtttccaggcgtccttgccggtgttatggtcctcattaccattgttgtcctctctgctggtgctctcagatatgctgcctatggctccgcgacgcaaactgtagtcattctcaatcttcctcaggatgataaattcgtgaatgcggtccaattccagtattctctagcaatcctgctgagcacgcccctacaactcttccctgccattcgaatcatggaaaatgagcttttcactcgcagtggcaagtataacccggggatcaaatggaagaaaaactgcttccgattctttctggtcatgatttgcgcgttcgttgcttggggcggagcagatgaccttgacaaatttgtctcactcgtcggcagtttcgcctgtgttcctttgatttacgtatatccggtatgcctctga

SEQ ID NO: 2570 - DNA, 255 bp, A.fumigatus
gggatacggctacggacaacacagacaaccacacacacacacacacacacacacacacacacacacacacacacacacacacacacacacacacacacacacacacacacacacacaagggttaggatagacacgctgacagacgcttttcgtcgaacagagatcaagaagagaagactattccgcatgttcacctaccgcggaattgacctcgagcagtatgttcagctatctttcatccatgcattcttgtga

SEQ ID NO: 2571 - DNA, 315 bp, A.fumigatus
cttggaatgtgctacaggctcctcgacctctcatgcgaacagctccgcgatgtcgtgcacgcccgcgcccgccgcaggttcaaccgtggtctgaagcgcaagcccatgggcctgatcaagaagctccgcaaggccaagcaggaggccaagcccaacgagaagcccgagctcgtcaagacccacctgcgtgacatgatcattgtccctgagatgatcggcagcgtcatcggtatttactccggaaaggagttcaaccagattgaggtcaagcccgagatggttggccactaccttggtgaattctccatcacatag

SEQ ID NO: 2572 - DNA, 978 bp, A.fumigatus
  unsure (65): Identity of nucleotide sequences at the above locations are unknown.
cctgaccccgatgcccagcaaatacatcgaatcggccctacgaagccgcagacggatctcgaagntacgattcacaatatcctggttgaaagtggtcttgcggatccgagcggcaaatccactgaggagcaggttcaggaatttgaggagcttcaggcacgaaagttgcccattgaggaaatcagagctcgtcgagcagagttgcgcaagcaacgagatttgctcttccgtgaagaagtacgggccaagcgaatcaagaagatcaaaagcaagtcgtatcgccgtgtgcatcgcaaggagcgcgagcgtctacagcagcaggaaagacaagctcttctggaagctggcgtggacttggaggaggaagatcgagagatgaatgagcgccgccgagctgaggctagaatgggcgccaaactcaaggatagcaagtgggcaaagagcctcaaacagactggccgtaccgcttgggacgaggacgctcgacgcggtgcagcagagcaggccctgaaggaagaagagctgcggaggagaattgaagggaagagtgtttcccgagcggatgaggattacctgggttcctccagttcagagtcggaagacgaagatccttgggcagaagatgcaggctcggatgctgagaagcagaaactacgcaagaaacttgaggggctggagagggatgatgtggatgcctcagagataactggtccacatgcaaaacttttctccatgaaattcatgcagaacgcagaggctgcacgcaaagccgagaatgatgctgaaattcgacgactcaaccgagaactccgcggcgaagaagagtcgcagtctgaagcagagtctgaggttggtcggcgtaaattcggccagtctcaggatgacaaatctggcaaggacaagaaacaaaaatcgttgcccaagactgaatttgaagaggcgccaggttccgatgatgaggccgacgccgtgccttga

SEQ ID NO: 2573 - DNA, 186 bp, A.fumigatus
agaatcatccgaccactactacctctccctgtccctcttaaacttactctcttcactttcgtcacctacgctcttcttgatccggttgtcatccccctttccattgaaattgtcctcctttccgtggcatcccgctgtgcctttacatatcacgtcattcgtgcgcaaaagggacctgtctgcagt

SEQ ID NO: 2574 - DNA, 741 bp, A.fumigatus
  unsure (660),(703): Identity of nucleotide sequences at the above locations are unknown.
agaagtccagcggccacggggagaacaaagtgtggaagccaggcgggaaacttgttgcactctttgggcgagcatagcgggccggtaaacagggtggtggtagctccagatcacgccttttttgtcactgcatcggatgatgggaccgtcaaaatctgggatactacgcgactcgagaagaacttgacgcccagatcccgccagacctatcgtcactccagccaggccaaggtgaagacgctgacctttgtcgagaacactcatgcgttcattagcggtgccactgatgggagcatccatgttgtgaaggttgattaccataatgtcaatgatacggttcgatacgggaagctgcagctcgtacgtgactaccaactcccagcaactgaggatgggtctgtcgagtatcccctctggatcgaacatttccgctctgatgcacaatccactctgttgattgcgaccaacacttgccgcatcctagctctggatatgaagactatgcttcccatctattcattgcagaaccctgtccatcacggaataccgacaacgttctgctgtgaccgaaaacataactggctgctagtagggaccacgcatggagttcttgatctttgggaccttcggtttcaggtgcgtctgaaggcctggtgtctnccaggatcgggtgctatccttaggctccaggtccatccgacanagggacgtgggcggtgggttgcgtctcgagcagtgtga

SEQ ID NO: 2575 - DNA, 783 bp, A.fumigatus
  unsure (20),(146),(178): Identity of nucleotide sequences at the above locations are unknown.
gctccaggtccatccgacanagggacgtgggcggtgggttgcgtctcgagcagtgtgaagtcgcgcaacgagattacaagctgggatattgaaaaaattcgctgtcgcgaagtataccatgccgacttcgcccggaagcaatacanttgcccaacggaggatctggcggcttttcaantgattaacgccaaggcgaaatcagccttcgtcaacaccagagactatgaggcctggcacatcgagagcgaccggccggaaggaatgctcagtcggttcggcacggaggggcaattgtcgggggccattgagtcctcgggaccatcggcagctagcactcctgccggtatctgcgcctttgccgttggctatgactcgccggaggatggcaaggacaacagcaccagatgcggattcatcgtgtcgggaggttgcgaccggaagatccgcttctgggacctggctcggcccgagctttctactattgtcagcggtcaagacattgtttcggaaggaggggtgagcggcaagccacgctacgagttatctcaaccactgccgaatctactcgtgactacagaacacattcccggccctccagcggctagcagtgcgggaagcaagggcagcagcaagaaagggggcggtgccaggcttccacgtagtacagtgatcagcctacagcagcagcaattactgaagagtcatctggatttcatccaggatgtagcggtgttgagggtgccgtcttcaccgcggggtgagaaggatccgaccatggctcta

SEQ ID NO: 2576 - DNA, 459 bp, A.fumigatus
caaccttgtaggggaagttcttggcgtccttctggacatccttgtcatcgaacttgcgtccaatcagacgcctggcagaggttagcacaaactcttcagctatccaaacctccattgaaagactcacttaatgtcaaagatggtccgggtagggttcgaggcgtattggttcttggcggcgtcaccaaccagacgctcttcatcagtgaaggcgacataggaaggagtgatacggtttccttggtcgttggcgatgatttcaacctttccgttctgcatcacaccgacacaagagtatgttgttccaagatcgataccgatgactgtggacagcacgatttagcacgagaacttcatgatttcggaaaaacaatatccaagacataccagtgccatagttttcctgtactgagtcttcctcagcgtgtgcggttccgaaaaaagccaatggcgcaataa

SEQ ID NO: 2577 - DNA, 216 bp, A.fumigatus
atcgtgctgtccacagtcatcggtatcgatcttggaacaacatactcttgtgtcggtgtgatgcagaacggaaaggttgaaatcatcgccaacgaccaaggaaaccgtatcactccttcctatgtcgccttcactgatgaagagcgtctggttggtgacgccgccaagaaccaatacgcctcgaaccctacccggaccatctttgacattaagtga

SEQ ID NO: 2578 - DNA, 342 bp, A.fumigatus
accgtacacttcttcatcactttcattgtgaaggagctcctttctacacctcacatactcaccatgtcgcgactatcgagtcgcaatggcgcggccaagccgttcactgcttggaccactgttttctacctcctccttgtctttattgcgccattggcttttttcggaaccgcacacgctgaggaagactcagtacaggaaaactatggcactggtatgtcttggatattgtttttccgaaatcatgaagttctcgtgctaaatcgtgctgtccacagtcatcggtatcgatcttggaacaacatactcttgtgtcggtgtgatgcagaacggaaaggttga

SEQ ID NO: 2579 - DNA, 366 bp, A.fumigatus
gtgagtctttcaatggaggtttggatagctgaagagtttgtgctaacctctgccaggcgtctgattggacgcaagttcgatgacaaggatgtccagaaggacgccaagaacttcccctacaaggttgtcaacaaggatggcaagcctgtcgttaaggtcgaagtcaacaagtcccccaagatcttcacccccgaggaggtttccgccatggtccttggaaagatgaaggatatcgctgagggctacctcggaaagaaggttacccacgctgttgtcactgttcccgcctacttcaacgacgcccagagacaggctaccaaggatgctggcaccattgatggcctgaacgtcttttcgaccacggtg

SEQ ID NO: 2580 - DNA, 1029 bp, A.fumigatus
  unsure (15): Identity of nucleotide sequences at the above locations are unknown.
ttcggctcttgcatntgcattcctagcgaggaaacacgcctgaatgatattgctggcgtgatcacgaagatgaaagtgaatcacgcatcacttacaccatcatttgttggattcctcgatcctgcagctgttccagggttagaaagccttgttctagctggtgaagcaatgtctccgcaacatttggcgacatggtctcatatcaagcttgtgaacggatacggcccaacagagagttctgttgcggctgccctcaatcctaatatgtcttcttcatcagattgcagggatattgggttgccagtcggagtgcgcttctgggtcgtgaaccctgccaaccatgaccagcttgtgcccgttggttgccccggtgagctggtactggaaggaccgacgcttgcgcgatgttacatcaataacccacagaagacgagcgattcatttattttcaacccttgttggacgaagcgagatcctaacggtggctcagaccgaaggttttacaagaccggtgatttggtaaggtacaactccgaatccggatcattaacgtatataggacggaaagacgcacaagtcaagttccatggccagagagttgagcttggagagattgagagtcagctgagcgcagacacagacatcaagcactgcacagtgttgcttcccaagtctgggttcgcacaaggaaaacttgtgactgtcgtgtcactgtccgctggccctggacaggcactggaggccgatgcagtgccccttaagcttatcgagcatcgcgagaagcttcgatatgtcaagagtattcaggaacgattatcaattaggctgccgacatacatggtgcccggagtatggctatgtgtcgaggctttgccgatgctcgtgtctggtaaactggaccggaaatctattgcaacctgggttgcgagcatgtcagaagaaccagaagtacatgcaactgaggccgccaacgctcgtgccgctaactcgacggaggatcaactggtgtcgatttggagtcgtgtgctc

SEQ ID NO: 2581 - DNA, 858 bp, A.fumigatus
  unsure (768): Identity of nucleotide sequences at the above locations are unknown.
cacaccagcttgtacgtctgctggcaactataccgtatgccgattgttgacagtgtccaggtgaactgtctgcatgaagtattcttcgaggcagcgattgaagatgccagaagactcgatgcctactttgcagagcataagaagcctgttgggcctcttcacggtcttccggtcagtctgaaggaccagtttcatgtgcgaggcgtggagacgacgatgggatacgtgggctggatcggtacattccagggcaagaagggagatccgagaagaggcgtatttgaaagcgagcttgtcagggagcttcgcaacctcggggctgtgccatactgcaagacaagtgtgcctgcgactctgatgacaggagaaactgtcaaccatatcatcaagtatacaactaacccgcagaaccgactcctctcgtgtggaggaagctcgggcggagaaggcgcgcttatcgctctgagaggctctcctggaggtttcggcactgatattggcggcagtgtccgtataccggctgtatttaacggcctctatgggctccgtccctcgtccggcaggatgccttacgagggtgctgcaaactccatagacggccaaaataccatcctatctgtcatcggcccgcttgcaacaacagtgcgctctctgagactccttttcaaggctgtactcagccaaaagccttggtttcatgatcccctggtgctcgagatgccctggcgtgaagatattgaacgagaggtgggggctctggtgaagcantcagcaactgatccttccaagcttgcctttgctgtgatgcacaatgacgggatactcatgcctcaccctccgattgcacgggctatgaag

SEQ ID NO: 2582 - DNA, 294 bp, A.fumigatus
ctcaagcgcggatccgtcggcccctgtggtagaagacatgcgattcctgcaaaatggaggattcagaatccgatcccatcaccatccgagctacgggatgttactggttacattgagcagttcttgaccgctcgggagctagagatcacaggaaacgatgctgtggacatcgtgaagcagacgacgtctggtaactggactgctgtggaggtaacagaggcattttgccatagagctgctctagcacaccagcttgtacgtctgctggcaactataccgtatgccgattgttga

SEQ ID NO: 2583 - DNA, 345 bp, A.fumigatus
aggccgttaaatacagccggtatacggacactgccgccaatatcagtgccgaaacctccaggagagcctctcagagcgataagcgcgccttctccgcccgagcttcctccacacgagaggagtcggttctgcgggttagttgtatacttgatgatatggttgacagtttctcctgtcatcagagtcgcaggcacacttgtcttgcagtatggcacagccccgaggttgcgaagctccctgacaagctcgctttcaaatacgcctcttctcggatctcccttcttgccctggaatgtaccgatccagcccacgtatcccatcgtcgtctccacgcctcgcacatga

SEQ ID NO: 2584 - DNA, 360 bp, A.fumigatus
aaaacagtcaaccaaaataatccaatctctcgtttagtgatcatcagaatgaggctgctttctactctcactcttctggtttccgcagtggcggccaaccccatgttccatactgctcgccaggacaccagcgccaccaagcccttccatcttaagaccgcagacgcgtccaacgagaaacacaatgatttatatgtctacgcctaccacaccggagcaggattcaatgacgctgtcctcacgcccgataaggatactgccagtacggcgttcctgaacggcacatacacccagttcgacttgaagactccattcccttggggcttcaagccgatcgctgttaccaactatgcccgttag

SEQ ID NO: 2585 - DNA, 234 bp, A.fumigatus
  unsure (169): Identity of nucleotide sequences at the above locations are unknown.
gtgtgccaaagaccagtgcaatttccaatccggggccaatattacgttattgcagcggcatttggcaagataggcgttttggttggcaattatgtgtttccgataatccaaaacaacgctcccaatgacgtgcgccaaggacaagatcttaactttgttagcagctccntatgcatcttcagcgcattcctggcctacttcttgctgccacttattgggcaggtatgttcttga

SEQ ID NO: 2586 - DNA, 636 bp, A.fumigatus
  unsure (502),(503),(511): Identity of nucleotide sequences at the above locations are unknown.
cttgatcaggtactcgactgtcgtgcggaagtcaccccggatgctcaactccttcagagcgacaaccatgtgtttccgcgacgcggaacggttctcaccgtaggcaaagatgtgaccgaactggctgtcggagaagctgtggataccaccggcggtaccgacggagaagtaaccccagacgttggacgaactgcggaagttcaattcatgcatggtaccgctggagggcttgaaaccttcgccgggatcttcggaagtgatacggcaggcggtcgtgtgtcccttgggctgaaggcggcgctgcgttttgaagctctcttcgctggagaagtcgaagtcaatctcggacgaggtgttggggtcaaccccgtaaagcaaacggatgtcaccgatgcggtgcagaaggatacccatggcgatttgcaattgggcggctggcaggttgacaccggagaccatttcggtggtggggtgctcgacctgaaaacgaaggttcaactcnnagaagtanaacttgtcatcggcgtgcgagtacaggtactcgaccgtacccgcggagacgtaaccaaccagctttccgaggctgaacaccgcacgctccatggcctggaaacttggcgggcttggcgatggtga

SEQ ID NO: 2587 - DNA, 282 bp, A.fumigatus
  unsure (273),(281),(282): Identity of nucleotide sequences at the above locations are unknown.
attcaggaaagttggtggccaatgccccggctttgggaaagtccaggtggtggggtgaatcggtatgggaaccacattttccttgttggcaggagattgttccgtaacagggttgttaaccagaagattattggaggaggcccccgttcaccatcgccaagcccgccaagtttccaggccatggagcgtgcggtgttcagcctcggaaagctggttggttacgtctccgcgggtacggtcgagtacctgtactcgcacgccgatgacaagttntacttctnn

SEQ ID NO: 2588 - DNA, 1485 bp, A.fumigatus
gagttgaaccttcgttttcaggtcgagcaccccaccaccgaaatggtctccggtgtcaacctgccagccgcccaattgcaaatcgccatgggtatccttctgcaccgcatcggtgacatccgtttgctttacggggttgaccccaacacctcgtccgagattgacttcgacttctccagcgaagagagcttcaaaacgcagcgccgccttcagcccaagggacacacgaccgcctgccgtatcacttccgaagatcccggcgaaggtttcaagccctccagcggtaccatgcatgaattgaacttccgcagttcgtccaacgtctggggttacttctccgtcggtaccgccggtggtatccacagcttctccgacagccagttcggtcacatctttgcctacggtgagaaccgttccgcgtcgcggaaacacatggttgtcgctctgaaggagttgagcatccggggtgacttccgcacgacagtcgagtacctgatcaagctactggagacccctgctttcgaggataacaccatcaccactggatggctggatcagctcatctcgaacaagctgaccgcagagcgtccggatcccatcgtggctgttctgtgcggtgcggtgaccaaggctcacctggccagcgaaggcggtgtcgaggagtatcgcaagggcctcgaaaagggtcaggtgccctccaatgacgtcctcaagaccgtcttccccgtggacttcatctacgagggccagcggtacaagttcaccgcaaccagagccggcttggacagctaccacctgttcatcaacggatccaagtgctcggtcggtgtccgtgctctggccgacggtggcctgcttgtgctcctgaacggtcgtagtcacaacgtctactggaaggaggaagcggctgcaactcgcctgagtgtcgacggaaagacgtgcttgctggagcaggagaatgatcctactcagcttcgctccccgtcccccggaaagcttgtcaagttcacggtcgagaacggcgagcacgtcaaggctggtcaggccttcgccgaagtcgaggtcatgaagatgtacatgcccctgattgcacaggaagatggtattgttcagctcatcaagcagcctggttccaccctcgaggccggtgacatcctcggtattctcgctctggatgacccatctcgtgtcacacatgcccagccttttaccggacagctgcctgaccttggtcccccgcaagtggtcggtaacaagcctcctcagagattctccctcctccacagtattctcgagaacatcctcatgggctatgacaaccaagttatcatgaacaccactctgaaggaaccggttgaggttttgcgggatcctgaacttccctaccgggaatggaaacgctcagtcttcctgcccttcaatctcgttatcccccaaaacctgggacgcccaacttccaaaacaccgtccaaacaaggtcaaccc

SEQ ID NO: 2589 - DNA, 462 bp, A.fumigatus
attggtctttacacgctgctcaattcttcacttccagctaggtctatttggtatgctctttcaacctttgaatacagtgacaacgcattcgtcatggcctctatggacaaagtcttttcgggatattatgcgcgccagaagctgcttgaacggagcgacaatcctttctctaagggcattgcttatgtggaaggaaagctcgtcttacctagtgatgctagaataccgctactcgacgaaggtttcatgcacagtgacctaacctatgatgttatatcggtttgggatggtcgcttctttcgattggacgatcatttgcaacggattttggaaagctgcgataagatgcggctcaagttcccacttgcactgagctcagtgaaaaatattctggctgagatggtcgccaagcgtggtatccgggcctgtccttacacgacaggaatcggcaggaatatccct

SEQ ID NO: 2590 - DNA, 1155 bp, A.fumigatus
aaacactacctcggattcgcccagtctgaaggtccctgcgccgaccacgccgaggatactctgaggaagtacgggattagtgctcctagcactcgcgctgaggtgggaacgcaagatcttcatgcggaagttgagagtcttgttgccagctttgtgggcaaggaggcctcgatggtcttctcgatggggtttggtacaaatgcaaatatctttcctgccttggtgaacaaaggctgcctaattatctctgatgaattgaatcacgcatcgatccgctttggtgctcgtctttcaggtgcgtccattggaatgttcaagcacaacgatatgaaggacctggaggcaaagctgcgtgaagccatctctcaaggccagccacgtactcatcgcccatggaagaaaattctggtcgttgttgaaggactgtactctatggaaggatctatgtgtaatcttccaggtcttattgcgctgaagcgtcgctataaatttcacctttttgtggatgaggcgcactcgattggagccataggtcccaagggacggggtgtttgtgactatttcagcattgacacgaaggaggtagacattctgatgggaactcttaccaagtcatttggcgccaacgggggctacattgctgctgataaggcgatgattgacaaacttcgcgcgaccaattccggtattttctacggcgaggcgccagctcctgctatcctggcgcagatctcttctgcgctccgcatcatcaacggtgagattgttccgggccagggtgaagagcggttgcagcgtttggccttcaactctcgatatcttcgcctcggattgaagcgtcttggctttatagtgtacggccacgacgattcgccaattattcctgtccttcttttcaaccctgccaagatgcccgccttctcccacgaaatgcttagaagaaagatctccgtcgtcgttgtcgggtaccccgccactcctctggtatcctctcgggctcgtttctgcgtttcggccgcgcataccaaggaagaccttgaccgcgttctgactgcctgcgacgagattggcaatgtactgcaactgaagttctctaccggaattgctggaggcgctctacccgtcttcaccacggggctggaaggagccgctcca

SEQ ID NO: 2591 - DNA, 927 bp, A.fumigatus
agacttgttgtcgatcgtacggttctaccagagtcctactcgacaacaagtactgcaatccctttcacgggcgacggccgccgggacaggcgcacgaagaacgggcccagcttcgagcttacggtgagcggcggatctcgtgaatcatctatcaagagcccacagaacaaggcattggcgccttgggtgcgctctatcaacccgtgcaatacctcaagggatgttcttcgagatactagttggttcggacgctggcaacatgcatacccgcgaccaccccatgttgcagtggtgaaatggaaaagcttgaagtcccccgctattttgccattgacgaccgaagaattccccacggctcaggagctgggctctgattatctgcagactccgtaccgcgtctttccaaatgatgacccggaaggcgtcgaagtacccaagacgaggggtatcctgctgcgagagatgatttcgttgcgattatctcatggattccagatcgttattgggaaacatgttgcagaggtatctggacagcctgctctcgaaacgttgaacgtcttcgacacccgcagtttggaacgggacggtgctacggtcttcctctcgaaaggaaacaccatccaccggctgatctgtgttgatggtggtgaaatcgaggtgacacgtttcacgcaccggacttcttctactttggcagctgggaaaagggacggcttttccctctacactccagcgatgcggaccatcctgagcacggagtatgagctcaagaacatcaagcttgacccgacggccgaggattacaattggaactacgctgacaactacgttgccgggcaccgcgactacttgttcaacccagcgcagcagctgcaattttggcgggtgcggtcttcacgcacggggatcaacagccgctctatgggg

SEQ ID NO: 2592 - DNA, 549 bp, A.fumigatus
  unsure (128): Identity of nucleotide sequences at the above locations are unknown.
tgtaaacgaccaaacgggttgtccgagcagacccccaagatcatcgagccggagcccaagagggtagctgccgaggccgccgaggagctgcggcgagctggtgaagcagcacggtctttccccattgngactcccacctggacaggtcaatttggagtcgcagggaggcctgaggaaagacctctcccttcagcatttggtggacgaagcagtactgcgcggcgaacggcggccggcccctcgtcagcgagcattctggctaacctctccgcacggacaccgtcgtcccggagcgccacgaacagccctgcaccgtccaggtcccccactggcgtggatttcatgacgatgattcgagactacatattgtcgcagggtggagccgtttacacacagatgctgatagaccacttcaaccgttactgtaccacgccccaacgatcggccgagtttaaggaaatgcttaaaacaattgctgttctcgaaaagggtgggcgaaacgggcgaggacgatggtcgctgaaacccgaattcgccaaggtgaaataa

SEQ ID NO: 2593 - DNA, 495 bp, A.fumigatus
  unsure (60),(64): Identity of nucleotide sequences at the above locations are unknown.
tccaccagcttcagacccccaacatccgggatcgtacgggacttccgttcatcggtggcngccntggagtttgtccttttcgtcaagtcgtctattttcgccccctatttcgataacttcgcccttagcatcgaccctttattggagaagaactgcgacctgctcctggacagcatcgagactcaccacactgagaccaacaacttccagtattaccagcgctcgctcgcgcgcgagcagcagagaatcagcgcttggcagcagaagcgcaagcaggagaatgccactcgcgcggcgctcaagcagcattttctgcccgaggacgaatggcagcgcctgttcaagctgccccaggagcctagccgcttcgagagcatgctgtacagccggcaggtggatcagtacgcgcgccagattgacagctttgtttcgtccacgactggaaagatgtttgctgtgaagggcaacctgttgcccggtgagaccgccaaataa

SEQ ID NO: 2594 - DNA, 258 bp, A.fumigatus
tctgacaccggctatgttgcatcgcatgctaagctagttttacaggccggagcatttgccgcagtgaccgtagactttgtcgtctaccccttcgacaccctcaaaacccgagtccaatcgcccgattacaaccgactctacaaggatgcagcgacaggagcagtgcgccggagcgctctctacagaggcttataccagggagtttggagcgtggtgctgtccacaataccaggttgtacgctctcccgttccgtgtct

SEQ ID NO: 2595 - DNA, 204 bp, A.fumigatus
  unsure (59),(148),(152): Identity of nucleotide sequences at the above locations are unknown.
gttgcaaaagtccgccttgagataccaggaaattctgtggtgaacttcccggtgaggantcacaactttcacctgatcacttctttaatccaccagcttcagacccccaacatccgggatcgtacgggacttccgttcatcggtggcngccntggagtttgtccttttcgtcaagtcgtctattttcgccccctatttcgataa

SEQ ID NO: 2596 - DNA, 633 bp, A.fumigatus
  unsure (75): Identity of nucleotide sequences at the above locations are unknown.
ttgcaatcagtggcattccaggttttgggaagacaggacttgcccagcattatggccattggcatcaaccagttntactcagatcaatatgcaattcagccgcccatagcggcggacatccctatggatggctatcacctcacacgagcgcaactagctcagatgccagatccagaatacgctgctgcgcgacgtggtgcggctttcacctttgacggcgagaagtttctgaggctagtgcaggcactgagggagccgataacatcagagacgcgcatattgtacgctccaagcttcgaccatgcggtcaaggatccggttgatgacgatatacccattgctccgacgagcaggataatattcttcgagggaaactacctcagtctgaacaaggagccgtggagctctgcagcaaagctcatggatgagctatggttcgttgaggtcgatttcgagactgctcggaagaggctggttcggcgacatgtgcaagcgggtatcgcaaaggatgaagctgaggcggacaaacgggcgatggagaatgatcttgttaacggacaagagattgtcgataacaggatggatgtccaagagattattaccagttactatgatacccggtgggataggtga

SEQ ID NO: 2597 - DNA, 264 bp, A.fumigatus
gatactcgacggtatagcctaacgaaatgtttgatagcttcaacgactcccaattcacacaaggtatcctctcactccgagccgcctagcagggtcgacaaccccgtcggccaacccaccggtctcccgatggacacctggaagaaggcttacaaatgccccgtcgactccctatggacttcgggcgatgcagcggcgcgcggccaatactccgggacgcgatcgcaggaagagcgggcggattcagagagagacaacatttga

SEQ ID NO: 2598 - DNA, 567 bp, A.fumigatus
aaagttgtgatcaacggagcgcatctgaatgcgacaagcaaagtctgggataatcgcgctgccgtgctgttcaaaatcttacgagaattacaattatactatagaattctttgtcttgcaatgtcagacaccctcccgaacccgtccggtctctcggccaaggtgaacaagaagcgtaagagacaagcggaggaagcacccaaggaagataaagccgcatcggccaaatctgccaataataataccttggaagcagccgagggtcctttaaagaaaaaaaagaagaggaatttcaaaaataagcagaaacaacaaaagaaaaaagatctggaggatgatcccaagcagcaggagcgcaaaggcggcatcgacgagtctattggcaagatggacggccggttgctggctgattactttgtccagaaggcgaaaagacataacaaggagctgactgcggttgaactgggtgatctgagcgtcccaggtatggttatatccgcctggctcaggctcgagtgggtcttcaaccggggcggaagtgtccgattgacccgtctattgggggaa

SEQ ID NO: 2599 - DNA, 891 bp, A.fumigatus
cttctatgccttaacagagccactctcttgttgcaccactctgcttcccaagcgctaaaccagcaacgactcgaaacctacctctcctcatacggccagcccagcctggacatcgcagagcatctgcgcaattctccgcctcaccattcccattccagaccgaacggcggcactgacactccgaaagatttggcagcgcgggttaagatcattgagctcttcacactacacgttcttccccgtaatgaggaatgggactatgccagagagtttatcaatatgagtgaagttctggacgaggaaagaaaagatgtctttctacagaccctcgagggaatcaaggaagagaaggaacaaggagaactgcgcgcagcggcgctccagcgcgagaaagaagctgagctggagagacaaacgcgtgaggaagaccgtcgacgagcggaagaagcagcagcagccgaacgattggagcaaaagaatcagcgacgcaatgatagcaaggtcgattctggtatcgaaaagagccgacccaacggcgcttcgaaagccaaagtgggaaagcccgcggacaaaatgtctagtagcaagtcaactccttcaggtcgcactgcattttcgcctcctgcgtcgtcgaaaaatgtcaagaaaaccgacaagccggcgagatcaaatcgagcgttggcaaatgtgctgcgcaatattatgcagtacatgtcaaagaccgtggctggcaatcctctgtcaattgctcgcacgctcttattcatgctaggcattattgtggcgctaagcaggcagaacatccgcgaaaaaattcggagaatcactgggtcgggttggcaaaaaatcaagggcactgtggggatgggagtgaaggtgagctatatctga

SEQ ID NO: 2600 - DNA, 309 bp, A.fumigatus
agaatcaaagtatggaatctttatatcactcttttgagttccattctcgaattggggcctgaggaagggaaaaagcaattcggtcagaagaagtggaagtccatctcgtcccaggtgcgcgatgggcaaatttgggagactgtagttcagactggctacagagggttggagggatctgtcgatgcagaggtcgtctataatctgtccgttaagcctctgcctccaccaattaactcctgcactgacactgacttctatgccttaacagagccactctcttgttgcaccactctgcttcccaagcgctaa

SEQ ID NO: 2601 - DNA, 408 bp, A.fumigatus
tttacggagacttcttcgccagccgttgaggctcatgtggcggagccacccgttcctcagactgagtccagaagagtcactcgcaaaccaatcgaaggagactgtaatatctgcctgtgtcttttacgagaacaagacagtgatgaaaacggcgagggatcagaagatcgcgatgatgagaatgaggatgatgcggcgggcacaggttccggcacagcgtccgacgagcacgacgcccccgaagaacatgacgatgacgaccttgtatattgcaaaaaccagtgcggtacgaactatcacaaagcctgtattgacgtgtggcatgctactcagcgtacatttgaaactccacgtggggatcctatcggcctgtcctgcccgtactgtcgagcagcatggtcctcctga

SEQ ID NO: 2602 - DNA, 804 bp, A.fumigatus
agtcagatctcctgcaaagccatgcgctcctgccaggcgtcggaggagcaaggaataaacaacaatacaagaggcagcgccatccccgttccaaacaatgccactggcctgaatgtcaagaaagtacgatttagcgaacctcttccacaaagacagcagaccttcactcaccatcagttgtccgataatcagtctcccttcatatgcaaaataacaaatcgcaccttaagaagtacaagcgacatgcagccgaagaagctgcgcatgagcagagggttcgccaacctgaaggcccttcagactgaagaagaggttatttcacagccagcatccgatgacaaccaagaccagagcgtttctaaaacaagccaacaggaacaatctgcaaatgtgcctacgaccagaaacaaggctggcactcagagaatggtactgcccagagatgataatcacaccagccggatcccaggcaacaagcagagaacgctgaccacgaccattcctgctggcttccaggtatccgaggcacagccccgtcagtattggcttggccgtttcatgactctcaccaacgcgttccactacgaagattctttcaatgaacccgatatcgccactggatttggcatgctgtcgagctactcccgacctctgggtcaccccgatgcgaaccttgcgaactatcgtgtcaagcgtgccttcatggttcttgagaatgtctgcgtgacggaggaggcgtctgctagtctgagagagttcagagacgagtatattgcgattcatggagatcgttggatgttgtga

SEQ ID NO: 2603 - DNA, 978 bp, A.fumigatus
  unsure (205),(206),(650): Identity of nucleotide sequences at the above locations are unknown.
ctcatttcggttcattcattcctattaagggatgaaagctcaatccgtaactcgctcagagtaaaggttcgcaattctcagatacacgaagcatgggattctcatcgccaagtctcaatgcgtatacctaccaagtcatcctcatgtggctctcaagattcaaacgagaccacagccagcagtgagaattttttagaaagatcannatatcgatcgccgtttgacagcaagagtgtccctttttcttcgccatcaagcagtcaaacgtcttcgagatccaccagtttcactagctcaacttcgacctcatcgtccgaacacaagtattcgaagatcccagtccctactgctcatccagtcaatggtattcactctcgcgaaacgtatcaaaaggaaggaaagcggagtttgctgtcatcactgaacaagcgttacatcaatctcagacggaacgcgagcaacgatgaaaacaagtccatctcaaatattggaacgcaagaaacagaagatggagatctcgacattcctactcatcctcggctggtcaaaatagctcaaaacgttcgatatgtccgacctaccgaacctgttcgagtttaccgaatcagtagacctgtccaggcagtgcaagttaaccaacctacgctacntactcaacctatccagccagtggtgcctattgagcttgccaaatctgctgagaatgtccaaccgactgccgaaagtgcttcagtctgtgaaaaatgtttggaacatcaatccaagcaaaccgagatgatcgagcagcgcactgaggttgtgttggactcatcatcgaagaaatttcgttcgtcaatcacacgaactacttcctcttcatcctcaaaggctgcattgatccatttgacttctccacggagttctataccggttcctgctaaagtcagatctcctgcaaagccatgcgctcctgccaggcgtcggaggagcaaggaataa

SEQ ID NO: 2604 - DNA, 183 bp, A.fumigatus
  unsure (79): Identity of nucleotide sequences at the above locations are unknown.
aggtgtcgggatacactaaaccagatgtctatctgttgggaaaggcgattaatcggaggagttattggtgtgaagggtngactgcaaactgctgtactttggacgacaccggagtttgatatctacatgggttttctaacaatcattggcagcagcctgtctgatgcgttaaaatttaatata

SEQ ID NO: 2605 - DNA, 345 bp, A.fumigatus
cctgatccagtaggagcggatatagtccagcatggggtgggccctgtcgatagttcagtctccttgttcatcaacaatgtgcttcgagcattacttacacctcgctgttccaattctgacggacacttagcatttcatggctatttggcgggggtgatctacacagcctttccagaccctgctgcgacggcatatcgctcggtaggtgctccaatgcaaatttttatcccaatccgcggctacttccctaaatcccttaatgtcatgctgacaagcatagtctattctattagtccaaggcggagcgtgtatgtgattgccatttttccagtttctgcaagatga

SEQ ID NO: 2606 - DNA, 576 bp, A.fumigatus
tctttgacgcttaattggggagtgcgagtggcatcacaagaggaagatctgttcaatgagattacgcacgtggaagaggagatcagcaaatttaggagcaccacgggcaatttgcaggactacattcccttcttgcggctgaaccccttcagcaccaactcgaggaaagcaaaagagatgagagaccggcgtgacagatatcttaatgcacttaaccgggacctggatgaccggatggagaaaggcattcacaagccttgcattcaggccaacgttattctcgacaaggaagcaaaattgaataaagaagaactcatctctatcagcttgaccatgctctccggaggccttgacactattaccacactcgtggcttggagtttttgtctcctgtctcgtcgtcctgatatccaggagaaggcggcacaagcgatccaggacatgtttagccaggatgagcccttgtgcgatgcccaagatgaccagaagtgcgcatacgtcgctgcactggtgagggaatgcctgaggtccgagatcccttgcttaactaaccttcgcttttctcgtccggcctga

SEQ ID NO: 2607 - DNA, 318 bp, A.fumigatus
tttctattctttgttttttcagccttggctgttgacgctgacgagtacgcactagaccccgaagtttggaacgatcccgaggaattcagaccggagagatggtttgaacaaccagatgcacccatgctgacctatggcatcggctatcgcatgtgcgccggctcgctactcgctaaccgggaattgtacctggtcttcatccgcactctaaacagttttcatattgaaccacatgacgacgttgactggcaccccattaatgggaactcggaccccacaagtctggttgcgattcgtcttcaccacggggctggaagg

SEQ ID NO: 2608 - DNA, 906 bp, A.fumigatus
ttgggttggccaaccattggcccttcctcccccgggaaacctttgaaattcttcttgttggcatcggattctaatcggacagcgttgcgcaaccggctggccggcgtctatggcgccagtatggcgattcccgacctcactcgcgtgcaggcgctgctgatgctcgccctccacgaatggggcatgtgccggggcaagagcgcctggctctatgtcggcatggcgatccggctgtcgcaggccatgggactgccgtttgaactggagaatgaggtctcctctcgcgatgatccccgctcgcctgccttcaaaaccgagacagagctctttggcgtgcgccgcggtccggaacccaaagagcagacgtccgacgatgtgatcgcccaggagacgaagcgacgaactttttgggcctgctttatcctcgaccgctgcctcagcagcggcaaatatcgtccccggatgatccgcgtcaaggaacttggtatccaattgcccagcgacaacgctttcgctttcggagagcgcgtgcgaacggcgcggctgaacgagccatccgcccgtcgcccgccgagcttcggctcacaagggatgcaaatccccagcattcgccagagtatcgggggcttcagcgatgacaaactgcccaacaatgtccctccggacaacaagccgtggtctccgatctcccggcgaaaggactcgagcgaggatgagatcgaccgatgggagattggggcggaggagtcggtgttgagccgggtgattcgcatcattcggatctggggcagtatcgccaagtggtcgtgtgcgggtggacgaaggtatgcatgcatccaccatcctcccgtgagtaacccccgaaaactaaacattgacagaaccgaacaagttcctccctgtctt

SEQ ID NO: 2609 - DNA, 1527 bp, A.fumigatus
gagcttcagtcaagcttgaaagattgggatagtgagccaatcaagatggaaactactcctcatgccaaaaatccctcagtcatcgactgctacgatggtatcacgccaactagcgtaccagagcaatggaattatcaaatcctttattacgacccaacgcagccatcgagtccgcctggaagctacctctcaaccaaagactcaccagattgttcagttgtcctagtggacaacagcaccgcaactgacgagtggagagggaagttctccttccggatgagtcgtcagccaccatacgcattcttacgtggccatgcagtccaggcgagtcaagaggggatagtgactgaacaatccggaagttcgggacgtgctctcgcctgttactctgaggactacttgttaagcttgccccttaatgcaagttttgttgtcggagtctacccccgcgaagacggggcttcattgcctgatggaaaagtcgaaattgtttttcaatctctcgctcagggcaggtatttcatgactaagagtgttgctctcgctccctttgtcgcactgactcggcgcgtttggcaactacggcgaagggactggcttggggatgcctccaagacgtgtattgtggatgatttgcatagccctgtttccggatacgcaatggccaaaatgaacggcacaattggctactacttcctcacccccacgggtattatgccttttgctaacggaagactgggtccagatcattccacatggcaagatgaggtcgcgatggcaggaaatgctaacggtctcttctccctaaccaaggcgggagatgtttatccatattccaagtccctatcagagcgcgagccttgcaatatttcgccggaccataagttctcggatgtcacttgcacaattacggattcttttgtctatgcaatcaagaccgaccgcactgtgtggagatatgatccaactcagcagcccggcacttgggagccagtttgtcaaacaagcgatttcaaagcagcagttctggtggcgtcagatgctgccgtctttgccatcgcacatccgacctgtccaccgcgatatggtccatctggggctgtttttagcctcttagaggggcctagtcctgtgctcattggcagtgatcagttacacatcaatcagttaaagattgccagcaattttctggttggattggcatcaggcgacaacaagatgtatgtctggaatggggaccctggctcctggaccgatctttccaccgcgcctctccggccatggggcggagtccgagacgtggttgacggcggcagtctaggaatagttgctttgtcaggggaccagcgcgagattgttcagttagatcggcatgagcggacgtggaattccttgggtgtcctgactgacgaatggcgcctacatgagggtacattgactctgtgcgcactggtcgacgatggtccgatatttggcatttggaatggacgcgcgaatttcatttacccgcctggaattgtgccataa

SEQ ID NO: 2610 - DNA, 222 bp, A.fumigatus
acaaatggcagcggcctacagaccaatggcttttacaacgtgcttggccctgattatatcggagaggctttccgtattgcccgaacagtgtgcccgggtgccaaactgtttatcaacgagaatctcgtccaatcacgtccgggcaaacgtcaagagctctatgatttcgtctttaggtttgtagcgaaagactcgtcttcaccacgggtggaagacagcgtc

SEQ ID NO: 2611 - DNA, 690 bp, A.fumigatus
agaaacgcagacatgtcgcacagcagaaccatgggggccttttgtgccgcaacactcatcaccgcgtttctcgccgctgccgaaggaacaaacgccttcaccaacacaggaactagcccgctgagaaaggaagcagcaagcaagggtattctcatcggatccggagccatcaatcagacctatctcgataatcctcagtttgcaaccatcctcgccgagcagttccagagtctttcccccgagaatgagatgaagtggccgttcatccacccgacgccagggcactacaattgggacacgatcgaccgccttgttggctttgcggagaacaatgacatggtggtcaagggacatggactcatctcgagctgctgcaaccccgactacctgctcaacatcaccaaccccaagctgtttcgcgccgccatggtcgatcatttcgggcgatcatgcaccgatacactggcaaggttgatcgatgggacgttgtcaccgaagcactctagacaaatggcagcggcctacagaccaatggcttttacaacgtgcttggccctgattatatcggagaggctttccgtattgcccgaacagtgtgcccgggtgccaaactgtttatcaacgagaatctcgtccaatcacgtccgggcaaacgtcaagagctctatgatttcgtctttaggtttgtag

SEQ ID NO: 2612 - DNA, 207 bp, A.fumigatus
cccttccagccccgtggtgaagactattccatgtctggagacgatctaagccatcaagcttggacagaaagacaacatataagtgagaggctttcaacatacggtgaccagttcgaagccctggaattcactacaatgactgagacacttgaatggcttccgaatttcagtggtcccaacacagtacgaaacatcaacgatacgtga

SEQ ID NO: 2613 - DNA, 495 bp, A.fumigatus
aatatcatgccaaacttccaagcccactcactcacacgatcaacatatagctggttaccgctcctcttcatcccaaccaacgcctcccccctcttcatcatttcctttgtcacactcacatacatcctccaccgaccatgcatctactgctccgcgctgctcctcatcctcttcatctcctcctgccactgggctgaccgctgcttcttcgacttccgcggcgactggttttcgccgcgctacgcaacctcgagcccctacgatgctgtctcggccaatacctccctggccagttatgtggcagaaaccgtcaatacgaccaccaaggcgctggcgggcgcggcggttgaggaggcgcagcggcgacttgcgctcaacggatcaagtgaactgggacagcaggagtggaccggtgttggactcgaatggttgcggagtttgctgggacgacgggactggactcttccctgtgtagatgtcaaggttcggctttga

SEQ ID NO: 2614 - DNA, 492 bp, A.fumigatus
gccgccgcaccatctgaaatatcatgccaaacttccaagcccactcactcacacgatcaacatatagctggttaccgctcctcttcatcccaaccaacgcctcccccctcttcatcatttcctttgtcacactcacatacatcctccaccgaccatgcatctactgctccgcgctgctcctcatcctcttcatctcctcctgccactgggctgaccgctgcttcttcgacttccgcggcgactggttttcgccgcgctacgcaacctcgagcccctacgatgctgtctcggccaatacctccctggccagttatgtggcagaaaccgtcaatacgaccaccaaggcgctggcgggcgcggcggttgaggaggcgcagcggcgacttgcgctcaacggatcaagtgaactgggacagcaggagtggaccggtgttggactcgaatggttgcggagtttgctgggacgacgggactggactcttccctgtgtag

SEQ ID NO: 2615 - DNA, 213 bp, A.fumigatus
  unsure (114): Identity of nucleotide sequences at the above locations are unknown.
attctgtacagcgatcataagaacgaaatcacatccagaaacgacgacaacttgcatgcgatagcagccgacaatctagtccaggtcaaaataatgcaagcccaatccatgctntatgaaccctccggtgcatgcaaaagaatgtccgctatttcagcctcatatagttatattgatctttggatctggtgggaaaagaaagaccgggaataa

SEQ ID NO: 2616 - DNA, 234 bp, A.fumigatus
gttccagtttacgagttcaaagtcgatggcgaaagtgttatgcgccgacgaggcgatgattggatcaatgctacacatattcttaaagtagctggttttgacaagccagcgagaacccggattctcgagcgtgaagtccagaaagggactcatgagaaggttcagggtggttatggcaaataccagggtaggatattctacacggtcaagtgtcgtcgtttgccattcggctaa

SEQ ID NO: 2617 - DNA, 198 bp, A.fumigatus
gatattctacacggtcaagtgtcgtcgtttgccattcggctaacattgtcgataggaacatggatcccacttcacgagggtcgtttactcgccgagcgcaataacatcattgacaagctaaggcctattttcgactatgtagcaggggatcacacccctccgccggcaccaaaacatacttccgccgcctcatcgaga

SEQ ID NO: 2618 - DNA, 465 bp, A.fumigatus
aaaccaacacatgatgccgatttgatctggattcgatgccgtcccacaattgcaacccagtcatggtccagccgtctacaaagctcccgcccgattgtctgtggttatgcatgcaagaaaattgagaattacctgctcgccgcggatactgtacacgaagataataagctcaagggcgtggagaaggcactggaggaagacgtgcccgagaagagggatttctacaccaatatcgtcgtgctcccaaagccagacggcatgcatgcgctgaaggtcgcggaagaagatctcgaaatcgccagcgttgagttcccgtggcagccagcgagggaaattgacccttatataggtgagaactccgtgctaaggacccttatgtctagttcaggagaaaaagattggctgaaattccgccaggcaggcagtacccgcgcttggagagtgttgagaagggagatgagttga

SEQ ID NO: 2619 - DNA, 972 bp, A.fumigatus
ggagggactcactttccatccccgcgggtaagacatgggcagatttgctttgaggaacggactcctgcatggaatatatctctctacggcatgcccacaggagacgaatttatccactatctggaaaagtggattgaagcacccacggatgcatcttgcccacttggcggcaaagccccatatactaacgcgcttgtcatcgattcaaggcgccttatgaccaatgccagccatttcagaaccagccatacccctctgaggagtcaggatgactatatcaaggcgtacatctcagcccgtcgcatcgcggatggaatctccaaagaacacggcatagatgtattcccttattccaaaccatatatctacttcgaccagtatgtctcaatcgtgcagctcacaggcactttactcggttgtgctgttgccattatctttgtcatcacgtcaatcatcttaggctctgtcgccaccggtgcggtagtaactgctacggtcgtgatgatcgttgtggatattattggctccatggccattgctggggtgtcactaaatgccgtttctttggttaacctggttatttgcgtcggcatcggtgtcgagttctgcgcccatatcgctcgagcgttcatgttcccttcacgcacaataatgggcaagactcccaccaagttccggggcaaagatgcaagagcctggactgccttggtcaatgtgggtggcagtgtcttcagtggcatcactatcaccaaattactcggaatttgtgtgctggcattcacccgcagcaagatcttcgaaatctactatttccgtgtctggctagcattggtcatctttgccgctacccatgcccttatcttcctgcctgtcctgctcagttattttggtggcgaaggtaggtttattctggttgtgtcttttgaatctttctctttctccccaacttccgggctgtctaacacaatatag

SEQ ID NO: 2620 - DNA, 210 bp, A.fumigatus
gttatgccgatcctggatccgacggtggtttggaagaaacccttgcctccagaggttatcgcgccctgcttgttgatgaagactacgactctgaagaattctagcgatgctctacatgatcccatggccaatgttttcgcttgttttacgtatgaacgatgctggcttatctatggttttgtactatgcacattttgctcttttatttag

SEQ ID NO: 2621 - DNA, 417 bp, A.fumigatus
  unsure (198),(249): Identity of nucleotide sequences at the above locations are unknown.
tccccgaagatcgtcttcgaaggcaccaccacctttggctataaagagtggagcggccccttgatccgcttcggcggcaaggacatcaccatcaagcagaactccggcgctgtgattgacggagaaagctcccgctggtgggacggcgagggcaccaatggcggcaagaccaagcccaagttcatgtacgcgcacagnctcgaggactcgaccatcaccgggctatccatcaagaacacacctgtgcangccattaatgttcaggcgaccaacctctacctgatcgacatcacatcgataacttcgacggggatgacaacggcgggcacaacactgacgggtttgacaataacgaaagtaccggggtggatattcggcgggcttacgtcaagaaccagaagactgcattggcattaa

SEQ ID NO: 2622 - DNA, 354 bp, A.fumigatus
caagctgtaatatccaacctgtccttcctttctttcttacctgttgagagatttatcctcactgaccaaaactgttctgttgatcggaactctcgttccttcattccctcattcatcatgcgttctgttaagctttttggcctggctgcgctgggctccctcggcgctgctgcccctgctccgtctcgcgtgtcggatctgaccaagaggtcttcaacttgtactttcaccgcagcctcccaggctaccgagagcgcttctggttgctccgagattgtcctggacaacatcgaggttcctgccggtgagacactggatctctcggatgttgatgatggaaccaccgtacgttaa

SEQ ID NO: 2623 - DNA, 207 bp, A.fumigatus
ttgcgatactttcaggccggcgttgaacaatccgagatgcgcccgacatacttgtctcctcaggcccatgtgaagctctcttcgcccggtgcatttgacggcctacgtattcacacagatgagatcaacgaagtgatcaagcgaatcactccccgaagcctgacaatcgctgtggtacgcagccccttgtatgatttgcccaaatga

SEQ ID NO: 2624 - DNA, 219 bp, A.fumigatus
cccatttgccagatcatggactcgatggactggttcgatcccgaaggcacagaagcatcgatccaagcccagaaactcaaccacgccctgaaaatggacggccgcattctcctccgctctgccagcatcgagccttggtatatcaagcagttcgaagagaatgggttcacagcccgccgtgtcggcgcccgcttccccggctcttgcatcgatcggtaa

SEQ ID NO: 2625 - DNA, 492 bp, A.fumigatus
ttatcttctgcggcagccccaggagcgggcaaatcgacattttactggaatcacctccagccgctgggttacgagtgtgtcaaccaggacaatctcaagacggtacgattggtgtacactctcggtgaacatgaaaacggtacactgaaactggacaccaacagagacaaaaatgcatcaaagtcgccaaggagtttctcaccgccggtgcctccgtcgtcgtcggtaggttgcatccgttttcagggctcagcaagcacccagacacacgcagctgacgccatgacagacaacacaaacgccgaccccaacacccgcgccgaatgggtacgcgtcgcaaaggaatccaacgtccccatccgatgtgtctacttcaccagttcgccggaactatgcaagcacaacaacgccgtccgcgccgcgaatcgatctttggtacctctcttttcgtctcaaatgctggaaacgaaactaacagtatatgcgctgtag

SEQ ID NO: 2626 - DNA, 282 bp, A.fumigatus
catgagaggatagcccgacaaaaagtttttggtgtcaggattgggctttccacgatgagaagcaaaaccgtgtgcaacatcgtgcaaccattccgttccctgtaccacgcaaagtggatgtctaacatgagtcttgatgtcgttgcgtctgagaagacgtgcatccgtctctaccaaaaagaaaaggaaaagagagaggaaaagaaaaagagaagcatgaatgatacggtctgccgtgtatatgtagatatgtacccgatatacccagcatttcaagaatga

SEQ ID NO: 2627 - DNA, 486 bp, A.fumigatus
  unsure (457): Identity of nucleotide sequences at the above locations are unknown.
accggtcgtttgtgtactatcctcaatgtacaactctcaggacctgcaaaatctcgctatcattggctgaacatattcataggccctgaggatgaactgttactgaagaaggacgaattgtcaattctcatcaggagagtacttcgggaatacccgatgctttcttacttccaggggtaccatgatatcgcgcaagtactacttctggtacttggtgaaaaggaggcagccccagctgtgaccaatatctccttgttccgaattagggactatatgctgccgtctctctcccctgcgctgaagcatttgcagcttatcccggcgattatcgagaaagctgatccggccttgcgggagcacctcggaggcataaaaccattctttgcccttgcagcaacactcacattgtatgcccatgatatacaggagtacagcgacattgcacggctgtttgatngtattcgccacgggccgaagtaccgcgta

SEQ ID NO: 2628 - DNA, 219 bp, A.fumigatus
atatggatggaccagctaaacctcacgcacttcgagggcgctgcgcattcagcgtatctggcacagtccagagtgcccaatataatcgcctgcaatgtgatcctgctgtcgatcgtcagtatagccgttgctatgcgactgtatgtgcgctatcgctatttcatgattcgttctgatgacagtaagtcataccactcgcaatcactgggtcaggactga

SEQ ID NO: 2629 - DNA, 279 bp, A.fumigatus
tcatggtcctgcggcccggctcggttgaaaacaggtcaactggtggaagctacaaaacatttggcaggatggctcattcgaagtgccattggaacaggatcgatggccgatgtgcctcagaatcttctacagcagattaaggatttcgaggagatgtttactgtggacaaagccaagctcaagcaggtggttgaccacttcgtcaaggagctcgacaagggtaagcctttgtctttaacctatttctggatcgctccggtagccagcagagagatataa

SEQ ID NO: 2630 - DNA, 528 bp, A.fumigatus
ccgcatccgtctggagaggcctgtccgctgaccactaggactacgcaacagccgatgaacgttacctgggtgatgggcttccccgatggagacgagcaggggaccttccttgccctggatatgggtggcactaacctccgcgtctgtgagattaccttgacggaagagaagggaggcttcgatatctgccagtccaagtaccgcatgccggaagaactgaagaccggaaccgccgaggagctgtgggaatacatcgccgactgcatacagcaattcattgagttccaccacggagaggaaggattgacatcattgcccctgggtttcaccttctcctacccggctacacaagagtacattgatcatggtattcttcagcgctggactaagggcttcgacattgatggtgtcgagggacaggatgtcgtccctccccttgaggaaacgcttaagagaaaggtatacccgctcttagttgttgttgttgccaatctacgcacatctaacaatgtcctcaccgccggttga

SEQ ID NO: 2631 - DNA, 213 bp, A.fumigatus
cccatgggtctatccgtgcgttcatcgatcaacatcccttacgcccactacgccatgatctatctcgacaacatgggcagactgaaggtgacggaatctccgtctatccaggagcagaatggaactgtcttcacaccagaagtccgtgaaagatttttggaaatccttggtgccaagatcgggtaccagcgccccatggttcgaagtatgtaa

SEQ ID NO: 2632 - DNA, 288 bp, A.fumigatus
cttactgattcatttttccatggtggtagggtggaagctcgtgccgatattctacgcattcactcacggtcgatgaacctgacgcgaggcatcaacttgacgaagattgcagagaagatgaatggatgctcaggagcagaactgaagggtgtgtgcaccgaggcaggcatgtacgcgcttcgggaacgacgagtgcacgtcacgcaggaagattttgacctagccactgccaagattctcaacaaacacgatgacaaggaggttgctgtctcgaaactgttcaagtag

SEQ ID NO: 2633 - DNA, 240 bp, A.fumigatus
  unsure (11),(16),(17),(29),(31),(37),(47),(48),(49),(51),(53): Identity of nucleotide sequences at the above locations are unknown.
ttgcggcgggnacccnncccggccccccncnatttcnacggaatccnnncnanatatacgcattgcgcggatccttcgagccccgtggtgaagattgcgttgctttcagactcttataaattagaaaaaatgttgccatcgtcggttgacccgctcgtttcgcttatgatggtcgagaaggtgcctgacagcacatacgatatgatcggaggccttgatcaacaaatcaaggagatctag

SEQ ID NO: 2634 - DNA, 480 bp, A.fumigatus
gaagtcattgagcttggtctcaagcatccagaactgttcgagtctcttggtatcgcacagcccaaaggtgttcttctttacgggccgcccggaaccggtaaaacactgctcgcccgagcggtagcccatcacacagattgccgattcatcagggtcagcggctcggaactagtccagaaatacattggtgagggtagtcgcatggtgcgtgagctgttcgtcatggctcgagaacatgcaccaagcattatcttcatggacgagattgacagtatcggttctagccgtatagactcggctggctctggagattcagaggtgcagcgtacaatgttggagctgctcaatcagctggatgagtttgagcccacaaaaaacatcaaaatcatcatgggtacgaaccgacttgatatcctggatcccggtttgttgcggcccggaaggattgaccggaagatcgagtttccaccgccatcgtaa

SEQ ID NO: 2635 - DNA, 336 bp, A.fumigatus
tattaccaagcagctcttcgctgtttcccgggtaaattcggtcctatgaatcgatatctagccagagtggttttcgctgatacgttgttgaaggaaaccgcccaacttgaggctcaggcttatgagctcgaacaacgcaccgctctggccgccgaggccaagtccgtccttgactcgtgggttcgctacgaaagccaggtcaagcagcgccagcagcgtgagctcgccgagtccgtcattgccaagattcagaaggagcttgagaaccccaaggtcctccagcagatccttcagcagagcgttgctgatgttgagcgtaagttccagtcgccctga

SEQ ID NO: 2636 - DNA, 474 bp, A.fumigatus
ccccaggtaggtgttacccggctccggccgactcttcccgtgcgcagtgtcggtgccaacctgactgcctctcgttcggcctccaatgtccctgccgaagaccccaagaagaaggctcagtcgatcatcgattctcttcccggcagttcccttgtatctaagaccgctatcctgtccgctgccgccggtctttccgtcgccgccatcagcaacgagctttatgttatgaacgaggaaaccgttgccgccttttgccttctgagtgtcttcactgccgttgccaagtacggtggtcctgtttacagtgagtgggctcagggtcaggttcagaagcacaaggacatcctgaatgctgcccgtgccgaccacaccaacgctgtcaaggcccgcatggacaacgtcaaggagctgtccaacgttgttgatattaccaagcagctcttcgctgtttcccgggtaaattcggtcctatga

SEQ ID NO: 2637 - DNA, 186 bp, A.fumigatus
gcaatatacccaaataggaaaaatgcccaactactccaactcatcccgaaactgcaaaacgcccaaccactgaccacatcctccaagtccaacaattttgataacccgaaatgtatctacacctctgcttgcgctacgtttcatgctgagcaggaatccgtggcaagcacatccacaaccccataa

SEQ ID NO: 2638 - DNA, 486 bp, A.fumigatus
  unsure (1),(327): Identity of nucleotide sequences at the above locations are unknown.
ngaagcgcttttccttccagcccggcggttaagaacaagttggaacaacactactccctcacctacaccatcgtctccctcgtcttcctctccccgctaggcggatacgccctcgccgccctaacaaacaaccacatccacctgcgcttcggccggcgcggcgtggccatcatcgccccatcgtgccacgtcatctcgtacatcatcaactgcctccacccgccgtaccccgttctcgtggtgagtttcatcttcgccgggttcggcaacgggcttgcggattcggggtggaatgcctggatcggcaacatggcggatgcgaaccangtgctgggcctgctgcatgggttctacggggccggggcggtgcttgcgccgttggtggctacggcgctggttacgaaggcggaggtgggatggtggtatttctattacatcatggtttgtccttttcatttccccagtgtgggagtttcatgttgctga

SEQ ID NO: 2639 - DNA, 759 bp, A.fumigatus
attggctgcgcggtcatcgagcttaccacctcggtctactgcttctgggacgatactggggcagtcttccggcgggacacgcagcattcgactggtggcactggcagcggcgggggaagcctgcgcaaggcgctgttcacgaaacacgcggggaggattacctggttgtgtgcggtcttcctgctcctgtatgtcggggtggaggttgcgctgggcgggtggatcgtgaccttcatgatgcgcgtgcggcacggcgagccgtttgcgagtgggatggcggcgaccgggttctggttggggatcacagtgggccgggtagtcctggggtttgtgactcccaggctgggtgagaaattagccatttcggttgcgtcttcccttttcatatttcttggtatttcatgcatgctaacggttgcagatctatctcatctcctccatcgccttgggcctcatcctctggctcgttccgaacttgtacgtttcgaccgtggccgtctcgctgcaggggttcttcctcgggccgctgttccctgccgtcgtggtcgtggcgaccaagttgctgccgcgtgggttgcacgtcaccgcgattggctttgcggcggcctttggagcgggcggtggctcggtgctgccgtttgctgttggagccattgcgcaggcaaagggtgtcaaggtgttgcagccgtttgccattggcttgcttggggcgattatggggttgtggatgtgcttgccacggattcctgctcagcatga

SEQ ID NO: 2640 - DNA, 354 bp, A.fumigatus
cggttgcagatctatctcatctcctccatcgccttgggcctcatcctctggctcgttccgaacttgtacgtttcgaccgtggccgtctcgctgcaggggttcttcctcgggccgctgttccctgccgtcgtggtcgtggcgaccaagttgctgccgcgtgggttgcacgtcaccgcgattggctttgcggcggcctttggagcgggcggtggctcggtgctgccgtttgctgttggagccattgcgcaggcaaagggtgtcaaggtgttgcagccgtttgccattggcttgcttggggcgattatggggttgtggatgtgcttgccacggattcctgctcagcatgaaacgtag

SEQ ID NO: 2641 - DNA, 228 bp, A.fumigatus
attacagaaggtaaagaatggaaaatagctttcagaataaagtttagatattttaaatacctagttatactatttagattaaccaacacaccagtattatttaaaaggtttattaagaaagtattatataaggttctgcactgctttgtagtagtctacttagataatatcttaatctttttagaaaataaaaataaatatatagaacatattaaggaggttctataa

SEQ ID NO: 2642 - DNA, 237 bp, A.fumigatus
  unsure (150): Identity of nucleotide sequences at the above locations are unknown.
ctaatgaagactaaggatgaaagacatcctcacgctgatctacctcgctgccgagcgcagaatcatcctgaacctaaaggatttctcaggtcgcaaattcgggctacagacagtggttacctcaccaggcaaatcgacaaagataagcancgcttcgtgggccaggtgcagcccgtcgaagcctcgtatacatacggcaacccgatccgggagaaagtcgtcaacatgccccgctga

SEQ ID NO: 2643 - DNA, 486 bp, A.fumigatus
gctggcatgtacccgccaatgggtgctcctcccatgggtttatacggtgctcctcagcctatgaaccagttcactgaccctaacaacacaactgtcttcgttggtggactctctggttatgtcactgaggatgagctccgttctttattacagggattcggcgagatcacttacgtcaagatccctcctggaaagggttgcggtttcgttcagttcgttcagcgccacgccgcggagatggccatcaaccagatgcagggataccccatcggtaactcccgtgtgcgtctcagctggggtcgatctcagaacaactccggccccgctggcagcccttaccgccctgcccctcccccgcctccgatgtatccctctatgggcatgcccccagcacaccagtacggtggtttcgcgcctatgaaggttggtagtctcaataatacttctgaagcccctcggtcatctgatgaagctcagtttgattaa

SEQ ID NO: 2644 - DNA, 183 bp, A.fumigatus
atccaattaatggctggagccctggaagtccaacctacatacaataaaccgacaccaatcccacatcacgatgctggtaccgcccttaccaacgactgcagcctacccaacatcatgggattcgaaaccgacctggaaagcacgccgtgcccaaagaagaatctaccgaaaaccgagagttga

SEQ ID NO: 2645 - DNA, 192 bp, A.fumigatus
tgcaatgattgtgaagattcttcttcgctccggaaatctgaaaaagattggttcaatgtgactttagctaatttggctggtatgcaatccagggcatccggaacagattcttcggtggctttctatagcaactttaatgggctgccatgttccaagaccgctcgcggcgcatcaactctcggttttcggtag

SEQ ID NO: 2646 - DNA, 261 bp, A.fumigatus
ctctgctcaagcatctccatctccgccgcctccatcacctcccccaaaacccgactccgcgactgcctcaacacatttgaggaacccgtctggacccaggctgggacgaccagggccaccacctcgcatcgatccatcattagcgagtatgttgtgatgcgcatcgagctcgtcctttcctatcgatggacgcggactaatgtgattggatctactagatcgaccgtacttgcaccccaacgaagatctgtcgaagagtga

SEQ ID NO: 2647 - DNA, 495 bp, A.fumigatus
aaacgatactgcgctgcggcctttcaatcccaccttcacacccatctctatccacacagtacgattagcattcacgtctcagtcctgtcggctgatgggtctctgctcgccgcagcggtcaatgcatgtaccctagcccttgttgacgctggtattcccatgccaggcctgctgtctgcctgtacctctggcatgagcggcagcgcctctacgccacgtgatcctcggaatgacttcctggatccccttttagatctatcactgccagaagagcaagagcttccattcctgacggttgggacaacaactgctattcccgttggagaggatgccatggacgacgacgacgaagatatgaaggtctctatgatggtgatggactcgaaagtccattgcacttatctcgagacaatgctcgccgtcggtattgacggatgcaagcagattcgggagatcttggaaggagtcatcaaggggacaaaccgaggagtatga

SEQ ID NO: 2648 - DNA, 201 bp, A.fumigatus
ttttccagccggctcgtcgataaaatgtacggagagccaattgagcctcctaacgaagtttattatatcggctcagtaaatcaatttgacaaatcatgtaacagggatggttctttctgtattgttgactctgctgccttcatcatgtcctgcagcacctgcaaagcagcatcctcctgtcctataggcacgaagatgtga

SEQ ID NO: 2649 - DNA, 477 bp, A.fumigatus
ttggccatgtctttgccaacgaaaggagaacaaaacctccccaccctcctagcgtcgatgcgacctacagtacacctagagacgtttgtctttctcaccacaacacagccaattgaaaatcttccccttcagtctctgaaaccagagatgctatttcaagaagacgagggattgagcatcatcaccacgaaagatctgcccgagtcacatggattgctcgagtatacctttccatgcaagaagatctcattgacggtgcattccagtctggaggccgtaggactaattgctgcgatctcgtcgaagctcgctagtcatggaattagcaccaatgttgtcagtgggtatttccacgatcacatcttcgtgcctataggacaggaggatgctgctttgcaggtgctgcaggacatgatgaaggcagcagagtcaacaatacagaaagaaccatccctgttacatgatttgtcaaattga

SEQ ID NO: 2650 - DNA, 198 bp, A.fumigatus
aaggcagttgagaatgagatgtcaacattgccctcatttctgacgcgactaggaaagaccaagcgctatggtgtcgtttcctcgctggacgccaaggaagtcgtacgtcaactgactggtgtcctgaacattcaagaggctgacaagaatgtgtcacgctttgaattgaggggacggacggtctttcggcaggcatag

SEQ ID NO: 2651 - DNA, 210 bp, A.fumigatus
  unsure (23),(27),(28),(38),(40),(101): Identity of nucleotide sequences at the above locations are unknown.
catcggtgccagcctttcagatntcgnnagatcggagnanataacctttcttcaaaatttttcgagtttttgaccggacggccaaagggttggaaaacganaggcgagacatcggacgatatcagtgccggagatgtggaacaggttgttcctgccactaatcagtctaccaaatccacctttctaggtcttaggaactcgttaatctag

SEQ ID NO: 2652 - DNA, 252 bp, A.fumigatus
tctccgcgctcggctgacgattatccacaggttactgctttcacacaagcgaaaatgtatactcaacatggtgcccaaatggcacccccgcaaaaaccggagacgtttatgttgtcgaatgaagcgcaacaaagtctccctcacgatgcgcaagttgcgcttcaacaggttgataattgtaagtcgatgatctgctactctcatttgcgaagcctctgcttcttacttgtaagactattaagcgctcgctga

SEQ ID NO: 2653 - DNA, 831 bp, A.fumigatus
agacatgcctggatatcacgttgccatcagctgcttgcttctctcggccagaagctacagtctctggctcctcagcccacactgagtgatttcccaatgctctctctcacctacgaggaactcgacaagatggtatcagcgaagctaccaatcgccggtattacctcccttgatcttgtcgaggacgtgtatccttgctcgcgcatgcaacagggtattttgctcagccagtcccgaaacacctcggtctatgctgtgcatgatactttcgaagtgaaaggcgtcggaatcaaacctagtgtggatcggctgatcatcgcttggcagaaggttgtttcgcgtcatgcaatgctaagaacagttttcttggagaacctgacaagccaggaccttttttgccaagtcgttctcaaggaatacaacccagctcccgcactgctgagctgctccgaagaacgtgatgttttgccaacctttgataatcaacagcccgtgaactatcgtgacccccgtcccgctcatcgttttagtatctgcgagacagcaaatggcaaactgttttgccgacttgaaataagccatgccgccatggatgggacttcaatctctctgatcgttcgagatctgcaatcggcgtacagtggtcagcttcaggaagaccgcaaacccatgttcaaggattacatgcggtacttgcagagctgctctcatagtgctggcctgaattactggctcccctatttatccgatgtcaagccgtgccatttcccggtgctcaatgatggaagaccttcaaacaagcggctgcacggacttttcacctcggtctga

SEQ ID NO: 2654 - DNA, 1464 bp, A.fumigatus
acctcgtccttcatccggcggctgataagaaactccgctgatcgacttcctgtgtccgcattgctcgctacgggtctcgtgcaccatcacatggtccgcaataagtggagatcactggcggctctagttgttgaaacggctgaggctcgtgaagtccaccacatgtgtgtcctcgttggttatggtgctgacgccgtcaatccgtacctggccatggagtgtattctcaagatgaaccgggagaagttgattcgcaagccactttccgatgagaaggtcattgagaactacaaggcttcttgcgatggaggtattctcaaagtcatgagcaagatgggtatttctaccttgcagtcatacaagggtgcccaaattttcgaggctctcggtatcgatgacagcgtcattgaccgatgctttgccggaactgcaagccgtatccgtggattgacttttgagctgatcgctcaggatgcatatgccttccacgaacgcggatacccatctcgttccatcattgaaatccccggacttcctgaatcgggcgagtaccactggcgtgatggaggcgaggcgcacatcaacgaccccgtcagtatcgccaatgtccaagatgctgtccgtaccaagaacgacaagtcttacgaggcttacgcgaaggctgctcatgagcagatcaagaactgcactctgcgtggtatgctcgagttcgacttcgagcaacggagccccattcctatcgaccaagttgagccttggactgaaattgttcgtcgtttcgtgacaggtgccatgtcgtacggatccatctctatggaatctcattccacattggccatcgcaatgaaccgtcttggtggtaaatccaacaccggcgaaggtggtgaagaccctgagcgtagcaagcgactggagaatggtgacaccatgcgctctgccatcaagcaaattgcctccggccgtttcggtgtgacttcccactaccttgccgatgccgacgagctgcagatcaagatggcccagggcgctaagcctggagaaggtggtgagctgcccggccacaaggttgtcggccccattgcccacactcgttactccactcccggtgtcggccttatctcgcctccacctcaccacgacatttactcaattgaggacctgaagcagcttatctatgatctcaagtgttccaatcctcggtcccgcgtttccgtgaaactagtatctgaggttggtgtcggtatcgtagcctctggtgttgccaaggccaaggctgatcatatcctgatttccggtcatgacggtggtactggtgcttctcgctggactggtatcaagtacgccggtcttccatgggaactgggtctcgccgagacccatcagactctggttctcaacgatctgcgtggtcgtgtcgttgtccaaactgatggtcaacttcgcaccggtcgcgatgtcgctatc

SEQ ID NO: 2655 - DNA, 792 bp, A.fumigatus
gtaaatgtcgtggtgaggtggaggcgagataaggccgacaccgggagtggagtaacgagtgtgggcaatggggccgacaaccttgtggccgggcagctcaccaccttctccaggcttagcgccctgggccatcttgatctgcagctcgtcggcatcggcaaggtagtgggaagtcacaccgaaacggccggaggcaatttgcttgatggcagagcgcatggtgtcaccattctccagtcgcttgctacgctcagggtcttcaccaccttcgccggtgttggatttaccaccaagacggttcattgcgatggccaatgtggaatgagattccatagagatggatccgtacgacatggcacctgtcacgaaacgacgaacaatttcagtccaaggctcaacttggtcgataggaatggggctccgttgctcgaagtcgaactcgagcataccacgcagagtgcagttcttgatctgctcatgagcagccttcgcgtaagcctcgtaagacttgtcgttcttggtacggacagcatcttggacattggcgatactgacggggtcgttgatgtgcgcctcgcctccatcacgccagtggtactcgcccgattcaggaagtccggggatttcaatgatggaacgagatgggtatccgcgttcgtggaaggcatatgcatcctgagcgatcagctcaaaagtcaatccacggatacggcttgcagttccggcaaagcatcggtcaatgacgctgtcatcgataccgagagcctcgaaaatttgggcacccttgtatga

SEQ ID NO: 2656 - DNA, 879 bp, A.fumigatus
tggccgttagagccattctcacatactatcagtacttgccgtcgcaagctctacttgactgaagtggactttcatactctctcttggctgtctcccaatatgtgtcagaacgaagttgaagtcaatggctggaccagcatgcctgctaatgctggcgccatctttgatggtggacccttcatcaacgtaccggaagccctgtcgatcgaagagatcaagtttccagtcgatgaccccattgttgagaaaaccatgagatatgcaaaggctgctcttcccactgaaacattcaaccactctatgagagtttactattacggtatgcatgactgcgcgtcccatggtgtcttaatcaatcgctcacaggctctaggaatggctatcaccaagcagcaattcccgaagcaagccagtgcccttagccccagtacctgggccttgacctgtttgctgcacgacatcggtacttccgaccacaacctcgctgcaactcgcatgtcctttgatatctacggtggtatcaaggctctggaggttcttaaggggtttggcgctacctccgatcaggccgaagcggtcgctgaggccatcatccgacaccaggatctcggagttcatgggacgatcacgtatatcggccagctcatccagctggccaccatctacgataacgtcggggctcacccatacgtcaaagactttggcgagttgatccatgatacaactcgctcccaggtgcacgaggcgcacccgccgggggaatggcgcacgttcttctctggcgtcatccagaaggagcaagcaatcaagccctggtgtcatacaaaaaagatggtgaatgttctgaggaaaggaagccagcaccctgatgagcagtga

SEQ ID NO: 2657 - DNA, 228 bp, A.fumigatus
tccacttcttccagcccgggcgcgtatatagtcttcatttatatttgggccattatctaccagctgtctattggtgccgttgggtttgtactggcgtcggaaattgccaccgttcggttacggagcacgacccagggtctggttacaatcaccaatgcggcttgggggcttattatccacttcacaatcccgtatatggtctgttccggccttccataccgaatttga

SEQ ID NO: 2658 - DNA, 504 bp, A.fumigatus
gccgtaccctcttcttggttaccccacaacagcacagctccatcacatcacagtccccgatccgtcgacctgtccccaacttccaccattcaatatcttcactgctcactatcacctcggcatctgatttattatatacttccaacctctctctctctctcactacgcgttgatgggagccccccgctccgagcgaccctcaacatggttcagtctccgatgctgtcatgtccattaaagcagaccaacgagattgactggattcggcctctgaaggattatattagacagagttacggggaagacccggaacggtacaatcaagaatgcgcgacgctcaaccgtctacgacaggatatgaggggtgctggaaaggacagcgcgacgggccgcgatctactataccggtattatgggcagcttgagcttttggatttgagatttcctgtcgatgagaatcacatcaaaatctcctttacatggtatggcttctcagcttgttga

SEQ ID NO: 2659 - DNA, 210 bp, A.fumigatus
agaatactaaccgtggtatgtgcacgaaatagccttccatcagatggtggcaacgcccccaatcagtcccacaagcacgagggtttcctcaagtctgcctggcacaagctcatgaatagcacaaagaacggcgacggtgaaaactcggccagcaattcaggcaagaaagagtctggggacgctgaaaagagtgacaaggaaagcaaataa

SEQ ID NO: 2660 - DNA, 279 bp, A.fumigatus
gatttcctgtcgatgagaatcacatcaaaatctcctttacatggtatggcttctcagcttgttgatgcgcgcctctggctggatggttcacacttactaattgacgctcaacggtcccatgacaggtatgacgcctttacccacaaaccgacttctcagtactcgttggcctatgaaaaggcgtcgattattttcaatatctctgccgtcctctcatgtcatgcagccaacgacaacgccgcagatgtgagatttgaccaggcggagaaatatagaccc

SEQ ID NO: 2661 - DNA, 726 bp, A.fumigatus
cctcgaatctcttcacaggccgactatgataaggaatgcaacgagaagttgatccacatacgagacactagagcaagacaagccgcagttatgcagaatgggatgatgccccaagggcccgcagcaggtatgcctggggtagggcagaatgggtttcagcagttgaaccgtcctgtgcaggcatctccaatgccaggccaacagcagatgccgatcggcatcaatgatcctacacaacaagccgcaattcaacagcgccaacagcaacaacagcagcagcagcagtcacaacaacagcaacagcagcaacagtcgcagcagaatcaggctatgctccagcagcaacgtgtgcaacaacggccaggcggcaatgcttccctgcctgacgatctcaataccctctcggctcaagaatatgaacatgtctgtcggatagccaatcaaatccttgctaaaacgcctcaggaagacatggagaaaatccgcatgaacctacagaatatgacaccggaacaaagacaataccttacccgaaagaacatggatccgattacgtacttcttccgttgccaggctttgaatcaactcagaaggcataaacggaaccgcatggaaatggcacgagcgcagagcgccggtgtcgatcccaatggggccatgatgacagatcccatgatgaatccgcagcagcgacagatctttcagaatatggtcacccttcagttg

SEQ ID NO: 2662 - DNA, 393 bp, A.fumigatus
ttcgaagtctattgggccaaggaggaccactacggagcacactacgatgccggagactatgaccgtgggcggcattcgctcgtcggcgagtccagcgtccgcggcgcataccgagtcaacgcgtggtggtcgagcctgatccattatattttcctggatgagccgcggacgatgtgcgttgttggggaacccaaggccacgaataccactgttctgtcgtatgagaatgcgcatggcctgacggtgcagaaatacgtggatctgggccataagcgatcggtccatgtgtattgcagccgggagaaatggtttcagctgtgtccccttttctgggatgggagggaaagaccactggaaagttcggatcggatggcgtgggatgcaaagctgtaa

SEQ ID NO: 2663 - DNA, 201 bp, A.fumigatus
caccggactgcaattcatgggacgattcggagcacagcgcgtcggagcctggatgaccagctgatatctttttctatcatccccttgttcacattcttggatgctactactgtactgctgacgactgtgtactattttggcggctttcgtagcgtatgtcatatgagctttgcctacctgtctgggtccgagagcttctga

SEQ ID NO: 2664 - DNA, 774 bp, A.fumigatus
  unsure (238): Identity of nucleotide sequences at the above locations are unknown.
taccggggccaaatgccggaaatcccattgtccaaacttgaccttcaggtaccaggttggggttcaattgaagcccgaacccagattttgattaagaccaaggttcagaatgacggttgtttggaccgaagcaacacgccaggccccaggaaacccaccccaaacccccaaagccttagcccaagaagatcgaatatttcttgcatatctatcccaaccgccgaagtgaccattctcntacattcgctcttcccaccctccacacctccagaaaaggcacgcctgtaccatcatctcgtcaactcgcgccgtgtccagcccaccttccacgtcaccttcatccaccgcgccagcaagaccgagcgcgtcgatatctgggaccgctacgcgaaccaatatatcgccaaaatgaaggagcagtcccaggcccaggcccataccgcaagccctgtcctgaccccaactctggcgcctgcgcgggtccgcctcgagcgtctcatctgggacgaccgcatcatggcctttgtcgcgcgtatcatgcctcccggggaccgcgagcagcccgactggccgtgtgcgaaccccatcccgcacgtcaccgtcggcaccgcctcggcggaggtcaagcccaaggagagcaatgacttgctgagacggtggttggaggttggatcgggcggggacactgggatctgggaggcggagattcccggcgtcaaggttgtgcagggctctgttgggatggtgatgagtcgggggaagttgctgaaatga

SEQ ID NO: 2665 - DNA, 462 bp, A.fumigatus
  unsure (24),(132): Identity of nucleotide sequences at the above locations are unknown.
gcccaagacccgggaacggacccncaagacccccccaaaaccgagcccccgcccccgaaaggccccgtcaaaaaccgaggttcccccccggagcctccacggcacccctcatacccccaccctggcgttcgngggtgccaacgccgccatctcaatcgacaaccccaatggcgacgcagacaacatcgccaactacggcgacttcgtacgcccccgtccccaaggcgccagaaagttaatgctcagaaagctgacagaccagaccccactccacaaacatgtctttttctgggaccgcgaccacgacggccagatttacccgctagacacctacaagggcttccgggagctaggcttcaacatgctcttctcgctgctggcaatgctgatcatcaatctgaatttctcgtatcccacgcggttggtgcattccgtgatcccggacttgtggttcagggttga

SEQ ID NO: 2666 - DNA, 732 bp, A.fumigatus
  unsure (23),(131): Identity of nucleotide sequences at the above locations are unknown.
cccaagacccgggaacggacccncaagacccccccaaaaccgagcccccgcccccgaaaggccccgtcaaaaaccgaggttcccccccggagcctccacggcacccctcatacccccaccctggcgttcgngggtgccaacgccgccatctcaatcgacaaccccaatggcgacgcagacaacatcgccaactacggcgacttcgtacgcccccgtccccaaggcgccagaaagttaatgctcagaaagctgacagaccagaccccactccacaaacatgtctttttctgggaccgcgaccacgacggccagatttacccgctagacacctacaagggcttccgggagctaggcttcaacatgctcttctcgctgctggcaatgctgatcatcaatctgaatttctcgtatcccacgcggttggtgcattccgtgatcccggacttgtggttcagggttgatgttggtgggatttataaagccaaggtgggttcgtttgacttgggacgggttgagatgggagctgatgagaggtatgcaatgcagcatggttccgatagcgggacgtatgatcctgaaggacggttcatcccgcagcatttcgaggatgtgtttgccaagtatgatcgggatcacgacggggcgttgactcttggggagctgtttgagatggtgcagggaaatcgatgtgcgatggatccgtttggggtaggtcttttccttctggcttga

SEQ ID NO: 2667 - DNA, 300 bp, A.fumigatus
gctgaattacgcgcaaatggctataaaatgactcagaatgaagaggattcacttattagatggattctatctatggatcaacgtggagcagctccccgaccgtcccatgtacgagaaatagcgaatatcctgcttgcgcagcgtggttcaactcctacccagactgttggagagaaatgggtatataacttcattaatcggcataatgagatcaaaacccgattctctaggcgctataaccaccagtgtgctaaatgtgaagacctaaagattatcctagaatggtttaattatgtctag

SEQ ID NO: 2668 - DNA, 309 bp, A.fumigatus
tctgactcgagcgttgaacgccgttcagatctgctcataatgtacctttcaccaactgcctttcttctctgtccagaggacggatcctcttgtccattgtcgactgtccttatgttcgacaacttttcttcacccgcactggtgtgcgaattcccttccacctaccttcctttcatcggagacctcgaatgccaggccgttttctatgtcctgtttttcaaaattcagaatgatgcaactatgcacggtgtgcttttaaagaggaacggcgtctaccttgcatgctcccaacaatctcatgccttgtag

SEQ ID NO: 2669 - DNA, 327 bp, A.fumigatus
cgcttgtggtcgaaaatctttaggtgggaacatgacccggcatgggccattacgtcgaagctcctgatctccaagcaccagcaagttcaactgctggaggccgcaagcgtcctggttaacatgaaccagcacgcaccttcagaaagcgccgaagccgagtccgaccagtcatctgcgtcacccgacacgtcatcggagcttcgcgacggcatcagctcggcggaaactacccctcctcctatggatgaggacgatgagaacgaagaggacatggagatgtcgggcatgcccgtgttcccaaacaaacgatacagcgtgggcgtcttc

SEQ ID NO: 2670 - DNA, 603 bp, A.fumigatus
ccacggtgttactggtcggaagagtgtcaccaccactggttgctgcaaatgccgctgccgcggtcgccgccatccatgaaggacaccaatggggaaccgataggtgtgccgatgcttcttcaccgtcgaagcagcaccaggaggggcctggaatccacttcggtcggagctccctccggcttcggccactatctttctcggagcatgaacagccccagccaagaacccgcggtcgctcgcaaaccctcgcccaatcattccaacatcggcgcttcttccgtcgccgcagctggcggcgaggagagtagttcggataacaaacccgtcaacaccaagagtcgaaaccgtcgcgccagcgaaggatcgcacttggtcaaaggcgaaggaaagcgcgccttggcggaactacgctgcgatcgctgcgggaaagggtataagcatggcagctgcttgtccaagcatatgtgtgtatactcccccccaaaatgccatcctgccgcttggatcgaatcggagcaatgcgccatgtcggctctgttgcaaggtcgccctcgtggtcatgcagctcccctcgtctccccagaccccttcccccccctctga

SEQ ID NO: 2671 - DNA, 207 bp, A.fumigatus
cacacgacagtggggtcggtccaggactacatcagcaccaaccagctggcagagtacagcgtccgtgatgtgggctggatcaccgctattcttgttttcctgactctattccttggtgtccaggtcgggcctctgtttgatcgatatggaccgcggattctgttggtgtgtggatctctcgcccaacaccacctcttatattctggc

SEQ ID NO: 2672 - DNA, 180 bp, A.fumigatus
  unsure (135): Identity of nucleotide sequences at the above locations are unknown.
cttagaatactgttgtatataccaaacttaaatttgagtacttctatatctagatatatctcaatccacgtatggctttcttctgaaactattagcaaaagaattaacattaatattaatgcccaccttcatgtntttaccgacgagcgccaagcacaaaatcttaaaaacccaaacacc

SEQ ID NO: 2673 - DNA, 495 bp, A.fumigatus
gttctttttctgtcagcaatgaagctcagtgctctccttcaacctcttgtgctgggaatgtctgcctcagctgcggcacgccccagcaagccctcgacctacacagagccctaccgcccccagtaccacttcagcccggagaagaactggatgaacgacccgaatggcctcgtgtacgatgccaaagagggcgtctaccatctatacttccagtacaatcctggcgggacaacgtggggcgcaatgtcctggggtcatgcgacgagcaaggacttgatgcattggacagaacaccctgttgcgcttcgtgcgaagggtttcccggataatatcaccgagatgttcttttctggaacggttgtgattgatgagcggaatacaagtgggtttgggcggaatggcaatacgccctgggttgcgatgtatacgtcctacgtgagtgtgctttactcgctggttctcatccggacaaacttacgttttctgcgagcagcc

SEQ ID NO: 2674 - DNA, 375 bp, A.fumigatus
ggatttggtatcggttacatcatcaaagacgattatatctcgatatgtgcttcgtccaagcaccggcagaccgcccggttgatgcaaacactggagtcgtatttgtacgagattcggaagctgctccgagccaccaacagtaaggcggtcagccctcgcacaagcagggcacgcgagatggagatggttgccgaacggttccaaaatgatcatcgtcggggccggctagtgcgtggcgactctggtttggtgcgacggggcacggatacgccaactacggacagtggcgatatcgaggatgatggcatgggtggatgtaggtctctctcaagaagctatctcttttcaagacatttgctgacaatgaccgtatag

SEQ ID NO: 2675 - DNA, 900 bp, A.fumigatus
gccaccatggtagccttacaaaatgcattggcatatcatgagccagggatcaaaactattctgatccaaactagctttctgcttgccctcaactgggtgaacaccctacttgataagctgatctactgcgggcttattgggcagcttctcattgggattgcatggggagttcccggagccaactggctagaactggacgttcagaaaaccattcagcagttgggatatctcgggttgcttctcttggtgtacgagggtaagttgattgcagaagcaccagccgataccgttatttttgacgagattgtttcaacaggtggcctttcaacatcattctcccaattgaaatcaaacattggtctgtcctccatggtggcgatcaccgggatagctgtgcctatggcattatccttcatcctgatgagcttactatcagcgactcctcttcaagcatttgccgccggtgcgtccctctgctcaaccagtatcggaaccacattcaccatcctgtccacgacgggattggcaaagaccaggttgggtatcgtcctgggcagcgcagcgatgatggacgatgtcgcaggcttggtgatggttcaaatcatctcgagtctgggtagtgcgaatcaagaatcgtccttcgacccggtggtcgtgatcagacccatctttgttgccgttgggtttgctttggggcttcttctcatttggcggtttgtcgttgtggcggtcgtacggaaatatcaggcgcacgcgattcgaattcctggctggatgaggtctctgaatgtcgcattggttatctacatgctctatctcattggactggtcaccagcgcacagtacgcaggcacgtcgggactcttcgctgcatatctggctggggctagcatttcctgg

SEQ ID NO: 2676 - DNA, 954 bp, A.fumigatus
gaagacatcagagatgtattcgctgcgaaagggttccttgttgatgtccacttgcctttggacgccgaaaccaggaaacatgcaggctttggttacctatacttcccttcaattcacgcggcaagggcggcattggatgccttgcaaggtacacacattgatggtcactctatcaatctggaactaagtgaccattcgccaattacgtccctccatcgtgaccacccttcagagttggaccacgctcgtcgaccatcggagctgcacagctcggccagtccatcttcgggaatacagcctgagcggctcgaggttggacaagatctcaaagcgagggaggcacgaccgattcctctgagtgtgacggatctatgttcgagcaacgaaagcacagatcatgaaccaaaaggaaacaatatcctgagcactacacctgacaatttcccccgtctcactcgagacttagagcagagccgctttcctcccctgtctcaaatagatgctcgtgttctaacacatcaccgtcgcgacccagacacatcaatgttgggtgcgtcggcgcccgcgtgtgatgcgagccatgggaatgacgcctctggcagatcgtgtcaactgcaaggtaccccaggctcgtttcctgacgatgatagcgatgggacgcggtcaggtccactccaagaactagctcaaacctcaggcgcaggtcatgatgatcactgtaagcctcgtcgatcgaagagtatgagatacctgaatcgcaacggagataaaagtccctcaagagccttgagacggcgggcaactgagcgacattccctacgccatggtacacggaacagtgttggtggatttcacgacgagggatgcgcatacgacaactactccaatacttccgggtactctcgcccccggagcccggccgcatcgcaagaaaaaatctccgtccccggatga

SEQ ID NO: 2677 - DNA, 729 bp, A.fumigatus
aggcggtcttccagccgtggtgaagaatcagttcgtcatagcgcccctacgtttgatcttccttatagacctcatccgtggcgccgttgtcattcccaccaccatcatccgcatcctcattctcgtccccatccgccgccccctcctccgcacagccatcacgatattccccatcctcatcctcctcaccttccccaccactatcatcaacatcagcctcgtccctttcctccgcctcccccaccgcatcaacatcatcatatgcctcccccccctcccccccctcacccgttccatccctcgcatactccgcgcccatcatggggagcccacggccccttccgtccatcatttccacctcatccgcgtgctcacgatcatggatcatggcgctccgcgtggccatttttctggccgcaccaggagtatcagtctgaagcgccgacagttgctatggaccaactccccgacgctaccgccagtgcaccccgtcctgcagacgcagtgttgttcattggcaatgttaggttcaatgtcagtgagaagacatcagagatgtattcgctgcgaaagggttccttgttgatgtccacttgcctttggacgccgaaaccaggaaacatgcaggctttggttacctatacttcccttcaattcacgcggcaagggcggcattggatgccttgcaaggtacacacattgatggtcactctatcaatctggaactaa

SEQ ID NO: 2678 - DNA, 405 bp, A.fumigatus
caactgtcggcgcttcagactgatactcctggtgcggccagaaaaatggccacgcggagcgccatgatccatgatcgtgagcacgcggatgaggtggaaatgatggacggaaggggccgtgggctccccatgatgggcgcggagtatgcgagggatggaacgggtgaggggggggaggggggggaggcatatgatgatgttgatgcggtgggggaggcggaggaaagggacgaggctgatgttgatgatagtggtggggaaggtgaggaggatgaggatggggaatatcgtgatggctgtgcggaggagggggcggcggatggggacgagaatgaggatgcggatgatggtggtgggaatgacaacggcgccacggatgaggtctataaggaagatcaaacgtag

SEQ ID NO: 2679 - DNA, 741 bp, A.fumigatus
ggttttggggggggacccggccgaaaacaaatgggacccaggggttttgggggatttcaggcccccgcaatgctttcacaaggggaaactaaaacgctcaagagcctggtcggaaccgtgtgcggcgttaccccactggtgacggatttcaaccgcgagtacaagcatcacatctaccaaccgtgcatgccgcatgtcctcaacgccctgacgcgtcagattgacatggcgaaccgcaccgacgatttcacgtcgtggccctggcactccaaatggatgcagtcggtgaccgagggctacgacaagcagaacgagctgacgccgcggctggggttcaaggacattctcgccaaggagcagctggaaagccccagcgccaagcactggccggtccagtccaaggagatcaactactatggatacccggacaccgagctgcgcgagtactttcgcgatgcgatcgacgacgccgagcgagagcgcaagcgcctgttcatcacccatctgaccggcacgacgcaccatccgtgggggatgcccaacaacagctaccagcactttatgggcgacaagaacttcaaggccaaggacgatctcaacaagtatctgaacaccatcgggttcatcgacaactggctggcggagattatggacattctcacggagaaaggcgttgcggacgagaccctgctcgtcatggccggcgatcacggattgtcgcttcccaatgacggcggcgtc

SEQ ID NO: 2680 - DNA, 1431 bp, A.fumigatus
ttgccggacgcaatacctttcagcctcgggcgtgtaagacagccatggcgacagctgatgcaggatgtgtcgccatcttttacctcgtccccgacatccacaatgaccaccatatctactactactgctgctactgctgctgctgcacccaaaccagacaagcctcgcaagctacggtcagcctgtgatgcctgtcaccggtccaagacgcgatgttccgggggcaatccctgtacccgatgccacgagtacatgagcccctgcacctacagctattcctcgcgctgcggcaaacccaagggggcccggagtcgcaagactctggagcgggagcagcgggtggcagcggctgcagaatccgctcggatagcaagaaatccctccgccctagcctcactcccggctacatcgacatgtacatctacagcaacaacagcagcagcagcagcagcagcaacaacaacaacaatagcaacaaccacagctccctcccagggtccagctgtggacagcgcggctgccgctgccgctgccaccacatcaaccgtcgcgtctcctcgcgcggacgactgcctcggtctgttcgacgacgatgaggaatcgaacccgtttttctccagcggtagcgagaataccggggggacttcgttttccccggactggatccctcctctgccgtccatctccgattccgacctttctttcccgttattagagtcctgtttagggccggaccatgactgcaacgactcccttttctggagcaccaccgccgagccggactgccagccgacgagcaaggagccgctggatcctcgatccaagctgctgcgctcctgcaaatgcctccagaccctcagcagcctaaccgctcgagatatccgccgatttgatgccacctttgtctttgtgcggaactatgcgcgcgcattttccgccttctaccactgttcccactgtccgaaagatgccggcagtattagcatggccgtgaccgcgctgcagctggccacgaccgcgctggaaaagaccgccaccgccgggaccgacgcggctggattcaagtcgggctgctcagggatgaccgccgcggacttggacgaggacctcctcacgccaggcgccgagtttttcctgcccgcgaacggcaggggtgcctccaatccggccttccagctgggcagctaccagatcgccccgctcccgggagagcccgatgtggaggaacacagcgagatattaaacgtcttgaatccggtccgcggtgccgccgcctactgggcggctgctggcaattttggaattgccccggggggccggttccccccaagggcccgggggatttttttagaaccctttaatcggtcttcttcctcttcttcctcttcctcctccttctcatcggggtccgaaattcccccacctctgtaa

SEQ ID NO: 2681 - DNA, 645 bp, A.fumigatus
ttccgcacaaagacaaaggtggcatcaaatcggcggatatctcgagcggttaggctgctgagggtctggaggcatttgcaggagcgcagcagcttggatcgaggatccagcggctccttgctcgtcggctggcagtccggctcggcggtggtgctccagaaaagggagtcgttgcagtcatggtccggccctaaacaggactctaataacgggaaagaaaggtcggaatcggagatggacggcagaggagggatccagtccggggaaaacgaagtccccccggtattctcgctaccgctggagaaaaacgggttcgattcctcatcgtcgtcgaacagaccgaggcagtcgtccgcgcgaggagacgcgacggttgatgtggtggcagcggcagcggcagccgcgctgtccacagctggaccctgggagggagctgtggttgttgctattgttgttgttgttgctgctgctgctgctgctgctgttgttgctgtagatgtacatgtcgatgtagccgggagtgaggctagggcggagggatttcttgctatccgagcggattctgcagccgctgccacccgctgctcccgctccagagtcttgcgactccgggcccccttgggtttgccgcagcgcgaggaatag

SEQ ID NO: 2682 - DNA, 189 bp, A.fumigatus
ccgtcgtttccaccccccttctctcgtcccgttcctgccctgatcgactttccctctttcttctcccctccccaagatgcccgtgggctggccttctccgcctgcagctggcaccttgaccactttagtatcatcctcttcccccgacgcctatcatccacactcccaagacagccggagcgccagtag

SEQ ID NO: 2683 - DNA, 1644 bp, A.fumigatus
  unsure (1510),(1553),(1602): Identity of nucleotide sequences at the above locations are unknown.
actatttggatggagggtgggttctccaagttcttcatgtttttgaagcagaacccgcgagacccgtcagccgacaaattccgcatgccttgtgccatgatgctcctctacgcattcgaattgatgcttcgcgacgggctcaccgctgccacttttaaagatattcaagaagagattgaagcagtctttgaagacggtagtgacaagcatcaacacagagctactgcagaaatccttggtgcacttattagctctgtcgcggatacgagcgtggagaagaggacactggtttgggaatatgctttcccgatcgtgcaaagaatcttcaccgatggattgaccccggaaaattcaggctactggaccactttccttcatatggtcctccaatgtcgggatccacgacgagcttggcccttggttgactggcttgccagtttcaggctggatatgacaaccaacgcagccttcaaagagagctccaagatcaacctgctgcatcaatgcattatagacgctggctggcacttccagttggagaagccaatcgtccaagatttcctcgcacatctcgatcacccgtacaagggagtccgtgaggcaatgggtcagacacttgcaacaatttaccgtacacgatatcacgagtcgtacgcggaccttcagcgtctcctcaaggcacaagagtctgcttcacctgtcggctcatatgcataccttcctactgaggagttttctaagatggtgcgcgacgtctttgcccggattgagaaatggcgccatgagagatccccgggtcaacagacgccatcttcctacacttctggcagcaagacagttctcctatggctcgactccaccctttcatcttacgaatgtacgcagcttgttccattcttccctgacgtgttcacagggcagcttttgcatatgatggatgtcaaagaagatccagaacttcagtcattagcctaccatgtattccgtcacttaccgaatattccgtaccctgccgagcaggactccgggttcatcaagtccttgatactcattgggcagacgtcaccctcatggcaccagcgcttgcgagtgatgatcaacatccagatcatctacttccgccgtctgttcctactttctcccatcgatcgggacaagttgttcgattgtgtcgcgaacatgctcgaggatacacagcacgaggtgagggctggtgcatcagctaccctttcgggcatgatacggtgctcgcccgtgtctctccggcagcgcatggttagcaggttacaagagcgcttcacgaggactttggttgagaacccattacccaagaaaccaaagaaccacgctcgttctgcattggcttctccagtctcctctcggtccggcacaccgactcccgaacatactagactcatcattgtcagacacggcgcagtcttgggtcttggggctttgatacaagcgttcccttacgatagtccacccccaaggtggatgcctgaggctntaaccacgctgagtaaccgcgccgcaagcgaccctggcattgntgggtcaagcgtcaagtcaattatcagtgatttcaagaggacgagacangatacctggcatatagatgcaaaggttagtgacgaacgatga

SEQ ID NO: 2684 - DNA, 285 bp, A.fumigatus
gttctctgcacttggctcagatggtctacaaatccgctaacgcactggttaggctcgacggcatactctctgtctgcaggtggctctcttattcatccttctattccgggcattctccttactcctatctgcccccatacgctgtctttccgtccaatggtattgtcagactcgctgttgctccgtatcgccgttccgacgggatcccgctccagtgcctattgttcatttgatggcaagggacgcgttgaacttcgtcaaggggactatgtgactgttgaaacc

SEQ ID NO: 2685 - DNA, 867 bp, A.fumigatus
ctggtcctgcaatcgccatgctttttccatcgacggttcgacgatgccgtcaacattcagaaggtgctggaggaaatatccgacgatgagtggttgtcgcattcgcggctggtacaaactgcaaccggagtgcgggaggtgtcgaagcagcttcaaaggcggccgatcaaacgggcagtgaaaaatgtgatgattgtgacaaaggcgcgtgataaccgtttggtgtacctgacgcgagagctagccgagtggcttctctcgaccccgcgatatgggagcgacctgggggtgaatgtatgggtcgattctaaactacggaattccaagcgattcgacgccgccggactgctgcaatctgagccgcgatttgagcagatgttgcattattggactccggatctctgttgggccgctccggagaagtttgatcttgtccttacgctaggcggggatggtacggttctcttcacgtcgtggcttttccagcggatcgttccgccggtgctctgcttctcactgggaagcctgggctttctgacgaatttcgagtttgagaactacaagtcccatttgaatgatgtcatgggagatgttggtatgcgggtcaaccttagaatgcggttcacctgcacagtcttccgcaaagaccgaagcaaaggggcacaagcaggtgcagtcgaagaaggagagcagttcgaggtcctgaacgagttagtcatcgaccgggggccttcaccttatgtgtcaaatcttgagctgtacgccgacaatgatctcttgaccgttgttcaggcggacggctgcatcttctccacgccaactggtaagttctctgcacttggctcagatggtctacaaatccgctaa

SEQ ID NO: 2686 - DNA, 204 bp, A.fumigatus
aggtgcattctcggcctctcgtgcctctttatcgggattcgtcctctcccacagttcctcaagttcctgttcccagccgagcgctcgtgcgaactttcgcacaccggcatcacaatcgcccaaaagaaggacatcgtcgggacgagaccccatacctcccacccgttccatgttaatcagtactcgcgggactccctcacgaca

SEQ ID NO: 2687 - DNA, 426 bp, A.fumigatus
aatagtaacgcattgcagcgtttacaccccaagatggccgacggcaaactcaggggtgcaatcctggttgtttcagatactgcttctcaggatccatccactgacaaggtcggcgatactctgaccgtttcatttacagccggggggtccaacagctgggaccctcctgtcatcaggatcgtgccagataatgtgctagatatccaacggacaatctgcaactggacagacggtccaaattggtttaatctggttttgatcagcggtggcactggttttgctgtcaaggacaatactcccgaggtctgttatgctgcctttgggggacccaagcgacaaactgataacttgtataggctgtgtcacctctcatccatcgccatgcgcctggccttgtgtaagccgactgccaaagttacttattaa

SEQ ID NO: 2688 - DNA, 726 bp, A.fumigatus
  unsure (673): Identity of nucleotide sequences at the above locations are unknown.
caccgtgtaaggctggaacaatcattttactcagtgcaacagctgaccattccttcagttgcaatgatgtctcggcctgttgcaggtgtcagaaacaagtcgctcttgattaccttaccaggttcaccgaaaggagccaaagagaatctggaggctatcattaagctcctaccgcatgcctgtgctcaagcggctggagcaaactccagagctctccatgcaggtggggtaaagaagctagaggccgacgctggtattgcttctcaaagccaaagctcagggagcaaagtacaatcgcatgatcaacaccaccaccaccatcaccacaaccacgggcattctcatggccacggacacgtagtcccaagggcgcatacatcaccttcacaacggcctcagtctaacgatccgaatgcaggaccgaaccgccggtatcgctcgtctccttaccccatgctgtcagtcgacgacgctctcaaactgatcagccaatacacgcctgagccggccgtcattgaggttcccgtgacaccttctcttgttggctctgttatcgctgaagatgtttacgccggagaggcagtaccagcttaccgcgccagtattgttgatggatatgccgttattgcaccggactcgccaacggcggagtatagtaccaggggaattttcnccagtggcctccatcacccacgcgaatccaggagggacgctgtcgccccttga

SEQ ID NO: 2689 - DNA, 216 bp, A.fumigatus
  unsure (195): Identity of nucleotide sequences at the above locations are unknown.
gcaggcttcaagtcgaaacaacctgcgtcaaagtcagcaggcgacaagaagaaccagggtgacctggctggtggcatgaacaatcttagtgtccatgagaaggtggctgtcaagagcaagaatttggatgtcttgtcggagtatcataagtctcaacggaagagagcaatgaactttgcggttatcggtcagtantcatcatctacaccacagtgg

SEQ ID NO: 2690 - DNA, 861 bp, A.fumigatus
catactgcaaaggaattggaaacactaccacagagtgatcagcaaggcatcgcgcatgcttggtcgattttttctgcggccccggcgaagcaccgaaaactcatcctgcagggcataatggcacagtgttgctttccgcaactgtctttcatctcagcaacagtccgcgatttgattcgtatcgacttcctcacggctctccctccagaaatctctttcaaaattctatgttatttggacacgacctctctctgcaaagccgcgcaagtctctagacgttggagagcattggccgacgatgatgtagtttggcaccgaatgtgtgagcagcatattcatcgcaagtgcaagaaatgtggttggggccttcctcttctcgatcgtaaacgattgcgtgaatctaagcgcgaaatcgaacgccgtgcagctacatgggatgtcagcaagcagccagcggggatcgaaggcagttcggctactatcgaaactgcagcggcaggatccaagcgaaaaccggaatcgggtaaagaagacacggccatggtaaaacgtcagtgcacgtctattgtttctcaatcagagcaaaatgaggactactttaaaacacgatacagaccgtggaaggaagtgtacaaggatcgctttaaagtgggcacaaactggaaatatgggcgctgctccacccgagtattcaagggacacagtaacggcattatgtgtttgcaatttgaggacaatatcctggctactggttcctatgatgctacgatcaaaatctgggacacggaaacaggcgaggagcttcgcaccataaagggacaccagtccggcattcactgtcttcaattcgacgacacgtaa

SEQ ID NO: 2691 - DNA, 354 bp, A.fumigatus
ttgattagtggcagcatggatcatactctcaaggtgtggaactggcggacaggcgaatgcatatctacttactctgaccaccgtggaggtgtagtcggcctgcattttgacgcaactatcgtagcatatgggtctgtagacaagaccgtgaagatctggaatttcgaggataagtttacttgccttctgagtgggcacaccgactgggtcaatgccgtccgagttgactcggcctctcgaacagtattttctgcctccgacgactgcaccgtcaaactttgggatttggatacaaagtcctgcatcagaacatttcattcttcaccccggggctggaaggaaccgcgtacaggg

SEQ ID NO: 2692 - DNA, 198 bp, A.fumigatus
  unsure (10),(38),(54),(60),(61),(80),(125),(188): Identity of nucleotide sequences at the above locations are unknown.
acggcaattnatggaacgggtggaaaaggcttgaaaantggggaaaaaccgaanaatctnntccttgagtcggaatacanaatttactgcttctcttccctgaaattaatggcctcctggttccncctaatgttaacgaatattcacttttctaccggtagcgaaaaattactttacccctttggttntttgatctaa

SEQ ID NO: 2693 - DNA, 225 bp, A.fumigatus
ctttggtgtcaatgtactggttctagaagactgaagcttatgggcagttacctagcctctcatgtgaagatatgtctcgttgtggccagaaataacacttgcagacactggaatatggtttcaagacaacttattggcagctccaagatcatcgacgtgcagaaatctgctcacatcaatgttggtggtggcggcatattcgctgatgccagtaagaggtactag

SEQ ID NO: 2694 - DNA, 867 bp, A.fumigatus
cacccgagccaggtcgctcacctttgtgccgtgcagagggtgaagggggggggagagctgatcccagaggccgcaggtgccgtatcaacagacatgccgggcgtcatcatggataatgctacaactggccggcccgggcatgcgccagacactcagaccccgagtaatggagataacttgcgaaatgggtcattccatatcaacggagcagccaaaggagacaaagatcacgatcctgataaggaaagttatgctggcaaacctagaattgacggacacagagctctgcctgagataccacatattacacaggggttctttccattctcaacgctagtcaaccgatctgtgcagcaatgctggaatgagctatctgaccttattacagagctggcggcaatacatgtgtcgccgcatagctcggtgcctttgttgcctgtcaatggaaaatctcctgggaatcagtctcccgagaacgtccagaaaaagctcagaatactagattttgctcatgctaaacgggccgagttcattaaacttctcgttctttcgcaatggagtcggcgagcgcgcgatgtcagtaaattaattgacctgcaaaactttattcgcgctcgccatcaagcttttgtggatgcgttgcagcgagtgggggaaatgaaacgggacctggtgcaggctcaggtggccaatccggatctccaaactgccctggagatcttgtcaaagggcaggctggaatccttagcggatgtaagccttgtttgtacgcatgaagctcaacatctactgactcaaagttgtctagctcggctacaagtcgtccaaacttctaacaccgagaggagctttgagacggttgcctaa

SEQ ID NO: 2695 - DNA, 600 bp, A.fumigatus
aactggtaccctgctctctggcccgcggtgtctaaagcatctaaagcggcgcctgttaccgaggttgcccgcgagagcatttcggttgctcaaaatgtagcatcgagcatgactacctcctcggaatccctccttcataccccaaaacaacatagaaacccttcacttcagctcaccaagaaaaaaggcgcatcaaccaggtctcttcctgccgacgctacgacaacaaaggtcaacatcacttccgatggttccgcatccacttcagcactggattctcagttcgatactgccggcccagccccgaatttggcccaaaaggaaggatcaagcgaggaggctgcaggagctactgacgataaaaacggagagcaactaaaacagacaaccgacacctccccatcaggcgcatgtactggagtggtggaaccgggtcaggctcaatcatcctcgaagccagctagtggctggttctcatggttctatacagcaaactcagctgaagaatcttccagtggtgctcagtcagaacgagcgcgtgagaccgaaagcactccgacagaaccgtccgctgaagaaccagacgccgaagaattgtga

SEQ ID NO: 2696 - DNA, 189 bp, A.fumigatus
ttttggcttccccttggtctgccagtcaagtccaaggctgacaaatgtgtgtttcttattaggacccgccctggtgagcgcgttgccaagcgtcgccgctgcaagtctcgcatcggttccagccacaagatcacccaggccgagaccatcaagtggttcaagaaccgcttcgacggcattgttcggtaa

SEQ ID NO: 2697 - DNA, 225 bp, A.fumigatus
tgcgcgaatccttccagccccgtggtgaagacaccatgccaagacgctaagggctctcgcttcccacaccagcccacacatacacttttgcacacttttcgaaccttcgattcttccactcaacgagtcgaccaatctaacgccaaaagcagtcgccatggtatgttgccagcttttttctacaaaagcccactacaatcaagaaagaagagtttttttttctaa

SEQ ID NO: 2698 - DNA, 375 bp, A.fumigatus
agttctttgttccgatgccgttgggacgacgaagaagggggcggggatggaaggagcaagaagaacagtgagagacttgggaacagcatggctgatgggacaacttttctccaaactataggcaaggctcgctacactgtccgtaccttcggtatccgtcgtaacgaaaagattgccgtccacgttaccgtccgtggccccaaggccgaggagatcctcgagcgtggcctcaaggtcaaggaatatgagctgagaaagaagaatttctccgagaccggtaacttcggtttcggtatcagcgagcacatcgatctcggtatcaagtacgaccctggtatcggtatctacggtatggacttctactgctgcatgtga

SEQ ID NO: 2699 - DNA, 198 bp, A.fumigatus
tattcagcaacccacgatattgacttaccgttttttcaaatcagccgcgcaattatgctgaacgaaactgtaacagggaaagcagtaaatctccattctgatgaccgacttcgtgatattgatatgccccctatgcatcgcattaacatctataaaacatttttaccacaggggccgaaggagcgcgaaaggggcgaa

SEQ ID NO: 2700 - DNA, 243 bp, A.fumigatus
acgctcgtaatgccccgtagtgttccggtaactcatcagcatcatctcactttacgggaatcctatattgactggatatacgacaacctgatcccggagaccccaaatgcatacacctgttacctcatgcatgctcaatcagatatgggctacgatataggacatacggcaataggcaataatattcagcaacccacgatattgacttaccgttttttcaaatcagccgcgcaattatgctga

SEQ ID NO: 2701 - DNA, 351 bp, A.fumigatus
gttggtgacctacggagggaagaaccagacatcaccttcgctcacatcgtcgatgaacgtttccccattctcattgacggcctgacggtcagcgacatcaatgaaaaggagggaaaaacgtacctggatacgacaggatccattgaggacaagcgaccactccgccgcgacatgccaatgcagttcccgatacgcatggggctcaagtctcatgtcaaccccggccatggctgttgcgtccggcatgacgttcgtgttttcctgtcgagcccatccagccccgtcttggccgagtctacttataagcaacgtccgtcaagccgagagtacaaacctacctattatgactga

SEQ ID NO: 2702 - DNA, 408 bp, A.fumigatus
  unsure (340): Identity of nucleotide sequences at the above locations are unknown.
ccgtctaggggcgttcctcactccattcaagctttcaacacaggggtcgagttccttctagtcttcgacgatggatccttctccgaggataataccttcctcgcctcagaagtctttgcacacaatcccagagaagtcctagccaaagacctgggtgttcccatcgcctcattcgaaaaccttcccgaggacgaactgtacatcttccctggcaccccagcccccaaggacatcgaggcccaaaacgtctcgacggcagcgggaatcgtccccagaacgcagagctactcgtaccacttctccgagcagcccgcccacgaagtcgccggcggatccgtcnagatcgtggatcccgtcaccttccccatcgccagtaatttctctgcggctgtcgtgaccgtcaagccg

SEQ ID NO: 2703 - DNA, 615 bp, A.fumigatus
  unsure (81): Identity of nucleotide sequences at the above locations are unknown.
caaaagccccattggaggatggaacagattttttgcggttggagggagcgactgttcgtgcagttttcacgcccggccaantcggttgaccacatgtgttttttacttgaggaggagaacgccctgttcaatggggataatgtgttggaacacgggatcagcgtggccccagatctgggacggtatatggagagtttggagctgatggcaaagttgggctgtgtgattggataccccgcacatggggctgttattgatgaccttcctagcaagctggaggaatatatccggcataaagagatgcgtgtgcaagggattttgtcagtactagtgaaggaaagggagagggtggagggggagagagggaaggaaggcaggaggaagggcggtatgacgctgcacgaaattgcgagagcaatgtttgggacggtgccagacgaggtaattgaccaggctatggcgccgtttctgatgcaggccttgtggaagctgacggaggatggaaaagtgggattcgagccaggagatcctgtcaagagaaaatggtttgccgttgcccgtcgaaagaccagaccatctatccgtaggcagcacgggtctgttacaagtcgatga

SEQ ID NO: 2704 - DNA, 534 bp, A.fumigatus
cctgcacaggtgcagatcgtccttaaacttggatctgtcagacgctcacggctagcaggagtcgcctattcaatcggcccagaatggctgcccccgagaaccatccagcggtggccgggaaagctcatcagtgagctggccaacaaagtgcccactgcaattgaatatgaatctccttcgcacagcgtcaagtcatgggggtttctctgcaacaccgaggacccggcatcggacatcaaggagtatttcaaactgcacctggcacctggcgctcaccaaggcggaaagatcactcgggcagaggctcagcgatggctccaggactatatccgttgcgtaagtcagcatgtcaccgcacatttcagagatactctcccctcctttgctgcttgcaaggtcgaatgggtattcagcgtgcccacaacatggaaggatgtccgtatggttgaagaaacgcgtcacctactgcagcgagcgatcaacatgagcagtccggggagtcccgtcttcaccacggggccggaaggaccagcg

SEQ ID NO: 2705 - DNA, 1530 bp, A.fumigatus
atgcacgatcaaatcaaaattaaactatctttagttatcgattcgctctccaaaaccttcccagactcgtcgcgagcatctgcggatctgtggaagttcgccaaggtgcacgatcgtcgtaactaccagcttattcgctttgcgatgaacgttaccagtgattatcgcaccgtcgtcaaggccatcagagaactggcgagacgcattcagagttccaacaattcgtcactgctcgaaacgttcactccattgctgtaccgcagcagttctctgatatttaaccgaagtcatacgccggcgatcatggagctctctcggacagacgagcatggtctcgccaaccccgcgcacgagattctacgggagatttcttctaagaacccagaagtgttggaagctcaagttcaggaaatgtgcaaagaccttgagtcgcaggctcccaaggcgacaactaccgctgccggcgggaccgaagagatcctcaaggcctgctccgggtttgcacgaaaacttgccgataaactccccaaagagcgtaaattcttacaggctcttagaagttatgctcttcacagcccatcccctcgagctgccaaacatgccgtttcaatcctcatggcggtcgctgataaaaaggaaatgtacgcgaaggatttgatccaagcatgtgtttcgaagtggaaatacggatccgatcgtttcctgacgaaactggcaacattgtcgcagctgaatcttctggctccatccgaagcggatgaagaaagtgacgccattatttcaatcgctgtcaatcagattcttttaacaaatcgctctcctgagcccgatgccgggtactcctggtcagatactgtggacgaggaaacggctgctaaggaatgggctctcaagatcattgtcaatcggctacgagccaaaaaagggtcagacggcgacgacgatttccgtgctcacgccgtacctgtattcgaaacattgaataaactcgtggcaaacgagggcgagttgtcgaagaagaaggacacacccgcagcgcagaaatcacgccttcgcctcctggcggccaagtcgcttgtcaagctgtgcgcaacgatcagtctatgcgaccaactgcttagaccgctggacttcaatgcgatcgccctagtggctcaggatcccatgttacccgtgagaagcggctttatatcccagctcaagaagagacttgtgcaaaggtcacatctgagctaccgctggtacattgtcccctgcctccttgcgttcgagccgaatgttagcttgaaggacagtacccttacctggctgcggtctcgtgcggcattcttctcacagcaggttcagagcagtggccagaaggagactatcatggagtcgatcttttctcgtcttctctctctcctcgcataccacccagattacccgtctgccgacctggacgaagcgacacaggttcgcgacctgactgattttgcgcgctatatcctcgtcttcaccacggggctggaaggatccgcggaggaacaa

SEQ ID NO: 2706 - DNA, 834 bp, A.fumigatus
cgcggtcttccatcccgtggtgaagacacagcgatacccattccccagaccgtgactaacggaattgaactgagcagggtccttcaaaactcctacacgactgccctgatcctagaagacgacgcagactgggatgtggccctcaaaatgcaactccgcgaatttgcccgtggggtgcgcctgctgaatggcgaggaaaacgcacccaaaactgccccctacggcacggactgggatatcctctggattggaggctgcgcctcgggccccggggccaacgagacgactttcttcgccatcccagacgacccaaccgtccctagtcccgataagcgggatggctggggcggcccactggagacatggaaacaacagtatcccaacttgccgattggaacaacgcgcttcttatatcgggccgaaatgggctgttgtacgtacggatatgccgtcacaagggaaggggccaagaaaatcctagccgcgctttccgtggatcgccttgactgtgctgtcgacaacgccatgagtgacctgtgcgccggcactaacggccgtcggcagctgaaatgctttgctacgtttcctaatctgatcggcacgtatcgacacgctggtccggcatcacgcgactccgatatcaacggtggcgatgatgcctcatggcatgaagcgcaagcatggaatatggtctacagcacgcggctcaacatccatcagctggtggcgggcgaaaggcaggtatattcgcaacacgagaatgaaaaatcaggcgccataacagagttggatctagcggaaattcactatccaaggggagtcttggttggctaa

SEQ ID NO: 2707 - DNA, 219 bp, A.fumigatus
gcaacgccgcccaagcagctgcgtggattccagaaattgatgctccagcctggccagacggggcgggcgacgtttaagctgacccggcgggacctgagctactgggacgtgcagcagcagaagtgggtggtgcccagtggaacgttcaaggtgtatgttgggagctcaagcagggatatccgggaggagggctctttcagggtccgtcgcggatggtga

SEQ ID NO: 2708 - DNA, 579 bp, A.fumigatus
tataaacaattctggctaaacccacggggagcgtctctccagtggctcggtctgctgtatgctatttttgcattggcagtttcgattttgaatacgatagaggaaccagtgccccattcactgggagatcaccaggccgccacgacccggttccgcaaacgtactgtacaatgtttggtccaagcgaactatataactcctggtagatacaaagttgaggccctgtttttatatacaatgggagagttcctcacaagttgtgatgcccaagccggagtctcgttcatgctcgggctcactataaggctcgccatgcggatggggtaccatcgcgatccccgaaatttccctaaaatgtccgcgtttgaaggggagatgagacggcgtctatgggctgttgtgagccaactcgataccctgatttcattccaagtcggacttcctcggacaatccaggcctggcagcacgacgtggagctgccgcgaaattttcgtttgatgaagattacgatgagaatacgaaaaaactcccacagtctcggccagaaactgagctcactccgctgtgctataccatag

SEQ ID NO: 2709 - DNA, 213 bp, A.fumigatus
ctggtctccaagtttgacttggacgagcggcttgtcctgctactggacttgccaggattcgcatgcttcggctactccggtttctcatgggaccgttctggcgactctgaagcagaggcagccctcttttccaagtcctccaagcgacgcttcagtatcttgcctgttgcatccggagattgtcagaacacattttcagcgcccatgagttag

SEQ ID NO: 2710 - DNA, 285 bp, A.fumigatus
gcttcggttaatctttccaaaccatcctggctttatacttgctactgcgcctttgaaattgctgagcataccttccttttcctgcacaagatgcatcgctcttcgaacaattcgtaccatcagtcttcgagctcccgaagctcgtccgcccacagctctagcagtgctttcagtcccaatgccaaccctaacgaggactggacaaagatctcagatcttgctgaacgtcgacggatacagaatcgcatcgctcagaggaactaccgtaagcagcttccttactaa

SEQ ID NO: 2711 - DNA, 273 bp, A.fumigatus
ttccttcttcagcagcatgacgacctcctcaacattcttgctagagaccatttccaaggcgataccgagcgctttgcgccgaacatcaatgtcagggctcgaaagaacccgaagaatttccatggtaagatcatccaaaacgccctcattgcgacttctaagctgatcaactctgtcgagtacaatgagcttgacattgttgtcggcttccttgatgcagagttcgatcaatttgcctgccgcagcttttacggccactgggttactggttag

SEQ ID NO: 2712 - DNA, 390 bp, A.fumigatus
gtcccgttgaaccggagttcatcgaacctatcttatcgtccgcacggtcatgcctcgaacatcgccacgcatatgttagaaaaaaggcagtttggggccgtggcttccattttccaacactccgagtctctaatcccagacgcgccagagttgattcaaacattcctcgaatccgagactgatagtacatgcaagcgcaatgcattcgctgctttgatgtccatcagccaccagaaggctcttgaatacctgggcacaacttttgacagcattcccaacactgatgaactacttcaactggcggagcttgagttcatcaggaaggatgcggttcagaacactcagaacaaggtgggtctgttgtcatacatgcattatacgcgacgctaa

SEQ ID NO: 2713 - DNA, 450 bp, A.fumigatus
aagggaaaatacttgcgtctcatctttgacctactagaggcgtcgacaagtacagtggtatacgaagccgcaacgtcgctcacggctctaaccagtaacccagtggccgtaaaagctgcggcaggcaaattgatcgaactctgcatcaaggaagccgacaacaatgtcaagctcattgtactcgacagagttgatcagcttagaagtcgcaatgagggcgttttggatgatcttaccatggaaattcttcgggttctttcgagccctgacattgatgttcggcgcaaagcgctcggtatcgccttggaaatggtctctagcaagaatgttgaggaggtcgtcatgctgctgaagaaggaactaggcaagacggtagatgagcagtacgagaaggtagggatagttttggtatgcagcaagaatcgaatgctaacaacgtacacagaatag

SEQ ID NO: 2714 - DNA, 345 bp, A.fumigatus
agtacgctaagggaaaccggaattcgcaaccccttaggggcttttccgaacccggataattcattcccattttgtgcgccagccatggttaattcgccaaggacctcccaacacccccaatggaaaacatttcgagccaacattttccgggtttgtaaggtaagtcccgttgaaccggagttcatcgaacctatcttatcgtccgcacggtcatgcctcgaacatcgccacgcatatgttagaaaaaaggcagtttggggccgtggcttccattttccaacactccgagtctctaatcccagacgcgccagagttgattcaaacattcctcgaatccgagactga

SEQ ID NO: 2715 - DNA, 267 bp, A.fumigatus
caacgtacacagaatagtgaatatcgtcagctcttgatccagtcgatacaccattgtgccatcaagttctccgagattgctgctagcgtcgtcgacctcctgatggatttcattgcggactttaacaataactcagctgtcgacgtgatctcatttgtgaaggaagttgtagaaaaattccctaaacttcgtgcttctatcgtcgaccgcctcgtttctactttggtcttcaccgcggggctgaagggtactgcagtgcaaatcgat

SEQ ID NO: 2716 - DNA, 309 bp, A.fumigatus
atcacaaagacggaatcgctaaactctggattcatgcaccccttttccatcctcactctcggtatctttgtagcgggctatatcactgcgcggtgggatcttgttacgcggctatacgaactggccatctttgcgtgggatcacggtgtcgtggtgagtgcatctcagttcgctcaaccggtcctacgtgcatttgtgactgcggaacacaagaccgcagatgcgaagacaattgagctaataacccttgttcgcagacacgaacagccaaaggcttttcgttgctgtcagtcttttttttcctcttag

SEQ ID NO: 2717 - DNA, 954 bp, A.fumigatus
cgtccacggaagcaagaccgccgtggctgcgagatggtcaaacccagcagccagatccaccgtgcttggtggaaggagtgctccgtctaccagatctacccggcttccttcaaagattccaacgatgacggcattggggatattcccggcatcatttccaagctcgactatatcaaaaacctaggagtagatatagtctggctgtgtccgtcctacaaatcccctcaggtggatatgggctatgatatttccgattactatagcatcgcagacgagtacggcactgtcgcggatgtggagaagctaatagaggagtgccacaagcgaggaatgaagcttttgatggacttggtggtcaaccatacaagtgaccagcatgaatggttcaagaaatcccgcagttcaaaggataacccgtatcgcaactggtacatatggaagccgccaaggtacgatgagcagggaaagcgtcatccaccaaataactggatctctcattttcaaggtatgctcgactggccgaagaaactcagccagatactgacagaagcaggaagcgcttggcagtacgacgagctcacggatgaatactacctccacctgtatgccaaggaacagcctgatctcaactgggagcacccacctgtgcgcgaggcagtccacgacattatgctgttttggctggacaaaggagcggacggatttcggatggacgtgattaactttatcagcaaggagcagagcttctctgacgccgatgtcaaagatccccaaagtatctggcaatgggccgacaaatactacgccaacggaccccgcctacacgaattcctacagggtctgggccagattctcacagattaccaccctttcagtgttggtgagatgccattcgtccaagacacggaagatgttctgaaggctgtccgtttcgaccgccacgagattaactga

SEQ ID NO: 2718 - DNA, 417 bp, A.fumigatus
gcggggtccgttggcgtagtatttgtcggcccattgccagatactttggggatctttgacatcggcgtcagagaagctctgctccttgctgataaagttaatcacgtccatccgaaatccgtccgctcctttgtccagccaaaacagcataatgtcgtggactgcctcgcgcacaggtgggtgctcccagttgagatcaggctgttccttggcatacaggtggaggtagtattcatccgtgagctcgtcgtactgccaagcgcttcctgcttctgtcagtatctggctgagtttcttcggccagtcgagcataccttgaaaatgagagatccagttatttggtggatgacgctttccctgctcatcgtaccttggcggcttccatatgtaccagttgcgatacgggttatcctttga

SEQ ID NO: 2719 - DNA, 609 bp, A.fumigatus
tccccgcggttcaggaccatccagttccttctcacaacaatcatgagctccatctcttttttcagcgagagctatcgcctatggatccagtccaatttctggcttatgatggtctcagtcttcggcgccctaggcttcatgctcgtcatgtactggaagcgcaagagctatccggccaacctcctcttcctttccgccttcaccctgctagaagcctactccatcagcgtcgtgacctccttctatgacgcccgcatcgtcatccaagcgctcatcctcgccctgggcatcttcgtcgcgctcaccctgttcgcctgccagaccaaatacgacttcacgaactggatgccctacctctttggggccctgtggttcctgattctcttcgggttcatgtcggcgttcttcccgtacaacagcacggcggagctgatttacggcggtctggcggcgctgatcttctcagcttatatcctcgtcgatactcagctggttatgcgccattaccatgttgaggaggagattgccgctgccatctcgctttacctggacatcctcaacctgttcctggctattctgcggattttgaacaaccagaataatcagtaa

SEQ ID NO: 2720 - DNA, 882 bp, A.fumigatus
ctgaacgccccttccacccgtggtgaagaccctcgcagcctctacgagacacacggcctctgcagcgcccatttccgccatgccctgcaagacgccgccacccgcttcaacgccctcacgccgggaagcgatatccgcatcgcagtgacaccatatgatatccgcgggggacactatcctgacttccggcacctgcgcaagacccaaaccccgttatccgaacacagtatcgatgcgatcctgatcacggggggcgcgccgggcgtctacgagatcgacaagcggccttggatgcagacgctggccaagttcctccagacggtgttccgcgagtatcccgccgtgaggatcatgggcacatgtttcgggcaccagttgattgggcatgcgctggtcgactccggggcgggggacgtgtatgtggagaaatgtccactggggagggaagtggggatccacacagtccagctgaatcgggactttgtcgatgcgtttccccttgctctgggccatctgccgaacggacaattgaagattcagatgttccacggcgatcgggtgatggtcaaagggggcaccgagggcgtcttgccggagaccgccgcggtctcgctgcccgcgccgtgggtgaatatcgggagcacgcctctctgtccgatccagggaatgtactaccccggccgggtgctgtcggtgcaaggacactacgagctggacgcgtgcgggatgcagagtatgtgtcttgagtttgcgccgctgctgggctggacggactcgaagctggggttgttcttggagcaggtgggggacgattacaatgggagacaggatgattcagaagcgtttgcgttggccgtggtttgctttctggctggggaatag

SEQ ID NO: 2721 - DNA, 252 bp, A.fumigatus
agattcatcctcatcgccgtgatcctcgtgccttttacgctcttcggaaccagctacgtgtacagcaagccgttcttcaccggctgggtagtcgtatccctgatctggatctgggccagtgtcatcatctgcgtggtataccccgtcgtcgagagtgccggcgcgctgggagacatttctagaggactatggatggacatgaaggcgttgacgggagtgaaaaagcagagtttgcagaccaacgccgtctaa

SEQ ID NO: 2722 - DNA, 186 bp, A.fumigatus
  unsure (84): Identity of nucleotide sequences at the above locations are unknown.
catcccgtcgtagaagctgtgcgattaagtcgcggaatttggaggcatcctctaaacttcgaggatcagtcgggataccgtccnagtcgctaccccaaaccaacatgttccaccccaaccagaccaccaatgtgcccaaatgtgatccgcaacttttctaagggttacatgctccatttcaatttt

SEQ ID NO: 2723 - DNA, 462 bp, A.fumigatus
cctaactgtgcacagaaccccaacgataaatccgccaccaagcgcagcctggagtactggattgagctggcgaaacttctcgagcggggcggaatcaacgccctgttcctggctgatacctttggaggacatgacacgtaccaggggaagctggacgagtgcattcgccgggcggcgcaatggcccgtgactgatccatcgattgtatgtctttgcccagccctgaagcacagcacactgctgacattgactgcgcagcccatctcggccatggccgcagtgacgaagcatctgacctttgccatcacctcgtcgacctcctccgaggccccgttcctgctggccaagcggttttcgacactagaccatatgacacagggccggtttgggtggaacatcgtgacctcgtacaaaaagggcggggttcaaggctatcgggctggacaagtccatcgagcatga

SEQ ID NO: 2724 - DNA, 357 bp, A.fumigatus
caagaatgccgatgtgggcggcacatggtaagacactggaggagaaattggagcgtagctgaccttgtcaggtttgagaatacatatcccggcgtgagatgcgatatccctgcgcatgtctatcagtccggattcgagcccaacacgcaatggacggaagagtttgctcagggccatgagatccgcgagtattggcagcgtgtcgctcgtaagtacgatgtctacaaatatctccggccccggcagaaggtgcagaaggtcgtgtggcggccggaagaagccaaatgggaagttactctgcaggatctggagagtggaaaggtattctcctgttattcagtgaataaacatgactga

SEQ ID NO: 2725 - DNA, 936 bp, A.fumigatus
  unsure (286): Identity of nucleotide sequences at the above locations are unknown.
gtctacgaggaaaaactcgacgtcgtgatcaacgccatcgggcatttcaatgcatggaagctgcccgactacgagggcatcaatgactaccaaggcgacctgttccactcctccaactggaatcacaacgtcgagctaaaggggaaacgggtcgcactgattggcaatggagcatcagggctgcaggtactcccgtcgatccagcccatcgcagcccacgtcgatcactacgcccgaaatcgcacttggattgccgattcgtttggcactacgggggttcgacgantagagcctaatctattctctccggagcagctagagtcgttcaaagaccccgagaagtatctgaagtatcgcaagagtgtcgagcagggttacttctcccgcttcggggccatcttcaaagactcccccgagaataaggagctgcgtgagaaatggacgaccttgatgctgcaacgtgtgggcaacaagcctgaactagcagacaagatcatccccgactttccacccaattgccgtcggcccacgccgggaccaggctatctggaggcgctcaccaaggacaacgtcagctacatccagacacggatcaagaagttcaccagcaagggaattgtcaccgaagatggaacagaacgtgaggtcgacgtcgtcatttgcgctaccggagccaacgtcgaccacgcgcctcccttcagcatcatcgccaatggcatcgatctgaagagcgcatggaaaccggatgggctgtacggtcatccttacaactatctgggggttgcaacaccgggctttcccaacctcttctggattggaggccctcattccaccggacacagcggcagtgtcccgaacagtatcgagaatctggtcacctatgtcgccaaattcgtccgcaagagtcttcaccgccggggccgaaggaacagcgca

SEQ ID NO: 2726 - DNA, 342 bp, A.fumigatus
ccagccgcctgggccagtggcaaatcatccaccgataagagagtcattatgtcgacgaatggtcccattgctaccgagatgccctttcagaacggaaacttggccgataagaatggaattatcagtcaggtaaagtctgttgaaggcgacgaaccgcatccgccagtaagaccgtcattcgagctcgaggaacatcccatcgacgaggttcgacagatcaaggtcggggttattggagctgggctatcaggtattacagccggagtattgctccctgctaagctgcccggactggatctgaggatctatgacaagaatgccgatgtgggcggcacatggtaa

SEQ ID NO: 2727 - DNA, 285 bp, A.fumigatus
gttgtctcgtccttctatgcccttcgtgtccggtccttggaaaatgaatgcactctatctttacttttagttcacttccgattctatactaactttgtctgcccctctgtagaccgcgatgttgccgaacgatcgattcttatcaagaacatgctggaagatttgggcgaatcggacgaggctattcctattccaaatgtgagtttgatttgcacgctgttcctcttagtgagtgttttctattctaactctatccttcttcacaggtcaacgaggtggtgctga

SEQ ID NO: 2728 - DNA, 198 bp, A.fumigatus
tcttttcattcgaaactcttattaacgcctgctgcagagtcagatcacgacctcgatactaaaaagattgtcaaaatgactactgttactctcacaagctccgatggcgttgacattacggtcggtaagttgtctcgtccttctatgcccttcgtgtccggtccttggaaaatgaatgcactctatctttacttttag

SEQ ID NO: 2729 - DNA, 237 bp, A.fumigatus
  unsure (77),(147),(231): Identity of nucleotide sequences at the above locations are unknown.
gctgccaactatctcgatatcaaagctctcttggatgtcggctgcaagaactgtgcgaacatgatcaagggcaagtnccccgaagagattcgcaagaccttcaacattcaaaacgatttcactcccgaagaggaagatcaaatccgncgggagaacgagtgggccgaggaagtaagctttacgtctctaactgcatcgaatggacccatcgctaacagggctgaccctagncgctaa

SEQ ID NO: 2730 - DNA, 225 bp, A.fumigatus
ctctatccttcttcacaggtcaacgaggtggtgctgaagaaggtcattgaatggtgcactcatcacaagaacgaccctcctagcaccggtgacgacgatgactctcgccgcaagactaccgatatcgatgaatgggatcagaagttcatgcaggtcgaccaggagatgttgtttgaaattatcttggtatgtaccagattgtctacccttcctgcagaaaaatga

SEQ ID NO: 2731 - DNA, 315 bp, A.fumigatus
tatgtagcgactaccccgccattttcggtcgctcttaatcagtcctcttgtgttcgtcccagaggtgcatttgcttgcaacactgtcacaatggttcagatcgccagtatcggcgccaagggcgcgcaggagaaggtgcagatcgcccaggctgaggctccccagttcgagaaagtcgactggaaaagagagcctcacctgcgcaagctgtacatgctgtcggcggcgctgatggttgcttcggccaccacgggttacgatgggtatgtactctgctgtggagaaagatctgcaggactaattgcggtcgtatag

SEQ ID NO: 2732 - DNA, 669 bp, A.fumigatus
tatgcttgtcaatacttcgcagatgatggacaactggacccttttcttctcccccagggtgaaggagagcaactggctgggtctcctggtcaacatgttcaatattggtgccattctcagttacttcattacgtatgttctccagtagccccctggccactgcgccaaggtgattctaagtttctaacggcgacctccagcccctacgttgctgatcacttgggccggaaaatcgccatcatcacgggatgctgcttcatggtcgtcggaggtgtcatcggctgtgcttccaacggatacaacatgtacatcgcttctcggttcatcctgggtttcggcaacggcctggcccagatgtgctcgcccctgctgctggtcgagattgttcatccccagcaccgtggtcctgttaccaccatctataactgtctttggaacgccggtgcgctgctcgtctccgtcattggatggggtacctcgtacgtcgcgagcgagtggtcctggccgtccatcaccttgctgcagatcgttccctcggtcatccagctcatgtttatctactgtaagtcatcctctggtacccgcgtggttcctattgtaatggctaatcggaacggcccccaaaggatccccgaatcttcccggtttcttcatcaacaaaggaccgcc

SEQ ID NO: 2733 - DNA, 531 bp, A.fumigatus
gtggtcaatcgggctaccgaacgagtcaagcgctactccaattggggtatattatctttcatgtaccccacaccaaacgaggtcaacttttgcttcagacaacatatattatcccacgctcctcacacctctgcaaccccaccaaaacacacgcaaggcaatggccgactcgaaagacaaactactgtcgcaggtcgacgacatcacccccgacccgccgccagcctacgatgccagcgctgcacccacccctcgtctcccacgcccaccaccgctctccctccccgtcctcaaccacctgcgcaccaaacgcgtaatcctcgcctcggcctcaccccggcgtcgccagatcctctccctcctgggcctccccttcgaagtcatcccaagcgatgccgtcgaggacttcccaaagacaatggaacccttcgagtacgtcctcgcaacggcaaccaaaaaagcccaggccgtgtactccgccgaaatcaacaacgaggagaagggcgaaccggcgctgatcctggcggctga

SEQ ID NO: 2734 - DNA, 1020 bp, A.fumigatus
tacctgccgatgtatacagtacctgatggcccagaagataagtggtcaatcgggctaccgaacgagtcaagcgctactccaattggggtatattatctttcatgtaccccacaccaaacgaggtcaacttttgcttcagacaacatatattatcccacgctcctcacacctctgcaaccccaccaaaacacacgcaaggcaatggccgactcgaaagacaaactactgtcgcaggtcgacgacatcacccccgacccgccgccagcctacgatgccagcgctgcacccacccctcgtctcccacgcccaccaccgctctccctccccgtcctcaaccacctgcgcaccaaacgcgtaatcctcgcctcggcctcaccccggcgtcgccagatcctctccctcctgggcctccccttcgaagtcatcccaagcgatgccgtcgaggacttcccaaagacaatggaacccttcgagtacgtcctcgcaacggcaaccaaaaaagcccaggccgtgtactccgccgaaatcaacaacgaggagaagggcgaaccggcgctgatcctggcggctgataccgtcgtggtggataatctgtcgggatcgatattggagaagccgcgctcggaggcccagcacatcgctatgctgaagatgctgcgcgataatcgcatgcataaggtttacactgcgatggtggcgatggcgccgctggagagcgcgcggcagccggggtatgcgcttgagacgcacatcgaggagacggatgtggtgtttgatcgggatgtgacggatgatctgattgtggcgtatgtgcggacgagggagggggcggataaggccggggggtatgggttacaggggctggggtcaattcttgtggagagtattcaggggagctgggataatgttgtgggtttgccgttgaaggcggctctgaagttgattgagaaggtgatggccaaggcggatgatgataatggggacgaaatgttggagggtgatgaggaagaggaggagtaa

SEQ ID NO: 2735 - DNA, 405 bp, A.fumigatus
gcccaagaccgagcacccaaccgctttactcctcctcttcctcatcaccctccaacatttcgtccccattatcatcatccgccttggccatcaccttctcaatcaacttcagagccgccttcaacggcaaacccacaacattatcccagctcccctgaatactctccacaagaattgaccccagcccctgtaacccataccccccggccttatccgccccctccctcgtccgcacatacgccacaatcagatcatccgtcacatcccgatcaaacaccacatccgtctcctcgatgtgcgtctcaagcgcataccccggctgccgcgcgctctccagcggcgccatcgccaccatcgcagtgtaaaccttatgcatgcgattatcgcgcagcatcttcagcatag

SEQ ID NO: 2736 - DNA, 750 bp, A.fumigatus
caactgagacgcaatcaccgcaaaatgtccctcaacacagtaaccagcggcctaaaccaagacctacccaccgacagcgtcaccaaaaccgcctcaggaacagtcaacagcaccgccgaccacatcaccgaccagaccatcccaggcgaatatccctccgacgacaccgacaccgaatatgacaagccggcccccgacatctccttctcatccatctggtccgcctccaagacctggctgttctcccttttccccaacgttctcgaccgcttcgaaaactggatcaaggcgctggtcgcctgggtcctccctcccccgcgacaagccaaaatgtacgaagcgattctgaaccggcccatcgcgtcctcgttcatcatctgccagctcgtctgctgtggggtcccgctgctggtcttcctggcgggtgtgttcctctttgcggcggttgcggtgttgctctgggcggtgctgtcgttgcttctggcggcgccgattttgttggtcgccagtatgatgggggtgtcgctttggggatggggctgggttttgtacgggttggtgaagtttattgatcagcatttcctgggggggatgattactcggttttggttggcgaatcggcaggatcaggatggaggggatgggcctgagggtgagggacagaagggggaggaggatgagatgacagggaaggacgacaagagtgagaagaagagaccgaagaaactgcaagtgaagaaggatacttga

SEQ ID NO: 2737 - DNA, 555 bp, A.fumigatus
cgacgatccgcctcaagtatccttcttcacttgcagtttcttcggtctcttcttctcactcttgtcgtccttccctgtcatctcatcctcctcccccttctgtccctcaccctcaggcccatcccctccatcctgatcctgccgattcgccaaccaaaaccgagtaatcatcccccccaggaaatgctgatcaataaacttcaccaacccgtacaaaacccagccccatccccaaagcgacacccccatcatactggcgaccaacaaaatcggcgccgccagaagcaacgacagcaccgcccagagcaacaccgcaaccgccgcaaagaggaacacacccgccaggaagaccagcagcgggaccccacagcagacgagctggcagatgatgaacgaggacgcgatgggccggttcagaatcgcttcgtacattttggcttgtcgcgggggagggaggacccaggcgaccagcgccttgatccagttttcgaagcggtcgagaacgttggggaaaagggagaacagccaggtcttggaggcggaccagatggatga

SEQ ID NO: 2738 - DNA, 858 bp, A.fumigatus
aattcagaaaacgccctgcagcttatcaccattcttaaaaagctctgcaacagcctttcgctgctttcacctaagactggtgacgaaaggcccagcgagacaatcacagcgcttttatcgtccctgcctccgaatctcttacgccacttcaccccttcatgcagcgcaaaaatacgtgtactcgatcagttactccataacctacgcacatctacttcagagaagattgtcctcgtctcgaactacacgtcgacgctgaacttgcttgcaaacctgctcaactcgctctctttgcctttcctgagactagatggctcaactccagcgcagaaaaggcaggccctagtcgaagatttcaatcgtctacccccaaatcgttgtttcgcttttctcctctccgcaaaagcaggaggtaccggactaaatttgataggcgcaagccgacttgtcctcttcgacgtggactggaacccagccaccgacgtacaagccatggcgcggatccaccgcgacggccaaaagaggcattgccggatctaccgcatcttgctgaagggaagcctggaggagaaaatttggcaacgccaggtaacgaagatcggactggcggacagcgtcatggaacacaaaaacagtgtggctcaattctcaagggatgagctgaaggatctctttcgtctcgacgaggcgagtcgctgtcagacgcatgagcttctgggctgcgactgcggtggattagggcagatggctggcccatcgagcaacgacaccagcattccagccacagatgcggaggactcgccgtccagcgatctctcagacacggaccatgaattcccggacattcccacactcatc

SEQ ID NO: 2739 - DNA, 219 bp, A.fumigatus
atcctatcgaccggtggcaacgttgagaacatgtcggatcccgagccttctgctgcggcatgttcctcctctccgccaaccgtacagactcctgaatctgctactttgaattatgccttcctcgtgcactcccagaagacgctcacccagaaccttcccccgcgagtcgataacaagctgctcgctcgtcagaagcgccgtcggacaaggtatatatga

SEQ ID NO: 2740 - DNA, 189 bp, A.fumigatus
  unsure (108): Identity of nucleotide sequences at the above locations are unknown.
acatcgagacaagtgatgcgcgtacagtgcagcacagtccgagatgcgcctccattttcgattgagcaaggcaagactcgcaaaagtgttggcatcaacaaggtatanaatcctatgtggaccattagcgcaatttctttcatcctgtcacggaggacacgtagaaacgacaacatcttgaacgcattg

SEQ ID NO: 2741 - DNA, 1338 bp, A.fumigatus
  unsure (40): Identity of nucleotide sequences at the above locations are unknown.
caggatgaaagaaattgcgctaatggtccacataggattntataccttgttgatgccaacacttttgcgagtcttgccttgctcaatcgaaaatggaggcgcatctcggactgtgctgcactgtacgcgcatcacttgtctcgatgttcatcattctccgcaactggggaacctatctccagtgcagctaacccggagaacttggcatatctcaaacgccgattcttatcagagatcaggcgaaatgcgttcgaggtttttctcagacctcgtcaaactctgatcaaactcatctcaacgtccatgagctcttcaacagcttttccgcagggcgaggcttttcgttttgctttttcgcccaatgctcagatgatcctctgcatcagttcttcaaggattgttgtcctcgacgtaacttctgattccgctgcggtaaagcatgagctcaaaatatggagacgacccctcaatgccaccattctcgatgatggctccctccttgcagttgtctcttctgatcaccaaatcaatatttacagtctaactaatgaagaagcttcattgatccaagaccttaagttgacagaagttcccagagctttggcgctttcccccagcggaggcgtcctggcagtcgcctacagtgacaaaatcgaaatgtacgctatcagagagggagctctcaccactgaacgcagagccgtccgctgcgatggggtcgacgcaatctcgttctcttctgaacgtgtcatgctaattggctcttcttctccgagcgccagtagcagcctggtgactataacagtacccttctacactgcaccagacactgaatcatccccgagagaggtccaagttcggatgtggacgacccagatcctcttcccggatctgatatctggttacagccacgcgtgcttgctgccacttcgtgcagagggcgagggcagctggattctggggtatgaccgccggatcagagctttcagggcgtttggggtgaccaatgcaaactccggaacaacgtattttgtgggacccatttcggccaacacattacaggaggcattgccgacaatgcttccctccgctgacggccaaggcgagcttgttgcgttggggttccaggattccggcctttgggtgtacggagtaccaagtcaacttgatattgctcgttcggctggagaaacgcaagcctcgcctagcccccctcaacgccattcgatgagaaatttgggcactctgccgcataataatgcactccggttggagtggacgatcaacaagcccaaaacaatagtcagcggacacaagatgagcgacttgccgggtatg

SEQ ID NO: 2742 - DNA, 612 bp, A.fumigatus
tgccgcgggtttttgcgtctcggccgttcggacccgggtaacagactgattgtctcccatctctggaccctcgtcagacgtactcataccctcagaaccatgatcctgctccaagttcgctggcgcaatatcctgggccttgacaagagaggcgtagatcccgttcttgcgcgccagctcttcgtgcgtgccctgctccatgatcttgccttgggacatgaccacgatgttatctgcctttcggattgtcgcgagtttgtgggcgaccacgatggtcgttcgattctgcatggcatggtcgagagctttctgcacggtagcctcagcgtgtgggtcgagcgcgctggtcgcctcgtcaaggaggaggattttaggccccgaaatgacgctgcgggcgatggcaatacgctgcctctggccacccgaaaggagaccacctctctccccgatgcgcgtgtggtacccttgcggcaggttctcgatgaagtcgtgcgcaaaggcgagtttcgcagcctcctgaacgagcttcatttggtcatcatgcgacgcggtctcccatggggtaccaccgagtccattggcgatattgtcaaacaccctggcgttgattag

SEQ ID NO: 2743 - DNA, 210 bp, A.fumigatus
gtaatcgataaatcgtatctgcggttgaacacgttagttaattcagtgataaagggaccgtctgggtcaggaaagagcaccattatcggattgctggaacggtggtattccccttgttcaggcagcatctctttggatggcaaggacatcagtcacctcaacctcaagtggctgcggacgaacgtccgtttagttcaacaggcaagatag

SEQ ID NO: 2744 - DNA, 792 bp, A.fumigatus
gctatttatttaacgtgtccagaacaggaaccggtgctaatcaacgccagggtgtttgacaatatcgccaatggactcggtggtaccccatgggagaccgcgtcgcatgatgaccaaatgaagctcgttcaggaggctgcgaaactcgcctttgcgcacgacttcatcgagaacctgccgcaagggtaccacacgcgcatcggggagagaggtggtctcctttcgggtggccagaggcagcgtattgccatcgcccgcagcgtcatttcggggcctaaaatcctcctccttgacgaggcgaccagcgcgctcgacccacacgctgaggctaccgtgcagaaagctctcgaccatgccatgcagaatcgaacgaccatcgtggtcgcccacaaactcgcgacaatccgaaaggcagataacatcgtggtcatgtcccaaggcaagatcatggagcagggcacgcacgaagagctggcgcgcaagaacgggatctacgcctctcttgtcaaggcccaggatattgcgccagcgaacttggagcaggatcatggttctgagggtatgagtacgtctgacgagggtccagagatgggagacaatcagtctgttacccgggtccgaacggccgagacgcaaaaacccgcggcactacgggaccgggaagatcatagcttgtacaagaagataggaattatccataatatttggaatcttttgagagggatgcctgagctctggatttggtttgcggtcacaatggctacgtgcatcggaggaggtgagtatctctag

SEQ ID NO: 2745 - DNA, 291 bp, A.fumigatus
agccgaagaattacaccgggggagtacatgacaaacttactcactacaatgtcatgcgcagctgccgtcaaccctgggcaagccctcttactcggcaatatcttgagcgtctttacttcacctaacatggtcgctcgcggcaacttcatcgcgctaatgttctttgtcatgtcgctcggtattcttgtcatatacttcattatgggctggtcaaccaatacgatcgctcaggtgaggactttcccacctgtatcaccagctaatttataccacgatactgaccaagtgtaa

SEQ ID NO: 2746 - DNA, 690 bp, A.fumigatus
ctctgcttgctgattattttccttgccaggcaaatgacccccttcaccaacaatgctcgatcggatggacttgttctgcgtcactggcaaagacagtccgaatccgcaaaggcaccggcacttgaaggagcttcggagatggaggtcgatcaggcgaaagcgggaggaggggctgcaacaccagaaaaggaatatccatttgcgaaatacaatgtcaaacctcgcgtaccgagacgctacactgacgaggaatacaaccggcatctgaagagcgatgactggtcgcggcaggaaactgactatttgatggaccttgtcgaagagtacgacctccgctgggtggttattgccgatcgctacgatttccagcctcaacccatagacgccgaagcgaatgcgaccgcgctcgtcccggctaaacagtatcgaacaatggagcagatgaaggcgcgctactatttcattgctgcatcaatgctggccctggaacatcccccgtcagaaatgtccgaagccgaattcgatttgcacgagaagatgatgaaattcgacccagaccgtgagcgggctcgcaaagaactcgctgcgctccaactaaaccgcaccgcagacgaagtacgcgaggagggcatacttttggaggagctcaaacgcagtcttcaccacggggacggccgaccgcgattgatg

SEQ ID NO: 2747 - DNA, 564 bp, A.fumigatus
ttctgttttctactcacagcaatcagaggaagctacgggattcacgttctaccatgtcctgagctcagaattgaccactggtgctgtagtgccaatgggtcgaactgttgcgacaacgccttcaaacttcaaatgggcacgctgatgttctccagtacctcagctgccccctcttccacaactacttctactatcgctacagacacaggtactactgccactactgccacccccacaacgactactcccacccccacgacgacgaccgccattataacagaacccacaacctccagagctgcatcaggcggctcggagcgctcggattcgaaaccattgattgttggcgttagcactggtgtcgggctgggtgtgtgtcttgtaacattaataggagccctatgtttgcaaagacgaaggtaccagcgaagactcaatgagaatcaacactttggagtcacgtacatgtcgagcggtggaatacacactcgtcctgctgccgcaccggcagagctaccctcgaaccaagctccgagagtgttcgagatggggacgggaggttaa

SEQ ID NO: 2748 - DNA, 489 bp, A.fumigatus
ctgcataggctacagacttggcttcacccacagggtctgggagttacaatacccgatcaacccgttcagcccccattccgtgccaatcccgctggtcttgtgtcctccaaacggcgccttgggcgagacgtcaaagtgcgagttgatccagacgctccccgcctcgagctgatcggcgatgcgacgcgctcgcgtcatatccttgctccatacggatgcccccagccccgtgtcggtgccattcggccgcgcaatgacatcggcctcgtccgaccacttgagcatcggcaggatcggggcaaacggctcttcttgcacgacccgggccgactcgggaaggttatccaacaatgtccggggggacgaactacccccccgagtcccggatggtgccgccgatggcattcgtcctgccttctgcggaaaggctctgccaaaaatccctggctttgttcgtactgcatgctgttctggcacgggcccaaataa

SEQ ID NO: 2749 - DNA, 579 bp, A.fumigatus
aagttgcacggggaagttcttcggaggggtttcccggggggaagctcggggggtttgggggattccctcaaggtcggggggggcacggaccccaaagtattatttgggcccgtgccagaacagcatgcagtacgaacaaagccagggatttttggcagagcctttccgcagaaggcaggacgaatgccatcggcggcaccatccgggactcgggggggtagttcgtccccccggacattgttggataaccttcccgagtcggcccgggtcgtgcaagaagagccgtttgccccgatcctgccgatgctcaagtggtcggacgaggccgatgtcattgcgcggccgaatggcaccgacacggggctgggggcatccgtatggagcaaggatatgacgcgagcgcgtcgcatcgccgatcagctcgaggcggggagcgtctggatcaactcgcactttgacgtctcgcccaaggcgccgtttggaggacacaagaccagcgggattggcacggaatgggggctgaacgggttgatcgggtattgtaactcccagaccctgtgggtgaagccaagtctgtag

SEQ ID NO: 2750 - DNA, 231 bp, A.fumigatus
acagtcagacaaacaacacacacgattgaagtcaaactccctctccccctcaccgatactatatcgatatctaaaagaacacgtccccggcgtgccccattgaccattctcaatttctgccccggtatcctcacggactcccccacatcattgcagccttttattgtttccctccccttcggcactgcttgcttattaaggcccacttgcactacttttgctagagtctga

SEQ ID NO: 2751 - DNA, 513 bp, A.fumigatus
aacgcccaacagctagctgctttgcaagctcaacagcaggcagcgatggcgggtcgacggtcccgccccacctccccaggcattgccatgcaaggaggcgcacttgcagcaatgggcttcacatcgcctcagaacaatggcttcctggcggcttatgacccgaacaatccgttactgggtaatggattgggtgctctaggtctcagccagtttgggctcggcggtcatgagggatacctctcagaccattccgaagtcactcgtggtcgctctccccggggtcgccgcggcagctccaagccgcccgaggatcccaccgatccgaatcttctgaaggatattcccagctggctgagatctcttcgcttgcacaagtatacggataacctcaaggatctcaaatggactgagctgattgagctcgacgacaaggctctagaggagcgaggtgtcaacgctcttggcgcccggaacaagatgctcaaggtttttctcgctcaacttgtgaattag

SEQ ID NO: 2752 - DNA, 444 bp, A.fumigatus
acctttgaatgctggctcacaaatccagcaattcttctcgccggctgcacctcctccaacggcctgagcattgtgtacctggtttccctgcaatacacaaataccagcacctcagttcctgatgaccccgtgctggtaaacccaggcattgcgggaaaagtctacaacgtgtcgcaccgcaacagcacgatttacgaagtgcgcgccgggtacatgggtctctgtttgaccctcagcaacagggcgcagttgtgctctggtagtgctgcggcgctggctagaatggtccaggccgagggaatacaggggaacgacgctggcgctgccgaccccttgaatctgatttggattgcgcagaattttaaagaaaaaattgtgtttgatgggttgatgtacgtgctgtattcgttcccatggctctgtctaggtgggggtatgatctaa

SEQ ID NO: 2753 - DNA, 276 bp, A.fumigatus
  unsure (261),(272),(273): Identity of nucleotide sequences at the above locations are unknown.
aagaaacggtcccctaaccttgtcaagggcggtgcggtatttgcattctcgctcgtctttcaaacagaaacctacgaaccagtccttctacagcggcgcgttgaccagctccgaaaagaggcgggcgacatgaccctgcgttctaaactcgctccgaacattagtgccagagacaacttcatccgctcaattgtccgaccaacaaaaatgctttttctctctcccattgtggcgatcttcgtcttcaccgggggatcgagnggcatcagttnncac

SEQ ID NO: 2754 - DNA, 888 bp, A.fumigatus
agaacaaacctgtatgactaccagttctctttatcgtggaccttttgtgctgtttcccgcagattgacgccccctcatcttgtcacttatccgaaaagacctcggctgtgtatacaaataaatacagtgcgcaaatcgctgatggactgcagagcgtcacgatcaacaggagctgcggcaatgagctgcgaaaagtcaatctgtcctctggacctggaaaagaatctggttgtgcaagtcgagaatccaacatcaggttgctttgtaacagactatgtaacctcgcatgtagtcgattgggacgggcccgatgattttgccaggccagtcaactggcacaagaagcggaaatggctcaatgtgaccagcgttgcattccttaccttccttaccccgttggcttcctcaatggtagcacccgccgggggattggtaatcgagaccttcaacatcaccagtgagtcgctggccagttttgttgtatcgatctacctcgtggggttcgctgttgggcctctggtacttggacccttgtccgagatctatggtcgtcttcggatctatcaagcttgtaatgccgtcttcatcgtttggaatgtagcttgtgcggttgcaccaaacgttggttccttactggcctttcgtcttttcgctggaatagcgggaagttgtccgctgacactgggtgctggctcaattgcagacctatttgtaccggaagaacgaggtgcagccatgtcaatctattcaatgggtccgttgatggggccggtggttggtcctattgctgggggatatctggccgaagccgccgggtggaggtggattttctgggttatttccatggcagtcagtatcctttctgatatagaagaaacggtcccctaa

SEQ ID NO: 2755 - DNA, 267 bp, A.fumigatus
aacaggaggaacgctgactgggtagaaaacggcttccacgctggcgcttttcagcggtctagcttgaaatacatgctgaactatgctcgggtctatgtcctctgtgccaccatcgctcgcatccaaaaacgaccgtcgtcggaagttctggcagatccagagtcagacgctgtgctggggctttggaagtcactggtcgaaatcattatgggccagatggcatggttggtcaatgagagtgcttatcggtgccagctcacctgggct

SEQ ID NO: 2756 - DNA, 312 bp, A.fumigatus
gtgtcgaaccgagccttcttccctctatatctccacctttatgtcgtccaattcctccttctacccttactcactcgcagtccgagcaacttcctcgctacttttctgggtaatacgctctatctctccgcgctgatctactacacctacattacctttctcgggtacaatgccctcccgtttttacacaacaccgagctcctccttcttccgatcctcgtcttgtccatcctctggctcgtgagtcttattgccggctggggggtcgtcatgcacggacacagtgtggagtggctgttttggggtgtgtga

SEQ ID NO: 2757 - DNA, 183 bp, A.fumigatus
tcaccccaaaacggactcgccataagcaagtacatgatctatttacaacggaagacgcacaccgagcagaatatcatttcaatgtgccactttatgcatattatgcatccaaaccacggaaagatggacgaaaaccagaaagaaccaaatgacacccatgtacaccaacgccctgttttctga

SEQ ID NO: 2758 - DNA, 225 bp, A.fumigatus
aacgtggaacttgccaggaactacccgaattttagtggtggacctgctatgggcttcgagttattcactcaaccacttcagcgaagagcggaaccggctgccggctacaggggaggcaagagaaagctggggagtacccactgtatcaatgtcaaattcccccaagcatttgacttctccagcattggattcatggttcaagttaggcaaaactgcccaccgtaa

SEQ ID NO: 2759 - DNA, 519 bp, A.fumigatus
gctcttcagtcgctgcatctattgtgctacgatgtccgtctaacgctagtctatgtacagcacgagagcggaaaagagcttaagctcctgcacttcatctacgaacagcccgacatcgatgagatcagaggcaacccgcaacgggttctggatctcatccacaagttcgaagagaaatatcgtttcatgaatgtgggagctgccaaaggcaagatcgtcaccgatctcattgctgaactcaagccacatacaatgatcgaactgggcggctacgtaggctactcggccatactgttcggcgatgccgtccggcgagctggcggcaagcgctatttcagtctggaactgaacccggaatatgccgccatcgccaacatgctgatcgagctggctggcctgcgggactttgtccgcattatcgtcggtcgaagtgacaagtcgctgcacaagctgttcaccagcggcgaggtcaagcagatcgagctcatgttcctcgatcactacaagcccgcgtacacc

SEQ ID NO: 2760 - DNA, 699 bp, A.fumigatus
ccacgatccagagccttgtccttccagcctggcctggtgaagacgatcgctcacggtatctttgggttttctcatcatgaagaatggggagctggattaattacgcacatcggctcgatcgtgcgactggcaatgaggctgggattgcaccgggatccgtcccatttctccaacctgtcgccctttgagggagagatgcgccggaggatctggagcacaatcgaccagattgactgcctgtcgtcctttcatcttggcattccaacggctgtccggtcggaggactctgatacaaacgcgccgcgcaacctcctcgataccgacatagaagaaggcatgtccgaattgccacctccaaggcccttttcggcaagtgtgccaattggttatctactaaccaagctcaaactttctcgagcgatgagacgtgtcgtcgaattcctgaattccgtccagcggcagccgtatgaaagggtcctacaactcgaccgtgacctcatagaggcatatcggtcgattcctcctcatttgcaactgaataactggcataatgcgccaaacgaacctgcatatgttatggtgcagaaagtccagttagatacgctttaccatcaagcagttaccgctctgcatcgcaaaatatctccaagaggcccggacgaaccccacatttgctctctctcagcaaagaagcattga

SEQ ID NO: 2761 - DNA, 714 bp, A.fumigatus
  unsure (14): Identity of nucleotide sequences at the above locations are unknown.
ctcgggggcactancgcggtatccgggcgtcctggaggagaagacaggtgtcgaccaaaggcacagatggatgtgaagaatcttgcagcactgcccagcaagatggaccaagcatttgcaaaatacccagacatcgatgcagtgatcatcaacgccggcatccagcgtctcctggacttcaacaccaccgatgtctctgcagctcagtacccaaccacagacgccatcaccgacgaggtcacaaccaacctgaccgggccgaccgtcctggcacgctgcatcatcgaacacttcaaagcgtcgcggccgaaccaaccttgccttctggcccttgtgacttcaggtctggcgctggtcccagcaaccatgttccccgtgtactgcgccacaaaatcagcgctgcattccttcacggcgctcttgagaaaccagctcaagcatacgtctatcagtgtggtcgagattgtgcccccgtacgtggagacagaattagataaagatcatgtcgatgaagtggccagacgcatgggtgggacaaggccgcaggcgatgccggtcaagcaatacgttgatcaagtgatgcgagggttggaggtcacagatgcgaacgggaagatccagaagtatgtcgctgatggattaccccgtgctgcggtcgatgcttgggtcacggctctcagtcccatggcaaagttgttgcatactgagctatga

SEQ ID NO: 2762 - DNA, 483 bp, A.fumigatus
cgcggtatccgggcgtcctggaggagaagacaggtgtcgaccaaaggcacagatggatgtgaagaatcttgcagcactgcccagcaagatggaccaagcatttgcaaaatacccagacatcgatgcagtgatcatcaacgccggcatccagcgtctcctggacttcaacaccaccgatgtctctgcagctcagtacccaaccacagacgccatcaccgacgaggtcacaaccaacctgaccgggccgaccgtcctggcacgctgcatcatcgaacacttcaaagcgtcgcggccgaaccaaccttgccttctggcccttgtgacttcaggtctggcgctggtcccagcaaccatgttccccgtgtactgcgccacaaaatcagcgctgcattccttcacggcgctcttgagaaaccagctcaagcatacgtctatcagtgtggtcgagattgtgcccccgtacgtggagacagaattagataa

SEQ ID NO: 2763 - DNA, 192 bp, A.fumigatus
tttaatatatttatttctactactatcttcctgttagggttaaactatataagaattagggctatagtaaacatcttctttagtgacttaaagaccttggtctattcatctctctatataaagggagctcccttatatatcagtactgttaatggttatactatatctaagaagttttatataaactattaa

SEQ ID NO: 2764 - DNA, 702 bp, A.fumigatus
  unsure (30): Identity of nucleotide sequences at the above locations are unknown.
cgtggatcctttgacccgtcgtggtggaanacatacacccatcctgccatcatgtcgcgttcacgtcttcccccaactccttcaatgtctggagaattcatcatcagggaacagccctccgtcgacggtgcggacgcctttgcattgcctccagctgccctaagcccagccagaagcgcgagcgcgagcaggagaccttccaaatcagactcctcatcttactttcctgcttctcctacctcacccgaactcacaggcgtgggccgcaatgcaaatcctccccgtcaggctggtaccaagaggttacttgaagattttgatcttcctcctccgccgacccggacccgcaagatcattcagatgaagcccaagacacaaactcaggccaagcctgccacaacaaacaccaagccttcaaccaaggataacgggaagaaccagcctgccagcaatgcaaacaccgcagcatctgccaactcgaagaaaaagcagcctagtgcgacaagcgccgcaggtcggaaaattgccaggaaaacggcgcacagtcttatcgagcgtcggcggagatctaagatgaacgaggagtttgcgactctcaaggacatgattcccgcttgccggggtcaggacatgcacaaactttccattttgcaggtacgatcattcttactttccaaactaatggctgcaagcgatctctga

SEQ ID NO: 2765 - DNA, 1218 bp, A.fumigatus
ctacggttaccctgttttcatggcaactcgcagatgtgtctcgctttcctcttttgtttgtttcactcgcgcatctccatcttctcaggaccttcggacataaccttgaaggatgagcccaccacgaaaggtaaccatcccaaagtacactcccttggcggagtttatgatgtatctgatgcgaaagtcgtgcaggctatcattataggggcaggtcccgcggggattctggctgcgctacgcctacatgagcacaaccacatctcccctacgatctatgaaatccgctcggagcccagtacccttggaggtgcaatcggcattccttcaaatgggctgagattgttgcatcggctgggtctctgggatgccgtgcaaggccgaggggccgaaacttctactctgtccttgcatggaatcaaggggcaagtcatcggccagatggacatgacttcatggagtcgacagaagaccggattcggctatttacggatccgcaggacggacctgatggacgtcctgtatgaggcggctcgtcgagcagacatccccatccacttcggcaagcgcctgacgcacattgtggaggatgaccaaaccgttaccgttgccttttccgatggctccagtgaccacgcagaccttctcctagggagtgatgggattcattcgacagtgcgcagcatctatgtcgaccccagcatggcgcctgaatactcgggcatatcaaatgcatattccctggttcccacttctgatctagccatcgcggccgggtcaattagtggtctgaacgcgactctcaccacggatgggcttctggccgtcttgccttgcaccccaggcggtgagttgatctactggttcttttcacgcgagctggccatgccagctagtggtgacacacgcgatggttgggaggaacgtgggaaagagcaagtggaaagcatcaaatccaccgtgctcgatctgattaaagaaacagaaggatcatggggcagcaccatgaaggaaatgattaagcatactgagacgctccagttctttccagtctaccgcctccccacggatggcaaatggtggagagggcggtgtctacttattggggatgcagcgcacgcaatgcaaccacatgccagccagggtgtttaccatggcgctggaagatatattcgtgttctcgtcttctaccacgagggggcgaggcatccgcgctaa

SEQ ID NO: 2766 - DNA, 636 bp, A.fumigatus
  unsure (586): Identity of nucleotide sequences at the above locations are unknown.
aggtacacttcgatatcttgctatcaatcgccagtctggctacagccactgcctcagcaggctgtggaaagccattgcccaatgatcagggtgccgaaggaatctatccaacggacttcaccacatcagatgacactcttcggccctatatcatccacattccgtcgaactatgacgagaatagagcagtcccgcttactttctcttttcatgggaggtcaaaaaccgcggaaagtcaggagcagctttcgcaattcagcaatgaagcgtggaatccggatgctattgcggtttatccccaggggcttgatgtacgtgtctcgaactcgtcctaagaggtcattatcaatgtacacacagaaccaatggcaaggagacccagattcttctggagtcgacgacgtggcattcaccatggaaatgctcgacaacttcgagaaaagatactgcattgattcttcccgtgtctatgccgccggtaaatcaaatggtgggggcttcacaaatctcctaacctgcgatcccacggcctttaaaagtattgactattgcggcatttgcccccgtttcgggtgcttactaccangacgtacccgaggacgcctgcaatcccgacagggtgccgatcaattgtaa

SEQ ID NO: 2767 - DNA, 498 bp, A.fumigatus
agctccagttcaatctctgttgcacttgttcaactaagatcaagcacatcaggaaatggagtatctgatatagatatcatcatggccagcctcagcagaacattacgacccttcgctcctcgccgagttcgctggggctcgcctttgtctcccgtaatacccagacgattccttggcatcccacctcaatttcttctagacgaatatatcccacgatatcaacttctatcgtccgtggacgcagcaaagaaacggtccctcgcttacgctcacctacagaactgcaatctgtgtccccgtcattgcggcgtgaatcggtacgaagagacaggggtgtgcttgatcggcgcggaaacggccaaggtcaatgtcattgcgccgcaccgaggtgaagagccatgtatacagggatatcatggaagcgggtctgtatttttctctgggtgcaatctgcgctgtgtcttttgtcagaaccatgtacgttctcgagagggctga

SEQ ID NO: 2768 - DNA, 261 bp, A.fumigatus
gatattgctcaccagcgaaacggcttcgatttgacccctgaagaactggcggagtggtacgtcaaacttcaacaggtgggaaatgtgcataatatcaaccttgtcacgccagagcacgtggtacctcaggtggctctctcgatcctggccgcccgtgacatgggcctgaagatacccatcatttacaatacgtcttcatttgactcgcttgcgtcgctccaattgttggatagagtgcctcacgccggggatagtaggtaa

SEQ ID NO: 2769 - DNA, 615 bp, A.fumigatus
agactgaaacatagcattcagcttgtctcatttattaagaatagccctcttgagaagctaaggtcaatcaatgcgaatagtccagtggttgtacggggcattgtacagccgaagaagacaaagggatcggataccgagcaaagcgactgctgggaggtgcacattgcggacattgatcctctgaatgaatttcctaaagacattatcatgactccagggactgcatttgctccagaacacagatatcttcaactgcgctccgacagtgaactccgcgatgccctgcgattccgcgctcaagtccgcaatatatgcagggaagagctggaacaatgtcggcctccttttgtggagatcgaaacgcctcttcttttcaagtcaacaccagagggtgctcgcgagtttctagtgccgactaggaggcgtggtctggcttacgctttgcctcagagccctcagcaatataagcagatcctcatggcaagtgggataccaaggtactatcagtttgcgcgctgtttccgcgacgaagatctccgagcggatagacaaccagaattcactcaggtgagcattgaaactcgttgtccacttctaaactgtgatctaacataa

SEQ ID NO: 2770 - DNA, 300 bp, A.fumigatus
  unsure (276): Identity of nucleotide sequences at the above locations are unknown.
cataagctcttcgctcagctcgatctggagatgtcttttgctacaggagaggatgtcatgcggacagttgaagggataatccggaggctttggtcctctttgatgaaagacgaggccccctctggaccgttccggagaatggcataccaggacgcaatgagccgatatgggtcagacaaacccgatacaagatatggaatggagattttcaagatcgactatcttctacctgtcgacctggtcaacaagatcggtccgttgaccgtcttctccacnaagggcgaagaatccgagcatggt

SEQ ID NO: 2771 - DNA, 687 bp, A.fumigatus
caacccttcaactgcttcattgctatctggatcgtatctcccaaacggatagttacctcaagtgagcatctgttctactgcctagcgcagaccacagttcatattgctgaaccgaagcacagcgccatcctccagcacaatcccgacgcgttcgctattgcgaacgccctggatcttgaacgcgctcggggcagagtacgtggcccgctacatggtatcccttttactgtcaaagataatatcgcgaccaaggaccgcatggagaccaccgctggcagctgggctctcttggggtcggtggcgccacgcgacgcatttgttgtccgacggttgcgggaagcaggggcgctgttgctggggaaggccgctctgagcgaatgggctgacatgcgatctaacaactactccgaaggctattctgctcggggaggtcagtgtcggagtgcattcaacctcacagtcaatcctgggggcagcagttctggctcaagcgtggctgtgggggccaaccttgtgccttttgctctcggtacagagacggatggcagtggtacgtttctcgtatggagctccctatttcaaacatctctgacggtcacggatagtgatcaatccagcgcagagaaatgctgttgttggtataaagcctacagtgggcctcacatcacgcgacggcgtaatccctga

SEQ ID NO: 2772 - DNA, 654 bp, A.fumigatus
cggtcacggatagtgatcaatccagcgcagagaaatgctgttgttggtataaagcctacagtgggcctcacatcacgcgacggcgtaatccctgaatcgctgcatcaagatacggtgggagtgtttgcgaaaacggtgcgcgatgctacatatatcctggacgccatacatggtgttgatccgcgcgataactacaccttggcccagaatggccggacacccgttggcgggtatgctcagtacctgagcgatcggtcatctctcaagggtgctgtgttcggccttccctgggaatccgtgtggcgcttaggagatccagaccaaatatctcagttgatgaagctcttggatttgattagggctgccggtgccaccatcattaatggcaccgagttcccgcattaccgtcaaattgtgtcaccggatggatgggactgggactatgggagtagacgtggatatcccaacgaatctgagtacacctacgtcaaagtcgacttttacaacaacatcaaagcgtatctctcggaactgaacaacaccaatatgcgatctctggaagacttggtcgagtataataaagccaatttcggcatggaaggcggcttccccggtcttcaccacgggggcggaaggaaccgcgcaatgcgtacc

SEQ ID NO: 2773 - DNA, 231 bp, A.fumigatus
tttggcaccaaaaagggaaaactcagttgtgatactattcaggaggttaataggttgcttttcaaggatttcagtcctaacaagacggctggcgtggtttctggtcagcgtattgataaggttaatttcccaagggtggtcttaaattcttgtaatagtattcaccatgcactcgacttatcgacaggtagattttatcgcctcatcgcctggaactttacagtaatttga

SEQ ID NO: 2774 - DNA, 693 bp, A.fumigatus
tcccagaagaatgcaggagaccaacttccaagtgtcgtggatgttcgcaacatgtcggttgccaaatctattgctgccgtgctggtagcactgttgcctggtgcgcttgctcaggcgaatacaagctatgttgattacaatgtggaggcgaatccggatctcacccctcagtcggtcgctacgattgacctgtcctttcccgactgcgagaatggaccgctcagcaagactctcgtttgcgacacgtcggctcggccgcatgaccgagctgctgccctggtttccatgttcaccttcgaggagctggtgagcaacacaggcaacactagccctggtgttccaagacttggtctccctccgtaccaagtatggagcgaggctctccatggacttgaccgcgccaacttcacagacgagggagagtacagctgggccacctcgttccccatgcctatcctgacaatgtcggccttgaaccgaaccctgatcaaccagatcgcgaccatcatcgcaactcaaggacgagctttcaataacgttgggcggtatgggctggacgtgtacgccccgaatataaatgcattcagatcggctatgtggggaagaggtcaagagacccccgcgagaagacgcttactgcctggccatcggcgtatgcgtacgagtatatcactggcatccagggtggtgtgc

SEQ ID NO: 2775 - DNA, 213 bp, A.fumigatus
caagccttttcccaggaggagacattggttcggtctcgcctgaagctctgggcctcattctactgctttgtccagatctatggactaatagtgtggttgctaggccagcataatgactcgttgatgtcgtgtgattacgctttgactctcatactgggctttcaacaggatattctcgcaaacgtcatctgtctcatgaatacattttcctaa

SEQ ID NO: 2776 - DNA, 189 bp, A.fumigatus
ctccggggtctacaaaacaacggagaattgaggctcggcaagtcgtggctctttagtcggtcatttgacaactggaatatgggcgaattcgctcgtttctttcccgaattgggcaaaatattgatcatggatacgatgatgatggaaccttggaatctccacgagactagctgcttcggaagtccgtag

SEQ ID NO: 2777 - DNA, 432 bp, A.fumigatus
tggggggtatcccaacctcaagagtttcttttgggggggcgggcagtcccaactgtaaccttttataagttcaagggattggtagcccagtcgcgtgaaggaacccctcacgtggagttcaacttacggtggattgaatctctcatgagaatccatggtcgttacttcaaggataattcaggcacgctcgcaacagaactgcgtgccatacagcgtgctgttgatgacattcgggagaacttgaggaagttgacggaaaagaatttgtacgatctcaattatctcctctcgaaaccggtacttgcagacaaaattaatggcgttccgaaagccattcaagattacgatgcgatactcgtggacggcgaggatgcgcgcatgtctgatgtagatggagatgatagggagggggaatgggttggccttgaatga

SEQ ID NO: 2778 - DNA, 453 bp, A.fumigatus
cgagctgaaaattgtttgcttagaacctacgagcgcggtgtgtcctttgatacatttgataatcccgacgcggcagacttctcgttgactttgaactataaacataaaggctaccagtgtactcgtcgaagtaggacttttctctgtggcactgatcagaatgattactcggattttgccctggagtggctgatcgatgagttggtcgacgatggcgatgagattgtctgtctgcgagccgttgaaaaggactcgggcctcgcgagcgatgcggaaatcgaggctggaaagtacagggaggaagccgagaggctgttcgagcaggtcatacagaagaacagccaggacgaaaaggccatcagcttggttttggaattggcggttggtagggttcaggacattatccagcgaatggtacatctccggacgagaatttggattgaagtatgctaa

SEQ ID NO: 2779 - DNA, 984 bp, A.fumigatus
tcgatgagttggtcgacgatggcgatgagattgtctgtctgcgagccgttgaaaaggactcgggcctcgcgagcgatgcggaaatcgaggctggaaagtacagggaggaagccgagaggctgttcgagcaggtcatacagaagaacagccaggacgaaaaggccatcagcttggttttggaattggcggttggtagggttcaggacattatccagcgaatggtacatctccggacgagaatttggattgaagtatgctaacacttcaaagatcaggatctacgaacctgcgctgttgatcgtgggaacgcgcggccggaaactcggaggcgtgcaaggcttgctgccaggctctgtctccaagtattgcttgcagcagtcgccgattcccgtcattgtcgtccgccccaccaccaagcgagaaaagaaaaagaaaaagcggcaagcagatcctacaaggcgcagttacaatcagatccttgaacagagttcgcgtcggggtagccgcatctttgatgccagttcgagcaccgaaagcaacatctccagactacccgacgaagaggccgcggttgcagcagctttgggtctccctgcctcttataccaattctcggagctcactttccatgtcggagagaagcagcgtcagtcaggaggagccagtgccgccaaattggggctctttgagcgtcactgccaaaagtcgtcttgcggagagtgcagaaaccacggaagatgaaggcgcctcggatgatgataattctgcttcccagtccggtcaacacatcgaagatgtgtcacccaagcacaaggctgcagatgacagtcaagctgtttccaaagaaggtgacgtggcgccagacagtggtactccgaccacaactgggactccaccacctctcgaatccagaaaggtcaatattccacttattgtcactgaagatatttcgacccatcagaaagataaaggcaacggtggatga

SEQ ID NO: 2780 - DNA, 1341 bp, A.fumigatus
atacctgatctccaggatataaaagcgctatgtgacccggttggagggagtatcgcctgcctacaagtgcaagtgcaaacaattagcatcatgcatctcacatctctggtcctcactgtcggcctagccgcagccgcaccctcgttcaacccccgcggcaagggtcacgactctcgtccagcagtcactaacatccaggtcggacctcgtccgtactatctgcttgacgcaatggccgacagcccgctgaaaaagaaactccagtcgtgctcggagaagcgcatcaagcacgctcccgccttctctatctcccaccgtggtggtccgctcgagtttcccgaacacactcgcgagggcattctcgccggtgcgcgcatgggcgcaggcatcatggaatgcgacgtcgcattcacctcagaccgtcagctcgtctgccgccactcgcagtgcgacctgcacacgacaaccaacatcctcaccatcccgagcctggcagcgaaatgcaccgttcccttccagcccgcggcaaacggcaagcccgcgacggccaagtgctgcacctccgacatcaccctcgccgagtttaagaccctctgcgccaagatggacgggtacaacgcctcggctaccacgcccgaggactaccagcgcggcacggcggcgtggcgcacggatctatacgcgacatgcggcacgctgatagaccacaacgagtacatcgagcttgtggaccgtctgggcctgcagttcacgccggagctgaagacgccggaggtggccatgccgttcggtggcaactacacgcaagcgatgtacgcgcagcagctcatcgatgactacaaggcgcacggcatcgacccgtcgcgcgtgtggccgcagtctttcctgccggacgatatcttctactggcttcagcatgagcccaagttcggcaagcaggcggtctacctcgatgagcgcgtcgataccgacgccggataccagaaggccgtggacggaatggccgacctcgcaaagaagggcgtgaagataatagcgccgcccatttttgcgctgctgaataccaccgcggacggggagattgtgccgtcggcgtatgcggttgcggcgaagaaagccggcctggatatcatcacctggtcgctggagcggtcggggcccctgaaggctgcggccgccaagggagagtactatatccagtccgtcaagtcgacgatcactggggacggagatatgtatcgcattgtggatgcgttggcacgaaaggtgggcgtcaaggggatattctcggattggccggccacggtgacgtattatgctgcttgtatgggattggactag

SEQ ID NO: 2781 - DNA, 450 bp, A.fumigatus
aaaagaaactccagtcgtgctcggagaagcgcatcaagcacgctcccgccttctctatctcccaccgtggtggtccgctcgagtttcccgaacacactcgcgagggcattctcgccggtgcgcgcatgggcgcaggcatcatggaatgcgacgtcgcattcacctcagaccgtcagctcgtctgccgccactcgcagtgcgacctgcacacgacaaccaacatcctcaccatcccgagcctggcagcgaaatgcaccgttcccttccagcccgcggcaaacggcaagcccgcgacggccaagtgctgcacctccgacatcaccctcgccgagtttaagaccctctgcgccaagatggacgggtacaacgcctcggctaccacgcccgaggactaccagcgcggcacggcggcgtggcgcacggatctatacgcgacatgcggcacgctga

SEQ ID NO: 2782 - DNA, 1167 bp, A.fumigatus
  unsure (235),(410): Identity of nucleotide sequences at the above locations are unknown.
ttttttttccccccaaagaaatttgttaataaggttgatagtcccggaaacaaaggttgttcaaattcggggccatttaattccccaatccgggcgcccattggtaccaatggtgatttttgccaaggttcgcaaagccgggctttaaccatgtttgtcatgtacgccgcttcttccaacaaaggtcaccttttctctcggtttggcagcgcccgcttcctgccaagctcaaacnccggtgcgcagatcgagctcctagacggtactgggatcagcaacgggtacatgcctgccaatgtgcgctgcgataactgccttcaatggaccggtggctctctggatccgtccagcagctcaagtagctggatctgggcagagaagcagggtcccgcgatcgactccaacgatcncaggtacgctatcacgcggcatgattcccgcggcgtgcacaccatcaacatgtcacaggcccgcgcggccaacgtggatgcatcgaacccgttcgcggggcagaacgcggcctcaaccccagagacagttacaacaggagggaccacagcctccgaatcagattcgatattaatagcccatgccgtcctcatgagcgtcgcctttgtcgtgttcttcccgtcctttgctatctcaattcgcatcatccccaactccacggtcgtctcgcgcatccacgctccactgcaactgctcaccctggctatggccctcgctggcctcggactgggagtctacctcggcgtcgatacaaaccaaatggacaagtaccacccaatcattgggctggtcgttgtcggcatgctgctgctcttccagcccctgatgggcttcctccagcatatgcatttccgtcgcacgggcgggaagagcttcttcgcgtacgtgcaccgctggctaggccggaccttgattgcccttggcatcatcaacggcgggttagggttcctgcttaccaagaatgcgggcaacgctgcccccaagggcgcggtcatcgcatactcggttgttgccggcgtggttggcctggcgtatattacttttgtgattgtgcttccgttcaggtcgaagaagagtgctgcgccgcagaaggtgacatcgttgaatgggtccggtgagggaattgctatgcaggagaggaacggtgccagtgattga

SEQ ID NO: 2783 - DNA, 225 bp, A.fumigatus
caggaccccttgatgggacgtcctgcgcagttcaataatggattggcgtatactcctcaacaattaggccctaagtatggtggtcagccacagcagtatcagccgcccgtgggatataattatgaagccttccaaacgcccggaacagcagcgaaacctcctttcggccggcgcaaactccaaatcggtatctatggcgtcgtcaccagccgcaacgccacgtag

SEQ ID NO: 2784 - DNA, 303 bp, A.fumigatus
tttggagtatcaacgaacagagctatcaggacaggaaagacttacttgcttaactcagtatcctcaagactcctgtcgtgcgtctctttggagtcggagtctttcctttgtttgcttcccgttgacggatctgatcaagtacttaatctacttctgtttacggttgggaacgctgccaaacaacctttttataacttttcattctctcccgattgcctcgtcacgattaccccgcctatctatattgatgatttgatgaaattgacgaatctttcctgtatcattacctataccgatccctga

SEQ ID NO: 2785 - DNA, 537 bp, A.fumigatus
  unsure (48): Identity of nucleotide sequences at the above locations are unknown.
ttcgggacgagtggtctttttggtatgggccaagcatacattatcagntctgacaccttcagaaaatcgatgaacatcgccctccctgtaaggcagcccaagaacggccagtccccgggtcgtgatgattcgcagcagagcaagtcgatccgcatacttcgtgagcatctggaggccgaaagagccaagatgattcaggaacagcacaagtcgcccaatagtttggagattagttttattgatcgcgccttgaacaatctgaaggaagccaaggagaacatcaagcgtgaaacggcggagaaattggacgctgttcgtggtcaggcccctgtgaagaacgcggatggaactatcgccgaacctcctcggcttggcgagaaggatctcaagttggcagccgactatgagaggaggaggaaggaggaagaagattggaagcgggaggagaggaatcatgctcgccgcgaggctcacctgaaggccatggagctcgaaagagaaaaggcgcgctcggcattcaaggtcaagcaaaggtga

SEQ ID NO: 2786 - DNA, 186 bp, A.fumigatus
tctgccagctgtgtatgtgatcccaccttgtttggaacgagcaagaacgttactgactatcttgtacacaagtgggaagaccctaacatccgggagctcaccccgcagttcctgcccatcttccagtctgtcctctgtggcgattcggaccagcttgaggactatcgccgtgccgagctcatctag

SEQ ID NO: 2787 - DNA, 258 bp, A.fumigatus
tccttccgcccgtctcgtgtgaaaacgaagacgatcggtatgtatatcctctatctttttctttctgcatattgcacgatggctgctttgcacaagcatgccgattccaatgatgaacacactcgtctacccagctcactcagacgcgcaaaatgcgtgcgtgatgtgaaacacgattctttccaacgaaacctgaggccttcatttcactgttcttactgttttcatgtcatctttggattggtattgaccacttga

SEQ ID NO: 2788 - DNA, 750 bp, A.fumigatus
catagggctactgtcgccgatatcaaccgtaacatggccgagaacctgcgctactgcggtccttctctgattgccaacgagactactctccacaacgtcatccagatggtcacagacatcatcacgaagaagcacccttgccagctcgaatttggccccgaagaggagtctctcgaggctggtgaggagacttctgagttcgactgggttgttgttgacactgccctcgatgttgtttccggtctcgctgcagcccttggtgagagcttcgccgagctctggaaggtgttcgagaagaccatcctgcgctacgccggtagcactgaggctctggagcgtgccactgccgttggtgtccttgccgagtgcatcaacggtatgggtgctggtgtcactcagttcactcgtcctttcctgaagctgctcatccaccgcctgggtgatgaggatcctcagaccaagaccaatgctgcttatgctgttggccgtcttgtcgagcactccaccgcagacgctgagatcgtaaaggagtatcctactatccttggccggttggagtcgtgtctgcagatgaaggtctctcgccttcaggataacgctaccggctgtctcagtcgtatgatcctgaaacaccgtgaggccattcctctcaaggatgttctcccagtcctcgtctccatcctccctttgaagaacgattactatgagaacgaacccctgtaccgcatgatctgccagctgtgtatgtga

SEQ ID NO: 2789 - DNA, 1008 bp, A.fumigatus
  unsure (772): Identity of nucleotide sequences at the above locations are unknown.
tggccaaatcgcttactgactaaacacgactcgtcttgtctcattccggacgcgccctctatgatgttacgctccccaatcccgcctgagcgcacctcctcccgatccccagctccaccgcgcccatcctttgacgacgaactagaacgacctgggtccgctgggagtgatgcctcttcagttgcatccaatgtgaccactgtgtctgctattcagagttccctcaacaacttcggtgctgctccagacgcttcctctccccggataccccggacttctagcaccaacggcagtggcaccacagacgataacccccggcgcccatccgcctcatctttgatgccccagaatgagatgaccagcaggaagatttccggtcgcgtcgtcccgcccgatctgtcgaggcatcggccacgacaccactctcaaggcttcttcgagccatccctcccgacagcgtccctatcagatgtaacactttccgcatcaagaatcgcagcgcaggctgcgatgcaacagcagtcctccgctgcgcaacacccgccgaaacgattgccttccaacgtccagggccctgatggaaggggtggaagcatctcgcccccactcccaccgccacaacaagtgctggcagcccctggctccggatctacctcggggcaatcatatcagaatgggattggtggcggaaatgctcttgcggctactacagctgccaacgtggtgtttcctcgaggacctgcgcttcaaccggggatggctagtgatccancgcagccggagcgtgagcagatgcagaatggccataagcctaagatgatgtcgttttcgaagccgaagcctttgggaatcagccgagaccaggatcttacggtatggatagggtataccgtccccaccaaaatggggtttccgggtctagtggggttatcccctcctccgggggtcgaacgaatccccttccccgaaccactctccgatgttttgtttaacccacgcctctgttga

SEQ ID NO: 2790 - DNA, 1209 bp, A.fumigatus
cgataccaggcagtcaaagacttcctgatgcaatgcttccagaaggatcctaatctccgtgtctctgcaaggaagctcctaaaacacccttggatcgtgaatgctcgtagatcggactcagtggtgccgaagaagtctacggagtatgaagaagcggtcagaagcgtccaagaatggaacgaggctctgcgatctcctggtgcgggaactttacggaagccctttagacacgatcgtcagagcccaagtccccttcgtcgcaatcagctgccatctcgaaacacccccactaaagacgctcttccagcccccgtcgttagcaatgccaaagaccaatctttgttgtcgaacgcaactgccgaagataactgggatgatgactttgcaactgccatttctcccagtgcgctgcagctaccacatcttcggccgcatgacaatttcggaggaatgctttcctctgaaaagctcaaggcattcgcctcactcgatgggaccgttatcaaatcagagaatagttttggagacttcaacgactcctttcggactactttgcactgcggagagtcggatcctctgcagactatccgaccttttccattcaagcaaaccggtacggacgatggattcgcccaaaagtcgccactccagatggagcccaagaggtctactcctttcgtacataacgtcccaattttgacacaaaatcctgttccaccttcgagacaggctcgtccagcctcgttttacaaggagaactcagtagaggattattctgatatcataataactgacgaagacgttttaggccgaaaacttaacggtgtgaaagtacgcatggaggccaatatttatccgaatgttgatgattgtttgtctgacctgtttcaggagaccgatgaagagcgatatatctcgaattcagcagaccttccgccgtcaaaggagatagtccgatatcacacgccctctcgggatgacgagcaggaaccccacttacggaggcagctctcaaccaagcgtcatagatcagcggtagagattcacagatttgccgagaacgagagagacgaagacttctcggatattctggggcccgaggaggtcgccctagacaagcctgatagcgatggtagctcggatagaagcaccttgatgcttaattcacgacactgtcttcaccacggggctggaaggagccgcgccaca

SEQ ID NO: 2791 - DNA, 276 bp, A.fumigatus
ccgaactgcatatgcgacacctgggcgccatcccggggggcaattcaggtctgcataaatcccaagtcccgcgcaatctccatccatccagcgagtgtatttgaaaagttggtcgttcgcaaactagacgggtactgcatggaagacaccaacctgctttatgtcgtcctacggtcattggggtaccaggtctatcgtacgggaggccgagttagtcgcgcggctgcggctgggagcaatgcggtggtcggataccaggcgctgtatgtgccttga

SEQ ID NO: 2792 - DNA, 222 bp, A.fumigatus
gtcggtacagggtggcgatctgtcgactgctccggagctcaaagagcaggttctgaccaagatctcgaacatgccaatcttcaaagcgtcattcgccaatatcacacaagaacatgggatcagtttttgggcgaagtattggctgaaagctgtgtcccggtcccttgggatgaacatacggaaaatctcgaccgactgcttcgctcattgtggctgggttaa

SEQ ID NO: 2793 - DNA, 1311 bp, A.fumigatus
  unsure (3),(6),(1252): Identity of nucleotide sequences at the above locations are unknown.
ctnccnctccgaggtgacgacaatgccattatcctgaagcggtacaacagataccctctgatcatcgatccttcgggtcgcgtcaccgagttcctgcagaaggaaagcacagataggaaacttacggtcacgagcttcctggacgactccttcgtcaagcaactggagagtgccctgcgtttcggtaatccaatcctcattcaagatgccgagcacctggaccccatcctcaaccatgttcttaacaaggaatatcagaagactggtgggcgtgttctcatccagctcggaaaacaggagattgatttctcaccttccttcaaactcttcctttcgacgagagacccttctgcgactttcccgccggatgtgtgcagtagaaccacctttgtcaacttcactgtcacacagagcagtttgcgaacccagtcgctcaacgaagtactcaagtttgagcgaccggatgtggacgcgcgacgcaccgacttggttaagctgcaaggagagttcaagatccatctccgtcagctcgagaaacgactgctgcaggcattgaacgaatcgcgcggcaacatcctggacgatgacaacgttattgagactctagagaccctaaagaaggaggcagcagagatctccaagaagatggtggagaccgagggcgtcatgacggaagtcgaaaatatcaccttgaactacaacattatcgctcgctcttgcagcgctgtctttgctgtattggagcagcttcatcacatcaatcacttctaccaattttcgctgcagtactttgtggatattttccactcggtcctctatcagaacaagcgccttgctgcggagaaggaccactcggcgcgtgtgcaaatcattctcaaggatttgtttgttacgacattccagcggacttccctggggctggctcagaaagaccgtatcacgctggccatgcttctcgcacaagctgctccttacccgatggacaagacgatcattgatatcattctcgatgagtcggtacagggtggcgatctgtcgactgctccggagctcaaagagcaggttctgaccaagatctcgaacatgccaatcttcaaagcgtcattcgccaatatcacacaagaacatgggatcagtttttgggcgaagtattggctgaaagctgtgtcccggtcccttgggatgaacatacggaaaatctcgaccgactgcttcgctcattgtggctgggttaaccttgcagggctggacnaattcgttccaactgccgaacgtttcatccaaaccgtccttgggccaaaaaatccttga

SEQ ID NO: 2794 - DNA, 189 bp, A.fumigatus
gagaccgagagagaatctatctccactttctactgtaacagtagccaaaaacatcaacccagcaacactaaccttttacctaccaaattcatcaatccatcaattgatcatttcattattcgattcattcggcccatcagtcagtccatctttcttcctcctcaaccatctactactattcggcaataa

SEQ ID NO: 2795 - DNA, 234 bp, A.fumigatus
ttccacaagctcactgtcgcgagcgcggatggcccagtggaggaccagtgcgcagctaagctggtgaacatgcttggcccggccgtgtctctgaaagcatggatttggggattgcaatatgcccgccctgggcagcaagtaagagcaggctcccaatttccgaaagacgagtatttctgtcatgatatgtttctgctgggctctcgaagtatgcaatgtttacgccagtattga

SEQ ID NO: 2796 - DNA, 195 bp, A.fumigatus
tgtagccactggcatgggcaatatattctagaagctccgagggacaactactggaagactttgatgcttattatcattatctttatctcttacagctcagcgctcagtgctcattatggcggtactcatatggagctacctacagtaccttatcctctgttatctgcacctctccacaaatccagtgattgttag

SEQ ID NO: 2797 - DNA, 420 bp, A.fumigatus
tccccaatggaggctcttcatcccccggtgaagaccagcgttacgggacacgccacaggagcaacggccgtcgtccttattggcctattcatccagttaatctcattcggtatttttggtcttaccgcagtgatgttttaccggcgcattatggaagccccgacaccacagtgccataatgctgatctgccatggaagagaacccttgaaatgctctttggtgtcagtgcgctaatcatcgttcgctccgtataccgcgtggttgaatactctgtgggctcgaatgggtatctattacagcatgaatggccgatgtatgtctttgacaccattccgatgctgacagtgatgattatcttctacatctggtatcccagtcgaatccagcagccgagttcctgcgaagatcagcgtaagtag

SEQ ID NO: 2798 - DNA, 192 bp, A.fumigatus
aggagaccatgcgtcaacaagcttttctcacttccttggctctgggcatcacagttccgcagcaataagcaagcctctagttctgaaacctacagcaagtcccccatcctgctcttgaccatatctaggttccccagcaccaagcatagccaactatatcagcaaatggaactcactgcgagctttgtgtaa

SEQ ID NO: 2799 - DNA, 216 bp, A.fumigatus
gaagtttattctacaatcttccgccaaccaggttcgtcgatatgtacactgatggatgctcttcaaactgatctatgtcctagcggtggtgttttcacccgaagaggcgtcatgtgcttcattctcctcttcaatgctttgctcgcgaaggcagaacttacagcgtctttcgaaagtcgaccgaatatgctgaaacacaaaaacttgtatgtgttc

SEQ ID NO: 2800 - DNA, 909 bp, A.fumigatus
cttagaccgtccgggatacccttctgttcgctcttaaaacccgcacaccaggcaaagactcacgcattccgggggaaagccgaaaggactatcagcacacatttctctctgcaattgccaagctgttctggattgaacatgcgctgggcacccaaagtcggcaacgagctcatccgcggcatctcaggaggagagaaaaaacgtgtatccatcgccgaggccatgattaccaaggccagtacacaatgttgggacaattcgaccaaaggccttgacgccagtactgccctggaatatgtacagagtctgagaactcttaccgacatggcgaacgtatccacgcttgtagccctctaccaagcttctgagaatctttataacttgtttgacaaggttatgttgatcgaagagggcaaatgcgcatactatggaagcgccaaagaggcaaaggcatacttcgaacgcctagggtttgaatgtcccccgcggtggaccaccccagactttttgacctcggtcagtgatccacacgcgcggcgtatccaacgtggatgggatgaccgagttccgagatctggcgaggactttcgaagagtgtaccgcaacagtgatacctacagggctgcccttcaagagattagccagttcgagaaagagctagagacacaggagcacgaacgtgcacaggcgaggcaggaaatgccgaagaagaattacaccattcccttctatgatcaggtcattgttctaactcgtcgacaatttctgatcatgtacggcgacaaacagaccttggtgggaaaatggtgcattttggtcttccaagctctgatcataggaagtttattctacaatcttccgccaaccaggttcgtcgatatgtacactgatggatgctcttcaaactga

SEQ ID NO: 2801 - DNA, 309 bp, A.fumigatus
gccctcagctcatactctaggccttactccatggcgaccaagcgcaaggcgtcggcgttgaatgccgccgtcgacgacgaacccgttgacccatctgacgaacttgctttctactgcttaggcggaggtaatgaagtcggtcggtcatgccatatcattcagtacaaagggaaaacagtgatggtgtgttgtgcaatttccctccttgtttggcgacaattaactgatggccaatatagctcgatgcgggcatgcatcctgcgaaagaaggattctcggctctcccattcttcgacgagttcgacctga

SEQ ID NO: 2802 - DNA, 678 bp, A.fumigatus
ggcaaccgctctaaacccgatttggtaagttatccaaaaggctggaagaagaccagctgttgcgttcctctccaactccaacgctacttgtactgctcttatccctcacctctgtcctatttcagagtgacaaggctatggtatgagattgctctgtcattgagcaacctccctagagctccttccttccccctctccgtcatgtcaacgtcctccctgtccatcgctgttgatccagtggctctggtgacaacagaatgcatcactgtcacctcgtcaatgcgcaaacatgcccgctgggctcattcgtcggttgccgccattcttggtggaaatgcttcctcccgggtttatgagaaagatacatctgcccctccgagcccccgcaatggcgcagcctctccccgtccccgttcgagactgtctgtcatggatgacgatcatgctttggccaaccgatggggcctgaggggtaagaaaggcaagagcatgcaagataaccctctgatctccgcgtttacgcggttacggagcgacttaaaggattgcaaagacattcggaccttcgatacaccggcactcttgcaccccttcctgcaagttacccggtcatcctcaacctcggccctcgatcacctcccgcgccctgattgctatcaccaagttcttcgcgtataa

SEQ ID NO: 2803 - DNA, 858 bp, A.fumigatus
aggattgcaaagacattcggaccttcgatacaccggcactcttgcaccccttcctgcaagttacccggtcatcctcaacctcggccctcgatcacctcccgcgccctgattgctatcaccaagttcttcgcgtataacatcattaaccgcgactcccctcggctctccatggccatgcagctcttgtcggccgccataacccattgtcgttttgaggccagtgactccgctgcggatgagattgttctgttgaggatcctcaaactgatggagggaatgctatcccgaccggagggagagctgcttggcgatgaaagtgtctgtgaaatgatggaaactggcttgagcatgtgctgccaagtgcgcctctcggaagtgctgcggcgttccgccgaaatggcgatggtcaatatgtgccaagtgatcttttcacggttgtcgcagctggaagttacagagtcggtcgattcgggctctctgaccacagccgggaacagtgccgaacagacgggccttaagatggatccctctgttgatgggaacaccgtaacctcccaacatccttccgccatgggctccgacactgcaggaccggaacgagagcgcactggcggcgatgagccgtccgatcaagctgccggcgggagtgctgtcgccgcgcctccgaatccagaggacgatttcgggaacgaagtcgaaccgtattccttgccttctatccgggaattattccgtgtcctcatcgacctgcttgatccacataaccgacaacataccgaccccatgagggtaatggcattacgggattatcgatgtggctctggaagtcgcagggggctccattgccaaccctcctaa

SEQ ID NO: 2804 - DNA, 663 bp, A.fumigatus
gaccgggcgaccaacgtcagtgatgcgggcagcaacgcggtccgcagtgaccctggcgagacggccgagtctaccgtggatggtgccggcgcccggcgcgagtcgtgggtccccattcacagcccgggtcttcgtctgcctggaccggatgccgagcggcggcccagcctgccgttgcccccacgggccttgcagtcgcagtcgccgtattcgctcccgtcgttgcagcaccatcccgatggccctctctacggcacctcgtcaccaagcctcccatcccttgctccttctgcaggggcacccccgtcgcagtatggccaagtgccgccgccgaaccgtctccagccattgaactcgtggctcacccgccaacaagggccatactcgcagtcgctgcccccgatcaaccaggcgacctcccatggcctgccactgctgcccccgccgggatccgtcaaccatgctgcggcctcgccccctgtgacggtggacggattcgaaggtggcgtctcgaatgccatgtggtcgaccagcctcggcggcgatgatgtggtcgcattcctcgagggatgcgactatgaccagctgtctagcatgatgccatccgaagttggcatccctactggatggttgagcactgtgtggagtgagttctcacggtag

SEQ ID NO: 2805 - DNA, 759 bp, A.fumigatus
aagatactgcaattgcctttgacctgcaatcgcctgttcaacgacctggtttgctgcatttcacctagttcaaagcattcgagacacaagagcgctgcctttatatacatccaccaaccccaacacctctcacaaaagccggttgaaccatccggaccagccaccgagctccgtgtatcactagagcgtcatagtctttgttccctctgcggctctctttgcgaccgttgttttcttttctgtttgagctgctattcttcctttgttctacacactatgctctctgctggggaaaggcatcagccgcctataaataccaatgcggttgtggatgcctctcggactccagtcaccaaagtttctctgaatcacaactcgaccacctcaatgcggtcagagacatccaaagccgagaacatccaacatatctgggtcgtcaccgggcccgcgggatgcgggaaaagtactgttggacggatgttgcagcaggagctgggtttgcctttcctcgaaggagatgatgtaagtacttgcatccacgcgatatttcttcatacggcttcccggcaaaatgcgcaagttgacctaacacgcacccatacagttccactcacagaccaaccgggagaaaatgggcaatggcattcctctaaccgacgaagaccgctgggactggctcatctccttgcgcaaagccgccatcgaggccctctccccttcgcaaggttttcaccacgggggtcgaacgttccgcgctaa

SEQ ID NO: 2806 - DNA, 549 bp, A.fumigatus
  unsure (2): Identity of nucleotide sequences at the above locations are unknown.
anacgacttctcgatccccggttccctgaaaaaatcccggatgtgttccaggtttcccaccatttcacgggcgctacatacggcgtcctttgcaaagtcaagcgtcaatgcgccttgcatgtctgggaccattgtgtctcgttccgggagatgaccacattcctgtcatcggcggtgtccttcgattccacctttgtcaataccactctgattggtctgggacatctgtcgtgcgttctgatccagcatcacgcagatgttgtccttccatgtgccgaatactttaatccgggatgggaaatcgaactaggaacctgcgaaggtgccctccagcatcgccggaccttccgtcgaaagatcgaccccgttgtgaacgggatcacgaacatggacaaatataagccaatcgagacgatcaagacggctaccccgacggtggtcatgttgtcacatatccggtatgttcttcgagatttgaatcgcagaattaagttggctgacgtccagcagatatgtcaaagacatcaagacggcgatcatggcaactga

SEQ ID NO: 2807 - DNA, 582 bp, A.fumigatus
tccgcctttcctctctgtgactatgtggctgatccagtacagtggttgttcatgaactcgtccatttccgaaggtcttccattagccatgggcgaggccgccttgactggtgtccccgtggtgtgcaccgacgtcggcgcatcgttctgtgtggtcaccgaccgtgcgactgggaagaagttcagcgaagtggttgcgcccaatgacgccatatcccttgccagcgctcagatcagggttctggcattactgggccaatggagcgcgtttgccgaggacgaggagggctatgtgcccccgactttatcactgcacccttcgcgcgaggaggtagaacagatcaagcggcggatgtacgacaaggccgagcagcgtcgcaaactcggcatgctgggtcgctcgaacgtgtacaacaatttctcgagtgatcggtacctccgggaacatgaacagatgctctggctgggcaagtaccagagccgcagctacgttgctcgagggccgggatcgtcgagcaactcccgcaggtttttcaaggagaaatggaagtcgtcgattctgatcgagctagacgaaatgcct

SEQ ID NO: 2808 - DNA, 309 bp, A.fumigatus
atcgcagaattaagttggctgacgtccagcagatatgtcaaagacatcaagacggcgatcatggcaactgacctcattgtcaatatctggggcttcagggactatcggctgcacatctacggagacatggaacgtgcgcctgcctacgcctcagagtgtcaggagatcatcgcatcgaagggcctgcgggagcatgttgtcctgaaaggattgggcaatccatctgtggtcctccaagacgctgtaagttgtaatccgcctttcctctctgtgactatgtggctgatccagtacagtggttgttcatga

SEQ ID NO: 2809 - DNA, 615 bp, A.fumigatus
tgtcaggaccgcgataaagtgtgcattctcacaaactatagcaaggacatctgccagccatgccccttatatccggtttggatgagtgacgagaatacggacgttatgcgacaattttttgagggactaagacaagtttggagtgatgagaaggtggatgaatggtataacgccatttatggagatgtctccgggcctgagaagcctgaaaatctcgtgcttctcagtccggatgcatatctactattcacgaagggatatattgcctttgagcctgtggacaaagatccagagggcatgtggctctcacttaagctttggtggctgcagcgagatgaaaaagacaatgtggactttagtattatcccgcacctcccatcagatctcaacccatctgagtacggtattgctctacatgatgtctgcaatgatagtccactcctctccggtaagacaatcactcttaatacacatgatccgcaaaattatcccctcccggatacacggatcattgaaatgcagtgggtcctgaatcgtgtgcttgcgttaagtggttcggtgaagccgaatgccctcgatgagtggcatgaagtcgcagacgaggaactcagctaa

SEQ ID NO: 2810 - DNA, 1701 bp, A.fumigatus
caaatttccgaagaccttagcgacaagctgagtgacatcctcacaacgttggtggaaatattcgccctttcgaccaaggccatcaagcgaggtagactgctcaagttcacccgcaacatcctcctgggcaccgatgacgccatcaaagaggcagtggataaattggataagttgaccaaagtggaagcgagcctcgtcggtgccgaaaccctggtcgaggccaaacggacagggcgcgtggtggacacactccaaaccactgtcacgtcgacgaatgtcacagtccaggagacgggaaaggccgtcaatcagatgaccgtgcaggtcaccgaggtgcatgaaatgttaggcaacctattgattgcaaccaacggcaaggacgaaaagcatggggacacggccaagtcacagcgcgatcttgtgaggaagattttgcaaccatccgcaacagactcggcacaggattggtatgacagaatcagcaaaacccgtgtccctggcacaggagattgggtaaggcacgaagacgtcttccaaggctggttggctcgagatctcccggtcatgttcgtctctggcaaccctggagctggtaaatcctatctttcatcgagcattatcaccttccttaaagaccaatacccgcagggggtacaacatccctcacatgtctccatagcgtacttcttcttcaaggatgacaaccccgccaccaggtcatttcaccaggccctgcgggatctcgcccatcagatcagcaacaatgatccggcatatgagaagtatcttgcggcccttggggattatgggagcgtcaggactttggaaagtgcgtggcggaccctttttgtcaactatttcttaaagaaggaatccattacgagcagtgtttatgtcctcttcgatgcggtcgatgaggcctttgaggaggaaagactcgccttcttacagcttgccagagacattctggactccccgaatcgcggccgtttgcagttggccatggttggacggccgcatatcagcgaccaagtggctgaagcactcgaaaccaacgtcccgacaatccatgtgacaacgctgaaaaattccgctgatatcgatcgctacatcaaaactagcattcagaaatcagtgatcctgcgacgcgtctcgccagctctacggaaggagattaccgaaaaactgtccgcaggtgccgagggcatgtttctgtgggtgaacctgatgctgcaggagctggtcaagaagcgcaacgagtccagtatccgtaagtgcctcgagcaggcgcccaagggcttgaaggagatgctgcgccacgtcctcctgagcttctccgccagtctgaacgacgaagagttggaatttctcaacgaactcctgctctgggtcacctgcgccgttcgtcctctgagccttggcgaggtggaggcaatcctcgagttgaagtcagccgagggagacgggatgatttaccctgaaggtgccctgcgcaaacaattcgctgccttcttcaaccttgaccgtgaggacggtctgaccacaacggagctccagaccatggcaaagaagacatatgagtcggacgacgaagatatgactaaactggatagcgatgacgaagacgcctttgaagatgtcgaccacctcatagaagttgaatcgaacaagaagtcgaccaccggcacctttaaccacgca

SEQ ID NO: 2811 - DNA, 450 bp, A.fumigatus
cttccgttcattaagggcccgccgcttacccgcaataatttctcattcatcggttcattcggcatcttcctgggcatcaccgcacccaccaaggaggagcccgagttctacagtctccgcctctgcgagtaccgctggacgctgagcgtcagccgcaagcacgctgagttcctcgaatttgccctcgacagcctcgacaacgcctgtaacctcgaccaccacgtccccggcaaaccgggcatcgacgagctgatgaccagcgccgccaaaccgaccatccacaacccccctctgccctctgcttcgcagctggacgagtcgatgctcgagatggaccgcgcgccggacagcacccgcggcggcacctcgtctgtcgtctcgggcctggcctctccggctacctccgtcagcgacgaaagtgtccaggaggcctctgttcctcaattgtaa

SEQ ID NO: 2812 - DNA, 492 bp, A.fumigatus
tgggatagcagaggattatacattatgattgtcgctaggctttttcacctcatccttgtgatctggtgtgcattcagcgatgggtatgatctcagcgagcgaaagcaacctcaaggtcgtctgggcataacgctcgattacggccttgcaaggaattggccgccatcaatcgatgatagaggcgcggacactcagcggaactggttttatagcagccatctcacattcaaagagccggttagcacgatcaccgacggccaactttggcaaatggtgagggatgcattggacgagatccccgctgttctgacccagtacggcatttccaaaaacaagggcggatccaacgtcatgacggtcctcgctttcggcaatgaaatcatcctagcttcttcgaagaagagcgttgatagtttcacatacgagtttggtgatggaaatacccccagttgccagggctcttcagctctgccaggttgtttggaaggatag

SEQ ID NO: 2813 - DNA, 186 bp, A.fumigatus
  unsure (159): Identity of nucleotide sequences at the above locations are unknown.
tttgagcactctcgcagggggaaatccgaagatagaccagatcccagtatgttctacgcccactgtaagctagatattgagcgtcttatctgtggatgcgtcgagccatttgactatgggcaagtggctcaaacgggcgaggataaatatcagaaattntcaaaaccatccaactcgattagctcg

SEQ ID NO: 2814 - DNA, 1152 bp, A.fumigatus
gaacgtcatccggatgacgttcctatcattgcaatgtgcggttcgggaggtggtctgcgcgccctcgtggccggcactggctcctatcttgctgctcaggaagtgggattgtgggactgtgtcacctacaccgccggcgtcagtgggagttgttggctgcagactctataccattcatcgatcactggtcgggattacaatcgcttggtcgatcatctgaagaacagactcggagtgcacatagcattcccacccaaggctctcaatctactcacaactgcacctaccaacaagtatctactcagtggactggtcgagaaactgaaaggcgaccctggcgcggattttggcttggttgacatttatggcatgctactggccgcgagacttttagtccccaaaggagaacttggagtctcccaccaagatttaaaattgtctaaccagaggtacaatctttataatggtgctcaccccatgcctatatacaccgctgtccgtcacgagatcccagtgctagaagccgtggaagacgaagagccgaagaaggaaataacccctgagaagcttattaaggcgtcacagagagaagcatggtttcagtggttcgagtttactccctttgaatttttctgcgaggagctcggcgccggtattcccacctgggctttgggaaggcatttcaatggaggtcacaacgtggtaccgcatggggaatacccattgcctgagatgcgagttccgggattgatgggcgtgtggggtagtgctttctgcgcgacgctatcccattactataaggaggttcgaccgctgctgcgagggatcgtgggcttcggtggcatagactctttaattcacggaaagtccaaagacctgatccgtgtgcatccgatcgaccctgcgaccatccccaattacgtattaggcatgaaaggtcaattaccgccttcttgccccggaatcgagtctgcagagcgagtatctccggatcatggatgcgggaatgagcaacaacttgcctatttacccgtttttaccgacagtccgagatggggatataattggcgccttagatgcctcccctggacagaaaggcagaaaaatgggatttctgaagagactggacacgcccgttcaacgagccattaa

SEQ ID NO: 2815 - DNA, 453 bp, A.fumigatus
tcatatcttacagttcttattgtgaccatcggtgttggtattcaaaaacggccatcctccgtgtcacaggtcggcccttggtcctctgacttcaggctcatcaactcgccatcattcaccgacggtgtgtcagctgtctcatctctgatttttgcatgctccgccacccccgcctatttctctatcgctgcagaaatgcgcgatccccgtttcttcactcgagcccttatcattagtcagattggctcgactctgatatacctcgttattggcgttgtggtatactactactgcggatcgcatgtggcttcacccgccctaggatcggccggtccgattatcaagaaaatttcctatgggattgctttgcccggcctccttgccaccacaaccatcgttatccatgtgagtccgctcgtcctcatctacacaacgccggtatacaaatactaa

SEQ ID NO: 2816 - DNA, 270 bp, A.fumigatus
gttggatggttgggaaccgttgctttgatgatgaagacgcagatcggattaggtgtcctctctatcccttccgtcttcgacactgttgggatgattccgggagttattcttctctgcatcgttgtctcaattgccgcctggacaagctacgtggttggtgttttcaagataaaccatcgccaagtctacggcattgatgatgcaggtgggttgatgtttggagccattgggaaagaaatcttcgctacgtcattttgtctttgtatgtga

SEQ ID NO: 2817 - DNA, 339 bp, A.fumigatus
  unsure (206),(261),(335): Identity of nucleotide sequences at the above locations are unknown.
gacccagtcaaagagaccagagcagctccaagtcaccagtctcgtgttagaagggtcgagatcgaccaatggcggacttacaccttcccccatctcaaattaaccagtgttgcgctgctgacccagaccatcaccttgccccagtcagcgtacctgaccttttttagtgacccttttaccatctccctctgggtgtatcatacttncacgtactatgaggagaacgatatagacaacactgatgacagcctgcacacaatncttctcgatggaagaaacatgctcgctgagcattcggggcgacggggcactgtgcgctcaggtccaggatttcnatga

SEQ ID NO: 2818 - DNA, 1140 bp, A.fumigatus
agagtcattgagcagtgtgcgattttggggattccgaaggaggatatgcacaaggtttactgcgatcgtgagttactactccctgatttgacttgtggattgagtgtttctgattttagtatagcgtggactattggctacgacgagcgttttgggagtgacgtccgtctgcagcaggcgctgatgtactaccggccccatgtcgatgactcccagtacacatatcctctggacttttgcccgatctacaacgcggagactaaagagatcatccacatcgatatcccgccagtacgacggcccattagtagggcaccgccaaacaactaccaccccgccgcaattgagcaggatgggggctaccggacagacattaagccaatccatatcactcagccggacggcgtgtctttcaaggtggatggacgtattatccagtggcagaattggagtatccacgttggtttcaatcaccgcgaaggcattgtgctcaataacatcactttcaacgacaaaggaaatgttcgaccaatcttctaccgcctctccttggcggaaatggttgtaccatacggcaatcctgagcatccgcaccatcgcaaacatgcattcgatttgggagagtacggcggtgggtacatgaccaacagtttgtcactcggatgtgactgcaagggtgctatccactacatggacgctgcctttgtcaaccgtgccggtgccagtaccatcgtaaagaacgccatttgcattcatgaggaagatgctggtatccttttcaagcacaccgacttccgggacgagtctatcatcgtcacccgtggacgcaaactgatcatctcacacattttcaccgccgctaactacgagtactgcgtttactgggtctttcaccaagacggcaccgttcagcttgatatcaaactgactggtattctcaacacctacgccatgaaccccggtgaggacaccaagggctggggtactgaggtctaccctggcgtcaacgcccataaccaccagcacttattttgtttgcgtatcgatcctaatattgacggtccaaacaacactgtctttcaggtggatgcagaacgaggtccaggagaggtcggaagcgcagagaacaagtacggcaac

SEQ ID NO: 2819 - DNA, 699 bp, A.fumigatus
aggagcatgcccaggagaacgctcaggaggaacagcgctgcctgcaggaggttgagcgcctcatcaaggagttccacaaccccgttgctgccgttgtcgtcgagcccatccagtccgagggcggtgacaaccacgcctcccctgccttcttccagggcctgcgcgacatcaccaagcgcaacaatgtgctcttcatcgtcgacgaggtgcagaccggtgtcggtgccaaccggcaagttctgggcccacgatcactggaacctccagactcctcctgacattgtgaccttctctaagaaggctcagaccgcaggctactactacggtaaccccgctctgcgccccaacaagccttaccgccagttcaacacctggatgggtgacccagcccgtgccctcatcttccgcggcattatcgaggaaatcgagcgtttgaacctcgtcgagaacaccgccgccaccggagactacctcttcgctggtctggagcgtctggccaagcagtaccccgagcatctgcagaaccttcgcggcaagggccagggtaccttcatcgcctgggacacccccaagcgcgacgagttccttgccaaggccaagggtgtcggtgtcaacatcggtggcagtggcgtgagcgctgttcgcctgcgccccatgctcatcttccagaaacatcacggtaagcattctgcagtctaa

SEQ ID NO: 2820 - DNA, 666 bp, A.fumigatus
cccatgggactaagcgctgcccggcacatgcgaggtgaaaacttgagcactggtctcctcaaggtcgctcccaagggacttaaccaggtgttcacggccatggccggctccgatgccaacgagactgcctacaaggccgcgttcatgtactaccgtcagcagcagcgtggaggaccccaggctgagttcactgcggaggagctcgagaccaccatgaacaaccaggcccccggttccccccagctgtccatcctctccttcaagtccgccttccacggccgtctcttcggcagtctgtccaccacccgcagcaaggccatccacaagatggacatccccgcctttgactggcctcaggccccctttccctctctcaagtaccctctagaggagcatgcccaggagaacgctcaggaggaacagcgctgcctgcaggaggttgagcgcctcatcaaggagttccacaaccccgttgctgccgttgtcgtcgagcccatccagtccgagggcggtgacaaccacgcctcccctgccttcttccagggcctgcgcgacatcaccaagcgcaacaatgtgctcttcatcgtcgacgaggtgcagaccggtgtcggtgccaaccggcaagttctgggcccacgatcactggaacctccagactcctcctga

SEQ ID NO: 2821 - DNA, 207 bp, A.fumigatus
tgtaattcatcagctatcccaacgttcggttccattcatccaagtaatgtgttcgagggatactcttcattccctactcccttgttagaactcgacctccccatttcagaacgacgcgctcttggttcgtctgttcttcaagcagaacactctgcagagtccttgccctcacattttacaagcggggaacgaaaggcatcaggatga

SEQ ID NO: 2822 - DNA, 243 bp, A.fumigatus
tcccgtttttctctccttccactcctccttcgtccaccttttactcccccatattcgggtgcaattcttttcacctctttccttcctccttctccagactacctcagtcttgtcgtcttttacacgctactccgtacgactgtatctctcgacgacatcgccgcttctatactgaatcaactaatcgaccgcttgaatccttctccgcacaaagttcacccggcgagttttagactacactag

SEQ ID NO: 2823 - DNA, 264 bp, A.fumigatus
ctgcaaccatacaggctgctgaggctcaggccagccagaccgtccgcgctgctatcaccggcggtatccttctctacctttgtgagtgcccatgaagatatttcctatctgaaggtgccgcaggagctaaccggtcattgtatcagctcctttcgccgtcgattttgtcaagaagttcctctaaatgtcagttattccatgtcgttggatagctcgttcaactcgtttacgacgatggctatggtggagattagtcttgcttga

SEQ ID NO: 2824 - DNA, 819 bp, A.fumigatus
cttgtgttcaccaggcggtgctgttacaggaggttcgtttcgatggccagattgtgcagattaaagcggcaggctaactctaccacagtacatcgaactgtacccatgcaaatcgaaattgtcaagaacaaatgggacaccggtagtcgcgcgtcgccgttcagaacttatctgtataatcacgtcggggatcaggctcctttttaccagcctactgctgaggacgacgagacgaaatgggaagaggccctacgcgaaagacccggctccggatatgtgcccgtcttggtgagagggttttgggagctcggcaagcgagcgcaacgacaaaaggatttcctcacaatggcccagacccgcctccatgagattaataactgtctcaccgacctgctatctcgccacgacttgaagatatccgtcaagatcgctgactgccgccggaaacatctggttctaagcaagcgctgtctcgctttggcggcgaagactcaagtactcaggaaccgagggtatgcaatggacgaggcagaggaagagctgaagaagaagcttgcgcagctggagcgatctgtctttaatccctcgctcaacgggcgagccgaggaaatctgggcccgcatgttggcaatccgagaacactcgaaacgtttgcaggcagaaatggagaaggcgggcgcttcaacggctgctcaaggtgaggaggaattggacgagaacaccatgaaaactgcaaagaaggtttgtctgccccttcagatcgcactgcattcaagcgtccctgtagccattttgctaattcccccagatcttggatga

SEQ ID NO: 2825 - DNA, 678 bp, A.fumigatus
aagtcccgccgtggcggcagccctggctcggatgtttcagaagatgaggagggcattgctgcttggggaacgtccaagaaggatctttacaacgccgaccaaattgagactgaagcggatgcgctcgaagaagaggcggaagcaaagcgacttcaacagaagcacctacaagccatgaacgaggaagactttggctttgacgaaacagaatgggttgaatctgacaaaaaggaagatgcagaagatgaggctggtgtggtaacggaggttctgccgcaggtggagattacagacgacatgagctcagaagagaaactcaaaatcctaaagacgagatatcccgagttcgaaccattggcgaaagattttgccgatcttcgaacaaaacatgccgagctagaaaaagctgccaaggccgtgaaggcgccggaagacgaggaagcgatattgggaccagctccggctcccgtcatcaaattccgtgctctgtcagcttaccttggagcgattagcatgtacttcatgctcttatcgtcatcccaggacgcatctggaaagccatgtcccctgccgcccgctcaactacgagctcacccagtcatggggtcattagtcaagttcaagaaactctgggaaacggtcaaagatctttccgttcccgaaccccccaaaggatga

SEQ ID NO: 2826 - DNA, 336 bp, A.fumigatus
tccagcgtgattcggtttggagagcgtcagtcgctgatgaatgattgctcttggtgtcgggttctcatgttctcagtcatgtcggactccaaagcaaggatcatacaagcgtattttaatggcgacaaactggtgattcgcaagtcaaggctgtacgacttctctacgcctgagacattgagctcctcgacgactctcttcatgcagtggatggctagcaagacaggaggcaacactagtggctttcctgtggaggactttgagccatttgaggaggatgatgataccgaactatttggcaagaaggagattgaaaagatctctgatgcgccttga

SEQ ID NO: 2827 - DNA, 615 bp, A.fumigatus
ggggggtcgtttgccttcgttccccgccgtctgaacagctttctttcctgtcgttcatgtttcaacaacaccgtcctccacagctggcggaaccatgacccaatggccatcatccgcagcaccaagaacgacctgaacgtagccgaagacttctccattgcctgcttcatcgccgtctcctggtacaatgccatcgaactcattgtcctgtgcttcaccaccttcaagaagcgcggcggcttctacttctgggccctcctcatctcctcgatcggcattctccccttcggtctgggctacatcctcctcatctttgacatctaccctggctacttctccgtcgcgctcgccgacgtaggatggtgcgccatggtcacgggccagtccctggtcctctggtcccgactccatctggtcgtatactcccgcctggtcttgcgcgccacgctcgccatgatcatcatcgacggagtcatcctgcacaccatcggctgggtcttcgagatgggcgagcagtcgccccggtcccattggttcaccccagccttttatatcttcgaacgcatccagctcatctgcttctccatccacgaaatcatcctctccatcatctaa

SEQ ID NO: 2828 - DNA, 627 bp, A.fumigatus
agaaggagcggggagcggtattgttgttttgggacggaggttgaggagtggaagggaggctttggtttagatgatggagaggatgatttcgtggatggagaagcagatgagctggatgcgttcgaagatataaaaggctggggtgaaccaatgggaccggggcgactgctcgcccatctcgaagacccagccgatggtgtgcaggatgactccgtcgatgatgatcatggcgagcgtggcgcgcaagaccaggcgggagtatacgaccagatggagtcgggaccagaggaccagggactggcccgtgaccatggcgcaccatcctacgtcggcgagcgcgacggagaagtagccagggtagatgtcaaagatgaggaggatgtagcccagaccgaaggggagaatgccgatcgaggagatgaggagggcccagaagtagaagccgccgcgcttcttgaaggtggtgaagcacaggacaatgagttcgatggcattgtaccaggagacggcgatgaagcaggcaatggagaagtcttcggctacgttcaggtcgttcttggtgctgcggatgatggccattgggtcatggttccgccagctgtggaggacggtgttgttgaaacatga

SEQ ID NO: 2829 - DNA, 1248 bp, A.fumigatus
  unsure (1142),(1197): Identity of nucleotide sequences at the above locations are unknown.
aaccccaaagagtcgcccgtggagcgggctctggctggggccaacctgatcagtacccaggacatgcgggtcctacaagctgcagtcttgtttctgttgtgtcttcgccggtgctgcgattcgcggctcgtatgggccgaggcggcgattgtggtccgcgtcgcgcagcgccaagggatgcatcgggatggtcagcggcagggactgaccccctttgagatcgaaatgcgccgccgactgtggtggcacatctgcattctcgacatgctctgctcggaggaccaggggacggatacacagatctggccagggatgttcgacacgaagcttccatcgaacatcgacggggacgaagtcacgccggggctaaccacactgccacctctgcgacgggggtataccgatattactttgtgtatcatccattgcgagatgatgtctaatttgtactgggccggtaagtctctagacgaggacgcacggcaaccgtccacgtctgagaaggagaagctcctatcgacgctggcaaaccgtctcgaggtgctatatctgcataacttcgatttggacatcccaatacagtgggtgacggtcgtgattgcccgtctcacgctgtccaagggatggttggtgcatcgcctcaacgcctcaacggcgggccgagaccccgcagctacaaacgacgagatcttccacatggcggttgagatcgtcaagtttgcgactttaatacaaaacaacgagagcacctctcagtgggcgtggctctgcaaaagttacaagcaacgacacgttgtggcatacattctttccgagctatgcgtgcggcccgtcacgcccgagacagagcacgcctgggaggtggtgacggagatttaccatcagtggctgcgcgaggatcggcagaccaatacgatgcttcagaaacccctgtcacgactgatggagcgcgcggctctcgcgcggaggacgaagctggctggagctgaagcttctgggggacgcagcgtggctgcaccgtctgacaatgcagcaatagacagggtccagggcacgttgcagcccgctgtctcgcaaagtattattcctccccccaatgttcttgtgggaaccgacatgggtgtgaggttagaggatcctancgcagcagtatcagaggggcatatcctaaatactgatgctaacccctccgaagtnactgaattctccttttctgccctcgattggcttacggggcctttaccgtga

SEQ ID NO: 2830 - DNA, 267 bp, A.fumigatus
tcctccaggaggatggattcctcctgctctgtaccaaataacaacagagtcatggcgcttcctgactccatgcctatctacggagtactctgtattccaagcgctaaaacgtcgacaccgctccggctctctgaagacaagacccaatccactcttgcactacctgtaatcactcacttgcagaatgccttgcgcgacacgccactgaccgcttcgtgggcctacgcgccatggactctgaagaagcggggttgtttctgcaggtag

SEQ ID NO: 2831 - DNA, 189 bp, A.fumigatus
aaactgaacaattggtccttgctggatcccaacttcccaaggatccccgtcagctcaccctggtccggggggctgaccttgggttcgcttgatggacttgtacatgccgggagggccacaaacaaaagaactggatgttcttcctccttgggcttcggggaggaacggcttcaaggacctccttggtga

SEQ ID NO: 2832 - DNA, 240 bp, A.fumigatus
cgggtgtgtctcacagggcgtctcaccgagtaccaggtcatcgggcgtcacctgcccaccgaggctaaccccacgcccaagctgtaccgcatgcgcatcttcgcgcccaaccccgttgtggccaagtcgcgcttctggtacttcttgacccagctccgtaaggtcaagaaggccaacggtgagatcgtcagcctcaacgtggtatgtctactatgggaaaggattgttcggtcaagatga

SEQ ID NO: 2833 - DNA, 369 bp, A.fumigatus
gactctggttacagcacacagtctgccatggcgtctgtctttacagacttcaaggaaggccagcaaaatgggtctggtccttgtttggcagcagctcttacttccatcgcaaccttccaaagccccgatcgcttgctgtcattctacaacttctctgacttcgaccatatttcggcagatctgcgctattcactttttcaagcgaacggcgtgaagcttccaaagcaagagcagaacggctgggttgacatcttcgcagcgtattggaaggccgtaagagagatcgtcaagtttgaggagtacacacccgttaagcacctctgggcacaaggtctgagaggttggagaaaagtgtggcatactctctaa

SEQ ID NO: 2834 - DNA, 420 bp, A.fumigatus
tgtaatctcgctttccaactaaatagctacgaagcagaaattcgagtcctgcgccacgagctggaatcgcgcggcgttcagcccgtctcatcccatcttgctggccctgcgcagcatgcgggcccgtctcaggcgcctcccccggcccttggccatggccccagcaatctgttcggtggaatcatgaccaaccaaggaggtagtggtcccggtcttgcccctccccctccccaggatcagcagcctccccagcatacccttcaacagcctgctcccgcggctcagcaatcagcgccccaaccgccgcagagctcctttggaggatatcagcctggtgctgctgtgaacggtatgttcttgctgtatttacttatggttctctggcgtctgaccgtgcgatgtctttcgctttctatgtag

SEQ ID NO: 2835 - DNA, 228 bp, A.fumigatus
gccacatgcagtggcccagacaccaccaacatatcaaggaattattttcgctctcctttaaatttcggtcccatcaacttgttcctcttgcattaccctgtcaccactacaactaagatgggcttgataactcataactggcttcccttcgctctctgtataggatttgcttacagtcgagctgctatcacgccaggggtcacggaagtagacttgatatttcccgcg

SEQ ID NO: 2836 - DNA, 243 bp, A.fumigatus
tccccaattgcactctcttgccatccccgtggtgaagacggtagagagacaaattggagagtttgggtcctgcgatgctgcaagctacaggacatgctgcatctctaccgcaatagccaggactggcaggatttctcaaacctacttttcctcgtgctgcgaggcattgtcgcaagagagcaggaggcatatggcccctacagctattataagccacgaaggggtcattataccatcctatga

SEQ ID NO: 2837 - DNA, 363 bp, A.fumigatus
gcattactgacgaattccggtgcagttacatgggcccagcgctcatccagctcagaccctgagcgcaactacctctacgtcaacatcaagactcccgatgtcgcgaagtcggccgcggatctcaagatcacccctactaatgtctcattcactggagagaccaacaagggcgtaaaataccacgtctctctcgacctatacgccgagatcgaccctgaaaacagcaaggtcaaccacactgaccgcgaggtcgagctggtattgcggaagaaggagcttaaggaggagtactggccccgtctggtgaaggacacacagaagctccacttcttgaagacggatttcgacaaggtatggcgctga

SEQ ID NO: 2838 - DNA, 198 bp, A.fumigatus
gctttactcattttcgacttaaaagaaggctgtacgagtcttgagtataccgttggcgacttgttggggaggcctgagatgcataatctgtggaacgataacctctcaggacataccgcaagtctgaatgatataatgaaatacgcttcattcaattcacttatcccgcccgataagttgcgactagttctgccatag

SEQ ID NO: 2839 - DNA, 1185 bp, A.fumigatus
tcctggcatctttgcttctcctggtacgttcatcccattatgcatcctggaccgtttatactgatttttttttttctctgtacagaccaagcatatttcattgcattttccatcttgattctacacaccgatgtctttaacaagaacaataagcgcaagatgcaaaagtcggattatgttcggaatactcgtggtgaaggcgtatctgatgacgttttggaatgcatttacgagaacatcgcatacacgccctttatccacatcgaggatacaccctctcacagtcgtcagcttgcaaaaccgcgacggcccttgttcaagaccccgagttcagagcatttgtcgcgcgtatcaagggaaccggttgacccctacacgctgatcatggacggcaagcttgactcattacggccgagtcttaaggacgtcatgaacttggaagacacatatcgatgtcatgggacgacagggccacctgacatcaacagcctgcatcaggccttttcgaaaacagctattctgcagatcgtatcagctcggtcccggccggatgcgttcatgccggctagcatccagaacccggccgaatccaaccctgggctggtcgacatcaaagtggccaaagttggtctgctctggcgaaaagacccaaggaaaaagagggccagatcgccgtggcaagaatggggcgctctgcttaccttctcgcagttgtacttctttcgagacgtcaattggatcaaatccctaatgtcccaatatgagtctcatcagaaggaagggcgccgccgggcggttgtattcaaaccacctctcacggagttcaaacccgacggtatcatgtccacggatgatgcggtggcgttggtggattcgggctacaaaaagcataagcacgcattcctttttgtccgccatcacgcgctggaggaggtgtttttggccaattccgaggacgacatgaacgattggctggcaaaaatcaactacgctgctgccttccgaagcacgggggtccgcactaaaggcatgatcgctaccaattacgacgctcagcgtaaccgaatgagtcgcaagccctccgtgacgtcgtgcaattcgcatcgctctgcagacagggagcctccctctcccaatcccgatacccacgtgtcttcacctcgagggaccggaccgcaatatgta

SEQ ID NO: 2840 - DNA, 843 bp, A.fumigatus
agactagtctgccccatgcttgctctcgtcggccagtatatcaaagtcaagcgtggagccgctatggggatcgtcattgcaggttcctccctagggggtgttatctggcctattgtcattaacgagctcttgaaaaaacccaccatccgatttgaatggacgatgcgcatcgttgggttcatcatgatacctcttcttgccatttcgtgtctttgttgtcggcctcctaagattccaacagctacgaagaggctgcaagacaaaccagacgccaacaaggctgtgaccccggagcgggagcctgtgagtactcccaagacaagattttcgatcttgcgagagcccaaaatgcaggtgacttgcctggcatttttcatcacttatttcggcatgttttcccctttcttcttcaccacatcctatgccgtagcacagggcttctccaccgacctgtcattctatacaatatccattatcaacggagcgtcccttttcggtcgcattattccgggcatccttgcggatcgatatggtcggttcaatatctgcattctcgcgacacttttgtccggtattatcgcattatgctggacaactgctacatccgttgcgggcttggtaatttggtctgcggcatatggattcacgtctggtgtacgccttggtctagccttggtccctttcataagaaatgctgacacccttcaaggccattctctcccttcaacaagcttgtgcagcccaaattgcgacaccaaacaccttgggcttatcaatcggtgctgtcatggcatctacatccctttcgtatgtacctacatattatcacacacgcaaagctaa

SEQ ID NO: 2841 - DNA, 285 bp, A.fumigatus
gaccgcgagctcatggaaacagagctgattcgtcgtctgatctcgtcgtatttcaatattgttcgggaaactatcgccgatcaagttccgaaagctattatgcaccttcttgtcaaccatagtaaagatgtcgtgcaaaatagactcgtgagcgagctttataaagaggaactgttctctgagctcctttatgaggatgatggcatcaaggcggagagagaaaagtgtgaaaggctgttagaaacatacaaagaagcagcgagaattgtaggtgaagtgctgtga

SEQ ID NO: 2842 - DNA, 402 bp, A.fumigatus
agcgcttgtccttccagcccggtggtgaagattccttcagggcctgccactaattcaaatgccgtatgcgggcctcgattggatttaggaatactgggatattgcttcttgccatccttcatcgcgcatattcccttgcaggtggcttatctttttctgaatgcgctgacccaatatctatgcattcgtggagttcatctcctctccgcccagacgtcttcgctgacagtgacggtggttttgaatgttcgcaaacttgtttcgctcctgttatctatctacctatttggaaatcagctttcgccgggtgttgttattggggctatctgcgtcttcgcaggaggtggactctatggtttggagggtgcccggctgagaaaaccgattaataagaaggattaa

SEQ ID NO: 2843 - DNA, 420 bp, A.fumigatus
gaaatgttcgagcccaacatgcgctcccttgcgcaggcctgcgcggccgcgtccaactggctctggaactttctcatctcgcgtttcacaccgcagatgttcgccaagatggagtacggcgtgtggttcttctttgcatctttgatgttgctgtccatcgtttttgtgttcttccttgttccggagaccaagggcatcccgctggagagcatggatgtcttgtttgagtcgaagccgatttggcgtgctcatgcgacggtcctggccaaactgcgagaagatgaggaacagttccggcatgatatcgaggaatcggggtatagcaagactggtgagcagcaggtggagcacctgttccaggaatcgcccaaggtctaccctgtttttggaatcctcggccaagtcagcaccatttcctaa

SEQ ID NO: 2844 - DNA, 909 bp, A.fumigatus
tacggtgtcagtgaaaccctggctcccagccacaagcagtggatcattccctttgctgtgcagttgattccatccggtctgctcctcattggtgcagttttcctcaaagagtctccgcgctggctgttctcgcgcggacgtcgggaagatgccatcaagaatctctgctggatccgccagctgcctgcggatcacatatacatgatcgaggagatcggcgcggtcgaccaggccttggaggagcagcgcaccaccattggccttggcttctggaagccgttcaaggccgccggaaccaacaaaaaagtcatgtatcgcctcttcctgggaagcatgctcttcttctggcaaaacggcagtggcatcaatgccatcaactactatagccccacggtgttcaagagcattggtctccatggggcaaacaccagcatgttcagcaccgggatttttggagtcgtcaagaccgtggtcacctttgtctggctcctttacctaatcgaccgcgtgggacggcgtctgctgctgttgatcggagctgccggcgcagcagtctgcttgcttattgttggcgcttatatcaagatcgccgacccggcctctaaccctacccaggagatgactgggggcggcattgcggccatgttcttcttttatctttacactgttttttacactccgtcgtggaacggcactccttgggtgatgaattcggtatgcccatcatgtcaccttgcgtcaattgtttttactaaccagggtaggaaatgttcgagcccaacatgcgctcccttgcgcaggcctgcgcggccgcgtccaactggctctggaactttctcatctcgcgtttcacaccgcagatgttcgccaagatggagtacggcgtgtggttcttctttgcatctttga

SEQ ID NO: 2845 - DNA, 834 bp, A.fumigatus
ttcggcgggccaagtcagcttgaaccgtttgacgaccgcggcgggattcagcgggcccggaagaagggtatggagtctgacgagatcctcaaccccaaccagaacgagaacaatgacaactggggcgcgcatgtgcgctggacgggcccgcagattctcaagcagcttccggagatcaatgtgctgtgcgccggaatgggtacgtcgggcaccatgaccgggctggggatgttcttcaaggagaacaagccgtcggtgttgcggctgggggtgtgcacggcggctggggaccgcgtgccgggcccgcggtcgttggcgctcctgaaaccagtcgagtttccttggagagaggcggttgatgccatcgaggaagtcaattcgtatgattccttctcgttgtcgctggatctgtgccgcgaggggatcgtctgtggcccgtcgtcgggattcaatctacagggattgtttcagctgctggggaaacgcaagcaggccgggacgctggctgagctagcagggccggatggcttgatccattgtgtttttatctgctgcgacctgccctaccagtacattggcgagtacttttccaaactgggagaggagaaattccatcccatcaagaaccaggtaagttcggctggtgcgcatcttctgattaacgccatcatactgactcccgcagaatctcagcgcagtcgacatctaccgctacgacgagagctgggaacgaagccccatcgtcctcttcacgcatttctacgagaccccccgctcgctctcggacagtcttctgcgaaacatcgagctcaggccactttgctgcgtgcttga

SEQ ID NO: 2846 - DNA, 582 bp, A.fumigatus
ctcccgcagaatctcagcgcagtcgacatctaccgctacgacgagagctgggaacgaagccccatcgtcctcttcacgcatttctacgagaccccccgctcgctctcggacagtcttctgcgaaacatcgagctcaggccactttgctgcgtgcttgacctgagaacggcagcggattactccacctggcatttgccgggatccgtcaacatcccccttcgcagcctggactcgcatactccaaagccattcgcagaccccggcgtgctggaagcccaatggctagaactcgagaccctcttcaagacagaagaggctctgagcaagctccgtggtcagcatgtcttggtcatttgctatcatggtgatacggcccgggtagcgaccagcgttctgcgagccaagggcatcgaggccgacagtctgagaggaggatatcaagctctgagggatcatgggctgtggggagagaacgaagtgagcacctgcactgccaatggcactagaactggcagtgaacatatgacgtcgacgatttcccttgagaggtcccacggtcctaacgcagggaagaagagcgcg

SEQ ID NO: 2847 - DNA, 1068 bp, A.fumigatus
ctgaatccctcaccgcggcatccttccagccccgtggtgaagacgcattctggttatgttacggatgtattcccttttgtggcgaaatcatcgaatctgttggttgccagcaacagtctggtagacaacagcttgtggaccatcattgacacccaggatacatccaaggtcagggttatctcatctattggccgtggaggcgccgcctttggtctttcacccacacaggtggatgagatttggttcaaaggcgcggaagatcaccccgtccatgcgtgggtggttaaaccgtccaatttccagcctggcaacaagtatccgctcgcttatctgattcatgggggccctcagggcgcatggaatgaccaatggagcactcgatggaatcccgccgtgtttgctgagcagggttacgtcgtcattacgcccaatccccgaggtagcaccgggtacgggcaaccattcacggacgcaatccgtggttcttggggaggcctaccttatatcgatatcgaaaaaggattggactacatcgaggagaatttggactacgttgacaccacgagagccgtcgcacttggagcgtcttatggcggttatatgatgaactggatccagggccaccctctcggccgtcgattcaaggcgcttgtcacccacgatggtgttttcagcatgacttctcagcttgccagtgaggaacagtacttcccactccatgatctgggtggcccgatctggaaggtcccagagaactgggagaagtgggatccgtctcgttttacggagcattggcagacaccccatctcatcatccacaatgagctcgactaccgtctgaccatagcggagggacttgcagcgttcaacgtcctgcagatgaaggggatcgagagcgccttcctgaccttcccagacgaaaaccactgggtactgaatccggagaactctctcgtatggcaccagactgtttttaactggatcaacaagtatgtcggcttgcctccggtgaacgatgaaaaatccgacgcttttagctccaaaaaaaacccttggagaagcctgtag

SEQ ID NO: 2848 - DNA, 228 bp, A.fumigatus
ggtaatatccttattaaatatccctctgggtatataaatataataaaagatatctattatatccctaaattagggattaatcttataagtatagatagaatatctaaggcactagggataattactatctttattaaaaataaagtatccctatataataataaccagtctattatggctagatataagaataatagcctctattatattctatttaccatcctttaa

SEQ ID NO: 2849 - DNA, 1071 bp, A.fumigatus
agactggacggtcctgaatccaaacaaatctcggccctttcaaaaattcgtgttggccagaagctcaatgatcttcttgtacttgacattcagagagcccgcagactcatcaaagtgtcggctagagcgagtctcaagaaagcagccaagcaaggatctctcccggccaagtttgaggacatccaagaaggcgctgaagtcactggttttgtccgaaacatcacatccgacggtctgtttatcgagttcctcggtggcattattggattggtacctaagagactcttagcggacgagaacgtcaataaacctgattatgacatggtcaaatcgcagcttgttactgcaactgtccactccatcgaccgagacttccaaaggttcatcctgagcatgaagccttcggaagcaacctcagctggtccaaagaaacccgctcccaagcctactccctcgaacgatgaggtcaccaatgctgtggacgaaagcatcaagtcgatgtctgatttcacctttggcaggactgtgaactgtaaggttgtatctgtcaaggcaacccaagtgaacgtccaacttgcagacaacattcaaggtcgcattgacgtctccgaggtcttcgataagtgggaagacatcaaggatcgcaaacaaccgttgcgatttttccgccccaagcaattaatctcagctagaatcctgggaatccatgatgcgcgcagccacaaattccttccaatcagtcaccgctctgggaagttccccgtgtttgaactttctgttaagccaagtttcctacaggccgccaatccttccccgttgaacttggagcaagtccaggttggctcaacctgggtcggtttccgtcaacaaaggttgctgaagcatggtctccggattcaacctccccacccaatgtttcgcggaaagactacgttttcctgggacgccttccgaatgacttgttctccttttgggcgaatttggaaaaactcctttccccaatccggtccaaccgctaaaaagtgtcatttttccggccgttggaaaccccaaaaaagggttccctttaaa

SEQ ID NO: 2850 - DNA, 555 bp, A.fumigatus
tcgaagcctaccccaacgccaaagtcattctgtcaacccgtgatgtggactcatggcatgcgtatgtgctgctgtacaagtctattcagaagagagtttaagtctaacaaattctgcagttccgtcatgaagaccgtttactggcgtgtcaccgatcccgaacaccgtttcgtttcccacttcagttgggccgccagcatgtactaccccatgctgaacaagttcttcgagacgttcttccgcggcgacttccccaacaaaggcaagcaggtctaccttgatcacgtggaggaggttcgcagcctggttcctccggagagactgctcgagtaccagattaaagatggctggggaccgctgtgcgagttcctgggcgaggaggtccctgacacccccttcccccgtgggaacgatatggcagacttcttcaaccgctgccgcactcgcaaccggcgccagatgatgaacgccgctctgcaagcttttaccatgggtggagccttgctggcgactggggttgctgctgccatggtgttcaagcgcttctcccggtaa

SEQ ID NO: 2851 - DNA, 351 bp, A.fumigatus
attcaagccttatgccagccttctgacggtttactagccctccgcaaggctcttgagagattgggatatgtcaaatgctaccacatgatgtccgccagtgtggagaaccctcctgactgtctgatgtggcacgatgctctctgcgccaaatacgacggtgtgggcgagtttggcagaaaggaatgggatcagttgctgggagactgccaggtatgcttggacgatcgaagagatagaagaaatgcaaccgctgatccctctccaggctgtctgcgactggcctgcttgtgccttcgccgaagagttgatcgaagcctaccccaacgccaaagtcattctgtcaacccgtga

SEQ ID NO: 2852 - DNA, 285 bp, A.fumigatus
tgtggcacgatgctctctgcgccaaatacgacggtgtgggcgagtttggcagaaaggaatgggatcagttgctgggagactgccaggtatgcttggacgatcgaagagatagaagaaatgcaaccgctgatccctctccaggctgtctgcgactggcctgcttgtgccttcgccgaagagttgatcgaagcctaccccaacgccaaagtcattctgtcaacccgtgatgtggactcatggcatgcgtatgtgctgctgtacaagtctattcagaagagagtttaa

SEQ ID NO: 2853 - DNA, 321 bp, A.fumigatus
ctgataagtatcatggtcatcttcatttcctctctgatggtcgttgccacaaatcaaagtttcatcttcatgaagaccaccctctctgccatgattgacctggatcgactcgtgcatggtgtcggtagtacttgcgatttcagactcttagggccgtggctcgatggccacgaagccgaggaacggagaccgctgagtgtgatgcggtcttttgttcatatgctaataatggtcggataccttaagatgatcttcgactggttccagtccagcttggcagatagtacgtatcagttcattaacagcagtgcaaagcgatag

SEQ ID NO: 2854 - DNA, 201 bp, A.fumigatus
tgccccctcggtatctgtcacctagtgagtgtggctgggttttctcccataagcacaactaacggctacagtgacaatgccggtatcctaggtatcaccgtcaagtcgaacaagtcactcatcggatcgggatccagtggtgtgatcaagggtaagggtctgcggattgtcagcggggcgagcaacattatcatccagtaa

SEQ ID NO: 2855 - DNA, 237 bp, A.fumigatus
tcaagggtaagggtctgcggattgtcagcggggcgagcaacattatcatccagtaagtttacctgtagtatgtggtcaaagataataattgacccttgcagaaacattgcgatcactgatatcaaccccaagtatgtatggggaggcgacgcaatcaccattgacaatgccgacatggtttggatcgatcatgttacggtcagttccccaggcccaatcttgtttggctcactctga

SEQ ID NO: 2856 - DNA, 483 bp, A.fumigatus
cgcttcgaaccgggtgaccatctccaacaactacttcaacggagtcagcagttactccgccacctgcgacggctaccactactggggcatttacctggatggatccaacgatctggtcaccatgaaaggcaactatatctaccatttcagtggccgcagtcccaaagtccagggcaacacccttctccacgcggtaagctcctcaccttcttttccaagcacaatctaacgaatcaggtcaacaactactggtacgactccagcggacacgcctttgaaattggatctggcggctacgttctggccgagggcaacgtcttccagaacatcgataccattgttcagagccccgttgatgggcaattgtttacctcgcctgatagcaacacgaataaggtctgctcgacctaccttggacacgtgtgccaggtcaatggattcggcagctcggggactttcagccaaggtcttcacgacgggtga

SEQ ID NO: 2857 - DNA, 342 bp, A.fumigatus
ttctgtggggtgacgaatctccacccgaacaatggcttggcaacacgactccagcatataaacaggttgagggccactgcttgggaagacaggctcaatctgctcaagacgaagatgaagtatcaggatcttcttgccatagcaggctgcatcgccaacgccggcgccgtcagtgtctccggcgctgctgagggtttcgccaagggcgtcactggtggtgggagtgcaacggctgtctaccccagtactactgccgagcttgtgtcctaccttggggacagtgaggctcgcgtgattgtactgaccaagacgtatgcattcattgaaatagctttgttgtag

SEQ ID NO: 2858 - DNA, 270 bp, A.fumigatus
actgcgcgtattggccgccagcatctcgtcctcgggactagcgcttcgaaccgggtgaccatctccaacaactacttcaacggagtcagcagttactccgccacctgcgacggctaccactactggggcatttacctggatggatccaacgatctggtcaccatgaaaggcaactatatctaccatttcagtggccgcagtcccaaagtccagggcaacacccttctccacgcggtaagctcctcaccttcttttccaagcacaatctaa

SEQ ID NO: 2859 - DNA, 564 bp, A.fumigatus
ctaccgcacgcattccccctattcactgcaccctttccccggactctgcacgccaagatgtccgttctccgtcatggaggttcatacctccagcgacgtcttaccaaaatgtacacagatacgaagaccgcttgtgagagtgtaacgacggcctctaaggctgtcgatgatccagagctcgtggctctgcatcggagttttaggacccagcgggatcggcttcttgcttggggtctagactggagcgacgctagcgccgcgcaaccgaatgatatcgatgaatcgcttacccaagctgggtttagcgatgttgtggaaagcgttatgtcttccattcaggagttactgagtgaagcggaacgcattcaacatgggggttcctctgatctacctcccaaaggcgctcagaaggactctacatcaaaggacagccttcctgccctgccggttaagacgcactggacccatgaagacataacacgctccaaaagcctccttgctgacttgacggcttgcatcgacactctgtatgatctgtcgcgctcgcgccgaaccatgacctcc

SEQ ID NO: 2860 - DNA, 540 bp, A.fumigatus
gataaattcaattgctccaagactacggagtatccgaggagggacttcgaaaacttcaaatggaatgctgattccgtctccctttgttcagatctgcaccccgacccttattacaaacccggcagttctagcgacgatggcgctccatgccaccgaggaaaaggttcggcaggatactttggagctgaagggtcggactgcgactcgccgttctccctgatcaacgaaactttcagctggatagagaagaacctgaagggcaacatcgactttgtcctgtggactggagactctgcccgtcatgacaacgatcagaagattcctcgaacagaggatgaggttgttcgattaaatgagatgctggcaaacaagttcgtcgatgtcttccgagacagacaattccctaacggcctctccatacccatcgtccctacaattggaaacaacgacatcatgccacacaatatattcagaggaagcccaaatcgatggacgaagaggctccaaaagatctggaggcagtttataccagagcatgag

SEQ ID NO: 2861 - DNA, 633 bp, A.fumigatus
aatcgtagtcctctcggagtgggttcatgcatcgcagccattctcaacggcaagctgctggatttcaactatcgccgtattgctcataaaatgggcatgccagtggatcgaaaaaagggtgacgatttgcggggcttccctatcgagaaggctcgtcttcaggctttctttcccctcatggctctcggtgtagctgccttcatcccgtacggctgggtccttcagcagggagcgccgctggcagtaccccttgtcctgcagttcatcatcggattcagcttcatcgcctccctcaacactctgagcacgctcatggtggatctgttcccagaccgagcgtctaccgcgtctgcagcatctaacctcgttcgatgctggctgggagctgtcggtgccgcggtgattgaccatatgcttaacgctatgggctggggctggtgcttcgtcttctggggcctgttgatgctggttggtctaggcctgctattggtggagtatcatcgtggcatgcaatggcgtctggcaagactcgccaagctggatcagagacaagtggagaaggagactcagaaggccgcaagtgagaacaaggaggcacacggagatgagaacgaggctaattcggatacctga

SEQ ID NO: 2862 - DNA, 690 bp, A.fumigatus
cgtccggcatacattctggcttcaactgtctacctggctgctaacattggcttcgcattgcagaatagctacgtggcgctgatggttcttcgctgcatccaaagcgcgggtagcagtggcaccattgcctttggctatggagttgtagcggacattgcaacggcggcggagagaggaagcttcatcggacctgtgtctgcgggcgttatggtggcgccggctctcgggcctgtcattgggggtattttggccaagtttctcggttggagaagtgttttctggttcctcgttatcatcagtggtggctacctggtggtgttcatgaccacaatgccagagaccaatcgcaatatcgtcgggaatggcagcgtccctcccgatcaatggtggaggatgtctgtcattcagtacttggccgcacgtcgccgactacagaagatgacaaccgaagaacgcattgcccatcaacagcagagagcgaatctcaaccaagcacgtgggcatcagaagctttcgtttcccaatccactcaaggctttcgttatcttgctggagaaagatgcattcatcgtggtctcttatgtcggactggccatgttggctaacactgcgctcttgacgagtacacccaatctctttggcaagctgtatggctttaacgaccttcagattggtctttgctacatgtaa

SEQ ID NO: 2863 - DNA, 1947 bp, A.fumigatus
  unsure (1189): Identity of nucleotide sequences at the above locations are unknown.
gagggatttggcaatatggaactcaaggagacgacgtctgggctgccggaagaggttttgctctcgaaagtcgaaagcttctctacgagattttctggcacattccagacccctgtcaggtcttttaagccttctcgaagagtgaaaattatcactctgtgccactcggaatgtgaaatcacgcagaacggaaattcggttgctctggctctttaccttttggaccaggacgcagaatcgatgaccgttgtgaatttacgcgctgacagggtagcactgccgaagaaagatgcagtgactgccaagaagcagcgaaagaaggcatcttctgaggagcgttctttacttgttcaggcgacgggcatacatcacttcgcaaatattcaagacgcctgcagggttgttgatggacatacttcacgcatcttgacacttggagcagcacacaacggtgataacgaattgtacctgcaaagcccatggagcaaccctatcaaaatcgatattccccacagtctaatgctgtatgaaagatacggagtgtcctccagcacatccgctaatcgcccccgagatagtggtatgaatcgtataatggctgatagcccgatatcaatatctggactcgaccatccatccgttcgaggcaaattcgacgtgatcgacgctacgaaaagacgacacaagctacagatacagatggagcccagcaacgagcttgttaaggacatcattcaaatttgtaaatttgttctgcgtggctttgagaaagctggtgatggtatattggctggatggtgggaaacggtcaaatggcttcgtgctagagggactggcgagactgacctcgaatggactgcaatgataatcgtcttgttcgcaatggcattacagtttatcgacagtgatcaaactcccgtcaaacaagcacgccgaaagaagggtctccttaggtccagcagcggaagctatgtcgacctggagagctgggaggcgatgttggacaaagaatcaagttcttgtggcgtcgtggcgccttggatggccagcagttcttggggatggatcctcgagcaagacgcagagcacgatgctgtcaagtctcagggaatgaacgctcggaagactgaccagcaggcttctaagggatcaacatttcgaaccaacacatatttattccgatgcatanctctggcccgggaatttctgcggactcctcagggtaactcgacgatcggtccgaacggccatcttcctactgcgctctcctgcaatgatactctccggcggaccgccctttgtacgattgtagtaggcttacacctgtttcgggaggaacagaaactttcaatctgtgatgctgagcatgaacgtaaacccttgggtctccttgcacccgttctggctcaaatcggcggctggctcggatggacgtcctggacatgggcagacaacgcgtactacggctctgagatggcgagtatggaacggtggcagttcgaagcttctcgtatctcgatgatggacattcctccagagccctttgcgcctccctcaatcttcgctcacctggagactgcatgggggcagcgctcctcgccgttcttcacactcctggaccttgtcagcacatcggagagcgctccgcgcaatggaaggttatggcaagagtgttttaggctcacgccgaggacactggctctcaatgggctcctctccgaaatacacgacatctcgtcgtcgtttgacagggtcaagctccttcatcgttggggtcttaccaggaacgttgtcgagaccttcccacaaagtgtcagtacgccactgtatgaagcgatcatgcgtacaccgacccaggcctcctgctcctggaattgcaatcttctgaaacttgtccagcgatatgatctgagcatgtccctggatatggatacgttcttttcacct

SEQ ID NO: 2864 - DNA, 189 bp, A.fumigatus
cccacaatatggactttagacttcgataactctgatgataaaacaggagcagaatccctgcgtcctttgagcacctattcacgaatgatgttgatgtatttgaagggcgaaatgaaatctggggaagatgattcgtgttccccatacggtgcaggttgcgagcggcaacttcattaccaaatgttgtga

SEQ ID NO: 2865 - DNA, 627 bp, A.fumigatus
aaagcagcatcctctgaccagtcttctctgcttcatctctgcagaatgcatcctagtgctcttcttggtctcctggccttcacggtcgccgcctcggccattcctgcaccgccagccagtgcgcactccaaacactcaatcaacaatttcaagtcgaagatcaagaatgtggtcatcctggtgatggaaaaccgctcctttgacaacctcctcggtggtcagaagctcaagggcctggagaaccccgtcaacaccggcccttactgcaacccctacaacctcaccgaccccagccaaggcgttgcctgttctgccgccaaggacttcgactccatcaccaatgaccccgaccacgccatctatggcaacaacattgagttctatggcacgttcaacccagacaacactcagatcgccgagggcaagctggttcctcataaccaaggcttcgttcatgagcaggtccgcaagtacggcgccaaggtcaacaagaccgtcctcgctacccaggtcatgaactactacaccgaagagcaggtcccagttctgacctcgctggtgcaaaactacctgaccttcaaccactggcactcggatattcctggcgtgagtatcttatgcctttga

SEQ ID NO: 2866 - DNA, 222 bp, A.fumigatus
ctgactctgcagaacaccaaccccaaccgtgccgccctggtttctggtacctccctcggccacggtctgaacgacgctgcttttaccaagcacgagttcccccagcggtccatcttccagcagttgaccgagaccggtcactcgtggatcaactatgtcgaccctgccggcggtaccggccctgatgcaggctacttcaactggacctatgtcttcacctac

SEQ ID NO: 2867 - DNA, 1005 bp, A.fumigatus
cttcctacacgaccactccaaatacaaagaagcaggaatcggtacgtctctccatttttagataatcccgccatgcagaactgcgagcacactaatgctgacttctttctagcttacgagtctctctcgctctacgaagatgcatacaagtgctatcacctggcgcacctctggcgcgagtcgctatactgtgccctgatggttcccctatcggaagccgacctcaccgcccacgcacttgctctaacgacaacactgacagaagaaagccgtgactatgtctctgcagctcaaatccacgcagagcatctgcacgacattccggcagccgcccgcctcctctgccgcggctcccgcttcgcggatgccacgcgtatcctcacgctccacggcaagaaggatctgattccagagattgtggacacaggtcttgcagatgccatgggagtcacgacggacctcctcgctgacttcaggtcgcagttgaacgcccaggtccctcgtatccgagaactacgtgaacgccgtgctgctgatcccctggcgtatttcggtggtgatccaaccaccgacgacctcggagtcgatattccagataatgtctctctagctcccacggacgcctccacactggctggtcgcaccatgttcacgaggtacaccggcaaaacggcatcctcacgacatacgtccaagacccgacggcgagaggagcggaagcgggcacgtggtaaaaagggcacggtctacgaagaagagtacctagtcaacagtgtgcggcgactcattgaacgggtcaactcgactgttcccgaggtggaaacgcttgttgatgcactcctgcggcgagggatgcgcgagcgcgccgttgctattgaaaaggctatgcaggaagtgctaaagatgtgtgctcaaagtagggaggaagtgttcggcgccctggaacagaatgagagtgaaaaagacgccgcagtcttaaagccggggctggaaggaaacgcgctc

SEQ ID NO: 2868 - DNA, 360 bp, A.fumigatus
  unsure (66): Identity of nucleotide sequences at the above locations are unknown.
agcgctgatccttcgacccccgtggtgaagatggcgaatgagtctctaatttcgcgcaggaccccncgagaatacctcccattcctgcggaaactccagcagcttcctgaagatcgacgccgtttcgaaatagacaactatcttggccgctgggccaaggctctgaagcatctccacgctctcaacgcatatgacgagatacgcgtttatgtcataaagcatgggctgtataaagaagcaatcgacttgtttaagtatcagccggagcagctgcgtgacataacacatatctatgctgacttcctacacgaccactccaaatacaaagaagcaggaatcggtacgtctctccatttttag

SEQ ID NO: 2869 - DNA, 1149 bp, A.fumigatus
acgcttgtccttccagccggcgtggtgaagacaatgatcaatcgcagtattatcggtcgcccaatgcccaatggaccggtatacctgctacagccggatacgctcctcccggtcgaggaagaaggcgaggaaggggagattgccattgcgggcgtcggcctggcccacggctactaccgcaatgccgcactaacagccgagaagtttatcgagtggcacggcaagcgagtctatcgcaccggcgaccaaggacggtggacacgccgtaacgacggccagcgcgtggtggaattccgcggccgcagtgatcgcaccgtcaagaaccgcggattcctcgtcaatctacccgccgatgtcgaggaaccgctacgccagatgggcttcggtgtcaccgacgtctatgcttcgctgatcaacggtctcttggttgcgctggtgaccccggcaactgcagatctggacggcctgcagagcgaggcggaccgtcggctgtcttctttccatcggccgggacgatacttggctgtcgatcagtttccactgtcagccaacggcaagattgataccaaggccattgaaaacatgctgaaagagtatcaggcgcgtctctgcgagggcaccgatgatgaagagaccacagggggcgagcgtcctacggagcgcgagcaagtcatagccgaatgcatgtataccgcgttggggttggatctcccgtcggcgtcggcgtccaaagatttcaatttcttcgccatgggcggaaactcccttgctgctcttcgattcacctccctgtgccgtgagcgaggcatcctcctcactacccgggatctgtacctacatccaacagtcagaggcattctcccgtatgctcgtgaccttgctcattctggtctgcctttgccagacaaggaggagcaaatcgaccaccgattatccctcaaggccgaggttgctgcggcccttcctctcttgggcgacattgacgtcgctccgttgactccccttcagctacaactgagcgctcctattttccaaagcgatgggaccaacacgaaccagctgcggcaatcgtatcccctggcctcatcggagcagatgtccaatgcatattgttccagagcagccggaaggtcaggagatcccccaaag

SEQ ID NO: 2870 - DNA, 543 bp, A.fumigatus
cgccatgaaaacccgattgagctgaataaccaggacatgacgggcacgttcattctacggggccgactagacgtcccgtatgagtatacagttcgccacatgcgagatgggagtatgtactgtacgcgcgctgtcgacgcacggcaaaatggcaagatctgcttctcgtgtttgtgctcgtttaagcgctccgaggggcagcagacgttccaccatcagccgggcccggcacaggagcgcttcagggctcttcttgccgggaagaagccggaggatcatccgcgtagtcccagcgtggatgcggactggtggattgaacaggttcagcgggggaatattgccgagccagagttcccggggcttgatgtgaggaacgtggatatgacgagttacaatgccacagaggaggtgaagcagagtccggaaaagtaccgtcagttgacattgtacgccctcaaggggtcaccgcatgactcaaatgttgcgttgagcaagcaagacctcaaagccagagaacagacaggcgagttcgataacctctaa

SEQ ID NO: 2871 - DNA, 300 bp, A.fumigatus
gaagacggcattcaagtcctccgatcaggtggcgtagtccgcggatacacaaactggggcacgttccgacttcccaaacccaccaccaaacatcaagctcggtacaccgacggccatcacttcatcatgcgcttcgatgcttcaggccccgttcagtccgccgtccgcagaacccttagtctcgacccacggatgatccgcttctcagttgtgaagctgggcgacaagcttgaggagatcaaggacgtggagggaaaggttgaatggaccaatgctcgcaagctcgccgattcgatctga

SEQ ID NO: 2872 - DNA, 354 bp, A.fumigatus
aaacattctttctgccgacactctccataccctagtattgagatatccacgtcccccctgatcattgtgacccttatccgtaacaattacttgattatcgacctcatcctctatctatacttacctctcctctatctcgttttctacgaatctctcaccatgcctgacctacgccgtcagatctttgagagcggcaagactatgtcccgcaaggccgcttctcgcgaaggctctcgccgtccctctcgcgcggcctctgctcaaagttcgaaacagtcgtctcgcaacgtgagcaggcatccatccgatgaagaggatgaaggtaatctcagcgacgacactgcatataggtga

SEQ ID NO: 2873 - DNA, 360 bp, A.fumigatus
  unsure (21),(31): Identity of nucleotide sequences at the above locations are unknown.
aaggggacacggaggtgcggnatacgatccntcaatgtaatgagatttggcgagacggcaaaaagcagcataggcctcttctcgggccaggacgctgctccgtttgcgatccaggatatcttcaacgacatcctcaagctcttcaggccagttggcgtttgtatcagcatctggaataatgtcacccacgtcatccagggaaccgaggctgtgaaaaatgccaacatgattagttatgattggattaccacgaacaattacgtcatcccgccctcaaggaccctcgaaaaggaaaaaagggaaaagttgggagaggaaagcgagggaaagaagctcacctatatgcagtgtcgtcgctga

SEQ ID NO: 2874 - DNA, 276 bp, A.fumigatus
ccagaaaagcatcccgtcgtccggacgcaccccgtcacgaaatggaaaacgctctacgtcaacgagaactttaccaaggagatcatcggtattgagaagagggtcagcgatgcgctgttagatacgctatatcgcaccatcgcggaggcctatgagtatcaggtgcggtggaagtggacgccgaacgccgtggccatctgggataatagggtgacgttccatacagggatcttcgattattgtatgtctacccctctgttctatggcccgtgctga

SEQ ID NO: 2875 - DNA, 489 bp, A.fumigatus
catccatttgcgaacaccatgcttgcactttctcttctttatatccccttgggtctggcagcggcccagctcatcggccctgtaggcccaaccactgctctctcaaaaaagacagtcgattgtaatatcctcagctatggtgctgtcgctgataacacgacggacatctcgacatctcttgaatcagcattcaattggtgtgtccgaccaaaccccggcagcagacttgttgtcccggagggtcaatacctgatctcccgcggcgtcgtgctcagcaacgcgaccaattgggcctttcagctggatggcctcatcacagtagcgtatggtggaaattggaccattgatcgtgcgttaatccttgagggtttagccggtacagatgtgttgaatactaccattaatggggagggtgaccagaagtttttgttagatgtcttggtcattgtcaatggtgagcgtcagtcattagttgtaaatgtcgactga

SEQ ID NO: 2876 - DNA, 267 bp, A.fumigatus
tccctctttgagcggaccagaaaagtagacctggatgctacagcaaccacaaagagcgtcttcgacgacccagtgctggccaaatactacctcccgcatccacaatatgaaaacatgcaccgattcgatgctgacttccggtggacctatcgggaagagatagctgtcagacgcaagacagacctcaagatcttcctctggatcctggtgatgtttttcggccttaaccttgaccgcggaaacctaggtaatgcccctgccggatag

SEQ ID NO: 2877 - DNA, 687 bp, A.fumigatus
  unsure (508): Identity of nucleotide sequences at the above locations are unknown.
tccttccagccccgtggtgaagactcgccttccctgcgaggtttgaatgaattggtcgagaacccctatttcggcgggacaagtgtcagggtgccctacaagacagaagtcattccccttctccactccatgtcaccgcatgctcgggctatcggagctgtgaacacgttgatacccatccggaagtttcccgatggcgtggacacagctattgagtcctccctttatcttgagaagagccgggctggtcccaccaaggcgttgcatggagataacaccgactggatcgggataggaaattgcttcagaagaggtctgtctcctgcaaatgccatccgtccgtcgtccacaggtctggtcattggagcgggcggtatggctcgggcggcagtgtactcaatgatccacctaggggtgcaaaacatcttcatctacaatcgtaccaaggccaacgcagagaagttggctcaccactatacccgacagaatcttttggcgcatggatggnaagggcgaactctcgctcgaaagtccacacctacagtcccttgcaggatgactggcctgcgaagtacaagccgccaaccgtcatttgcagctgcatacctgctcatagtatcggaggagtgccagctcccaactttcagttaccttcgcaatggcttgggagccctaccggaggcgtag

SEQ ID NO: 2878 - DNA, 291 bp, A.fumigatus
gcatcgcttcaagagacgaaggctaatatcatgcagctggcctacaaacctctgaataccccgctcatgaagcaaatgcgcgccctttcccatcgaggctgggttgcccttgatgggctcgatgttctcccagagcagggatttgcacaatttgagcttttcacgggtcgtcgtgctccacggcgagtaatgcgccggatcgtgttgcaggaatacaaggaagtggaaggacaagatgagcaaagcgccatccaaagtaggcttgaaaatctagacggacagcccacttga

SEQ ID NO: 2879 - DNA, 486 bp, A.fumigatus
  unsure (233): Identity of nucleotide sequences at the above locations are unknown.
caccgactggatcgggataggaaattgcttcagaagaggtctgtctcctgcaaatgccatccgtccgtcgtccacaggtctggtcattggagcgggcggtatggctcgggcggcagtgtactcaatgatccacctaggggtgcaaaacatcttcatctacaatcgtaccaaggccaacgcagagaagttggctcaccactatacccgacagaatcttttggcgcatggatggnaagggcgaactctcgctcgaaagtccacacctacagtcccttgcaggatgactggcctgcgaagtacaagccgccaaccgtcatttgcagctgcatacctgctcatagtatcggaggagtgccagctcccaactttcagttaccttcgcaatggcttgggagccctaccggaggcgtagtagtggaggtaagttctaggcatcgcttcaagagacgaaggctaatatcatgcagctggcctacaaacctctga

SEQ ID NO: 2880 - DNA, 531 bp, A.fumigatus
cagcatgataatgctgactattccgagaaccatcctcccccaccgcaccccccccccccctgctcaccccacacctcctccaggcctgtacaatggcgtccgacctgcgggattccccaccccccccctcccccccaccccccccctcccccgcacccccccacccctcccgcggcccctacaccccccccaacgaccctcgcctctatcacaacccccccccccacgcccccgccatcaccccccccccccccccgctccccccccctactccgtcccccgctctcacgcctcacccgactcccccaccccccccccccgcctcaccccccggccacaaccccacctctctccccccccccgcccccccccccccccccagccccccctccccccccacccccccccccctccccccccccctcccccgcccccccccccccccctccccccccactgccccccacccccccccaccccacccccccccgccctcccccccccccccccccccacccccccacccccccc

SEQ ID NO: 2881 - DNA, 585 bp, A.fumigatus
ttgtcatcctccgtaaggtccattaggcctagcatcatggttgggatcatggttgacagcatgataatgctgactattccgagaaccatcctcccccaccgcaccccccccccccctgctcaccccacacctcctccaggcctgtacaatggcgtccgacctgcgggattccccaccccccccctcccccccaccccccccctcccccgcacccccccacccctcccgcggcccctacaccccccccaacgaccctcgcctctatcacaacccccccccccacgcccccgccatcaccccccccccccccccgctccccccccctactccgtcccccgctctcacgcctcacccgactcccccaccccccccccccgcctcaccccccggccacaaccccacctctctccccccccccgcccccccccccccccccagccccccctccccccccacccccccccccctccccccccccctcccccgcccccccccccccccctccccccccactgccccccacccccccccaccccacccccccccgccctcccccccccccccccccccacccccccacccccc

SEQ ID NO: 2882 - DNA, 513 bp, A.fumigatus
ctattccgagaaccatcctcccccaccgcaccccccccccccctgctcaccccacacctcctccaggcctgtacaatggcgtccgacctgcgggattccccaccccccccctcccccccaccccccccctcccccgcacccccccacccctcccgcggcccctacaccccccccaacgaccctcgcctctatcacaacccccccccccacgcccccgccatcaccccccccccccccccgctccccccccctactccgtcccccgctctcacgcctcacccgactcccccaccccccccccccgcctcaccccccggccacaaccccacctctctccccccccccgcccccccccccccccccagccccccctccccccccacccccccccccctccccccccccctcccccgcccccccccccccccctccccccccactgccccccacccccccccaccccacccccccccgccctcccccccccccccccccccacccccccaccccccc

SEQ ID NO: 2883 - DNA, 516 bp, A.fumigatus
gaatcaagcttatcccacgtagctttgacctggagccgtctcttcacattacagcctatttctaacctctctacatatagggttttttatactacagctcagcatgtcccctctccatctcctccctctcctcatctccctcctccccatcccagtcctcacaaaccccataaccccaagagcaaccccgacaacctgcaacggcaacccagcctattgcacccgcctctactccaacatcacgttcctcggcgcccacgacagccccttcgtcggccccctcccgcaacaaaaccagaacctcgaggtgacggaacaactagacctcggcatccgcttcctccagggccagacacacaagaacctcgacgagagcgacacggcgctccggctatgccatacctcctgtctgctcgaggacgcggggaccttgaagtcgttcctggagaccgtgaaggggtggctggatgcgcacccggacgaggtcgtgaccctgctcttgaccaacggggataa

SEQ ID NO: 2884 - DNA, 717 bp, A.fumigatus
cctggagccgtctcttcacattacagcctatttctaacctctctacatatagggttttttatactacagctcagcatgtcccctctccatctcctccctctcctcatctccctcctccccatcccagtcctcacaaaccccataaccccaagagcaaccccgacaacctgcaacggcaacccagcctattgcacccgcctctactccaacatcacgttcctcggcgcccacgacagccccttcgtcggccccctcccgcaacaaaaccagaacctcgaggtgacggaacaactagacctcggcatccgcttcctccagggccagacacacaagaacctcgacgagagcgacacggcgctccggctatgccatacctcctgtctgctcgaggacgcggggaccttgaagtcgttcctggagaccgtgaaggggtggctggatgcgcacccggacgaggtcgtgaccctgctcttgaccaacggggataatgtgcccgtggcgcgcttcgacgaggcctttgcgggggccgggttgagggactatgcgtttgtgcccgaggggagccccaagacgttggcaatggatgcgtggccgaccctggcggcgttgatcgagaaggggaagaggctggtggtgtttctgggtgagtatcagccatctgtcacaggcatgttcgagaggtatgtgcgactgaccatggttagattacggcgctga

SEQ ID NO: 2885 - DNA, 450 bp, A.fumigatus
cagatggctgatactcacccagaaacaccaccagcctcttccccttctcgatcaacgccgccagggtcggccacgcatccattgccaacgtcttggggctcccctcgggcacaaacgcatagtccctcaacccggcccccgcaaaggcctcgtcgaagcgcgccacgggcacattatccccgttggtcaagagcagggtcacgacctcgtccgggtgcgcatccagccaccccttcacggtctccaggaacgacttcaaggtccccgcgtcctcgagcagacaggaggtatggcatagccggagcgccgtgtcgctctcgtcgaggttcttgtgtgtctggccctggaggaagcggatgccgaggtctagttgttccgtcacctcgaggttctggttttgttgcgggagggggccgacgaaggggctgtcgtgggcgccgaggaacgtga

SEQ ID NO: 2886 - DNA, 216 bp, A.fumigatus
cttatctcggatcggcgcgtccgaggtgaagacacaatgagactcggagccttcgctctccgttccacctctatcacggctaagcctgccgtgcagtccgctgctttcaacggcttgcgttgctattctactggcaaggccaaggttcgtgacgcttgttcggggtcaattgacatgtttcgagctttctttactgatagcttcttcttcttttag

SEQ ID NO: 2887 - DNA, 564 bp, A.fumigatus
  unsure (400): Identity of nucleotide sequences at the above locations are unknown.
gaatactcaggtctcttttggttgctgctgactggtgagatccctactgagcagcaggtccgcgacttgtctgccgagtgggctgctcgctccgaccttcccaagttcatcgaggagctcatcgaccgctgccccagcactctccaccccatggctcagttctccctggccgttaccgctctagagcacgagtctgcctttgccaaggcctatgctaagggtatcaacaagaaagactactggaactacacctacgaagactccatggatctcattgccaagctccccaccattgcggccaagatctaccgcaatgtcttcaaggacggcaaagtcgctcctatccaaaaagacaaggactactccttcaacttggctaaccagctcggctacggtgacnacaatgactttgttgagcttatgcccctggtacctcaccatccactccgatcacgaaggtgggaaacgtcattggcccaaactacctcacctccttgggattgctctgaacctcgccccagctcctctctggctggcgggtctccaccgctttggcttggtccc

SEQ ID NO: 2888 - DNA, 450 bp, A.fumigatus
gactcggagccttcgctctccgttccacctctatcacggctaagcctgccgtgcagtccgctgctttcaacggcttgcgttgctattctactggcaaggccaaggttcgtgacgcttgttcggggtcaattgacatgtttcgagctttctttactgatagcttcttcttcttttagtccctcaaggagacgttcgccgataagcttcccggtgagatcgagaaggttaagaagctcagaaagtaagcgcgcagcgtattgggaattaccacctaccatacagcgagtgctaatcaagcgagcggttgttcacagggagcatggtagcaaggtcatcggcgaggttactcttgaccaggcctacggtggtgcccgtggtgtgaagtgccttgtttgggaggtaggtccagagagcctttttccttctccctcagtctcagtgataatttga

SEQ ID NO: 2889 - DNA, 1005 bp, A.fumigatus
tgtttctccccttggttgcaattctcccattacagtggccttggtttctcaatctgctgtcgactggtggatgaattcttgaaatctcaccgacatccccgcgagtctctgaccgttattttcaccacgcggagcaccaggaagggaaatgacactctccttcgcctacaggatcaccttcggcgcgcctctgcctctgcctctgctcccgccgcagcatccgcacgagtcacctttgtggctgagaacgtcgacctgtcgaacctcgtctccgtccgggccctctcccgccgactgaacaagaccttccctaaactcgatgcgatcgtgctgaatgccggcctgggcggatggacgggcataaactggcccaaggcaatctggggcgttatgacagacctcgtgcacgaagtctcctggccatctttcaaaatcgcgcccgcgggaatggtgacggatgcccagaccgcactgggcgacgacaaggaaccgcgtctcggggcggtcttctgcgcgaacgtcttcggccactatatgctagcacacaatgccatgccgctgctgcgacactctgacatgcttcacggccccggccgcatcatctgggtttctagtctcgaggcgactgtgaagcacctcgacatcgacgacatccagggcctccgcaccctggccccctacgagtcctcaaaggctttaaccgacatcctggctctgacagccgatctccccagcacagcaccatgggttaaaagcttctactcggtcgacgagcaaccagaaccccgcaaagaaacagaactagaacccccgcacccaaacatgttcctcacacatcccggcatttgcggcacaggcatcctcccgctctcctggcccctcttttactccatgctcgcggcattctggctagcccgcctcctcggatccccctggcacaccatctccacctacgcaggcgccgtcttcaccacacgggggaggaaggcaccagcgcaagcgtga

SEQ ID NO: 2890 - DNA, 207 bp, A.fumigatus
atgtctcccagggagctccaagctgttgtggtttgccaaggcatggattgttgcgcatggcgcgtatatcccccgcgactccatggaaacggcgagagtaaggctgcgtgtccttcaggaatcaagttcgttattccatcagtggctatctctcttgccgaagcagatatccagattctgcatcatgagaatgaccaccgtctctaa

SEQ ID NO: 2891 - DNA, 186 bp, A.fumigatus
ggcacaatggcaaagttggccccattactcgcagcgatgaagaaggccatcaagaccaccagtccaaacatcagcccctccctctttgggtccagcagtccaacagctagcgccgctgcccccatacacacccccagacaaaccagccataccttcttcccccacaccgaccgggtataccgatag

SEQ ID NO: 2892 - DNA, 1044 bp, A.fumigatus
ttgccttgcggttcttcatcggaatcctcggagcaacctttgtgccctgtcaggtctggtgcacgggcttcttcgataagaacgtcgtggggactgccaacgcgctggcggggggcttcggcaatggcggcggcggcatcacctagtatgtttctccgccttgactttctatgtgcaacgctcacatccctcagcttcgttatgcctgccatctatgactccctcgttcactcgcaaggactgactccacaccgcgcctggcgagttgcatacgtggtccccttcatcattatcgtcaccctcgccttggcgatgcttttcctctgcgaggataccccgacgggaaaatggtctcagcggaacgacaacaaccctgtaatgcagagcaatatcgtcgacctccaccggcccagcgcatccggcaccccgtctagcattaatgtctccaccgtcccggagaagaagggtgtcgccacgccgcagattgtcgacaccgaagcgcaaccggttatcgatatcagccttgccaacaatgagacgattaaaaacccaacgcttcgagaagcactgcgtgtggcattctccctgcccacactggcgctcgctctgccgtacgcctgctccttcggcgcggagctggccatcaactccatgctcggcgcgtactatctgaagaacttccccagtctgggtcagaccaagtccggccggtgggctgcaatgttcgggctggtcaatgtcgtctttcgccccgcgggtgggttcatggcggatgtcatctatcggtatacccggtcggtgtgggggaagaaggtatggctggtttgtctgggggtgtgtatgggggcagcggcgctagctgttggactgctggacccaaagagggaggggctgatgtttggactggtggtcttgatggccttcttcatcgctgcgagtaatggggccaactttgccattgtgcctcatgtgcatcccactgccaatggtaagctcagcgtcttcttccgtcaggcgtacgctaataggcccaggaatcgtctc

SEQ ID NO: 2893 - DNA, 903 bp, A.fumigatus
  unsure (891): Identity of nucleotide sequences at the above locations are unknown.
ttctccagcagtcggtgcgctgacattgccagttacttcacacccaagtatatcgagggcctcggcacatttcaagacggcggtgtcagagtgaactgtcccctgcggactgcactccgcgagagtgaggtcctctggccatcacgtaaaaggccagacctagtcgtcagcattgggacgggctacgcgtctgagggatcgtcatttgacgagaactcgacacacgctttcctgaaaggcgggtttattgaccgagctatccgcacatttctatcgtctccggccgtcgacggaaggcgaggttggaaggatgccctagatagtgtccctcaggacgtccagaagaatgtgttccgattagaccgtatcctgccaggagaattgcctgaattagacgacatcaacgcgattgatgagctagatcagcatgactaccgtatatcggaggaacttaccaaagcatggtttgccaaggctctttttttcgaacttgaccaggagcctaccttcttgcagaatcactatgaatgccggggatccatcctttgctgcaagcatgacgccgcaggaatcgtgaagcagattgcagcaaggttcccagaagctcgatttgcgctttctcgcgggagtagtcttggagatgtcgacggagagtatggatgctcgaagtgcgggtactacaggaagcgggtctcgttcaaagtctccaaccttcacgaaacagtagacctgggtgtcaccggcaccacagggttcatctccattgggggcttccctactacagtccagtgcctgctggaaaaccaacaggctgattcacccttcgggcgaagtgaccacagccgagatcgatggccaccgtctcgcgggtgttattgcagcacgcgcatnttcacctcgtag

SEQ ID NO: 2894 - DNA, 189 bp, A.fumigatus
aatagaagtcaaaacgcgtttggtgatccgctcggttgcgtgatccgctcgcttaccgattacgttatcgataacatgatgactcagcaagttgcctgtccaacgccgatcgcccaaacaaaagcgtcattcccagccccccctaattatatccaaccaccgcaatttcaagggttctacgttgcttga

SEQ ID NO: 2895 - DNA, 441 bp, A.fumigatus
gcgagcggatcacgcaaccgagcggatcaccaaacgcgttttgacttctatttcaaaagctgcagtgctcagccagccactatgccaccaaaagcgcgtataaactcaaaaaattcagttgagcaggagggaagggtcctacttgcagtatcagctttgaaaaataaggaaattctcaatattcgtgaagctgcgcgtgtctataatgtgccttatactaccctccagcggcgcctaaaggggcatacttttcgagctgaattacgcgtaaatggctataaaatgactcagaatgaagaggattcacttattagatggattctatctatggatcaacgtggagcggctccccgaccgtcctatgtacgagaaatggcgaatatcctgcttgcgcagcgtggttcaactcctacccagactgttggagagtcttcacccggg

SEQ ID NO: 2896 - DNA, 192 bp, A.fumigatus
atgatcgcgatcacttcgggaaagaaacggcttgaccttgctggccctctgcttgccaatctcttccgagttttgttcacgaaagtgactcgggatctccagcgatatgtccagagatgtgttggaactaatcgtgaaatctaccttaacctccgtatcaaggctattaccttgatgggatgtctgaaataa

SEQ ID NO: 2897 - DNA, 1395 bp, A.fumigatus
tcaacacggaagaggaatcttttcttgtttgagcgcgtcgctccctccctgcgctcaacacattcttacatcgatcgaccgcctcaaaaccgaatccgatttccgtcaaaatggccgaatacgatgatgcgtacgaggatgagttctacgatgagatggaggaggggatcacgtcggaggactgctggacggttatctcctccttccttcgacacgaagggtttggtgtcgcagcagctggactctttcgatgagttcatctcatcaacgatgcaggagctggtagaggaacaaggccaggtcacactcgaccagacgcttcctccttccgaggatgaagacgatcccgtcgttctccgtcgatacgagctcaagttcggaacagtcatgctctctcgcccctcggtcactgaaggtgatggtgcgactaccatcatgttgcctcaggaggctcgtctgcgaaatctcacctacgccagtccgctctacctcggcatcacaaagcgaatcatggaaggtcgggaacggctgatcgcggatcgtgatgaggacgacgcggcgccagatgcggacgaggatagaaaggcccgtgggacatacttgcagtgggaacagaaagagctcccccctgatcaggcgaaggaggagacggtgttcatcggaaagatgcctattatgctcaagtccaagtactgtattctcaaggatctgagcgagcaggcgctttacaactggaacgagtgcccctacgactctggtggttacttcatcatcaacggaagtgagaaggttttaattgctcaagagcgaagcgccggaaacacggtgcaagttttcaagaaggcgccaccaagtcctacaccctacgttgctgagattcgaagtgcggtcgagaagggttctcgactactttcacaattgtctctcaagctttttgctaagggagacagcgcgaaaggcggatttggccccacgatcagatcgactctgccctacgttaagacggatattcccattgttgtcgttttcagagcactgggtgtggtttcggacgaggatatcctcaaccatatttgctacgacagaaatgacacccccatgcttgagatgctgaagccttgcatcgaggaaggtttcgtcatccaagaccgcgaggtcgctttggatttcatcgccaaacgtggatcttctcagtccagcatgaaccacgagcgtcgtgtcaggtacgcacgagagattatgcagaaggagttacttccccatatctcccagagcgagggtagtgagacgcgaaaagccttcttcctgggttacatggttcacagactcttgcagtgtgctctcggtcgtcgcgatgtagatgatcgcgatcacttcgggaaagaaacggcttga

SEQ ID NO: 2898 - DNA, 1002 bp, A.fumigatus
  unsure (241),(243),(377),(414): Identity of nucleotide sequences at the above locations are unknown.
cagagacagggcctatgtggcaggggtggaacatccacacaggagatttggggggaaattattcccttccaggttcacacttttggggttcggttttggggtgggttaatgggatatatttgggttaacatattcccgttaccagcaattcagctggcgctttccactcgcattcagtttttttttggcatttttagcggcttcatggtgccctttcttggggagtcaccccgttggtttngngtaaggagtcgttcttctgccgcaaaagaggtcatcgcacggtttctggacaaacgtctcgaggatgatgaggtacttacttcgctccagtcaattgagactacagttgcccacgagatggagtcgcagaaacntggatggcgaacgattttttccaacgggccgcaacanaccttccgtcgaattgctcttggagttggagtcaacttcatgcagcaatttggtggcgtgaacattgttgcttactatctgcccatcattatgaagcgctccttcggtttcagtgaccgcatgtctctgatcctgtctgctgtggattccatgcaatggatgttttggactggtctcggaactttactgattgacaggctcggccgtcgcaagttgttgatcgtcggcgctgcgggccaaagcctgtgttttgctatgaccgctcttggtcttggtattggcactaaacctctggagggtcttgctgtggcattcatctttgtttactatgctttctttgtaagaaaccccagtgactcagaagccccttaccatctaacctcgcatatgcaggggctatcctttttggctatacccttcatgtacccgtcggaactcaactccagcattcaccggaacttcgcgtgctcggctgctatggtcatggaatggctaggtgtttatgtcattgtggcgatcacgccagttggtgatttagtccctccgcccctttggatgtatcactatttcaatactaactcacactag

SEQ ID NO: 2899 - DNA, 264 bp, A.fumigatus
ctcacactaggcattgagagcatcgcctggaaattctacttggtattcgcgatcgcaaattttgttttcaccatcgtttgctggtttttcgttgtggaaacctcaggactctccttggaggagattgacaaaatgttcgagattaagtactatggcggcaaatatatgacatacctagaggctgccaaaaaagcgaaagggaatcctctgtgccacgaactttgtgaagacggagaaagcaaagacaagcagaggagtttgtaa

SEQ ID NO: 2900 - DNA, 231 bp, A.fumigatus
tcaatgcaggtttacactaatctcttccctgtccgccatacatggtacttgctagggaccatcatcatcttgaatggaatcgactgggcaggttttgaggttctggccattggaaataaagaaatagagacactgccgacaggctatcgcatcttggatggtctgttccaggctttgggtgagggtcttgacggtcatgctcgtctcctggggctaactggagtggtatag

SEQ ID NO: 2901 - DNA, 246 bp, A.fumigatus
gcgcggaccgggcgaggtcacagtggtcctccctgccggaaggcaccagcttggccgacggcgcgccgacagactccccgcatgcacgacgaaacctggcgcgtggcgcaacgccctgctcctcgtcctgggccagatcctcttcgacctcgtcggcagcgtcgacctcgtatctcgggttgtcgaccttgttgtcgatcctcttctgctacacctacatcctccaagcatacaaagacattttaa

SEQ ID NO: 2902 - DNA, 297 bp, A.fumigatus
gaagtacaaatcaataaacctaccgataccccttacacaatgcaagtcctcctcctcggcggccatggcaaggtagcccagaaactaaccccgctcctgctcgcccgctcctggaacgtcaccagcgtcatccgcaatcccgagcatgagaacgcgatcctcgccctgggcaagggcgcaaggggcaaactctccgttctcctatccagcctggaggacgtaaaaagcgacgatgacgcgaagaagatcatcgacgccgtgtccccggattacgtagtttggtcggccggtatgtaa

SEQ ID NO: 2903 - DNA, 357 bp, A.fumigatus
gttattctctgccattgcatcaattgcaaacgatacactggctctggcttctccgccaacattgccgtaccgaagacaagcctgcactggaccaagggccagccgaaactttacgtcgacaagagcgaacgcggcactggtgttcctcggatgttctgcggggactgcgggacgcctttcacgtccgagccgagtggtcaggatgaagttattattatcaaaacggggacactagatgatccgtaccgggatgaatgtggggagctggcgatggagatctggtgtgttcgcaaggataagtgggttgaccagatgaaggatgagagcatcacgcgactggacaaatctatgggctag

SEQ ID NO: 2904 - DNA, 777 bp, A.fumigatus
tcccggggtggaagcagtgaaccccggaggacccgaattttgccaaaggctgaaaagaaaacaacccggtcgattgaattcttcccaagagggttaggagaccgaattaacaaaggaattacccggattacccccgtttccgggaattgtggagggagtaactcgccgagtcggcccagttatccaagaagttcatgctccatgtggcaggatgtttgttcgctcccgcagaccacctttgaggcgttcaggggcaacatggaccggctcaagtttatcaagtaccggcagtcgccgcgggggtcgcagggggtcgttccgcacaaagactcgagcggggtgtttacttttctctcgcaggatgatacggggggattgcaggttctgaacaagaaaggcgaatggatcgatgcgccgcccatcgagggaagtctggtggtgaatatccagcagggatttgaagctatcacggggggggtctgtaccgccaccacgcatcgggttattgtgagtctctgttttacgctttatcttggccaccggtctgacgttgaaaaggcacccacgtccaaaacgagatacagcatcccctatttctccgcggtgcggatggacctcaccctagcccagctgaaagagtcggcggcgcatattgtgcagcggatcccggcgtcggacgatcgcaagaagcgggcagtggatgtgccgagcgagttcctgtcgccgttgtactcttgtgtaagtctcttgctgccatgtgctcccttcgcggtctga

SEQ ID NO: 2905 - DNA, 357 bp, A.fumigatus
ataaatcttacacctcccacccggatctccccagacaaccccatcgctatggccaaagtggctgccctcggactgctgctatgggcaatcccctcggtggccgtcatcgcaaccgtgaagtccccctgtttgtccgtctgcggaggcacccagaagacgatcggcgacgagctgatctgcaacgatggcgattacaatgcgacgacgaaagggctgacgatgaagaactgcctcctgtgcgagagtaccagtacgacctactcgagccagttcgacagtgacgtctactggttcatctgtatgcatgctctctcccttgattcccccaccacataccacaccggggcacatggctaa

SEQ ID NO: 2906 - DNA, 294 bp, A.fumigatus
tccggcgtagtcaaccagaaatacaccatccaggtctgcgtctatgagaattccgcctcgacctcgctgtccccctgcgagtcgcaatgtctccccctgaaacccgtcttcgagaccctctggtggaaccgcaacgtgtcgctgttcaactactgcacgcagaacaacaatgcctttccgacctacgcgaacggctgctcccagtgtctgatgggcaacgcgggctccaacgtcctgggcaatttaatggaaaatatgggctccgcgtgcaaaacccaacccatcgccacctag

SEQ ID NO: 2907 - DNA, 540 bp, A.fumigatus
atcgaacttcggaacgcatatctcgctcaccatttagtcgctatttactaccaccatcgacaaaagaggcaaccactcgggaacatgactgccgaaaaacttcgcattatcatcgttggatctggcctggcaggtctagctgcggccaggatccttcgtgagcatcacgatgttactgtctacgagcgcggtggtccggatacggccaccggtggacagggtatctgtctgttctctaacggagtcaagatccttcaaaccatgggatttgatcggtatcgtgccggtggcgttccatgttacggttaccggctgtttgacaaagacggcaatcaattgcaggacttcccagttgacttcaagaagcgttatggagccgataccctcagtatgaagcggtctgatttccgtgacgagctccttcgactcgctactgctccatcggatgaactcggtattcaaggcagtccggcgcagatggtgttcaatatcaggtcatcagcccggggtcgacgaacgcgtacgaacgcgtcagaaggg

SEQ ID NO: 2908 - DNA, 183 bp, A.fumigatus
ttgctgctgatgcttccacaaatcaccgccgaatctaccctttctcataatcaagagctgatgctatgccaatgctcaaatttgattctactgtttcacacgtatggagcaataagcaattgcaatatcgacgaggtctgggctcagcctgcctcttccaaggaatttatggagcgaaagtga

SEQ ID NO: 2909 - DNA, 408 bp, A.fumigatus
  unsure (166),(387),(395): Identity of nucleotide sequences at the above locations are unknown.
atgactggtctcaaccccgagacagacaccatcctccagatctgctgttacataaccgacgccaacctcaacctcctcgacccagaaggcttcgaaaccatcatccaccacgaccgctccgtcctcgactccatgtcgccgtggtgcgtcaacacccacggtcgcnaggggctcactgccgcagtcctcgcatccacgaccaattccactaccgccgccgaatccttgctcgcctacatccaacgatacgtgcctcatcctcgcacggcgctgctggcggggaacagcgtgcacgctgacaagatgttcctcgccaaggaaccgtataaggctgtgctggagtggctgcattatcggattctcgatgtgagtgcgttcaaggaagcngcaaagcngtggggggggtga

SEQ ID NO: 2910 - DNA, 315 bp, A.fumigatus
  unsure (111): Identity of nucleotide sequences at the above locations are unknown.
ccgacgccaacctcaacctcctcgacccagaaggcttcgaaaccatcatccaccacgaccgctccgtcctcgactccatgtcgccgtggtgcgtcaacacccacggtcgcnaggggctcactgccgcagtcctcgcatccacgaccaattccactaccgccgccgaatccttgctcgcctacatccaacgatacgtgcctcatcctcgcacggcgctgctggcggggaacagcgtgcacgctgacaagatgttcctcgccaaggaaccgtataaggctgtgctggagtggctgcattatcggattctcgatgtga

SEQ ID NO: 2911 - DNA, 249 bp, A.fumigatus
ctcgttttggcttctcctggtgaaaacctcaccacaggtattgcattattatattctactggtggcaatacccattgtctagagcacgagactcagctggcctcatttgtggaccccggggatattttcgctctcagtactgctaatcctagcttggtaggggaagactgtgcatcatgttcatgggccgtacttctaaatttggaggtactcgagcttgtggctttgggcaaggtaactgagtatcag

SEQ ID NO: 2912 - DNA, 525 bp, A.fumigatus
cgggtgtgcaggccaacaccgttaacgaggtgttctccgccatgtatggcttggacggtaaatggctataccctcgcatgcagcccggctctgagctcgccgcgtctttcatctactacagcggaaacgggttcaagtactcagacgactggtacaaatacgtcgtctacaacgatagcaactgggaccactctacctggacgcttgccgacgcagcggcagccgctgcgcaggatcccttccagatctcctccttcgacgggaatatctccggtttccaaaaggcaggcggcaaggttctgcactatcacggcctggaggatgcgatcattacctcggatagctccaaggcgtactacaagcatgttgctgataccatgggtctcagtccctcggagctggaccatttctatcgcttattcccgattagtggaatgggccattgctcgccggggaccggtgcggcttccatcgggcagggttcttccacctatgccggcgatgacccgcaggataacgtgttga

SEQ ID NO: 2913 - DNA, 1110 bp, A.fumigatus
  unsure (52),(161): Identity of nucleotide sequences at the above locations are unknown.
cgccctgcacacagggaacagtggttggggaaagcactggaggaagtaattntatccttcaaggataccaggatttcatactatttgggttgctggacagtggccgggcaaggatggaagtcatcccagagattcccagagaatttggacggcgtggtggntggagcaccggccatcaatttggtcaatctctgcagctggggatctcgattcctgaaaatcaccgggccgccaggttcagagacattcgtgacaagcgcgcagtggtccgcggtccacaatgagattctccgacaatgcgatgctctcgatggcgccgtcgatggaatcatcgaggataccgatctctgccagcccgtcttcgagaccctgctttgcaattccacggctgtggacaagacctcttgcctgacgggtgtgcaggccaacaccgttaacgaggtgttctccgccatgtatggcttggacggtaaatggctataccctcgcatgcagcccggctctgagctcgccgcgtctttcatctactacagcggaaacgggttcaagtactcagacgactggtacaaatacgtcgtctacaacgatagcaactgggaccactctacctggacgcttgccgacgcagcggcagccgctgcgcaggatcccttccagatctcctccttcgacgggaatatctccggtttccaaaaggcaggcggcaaggttctgcactatcacggcctggaggatgcgatcattacctcggatagctccaaggcgtactacaagcatgttgctgataccatgggtctcagtccctcggagctggaccatttctatcgcttattcccgattagtggaatgggccattgctcgccggggaccggtgcggcttccatcgggcagggttcttccacctatgccggcgatgacccgcaggataacgtgttgatggcaatagtgcagtgggtggaaaagggtattgcgcctgagtatgtgcgtggctccaagatgtcccgcgatggtacgatagattaccgccgcaagcactgcaagtatcccaagcgaaatcgatacgtggggcctggcaagtataccgatgagaatgcttggaagtgcgtgtaa

SEQ ID NO: 2914 - DNA, 279 bp, A.fumigatus
cattacttggaaacacggcacctacacatcaaagtcagtgcgttttccatcgatttcaccaagcccgaggagagatgcttttctctatgtagccagcaaaggaaagacatcttagcttctcaccggaaccgatacgaattcctgctttcaaacattcttactgctacttaccactctaagaactctgtagaccaggaaataggttctgccattcctggaaccgacagctggcaaagacttataccgtcatcgtcgtccttgtttgttccgtgtatatag

SEQ ID NO: 2915 - DNA, 921 bp, A.fumigatus
cgtggaggagtggacttcgtggtaccggtgatggaagctatatctggcctctcttcgtcaaatgaactcggtcgaaatcatccgcgttccactgaagaaacgcctaagttgctctactgtaccgcaatcaaatctcgcaccatggttaaccacgataccgtcgacctgcccgtcatcgattatgcagccctcggcgaaaaggatgccgcgggctaccgcactgccgtctccatcgatgagcgccgtcgactgttcacggcccttcgggacattggcttcgcatacctgaagcaccctggggtgaaccaggtcactgtggacgaactcttcgcgcattcccggcgcttcttcgccaagccgctggaggagaagatgcagattctcggcaagctcgacaagggccgtgggcccagccaggggtactccaacccgcagcaactggcccacgatccccagacgtcggacctgaaggagttcttcggcatgtatcgcgatgacgacactgagaagcccaatcagtggctgtccgacgccgactcgaaggccatgcggacggatctggtccggttcttcgactcgtgccacggggtcatcctcgagcttctgagcgctctcgcggaggaagtcggtctggccgccgagacgctgcacccgttcatccgcgagaagaatcatttcattgcctgtttgcactatccggccaccgagccggagtcgttccggacgcgggtccgcgcggcggcccacacggactatggctgtctgacgctgttgtttaatgactcgggcgagggtctccaggtgctgcgcaacaatggccagtacgagtatgtgcctcggaaggacgggtgtgcggtgctgaacggtgagccgtccatttccctcattggcaagcagaggaaaccagagataactgattga

SEQ ID NO: 2916 - DNA, 288 bp, A.fumigatus
tctaaaattagattaattctctacaccatagtgactacttacttagatatcactaagataacatccaatctattaaggtatctattaaatccaggactggcccattttgatgcagctaatcgaatcattctatatctctctttaataaaagattatatattagaatatagaagtaacttaacagggaatatctttattattactagtaacactgcctacatagattatatagattatagcagtagtaagggatatctaataaagctatttagtgctgctgttaactag

SEQ ID NO: 2917 - DNA, 666 bp, A.fumigatus
tcaaattttcaaaacgtcgactcccagaaaaaggcttccaccaggttcgcagcagcaaaccaagaagatagtctgaaagacctcagccgttcagcagagtcattctgggagagaggacatttggtgcaagccgaggaaaccgcacggcgtgccctggacgggcaaaaacagcttcttggggatggccatcgcgaaacattgaccacagccactacattggcagggatcctaaagcagcgagaccgcgacgatgaagctgcaatattttacgaaaacatcctgcaaacagctgacgaggtcctcggcggcgaggaccttgttaccttgcgagtcctcaatgacttggggttacttttacagaaacaaaggaagtatgacgctgcgcgtcggatgcatgaacaagccgtgagggcgtatgctgcgcattacggcgaagagcacagttccagcattatcagcatgacgaatctggcgcgagtgatgaaggctcaacgtgactacgaggaggcagaagacctatttcgacatggactggcgctccgcgaggagctgctgggagtcacgcatccggaaaccatggatagtgtacgtttcttgggtagagcaggcggaatcactggtcagagagaccgccggtcgacagctggcactgatgggaggaaatag

SEQ ID NO: 2918 - DNA, 528 bp, A.fumigatus
  unsure (519): Identity of nucleotide sequences at the above locations are unknown.
aggctcaacgtgactacgaggaggcagaagacctatttcgacatggactggcgctccgcgaggagctgctgggagtcacgcatccggaaaccatggatagtgtacgtttcttgggtagagcaggcggaatcactggtcagagagaccgccggtcgacagctggcactgatgggaggaaatagtccagacctgctacagtgtatgagcagttttgcaatactcatgctggaccatggtcgcacggatgctaccgtcgaaatcgccaagcgagcagtcgagacccgaaaacactggaaggataagcatgccctagatactgtagatcccaacacgctcacgtcattgaacaacctggcaggcgtgctacagagttgtggccaccattactccgccgaggaaatccaccgagaggtcctcgagggatcacgtttggtcctgggacccgatcatcccaataccctatcaacgtgcagtaatttggcccagctactagacaagtcttcaccacgcgctggcatncatatccac

SEQ ID NO: 2919 - DNA, 933 bp, A.fumigatus
actgatagttgttgtgctagaccgaccagggactcgatgcagctctgggctgatcttgttcagaaccagagttacacttttgacaacactctcccctattatcaggagacggttcagttcaggcccccagacgcgctgcggcgagccgcgaatgctacagcgcaatacaatcctgatgctttcgctcatgaaggacaacgcccgcttcatgtatcataccctgtttacgctatgcccttttcaacctggatgagacttggagtggaagaggtgggtataaacgaaacgctggacttcaacagcggatcattgttcggtgctcagtacggcagctttactatccgaccctctgatgagactaggagcagttcgcaagccgcctttctgagtccgctaccttcatcagcttatctgaaaatatatcagagtacgatggcaaagagaatactattcaacccacaaaagcaagcgtctggggtacgagtcaccggtctactgcgaactttcaccctcaacgcaaagcgagaggtgatcatatcggcaggtgtatttcataccccacagcttttgatggtttctggagtcgggccggccgatacacttgcagaacacggcattgatattgtccaggatgcccctggtgtcggtcagaatatgtgggaccatgttttctttggaccaacgtaccaggtagctctcgagacttttacgaaagtaccaacagacccatggtatctcgcatcgcaactggctcaatacatattctctcatgggggagtactgacaagtccggtcatcgactatcttgcatttgagaagatcccaaattcctttcgtttgaacttctcagtccaaacaatcagggacctttcgtggtttccaaatgactggccggagattgaggttggtcgcctcgatgtactgctttgttga

SEQ ID NO: 2920 - DNA, 414 bp, A.fumigatus
cagtacatttcaacagctgcttacgtgggaaatttctcgaatcctgttgtctcgcaaccttcgggtggtaagcaatacgcaacaatcctgggtgcccttgttgcgccaacatctcgcggaaatgtgaccattgcctcgaatgatacctcagatctgcctataatcaacccaaattggctttcgacggaagcggatcagcaaatagcgattgcagcgtataagcgtatccgtggtatgtttcacagcacggccatggcgccgattgttgtgggagatgagtacttccccgggagtcagtatcagacagacgcggaaatcctcgaagttattcgcaatacattgatgactatatatcacgctgcctgtacttgcaagatgggaacacgagacgagttttcaccacgccgctggtag

SEQ ID NO: 2921 - DNA, 534 bp, A.fumigatus
ccaggtatgctattgtaccgatcatggatgcaggttcaccgagctcatccagtctacgaacaggttgcgggcgagctccgcaagatgacagccttcatccggcaagaagcgctggagaaggcccgcgaaatccaactcaaggccgacgaagaatttgcaatcgagaagtcgaagcttgtccgccaggagaccgccgccatcgactcgctctacgagaagaagttcaagcaggctgccatgtcccaacagatcacccgctccactcttgcaaatcgaactcgtctccgtgtcctttccgctcgccaggagctcctcaacgacctgttccagcaagcccgcgagaagatctctaccgttgcgtcccatggatgcccagatattaccagaccgttcctcaagggcctgaacctccaggggcctggttcgcttttgaatggaggaccaaggtatccgttcgggggccaggaaataccggattttcagcgtggggtcaaacaatgccattcgaaagaaaccgttgaaaaggaattttaa

SEQ ID NO: 2922 - DNA, 378 bp, A.fumigatus
tacctcccactggtgcttatcaattcggttggactctccaattctatggctcgaatcctgacagcttgcaatgcaatctcatactttatcttctcctgcgtgatcgccacgatggtagaaagattaggacgccgaggattgatgctgctgtctggttttggccagtccctttctatcctggtcatcaccattcttctttgtttcgctgagaataataaggtgtacggcactgcatctgtagccttctttttcttataccatattgcattcggagttggcatgctgggagtgccatggctgtatcccaccgagatcaactcgttgccgatgagaacaaagggagcggccgttgccactgcgacgaactggttggtttaa

SEQ ID NO: 2923 - DNA, 189 bp, A.fumigatus
tgcttatggactcttcacaggattaccaattttgccattgtcgaaatcactcccattggcattcagaatctcggctggaaattctggatcgtatggaccgtcctcaatgcagtatttttaccggtgatttactttttgtacccagagaccggtaagtccgtttggattaattttccattctccggctaa

SEQ ID NO: 2924 - DNA, 219 bp, A.fumigatus
cctcagtcaatccttacagcgaaccgcacgctggaagatgtggatgcctattaccggaccaacccgccgctcattgtcgttcttgatccggatgctatctccaccaagcgcccgctcagatttacccagcacgaagacgaggagcttcagcggaaggtcaaggaagtgcagattgaaattcccaagggggactccgctgacgtggagcatgctgaatga

SEQ ID NO: 2925 - DNA, 873 bp, A.fumigatus
gcaaagcctggagacgttaaagattatttttggagcagtacgcagagtcttttcactgatggatggacgcttgtcttcagtcggatatccagtgtgttcggggacattccaaacggcgagagtgcgacagcggcaggagatacgtctagcagggtgcgtgatacacgctcgattgccgattcgcctcggctcgttcgtgctgcatacaaatctctacagttagtcgcttctgattttatcgctctcttgccacgccaatgtcggttggacctcgtgaattcattatcccgtttcgctttacagcaagaggacttcaacatctcattgacaacgacatcatctttctggaatatatctgattttctacaagggcaaattgaggaattctgcattgagtctcatgtcgaactctcagtcagcgaggagacactttcggctcttgcaagaggtgatgaaccctcggtctcacgaaatgcgctgtggctgctgcttctgcttaggattgtaagccttgcgagggatagcaggctggagatccgaaactgcgcgattcagacccttctaagaatttttgatgcgtacggacaacaactttcacccaaggcatggcgtctgtgtctgaaccgtgttttgttcctaatggttgaaaccatcgaacttgaactcgcaaattctcgggcagcggagaaggccagaggctctgaggtggtccattcctggatagaaacggcagttgtcatgatcaaggggattgccaatctgataactactttttttggggcctatggttggagacagtgcctttggacgcttcctgggaacatctcttgggatatttgtacaagcttatcagctcaaacttcctggagctaa

SEQ ID NO: 2926 - DNA, 324 bp, A.fumigatus
aggtcttcagtactagttattatggaatacacggagcacgatcttttacagatgtccagactaacattgtcgctcacaaggaccattgctgcacccgtcatgtggctgtggccacccgagaccgctttaacagtggtgcctaacatcagtcaccgacattgcgatctaacaggcatcaagctctgtacgcatcatgaggtattttacgatatgaaagcctcttatatctcatccctaccacttcttttctacagagaatccgctctagttattggtgcgagagacaagataaacttggtgccatttatgtgcacatggatatag

SEQ ID NO: 2927 - DNA, 357 bp, A.fumigatus
aatcagttctgtcctttcgtggaagaccggagtataggaggaaggctttcatggggtttccacgatgaagcccagaaggccattgctcagggacagagctggagcaaggtccgtgatgccacagctgaccttcagacttctttgcgtagcatgaagtttgagactccagacaacgaggcagcggtcacagagaaggttagtccagttttccctatcaaaatcggtagtctctcgccactgaccattttacacagtatgagaagatccttcagaccatgtcggagaggttcgcttcagtgtcggacgagtaaggagacgaacgtccggagaggcgatattttctttcatgtttattag

SEQ ID NO: 2928 - DNA, 423 bp, A.fumigatus
ctgacatcaggaattacaatcagtgtcccggtgaagatgcaacgttcaccggccttggcgcggtcgaccatctcgccacgcaagatcacatccatggtgcggggcatgctcccagttggaatttcgtgtgatgactcctgtagtttcaccttttgccagtcgacgaatgtgctcttcccaatatcgaggcgccatccagagcggttcatgcatatgtcgttcgggcactgtgttggctcggtgtatcggaaagtctgttccacattcgagacaacagatttgcactgctcacaaacgaaggtcccaagagagagctcaggccgaatctcagatgttcgagtaacggtaccagaaattgagagcagctttccaatttgggcggtacggagttggcgcagtctagaaaccaaaggcaggttgtag

SEQ ID NO: 2929 - DNA, 1278 bp, A.fumigatus
  unsure (52),(57): Identity of nucleotide sequences at the above locations are unknown.
tttcgcacaaatccccggcaagaagaatttggggtttacacccttgaaggtngactntaccaattgacttctctcaataaccagattctggcggatgcgattgccaaccaatactttggattccaacccttcctaacaagggcccttcacaatttaattgcgaaatatgaacccgaatacttcgtttctcatcgtcaagccagcagtgcctcctcccaggctagctcatccatgatggccgccaatgcaagcgtgaccgaaaaccctgacttggagcggaatatgcgcgagaaaacccgccatcagcagactgacaagctgttttcgttggcattctacaacctgcctttggtttctagactgcgccaactccgtaccgcccaaattggaaagctgctctcaatttctggtaccgttactcgaacatctgagattcggcctgagctctctcttgggaccttcgtttgtgagcagtgcaaatctgttgtctcgaatgtggaacagactttccgatacaccgagccaacacagtgcccgaacgacatatgcatgaaccgctctggatggcgcctcgatattgggaagagcacattcgtcgactggcaaaaggtgaaactacaggagtcatcacacgaaattccaactgggagcatgccccgcaccatggatgtgatcttgcgtggcgagatggtcgaccgcgccaaggccggtgaacgttgcatcttcaccgggacactgattgtaattcctgatgtcagtcaactgggacttccaggtgtacgaccggaggctgttcgcgataacggtgctttccggagtggcgatgtcggtggaggaggtgtcactggtctcaagtcactgggtgtcagagacttgacttatcgactggcgttccttgcctgtatggtcacccctgacaccacaactcctggccagcaatcaaaccagcagttgaatggccaatcccacaacatcctggcttcattgaaccaaaacaatgaaccggaagtcgacgaggacaaagcccaggaggctctccttcagagtttcaccccatatgaagtgcaggacttgaagaatctggtccactcagagtatatctactctcgattggtagattcaatcgcccctatgatctacggtcaccggcagatcaagaaggggttgcttctccaattgattggaggtgtcagcaaacatacggagcaggagaacatgcaattgcgtggtgatattaatatctgcattgttggtgatccctcgacaagcaagagttgt

SEQ ID NO: 2930 - DNA, 1104 bp, A.fumigatus
aaccaaggcagcaagcaggatgtggaagctctggttgattatatctacgacacaaagaagggtctcggctgggacctggactttgtcgtgccatttgccgcaattccggaaaatggtcgggaaatcgactctatcgattctaaatctgaacttgcccatcgcatcatgttgaccaatcttctacgacttctgggttgcatcaagacccagaagcagacccatggcttcgagactcgaccagcgcaggtcatccttcccttgtctccgaaccacggcacctttgggaacgacggtctgtactctgagtccaaacttgctctggagacgctcttcaatcgctggtactcggaaaattggagtaactacctcaccatttgtggtgcagtcattggatggacacgtggcacaggcttgatgagcggcaacaacatggtcgctgagggtgtcgagaaactcggcgttcgcaccttctcacagcaagaaatggcatttaatttgcttggtctgatggcgcctgcaattgtcaacctttgtcagctcgacccggtctgggctgacctcaacggtggccttcaatttatccccgacttgaagagcctcatgaccaagctccggacagacattatggaaacaagcgatgttcgccaagcggttatcaaggaaactgctatcgagaacaaggttgtcaacggtgaggaaagtgaactcctatacaagaaggtgatcgcagagcctcgtgcgaatatcaagttccagttccccactttgccagactgggaacaagacgtgaagcccttgaacgagagtctcaagggcatggtcaacctggacaaagttgttgttgttaccggtttcgctgaagttggtccttggggtaactcccgtacccgttgggaaatggaggcttacggcaaattttcgcttgagggctgtgttgagatggcctggatcatgggcctcattaagcaccacaacggcccactgaagggcaaagcctactcaggttgggtcgacgcgaagactggtgagccagttgatgataaggatgtcaaggccaagtacgagaagtacattcttcacgacggggtcgaagtacgcgtcatg

SEQ ID NO: 2931 - DNA, 444 bp, A.fumigatus
cctttatctagattcgtgttaaagacaaaggagcagagagccgctgagaaagctatgatggacaagtctccattgaacacactaacattggaggactggctcgaatcagaacgtcacaagctcaccggcaacctgacaccggtgaccccggagaccttcgccaagtggaagaaggagcgcctggataagaaggctgcagaagaacaggcccgcaaggccaaggaggccacgggtcgtgctctgttcgagagcggcaactggcgtgcggaggaggagagcgacgacgaggacggagacgacggaacctggaacctggaagccctgcggagggagaccgaaaagctacgggagaagaaagaagaggaacgtcttgcccgactggctggtatttccctcacgccatcatcgaacgacgagaccgttgcccaagagggcgaaggctga

SEQ ID NO: 2932 - DNA, 276 bp, A.fumigatus
acgaactactcatcccggtgttcgataggacaaatgggacgaacagaccttcgcaaagttgttctcagcaagcacggcaaccctcggacgactaccgagaaagtttgcaagtactttattgaggccgtcgagaaccaaaagtacggttggttctgggtttgtcctaatggaggcgacaagtgcatgtacaaacacagcttgccacctgggtatgttccagtaccggtttccaaagcattgtatcccggtgttaacctttatctagattcgtgttaa

SEQ ID NO: 2933 - DNA, 888 bp, A.fumigatus
  unsure (464): Identity of nucleotide sequences at the above locations are unknown.
attccccgccaccggagtacctgcacgaagccaacatccagaacgcgtacgcgcatttggacggctttccgccgcctaacagccgatgagatacttcccgaagtgcaatggggcgtgcgctatcacacgtacgtggtcaactcgccggtatactgcgcgtacctgcttcggaagttcgtccttaatggcgggcagacgagagagtatacgctcgtagacccgatggaggcgtttgagctgtccgggacggggacggggcctgtcaggacggttgtgaactgctcggggctgggattcggggatcctaaatcctttattattcgaggtatgagccgagctctatctcttcaagttctaatacagctgctgataaggctaccagggcaaacgtgtcttgtccgtaacccctgctctgtgaccatcacccgccaaaactcagacggcacatggtctttctgcattcntaggcctctgagcggcggaacgatcatcggcggcaccaagcaaccacacgactggaatccaacaccctcgcttgagacgaggaagcagcttctctccagtgcggagaaatggttcccctttactgaggggagtggtggtcagtttgatgtcatccgtgatattgtcgggcggaggcccgcgagggagggtgggatgaggatcgaggcggagagagtgggaggtgatcgcttcattgtgcacgcctatggggctgggggacgaggcttcgagttatcgtggggagtcgcacaggatgttgtgcagttgatgtttgaaaatgggttggcgcggcagaaagtgtcgttgtacataattcttgaggtcagtactcacggctcgtttacgaacaataaagctctaccagtcgctgattcactctattaa

SEQ ID NO: 2934 - DNA, 225 bp, A.fumigatus
ccgagggttcttaccgccaaaccgcaaggggaaaacaaccaaagcaccccgcaaaatattcataacttcaagcaccttgccaggggaggatccatccttcaggggtccaaatgtttggacggcgaggaacacttagattccccgccaccggagtacctgcacgaagccaacatccagaacgcgtacgcgcatttggacggctttccgccgcctaacagccgatga

SEQ ID NO: 2935 - DNA, 492 bp, A.fumigatus
  unsure (181): Identity of nucleotide sequences at the above locations are unknown.
acatactgcacgaccgacgacagacacgacatgacccacctccaggttaacctctcggccgtcgctccctccgccactccccccatcagcctccccatcaacgtcgccatccacaacccagcagccaccccagtcaccttcgtcaactggggcaccccgttcgacccaaaagccaacctcntgggcgtcttccagatcaacgacaccgccaccgatcatccaatcaccctcgacaccatcaagttccagcgccggctgcctccgtcgcgggaggatctcgtcgagatccccgccgagagctccatggagcggaccattaccatcccacatgtgccgctggaagaaggccacgagtacgccgtgcaggccaagggcatctggcatggaatctgggagtgtgcgcgcaaccaggtgacggatgcgcagctgcaggagctcgaccagaggggggagtttgagtcggagcgtgcgctgttcaaggttacgcagtag

SEQ ID NO: 2936 - DNA, 408 bp, A.fumigatus
  unsure (131): Identity of nucleotide sequences at the above locations are unknown.
cctctcggccgtcgctccctccgccactccccccatcagcctccccatcaacgtcgccatccacaacccagcagccaccccagtcaccttcgtcaactggggcaccccgttcgacccaaaagccaacctcntgggcgtcttccagatcaacgacaccgccaccgatcatccaatcaccctcgacaccatcaagttccagcgccggctgcctccgtcgcgggaggatctcgtcgagatccccgccgagagctccatggagcggaccattaccatcccacatgtgccgctggaagaaggccacgagtacgccgtgcaggccaagggcatctggcatggaatctgggagtgtgcgcgcaaccaggtgacggatgcgcagctgcaggagctcgaccagaggggggagtttga

SEQ ID NO: 2937 - DNA, 528 bp, A.fumigatus
  unsure (510): Identity of nucleotide sequences at the above locations are unknown.
cctctccacggcgctgtagcctgtagtaacttatgccttctatctcaagtcaatcagtccatcagtccatcatcgtgcggtaaggcaacaatgcagacaacgattgatatcccgactgacgcagcgcgcgtgttctccatcctcgctcaaggcggaataggcatcgtcccctcgagcgtcggctacggaatcatagcgactgagcctcccgctctgcagcgcatctataccgtcaagcgtcgccagccgcacaagcgccacgccatcataggcagctacgcgctgcaccgcgagatccacgtcctcccgccggacaagatggctctcgtgcgctggctgacggtcgatctcaacctcccgctgggggtgatcgcccggtaccgacgggatcacccgctcctcgccagactagacgaagaaacccgagcggcgagttcaatggacggcacgatggccatgcttgtcaacgggggtccgttccaggaagagttggtccgggtggctgctgcngctgggcgggcggtgctg

SEQ ID NO: 2938 - DNA, 243 bp, A.fumigatus
cctgtgttttctttccttcttccccctcttttcacctacccttcccctctctcggtccttgcctgcccctcgttctctccctccgttcctctttccctcttcccctctctcatctcccacttccaattactatgttcacttctatctatcttccattttcttatccccgttcccttcatctttcttccctcctgtacccttttttccccttcttccttcccttacatcttattccttctgtag

SEQ ID NO: 2939 - DNA, 1716 bp, A.fumigatus
tgctgcggtcccttccagccccgtggtgaagacgtgcagagcgagcggctgaagaaagtcctcggagaagtactcgatggctatccaggcgtgaccatgaccttggaacgagtggaattccgcagtcctttcaagcctttcgttcatcgatgggagcgatttgcgagtgcgcgtgaccaggagctagactcggtgaccaaatcgcacgtggaccttctctacactaccctcgaagaggagctacgggatacgattgcccgtaaaaatgaccttgtgctcaacggtgtcgttacccacgatctgctctggaccatcttcgagcccgaggatgagatcttcagtatggttgacggtcgcccccgagcctttcggttcaagtcaggagagacaaattgtcggaccggcgcatttgatcttgaagcccaatacattgatttcgacggtgaggacttcggtttccgcgacaaggacttcgaagtggtaccgtttggtggcaccatgcccatcactgctcttccggtatttcccctaagacatcatagtgaccagatatccattcgtgacgccttgatcgctcgtggagcagtctgggagacttacaaggggtatcatttcaagtattacgaaggcctggctgttggtcggtacatgagaagggaattcaagttcaacatcaaaagccgcatcatcatcgacgcggaggcattcaacaccttcaacccagacgagtctgtctcagtgtaccctacttgtggaaatgaacttaccgatgacgagcgactgctggccgctcccactttgcgtggatattcgctcaaagagaaacggtggctggagttcaatcttgacagtgtcaaggagatcgtgtgggattcacaagccttcgattccctggtactgccgcaggatcaacaggatcttaagacactgattctggcctttgccaacgcgcagtccaaacaagcggattcgtttgacgacgtggtccagggcaaagggcgcggaatcatcatgcaactgagcgggccgccgggtgtcggtaagacactcactgcggagagcgttgccgaagtgatgaaggtaccgctgtatgtgatgagtgcgggagatctagggacttcggcctcgagggtagaggatgcgtttaaagatatccttcggatggttctcaactggggaggatcgctcctgttccactatacatatgtctccttcccatccccccctctctccgactttttttccactcaccattgttccaccttccctccacctctcccctttttaacctgtgttttctttccttcttccccctcttttcacctacccttcccctctctcggtccttgcctgcccctcgttctctccctccgttcctctttccctcttcccctctctcatctcccacttccaattactatgttcacttctatctatcttccattttcttatccccgttcccttcatctttcttccctcctgtacccttttttccccttcttccttcccttacatcttattccttctgtagttagtgccccttcttccttctttcctctcgctttttcctttggtactcctcttcttatccacttggcatctaacggtctttcttcttctcctccgggttatcatctctcttttctctatcgttttctgaacttccccttcctttatctatccctccccttctctctctctatttgctcttccatc

SEQ ID NO: 2940 - DNA, 243 bp, A.fumigatus
tctatacacacattcgctacagatgccatcaatgaattcaccgttgtccggtccatctctgatatgccacacagtgaactgtgttcttactgctatgtcacccgctacaagatgatgcaagcgactccgtactctatttacgacaagacttatcagtctgacctagagttcattcattcgaaatgcgggctcagcgggccgaccagtatcctcccaccgctgcaggagtccccagacccataa

SEQ ID NO: 2941 - DNA, 198 bp, A.fumigatus
ccgcccacagtgggagttggcataaagtccgctatctccgccgactacgtcaacagccgatttggaagtttggaaggtcatcatccatcaccattcgttcaagaggtcatagccttcacttttttggtatacttgttgaattatgatatctactggaacccttttgtctctatagaatgcacaattagagactggtaa

SEQ ID NO: 2942 - DNA, 864 bp, A.fumigatus
  unsure (118): Identity of nucleotide sequences at the above locations are unknown.
tctggagcagtagccggcctcacagtcgattgctcgctgtatcccctcgacacaatcaaaactcgtctacaaaaagctagacatcatgctccaagcacaccagggtccaccctgtcgntaagacaaaccatccgcggcatttacgcgggtctcccgtcggtgctgttcggctccgccccttccgcggcatcctttttcatcgtttacgacggcgtcaaacgctctctctttcctcccgctggctccgacacggccgcaactcgctcccgcatcgtcatcacacactcactcgcctcctcgatgggcgaaatcgctgcatgcgccgtgcgggttccgacagaggtggtcaagcagcgggcacaggccggtcttttcgggggatctagtctcctcgcgctcaaggatatcctggcgctgcggcacccggacccgacgggcattgcgaagcgcgggtacgggcaggttatccgcgagatgtaccgcggggcggggatcacgatcgcgcgggagatccccttcacggtgctgcagtttaccatgtgggagtcgatgaaggaggcatatgccaagcgcatgctggtgccatcgacgcgggagtcgggcgccgtgagtcagattcctgcgtcgacgagcgcgatgtttgggagtgttgcgggggccattgcggcggggctgaccacgccgttggatgttattaagacgcgggtgatgctggcgcggcggggcgaggggggggacgctcgcgtgcgcatccgcgacgtcgtgcaggagatctctggggaaggattcggggcgttctggcgcgggatggggccgcgagtggcatggattttcttcaccacgccggctggaaggtcatgcaat

SEQ ID NO: 2943 - DNA, 1068 bp, A.fumigatus
cgcggttccttcgccccccgtggtgaggacgaaattgcaaagatgcaggcggaggcaggaggaaacgggaatgagatggacgactacgcgcgggtcacttcagcgttcgaagtgacgacattagacgatggcgaggaacaaggggaaccagaggataaggaagacccggagcacttggttggttttgcacgactgtactcaggcactctctctgttggtgatgaggtctatgtgctggcacccaaattctctccggagcatcctcatgcacaccctgagccacagaaggtgacagttacggatctatatctccttatgggcaggagcctggagccgctcaagaccgttcccgcgggagtgattttcggtatcggtggccttgcaggtcatattctcaagaacggaacactttgctcgcagcttgaaggaagtatcaacttggctggcgtctcgctaaacgccccaccgattgtaagagtttcgcttgagccggccaaccctgcagacctgaacaagatggttaccggtctgcgccttctcgaacaaagtgacccatgtgcacaatatgaggtcctccctagtggtgagcatgtgatcctgactgccggtgaattgcatcttgagcgctgcataaaagatctccgcgagcgctttgccaaatgcgagatccaaaccggtcagacaatcgtaccatacagggaaacaattgtcagcgcgccggaaatggcgcctccaaagaaaccagaccttggccgaggatgtgtgttggccgtttctccttcgaaacaattgactgtgaagttgcgcgttgtgcccttacctgaagcagtgacggacttcatctccaagaacgttggaacaatcaagcgtctccagtccgagaaacgctcagcgggtgagaccaaatccgatgcgaaagcaagcaacgggtccttggagaccacacaacaggcagagtccggcgatgcttctggagaagcccgagagggcagtctactttcccaagaagacatcataagggagctcaccaggatcttcaacgaggaggataaggagggcaaagaataa

SEQ ID NO: 2944 - DNA, 306 bp, A.fumigatus
gctaatcggcgtcccaacataggaacatggcatcctctgggacgtgtcaccggtggcacgttatatcccggtctcatggtgacgagcggcgtgatctaccatatcttgcgattccttactatccccgtcgatattcgcaacatctgcgtcctactggcgccaggattctccggcctgactgcattggcaatgtacttgctgacatctgagatgtctccttcgccatctgcaggtcttcttgcagcagctttcatgggaatcgcccctggttacatctcccgatcagttgctgtgaaactacgataa

SEQ ID NO: 2945 - DNA, 285 bp, A.fumigatus
ctgatcactttctttctaccaggcttcgagagtatcatccacgaatgtaagtataggtcaattgtatacctacggccttcggcctttaacggacctcgcttggacgaattgatactgatgctccgtgatatagttgacccgtggttcaacttccgagcaacaaaatacttagtacagaatggtttctatagcttttgggattggtttgatgaccgtatgtggttccccaccgcacaagagtgcatgaagcaacaggtcacctgtcctggagtgcttctaggctaa

SEQ ID NO: 2946 - DNA, 183 bp, A.fumigatus
acgcggaccttccaccccgtggtgaagatctgggcggaacaaacggatctgacccttcttatccttgtaagccttcataccctcgaaacactcgaaagcataatggaacacgcaagccgaagggtcgaggctaaggttttggtacggaacgatgcgaggagcgttccaaccattggccgctga

SEQ ID NO: 2947 - DNA, 315 bp, A.fumigatus
ggagctggtggcaccaaaagatcttgtgttcggaaagaccttcactggtatggctccttattctccggaatacgtgccaatctaggcactaatgcgaatatttctgtagatcatatgctttccattgaatggtcagcggccaatggttggaacgctcctcgcatcgttccgtaccaaaaccttagcctcgacccttcggcttgcgtgttccattatgctttcgagtgtttcgagggtatgaaggcttacaaggataagaagggtcagatccgtttgttccgcccagatcttcaccacggggtggaaggtccgcgt

SEQ ID NO: 2948 - DNA, 888 bp, A.fumigatus
aagcgaaactattgtccagtcccgtctgttaagacaaactggccaacctggaaacacgtccacaagcatctgaccggctacctgcgaatgcaaactggcaatctgccctctggcttggacccgtctccggatcttcaagcaattgcggaaaagaactcggtgaaggaaaccaacaagctcctgaaactgctcctgatcgctgtcattcgctcgccaaacccagagagattcgtcaaccaaatccaggatttgagcctacaggcacaggaagggctcaagatcgcaatcgaggagtcgaacggggaattaattccaagtgatgtcgaggacgaaaccaccgaagacaccaagaaacaggatctttcggtggatctcgagctacaatttgaagaacgagtgggaaaggtgattgcggagaacgatcgcttgacgcatgaaaagaaagagttggagaaagcgctggaagatctacacaaccgactagcgcgcctccaggaaaacaatgacactctgcagagccgtcttgcttcaacggaggatcgcttggtgacgctgaagtccggaaaaggcgacattggggtcagtgcaaaggcattggagtcgaagacgcgtcagcaggaggatttgattgcctcccaggaggagcgaatcgccgcagcgcaggatgagattgacaccttgcgcatgacggtggagtctctacatgtcaagaatcagcgcttccagaaattacaagatgactatgatgaactcaagaccgacagggaccaacttgcacgaaaagccaatgcagcggaaaaataccgccaaaagctgcaggccagtcaggcctttgagaaagagcaccaactgcccctacggaaatcacctatccgcgcttcattgtag

SEQ ID NO: 2949 - DNA, 294 bp, A.fumigatus
cgttatggcccgcggacatatcacaggctcacagcagttggccagtggtctttgcatccattctttggccgatcttcatctgagatctactccaaataccagaaagtttacgagtctaggtattaccatattcagatttcagccgctcaggctcaactgggtcaccactacagtccattgttccacttcaatacaatagttacttttagtttctgcaaattgtcagctgtcaacttgtcaggactccgtaatcctcagtcttcaccacggggctggaaggatcagcgctgtcga

SEQ ID NO: 2950 - DNA, 201 bp, A.fumigatus
  unsure (174),(183): Identity of nucleotide sequences at the above locations are unknown.
ttccactgtatagttttcgctggaaaggatccctcccgggcccttgcctgctcgtctctgaagcctgaggattgcaggccggattggtatgatttggatgataaagagaagacggtgctgagtgaatggtttaccttcttcagcaagaaaatacatatcctccggaaggtgaangatgctacnaactactattgcccctga

SEQ ID NO: 2951 - DNA, 234 bp, A.fumigatus
ccccatcactatggaggaattgtccaaatgcgacggtatgtgattttctcggttggattcgtcaatgatggaaaacaactaactgatgcgctttttgcaggcacggatcccagccggccaactctcgtcgcgattaagggaattgtgtttgatgtgagcaagaatccagcttatggccccaatggccagtatcgcggtaggttgattcttcccctcccgtgcgctgcaaaataa

SEQ ID NO: 2952 - DNA, 246 bp, A.fumigatus
attacaagtgtatgcggcctacctagtcaaagtggtgactctgtcagggtgatggtgatttcgctactacgttactaccttacggactacattggggtatacagaacccgcgttgctagtttgaaaagtaccgcatctagattgaaggtatacaatgatccctacattcctcccagtattctagaagacgcctctaaagtcccattcaataagcgacaagtgacagttgtaaacggtagtctctag

SEQ ID NO: 2953 - DNA, 561 bp, A.fumigatus
atagagcccccgttggacctcctcttccccgcggtgaagacctccgggaaatggaacaaaatgcctatcctgactggcttcaacacaaacgaaggaacatactacgtcccgtccgcaatgtcgcatcggcgaatgggaagcttcttccgcaccttgctccctgcctactcggacaaagatatcaggaccatcgacgagctctacccagaccccgcggtggacccgtcctccccatatcgcgaaactagaagcatacctgtcggaccgcagtataagcgcgtcgaagccgcgtacggtcattacgcatatgcctgtccggtgaggcagaccgcgactctcgcctcggcgggacaagaggagcccgtgtttctgtatcgctgggcgctgaataagacggttcaggggggcgcgaaccatggtgatcagatggagtatgagacgtataatccggaggtgcgaggaatctcgagcagtcaggatgagatcgcggggacgtttcatgcctacatcacttcgtttattgtggctggggatccgaatgcggttggggggaaagtataa

SEQ ID NO: 2954 - DNA, 1089 bp, A.fumigatus
ctggatggcgccgggttgatagctcgtcaagtcggcttacagcactcgcatgtgctcattcactgctcggatggatgggatcgcacggggcagttgagcgctctgagtcaaatatgtcttgatccgtactttaggacgatggaagggtttatggtacttgtggagaaggactggctttcctttggtcacatgttccggcacagaacgggtcctttgagcagcgaaaagtggtttcaaattgaaaacgaaagaattgggggtgattccggccgtccattcggagagggcggtggtgcaagcaaagccatagagaatgctttcctcagcgcaaaaggattttttaacagagacaacacgagccgcgattctctcccagattcggaaggggagatgcaaaattatgactccgacagtccccgaaagccaggttccgcccccagaagcgttgtctccgaaaaggaggtaaccaaggtaaaggaaacaagtcctgtctttcatcagttcctggatgcgacctaccaattgttataccaatatccgacacgattcgaattcaacgagcgctttcttaggcggctgctctaccatctctactcatgccaatatggcacattcctcttcaatagtgaaaaggagcgggtagagatgaaggcgaaagaacgcactcggagcgtgtgggattacttccttgcccggagagagcaatttctcaatcccaagtatgatcctctagtagacgatcataagcgcggcaaggaacgcctgatcttcccacgtatcaatgaagtcagatggtggagcgaagcatttggccggacagatgcggagatgaacggagtccgctctgccagcgtcactccctctgtccgtcgtggtagtcccgcctctgagtcaacgccggtcctgacaggtattgagacagcccatcatgctgtcggaagcggagcttctggcaatgtaaccaacaacgctacctcgaccggaatggcagcagtagcctcaggaatctcaaatcttagtttctcaaagggaaaggagagctctcaggagccgaaaaatctgagtcagatggagcttgaaatgcaatag

SEQ ID NO: 2955 - DNA, 1017 bp, A.fumigatus
  unsure (1011): Identity of nucleotide sequences at the above locations are unknown.
cacttcgatgcggatgatgcaaccatgtctgccttcgacccctccaacgttgacctcaacaccgccagcaaagaagatgtcatctgcttcctctcgttgtcggaaaatgagtacaacggccacctaggcgcgcgcatctcctccatcttcgtcatctttatcacgtctaccgtatttaccctcttcccggtggtggcccagcgactcccccagtggcgtattccccatcatgtatacctgttcgggcgatactttgggactggcgtcatcgtggcgactgcgttcatccacctgctggaccccgcctaccaaagcatcggaccaggaacatgtatcggcatgtccggcgcctggggcgagtactcctggtgcgccgcaattgtcctctcgtccgtcatactggtctttctcctggatgtcggggcggaggtgtacgtcgagtggaagtacagtgtcccgcgagaagcgaatgccaccgcgacgttcatcacccagcccgcatgctcaagcccgcacgaatcatccgacagactgacagcgacggaaccgtcatccccaaccggaggcaaggatctctatccccacgccgacgagctctcggtagcctccgaacaggccttccgccaggacatcgccgccttcctgatcctcgaattcggcatcatcttccattcggtcatcatcgggcttaacctcggcgtggccggcgacgagttcgcaacgctctaccctgtcctagtcttccaccagtccttcgagggattggggatcggagctcgcatgtcagcgctccatttcggccgacgccgctggctgccttggattctctgcctggcatacgggctcaccacgccagttgccattgcgattgggctcggtgtacgcacgtcgtacagccccggctcgaggacggccctgaccgtgcagggggtgctcgacgcgctatcggcagggatcttgatatacagtgggttgggtcttcaccacggggctggaagggtccacgcactnaaaagc

SEQ ID NO: 2956 - DNA, 192 bp, A.fumigatus
atatttccgcagcctgctggccgcaaggcaccttcgggagccaacacaatttctgccaaacaggagggccttgacagttcggacactgacaacccttacgttgcagaaccgggaaagagcgtaaagggtgaaggggagacggactccgtcaagctgaagggaactgttgaccctgctcggccacagcgatga

SEQ ID NO: 2957 - DNA, 228 bp, A.fumigatus
accaccttcgtcaagcgccaccttactggtgaattcgaaaagaagtacatcgcaaccctcggtgtcgaagtgcaccctctgaccttcaccaccgtatgccccgccaacaaccccgctctatcgttccactttgcttctccgggccgactaacctttcgcgatagaacctgggaacgattcagttcgatgtatgggacacagctggtcaggagaagttcggcggtctga

SEQ ID NO: 2958 - DNA, 264 bp, A.fumigatus
cctgaagggaaaggtcggcactgtcatgcattggaatcttacacaactagtagtttagatgcttatcacaatttttctccctttttcctttcctttctcgcaaacgataactctatttacgatgaacaaaaagcaaatctgttgacaggttttggccacctacggatggccgaaaaaaattttcataccgtctctttgcttcaagggggttactccttactcccacacacagccttacagcgtaagccactgtacggcaaatag

SEQ ID NO: 2959 - DNA, 186 bp, A.fumigatus
catcttgttgattccctggaattccaaggaacagcatcttcaattaatagctttattatgggtgatgtcataggctttcttttgggaataggtccgatgaacagcatttatgtctcaaccacttgtatacaacatctaggaactacatcacttggacaactacttaagcagcttcgtgttttcatt

SEQ ID NO: 2960 - DNA, 288 bp, A.fumigatus
gttattgtcggcttactggggagtgatggccatactgaacatcacgaaacaggtgacctcgtccgtgtctgcgagaacatccccatcgttctctgcggcaacaaagtcgatgttaaggagcgcaaggtgaaagccaagaccattactttccaccgcaagaagaacctccagtactacgatatctcggccaagtccaactacaacttcgagaagcccttcctgtggctcgcccgcaagctagtcggcaacgccgccctggtgagttttcgtgcctatatagtcttgtga

SEQ ID NO: 2961 - DNA, 288 bp, A.fumigatus
aacctgggaacgattcagttcgatgtatgggacacagctggtcaggagaagttcggcggtctgagagatggatactacatcaacggccagtgtggtatcatcatgttcgatgtcacctcccgtatcacgtacaagaacgtccccaactggcaccgtaagttattgtcggcttactggggagtgatggccatactgaacatcacgaaacaggtgacctcgtccgtgtctgcgagaacatccccatcgttctctgcggcaacaaagtcgatgttaaggagcgcaaggtga

SEQ ID NO: 2962 - DNA, 207 bp, A.fumigatus
  unsure (123),(150): Identity of nucleotide sequences at the above locations are unknown.
ctcaccccactttcgtcattctccagacgcaattatctgcattcgaccacttttcgtgctgatatcacagccaagcaacctaagacggtacaccgaaccaaattgggcatcgtccatatcgtnccagtcccaatcaaacccaccacccantcagaagtcatcaaagacgattgtcccgaacctttcccaattccaggcaaatactga

SEQ ID NO: 2963 - DNA, 660 bp, A.fumigatus
cgtgaaaatctcgcagtcccacctggtgatccaggatcgtacaagtcccccttttttaaggattttattcatctgaatgttgccatgatgacatcgaataacgcgcttgttcctgatccagacaaacaagatgaccttgcgtcaaaattctggcaatggcccatacttaatgtgggccttcgtatgtgctcctgggatgacaacaccattaagtattacctcctcggaaatccctttgtctactggggcagtacattcagtctcggagtttttggactcttaatattctggtatctcgcccgctggcagcggggttacaaggatctcaatcaagcggacatcgatcacatccattattccggcttctatcctcttctcggatggatcctacactacttccctttcataatcatggctcgggtgacctacgttcaccattattaccctgcgctctactatgccatactcaccttcggtttttgtgtcgactggcttactcagaaaatgagtcctgtggctcgtgggtctctgtatgccttcctttacgtgatcattatcgggatgtttgttcattttcgggtcattgtgttcggcattgagggacctagccagcagtgggccaatctgaactggctgagcggttggcggattgcgaattga

SEQ ID NO: 2964 - DNA, 252 bp, A.fumigatus
tactctataagaagtcacttggtcacacggctgagttttcaacagggaaatggctatgcacttctacgactatatggggacgttacaatcgaaaaggatgctggtgttgatactctgttcttcccatttgggcttgtgaaagtcgcgggggaggggctacaacttgggaactatatgcggtttaaggaaacgaaatattttaacgccagcgtggactgcctcattgttactgttcctcagacaacagcatga

SEQ ID NO: 2965 - DNA, 183 bp, A.fumigatus
tgttcacctaccacaaaaggaaatctctatggtgcacttcaagttgatatgacccaggcatcggagcagaaagctcctagacatttgtgcacagaactcccgtgcgcgaagctatctgacaggaagaaaggtgcctatagcgatgcagggtatatgctcaggccgtatagagtccactattaa

SEQ ID NO: 2966 - DNA, 282 bp, A.fumigatus
aacaagagtgcgggtgaatttcccgcgggttcagtaggaggtgcattggcacccgcggctcccaagttttccatgtcacttaacaacaataagccgaagaatgttttcgcagccatggcaaagaagaatcccttagcaggaaagaaagggccagtgttggaacaacctaagaagatgaccgagcaggagcgcatcatgaaggaggagatggaagcgatggagcgcaagcgtatgcgagcaggttcgggctttccaaatgccaagcgtccgaagatctcctaa

SEQ ID NO: 2967 - DNA, 198 bp, A.fumigatus
ttatctattctttttggcatctcgacagaggactctttcatcagtttatcatacaataaccaaagttcaatcgcagtagccaataccactatgatctcctctaattttgcccatcacggctacatcgcttattgcccctcgtttgctgtaatcttgacgaccagcagactttggtttagaacttgcaggaggccgtaa

SEQ ID NO: 2968 - DNA, 192 bp, A.fumigatus
gctggacctccagaccttatctatttttacccgcatgctaccaccacatctactaccactaccggatgcgcagtcggatatgggcagcatcgaccaagatggtttatacttgcaaagatatatctaagttcccaatcgaaccaacaatttgatgatgaggtcaactatttggcgtacacaaagccattctaa

SEQ ID NO: 2969 - DNA, 375 bp, A.fumigatus
cgcggatccttccggccccgtggtgaagacagatggcacagggcggaaatgcaagtgaccaagggggagaatttgatcaagcacgaagccgagattatgtcgcggccgaagcgcacttggttcgagactgaacgtgacaagcgtgcggcgcgcaaattgggtgctaccgagctcaacggaccatctaagaaggataaagtaaagctgagcaacaaggataagaaacggcttgacgacgcgcgccagcgtcatgagggcaatattggttggaagaagggcaaggctgaccgagaggctcccaagcagggtaagaataaggggggcaaaaccaaaagtgacaagaaaaataagatcaagatgaagggaaagaaatga

SEQ ID NO: 2970 - DNA, 552 bp, A.fumigatus
  unsure (52): Identity of nucleotide sequences at the above locations are unknown.
gacccatggcctccgggaacttttttttttcacctgttccactctggctttngttttccatggcaggatacgttccctttttctccggccaggcccgcgattggatctttggcggatactcggagtcaagagatggaggtgtacaccggtgttagggcagcaagttccaggaatgcagctccaccggccgatgtcaagatacacactatctttcccatgggcattctcagccctggctttgacaacgagcaaggactcaagcctcaacttacaaaggagctggaagctgccgataagccgcagcgtccgatcgaagtcgccaaggcatcgattcaaggcttggagaagggcgactatttaattactacgatgttcgtcggccacatgatgaaagcgagcgctcttggtgccagccctaggaattcaatcattaccgacactctgaccagctggctcagtagtctggtattcctgcaggtgattcctgatctccgaaagaaggctttcaattggggcttgaagaatggcgttccatcatctcagtcgaagtag

SEQ ID NO: 2971 - DNA, 1344 bp, A.fumigatus
tcgacgcggtcctgccagcccgtgctgaagacaacccctatgctgggaacagatgccgctgtaggagatgcagagcgccgaggtcgccctcgaccttcattatcggaacggactattgagacattatcccggatccctccatcacctggccctccgagcaggcaatctagtttcttcaatggcaacagcccggtacggtccccgtctcggacaccatctgtgatgacctcaagatcaccttcgagggcatcaactacgcggcaacctagcgagaatgattttctttcacaacaagcgtctgcaatacaacttccttcgaggtctaggatatcacccgctccgactttgtcttcaaacgacgcttctaccggccagagaacatcgtcggctggtactgacatctcttcgaccttgaagaagccatctgtaagagcaagtttatataacggagttaatgatacgacaagaaagtcgccagatcctcgcccagctctgggcaagacgtccgcaaacgctacgttttcagacatgggacctccgcctcctccactccatgtgaaaaagacaaggaaatctctggcgaacaattccagccctataaataactcgagaaagccatcaaccccgctgaatgcgccggatctctcgatagagcaacagtcggaaatagaaatgagaaaggcttccaagtcatccagcgcattaagggagagcattgctaaggcgaaagccgcgcgcaaagcctccgcaaggcagaacaatactcaaaacggctccgttgatatctttgataacctcaacgttgaagatcccttcaatcaacagcccaaagactcaaaaagtgggttgctccgcaagcgtgtggaagcagggcggacctcgggccatttgaacattgcagccatgtcattgacagagataccgaaagaggtcatggctatgtatgacttcgatcctaactcgacgacggattggtatgagagcgtagatcttgtcaagttcatcgctgcggacaatgaatttgttgagctgtcggaggcagcctttcccgacatcgatccgttcgatatcgattccgacaaagacgaacgaggcaatcagtttgctggactggaaataatggatcttcatggcaaccagctgcgcacccttccaatggggttcagaagactacaaagacttcacactctgactctgtccaataacaaattggacgcggaaagcattcagatcgtcatgcaaatggaggctttgaaagacttgaaactagcaaacaatctcttggagggttcgttctcctcagtcttcaccacggggctggaaggatcaggggggtgctattgg

SEQ ID NO: 2972 - DNA, 243 bp, A.fumigatus
cgtccgctcaaggttagaggactaatacccatcaggctgtgcctgtcctgccatttgcattggtggagaaggctcacatccatgaacgggacggtaggcatccaatgtgcttttcgcttttatctgtcctatactaacacaatcctagtgcaggcgtgggtttctatcctcttggccgtccatggtgcgggcattgccgtcggctcacgtgagtctctttggaagtacctttgctcaagctga

SEQ ID NO: 2973 - DNA, 432 bp, A.fumigatus
gtctctttggaagtacctttgctcaagctgatatgcgatccgatagcaatatgcgcatgttgggcggataggagcgccactcggcggtggccatatctagctggtctcctgggactggtgggcgctaccttgattctctccttctcggaatcggtctcgctatttgtcgtcggccgcttattgcaaggcctgtctggggcagtggcatggacagtgcccctggctattatcactgaccgcgttggagtcactcaagtgggaccctacttgggatacatgactctgggacgaagtgctggcatgtcggctgggcctatcttcggtggcttggttttcctctactggggatactttaggacctacgtgaccgcattcattattctcggcatcgacattgctctgcgtctacttctggtccaaggtccgcaatag

SEQ ID NO: 2974 - DNA, 390 bp, A.fumigatus
  unsure (78): Identity of nucleotide sequences at the above locations are unknown.
gaatcttcccatccgcctaacctatatactcctctcgattccccgtcgtctcctcccttccccacacacgcccgtcgngacaccatgaagacctcatgggcgttggccactttggtcgcgctcgcctccgcaaagggctccaagggtgcgcagtgccgttgcttgcccggtgacagctgctggccctctcctgcctcgtgggccgcgctcaactccactgttggtggtcgtctggtcgctaccgtccctatcggatcgccctgccatgatcccacctacgatgcggccgcctgtgcggcgttgcgggatgcctggaatcttcctcaaactcagtatgtcgaactgcgctatgctggcatgctccatcgcaacaagggaagggaaagctga

SEQ ID NO: 2975 - DNA, 759 bp, A.fumigatus
  unsure (555),(625),(701): Identity of nucleotide sequences at the above locations are unknown.
gtaagttggttagggaacaaggatggccgagagactgctaacgggaggtgcagttactttgctcgctcgtctggtgctggtgctctttctgtttggatgcaccacttcaacgacatccaatacaaggattggtccgactctcactacaaaggtcccgcattcaaggtgggcgctggtgtgatgggcttccaggtgctggaggcagctcacgccaggggtctggtggtggtcggaggtgaatgtcctaccgtcggtctggctggtggatatatccagggaggtggacactccgccctcagcacctcctacggactgggggccgataacgccttggagttccaagtggtcacggccgctggaaagctggtcacggccaaccggtccacaaaccccgacctcttctgggctatcagcggtgggggtgccggcaactacggtgtggtcatctcggccaccatcaaggcgcaccccgacgccacggtggccggcgctggtttgcagttcctctccagcaagacgaccgcagacaagttctacgaggctatcctcgagttncacggtctggtacccgaaatgatcgatgccgtgccaccgtcatctaccaggtcgctttcttcttctttgncatcaaccctattcaccgcgtaccaccaagacgacggacgatgtcaagaactttgttggcgcccctcattaacgtnctggatttccctgaacttccccttcactgtttctattccaaggtcgcttatactttga

SEQ ID NO: 2976 - DNA, 543 bp, A.fumigatus
  unsure (8): Identity of nucleotide sequences at the above locations are unknown.
tacgctgntccttgccgccggctggtgaagactgttccctcgagctccttcaatggtgatgcacccctgcattcacctgccttttcgcactttcggcactctagcatcgacacccgaccttccaccgccgaagccaagttgcatgaggacgatgaagcggatttggccgctgccattggcctctgcaatttcggaacgccgcgcactggaccggtgccgatgtcccctggcattcccccggtacccccgctcccgtctcgctacctcgatcttagcaacggtactggcagcattagtcaaagtctggaccctgccgctactgtcaatgccacttcgtctctcaccgagtccaccccgaacatcttcctctctgtatcatataacccatcactctcctacaagatctccgacgagcgggaggtgaaaatgggtgatgcggatcgcgtgcaaaggcagaaccgcaatgccgatgttgacttcagcaaccgtcctgctcatgcggatgacgatgacgatggcgtctttggtcgcatggaggagtag

SEQ ID NO: 2977 - DNA, 243 bp, A.fumigatus
  unsure (89): Identity of nucleotide sequences at the above locations are unknown.
ggtttgcgggggtcccaatcaagggcccccaaggaatatctcctttccaattttttctcttcctcacacacccctaaaatctctccctnaaaaaacatatcttttttcctctcccctttccccctcaataaatctcctcactcccgctccctccttaaaatttcttttttgtccttttctccccaaattttcacctcgtatccgttctgcgtgcccttttatcgcctccgcttgtctatctaa

SEQ ID NO: 2978 - DNA, 561 bp, A.fumigatus
ttatcaccggcttctttaatgagagcttggatttcaacctctcgaacagctatatcggccttctccttcctcaggtcttccattcggttgatcatctgcgtccttgacttctccaagacggccaacatcgtgcgcaatcgttctagacttgtcgaaagacgaggtagtgaagttatcttaggcggagtccttggtctgttaatatggtctctgccgccgctaccgattgcagcccttgtctgtgcggcttcatatgcagccttctcttctaggtctgaatcatcctcatcagaaatggcttcagcctcctcaatgagttcccgcatctgttcccgctgcttcatcttctgctcgcgctcagccttctttcctaatgagattcgaccgtcctccacatattcgtcaaatccctcggcgaaatcttcgtcttcgcgaataagcctggtatcgcgcatgtcttctttttcggtcttttttagaccccattcctcgtcgctcatgttttcctccagagagatgaaatcctgctcttccgtttccggaagccatttcctttggtaa

SEQ ID NO: 2979 - DNA, 1002 bp, A.fumigatus
ggagttaaaacacccacaaggaaaaccaaggaaaagggcccccgggaaaccaggcggaggggtttaattttaacaagaggttgcgggaaatttcaaacaccggtgaaaggccctaagggccagctaaccggatggacggaggaaggaaccaaggaccatttggaaagttcgatgcggaaaaatatgggggaaagtaaaggaaaggattatggcgcctttcggcccatcccggaggggaaggcggaaatcaggggaaaaagaaaagagggcagaagcccggtttaccaaaggaaatggcttccggaaacggaagagcaggatttcatctctctggaggaaaacatgagcgacgaggaatggggtctaaaaaagaccgaaaaagaagacatgcgcgataccaggcttattcgcgaagacgaagatttcgccgagggatttgacgaatatgtggaggacggtcgaatctcattaggaaagaaggctgagcgcgagcagaagatgaagcagcgggaacagatgcgggaactcattgaggaggctgaagccatttctgatgaggatgattcagacctagaagagaaggctgcatatgaagccgcacagacaagggctgcaatcggtagcggcggcagagaccatattaacagaccaaggactccgcctaagataacttcactacctcgtctttcgacaagtctagaacgattgcgcacgatgttggccgtcttggagaagtcaaggacgcagatgatcaaccgaatggaagacctgaggaaggagaaggccgatatagctgttcgagaggttgaaatccaagctctcattaaagaagccggtgataactatgagagactgagacaagaagccggcctcacacctggttccgaggaggatctgtcaattgctaccgatatcaagaacgctcgcgggctcgaaagcttcggcgcttccatagctggctcggcaggcgactctgggagccagtcgccgtcatcgacttga

SEQ ID NO: 2980 - DNA, 243 bp, A.fumigatus
aatccaggtcttggagcatatataggcttcctgggggtcatctggttcacatggcttcaaattacattatttgatatacgattcgctcgagactcggtttttgaacgaatttgcaaagctgctcagctggctgccatggtaggcttcgcgtctgcgggaacacgattcacgactcagatccgcggtgagaacgtttgggccttccagtccttgagtcttctacttggtgtgttcaccaagggc

SEQ ID NO: 2981 - DNA, 282 bp, A.fumigatus
taccttacctccctccatatatgtttatatactatccgaagatattccccctgtataatgaaacattcccccccagcccaacaaacccaacgtcccccacatcctattccgcctctgtcggaatccactccattggccccgcccatgcacctcttttcaatccctccttccatccaccttccttcccttaataccttcccccccgcaaatccccttcttttatccccccacaatccctcccccccttttcctaacttttgcgaaaagccctctcctcccacc

SEQ ID NO: 2982 - DNA, 564 bp, A.fumigatus
gttcggacgggcgtgcaactcgctatcatcgccgcagttgcattgctccttgtggtgattctagataacaaattccgtgtgctaccggcgtccatccatggccaccttcccacgcattatgctggctacgtcgttaccgatgtgaccgtggttacatgctcttccatcagcattttttccagttgcaaagttgacccgaaggcatggtctagaattgaaaaggacctatatctgcgctctgggtggacatccagtgcttacgtacaattccaacggaagaaggaagaggaactcctcgcatctgacaaggtggtgatcgacttgaagataagccggctgataccgcaatcctcgaatgacccacatggagagaaaattgaatgggagcagaggccaggtggcatctggctgaagcggacggccaagcgccatgcgagtgactcgcagaaagcgatcacctcgatcgatgttttgttcggcgcggacgcggttgatccacgtgtgggctgggaggtgaaagacactccgctgccgctggtcttcacctacgggaatggacggatc

SEQ ID NO: 2983 - DNA, 255 bp, A.fumigatus
tctgatgcagaacgcgaattggctgcgtcatccaggctgtggcttctttcccttgtttccctttctcccttccttacctattcttgctatgtttctttctaccaattagtctgcttaggctcctttcccccgcgattgttgattcctttggaactgaaggatcatctctttatccatggatttcttcgcagttgtcaatctaatctaagctcgctgtttctttatatctttagcgtcctccccattgtcgcctaa

SEQ ID NO: 2984 - DNA, 324 bp, A.fumigatus
atcgtcgagtcgacacgtgcctggcgcgatgcgtggtcatccatcctgctgcatcaagagcgaatgctctgcgagttcgacggtatctatgctcccatcatcgggtcctccgatccgaccaccgcgaaagccgctccaacaccggaagtcacactagccaggacgcgcagactgcgagaggaatacgaggagttgcgcaaggagctggcggaggagcttaatgctgtggatcagcggatgatcaggcccgcctcgcaggcgaaggagtacctggctccattgaagaagaccatcaagaagcgggaagatcgcaaggtcgcttag

SEQ ID NO: 2985 - DNA, 324 bp, A.fumigatus
caagtggtgttcgtgcctcgtggccgtggaaaaggagtagcgagaggcgggggttcgcgcgcaagcgccaaccgtaaaaccactgcccccaaagtggtcgcagctcccgtggagagtgtggttgagatccccacgcagcccatcgaccccgattctttcagtcggtccttaggccccactgccaagcaacagcctaccgtcgacttgagcactcaagctggggccgctcgtggccttgctggcgcatctcgtggtcgtcgtggagcatcccgaggacctgctcgtggtaacaatcgtggtcgaggcaagctctgggttccttga

SEQ ID NO: 2986 - DNA, 756 bp, A.fumigatus
cacattctctgccagcacccgtttctccccatagcttccggtacttcgacctcaccgttgtttcgaagtcgggcgaaaaccttggcttcactcaccacatccaagctcggttctcagagcgattcgacgcctaaggagatacatctgcctgaagacccatttgtcaatgggcagccaatagaagcctatctctataaagatgcaaccgaatgtccgatatgcttcttatactatcccccttaccttaaccgcacgagatgttgcgaccagcctatctgttcggaatgcttcgttcaaattaagcgtcccgatccacatccgccagaacatggagaagcggagcccaatgccgccgcggcggagggcgaccgtcgggacaatcaagactgccagctagtatctgagcctgctgcatgtccattttgtgtacaacccgaatttggagtcacatacactcctccgcccttccgcagagggctcgtttacgcaacagatcctacgcttcgccccaactttacttctccaatgtcctcaacgtcgtctttagcatcggccaatgcgtctccagggacgggccgtcggcgcgctacctcgctgtctgccaacgaccctgcggtcatcacgacagacagagttcgtcctgattgggcccaaaaactagcgaatgcccgggctcatgctgcgcgaagatcagctgcggccacggctctgcataccgctgcatatctgaagaattctaccgaatcagggaaatga

SEQ ID NO: 2987 - DNA, 486 bp, A.fumigatus
aaatctcagtatttcttccagctcatcggtcactgcaaagatacacagcaaatgactaccacagcatcagagaccgcgcgcctacacatcactcctttcactccggatctcttgccctctgtactaccatcttcgatccgagcgtccgcaacagatatatcttttcatagcattgcaacatttcccgagaacaattacggctacgtgacgctgccggcaatggaagcagataagatcaaaaagaaattgaatggttccattctgaaaggacgaaagtttaaagtcgagactgcgcggccaccgaaacgacaagaagtggatgttgaaaccgacactgttatgtccatcagaaagactacttccgacaaagtatcccaaaagcgcaaggccaatgacaacgttctcgatggatacgagcttccgtccggccgtcaagtgaaaagagggtggacagagtcggcagatgccaagaaaggggagacgtaa

SEQ ID NO: 2988 - DNA, 732 bp, A.fumigatus
aaagagggtggacagagtcggcagatgccaagaaaggggagacgtaaggatgaaaagctgaagaagggaaaagatggcaaaaaggcgaagacccaagtaaaatcgaagtatactgagaagtcagaatgcctcttccgaaccaagatacccaagaaccgatctgcgtctcccgatgagaagcaggaaaagcagatcaagaagaaaaagaaatctccacaggaatccgttgtccatgagttcgccacgaccatcacccatccgagcttcttacggtcggaagtagatggagcagcacctacatctgcatttgaggaaggcaaaggttggatagattctgcaggaaacctcaaagagacggttagtgaccggctgagaaaagaccaatatcgcccggggcaagtcgccggggctaaggagaagcgaaagtcggcgaaagctcatccgacagcgcaggagacgcaccttgagaaaacagaggatgacagaattgactcggcagatgagtcggaggactggacgtcttctagtgggacaacgtcatctgatgacagcagcacagactcagaaatcgacgacggcatgtcgtctgcatcttctgaatcaagcgcgtctttcaaccgaggcgaacagcaacaatcacattcattgacgacgaaggaaaacgtatcttcgcctcggaagactgatgagtctgagctatgtcttccacacgccgggcgaaggaaccaagta

SEQ ID NO: 2989 - DNA, 390 bp, A.fumigatus
agcatccagtcctgtgagcatcataccaaaccagaatcacacacttccttcaaggtaagtgagcaaggcaccatcaaaccaccctcaacgctgcaagagagtgacacggaccaaacaatcacagacacaatgaacaaaacttccactgagctaatcgctctcaagtcccccatggccaagcactccagcctgatcttcttcctccacacggccgccaagatcatcatcctcctcgctatcgtggatgtgctcagagtgctcatccgtcaggtgcaggtctaccttgatcagcaggcacgcgagcacaacgagatccacggcccgcagagagttcgtcttgtccgtcgccgtcgccgcctggacgacgatatctttggatttcctttctag

SEQ ID NO: 2990 - DNA, 219 bp, A.fumigatus
catgatgagattaaaacccaattctctaggcactataatcaccagcgtgctaaatgcaaagatccaaagatcatcctagaatggttcaatcatgtccagattataatcatgcaatatgggattatacctaaagatatctacaactttaatgaaactggctttgtaatgggcttagtagctactgctaaggtagttataagagctaagatgcttagttag

SEQ ID NO: 2991 - DNA, 684 bp, A.fumigatus
cgcacggtgtccgctcgtcaagcataccgtcgcatccgcagagtcctccaattacagtggcgaggcgtaactctggtcttgatcatcatcgcgaatgtgattttcttctccgtgaccttcatcgagctcgacagctccctcaaaccgaccgcggagaatatggaaaaggcgcttccatgggttgcatgtctggcagccaccaatggtgaccgagaaaaatgcgaccccgaggcggcaaagttccggcctagcgaagggttactcctcgccgtcctggttctcctttccctggtcggattctggaacttcatcctctttgcccgcccctcgatcttccacggctgggtcgacttcttccagaacaagtttggcacgggcgacggccgtctcgagttcgtgtcggctgatgcccgcacgcggctgggcgacacgcggtcctacgagatgctcaacagcacgggcctcccctcctacaaatcgccatcgcccatggtccgatcgccaagtcctgcgcgcatggggggcacgaagagtcccgagaatggccactttgggcgagacgccaggtatgtgcggccgtccatgagtttttccagcccgcggccgcccagcgcatcacaagggcgcggctgggatcccaagacaacgtttgccccggctgtctatcgggaatatgatgactag

SEQ ID NO: 2992 - DNA, 387 bp, A.fumigatus
tggtctatgtgtaggtacttccttttccaggccggtctgatccccatcatactcctcatgacagatcctaccagcacggacgcacccgcctggcttcaagacgtcgaaaccaccaagaagcttctcacccacccttctctaagcaacaaccgtctcgccactcgctgtctagaagtcgtgaataggctttgctcccctacgtatacttcctccgtctcggacgggtcgacaccgatacagccaccgatgctgatgcaattctcagatcagctcctcaacgatcccatgttcgggagtatgttcccggatgtggaccaggagttaaatctaggggggatggatttctccgaatgggtgaattatacgcctcaaactgacttgcactga

SEQ ID NO: 2993 - DNA, 225 bp, A.fumigatus
gacgcgcccggaaatcttgcagacggcgctgaatatgttctcgatcttctaaacatcctcttcctgcagcgcatatggctttttatcaagatctggatcgccagcctgagtttctcggagctccgcctcgatctgaacgatgcgctgtttctcctcatgcgccgctgtgtcaccgaagatcagatccatatcttcgagagtctgttaaccggactctcaagttag

SEQ ID NO: 2994 - DNA, 189 bp, A.fumigatus
cttatactaggaatctatctagatattacttgtactatatctaagcttacttactttactaggaatcctagccctaattactttattatagtaaagtatatattccactatctagcagagatacttttactcttattatattatccttctatatttagtaatgttaatagttttattaatgctaattag

SEQ ID NO: 2995 - DNA, 717 bp, A.fumigatus
aggacgagctccttcgtcatcctgatctccaacagctacaagttgaaggactggcatctttatatttactggcctctggccacatcaatcggtatgccctcgtcgcctaccagtgaccgaaacgatttactgctgaatgtgactatactaactttcatactttttagagcatggaaactgtctggcagtgcgatgcgcggggcctttgctttggggttgcatctacgcaatgtgggaatctgtacatcagatacttccaaggagatcagataccgtgtttggtggtctttgtacaccctcgatcatttgctcagtgcgatgacgggacggccgtcgtgtatcgtcgataactcatgcaccactcccttaccggtaccgttcgatgagcctgattttcagaaagaagaggtggtgcgcatgataggtgatgcatcaagaggcaactcgaaccagctggaccggatctctccagtctgtccaagcgcatctgatctgagcactaccctggatgctaaaacagccgacggaacagccaacgcgaaaacttcaggaagtagcatggtagagtacttgaagagcctccctccttgcatgtcattatatttcattcagctctccacgctcacttcaatcaacaagaggatgacttccaaattatatggtcccgaggcgatgcattctccttggccaagcaaagaattcacaatccagagcctg

SEQ ID NO: 2996 - DNA, 477 bp, A.fumigatus
agacggcttggctggtcctctccacggattgtaagcggcccctggtgtgaactcgccgtccttgaagagttttcgtttactaataattgtgtttttttcaccaacagggccaaccaggaagtgctcaactggctcactaagatgaagaagagcattggcaacgacctcagcgaccaggccatcaaggattacctctggtccaccctgaacgccggccaggttgttcctggctatggccacgccgtccttcgtaagaccgatcctcgctacgtctctcagcgcgagtttgctcttcgcaagcttcctgatgacccaatgttcaagctggtcagccaggtctacaagattgctcctggtgtcctgaccgagcatggcaagaccaagaacccctaccccaacgttgacgccgtaagttcctcccttctcatgattgattcaggtatggcgagcgatcatggtagactgacccatctttag

SEQ ID NO: 2997 - DNA, 189 bp, A.fumigatus
cactctggtgttcttctccagtactacggcctgaccgaggccaactactacaccgtcctgttcggtgtctcccgtgccctcggtgtcctgccccagctgatcatcgaccgtgctctcggtgcacccattgagcgccccaagagtttcagcactgaggcatacgccaagctcgttggagctaagctgtaa

SEQ ID NO: 2998 - DNA, 1212 bp, A.fumigatus
ttgtttggtctccttttgtttactacgttctggggagatcaagtccgctcttttgttgcagctatcctccgaagctggatcgcccgtgaaggcaagatggcgcgtctgggccgctttgggtttctcgccctcgcggtggtgttccatcttatatatgcttattccatatttgacatttactttgtcagcccgattgtgagcggcatgagatcgtatggcgttgagcgagaacctggagcgaaagcgcccgccagtcgtcttgtgctcttcgttgccgatggtttgcgcgccgacaaggcgtttcagccagctccagacccttctccggaagacggcgaagatgcagaaaacaacgatccaatctacctcgctccttttattcgatcgcgcgtgctctcccacggaacgtttggcgtctcccacacccgagtacccaccgagtctcgacctggacatgttgctctcattgcaggcctgtatgaagatgtctcggccgtgacgacaggttggacattgaacccggtcaacttcgatagtgtcttcaaccaaagtctgcatacttggagctgggggagtccggacattctcgcaatgttcaaggagggcgcagttccgggccgggttgatgccgacatgtatggagaagagatagaggactttaccatggacgcaacgcaactggatacctgggtcttcaataaagtgaaggagctttttgcctctgcaaagagcgatcccgaattggatgcgaagctacgtcaggataaggtggtgttcttcctgcatcttctggggctcgataccaccggccacggctaccgcccttactccagggaatacctgcataacatcaagattgtggacaaaggagtgcaggagatagcgactcttatagaagagttctacggtgacgacaggacggcgtttgtcttcaccgcagaccatggtatgagcgattggggaagccatggagatggtcatcctgacaatactagaacacctctggtcgtctggggatctggtgttgctggtccaaagtacacagatggaaaggctgtcactggccatgaagatggattctccgccgattggggccttgacggcattcaacgccatgatgttgcacaggccgatgttgctgctctgatggcctaccttgctggcttggatttccccgtgaactctgtcggtcaattgccactcccaatatat

SEQ ID NO: 2999 - DNA, 255 bp, A.fumigatus
gttcggtgttgggcgtccccctgcgataagtacgaactgttttcgcctgctggacattgttcatcttcaagttcttactccagcctcgtagactcagatctcacaatggcatcccttgctcgttcgactctccggctccgcgccacttctcgcttccctgtcgcagcccgcacgctcaccacctccccgcacctccgagcagctgcgaagccttacttccccgatgagcccagcgctcctaaggtggtcaccgcg

SEQ ID NO: 3000 - DNA, 315 bp, A.fumigatus
cattttgctggacaacagaatttgcgttcggcggaggagatggaggaggaagagcgggaagcacaatcggcgaagctgcaggagctgatccgccgaggcacgccagcggatttgcaggaagccaatcgactgatgaaggtgatggccggtttcgacacccgacacaagaccgactaccgggccaaggcagctgaggaagtggctaaggtgcagcagaaggctaagattttggaggagatgctacagagccacaagccgggcgatcggattgctgaaggcgacgtgtttgaggtgaagattgcgcccggcgactga

SEQ ID NO: 3001 - DNA, 222 bp, A.fumigatus
tcatccgcggatccttccagccccgtggtgaagactgaagaatggcggcagactatatgccagacgtcgcggtacaaggaggatctgggccatattcgcgacatgcaccgtctgctgttatacaagggctacatgtttcctgagatccgtcatgaagatgccgcggtcctgaacccaagcgacgtacgtccttgtcttcgtggttcccgccctatggcatga

SEQ ID NO: 3002 - DNA, 390 bp, A.fumigatus
ccaattcgaatagggaacttgcgagtgcacttcaaagtgctcatccgaagattcagaagatgtgcgaagaaagagtcggatgaccctgaagctgttcataaactgctggagatcaatgacagcattcaccgcaccattgaacgttacaagttggttaagaagggcgactacgatacggcatccaagatccccaagggtactctaggcactacaacgggggtttcgaagaacgcaaataacgaactctccttgatcgatttcgacccggagccgagctcgaacggcaatgccccgccaccggcggggggcagttccttggagaatgacctgcttggcttgtcaatagaggagccagtccccgctggaagtatctcgttgggacctggttag

SEQ ID NO: 3003 - DNA, 468 bp, A.fumigatus
cgactgacgatggacataggaaatctgactacatctgcaaacgcaccgctacaacaagcccctgcaggattcaagcccacttacgatatcatggcttcgttcaattcgtcccgacctgtctcacagtcttcgacgccggctccccgaccacctcagcaaccgactgcgacccccacaccaccaccgccgcctgcgagcgatccttttgcagctcttgtgtccgcaagccctcggacctccagtcccttcccgcccggagcttcttcgactcagtcgcccgcagctgcttcgtcggctctcctcgacttggtgggagctggtcctcctaccaccgcagcggccagtggtagcagtgcccagacccaagacgatgacgagtggaactttgcttcctcgctgccggagagcaacgcccttccgaccactaataaagtgtcttcaccacggggctggaaggagccgcgccat

SEQ ID NO: 3004 - DNA, 957 bp, A.fumigatus
tacctaagtgcggatccttccagcctcgtggtgaagactcagctggacgacgatcaagatgcctttaacgaggacacgttcggcgacgttggcacaggctcagtcggcaaggacttcgactttttcgggcagacagcaaaggttgcggatgctatcggggaggagcaagttcgtttcaatttacaacactcgggtgctcctagtgggagctcggcgaaagagatcgctgctcagcctccagcaaccagcgtctcatcagacaaacccaaacgtactggatatgagaaataccaggacccggggtatatccctgacctgcaagccaaatccagcgtctggggcttgcaaaagaagccagagcctgctcatgagcctgttcacgagcctgcatcgcaaaccaagaaaatgttaagcttggaggaggtcgaagctcagttacgtagtcgcggtattgcgtcggtccagcccccggtctcaatgccgatgccgatgcccgatctttcgcatcttcaacggacccaacagctgccaaacggtcccgaagccttttcacagctgccgcccgagtttctccaggcccagttccccaaagatgtaccgccagcacatcttctgcaccatccctccatggtgccagagccatattctctaccacccagtgcgccaaatgtgccattgcatctcctgcataatgccaatgtccttccccaacatatggcacctccgcagcgtcaggcgatccccccacgagtgcagcagcctccaccacagcatccgccaccgcaggctataaagggagcaaataccggcctgcctttgatcaccaaccctcagcagctgatgcagttgacagaggaacaacgcatggcatatttaatggaggatgcgaagcgggcaaagcgcaatcacaagatattcctcttgtcttcaccacggggctggaaggagccgtgccat

SEQ ID NO: 3005 - DNA, 303 bp, A.fumigatus
accaccgcggatccttccagccccgtggtgaagacgtatggccatgctagtcctgtgattattgctggcggctacaaggccgactccgccctggaggcagtcgactcgcgctacaagggttacgacgtggtgattggtattggtcgtccgtggacgtcaaaccctgacttgccttttaagatcaaggccgggatccctcttcggccgtacgagagagagttcttctatttgcccaaggatcctaagggttacattgactacgagcccagcgaggagttcaaggccacacaggttgcggcttga

SEQ ID NO: 3006 - DNA, 693 bp, A.fumigatus
aaaatgtaccaattcgtagaagtattcaaggacccccggacgtacttcatcgcggtgatcgtggccgcaatgaacatatccaacgccgccatcagcagtttctccgtgctgatcatcagaagcttcggctacacgaccaaggaaaccgagctgctcaccatcccgggcggtgtggtcagcgttattagcattgtcacaggcacatatctggccggtcggtttgatcagcgatgcctgagcctcatagggatcctcgcctgcggactcctcggaggctgcttgatggcattctcccatgagggaatgaaagccgccgagctagctggcaactatctgaccacctgtgtcggggccgctctgccgctgatgtactccatctctggtgctaatgtcgtaggccacaccaagaaagtcaccctgaatactatcgtgctgatgtcgttctgtctcggaaatattctaggtccgttgacgttccgcacggaagacgagccagactatatgccagcgaagattgcgatcgtggcaacggtctcagtagcggttgttttttctgtcctgttgaagcgctactatatgtatgagaatcggcgtcgcgacatacaggccgagggacatggtccggagaactctgacttttttggatctgacggacagggagaatccggtcgtctacggtatagcatgttctga

SEQ ID NO: 3007 - DNA, 1107 bp, A.fumigatus
  unsure (1025),(1064),(1073),(1089),(1090),(1095),(1096),(1097): Identity of nucleotide sequences at the above locations are unknown.
gatttgaccgaccacaatcgaagccaccaagaagccagcatgcgtcactgggatccgcaatatgtcgccgatttcgacagacacaattattctcatatacggacggctcgtgttcaaccaccgggatcgttgttccagaatagtcaccaggtcgcagtgcatcaaagatccaacgtgcagccccgtggtccacacgatgtgacagcatcagcgtaccaaatgataccgccagatacggctaatactcccgcgcctttagagaatcagcattacggaggtgtgcgatataggcctgcttattctccaccatcgtacgcccgtcccaatccctacatgccattcccgcaatggaccatttcaccagtgaccaaccagcccagacggcaccatcggacgcagaactcctcttccaccgcaagcgcagtgcaggggcagcagcaggcaacatctgtcggccacacagcacgccgacgcacgcgccctgctggtgagacgaatccgcaactcccacgtcgcctctcgacatctcaagtgcccagagtgccggccgtggcgactgccacaagctctagtcctgggatggcaatcggagcaccacattacctcacgtatctcacgccagaagatcatgtccggatccaacgattggcagagctgcaagcatacacaagcagtatgcgcactggtagtgtcgtccatggaagtcaccgacagcactcactggatgacgatggcatcggtgatcgtgggtcatcaactcccaaaggcctcgatgacacgacggacggtcgtcccgaacccaaagaagacaaagatttgaccgtcaatctcgaatgcaagatctgtatgagtcaactcgtggacaccgtgacaattccatgtggtcacgcgatactctgccgctggtgcgctgagcagcacataccgtccagtcaactcgatcaagctcgggtcaaggggcgacccctttgccctatgtgtcgtggagtcgtcaaatccaaggtacggcctcggattcggagagnggatagcgctaacgttattgttgtccgtcttcaccacgnggctgaagnaggcgcgttcaatgtnnaaaannngccctctccg

SEQ ID NO: 3008 - DNA, 198 bp, A.fumigatus
ggttcggtcaccaagtttgttccataccttgttgctggtgtccagcactctctgcaagacattggtgtcaagagccttgacgagctccacgacggcgtcaacaagggcattgttcgtttcgagatgagaagcgccagtgccatggccgagggtaacgtccacggtctgcacagctacgacaagaagctctactcctaa

SEQ ID NO: 3009 - DNA, 234 bp, A.fumigatus
tccagcggcagtgttcagatacaatccgaatggtttcttcttgagccaagcttcgaagcgcaattattcgtctacgtcttctctgcgatctccggcctccattcaaagttcatggagagggatatctcggcaccattcacatgcgcgatcgtcattccgcacatgtccgtcttcgcggttctattctacaaaaacacctatcttgccggaggatatcaagtctcgggacaatag

SEQ ID NO: 3010 - DNA, 879 bp, A.fumigatus
ccgcaggttcggttcaatttcacaaccgtgggcgatctccagtctgttgagaaggataccactattgacattattggagtgctgaaagacgtcggggagactactcagatcgtatcaaagacgacaagcaagccctatgacaagcgagagcttaccttagtcgatagctcgggcttttctgttcgtcttaccatctggggctccacagcattgaatttcaatgcgaccccagagtctgtaattgctttcaagggtgtcaaagtctctgattttggaggacgaagtctgagtctgttgagttctggttcaatgactgttgaccctgacatagaagaagctcatcgtctcaagggttggtatgatgctcaaggcagacacgagacattcgcgtcacatgccactatgtccaatgcatcctcgtctgcaaagagattggatcacttgaaaacaattgcacaggtacgcgaggaacaactagggatgtcagaagatgcagtatacttctcgctcaaagggactgttatttacataaagcaagacaacatgtgctaccctgcttgcctctccgaagggtgcaataaaaaggtgacagaactggatcctggtcaatggcggtgcgaaagctgtgataaaactcacccgcgcccagagtatcgatacatcatgctcatcaatgttagcgatcatactggccagctctggctcagttgcttcgatgaagtcgggaaacaggtaatgggcacgtctgcggatcagttaatggatcttcgccaaaatggagaaaaggccgctggagacattttccaggaagctaattgtcgaacttggaacttcagatgtcgggccaagcttgatcatttcggagatcagcaacggtaa

SEQ ID NO: 3011 - DNA, 723 bp, A.fumigatus
aaaatcgtgtacaaggtcgtgcaagacaaagagggtagacctcgtgtcgtggaagtggagctggatgagaatgggaatgtgattaaaaaagagaagatggacgacgtgcaagacccctctggccgagagttcactgaggaggagttgctcattgcaagtcctgtcgttctggggttcgccttcagtgagaagttgtggctggagttcagcgtctctggaatcagcgacatcgactggaacgaggacgcatttgactctcttgtccttcccgacaaccaaaagtcgatcgtcaaggcccttgtcgagtcgcatacctttcgcgccgcccagaacatcgacgatgtcattcagggtaagggtaaaggccttgtcgcagtgctacatggaccacctggcacgggcaagaccctgactgccgaaggtatcgccgagttgctaaaacggcctctgtacatggtcagtgcaggagaactcggaaccgactcaaggactttggaggcggaactcaacaagattttggacatcgcccactcatggggcgcggtcctgttgctggatgaggccgatattttcctcgagaagcgcacaatccaggacatccatcgcaacgcccttgtgagcatcttcctccgtctcctcgaatacttccaaggcattctcttcttgaccaccaaccgcgtggaaacgtcttcacacacggcgcctggaaggatccgcgattgc

SEQ ID NO: 3012 - DNA, 255 bp, A.fumigatus
aagcagttactaacttgcttcttaagctctcaggcaatggacgtcggtaccttgaagagccttcctgccgataccatccgcatcctggtttggatcctttctttcttgagcttcggttatgcgacggctgagtttgaggtcacctccgagagactcggagtataccgcccggaggagcatatcgagtatgtcaatcccttattctgttcggcgcgtctacgttttggtactgatgcttctgtccgacttttgtag

SEQ ID NO: 3013 - DNA, 1266 bp, A.fumigatus
  unsure (1257),(1260): Identity of nucleotide sequences at the above locations are unknown.
gcttcggttatgcgacggctgagtttgaggtcacctccgagagactcggagtataccgcccggaggagcatatcgagtatgtcaatcccttattctgttcggcgcgtctacgttttggtactgatgcttctgtccgacttttgtagcaatcccaaagactatgccgataatcaggatgcacgtcagtacgactctcgactccgtggccccatccgccaagttgaacttgaaatcgacccacagactggtatgaagaactacatcgcgaacgaacgaggggactgggctacgagtactgcctacatcaagtatagtctggcgaggagcatccactatggaagattgtataccagcggtggacaccacaaggggaaggaggaagacctttgtgaggctctgcgatgcctgggtcaaggcctacatactctggaggactttgcagcgcacacaaactactgtgaacttgcgctccgtgaaatgggttttcgcaatgtgtttccgcataccggcgcagccaccgaaatgaatatccgtggtcaccgtgtctttccccttgtgacaggcacctttggtatggtggacttcttccattccgtgcttggagaggctacagatcacttcactcagtcagaggtcaatgaaatggatatcgcgctgggggatgctcaggcgaattcctcgggtggatctctctctgctttcaccgggctgttgggcaaaatccccgggacaaaggacttgatcgcggaggctgaggaactcaaacgtcgctctgatgctcagcagtatgccaatcaacacggtggtcagaggacgggatatgcccacgagacgtctcgaggattggatagttacggttcagctgtcggacgtgacctgggagaatcgctcagtagagcttcagggcccagccagccctcgacctccggaggccctgctgggcccggtttgccaggaatgccagactttgatcccaagaagactgtggcccagatctaccccattcttcagttcagagataatgtggtgcggaagctttcatcgataattgagaagattccgggtctagaggcactggtggaaaaagtcacggagaccctgactatattcgtgatgtcacttcttgctccgttcatccgtcccatcatcaacgccgcttccaattcgttgcaagctggttcgtcaagcgtcattgatgcctctgggaagcaccaatttgaaccatgtcttcaccacggggctggaaggatcgacggnggngtctaa

SEQ ID NO: 3014 - DNA, 186 bp, A.fumigatus
agatacacattactaccggtacgccaaaaaccacagagcacggaatacggagtgagagaaaacgtcctaagcggtaagcatggcttagtacaaccatgtaaccccaagtcccaatacctagatgagttgtccaaggttagcgcaaggagtgaagatgtcaagcaaccaaaccagattatgaaataa

SEQ ID NO: 3015 - DNA, 213 bp, A.fumigatus
attccgcctacccttgctagtctgttacctcaggcagctaccaatacaatccgtagcacgacagagttctatcaacgatggtccatgccagtggaggaattccgcgacacgatcaataattgttatcagaaatacgatacaatgtcctattcgatacaacgaatcatacttccccaagaagccaaaatggaagttcatccaaaagcttattag

SEQ ID NO: 3016 - DNA, 1017 bp, A.fumigatus
ttaacactaccactgcagcttgcacgaagcacgatgttggctacacgtcggggtgtgcgatctatttccacagatgatttgatattcctaattagacatgacaaggccaaagtctcacgtcttaagaccttcctttcttggaaggatgtccgtaaaaatgtcaaagactcggatgataaaggtggcgccgacgctgcggacttcgcaggtgctgacgacccgattgcgggaggcgtcgttgccgggcctcaagacgttgcttccaaaccgaaaaacaagagggcgcgtgttggccttgtgtgggatgtaaatagcttctactccgtccaggtaccggagagggaggacgaagaagatgaagaggaagaggagcagaactatgcaactcttcaacgtcttgcagcagctgatgaacgcacaaagaacatgaccagggaagagtacgtgttctggtcggaatgccgtcaagcatcgtttacctatcgcaagagcaagcgttttcgagagtgggctggctttggcattgtgacggaatcgaaacccaatgacgatatcgtcgatattctcggattcttgacgttcgagatagttcagaccctgaccgaggaagctctcaaggtcaaggaacgtgaggaccgtgagaagatccgtcgtggaggagccgaaagcggagcaggtgaaaacacgaagaagcgtaagcgagaaactggtcttttcgatcctcccgaagagggacgtacgccagtcgaaccaagacacatccgtgaggcttaccgtaagcttcaagccactccgaacaagaatattgctatgctcctgcacaacgggcgcatcccggcccgtatgcctttgagattggtaggatccattctcagctgtatttctgacctccatgctgatttactcccagatttgaccgagttccacatcctgtcaccgtcttacactcgcacgtttcctttcccggcgtttacattctttccttcggcggagctatactacgatagatacccatga

SEQ ID NO: 3017 - DNA, 561 bp, A.fumigatus
  unsure (274),(444),(502): Identity of nucleotide sequences at the above locations are unknown.
ccaacaacaatgaagcaaaccggcactctcgtcgccctcgccggcctggtctccatggtccacggtcacggttttgtcacctctcccaagccccgtatgcccggcccggctatgaaggctgcctgcggtaaccaggtggagatcaaccagcagtccgacaactacggcaacatccagggtgagcttcaggtatccaagggccagagcgactacaacgccgacgagtgtaacatctggctctgcaagggttacaagtttgacgacaacaaggacnacgtctactcctacaccgccggccaaaccgtcgacttcgtggttgacatccgtgcgcctcacaccggtgtggccaacgtctccgtcgttgacaccgctaccaacacggtgattggcaataccctcaagtcctggaacgactacgcctcgaacgccaccggtgtctcccangatgagaacaacttcagcatcaccatccccgacaacctgggcaacaagtgctccgaanccccgtgcttgtgttctccaatgggtatggttcccccaaatctattcaacagaacctag

SEQ ID NO: 3018 - DNA, 543 bp, A.fumigatus
gcttcgcgacgggttggagcacagtgttcggatgtgagcttggctgggatcattgatcgggaaagaattctgacgggggacagggatattcacaaccgcatcgaccaatttgatctacgcgaccaacttcatggccttgattgcgctgtacaagacggacctcgtgatccagccatggatgaccttcgttgcgtaccagggtttcaacattttgacagggggaacagtcatgttcgggaatcgttttattccacttatcaacaagttttcctgtgggctgagattttcactttcatatgtaaccctggcatactgacagttgcgcaagtatgctatctccaactggcctggttcgtcatcatggtcaccgttgctgccgcagctcccaagcataacgacagcgagttcgttttcagaacgtggatgaataacaccggctgggagaacaatgtgatttgcttcatcacaggactggtgaacccgctatattctcttggtggactggatggcataacggtttgtcctttccctgaagatgtctag

SEQ ID NO: 3019 - DNA, 243 bp, A.fumigatus
cgggggacagggatattcacaaccgcatcgaccaatttgatctacgcgaccaacttcatggccttgattgcgctgtacaagacggacctcgtgatccagccatggatgaccttcgttgcgtaccagggtttcaacattttgacagggggaacagtcatgttcgggaatcgttttattccacttatcaacaagttttcctgtgggctgagattttcactttcatatgtaaccctggcatactga

SEQ ID NO: 3020 - DNA, 282 bp, A.fumigatus
tcacctcgatcaaccccggtggacctggcgcttgtaggacgctccctggtaatcatgcgcaacttcatggtggacggcttcagtatttacggtttcatcttcgttttcatcatgcaatgctttctgggtacttccctggctgaatttgtgtctgcatacccggtcgaaggtggcatgtaccattggattgctgcaattgccccgaaacgatacaacagcattctgagcttcgcgacgggttggagcacagtgttcggatgtgagcttggctgggatcattga

SEQ ID NO: 3021 - DNA, 825 bp, A.fumigatus
  unsure (69),(79): Identity of nucleotide sequences at the above locations are unknown.
tacgagacccccgacgaggacgagtcgaaactcgaatgggtcgtcatcaccaatggtacacccgccagntgcacccaantaggcctattcaacgttttcgccgaccgaggccccatcgaccttgtgatctcgggccctaaccacggccgcaacgcttcaacgatgtacaacctctcttcagggaccgtcggcggcgccctggaagccgctatctgcgggaagcgcggtattgccatctccttcggcagcaaggacgagcagccaatcgaggtcatccgcgccgcggcccggcttgccgtgcgcgtcgtcaaccacctgtaccagaactgggacgagcgtgtcgagctatacaatctgaacgtgccgatgcgcgcggacgtggaaaccagaccagtcctctatactcgaactctaccctactactggccgaaaggctgtctgtacgccgaagtgacccaggccaacggtcattccgcgccgggcttgacgaacggaaactcgaaccactcagacgaaactgacgcgaaactgtgtaatggcacgactacaaaagccgtgaatgggttcggtggctcacacctcaagaaacgtaatttcgcctggtcggcggaattgtctgagatgaagaaagctctgcaggcaagcgagaaggggactgatgcgcatacagttctgaatggaagtactaggttagcatcctcgatcatcttccgtccacgggacggtacatctcgtctgcaggaagctgactgtccaatacagcgttactccccttaccgcaaacttctcgcatgtttctggtctggatggacccttggagcttga

SEQ ID NO: 3022 - DNA, 432 bp, A.fumigatus
gcattgactcaaatcaaagcacaagatatccggtcagacgctaaccccgacaatgtaggtctcacggagacgtcgactgtcgtttgctcgacccatcccacagacgtatttctcggctcatccggcaccttgctgcctggggttgaggtacgcatcatgacccccgagggcaaggaggtaaccagctacgacacacctggtgaactcgtcgttcgcagcccaagtgtggttttgggttacttgaacaatgagaaagctaccaaggaaacattcgaggacggatggatgcgcaccggtgatgaagctgtcgttcgggtgagcccaaagggcacggagcatatcttcatcgtcgatcgaatcaaggagttgatcaaggtcaaggtccgttacccccgaagttgtatatcttcactagcactcagtttcaattga

SEQ ID NO: 3023 - DNA, 294 bp, A.fumigatus
aaaggagtcatgatctctcaccgcaatgtcatcgcgaataccttgcagattacggcgtgcgagaaaacatggcgggactccctgactccaaccggcggaccacgatacactgatatcgcactgggtctgctgccctacagtcacatttacgcgctggtggttatttgccattcagggccgttcagaggcgaccaagtcattgtcctgccgaagttcgagctcaaatcgtatctctctgcaattcaacagttcaagataacgtctctcttcttggtaagtggtgtcaactcgtag

SEQ ID NO: 3024 - DNA, 225 bp, A.fumigatus
agcgaagataccatagaacaaatgctgaccgaggatccctccttctccaaggttcctcccatcattattaccatgctgagaagccaggaaatttgctccaagttcgacctgagctctgtcacatcgttgttcacaggtgcagcaccactaggaatggagacggcggcagatttcaataagatttatcccaaagtcataattcgtcaaggctacggtaagcattga

SEQ ID NO: 3025 - DNA, 330 bp, A.fumigatus
ggcctacaagtcgctccagcggagctcgaagctcatttgctcacccacccagcagtcgcagactgtgccgtgatcgctattccggacgaggccgctggtgaagtgcccaaggccatcgtggtcaagtctgcctccgctggcaatgacgatgaagctattatccaatctattaagaaacatgtggaggaccacaaagctagacacaaatggctcaagggaggagttcgcttcatcgatgttattcccaagagtccgagcggcaagattttgcgccgattgctccgtgaccaggagaaggagttgaggagacaggctggggccaagttataa

SEQ ID NO: 3026 - DNA, 249 bp, A.fumigatus
  unsure (144),(158),(181),(221): Identity of nucleotide sequences at the above locations are unknown.
tggtatactaacccctccctagtgaagcatggagatacaccggccccttcagccgcttcaaccgctttaagcgtatcttccccggcttccgtattgccagcgtcgccttcgccggttactgcgtatacaagcacttcttcctcnaggatgagcaccancaccgtgaagggctacactgaancgttttttccggggaataactgggaatgcatgggaagtcnaggcaaaaaccccgatacccccggttaa

SEQ ID NO: 3027 - DNA, 573 bp, A.fumigatus
ctacaaccccgcgctgcacacgacaatatgccacctcctgtcggcagatacgggccttctggcctgagtggtccttattcacatttgcaacaagcgcatctccaacaacagcagcagcaacagcagcaacagcagcaagctcaacatcatccggcccacgcccagtcggccaacacggcgctccctcctccctcccttggcggccaccctggttttgcggccggcaaccccaacactaatatcaatccttttacattatcagggacagggattgcgaacggcatgtccgttgctgggtttacgggggctggcgatggagggggctctgggttggcgagccatgcggcccagattggttttgcgagaggggcacagatgcagcaacagcaattacttcaaactcatgatggccggttagctctcgagacaaaagcaggcggtgtgaagactcggatacgggatgtatggaaacacaatctggcccaggagatggccgtgttacggcagctggtcgagaagtatccttatatcagcatggtatgtccgtattgggatgacgatcccggggggtga

SEQ ID NO: 3028 - DNA, 684 bp, A.fumigatus
caacatcgaacaatgctatatcagcgtctcaccgctctaggcgttgccgctctggtcgcggcctcatcggtctctgcaagccctatggccaggggcgttaaaggtcgctgtcgtgctaagtacaacaaggccgtctcccacgtcccaacaacccatgaagcaactccgaccataaatctcccggtggagctcccagagactcgatctcagtccccttggcccactgtagatgagatcgtccctgtcaagaagccccaggctgatgaggatcccaatgcttcctcttcctcctcctcttcttcctcttcgttgtcaacgacatctgcactgccctcttctcccgctacccaggaacaagacaccgtttcggcagctcctgctgagcctacaacagccgctcccgagaccgttaacaaggcggccacgactgcatcttcctccagcagcaccacccactccggcaaagccaccttctacggcggcaacgtctccggcggaacctgctcgttcaccgggtacacgcttccctctggactcttcggaactgcctactcaggcgccgcatggaacaacgccgcggaatgcggtgcctgcgtctccgtgacaggacccaacggtaaaaccatcaaagcaatggtacgtctcctcttttcgtgcggatcatatcatatataccccagctaa

SEQ ID NO: 3029 - DNA, 432 bp, A.fumigatus
aaccatcaaagcaatggtacgtctcctcttttcgtgcggatcatatcatatataccccagctaacgccacccatccagatcgtcgaccaatgccccgaatgcgaacaagaccacctcgacctcttccagaacgccttcacccagctagcagacgtctccaagggcatcatccccatcacctggtccttcgtcccctgcgggattaccacgcccctcgtcctcaagaacaaggggggaacctcgccctactggttctccatgcaggtcatgaacgccagcgagcccgtcgcgaagctcgaggttagcaccgacggcgggaagacctggcaggggaccacgagaacctcccacaacttcttcgagaagagcaatgggtttggaaaggataccgtgggacttgaaggttaccgggccattcggcagctaccctga

SEQ ID NO: 3030 - DNA, 228 bp, A.fumigatus
attggagtagtattgcttctcatccaatcgatcccacaggaaatgtgccttaaaataaggtgcattctggagagttcccccatgttgagagatgaaaaggtcaatgaccctctttcctcactccagtctgttcttattattttgaagcaattaacttttgtattaaactattcgggcgctgacgtggtggtgtcaagcgagcggaggcgtagatcacgtgagatttga

SEQ ID NO: 3031 - DNA, 249 bp, A.fumigatus
cggcgaattactagatatagtatagcgtgcctattcaggaataatgtacatgtgcctcttggcatcgcagtgcttggtctatatagcttccaactttccctcttgacattaggttatttccccaccatttccttttgtttctttcgcttttggttctgtctggaccagtcatcccgtgtcctgcacttcgccacccccttaatcctctctggcaacgtgattttgggagattggatttgcggttcgtga

SEQ ID NO: 3032 - DNA, 1173 bp, A.fumigatus
gcgcaattcgcggttccttccaggcccgtggtgaagaccttcctcatgaagacagttaacagtgtcaacaaagacggctctcgcaaataccacctagacatccaattgaatactctagtaacaaatgttcgttttgatacgaccggtgagcggcccagagccatcggcgtcgactatctccggggccaaagcctgtaccgcgccgatccccgtgccagcaaagcatccgcaggaactcctggcagtgtcaacgctgccaaggaggtgatcctctcggcaggcaccttcaacacgccccagctgctcaagctcagtggtattgggccgaaggaagagctgagcaagtggaacatccgcaccctggtgaacttgcctggcgtgggcaagaacctgcaagaccgatacgagaccggacttgtgggcaaggcccctaccgattttgtcctcacaagcaagtgcacattcatgtatagcatgcctgatccctgcctggaccagtggaagaacaacgccattaacaagggtacctatacgaccaacgggattgccatcgctatcgtccgtaagacatccacggccgagggaaagccggatgtgctcatttcaggggctcccgtcaactttccagggtattatcccaactactcgtacgagggcctgaaggatgcgcaatactggacctggattaccctgaaagcccagagccggaacaatgccggcacggtcgaactgcgctccgcggaccctagagatactccgatcatcaacttccactccttcgatagtggcgttacggacaatggcgcggacgagaaggatcttcaggctgtctatgagtcgatgctgttctcacgcaagatcttcaacgatctggtgcctttggacggcaaatttgaagaagtatggccgggtcccaacgtgacttccgaggcggacctgaaggactttatcaagcgggaggcttggggccatcatgcctgctgtaccgccgccattggagccgacgaggatccgaacgctgttcttgactcggacttccgggtgcgtggtgtggatggcctgcgcgtggtggatgcttcggtgttccccaagatcccgggatggtacattgcgcttcccatctatatgatcagcgagaaggcggccgacgtcattattgctgatgctgcatga

SEQ ID NO: 3033 - DNA, 342 bp, A.fumigatus
aatcttgacgataccagtaaggtgcaaaactacactttcaccgacttcagccccggttttctggctaaagccgccgaacgattctccaaggacgcagtaatcctggagtttttgacgctgaacatcgaagaggatccgctagcacagggttttcaggctgagtcatttgacctgattgtatgtgccaatgtcctgcatgccacgcggtcaatgcaggagactgtagcccactgtcggtgctttctgaaactgggaggcaagctcgtgctgtcagaggtgacaatcggcggcctcggcggtatctgccgtgagatcagtcgctggctacggagaagggcgtga

SEQ ID NO: 3034 - DNA, 1149 bp, A.fumigatus
  unsure (747): Identity of nucleotide sequences at the above locations are unknown.
cctccatgtcttttggtttctctccagcgttctccctgtttgcttttgtttatggtccatggtcgtattctagaagtcatgcattctaatcagcctagactctgtagctcacataatgatgaacctgcgttctactccatcgtggacagcgacgatccttacgtgcagagtctgatggaacaagccttacaacgtcgccttcgcaaaggacagtatcaaatggtatcgaagctatccgatcttccttccccctcagcccctctctttcaatatcgcgaatacgaacggctggactttgagcatgcgatgatgtactcgaatacctccctgatcaatgcctatatcatccggaaagcgctcattcgcaagcactacctctccaacacagtggccaactgggtcaccaagcaccctaacagcgtactacggaaccatttcaaattcgcatgcgacttcgagctagactacgccgagtttctcgacgaagccttgctcgaggcatacgagcttcgcgagagcctggacaggaacgaaggcaagccggattcagaaaaggaatggtggattctgaaagcaggaatgagtgaccgcggacaaggcatccgtctcttcaacagcgaggatcaactgcgcgagatattcgaagaatgggaggaggacaactcggatgatggaagcgaacccgagaacccagataccgaggaccagaatggggacagggacggacaaggcgttgtcacctcccanctacgtcacttcatcgcccaaccctacatagatcctcctctcattctaccctcctcgtcaaaccgcaagttccacatccgaacttatgtgcttgctgtcggctcattgaaagtctacgtttacaaggagatgttggctctcttcgccgcgaaaccatactgtcctccatgggaggacgaagacgaggtcatcgatctcgccagacacctgacaaacacctgtttccaagaaggcggcagcaccaacgaaggaagcgtccgacggttctgggacctggatcaccatgtacccggactgagccacggctggaaagagaagatattcgaccagatttgcgccgtcaccggagaggtcttcgaggcggccgtcttcaccacggggctggaagggtccgcgcaacag

SEQ ID NO: 3035 - DNA, 1014 bp, A.fumigatus
ggacgcggatcttccatccccgtggtcgaagatactttgccccgtacgcatagacgaagaagggaaaagaaattgatgactatggatgaggttaattcacggtttccactcacaaagtacaaggcatggaggtcgacgcgggcaaacgccagcattccgaccgcagaggtgatatctacagccgacagcagtctacacagtccaaacatcaagaacggcacattggttgtagataccagtgtatcgccatccttggtgaaatcggcatcgacggatagtcaacggcagatggggcccaccatcgcgcaaacttcaacagtcgcaccggatgctggagcacaattcgctcagttggacgaaaagtccaatggtcgtccaatttttgctgattgcattcatgctcgagacgtttcgaagtacaccaacgatgagatgaaagacatacataatcaggacagttgtgaatgtcatgggttggaagacatcggagacgccgatcatcccatccggactgcaccactggccgagcttcttcccactcccgcagactcctgtgcaatatgccttgacgtgatcgaggatgacgatgacatacgtgggctgacatgtggtcatgctttccatgcatcctgcgttgacccgtggttgacaagccggagggcctgctgtccactctgcaaagcagattatttcactcctaaacctcgctctgatccggtggtggagcgtgcgagcacagatcgccgtagtatggtgggaatgtatgctcccagccgacctcggcctgtctttataggatggcgatcaaatccgtttcgtcgaacaacaatattgccccagcgactcatgcgacgcgatggaatcccgccatcgcagctgtcgggtgcactcaatgtcgattcgtacatggcgcacaatgcatctgacacaaggtcagaaatctccagacctcaacccaggggatcaatgcggttgttccgtcttcacgacggggctggcaggaaacgcgatgca

SEQ ID NO: 3036 - DNA, 198 bp, A.fumigatus
ttgacattgttttcaggtacctctggtcaggccaaaaactacattaccagaactcaggcagttcgcaagcttcagatctctttgcctgacttccgtcgtctttgtatcttcaagggtatgttcagaaaatacgatcctttatttctcttttctatatgtggtggcgtcgatcctgatcggattgcttctgcgatttag

SEQ ID NO: 3037 - DNA, 282 bp, A.fumigatus
  unsure (59): Identity of nucleotide sequences at the above locations are unknown.
caacaaggaggtctcgaaggaaattcaggcgaaagtcgacaacgtgatcaaatcagcangacctggatgaagccaaggaggagccggccgccgagacgacccgagaatctaatggaacaaattgacaagttcgagcccgcagccccagaagctgatacactcccccaacctgacctgatgggaaccgaggctggatcgctcttcgccccattcacattctacatttcacgagaggcacctagggcgcccctggaatatttcctgcggccttttgggtgggaa

SEQ ID NO: 3038 - DNA, 840 bp, A.fumigatus
  unsure (829): Identity of nucleotide sequences at the above locations are unknown.
tcggattgcttctgcgatttaggtatctatcctcgtgagcctcgaaacaagaagaaggcttcgaaaacatcgaccccgaataccactttctactacaccaaggacatccaatatcttctccatgaacccctactcaggaaatttcgggagcagaaggccgttgcgaagaagattgcacgatctcttggacgcggagaagtcggcgatgcagctcggttggaaaagaaccatgcccccaagctcacattggaccatgtcatcaaggagcgctatcccactttcattgacgctttgagagacctggatgatgccctgtcacttctgttcctctttgccaacctcccctcgaccgctcacgttcctcctaagactattgccctctgccaacggctttgtcacgaatttcagcattacttgatcacgaccaactctctgcgcaaatctttcctttccatcaagggtatttactatcaagctacgatccaaggacaggatatcttgtggctggttccttaccgattcgtgcagcgcgtcaacggcgacgtcgattaccgtatcatggccacattcgttgacttctacaccactttgcttggatttgtgaacttccggttgtattcgtcgattggtctgagatatcccccgaagtttgacaccagaagcgacgagaatggcgcagaattggcggctttcaccctcgagggccgcggagtcggcgatgccccgaaggccattgaggctggaaacacacaagcaaccacctctactaacaacaaggaggtctcgaaggaaattcaggcgaaagtcgacaacgtgatcaaatcagcangacctggatga

SEQ ID NO: 3039 - DNA, 237 bp, A.fumigatus
ttgatgcgactatacgtcaaggattgcatcaccatgggaaaattccccatagcagcagtgttctctacaaatcctatctctgacgttagcaactctgagcaggtcatgcgatcgagtaccagtaaagggacatgtgtgaccattagtctaggccctaagaacaactttctgtgcttagatccagtagtacatatgttgtgccattcatctctgggcatcccatattcatctccctga

SEQ ID NO: 3040 - DNA, 561 bp, A.fumigatus
caagtttcgaacaatagtttcgtcaagaccctgacgggtaagaccattaccctcgacgttgagtcgagcgacaccatcgacaacgtcaaggccaagatccaggacaaggagggtatcccccctgaccagcagcgcctgatcttcgctggtaagcagcttgaggatggccgcaccctgagcgactacaacattcagaaggtacgcgaatctctgacggacgacgattggtttcgtttcgtttatgcgcatggggtattttcgggagatgcaagttgttcgctggattgctggacttggtttccggatcctcgggcaggaccgtctgcgccaggagatgtgtggattgttatggaggatttacagttattgagaaggatgtgttcggctgaccggatgcttttgcacatgtttaggagtccaccctccacctggtcctccgtctgcgtggtggtattattgaaccctccctcaaggctctcgcttccaagtacaactgcgagaagtccatctgccgcaagtgctacgtacgtctttgtcccgatcgctcgacccaacatgtaa

SEQ ID NO: 3041 - DNA, 426 bp, A.fumigatus
gagtccaccctccacctggtcctccgtctgcgtggtggtattattgaaccctccctcaaggctctcgcttccaagtacaactgcgagaagtccatctgccgcaagtgctacgtacgtctttgtcccgatcgctcgacccaacatgtaacccgttactggggacgctcgctttggaattctttactaactcgatccctgtataggcccgtcttcctccccgtgccaccaactgccgtaagaagaagtgcggtcacagcaaccagctgcgccccaagaagaagctcaagtaaacgatttctatcttgttacggtttttccgcgttgctgggggaaagagatgctcggagctatgacgtgattgctacatgggaggttttaaaaggcgttggaatgatgaaacattatagccgaagtcacatattttag

SEQ ID NO: 3042 - DNA, 402 bp, A.fumigatus
atcctccataacaatccacacatctcctggcgcagacggtcctgcccgaggatccggaaaccaagtccagcaatccagcgaacaacttgcatctcccgaaaataccccatgcgcataaacgaaacgaaaccaatcgtcgtccgtcagagattcgcgtaccttctgaatgttgtagtcgctcagggtgcggccatcctcaagctgcttaccagcgaagatcaggcgctgctggtcaggggggataccctccttgtcctggatcttggccttgacgttgtcgatggtgtcgctcgactcaacgtcgagggtaatggtcttacccgtcagggtcttgacgaaactattgttcgaaacttgtcagtcatggcttttccggaggttccgcgtatatcgtgtcgatga

SEQ ID NO: 3043 - DNA, 261 bp, A.fumigatus
caatccacacatctcctggcgcagacggtcctgcccgaggatccggaaaccaagtccagcaatccagcgaacaacttgcatctcccgaaaataccccatgcgcataaacgaaacgaaaccaatcgtcgtccgtcagagattcgcgtaccttctgaatgttgtagtcgctcagggtgcggccatcctcaagctgcttaccagcgaagatcaggcgctgctggtcaggggggataccctccttgtcctggatcttggccttga

SEQ ID NO: 3044 - DNA, 222 bp, A.fumigatus
  unsure (51),(112),(218): Identity of nucleotide sequences at the above locations are unknown.
gactctacgaagcggtggtactggaatctcagcccccgcgcttcgtggtancacgggtatgatggcattgtcatgggtaaaacgaactggacgctggcaaggcgcttgccancgtgtcatcgaagtattaagactcggataactatcattgaaaatatgaggctgacgcataacgtcctggtgtctttcacagataccacgggaggtatttcttgccnatag

SEQ ID NO: 3045 - DNA, 237 bp, A.fumigatus
ggacccaacttatgcactgggcttctgtattggcttacgagacatcagtccgagcaattgacatcgtttaattctattgactgtcagcaattgactggcaaaaatatagagcaacgatctgaccacgtccaaagacgcgcgatgcatcggaacgccgttctgttctgcgactacgagctcatcaccctttacctcgctactttcgaccgctactctgttcgtgccttgctttgttag

SEQ ID NO: 3046 - DNA, 195 bp, A.fumigatus
gtgcgcggcgttctgcttgacacatgcactaagtactctaagctgtctcaggctgtggatgccggtccagctcagagacttcaagtgcttcaatctcacaagcccatcaacgttcccttccagaaacatgccatgtcttccctgttcacaaaaaccctgaccgggcgccaacaatttcaagctccgtatgcctga

SEQ ID NO: 3047 - DNA, 231 bp, A.fumigatus
cgaatccggcctaataccaggcgcagccccgccaaaatgtcgttaacaaattgccgtttctacgaggagaagtacccggaggtcgacagctatgtcatggtcaatgtcaagcaggtatgcgactgtttctatgataatggtcgttcttttgcaggaatcttcgactatctctctgtggttcattctgcagatcgccgaaatgggcgcatacctgaaggctcttcaatttga

SEQ ID NO: 3048 - DNA, 201 bp, A.fumigatus
caaattgccgtttctacgaggagaagtacccggaggtcgacagctatgtcatggtcaatgtcaagcaggtatgcgactgtttctatgataatggtcgttcttttgcaggaatcttcgactatctctctgtggttcattctgcagatcgccgaaatgggcgcatacctgaaggctcttcaatttgacaacttgaatgcatga

SEQ ID NO: 3049 - DNA, 417 bp, A.fumigatus
  unsure (31): Identity of nucleotide sequences at the above locations are unknown.
tccccccgcactgcggtaccttccagcgccntccgtgtagacgaggaggctattcaggcgtacgagcaagctcttaccatcaaccccaactttgtccgtgcccggtacaaccttggcgtgtcctgcatcaacatcggttgctaccctgaggctgcacagcacctcctaggcgctttatctatgcaccgtgtcgtcgaacaggaaggccgggagcgagctcgcgagatcgttggcggtggtgagggcggtattgatgacgaacaacttgagcggatgctccatatcagccagaaccagagcacgaacctgtacgatacgctgcggcgtgtgttcagccagatgggccgtcgggatctggctgatatggtagtggcagggatggatgtgaatgtgttcaggaaagagttcgatttctag

SEQ ID NO: 3050 - DNA, 225 bp, A.fumigatus
  unsure (190): Identity of nucleotide sequences at the above locations are unknown.
ttcactttccctagcaccaggatggctgtcgttactggtgctcaactgatcgcccggacgctgcgggacctcggcgtcactgtgatcttcgggatagtgggtataccagtaatcgaaatagcagagagtgctatcgacttgggtattcgcttcattgcgtttcgcaacgagcaggcatgcagctatgcancgagtgtgtacgggtacctcacaggacaacctggt

SEQ ID NO: 3051 - DNA, 285 bp, A.fumigatus
gcgtcttatgtcgtgcgctcgattaccacaggtactcgatcacgactaaattttggagcgcaatggaatgaacaatcgaatcctgacaatgtcacagcggatatcatctcgaccgtcgagttcgaccacaccggtaactatctggctacgggagacaagggcgggagagtagtgctgtttgagaggaatgagacggtagcgacaaccttttctttccacagcagcaatgcacagggttctaatgagtcaaccagaaaaaaacctgcgagtataagtttcacaccg

SEQ ID NO: 3052 - DNA, 363 bp, A.fumigatus
ctaccctctcatagaacaatccatagcatggtgtacaacgccatgaagatgttcatggaaatcaaccctcaactgttcgacgaatgttcccacgaatataatgagcgacagaacagcgccgagcagcgtgagaaatctcgacaggagcgatgggagaaggtcttggagcgagccaagcaaaggaaaaacggactcttacctcctccagctccgcctgcagaagtgccagcgcaagttgatgaggttgatgctcttgctcaggataaccagaagcgtctcaacgccctgaagctggaggactctgcgtcaaacaaggagcggaaagaaggtgcaacagctaccgtaagtagcatcctaccgtga

SEQ ID NO: 3053 - DNA, 1143 bp, A.fumigatus
  unsure (846),(918): Identity of nucleotide sequences at the above locations are unknown.
atcagaagtgccagagtcaggcactcgaaaagtctcagggaagaagctgcgcccgcgcaaacagtgacggaggaagtgcctcttgtggactctaagccagtggagctatcttcagccgaatcgacaaaggccgagaaggcccctacaaagatgaccactgatgaggcgccacttgccgagaaatcctccgagaaaacagtgcctgcggagcctatcgctgaagagaaggttcaagcgaccatcggggatgagccgctctcccggaacaatgtggaagaacagccaaaacagaagtctgtcgaggcgaataaggcggccgacgaggccgttctcgaggaaccgatcaaggaatccgcccctgaggagattccagaagattctaggaatgcagttgttgcagacgccccggtcacggagtcatcaacgacggaaaaggtcgaagtaacagcacctgacgctgagaaggagcccgctcttaaggaatctgccaaggaaccaatccaggaggagatccctgaagcttccgagaaggaagttgctgcagagaccccggtcacagagtcatcgacgacagagaaggtcgaagtaacagcacttgacgctgagaaggagccagctcttgaggaatctactaaggaaccgatccacgaggaacaaacaattgagactgttgttactgcagaagtgacagccgccaaggaacccgaggcgcaggcaacggaggagccagttgctaatgaatccatcaaccaaagaggtcgaggcaacaacggagggagcctactgctggccaagaattcggccaaggagcctatcagtaatgagacggcaattcgtgtcacccangctgatgaatcaacaaaggaactatctaccggatttgcagccgcagaagacatcaccggcaaaggggctgancaccttacggaggtgtctaccgctgccggaaggactggccaaggattttgtcaacgacgcatctgctgtaaaatcggctccaaccgaggtgaacccggaacccacctaaggaccattccgcttcagtggttattcccaaaggaacctgaaccccctaatgctgaaaaaactgctgttgaagaatcattttggcgccaattcccgaagcccccatgggatgaattc

SEQ ID NO: 3054 - DNA, 687 bp, A.fumigatus
  unsure (72): Identity of nucleotide sequences at the above locations are unknown.
tcagcccctttgccggtgatgtcttctgcggctgcaaatccggtagatagttcctttgttgattcatcagcntgggtgacacgaattgccgtctcattactgataggctccttggccgaattcttggccagcagtaggctccctccgttgttgcctcgacctctttggttgatggattcattagcaactggctcctccgttgcctgcgcctcgggttccttggcggctgtcacttctgcagtaacaacagtctcaattgtttgttcctcgtggatcggttccttagtagattcctcaagagctggctccttctcagcgtcaagtgctgttacttcgaccttctctgtcgtcgatgactctgtgaccggggtctctgcagcaacttccttctcggaagcttcagggatctcctcctggattggttccttggcagattccttaagagcgggctccttctcagcgtcaggtgctgttacttcgaccttttccgtcgttgatgactccgtgaccggggcgtctgcaacaactgcattcctagaatcttctggaatctcctcaggggcggattccttgatcggttcctcgagaacggcctcgtcggccgccttattcgcctcgacagacttctgttttggctgttcttccacattgttccgggagagcggctcatccccgatggtcgcttga

SEQ ID NO: 3055 - DNA, 465 bp, A.fumigatus
tccttccagccccgtggtgaagacgccaaacaccccaacatcgtcggcgtcaagctcacctgcggcaacacgggaaaactcgcccgcatcgccgcccaggccaagcccgacttcctcaccttcggcggctccgccgacttcaccctccagaccctcatcgccggcggcgcgggcatcatcggcggcgtggcgaatctgattccgcgctcgtgcgtgcgcctcatggagctctaccggagtgggaagatcgcggaggcgcagacgctgcaggcggtcgtcgcgcgcgcggactggttggctatcaagggtgggtttgtcgcggtcaagagcgccctgcagtcgtatcgcggatacggcgcgctgccgcggcggccgtgtgtgccaccttcagcagaggaggcatctgcactgaagaacgcgttccaggaggggatggagatggagcggagtttcgaggtcgcgtaa

SEQ ID NO: 3056 - DNA, 216 bp, A.fumigatus
agacagcgactagcaagccagctgggctcaaattcaactttagcccgcgaatttagtggcgaccgtgccgcttcgagtgtggaggagattagcacccttggactaaatgcagatcaagaggctttggttaggaagacgtactatgaggcgttgcgaatggtgtgggtcatggtaagccaccgcaacatagcaacggtgccagtgcaatcatgctaa

SEQ ID NO: 3057 - DNA, 402 bp, A.fumigatus
ctggtctctattaccattcatggcgttgtcagacggggcgcatgcgtacgaagccagccttcccttccccattgtccgttacaaagcgaagtcttacgattgactcgatgccttcggcgtaccagatccaccgaggaattctcgtactttaccctacgcaagaaggagactgagaaggcgcccgcaacgtcattgtttggaatcgcctgttcacgacagctcgactcgaacctgcttatcaaccgtcctgcggatgtgactagatcaactgtacaaaaggcggtcgtcgttattacggacacccctcagagcgtggggcaactgagggagaagctctctgtcgtgacttcggcttggttcgcgcagcggtacgttgaaaatatccatgtctgcgttaagtga

SEQ ID NO: 3058 - DNA, 402 bp, A.fumigatus
tttctggcgggttccccgaggtccaacctaggggtgcctttgaaggtggtttcaagccccaatgttcaaagcccggcaggaaattctcccaccagccggttaggccccattcccaagtttcttgggttctcccccagttccaagctattcacctacttctcttggcatgggcatcacaagtcctcgttttatgacgtcgcctgggttcttacgggccagcccatcgttggctccaacctcgcgtgcatattcaccgacgtcgccggcatatggacaggcatccccgacgtctccgtcctactctcccacatcgccagggttctcaccaacatcgcccaactacagccctacgtcccccagcttcagcccggcttctcctgcgttcagccctacgtcgcctag

SEQ ID NO: 3059 - DNA, 540 bp, A.fumigatus
gccccattcccaagtttcttgggttctcccccagttccaagctattcacctacttctcttggcatgggcatcacaagtcctcgttttatgacgtcgcctgggttcttacgggccagcccatcgttggctccaacctcgcgtgcatattcaccgacgtcgccggcatatggacaggcatccccgacgtctccgtcctactctcccacatcgccagggttctcaccaacatcgcccaactacagccctacgtcccccagcttcagcccggcttctcctgcgttcagccctacgtcgcctagctacagcccgaccagtcctgccatcggtggcgccggtcgacacctatctcctacttcacctacatctcccaagtacacgcctacatctcctggctggtctcctacgagcccgcagacgtactcacctacgtcgcctaactttgctggatcgccgacgtctccgggcggccccacctcccctggatacagtcctacgtcccccgccttcagcccttcgtatgtaccctcgtcttcagcttga

SEQ ID NO: 3060 - DNA, 210 bp, A.fumigatus
acgcaacgggagctaccccaggttccagttgtggaagaacattcaactttcttcaacactacggagtacaaggcactattttctcttagctgtagaatctctcgagaacatgacgaatcatttagcaccgcctatttgagcatatatacccacctctaccgacatcgaggatacaactacacaataaatccaggcgcagaatgtctctga

SEQ ID NO: 3061 - DNA, 327 bp, A.fumigatus
tttggaattagtcaagttaaatcccagcccaagcctgccacggccgccaaggccgccaacaccactcggggccgtggcgcacgccgtggccgccgtggtggtggccgcagctcaaaccgtcctaagccgaagaccgtcgaagagctcgatgccgagatggttgactactttgctagcaatgagaatgctggccccgcagatgccaatgcccctgccgctgcaaacggcgctgttcagcagcctgccgccggtggtgaggatcttggaatggccgagatctctgtaagcttcgctgattttaatgctcactggacgcacagacactga

SEQ ID NO: 3062 - DNA, 213 bp, A.fumigatus
tcggcaggtcccgtcaagcgagtgatgctcacttacaacaagaacggcaccagtcgtggtattgcttcgattgtgttcagcagacctgacacagccgccaaggctgccaaggagttgaatggcctccttgttgatggaagacccatgaaggtgagaggcgcatcgtcctcgttttcattccaaccgtctctaactctccgcagattgaagtag

SEQ ID NO: 3063 - DNA, 246 bp, A.fumigatus
caaccctcacctcctccacaagaaacctcaccacaaccgcctcccgcatctccggcccctggaacatactcgtcccgcccgcattatcatcttaaccgcctcaatctgccggcgggaaccgagttgaagaaacgaccccccgtaaatgcccccccagaacgtttgatgcccatgccagaaggcaacctcctgcgccggatagcgggcccggttccgggttgtttggtgggttcagccccgcggtcc

SEQ ID NO: 3064 - DNA, 651 bp, A.fumigatus
ttgatcaccaattcaacatcaaaagtagttttcgcttatgggccagtcatcatggtttcctgtcccatttgcgggaattccgttccgtccctaaagatcaacgatcatatcgactccaattgtgagaacttcattgaagagccgacatcgagcacgggggagccagggtcttctcataagactccggtacccagcttctttcagccgacctctgtccgaaaggccgcctcccaaagcataccgcaaaatgattccccgtccgcaccctctccgctacgacccgccagtgggaaacgaacgattacacatgagaaggagtctgccttgaacggggacaacccggatcagggtgaagcgcagagagagcctcatccgaaaaagccgaaggtgaacgcgcttcagaaagcagcaccgttggccgagcgcatgcggccccggacactcgatgaagtctgtggccaggagctcgtcgggccaaatggcgtactccgcgggctaattgagcaggaccgtgtcccaagcatgattctctgggggcatgcaggaactggtaaaacaaccattgcaagggtcatcgcgtctatggtagggagcagatttgtggaaatcaacagtactactaccggggtcgcggaatgcaaaaagatattc

SEQ ID NO: 3065 - DNA, 462 bp, A.fumigatus
agacgcaaaggccctacaggccgatttgagtatctcggaaacggcagggttattatcagcggaaaggagcggcgcgtacgctccttcaagaggatctgcggcggtactggtatcactccgatctttcaggttctccgcgcagtgatgcaagaccctcaagatcccacttcatgcgttgtcctctttgggaacagacaagaggaggatatcctgtgtcgagccgaacttgatgcatttgaagcgtcagataagaacaagtgtaagattgtacatacactcagcaaagcaccagacacgtgggctggtcggagagggcgcatcggtgaagcacttctgaaggagttcgctgtacctgacgatgagagcatggtactcatctgcgggcctgaggcgatggaaaactctgccaagacaatccttttagcccaggggtggaaagagtcaaatcttcattttttctag

SEQ ID NO: 3066 - DNA, 633 bp, A.fumigatus
gacgctctccttcaccccgcctgtagatcactgccgggaccgctggcgttctccaatgcaagtgcggcaagcggatgggcgcagaagatcagcccctatgcctctggctaccatctgaaggctgccttccatgcaaacgatcagaccaatgccgagcgcctcctacgtagcgtctggggccctatgagcgatccatcgctcgccaactacaccggctgcacgtgggagacattgaatgccgacggcacgcccggccttggtgctgccacctcgctctgtcacgcctggggttccgggcccacggcggatctcagtcgttacgtgctgggtgtccaggccgtaacgcccggcttcaaggagtggacggtccacccacagactttgggcctggggtacgcccgcggtaagcaccctgttccacaaggtaacattcgggtggattggtccttcggcaaagacggcctccttaacatgactgtgaccgcccctgcgggcacaaaggggattatatttccccccagcccactgaaagtccctttgtcgaagtatagggtctcgggacatgcaaggaaagtcggcgagggttttgaaatacagggagggcaggcattcacccttcaacagagcagatag

SEQ ID NO: 3067 - DNA, 426 bp, A.fumigatus
  unsure (15),(40),(41),(65),(234),(243): Identity of nucleotide sequences at the above locations are unknown.
gagtatttcccggtnagatcatccttggttatctttgtgnnttatagagatttcaaagtgcctgntgagtacgccccgcttgccattcgcacacgcgccgccgcgcttgcaacggcatccaactggatattcacttaccttgtcgtggaaatcaccccggtcagcatcaagagcatcgggtggcgcacatacatctatttcagcgtcttcaatttttgcttcattcccctgatntatatcttntaccctgaaacacggaatctctcgctggagcacatcgaccggctgtttacgggcgaaaagattcttcttcacttgcctcagagcatgctggctgatgctgaggatgctgttgctcccggcacagataacagtgacgggaaagacgtcgacttacgtgaggttgagaacgtcaaattggggtga

SEQ ID NO: 3068 - DNA, 798 bp, A.fumigatus
aggaagccggaggtgggaaaccccggccaaggccggccttccagcacggccgggccattcttggagcccgttaaaagaggaaaatttctggatcacaaaggcgaacgttggacattagcaggggaggttgccttggaggcgctgggcggccccaaggttgtctggaagcccggccggacggacctcgtcgacgactccaaggtgcccccgcgcggccggctgcctgacgccacacagggcgccgagcacctccgcgccgtgttctatcggatgggcttcaacgaccaggagattgtggcgttggcgggtggacataccctcggccgatgccacatcgaccgcagcggatttcagggtccctgggtgaacaacccgacacggttctcgaaccaattcttcaagctgctgctgacgctggattggaagccgaagacgctgccgaacgggatcagccagtttgtgtatgtggatccggacgctgaggaaggggacgagccgctcatgatgctgccgacggatatcgcgctcaagacggacccggcgttccgcgtgtgggtggacaagtacgccgccgacaaggacctgttctttgatcatttcgccaaggcgtttgccaagttgatggagctggggatcaagcgtgatgagaacgaccgcgtcatcaacgccgataatgtcaagggcgggtacatctctgcgccgaagaagagcaatcaccccactgggccggcgaaaggggctcagggtggatgtcctgtggcggcgtcacagggcggatgtcctcgggctaagctgtaa

SEQ ID NO: 3069 - DNA, 345 bp, A.fumigatus
gtgtccataagaaacgcttcacgagcttgcagtggcttgatgtctgaatactttgtggaggaaatgtcacgccttcttgacgaagaaaagcaaatgactcataaggctctttccgcgcgggtcgatgcaaaaatcgacgacgctaagttcttcaacaaactgggcaaactaccggctgagttcgacgctcaacagattgactgggcctatggacccgtcattcaaagcgggggaaagtatgaccttagactcacagcagtgtctgataacagcaatcttgaaccgggcattattatcgctgggttcgggatacggtataagacttacagttcaatgattgcacgg

SEQ ID NO: 3070 - DNA, 294 bp, A.fumigatus
ttcttcaggcaggctaagcacaccctgcacgacaatctcaactccaacgcccatcagatcatggctgaagagattgtgatagacaagactttgtttttcaatcggttgtcaagcttctacgcggcatggagagcggacaaacgctcaagtcaccccacatttggtggcgttggctcgattgtcatcttgatgggcaagactgacgaagcgagtacttttcaaaagaataatgctatgcacgtatgttcaatccttaccacttcatttggtacttcctttgcaacgctaacataa

SEQ ID NO: 3071 - DNA, 195 bp, A.fumigatus
caaccgattgaaaaacaaagtcttgtctatcacaatctcttcagccatgatctgatgggcgttggagttgagattgtcgtgcagggtgtgcttagcctgcctgaagaactagaagtgtacaagtctagtcaagcttctctggttgccttaagctctggattcggtaacgcgactatggtaaacacaagattttga

SEQ ID NO: 3072 - DNA, 747 bp, A.fumigatus
tgcccctccccccgggtgaagactcagctgcatgccgacaactgtgccaacaccggtgtcagttcttccacagtctccagctcggtcgttcctgtcactccaacaagttccgcagtgcaggagagcacccctgccacctctcctactcccgagtcgagcgctccgggatctaccaccactgtcaagacaaccatgactagtaccttttgccctgagtcaaccatcccagctggctctggatctcagccttctcattctgcctctgccacccagtcttccagccccaactgcccgaccgatctctctggacaatatgaatttcctcacctgatcatccctgtcgactcctcttctcccaacaaggctcctggtacctcgttcaacggcacagtctcttccaccgtctcgagcatcttcaactttgacattccttcctcggacgcaggcaagacctgcagtcttgtcttcttgttccccaagaaggaggatctcgagacctcttcttactccttcagcggcgacggcaagatcgattttgcaatgctagagtctgccgctacttcccagacctccttcagcaatgctcccaaagtcaagcaagactacggcgttaccacggtctcccctggcaactcctacctgatctccaccttccagtgccccgctggacaggcagtcggcttcgagatgaagaatgctggtagcaccaacctcaacttcttcgaggactacaatcccgctccgtaa

SEQ ID NO: 3073 - DNA, 666 bp, A.fumigatus
caatgtccatccacatcagagaagccactcagggatgacatctctcaaatccataccatctacagcttctatgtgcgcgagtcagtcgccacattcctccgacaacctccgcccctggaatccctgatctcctctttccgagagatccagtcccgcggattaccctatcgcgttgcaatcgacacgaccggcaaagtcctagggtacggctacctcgccccgtttaatggcacccggatggcctacgcgccgactgtcgaggtatccctgtacgtccacccggaatatacatcgaaaggcgtaggaagccgtctactctcgtccatcctggagtcggtcgagtcggaagcgggagtatggcaccgtgcctacgaacacaaggaatacgaatcacatgtgcaagtcattccagaggacgagggccgagtgtgtagtatcatcgcctgcatggcggtcgatactacggggaaggagaatggcgagggtttgcgaaagtggtatgaacaacgggggtttgtggagcgagggcgactgaagaatgtgggatataaacaggggcgatggtgcgattccttatccatcctatggtttagcttacctactgacatgagaaggattgatacggtatatctgcaatacagtgttcgtcgggatgctaacctctga

SEQ ID NO: 3074 - DNA, 519 bp, A.fumigatus
gttatctatattccctctcagaagtcaaaagactttcaatcattttcggctccgcttctcaacatacatgactcgcacgttactgcaccatttttcggtccaaatcagtggatagcccttgtccaacccgtgtctggaggagggattcccccgtcattgccagccgttcaattgaaggttacgttcaaagaggggggcgcgttcgacttccacaacaactttgagagactcaaggagcgtatgcagcaggcacttgagctctcacaagaagacggccgacgatcgggaaacgttgacctctccacaatccacctggaagagctgcccgcctacacggggccgcagggtgatatggctggggttcactctcatggccaagacctatctccagacccgtacagtcgccaggacggtgcagggacagaaaccgaaccattggatccaccgccaggctacgaagaagttcagcaacagagtgttgccaatgaactcgaagaaaggctacgccgtggcagttga

SEQ ID NO: 3075 - DNA, 282 bp, A.fumigatus
tactttcacacggtcaggatgggtctcgccgactttttctccgatatgatctcctccctgagtttccccgaggctcaggctgaggctcctgccgaaaccgtcgagcagaccagccaggaggctgaaaccgaaaacaagcccgacgtgagcgaggagaagaccgaggagagcacggaggaatctggtgaagagactcccgctgaagagtcttccgaggaaagccaggaggagcccgaggaagaggagcccgaggaggaagaagaggcggaagaggagctgtag

SEQ ID NO: 3076 - DNA, 183 bp, A.fumigatus
gcttccatgaatcgaccagcgaggatgaacaacgtcagaaacaccaccgagtcaaaatatgttgtgctgtggctgctggtggatgagtttgcggcagcatccatgatgagaacagccaacgaagacacgtatgccactgtggtgccagcggaaatgagaagattcatgctgccgaagcgatag

SEQ ID NO: 3077 - DNA, 1506 bp, A.fumigatus
cctgtggttcctgctcggcgaccattgcccgaagggcttgaagaaatgcccttcgtgacggaagtttctgtgaatctcctggctcacagtggcagagttcagtttgtgggacgggaaaatgttgatgccattctggagaaaattgatgaccttggttacgaggcctccctcgacaacatccaacctgtggtcgtgaacaacgaagagggtaagaaccagaaacggacagtctcagttcgcgtcgatggcatgttctgccaccattgtccagagcgggttcttgactctttgaaggcgtttcccgacgtggaatgcgaacgaacattgtccctcaacaacaatgtgctgaaagttacatatacgcctgaccctccttcgttgactatccgggccatcattcaaaccattgagtcagcgcatgatgctttccaggcatctgtcttccatcctcctagtctcgaagatcgatcgcgcgccatgcagctgcacgaacgtcgtcgattgttaatgcgcttgacctttgttttgctggtcgcgattccaactttcttgatcggtattgtcttcatgagccttgtgtcatcgaacaacggggttaggaaatatttagagcagccgatgtgggctggaagtgtctcccggatggaatgggccctcttcatcatgaccacgccagtcatgttctatggcacggacattttccacatacgagccatgaaagagatctactcactttggcgaccgcgaagtcgcactccatttgtgcgacgattctatcgcttcggcagcatgaatcttctcatttccgctggcaccacagtggcatacgtgtcttcgttggctgttctcatcatggatgctgccgcaaactcatccaccagcagccacagcacaacatattttgactcggtggtgtttctgacgttgttcatcctcgctggtcgattcatggaagcctacagcaaagcgcggacaggagatgcagttgcgtctcttggaaagctcaggccctctgaagcactattggttgaaaagtccactcctatcgatcagactgaatttgggaaatcattctcgtatgaaaaccaacagcggattgcagttgatctcctcgaaatcggagacgttgtcagcattcctcacggcgcttcccctcccgcagacggtgtcatcattggtcccaatacctaccagttcgacgagagttccttgactggagaatccagatgggtgcgaaaatcagcgggtgaccaagttttcacgggatctgtgaatgttggccagcccgtgaaaatcaagatcactgccctcggcggttcttccatgctggaccagatcatcaacgtggtccgcgagggacagagcagacgggctcctctggaaagggttgcagacgtactcacatcccattttgtgcctgtaatcactctcatagcaatcctcacatttctcatctggctctctctcgggtcttcaccacggggctggaaggtgcacagtagtcat

SEQ ID NO: 3078 - DNA, 213 bp, A.fumigatus
gttgacttttccagctttctcttgcccatcacattgctatggaatatccctatcgtcactgaaaacgcctccggcgtcaatcatggcagtcaatacgagcatcatgacgttctattttccggattattttactttaagagttattatcccatcgattgtatgatcactggaatattgcagaactgtcccccatttcacctcccttgctcttga

SEQ ID NO: 3079 - DNA, 246 bp, A.fumigatus
  unsure (43),(83): Identity of nucleotide sequences at the above locations are unknown.
gaactggcactaggcggagatctgggctttcaattcgtcaacnggggttttaagtattgctctttttatgatcgaggttacantagcctaggagcaatttcagatacccacccgaaccccaagttgcgtgtggaacacagcgccgatccaggccaaggcgttgcagacggcacacaatctcagcactaccgaccagcctacgaattaaccgaggaccaggaggagaggctgggacgcagtaaatag

SEQ ID NO: 3080 - DNA, 324 bp, A.fumigatus
gctctttttttcatgaggaatgctaacatactcaagaccgatatcacggaccctcaaagacactttgaaatggtggctccggcgagagccctccatgagccagtattacgcgccgcaatcctcgccttttcgtcccggcatatcaacagacaaaaacaggacggcgacacagagtctttgaagtatcacaacgaatgccttgagcttcttattccaacactgtcgtgcgatgagaatgagattagcgaggaattactagcagccattgcaattctccgtcagaatgaagaaatggatcgtaagttctcaaaggtagttagctaa

SEQ ID NO: 3081 - DNA, 273 bp, A.fumigatus
agacgcgccattatctcgaacatcaatgtcaataacggccggtcgggcatcgatctcaactcagtcctgaccagtattcatacctttgaccctgcggctggttgtgatgattccaccttccaaccatgttcgtctaaagctttggcaaatcataaggtctatgtcgattctttccgttctatctacggtatcaacgctggccttggtcctggaaaggctgcaaatgtaggccgttacgctgaagatgtttaccagggaggaaatccatggtag

SEQ ID NO: 3082 - DNA, 795 bp, A.fumigatus
aggtacctcgcaactcttgcggcggcagagcagctgtatgatgccctctatcagtggaaaaagcagggttatctgaccgtcacacaaacctcgctcgccttcttccgtgacttctcgtccaccgtcgagccaggaacttacaagtcgaataccccgacctacaaatccctgactgattatgtccgcacctacgctgatgacttcttcttccttgttgaaaaatacaccccaagcaacggctccttagccgagcagtatgaccgcaacaccggtgtccctctgtcagccaacgatcttacctggtcctatgcagccttcctctctacccttcagcgccgcctcaacatcatgcctgactcctggggcccctcgtctgcaaatcctgttcccactacctgcagcaaaaccaccataactggtacatatagtgctgtggcgcctccctttccgacgtccaccgctcagtgcgttgccgctgtgactgttcctgtcaccttttggttgatcgagaatacctactatggcgagaatgtgtacatgaccggcaacgtcagcgctctcggtgactggaacgccagcgcaggctatagtctgaatgccggtctctacacctcggatgagaatctttggttcgcaactgtcaagggactcgagccgggtgttaccatggagtacatgttctacaagattgaaccgggaaactccgtgacttttgaggggggggagaacagggtgtatgcagttcctacagcatgtcctgtggcgcctcaggtccacgcggtttggcagacctga

SEQ ID NO: 3083 - DNA, 939 bp, A.fumigatus
caaacaaattccggctggtccgtccgtgccagccccgctataagtcgagccgactcctccacgattccgccttcgcctgcaaggactatctttgaggaacgcctgagcgagtcggggacacagcccatcgacattgccaaagcgaatagccaatcccaggatgactcggaagctccacaagccaccactcctctgcttcctcccttcatgggggacgagccactgagtgttactgcctcccgagttcaatcacctctgcagtcaccgtcggtcgccgacgtctccgaggagagcctggacaagggcatgatgtcgtcagaccctcgcctggcaggaatgccgtcacctccgctgtcgaccaagccgtcggtcgcgtctttcaatcgtccacgcgccagcactatgcggacgctgtctggcgagggtccatccttcgcgttgaccgatccgaacgacgagtgggcgacacaacttggccatgccaatttcactatccagcccgagccttacgtgccggaagtctacgatctgagctcattccggcaattgcgcgaacactgggaccaagcacagtgcaactttaccaagcatctggtccggaccggtgaacactacggtgtgacctccaccatctacaagctcacggaggccaagtgggacgcgatcaacagtgaatggaagcgcacctatgacgagatgttgtcccaactggatgcgaccgacggctcgctgatgggcatcatccagtctcaaggcaacccctgtgagccagtcaaaattcctcggttacacgatgagaagttccccgaactgggcgatggcgagatcgtcggtcccatgaaaatcgctccggcggcgaatatgccagcccgctgccggagccgatccttgaaacgaagctttttcaaattcttccaggatctcatatcgcgatcctga

SEQ ID NO: 3084 - DNA, 477 bp, A.fumigatus
ccccactccaccccgcaaactgacggctcatactgcgttcctaccgtcaacatgtggacgactaccagcggcttgagtggtcggtcgctccggttgagcatcacctttgccgctgtcgttggattctcgctctttggctacaatcagggcatgatggccggtctcctcaacggcgacgagtttgttaactccttcccaatcctcaaaatgcccgacaatccgactgcaggggagaaacactacatcgacgtcatccgtggtgctgttacatcctgctatgagcttggctgtttcttcggcgcgttgttctccatgttctgcggcaatagactcggccgcacccgcctgatcttcatgggtgccagtatcctgatcgttggcgccttgcttacaacggtctgctacactggtaaatgggaggttggtcagtttgttattggccgtgttgtatcgggcattggaaatggtatgaacacg

SEQ ID NO: 3085 - DNA, 426 bp, A.fumigatus
accgcgaaagatgtgaatggaaagacaacattccaaatccacaccaacgtagtctttccccccgttctatacccgccaacccaacagcacaacccgcctgtcccaactccagaatggtcctcgctcatccaatcctggtgtcgccatcatcgcatctaccgcctctcgctgattgaagcgatcgagagcccgctcttccataatggtacgctgcggacacggttaagtatgagcgaggctagggctgtattggactggatggccaaacccgaagaggaagggggtggcgggaggcgcgcggaatggatcgatgggggaagtaagtcggtagcctggatttggtggaggagaccggaggagtgggcggggattgtggcagattgggtgtgtacttccttttcctctgcttgttggctagcttgctga

SEQ ID NO: 3086 - DNA, 336 bp, A.fumigatus
  unsure (38): Identity of nucleotide sequences at the above locations are unknown.
tcgtttgatgcatgttcaatgtacgttgatgtgatctnccatctagcgaggatgttcgatgtagtactaatgttctcttcactgattgctcgtatgttgcaactctcgagtgttgtctgtatgctcttctctatgcacctcttccatcgtgtgatctccacgatatgtctgatcatcatccttatcttcatggagctgaccaagccgtcctctgatgtggtgaaggtcttctatacaatagcttatgaggcactgtatcgtggctcgtatcctatctatgtttctactatatattgttcttctctacgcgtcgcattgatgacgatggatatctac

SEQ ID NO: 3087 - DNA, 474 bp, A.fumigatus
cttgcatcaacgttcgaggcacatggcggggagaccgtgatctacgagccgccagcagactttccgccccttacagaaggattcacacatctgatatcaaataccgtggattttcctgcatttgatgctgctaatgatgcgctcatacccgtcgtcaaaccgcaatgggtgcaggcgtctctcgcgaagaaaaagttggccaacccgcgacagtacaacccggatcctaggctattcttgaacgatgtcgtcgtcatgtgcggtgatattccagaaggggataaggatgcgattattggcggcgttttggccaaaggcggcctctacagtcccagggtgtctggtatggtcactcacttggtcgacctgacgatggattccgacaaggcgcgaatcgtcacttctcgaaagctgaacatcaagattgtgcttcctcactggtatgactgcgattaccctacaatctttgattga

SEQ ID NO: 3088 - DNA, 612 bp, A.fumigatus
gcttcagggccaggcgtcaccacaatgcgagggcactggggactgcaatcgccctacgtatttcctacaaactctacgacggtaaggaatcatttgcaggacactctgactgtacaaacgcgacccatgctcatcctcggcagtatcatagacgaccccagaaattcgcatctcatcagatggtccgacaagggggattctttcatcattccagacaggaacaaatttgcgcggacgttactccctacaatttacggtcatggtaacttcagagcattttgccgccttctatggtactacaagttggatctcaagaagcaatcctctccgtggaggtcatggcaaaggactccgttcagagaattcagcaatcctaattttcgacgagacgatgacgctgggtttttgcgtattgaaggacgaaggaagaagactaaggagtcctcaaaccctgtatctcggtcttccgtgtccgatccgttttcccgttctggcggagaatccagtatggatgaagatcatgtcgcaagcgacatgtggcgaggcggcaaggcatgcgagagtgtccgaggatcatacactagatatccaaagcggagacgggtatcttag

SEQ ID NO: 3089 - DNA, 270 bp, A.fumigatus
ggctctgaatgcattctacccttgaatggagtcgggttgctaaccgtgtgcgaagtgggtatcacgcgacacacgcagcgcggacatattgctcgcgcgaccatggaagcagcctgcttccagacgaaggctattctcgatgccatggcaaaggacagtggacacaaattgtcggaattggccgtggacggcggaatgagtaattccgacatttgcatgcaggtacgtctccgaaagaaagcaagctctccgcttcacggatatcagtga

SEQ ID NO: 3090 - DNA, 270 bp, A.fumigatus
acacaagccgatatcatccaaatccccgtcgagcgtcccgccatgcacgagaccaccgcgctgggcgccgccatcgctgccgggttcgccattgacgtctggaaggagttcagtgagctcaagaacatgaaccgcgccaaccgcaccaccttcacaccccgcatctcgcccgcccagagcgcacggatgtacaagcagtggtccaaggccgtcgagatgtcccgaggctggctggacacgagcgagatcgagtccgaggaccaacagtaa

SEQ ID NO: 3091 - DNA, 213 bp, A.fumigatus
caacctgatttcaagatggccttcttacaagcacaggtgcaaaatcccaactttacaacttcattgataacggatgaacatgttataagcatgtatatgcaatacagtacattgatcgctcattcttacaccgatatgcccaaaccttatatgcaacaattgctgttttgggacttcatattcgaaggaggagaagccaccaagaactcataa

SEQ ID NO: 3092 - DNA, 771 bp, A.fumigatus
ccaaatactgatttctgtgtcagggaggaacatgaggacactttgcttcatgaaacccttttgtgcctgaaggctctctgcacaacttctgtcgcattgaagcacctgaccaaaattgaggctgaactcttcccagcattgttgaagatgttgttcgatgaggaaaagaaaggaccgagcgaatacaccacccgcggcatcatcatgaatctccttttcactcagcttgctaccgcctcctccgacgagatggcaacagcatgcgcctcacggatcctttcttacttgcaggatccaagtcccccggaagaaagccaaccgctctcgttcattgccaatatctaccagtctcgcccttatcgagtgtggtgtaaggaagtcagcaatgtaaccaaagaggtgttttggatttttcttcatcacctcaatgtcatacccatcgtcaagtccgacaaatcgccatcagaactagagcaacagacgttccgagagcgacattttccggcacctagacctcctgttcccgccgcgccgtacgtaggtggggtcgaatgggatgccaccaactatctcgcagcgcatctggacctgatgaacggcctcattgcatgcctgccatctgttgaagaacgcaacaatttgcgttcagaactccgcgcttctgggtttgagaaggtaatgggcggcagtctgagaacatgcaaggagaaattctactcctccgtccacgattgtctccgaacatggactgcagctgcagttgaggatgga

SEQ ID NO: 3093 - DNA, 276 bp, A.fumigatus
accgtgtctctctctgctacagccagtcgcgacactgctgccgatccatcggactttgtccactatctacgcgagatacaaaagcctgagatgatcgagatcgggaaaatacacaagcttcgtatcctattgcgcaatgagaccgtcagctgggttgatactttcattgccgatggcggtatggacgaaattgtccagttgctttacaggataatgaaagttgagtggcggtacgttcatgcggtccgaactgatgtccttatgaccaaatactga

SEQ ID NO: 3094 - DNA, 270 bp, A.fumigatus
gacgttggctcgtggaggcgacgctgctggcatatcgcttccttagaaacggtgtactatgactactactactactactactactactactactactactactactactactactactactactactactactactactactactactactactactactactactcctgctgctgctgttgtcctaccgctacccacacaacactttctctatgtcggggcaatatttatgaaattactgacgccatgtgcatgccattttcatcatta

SEQ ID NO: 3095 - DNA, 1077 bp, A.fumigatus
  unsure (495),(555),(558): Identity of nucleotide sequences at the above locations are unknown.
cttgaaatttctctcccgctgctgttgacaagtcctttggaaatgcgtcctcggcatcgcgaagagttcgaaatcgccattttttgcagcttaccctgtgaagccgaggcgatcgaggcattgctagatgaggtctacgaccggttcggcaagatctacgataaggaacccgaggatcgtaatgtctatataaacggacgaattggcaagcacaatgtggtcttatgccaagtgccggagtcgggcaaatgcagctcagcgagcgtagcgtcgagtttgacattcagttatacaggtatccagctcgcccttgtcgttgggatatgcagtggtgttccctcgccgtcctgcagtgagcgggagatctttttgggagacattgtcattgcggatagtgtgattgaattcgacgtgggagagcagtgtccttggggattccagcgggaaacgagcgttgaggctgcccatgaaagacctgtccttgaaagaccgaanagagctataagaaatcttttgaatgctctatcaattcacggaaaccgcgcattaatggangcngaaagtgctggcttcttgaaaagctacagtccagaggaggtccaaagtggcagtatcccggagcatcgaaagatatctttttcacgtctgcatatcgacaccagcatcgccgagattctgtttgcattccacgacgagtatgaggatacgctctgcaagggcgcattggaagaagaatgctacatctctgcatgcgcggaggaacaagtctgtcgccgcagttccagcgacgagtcagtcaagcctgcactccatgttgggatgatcgcatcgggagacacggtaatggagtccgcagaacaccgtgacatgattgcggagacggagggggtaatcgcctttgagaccatcggggcaggaatgtgggatactcttccttgtgtgataatcaacggcgtatccgattatgctgatggccgtaagaatgaaggatggcaaaactatgcagcggcagtagccgcttcaggtgctaaagcgtttctgcaatactgggcaccctgtgcaaaagctagtgagtga

SEQ ID NO: 3096 - DNA, 438 bp, A.fumigatus
catatactgaggataagcacgcagacaatccaattgtgtcttttcacaaagacatggagctttgccaactatccctcgtctggcctgaaggacatcacgtttcccatttcgatggcggatacgcctcacgagactggctactatttcgcacagcaattcaccttcaccggtgtctttgatgtcgggcatatcggtctccagccccgttccgatgcctccggttcaagcatcgtccacgctgttttctccagcttcgtgtccggaaccacgagcaccgacccaaactgccacgacggcgcagacggcggcgcagatgtcagctgcgcggtggaaatcccagctccatatgctccactctatgacctcgtggtccagaactcagccgggaccacctgtcttcatccatcggggatggacagagcgcgattaagccaaccc

SEQ ID NO: 3097 - DNA, 390 bp, A.fumigatus
cctgcaggaggaacaattggaaccggtctgtttatcagcagtggaacggccatcgcgcacgctggtccagtcggggctctgatcgcatacatctttgtcgggacgatcgtctactcggtgatgacctcgctgggagaagttgcgacgtacatccccaccgcgggcgccttcacctcgtatacaacacgactggtcgatcccagtctgggatttgccatgggatggatctactggttcaactggggcttccgactacgcggtggaattgacggcctccgggatgatcatcccctactggggacgaggaactggtcgattgctatctttctccggggtgttcgggtgttcaccacgccgatcaacttccggcccgtcggcttctactgggaa

SEQ ID NO: 3098 - DNA, 537 bp, A.fumigatus
tcggaagccccagttgaaccagtagatccatcccatggcaaatcccagactgggatcgaccagtcgtgttgtatacgaggtgaaggcgcccgcggtggggatgtacgtcgcaacttctcccagcgaggtcatcaccgagtagacgatcgtcccgacaaagatgtatgcgatcagagccccgactggaccagcgtgcgcgatggccgttccactgctgataaacagaccggttccaattgttcctcctgcaggctattagacttttttttcttgttgttccccctcctccgtaaaagatcagatactgaccgatggcaatcatctgcaagtgtctatccttcaactgccgcttcagatcgggcgtctccgactcctgtacctcctcattgctctcctcatcgctgtgatggtcgcctcgcagcgagtttaccttgctcgagcgaaaccgaaccttgtctgctaatctccgacgcttttcagcgctggatacctccagacccttggcatctgaggtcagattgtcttgaacagccatga

SEQ ID NO: 3099 - DNA, 210 bp, A.fumigatus
aagcctagtgtgttatatttgatctatcgctcctctctgagccttgtggctctcccttcggggttcaagggctgcttgactcgggatggatggaggatgataaaggcgttcggcacatctccttgttacttcgacggacgcgatgaaggcatctctgataccaaatacattacttggtggtgtttgctcctccatggactttccatatga

SEQ ID NO: 3100 - DNA, 183 bp, A.fumigatus
gacgacggcttttattccgttcatcagactcttccgactttgctgaacgtcgagtggcagcataacaatactgttgaaaattctgtacacgcatactcgaagccatatccagtctgcaataatggagatttcgagttcaagcatgagcaggcctacctcgatgaggggcagaacttttggtga

SEQ ID NO: 3101 - DNA, 879 bp, A.fumigatus
ttaagctgctacttggagcatggggcagatgtcaatgcaaggagcgcgtttaaagggtggacagcattctttgaagcagcttctaatggccataaagctgtggtgcagttgctgtttgattgcggggcagacgtcaccatgaaagatgaggatgggtggacgccgctgtgtcaggcagcatccagaggacatgaggcagtggcagggctactagttagccatggagccgatatcaatgcaagggacggaaatggaaggacagcattataccgagcagcttctgatgggtatgaggcagtggtatgtctgctacttgaccatggggcagatattaatgcaaggggcaagtataagggtcggacggcactctttgaggcagcttctaatggccatgaggcagtcgtgcatctgctacttgaccgcggggcagatgtcaacatgaaagatgaggatgggcggacgccgctgtatcaggcagcatccagaggacatgaggcagtggcagggctgctagttggccatggagctgatatcaatgcaagagataatgatgggcagacagcactgttccgggcgtcttccaatggtgatgaggctgtggtgcagttgctggtcaaccgcaaagcaaatgtcaacgtggcggactactttcgcgggatgacaccgctatcccaggcagcttccagaggtcatgaaggggtagtgtccttgctacttgaccatggagcagacatcaatgcaaaggacagtggcgagtggacggcactggatgtagcggcattcaaagggcatgaggaggttgtacggctgctcagatttccacagaagtttggagtctctttcaagtttcaccaaaagttctgcccctcatcgaggtag

SEQ ID NO: 3102 - DNA, 1017 bp, A.fumigatus
  unsure (76),(224),(278): Identity of nucleotide sequences at the above locations are unknown.
ctccgggcgtgttttgtcaggaatttgttgacctggtacagggaaccaaactcacattcagtacatccagccttantacctgattttcaagtcgctagctgcgtacctgaagaaacattatcccaaagaatcaccttgaaacaggagtctggtatcgatgcgcaagaagcgctcaggcaaattaaaagcggcgcttccggccagacagcaccaccagcacctcntccacctcccgtgccgactttgaatgtccctggaggagtcccacctccgccccntccgccacccggcgctcttcctgcgcccgttgctgcagcaccggacatgtcggcagtctttgctcagctgaaccaaggcgatgccatcacctccggcctccgcaaggttgataaatccgagatgacgcacaagaaccccagcctgcgtgcgggtgcaacggtccctgaacgccccagctctcagggtagcatttctcgctccaagtctcctgccccgagcaagaagcccaagccagagagcatgcgtgctcgtaagccgccgcgtaaagagctcgaaggaaacaagtggctccttgagaatttcgataaccccggtggcatcatcgagatttccgctcagcagaatcagtctattctaatcagccgttgcaacaagactattgtaaaggtgaacaacaaggccaacgcaatctccatcgacaactgcaacggtctttccatcatcgtggattcgcttgtcagcagcctcgatgtcatcaagtctgccaaatttgctctgcagattgacggagtcgtgcccactcttctgcttgaccaagtcgacggtgcgaccatctaccttggacagcagagcttggctaccgaggtcttctctagtaaatgcacggctgtcaacgtcatgctcccgcctaaggagggaaccgatgatgataccaaggagtgcccagttccagaacagatcaagtcatatgtcaaagacggggttctcgtgagcgaaatcgtcgagcatgctggctag

SEQ ID NO: 3103 - DNA, 762 bp, A.fumigatus
  unsure (47),(128): Identity of nucleotide sequences at the above locations are unknown.
tcgttcgaaccggtcaccccaccacagcacagcgttccatttgggcntgaaccggcttatatcgcaaacgagaacacaggtctttacactgcgattcctgacattacttctgcagccaccttcaatcntatgatgcagctaccgccgtcaaacctagcaagcgcgtcttacccgatgcctgccaggacataccattcgaacgtatattcggtgattgaggggtctccaacgtacaagcaacgtcgtcgtcgctcttcaattccaccgagtgccgcggctaatggacacgcccaaacaacatccccaccatctcagcagattgcgtatgccgcccatcggccgagtgatctccgacgttccgtctcaaattcggtggtgccggcagcagaaggggaggacacacatgaagcttctaatcatggcgcaaacggatatacttctgcagttctcccacggaggaatttgttgcacgatatgtcccgcaacgggaccccgctctcaaatgtcgaggaaaatcctgagtcgaatcctcagacgacgggccatcaggatgacctggtcacgcttcccaatggagaagcgtacgagggaggtgtgcagaacaatgtttcaaataaagtggagcgatttactcctggccccattcgccgcgcccgaagtgctacaatgatggagctaggaccataccctcagaagtctcactcgtgcccgattccatcgtgcgggcggcttttcaagcgattggaacatctcaaacggtga

SEQ ID NO: 3104 - DNA, 642 bp, A.fumigatus
attctacaggcttacttctggaccaatactcgcaagaacataaccaaatacaaccctatgcggggcattgttgacgatgatgtcgctcgcgtccttctgcacgatgtcattgtcgcaaaggatctcgcgaaagcagaacgagaactgctggcgatgtcagggctgaagaaattcatggcccggttgcccaacaatcgtgagaaggattggttccgccgtcacctgcgtaaatacatccagatgtacctgcctgactccccgtttgagatcaccacgaccaatcgctacacaattacggaatatgaggctgcagtctgcgctcgcaaattcatcaagcaaggacaggaaatcaagtatctcagcggaactcttgtcccaatgactcgcgaagaagagcgggatcttgacctgaagcggaaggatttcagcatagtgatgtccagcaggaaaaagactccatcttttttccttgggcctgctagatttgccaaccacgactgtaatgcgaacggaaaattggtgacacgtggatccgaaggcatgcaggtcgtcgctactcgtgacatctacattggcgaagagattacagtatcctacggagacgactatttcgtcttcacgccgcgccggaagaaagagagc

SEQ ID NO: 3105 - DNA, 1038 bp, A.fumigatus
accaccgcaggagtcttcttggtaccccactatccaaggagggctcgcaaaatctcacactttggttcggtaacccgaaagctccatttcgcagaagaacggaggaaggtttgccaagctcaccaggaagagagcgagagggatgatgagccccagagaaagcagcctatggtgcgaaagaagtcaggggaacttgtgagacccgcccttcgccctccgtcggcgcggcggcgcccgtctagcatgccgggtacgcccacctacgcgaaggcggtgcattttgactctcaacttgaacacattcgtcacttcttgcagttggacaagccacaggcggtcagtgccaacacgtctcctgcggaggactataacaacgaaagtgaatttccttttgaggcgccttccttcgagcgggagattcgactttcaaacttcccgaaggatgtctcctctagagctcttcaaaaggtgcggctcgaacgactattcctatcatcggacaaggatacattggttggcgtggtggcggttgccaatctggcttttcagaagcacattgccgctcgctttaccttcgactactggaggacagtctctgaagttactgcggaatacagtgacgatgtccgtcggaagcaagctaatgacggctacgaccggtttacattcagcatcaagctcactgaccatgcaaacttggagcagaaaaccatgtttgtctgcgtccgctatagcgtggctgggcaggaattttgggacaacaataatttcatgaattaccaagtcaacttcgttcggatcccccggccacgcccagagccgcggaggccatccgctgcaacctcgcgcccaactcttcctcgtagcaagagctttgccggcgtcaacagccgtccttcgatgccttcctcgctcgatgattttgatgaggatatgaacgattatttgtcctttggtcggcccaagaaacccttgaaagaggaatcttcatccgagaatctgttgaaggaggttcacagaatgtctgcttccccgtga

SEQ ID NO: 3106 - DNA, 444 bp, A.fumigatus
cccctcacgattccgagtataaaacatgcgccagtctccagcctccatcctccacaatctttccacaaggaagcgacttctgtgccattcaataaaatgaagacaaaagcaacctccctcttcctctgcgtctcggcgcttgtatcctcaatctctgccctcaccatcagccgaatcaatggaaacaaatacctctcgccctacgccggcgaaaccgtctccaatatccaaggcctggtaacagccaaaggcccctctggcttttacctacggtcaacaaccccagacgacgacgacgccacctcggaatccatgtacgtctacggcagcaccgctgtctccaaagtctccgtcggcgacatcatctccctttcggggaaagtctccgagtaccgctcctcggcctcatacgttgtcttaaccgcggggcgagataggcgtaag

SEQ ID NO: 3107 - DNA, 261 bp, A.fumigatus
acattcccctttttgctcagaggtcttttggtctttattggatgccgttggctgactggtgaaaacggccctaggcttttgcatgtcgctggcacatatttttttacgaagggtttccttctcactcggatggtcttggaagataaatcagcttgcgacgttcttcctttcgacgattcgtcttcgtcagcaagtaaagggaaacaaggatgctggcatgaaaagtcatttgacaaggctattgtgatcactatagatgca

SEQ ID NO: 3108 - DNA, 1332 bp, A.fumigatus
  unsure (278): Identity of nucleotide sequences at the above locations are unknown.
ggtcttttaggttcgccaagtttcccaacaccagtcccaaaaattttcgtacgcatcccctcaacgctttttgccagccgccagtcgttttcggatttccataccagccccaacttaggtatgatacagcttacgcccccttcaaatgcacagtcaagtcttccgtaccctcctgtcatgcacttgactcaacatactcttcaacctgtacaagcgccgatgatgagtcctccaatgcgttggggttttgaagcgtcaccacctacaggaacctttgntagtcctcggcgtagcaatcaatggacgccgcggcaatttagcacacaccagaatcaatcttcctctaatggaaactcaatgaaacacggcggaaaacgggatcatgcatcggcatttggaggaaaaccgccaacggttgcaccttccgttcctgcaccgcctccggtcccaagcttcggcaaccctctgcctgtgaaacctcctccggcagttgatgctgcaaatccaagaaaaaagaatagaaaacacaaccagttagggcttacacccaaaaccgaggatcatgaatcgagtgaggaggacgacgtggatgaagaatccaggttggcgcctgcggctgccagtgctatagtgccgttgcgattcacctataaaggacggacgtccacacttcagtcacccacagacattgccgcatggattgaggaacggaagaaacgatttccgacgcaagcaaaggctgaagagaagaggaaggctatgcaggaggccaagaaggcccgtgaagaagctttgaacaagaaaaggattgagagacaggagcaaagacgagcccagaaggtcgccaatgatagaccagagagcgtcattgatccggcggatgcggccgcaaaggcgaaacgaaaggctgataagcttcaacgcaagttgctaaaggagcaggaacgggtagccaaagcggaggcggatgccgagcgggctcggctcgaagttgaaaggctgcagaaggtggccatggaggcgagaagagggtcagagtctgcaacgcagaaaactgaaattcaaccttccgtcgctgcagaaaagccggacccagaatctggtcagaaagtggagatggtcggctccaaggacaacaactcggaggctgtggctgtccctaccgagagttctatcgcatccatggcccatgggacagtggtaacaaagattgaacccggtgactcggtagagagtcgaaacgaggaatccgccgcatcatctttcgacgattcggacagcagtgactggacgtcatcaagtggatctgacatctcttcggattccgacgag

SEQ ID NO: 3109 - DNA, 798 bp, A.fumigatus
tatgttccagtacgtttccctctcgctatcaattcggaccaccgcctgctgacaacttacagatccgaagcgaaaggtatgctcatggacttcaagtccagagaaaagggaggcaccacgtattctcatgtgcttgaagtccttctccgtatgcgacaagtttgcaaccattgggcgctctgcaaacaccgtgttgacgccctcgcgggtctactggagaagcacaaggtcgtcccgttgaccccggagaacataaaagcccttcaggacacgctgcagctcagaatcgagagccaggaaatgtgccctatctgtctcgatatcctagagcagcccgttatcaccgcttgcggccattcctacgaccgaggttgcatagagcaagtcatcgagcgacagcacaagtgccccctctgccgcgccaacatcgacgacaactccaccctcgtcgcccccgccgtggatctcggtgaaagcgccgacgaggacgtcgacgcagacccaaacaacccaagtagcaagatcgaagccctgatcaagatcctcaccgcgcagggccaagcacccgacaccaaaaccgtcgtcttcagccaatggacctcgttccttacccttgtcgagcctcacctgcaacgccacggcatcggatacgcccgcatcgacggcagtatgaagtcgacagcccgcgacgcctccacatacaagttctccaaggacccacagtgcaaggttctcctcgccagtctgagcgtctgcagcgtcggcttgaaccttgtcgcggccaaccaggccatcctg

SEQ ID NO: 3110 - DNA, 231 bp, A.fumigatus
agatggcgctgctccttccagccccgtggtgaagacggtcgtctcctcctccaggcactgatgagcgcaatctgcctgaggcgaagaaaggatatggaatttgtcaatctgcgcctgccggccctcacctcgcgtgtgttgcgcatcaagtttcatcctcatgaacaagagaaatatgatatgttccagtacgtttccctctcgctatcaattcggaccaccgcctgctga

SEQ ID NO: 3111 - DNA, 663 bp, A.fumigatus
agcaacaataccgcatcaggtggttatgtctggggccactatgtctcgcaatacgccgatgtgaacctgtacaactacgccgtcagcggcgccgtatgctccaacgagatcaccccacgcacattctcttccattaacgctcctttcccttctgttttggaatacgaagtgtccgccttcctggctgacagcaagcataaagtctctggaaagaggttcctccacatcccaccccgggaaacggtgtactcgatctggatcggcaccaatgatttgggcaactacgcctttatcaccgactcccaggtcaaggataaaaccatcccggattacatcaactgcgtgtactctgtgctcgaccgcgtctatgcaagtggcggccgatacttcgtgctcatgaacctggcgcccctgcagctggcacccctgtatgcgacgcccgagaacggcggcgtgggggccaaccactactggcccgacaagcccgataatctgaccttgaccagttaccggatgtgggagcaggttgcgactgtgaaccatgtgttccagtaccagacgccgtatgagctgttggtagcccggaggtatcccggggcgcggtttgcggtgatggacatgtatggattggtatgttgcgtattagtcattgggtctggatga

SEQ ID NO: 3112 - DNA, 267 bp, A.fumigatus
tcattgggtctggatgacactgatttttggcagctttccgaggtttattacaatcccacaaagtatttcaacggaagtgcacaggccaatgtgaccgggttcaacaatcactgcacgcttgacggagggcagtgcacccggctcccaagtccagattccttcatgtggttcgatgagttgcatccctcgcagcgaacagaccaaattatcgccgaggagtttgtcaaggttgtcgggggggacagtaagtgggctacctactggtaa

SEQ ID NO: 3113 - DNA, 207 bp, A.fumigatus
aatactttgtgggattgtaataaacctcggaaagctgccaaaaatcagtgtcatccagacccaatgactaatacgcaacataccaatccatacatgtccatcaccgcaaaccgcgccccgggatacctccgggctaccaacagctcatacggcgtctggtactggaacacatggttcacagtcgcaacctgctcccacatccggtaa

SEQ ID NO: 3114 - DNA, 477 bp, A.fumigatus
ccaactgaacttaaatcacagaatatggcccaaaagccaaaaaaacaacgagtgaccactgccgtcttcgtcacatctattccccttgatgctgagttcgatgagatccgcgacgtcttctccaagtgtggcgttatcgccgaagagattgacagtggccggccccgaattaagatgtatatggatgaaaacggcaagttcaagggcgaggctttgatagtgtatttccggccggagtctgtcaacctcgccatacagatgctggacgagtcagactttaggttaggggtgtcggggccgcagggaccgatgaaggtccaggctgcagatttctcgttcaagagccaacaagaggcaccggcaaagagcagcatgagggataagaaaaagatcatcaagaggactcagaaactaaataggtctgtccaaggcaacccgcgggacttgacaagatgtgggctgacgtggtcatactag

SEQ ID NO: 3115 - DNA, 618 bp, A.fumigatus
gacttctcatcggcatcatttgccaattccttggtcctggcaaccaacaatgccacagacacaccgttggacctttccacgccactgtcacgggtgctatttgaccttcaagaaattgatactcatatacacaatctgacgagcaagtcagctatccctctgcttacgcacacgcgagatcagaccgttgctgcagagcggattctcaaggagacggaggagcaattatcctctgtgaccaaaggctatgaacgcctggagcaagaagttttacgaaaatgggaggccgcggatgaggctagagtggctgcagaaaagtcgttggcaaccgtgcgattagcgagagcggtcgcgcgttgtctggctctcggcaggcagttggagggtcagctttctgaggtaactggtcgaggtggccccgcagcgactgcaggagcacaagatcgctcttctgccaaccctggcagagaggactaccgggcgctggagcgagccgcatctaccattgtgagtttgcgacggatgttctccgctacagccgtgggcgaggaaggctacggattggaacgtgtcaacgtcatccggactttgagaggtgagctggtgattcccggctga

SEQ ID NO: 3116 - DNA, 429 bp, A.fumigatus
ctgacaacgtttaggggcattcgttgggctcccttgaatatcggtattgaacgacgcatgcagacgttcgtggtcttatgccacactttgacaatcgcgatattcctcacagtgttcttcttcgcttgtgccctacctgtcttctggccactgttactaccctacctagtttacatttcacttttttcatcatctgcaacgtctggaacgttaagtgggcgtagcaatttcatgcgttcgctctcaatatggtcactttatgcctcctattttcctgcttgcttgcatcgctctgaagcgctacttccaacacgcaaatatatattcggctaccacccccatggcatactttctcacggtgcatttgctgcatttgctactgaagcactcggattttcgaggttgtttccgggaatgtcttcaccacgg

SEQ ID NO: 3117 - DNA, 216 bp, A.fumigatus
gtgggcgtagcaatttcatgcgttcgctctcaatatggtcactttatgcctcctattttcctgcttgcttgcatcgctctgaagcgctacttccaacacgcaaatatatattcggctaccacccccatggcatactttctcacggtgcatttgctgcatttgctactgaagcactcggattttcgaggttgtttccgggaatgtcttcaccacggg

SEQ ID NO: 3118 - DNA, 1113 bp, A.fumigatus
  unsure (172): Identity of nucleotide sequences at the above locations are unknown.
atattagcaagcgggcagttttcgcaccttccagggtacggaaccctttgcagcctggttgacaggttggtccactggattggccaagatcacagcagcgccgtcggtagattttgcatggcggcgattgattctggcagttgcatcgatttccacccggactatatcccanccagtggcaagacgttcctcctcactacgctgatcatgatcatccacagcttcatcagtagcatgccgacgaaatgggtcgcgaggttcaattcatacggttccaccttcaacatgatggctctcgttgtcgtcctcattgccattcctgcgggtacgaagaacgaaccgaaattcaatccgtcaaaagaggtatggggcaccatcaccaacggtacggagtttccggacggcgtggctgtgctcatgacctttgtcggtgtcatctggacaatgtcaggctacgattcgcctttccatctgagcgaggaatgctcgaatgcaaacgtcgcctcgccgcgcgccattgtgatgacctctggggtcggcggcctcatgggctggtttctgcagctggtagtcgcctacactgtcctcgacatcgaggccgtaattgactcggatctcggacaaccttgggcatcgtacttgctacaagtcatgccgcgcaaaacagccatggccattctcggacttaccattgtctgcgggttttccatgggccaaggctgcatggttgccgcatcgcgagtgacctacgcctacgctcgcgatgattgcttccccttgtcacggatctggaagaaggtcaacgagaggaccaagactcctgtcaacgccgttatcctcaacactgttctgggtattctgatgtgccttcttattctggcgggcgatgtggccatcggagccttgttttctattggcgccattgcacagtttgtcgcctttaccatacccatttctatccgggtgttcttcgtggggaaccgcttccaaaaggggccatggcacctgggcccatttggtccggcgattggagggctcggcgtcttgtttgttctgttgatggtgcccattttgtgtcttccccagcgtgagaggggcggatttgatccctga

SEQ ID NO: 3119 - DNA, 198 bp, A.fumigatus
  unsure (165): Identity of nucleotide sequences at the above locations are unknown.
caagcgggcagttttcgcaccttccagggtacggaaccctttgcagcctggttgacaggttggtccactggattggccaagatcacagcagcgccgtcggtagattttgcatggcggcgattgattctggcagttgcatcgatttccacccggactatatcccanccagtggcaagacgttcctcctcactacgctga

SEQ ID NO: 3120 - DNA, 264 bp, A.fumigatus
tggtgcccattttgtgtcttccccagcgtgagaggggcggatttgatccctgaccagatgaactggacttgtctggtttggggtgcgccgatgctgacggtgactatctggtgggtcattgatgcacgcaggtggttcaagggtcccaaaatcaatgtggagcatgttatccatggcgtggaggcgatcgtggatgtgggggtggaggcggaggaccaacggagccaaagtcaagatgcagcgagcaagtcttcgaatgtgtag

SEQ ID NO: 3121 - DNA, 252 bp, A.fumigatus
caactttgccgtcggaaaactgctgctagagtgctttactgtacttcatggtatccttctctcgccgtcttcaaccagcaagacctctttgcgacctcgaaaacgcacattgagctcactgtccaatgccattctggtctcacacatttccattatcaaatttcctccgactgcgccgtctccgcacctccacgtgaccctccccagacgcaactttccccactttcatccattatcggtctttatcgctaa

SEQ ID NO: 3122 - DNA, 1212 bp, A.fumigatus
gccgagcaaacggaccccatgcaccggcttgcccttgtcacagcatatgaggccatggaaatggcaggcatgttccccgccgcaatccgttccacccggccaaaccgcatcggcacattctacggacaagcgagcgacgactggcgcgaactgaacgcctcgcagaacatcagcacgtatgcggtgcctggtggcgagcgcgcctttgccaatgggcgaatcaactacttcttcaagttttccgggccatcctacaacattgataccgcctgttcgagtggcctcgcggcagtgcaggcagcctgctcggccctgtgggccggcgaggccgatacggtcattgctggggggctgaacgttatcacggatcctgacaactacgccggtcttgggaacggccatttcctctccaagacgggacaatgcaaggtttgggataaggacgccgacgggtattgccgcgccgatggcatcgggtcggttgttatcaagcgcctggaagatgccgaggcggacaacgacaacatcctggctgtgattctgggcgctcgcacgaatcattccgctgaggctgtctcgatcacacacccgcatgctggcgcgcaaaaggccaattaccgccaggtgctgcaccaagcgggcgtcaacccccttgatgtgagctatgtcgagcttcacggcactggcacccaggctggtgatgcggtggagtccgaatcggtgtctgatgtctttgcgccttctacgcctcgccgtcgacccgatcagcgcctgtatctgggcgcagtgaagagtaacatcgggcatggtgaggcagcggcaggcatcacttccctgctcaaggcgctcctggtgttccaaaagaacatgatccccaagcatatcggcatcaaaaccgagatcaatcctatcattcccaaggacctggagcgacgccacgtgggtttggccatggagaacaccccgtggccacggcctgccgggaaaaagcgtcttgcggtcgtcaactcgtttggagcgcacggcggcaacaccaccgtgctcctagaagacgccccggagagagtgaaggtttcaacccaggacgaccgcacaactcatccagtagtcatctccgcaaagagcaagaagtcgctccaggcgaatattgagaagctgctgtcgtggctggatcagaacccggacgccgaaacctcggggaactttccttaa

SEQ ID NO: 3123 - DNA, 441 bp, A.fumigatus
ctatccgctctagtgagatgcattttgagtatctttgaagctagtactgataccatgttctcagttatcgtgaagcatcaaggcaaacgtcatgaagtcgagctcgatccatctgcaaatggcgaaacgctgaaatatcaaatgtactccttgactggagttgaacccgagagacagaagatcttggtcaagggtggccagctgaaagatgagacgcctttgtccgccctcaacgctaagccaggtcagacatttatgatgatgggtacaccgtctggcggccaagatgcggtagacttgggacggccaaaggaaccagtcaagtttcttgaggatatgaccgaagccgaggcggccagagcggaaggtgccattcctgctgggtctaaaaatcttgggaataactggtacctcaactcctaccctacaaaccctgaagga

SEQ ID NO: 3124 - DNA, 459 bp, A.fumigatus
tctcaatcactgcgcccgtaccttcaatgcgttcggtcctcgcttaccgctgctcttgcaatctcgaacttcgcctcgcaaacctccgaaaggcataatgtccctgaaatcgaggctcagagctccccagaactgctcctcaaccccctcacaatttctcggaatgagaatgaaaaggtcttgattgagcccagcgtaaacagtgtgcgcgtcagcatcagaattaagcaagcagatgaaattgagcacatcctggttcacaagtttaccagattcttgacgcaacgagcagaatccttcttcatcttgcggaggaaaccagtcaaggtacgtaaatccaggccgcggagaggacaagtcgctcacctgttcaagggatacgacatctcgttcttgatcacgcccttccatacagaagctatggtcttcaccacggggctggaaggggccgctgccatt

SEQ ID NO: 3125 - DNA, 516 bp, A.fumigatus
gtatgtatgaatgataggcctcccccttgcacaaccatttccgtcggtttcatttcatatttgagcactcacttgctcatatccaatcgcgttacactgatcccctttacaattccaaaccaacaaatcacttttgccattgtacttgtctattattttttcttcctttttttttttttttttaatccttttgaccacttgctccagaccaatctcttgattatccataacagcactattgcgtcgcattttagtttccagcgaattatactcccttgccaacctgtatcctatcatcattcttcttcttcttcttctttgttgtctgcaatccggtttattatcacggcgcgcagcgacaaaaacccgcccgttgtggcttgttctcgtttacgggtcaacccgggccgggctgacatcagcggtagcctcaaattatgtcggaacccctttggttcgttcctcctccccttgggaaaaacggatttcccttccccctatctcccagatatctcc

SEQ ID NO: 3126 - DNA, 408 bp, A.fumigatus
tggactgtcagacactcaattgaactcttcaatgccacagatggctccagacataggaaaacacgtaggcaatcaggactttacccgcgcgacggcggtcatcatcggagctggcatctccggtctgtaccatccatagacgcttttcgacgtattgcacgtgcggcggttgacataagaccaggaatatgcacggccattgacctcatcaaacgcagcaagtgccataactttatcatcctggagaagagcagcggggtgggagggacatggaacgataaccgctacccgggatcatgctgcgacgtctggagttccctgtacagttactcgtttgagcagaaggcagactggaccagggaatacccaggtcaagaggagatcttggtacttcctaccgtcgtctga

SEQ ID NO: 3127 - DNA, 522 bp, A.fumigatus
gtaatggtgataggcgcaaccgccgcccaaatcatccccgaaattgccaaaaccgccgcgcacgtttccgtctaccagcgcacccccaactgggtcatgccgcgtctcgacaggcccgtgggtgcggtgcaaagagccctgctgacatacatcccgcccatccggtggcggaagcgcgcgctcatgatggacttccgggagtggttcttcgaggccgtggttgataggaactcggcgctgtcggatgtgatccgcaaaacgtgtcttgagagcatgcgagcgcagttgcccgacaggccggatttgtgggatgtgttgacgccgaattactcgccgggatgtaaacgggtgatcatctcggacgatttttacccgacactgggacgggagcatgtcgccctagaaactcgtcccacccagcggattacggaaacggggatcgacactgccgacggcgagaccaaggagtttgacctcattgttgcggcgacggggttcagaacggtcgagttcatgtatccc

SEQ ID NO: 3128 - DNA, 585 bp, A.fumigatus
caggattatctgattggcgtcgctcaaaagtacggcctatacaggtacatccggttcaactcggctgtggaggacgcacgatgggacgaagccgacctcaaatggaaggtcggtgtccgagtctcgggaggaaaagatagccagtacctggagtcgtatgaaatcaccaccgactttctcatttcggctgtcggacagctgaacgtcccacgcatgcctgatatccccggactggacgactacaagggcaaactgatgcactccgcccggtgggactggagcttcgactggacggggaagagagtcgccgtgatcggaaacggtgagtctcgcgcctcacactgcctaaggcaagacgtaagtaatggtgataggcgcaaccgccgcccaaatcatccccgaaattgccaaaaccgccgcgcacgtttccgtctaccagcgcacccccaactgggtcatgccgcgtctcgacaggcccgtgggtgcggtgcaaagagccctgctgacatacatcccgcccatccggtggcggaagcgcgcgctcatgatggacttccgggagtggttcttcgaggccgtggttga

SEQ ID NO: 3129 - DNA, 312 bp, A.fumigatus
ctaacgtcgcgacagatccttttcctcatcggcttgacgttaatcattggagttcaacggacactcgctttcttttcgcgccgccaaaaacttaagggcactgccgctttcgcggcaggcatcctcctcatcctgtttcgctggccactgacaggtttcctgatcgaattatacggtctcttcatcctcttcggcgatttcctcgtaacaatcggtcaatttgcagggaacatcccggtcgtcggtccttatatcaagacggcattagagaccttggcgggtgggagacggaacgcagagctcccggtataa

SEQ ID NO: 3130 - DNA, 642 bp, A.fumigatus
cggcccttgcgtgaccacggtttcactggctttgcgttctactctagctgggcctaccatgcacccaacaacagcaccgtcgatttctcgactggtgctcgtgatatcacgcccatcttcgagcttgcaaaggagctcggcatgtatatgattgtgcgcccgggaccctacgtcaatgctgaagccagcgcgggcggcttccctctgtggctgatgactggcgagtatggctcgctgcggaatgatgacccgcggtatacggccgcgtggacgccgtattttgcaaacatgtctcaaatcacgagcaagtaccaggtcacggacggccataacacgctcgtctaccagatcgagaatgagtacggccagcagtggattggagacccgaagaatcgcaatccgaataagactgcggtagcttacatggagctcttggaagcgtctgctcgtgagaatggtatcacggtgccattgacaagcaacgatcccaacatgaattcgaaatcttggggatcagactggtccaatgctggaggcaatgtcgacgtggctggtctggattcctatccgtcagtgagttaccgtccaattattttttatctgatctgctctgactttggaagtgctggacatgcgacgtaa

SEQ ID NO: 3131 - DNA, 696 bp, A.fumigatus
  unsure (640),(688): Identity of nucleotide sequences at the above locations are unknown.
ttgattattatgactacttccaagaagttcagcccactcttccctcattcatgcctgagttccagggcggttcctacaacccctgggccggtcctgaaggtggatgtcctcaggacaccagcgctgagtttgctaacctgttctaccgatgggaacattggccagcgagtgactgccatgagtttgtacatgctgtatggagggaccaactggggtgcgattgctgctcgtgtgacggcaaccaggtacgagtactccgctcccatctccgaagatcgctcgattggggccaagtattccgagaccaagctactggcattgttcacccgtaccgcaaaggatctcacaatgacagaggcgatcggaaatggaacacaatataccacaaacacagccgtccgtgcattcgagttgagaaatcctcagacaaatgccgggttgtacgtcacattccacactgacaccactgttggtggcaatcaagcattcaaacttcatgtcaacacttctgtcggtgccttgaccgtccccaagaacgagggcctgatccagctgaatggacatcaatccaagatcatcgtaactgagttcacgctcggcaaacgcaatattttatattcaactgccgagctcttgagtnttcactcggagcaggaaacgggatccgcgcatatgaggccgcaaccgnacgaagcg

SEQ ID NO: 3132 - DNA, 585 bp, A.fumigatus
cctcggtttctcctcctctcacccatagttgcgctcccaagtgatatcaccgatgcccttaaaatcgctcgcctcgcttctcactggatgtttggtctcttcatcgcagccactgtcctgaatttcatcctgatcttcctcgctccatttgccgtctcctctcgtcctcctcagacaatctcgcctgatcctagcgtcaacgaattgcatcctccgcaccggcggcgcaccttccttttccttcgggcctttccttttctcattcttactttcctcgccgctcttttcaccattgttgcctcagtggttgccacggtcatgttcagcatcttcaagaacgtcttcacatcgtcaggatacgatctcaacataggggctgaattggggtcccggatgatggcgttcatgtggattgcgtcggcagtcaatctcctggctttcatcttagagcttggttcatgttgtgctgcgtgttgcggcggccgcaaggctcggaaagagctcaagtccctcaagaagacagaacgaggagctataaacgaaaagggcagcccccatagtcctgcgacgaccgtaacaggttga

SEQ ID NO: 3133 - DNA, 336 bp, A.fumigatus
  unsure (132),(270): Identity of nucleotide sequences at the above locations are unknown.
cagacgattatggtgctctggagccttcgatctctggcaagatcatggagcttcaccacaagaaaccaccaccagacctatgtcaacagctacaaccaggccatcgagcagctgcaggaggctcaggccaanaatgacattgcgtctcagatcgccctgaagcccctgatcaacttccacggcggtggtcacctcaatcacactcttttttgggagaatctggcccctaaaagctctggtggtggtgagcccccgagtggtgcgctggcnagggccatccatgagaactatggcagcttggaaaacttccaaggtaaaatgaaccccgctttggcc

SEQ ID NO: 3134 - DNA, 420 bp, A.fumigatus
  unsure (388): Identity of nucleotide sequences at the above locations are unknown.
acatacttcgttgcatttgcctccgttagactggtcatggagtcacccacctcgtcgtccttcgctggtcagaagcgtaaaatcgtcgagatgagctcagatgaggaagatgctcgccctcctacaggattccgccgctttgcgagagcttcctcgcgctccgaatcgcctccttctttcggcctgggaagtgctcgtcgtaatccctggaatgtcaacatgcagtcagccaccgcagccccccgaggcggaaacgccaatagcagcaaacccatcactggtagagggaattcttttgctgcgcgtatgatggctaagatgggttacaaagaagggcaaggtttgggtgcaagtggacagggtattgtcgccccgatcgaagcccaancgccgccgaccgggcctggggttgggttgccg

SEQ ID NO: 3135 - DNA, 1044 bp, A.fumigatus
agactcgccaattgcgctgtctggatcaacctcatcgtcatgttcatcaccatgggcggagccgccaacgcgccccccaactacgcggccgcctcggcgtcggcgggtgcggtcatcaacgaggccctcatcacgccggtgaacggcgtctatccgcccgtccagacctccggcggcctgcccgaggcgggtaacttcgtcggctcgctcaatggcgcgatgcaagccgtgtttgcatacgggggggccatggtgttcccggaattcatgtcggagatgaagcggcccaaggactttctgaccgccatgtgggcggcccaggccttcatctacttctggtacatgttctacggcctgttcatgtacggctatcagggccagtacaacgtcaaccccagctacctggggatcggctcgtacaacatctcgacggccggcaacgtctttgccatggtcagtgcggccattgcggcgggtctgtatggcaacatcggtctgaagggtatgtctgccgcaaaaagtttccggaggtgtgttaatgccgtactgaccgtcttagtcctgtacaaccaagtcttcgtcgagctcttgcggtgcccgccgttgaccactcggggcggcaagtggttctgggtcatcctggttcccatctactgggggatcgcctttgctctcgccgccggtatccccaacttctccggtctgacctcggtggtcgcggccgtgtgtattctgcaattcacctacagcttcccccctctcctggccctggcgtactgggtcaagcgcgccgccctgcgagacggagagggcttcgatcccgcgacgggccagaccattctgcacgatcggagcatgtcgcgtgtcatccgcgggttcctcgcgcagagacctaaggaactggcgatgagtgtgttcaacattttctacgtcttgggtgcattggtgttggcgggaatgggtgcatactctgccattgagagtctgatcaatgcttttgcacagagccgtacgacgtcgtatacctgcaagatcagtatatga

SEQ ID NO: 3136 - DNA, 657 bp, A.fumigatus
  unsure (150): Identity of nucleotide sequences at the above locations are unknown.
gtccgcaatgagtaccaacaagccagaacattccagtaccaagtcgacatccacgatgccgtgcagggtaagaatctcaaaaccatcaccggcggccggtacaccctccaagcgaacgagacccggaccatccgcaccacaacacacctntcggacctgaacttctggagctgggggtacggctacctttacgacgtccggacctcgctactcctcaaccaccacgccatcgactccgtcaagacccgcaccggcttccgcaagaccgagttcacccacggcgcgtttaagctcaacgaccgcaccctccacctcaaaggctatgcccaacgcacaacaaacgaatggcccgccctcggctgcgccgtcccaccctggctcaccgatttctcgaacagcctcgtcctcgccagtaacgccgccctcatccgctggatgcacgtcaccccatggaaacaagacgtcgagtcgctcgatcgcctgggcctgctccaggccctgccggcgggcgactccgaaggcgacgcaacaggccggcgctgggcgcagcgcacggagctcatgcgcgacgcaatcatctaccaccggaacagccccagcgtcatcttctacgaagccggcaaccacgggatctcggaggcgcacagagcgagatga

SEQ ID NO: 3137 - DNA, 564 bp, A.fumigatus
acttctggagctgggggtacggctacctttacgacgtccggacctcgctactcctcaaccaccacgccatcgactccgtcaagacccgcaccggcttccgcaagaccgagttcacccacggcgcgtttaagctcaacgaccgcaccctccacctcaaaggctatgcccaacgcacaacaaacgaatggcccgccctcggctgcgccgtcccaccctggctcaccgatttctcgaacagcctcgtcctcgccagtaacgccgccctcatccgctggatgcacgtcaccccatggaaacaagacgtcgagtcgctcgatcgcctgggcctgctccaggccctgccggcgggcgactccgaaggcgacgcaacaggccggcgctgggcgcagcgcacggagctcatgcgcgacgcaatcatctaccaccggaacagccccagcgtcatcttctacgaagccggcaaccacgggatctcggaggcgcacagagcgagatgaaggctctgcgggatacgtacgacccacacgggggtcgcgcggcgggatcgcgcgagatgctgaatag

SEQ ID NO: 3138 - DNA, 924 bp, A.fumigatus
  unsure (871): Identity of nucleotide sequences at the above locations are unknown.
ataacaggacagtcggcgatactattagaagacaactatcggtcatctggctctattttaagatcggcgcaggacgtcattgagcaggactcatctcggccatccaggaagctgcagccgactcactgcccgggaacaatgcctgtgttgcgcaagcttccgactgcggaagccgaggcgcaatggatcgtgcttgagattaagcggtccatggctatgacaggaaaattgctcaactactcggatttcgcgatcctgctcagatcggctgctctttcgcgacatatcgaatctgagatgggcaagcaaggcgtaccgtacaggatggtgggtggtctacgcttcttcgatagagtcgagatcaaggtattgttggactatctgagagtcataagcaatcctggaaatagtgacgcgctcctgcggatcattaacataccgtcacgaaagatcggcgaggagtccgtgaagacgttgatgaatggtgcagacacagcgaagatccctttgtggaatttcattaaagatgtagcgcagggtcgcaggtcgactgacaaaagcctgtccaaacttactgaccaaggcctttgcactctcgttgggatcattgaatcatccaggcagaaactcctcgaatgtacagacggctctgcacctcgcaagcttcttgagtttgtgatcaagaaactcaattttcgagaatatcttacaacaacttactgtcagaatgaggaaaatcgatgggcgaacgtcgaagagctcctggcccaggcaggtgatgtggctgccactgcggctgaaaagggtcaggatgatagtctgcctgaaattcaggggcttgcccaacagcaggcccatcagggtttaaaancattgtcccaatttctggcaaatgttgcgttgtccaacgaaattcccctctaa

SEQ ID NO: 3139 - DNA, 1236 bp, A.fumigatus
caatcgagtggctctgtccatcccgcggtgaagactactgaccctagcaaaccaatgccttcccccttgaatacaagtgaccattgtcgagaaaaccgtcaagacaattccagcgtgttacagagtcctgtatctcctcgatcatccgttaaaacagctccgccgcccaaccattcttcgaccagccggatagtccatgctccatctccctcaaaaccatccggttctggccaggagtcaaccacatcgtcggcaggcgatagggtgtgtggtgacccgaaacagcatgatagaggtgtgattgcgatcgcaaacgacatcggagcccgcaaattatcggatacaggtgactctgtgcagtcaccaacatcatcaccagtatcactactggactccttgcaatcaatgtctggggaccgaacacccgggcaccgtattatgccccgcacttcgtcaattgattctgcaatctcctctctatcgtcagcgtctcaaccccacaagtcgtcgtttgatgccagcgcggtcagccaagctgacatcgatcgccttatagcaaccgcaggatcaaccgaagctgttatcatacaccttctgaaggagaagcatcatgcagcgtctcaaaatgcgcaactctggcgattggtggataagcagcggactttgatactcggcctgaataaggatcttgagcgtgccttgaaagagaaggagcgatataagaaaagggccaaagagctacagaactccataccaccggtgccacccactaacgatcacatcgttcagtctcgaagcgccgatacttcggccatccctgccagccgcgatttatcaaagcaagaacaggcccagggcgaatcatcagaggcgaagagcacgaatgcgggcatgcaggatctctgtgacagttccgttctctccccgaatgcgaaagtagatcgtccgtctcccgccggagcagactcttcgcgcctcgaatacaactttggaaaacgaattttcgcgacccggacaattgaagagctcgatcaggaatctaaattcgcaatcgctcgcttaaccgcgggaagaaatgttatcggcgagcccaactccctgggccatcccagctccactctgaacaagacctcccatcggatgaaagttcaaaaaggttccccaaccctccccggaagccccccctggccccctgaaaaccggaaaaaacacaaggtttggttatggaaaaccacg

SEQ ID NO: 3140 - DNA, 216 bp, A.fumigatus
agttctcggcctccgcatcgctgtcccgcatctcacggtttctccccaatcgcagcaactgaatacttcacaccctctatccagaggctgtcccgcatcgactactatttgcagctaatgtacgcttcctggtcgtctgagcagagagttctctatgcgaccagatcgtccccagacatactagtcttcaccgcgggtggaagggcagtcagtcaa

SEQ ID NO: 3141 - DNA, 183 bp, A.fumigatus
taccagctctatgaatgcactattttgttgactcttttctgtgtgtctgctattgacaccaagaaaggacactgtccctcatcagccgttaccgtttctctcacctccccccaacaggtacccgctgcggaacagcgggtcccagtggcagaaagtcacagaagtttggttgttgtcaagtag

SEQ ID NO: 3142 - DNA, 525 bp, A.fumigatus
ctaccgcggaccttcgcccccgtggtgaagaccaccaatgctcattcacctgaagtcgctcacgccttcttgaagcttgactatctggggattgtcatgaccattacaaccacatgtatctcagtgacctattttgccttatacagctatcccatcttgcaggttacatatatcttcctcactgtgctctgtgccgccacaatcttttgggttgcgctagatccccggatggatggtgcacgtgctgggccatggaggtcagtatttgccatgccacttttggctctacagcgtcctgactctgccaaccttctttgtaaagcagctgtgtttttcctcctggccacgagtggcttagctcccatatttcatgtcatttgggccgaggcttcttacggcctaattcgcattcctctggacagtcttacggtgacctgctcgtcatatgccgtcggcacggcagtgtacgtcacccggttcccagaaaggttttggccagcacgattcgatctgattgtaagttga

SEQ ID NO: 3143 - DNA, 204 bp, A.fumigatus
agcgccaccgcggatccttccagccccgtggtgaagacaagcatccgctctgaatttgtctattattttaaattttttagcctcttcacaaagattttagtttcggctgttggtcagacccaccggcccctcccatcctcaacaaaatggctccgccccaacagtttactgagacttcctccggacgcaacttacgaagaatga

SEQ ID NO: 3144 - DNA, 201 bp, A.fumigatus
gtttcgttttcctcttctagaatgaacatctctcagtcatcattccccttccacttccccacatgtcaaataacccctccgagaaggcctaagcagccgagacctgcccagggttgtatggtcattctagcgtgcttcgagaaggatatcgggcaactcaagtggtccaatcacatcatctgggcccccacgagacgataa

SEQ ID NO: 3145 - DNA, 603 bp, A.fumigatus
gatgggcgcccggtctacattgagaagttgggcaagatcgatctcaacgccatgtacaaaatcacaaccgccgagcgcatgctgcagaacctggtgtgcgagtacgaaaagctcgcggacccccggctgcctgcctgctcgcgcaaggccggcaagttgctcgagacctgctgcagcatcatggatctgaaaggcgtcggcatcacaagcgtcccctctgtgtacggatacgtgcgtcaggcttccgccatctcgcaaaactattaccccgagcgcctgggcaagctgtacctgatcaatgccccctggggtttcagcagcgtgttcaacgtcgtcaagggattcctcgaccccgtcaccgtgcagaagatccacgtccttgggtccaattacaagaaggaattgttggagcagatccctgccgagaacctccctgttgaattcggcggtacctgtgagtgcgctggaggctgtgagctcagcgatatgggtccctggcaagagcccgagtgggccaagccgccaaagtgggctctgcctaaggaggaacaggatgtcgtggtcttcacccggggctggaaggagccgcgccatggcgcgcct

SEQ ID NO: 3146 - DNA, 306 bp, A.fumigatus
ctttcttcgccttgtatctttcttaaattcgattctaccattttaccaaccatggctgctgtagctgagaacaagccggccacgacgtcgaaatatgacgactacgatttcccgaccactgcgcctgagccccagccgggccaccctggccacactaccccagagcaagatgcaaaggttgaccagctccgtagtgagctggagcagctgggatacacggacagactggataccctgaccatgctgcgcttcttgagagcccggaagtttgatgtggctgccgctaaggccatgtatgtttgttga

SEQ ID NO: 3147 - DNA, 315 bp, A.fumigatus
gagcccggaagtttgatgtggctgccgctaaggccatgtatgtttgttgaccgtcctgccttgttgttctcaagggttacttgtctccgccgattggagtctgtactgtggattctgagcattgttccattactaatgcatgaattcgttactttaaccaggttcatcgattgtgagaagtggcggaaagaattcggcaccgacgacctcgttcgcaccttcgactacaaggagaagccccaggtcttccagtactatcctcaatactaccacaagacagacaaggttagcctttttttctttcttgctgcttga

SEQ ID NO: 3148 - DNA, 378 bp, A.fumigatus
tcgtctaacctgaatactgccgcagcctacctcgtgaagagtctgcccgatgtgaagttcgacattggtgagatgtactccggctcagtccctatcgacaagggcaacaaatccagagagcttttcttcatcttccagcccaccatcggtgaacctgtggacgaagttaccatctggctcaacggaggaccaggttgcagctccttggaaggattcttccaagagaacggcagattcacctggcagccgggaacattagccccagttgagaatccttactcatgggtcaacctgacgaacatgttgtggtatgtgttacctttccaggccgttattcaagagattacatgtccgatatctgatgcgcatcgactgtga

SEQ ID NO: 3149 - DNA, 285 bp, A.fumigatus
cgaacatgttgtggtatgtgttacctttccaggccgttattcaagagattacatgtccgatatctgatgcgcatcgactgtgacagggtcaatcagcctgtcgggcacggcttcgccaccggcaagccgaacgcaacttcgcaggaagagatcgcggaagactttatcaagttcttcaagaacttccaagagattttggtatcaaaaactataaaatctatgttcacggcgagagttacccaggccgctatgttccttaaatcttcggcgcaatgctgggacaga

SEQ ID NO: 3150 - DNA, 315 bp, A.fumigatus
tcttcacccgtacctgcaagcctcagtttcccgtctttgatttcccctttgccttgcccggtcgagatgttgttcggctcggtggcttcgaccgccctcctggcgctctctttgtgcctggacagcgcgtctgctgcaaaacatggtcggttcggccagaaggctcgtgactcgttggccaaacgaagctcgtcatcgttggttacccatgagccagagacgcgctcacgccacaaggacttccgattcctgaacaaggatacaaagcgtatgtatatttttgtgttacctgcgttggaattgatgatcgtctaa

SEQ ID NO: 3151 - DNA, 570 bp, A.fumigatus
  unsure (395): Identity of nucleotide sequences at the above locations are unknown.
agtacccgagcattcttcatctgtaaacttgaatcaaccgacatcaacaccatgagagcaaattggcgaaccacacgtctcctccatggcgtccgagccatcatcggcggtcaaggtcctcctttggttctcattccagactggccgcaaacagctgaggcgttcagtggtatcttcgagcccctttccaaacgttatcgatttttggcgctcgatcccccgggcttgggtgattcgcctcctccacttaatggctatgacactgggaacgtgagcaaagtcatggtcgaagctattcatgataccctgaaatacagaccgtaccatctagttggtcatgatgtgggtggatggattgcctatccttgggccgctcagtttcgatcgagagtcanatcacttagtatcctggacgcgtcagtgccgggtttccagcctcagcttcagtttccgttgcctcatccgaccaaactgcgtctttggcaattctcattcaacgcccttcctgaattacctgaaattctgactccacgtcggaaccgggagcttctgacctgtttctttatctaa

SEQ ID NO: 3152 - DNA, 402 bp, A.fumigatus
atttttcttagcgcgccgtgggttccgtcagctcacccttccatcttcactcaatgctttgctatggcgttcaacttcaactggtcgccgcttatggcggacgcgagtttctacactcgtgcgcaagatttattaacggctgcgctcaataagtcgccgaaaccgcccatcatcgtcgacgatattatcgtaacggaactcaaccttggttccattcccccggagctggagatcttggagattggagacctggcggaggaccggtttcgaggcatctttaagatgtcctattcgggagacgcatttctgactctcaaaacacgagtccaagcgaatccgttgaacacatatcttctcacacgaccgtcctttgcaacaccccgacctctggctgcagcgtaa

SEQ ID NO: 3153 - DNA, 1170 bp, A.fumigatus
caatacctctccaaatcactctttccgatttcaaattatccggctttgtcatccttggtcttctcgaaacaaaaaggaatcactgtggttttccgaaacgatccgcttgaatcactcaaggtctcttcaactttcgactctatcccgtttgtgcgtgatttcttacaaaaggaaattgaagcgcagcttcggatcctctttatggatgagttgcccgccatcatacatcgattgtcgctccgattgtgggtccccgagtaccgagctggagaggagttgcagactcaaacggcaagcgcaaatggtgaaggacctggtcaagaccctctggccagcccgccacaagatcccgtcgacgctctcggaaatgctttgaacgagtcagaaatcgaatctctttccttggattcgtctgttgaaacccatacactgttttctcagaaaaaccttctgcgtttggctgcccttacggactctcaacggacattatcactcttcaccccttccattagggaggtagtttaccgcgcatggacctcgccttcagatcagaccgatgcctccggaagcgtgacgtcacccttctttcccgtcctttccagaacactgtcccaggttggcagtatgtcgtccttcccagattcggccagcatggtttcgagccagagtcggtcttcgacaccttcccacacctttagcggatatggcttgagtctaggggctgaccgtcattcgaaggctcatgctcgaaagcgaaagaagcgcgttgtggatatgcgtcgcccaaagaccactgacgacgcaccaagcgtgagcgatgagagttcgtttaccgagtcgaccagcgctccctccatctgttcagcccctctgccagtcctagatgaacagaccgatgatccggtgacgccgcccttgtccccggataatgatctacacctccctgcaatccccgaacgacaccgtatgagtatctctcgacctgcgctccgccgtgagaatgcatcggagatgattcgcgataccgccgaatgtaaaccatcgtccaatgcggtcggacaggccattcaggaggaggacctgagcgccactccgcgtgccgctgtgcgcgcccatggtgcgtctgttcttgaaaagggaaaacaggaccctgattcgtcggcagggtag

SEQ ID NO: 3154 - DNA, 741 bp, A.fumigatus
  unsure (624),(680),(699): Identity of nucleotide sequences at the above locations are unknown.
gcaagcctgattcacggcggagcctggagagacccaacacaaacagccgcctcatacgtcgcgccggccgagtctatcctcaccacttccccaacatacacctctacgacccttccgcacatcgcggccttcgcatcgatcgagtaccgattgagtgcccatccgagttacccacagaatcccgatcatctcgattctactgaataccgcaatgccaaacatcccgaccatatccgcgatgtgcaagcagccctggctcttctgcagcgtaagtatgggttcgggagtaagtatatcctcgtcgggcacagcgctggggcgactttggcctttcaatcggtgatggggactttccgagacagcgctgctgctgtcgcttctcctccagtcgcgatactcgggatggcgggtatttatgatttacgacttctgcgtgatacccatcgggatatttctgcctatcaagagtttattgaaggggccttcggttctgacgaagcggtgtgggatgccgcttcccctgcctttgtaaagggctctcagggagttgagggtggatggacgtctggtcgactggctgtgctggcgcactcggccgaagatgggcttgtggacgctgcccancaaaaggcgatgcaagctgcgctaagtcgctgggaggacaacacaccgcaaggtantggccagagacgagttganatgctctctctcaaagacgaccatgatgacgcgtggatgtaa

SEQ ID NO: 3155 - DNA, 1164 bp, A.fumigatus
agacacgcgaagattgacgtcacaagttcgttgggcctcatcagagtaactgggactgagcacacatgtgaatcgattcgcgagattatatacgatgcaacgaacagaatccgacaggaagatgtcgatctacctacgccaaatcatgccacgtccaagagtggtcgtactcttactcctgattttcttgcatgggtcagcaagacctatggagttgcattcgagcagaatccgtcgcagggcgttattaagatgttctatcttgcggagaacagagaagatgcggacaatgctcggagaacactaaacctagcgatttacaacacaatttctcctgcgataccctttggcacttacttatccgcggctcagtcggctagtgtctacaatgtagacccagagcaaaacgtcctgtggttcgatcggcaaaaggtgtggtttcggtgggcaatgtcgtctacccaatcctctgagacgaagatcctggacaccccgtatttcgataagcatcaatcgcttttgtcggacgagcttctcaaattgctcagaaagtcgtcgccatcgtcagaatgccatggtatcagtgagaccgtgatagccgccattgggcagtgtttgttcttacgcaagccttccttcgagatccagactctcagcgctcctcagctgggcaaattgaatcttcctcgaactttcactacggatgttcctcgagtaacgtcgtttctccgtacgctcaagccacgtctgcttgatgatgaccaacagtgttacattttccagttgatcccaacccctgcccatgcaaatatctttccgcgactggaagtagaggtaactctgccaggattacacccatcatctgtctctgatgcccaaattgagattcgtagcgtgaaagctgagttggctgagagcagtgttgactatctgctccccgagaatggccttgaccttcggtttaccagaaagttgcaccgcgatttactgcatggacattctgagaatgagtcagccgcgaacgttacggtggaaagcctccgggaatacctgcagggcgtcttttctaggtatatgaacaacgaaggtgaagcgcctctgcctgcgtttactcatgttccgcttcccaacaatctgttgaagggaactttcagcagaaaacca

SEQ ID NO: 3156 - DNA, 459 bp, A.fumigatus
gtggtgggagcttcggacgagtttacaaagggtatgctgctgtgcccagtgttctacctgatcattgaattagctgactatgttcgtcttttgcaatttagggtcgataaacgcaccggtaattctgtcgctatcaaggtcattgatgtcgaaaatgccgaagatgaagtcgaagatattatccaggaaattgccatcttgtccgaactcgactctccatatgttacgaagtatcatggctcttttctcaagggttctcatctgtggatagtcatggaattttgttcagggggtagttgcagcgatcttcttcgcccggggccaatcccagaggactatatcatgataatcatgcgagagttgcttcgtggcctggattatctgcatactgataagaaattgcaccgcgacgtcaaaggtacattgcgatcttcatttgagactcaattgggaagctga

SEQ ID NO: 3157 - DNA, 720 bp, A.fumigatus
  unsure (618),(683): Identity of nucleotide sequences at the above locations are unknown.
caaattcggacagctgcaaatatccttctcacttccaatggccaggtgaagctcgcggattttggtgtttctagccagctctcagcaactatgacaaagaagaacaccttcgtggggacccctttctggatggctccagaggtcatcaaacagtcagggtatgattataaagcagatatttggtctctcggaatcactgccatagagttggcgcagggagaaccaccctactccgatatccatccgatgaaggtcttgttcttgattcctaagaatcctccccccacgcttcagggacctttcagcaaaacgttcaaaaactttgtcgagctctgtttgcggcgcgaccccagggaaaggccgtcggccaaggagttactcgagcacccctttgtcaagcgagcaagacggacgacttatctgacagagttgatagagcgctatgaaggatggcagatacgtaatggcgttcaaaatggcggcgtggatgaggactgcgtacaagatctcccgtcgaatgacaaagatcgcgaacatgaggaagacctctgggactttggcactgtgcgccctgtaggacgcacaacagctatgggtccgatgaaggaggccgatacnaataccaggaaccacaataccacggcctggaatttccaagacaagtcacacgaagaagtcatganatcaagccgtcctcaacccgactatccaaagaaatag

SEQ ID NO: 3158 - DNA, 198 bp, A.fumigatus
tcatcagtatgttatgctggatgtgattccaaaatgccaataagcagatgcaaggtccagatcaatattggccacgtgactgataagatccaaaagataaaattaaaaagtatgaatcacatccccaccaacaccaacagacctcaatcgcgagataccgatgtctcacatcctataattagacggcagaccgcttag

SEQ ID NO: 3159 - DNA, 717 bp, A.fumigatus
  unsure (631),(681): Identity of nucleotide sequences at the above locations are unknown.
catacacctgtggcatctgtcctctcgcccatggactccatgaccgactcctccaattcgctccgcagcagcgaccttccagaaatgtttcgaccacccgtgaaccgcgcgatgcgtgttttggaccgctcgttctttcgcaagacggttcctctgtccgctgctgcggtcttccaaaactcagacatttcaaaggtgcgagcggaactgcacaagagccgggacctgctggctgtgcctcggctcaactgtatccgggacgtggcagaccaggaggggcagataaagaaggctttactgctgcgcgagactgtcaagcatgacgataaggaaacgtggtcgcccaagataagcgagctggtcgagaagggacgcatcgcaatgcggccgtacgacttgacgctggactatgatttttggacgtacgccgacattatctcctcgattctacccgaggacgagctacaagagattccgcaggggtttactcaagtgggacacgtgctgcatttgaatcttcgcgaacaatacctcccatacaagtatctcattgctgagatcttgaggaacaagtacagggtgattagaacgtggattaacaaaaccggagatgttggatcacatagcgagntccgcacattcccttttgagtttctggggggtgataatgatttgaatgtngtcccagcacgagcaggattgcgagttccgctttga

SEQ ID NO: 3160 - DNA, 738 bp, A.fumigatus
  unsure (5),(733): Identity of nucleotide sequences at the above locations are unknown.
atgtngtcccagcacgagcaggattgcgagttccgctttgactattcccgcgtgtactggaacagtcgtctggagacggagcatcgtcgacttgtggagaaattcaacaagggcgagatggtttgtgatgtcatggctggtgtgggaccatttgctgtacctgctggcaagaagaagatttttgtttgggccaacgacctcaatccacacgggtacgaggtgatgcaggacgccatcaaaaggaacaaggtggagggcttcgttaccccgttcaacatggacggccgggaatttatccgctggtctgccaaggaacttttggagaccgagccggtgaccgtcaccattcatcccaaggtgcggcgggacagaaaatccggcaataaagtcgagcaggcccccccgcctcatccggaggagtatcaccgtccagtgttcttcgaccactacgtgatgaatctcccggccacggcaatcgagttcctcgacgcgttcccaggcatttacgccggcaaggagtcgctgtttgcgccgcacacctcccagcgtctacccatggtccatgtgtattgcttctcgggccattccgagaacgagctggacgaccacattgacatctgccagcggatatccgagcgtatcgggtacactatcacgcccgaggatcggatcggaggcagtgggaatcagagcgttgagcgtatatcacgaccgggatgggacgtacgcgtcnggcaa

SEQ ID NO: 3161 - DNA, 666 bp, A.fumigatus
attctcatcgagataagcaggatggccactggtacttccgccaatcgttgtgaggttcgcgcttgtcaacgatgtcggaagttgaaagtcggctgtgataaggcgaaaccagcatgccgccggtgcatcaaggccggtatgcgttgcgtggtgccccacgctgggagcaacaaggccgacagggcatctacaaattgtgacaagagtattctgacggacggcctggatgattctctgcggaacagggatgaggtacgtttggcccgatgtcactgctgccctccactcacagctgtacagctcaccggcagctccatatccgacaaaaatgggccctttcattccccatcgagctaccacaaattaacacctcacaagcgcaatcgcaatcctgtgtcttgtatccgttgtcgccgattaaaagtccgatgtgatcgacagcagccatgccacagttgcacaaaggcaaaagcagtctgtgcatatggccggtcaagcggaattcaccgtgattctgatggagaatcttttgcggacgactcgagtgctgccgttcgctttgctgcgtggagtgaccggttccggacagacactcactggataaccctcgtcagggaggtgtgtcctgtagttcatccttcaatgggatccagcgaacattgctga

SEQ ID NO: 3162 - DNA, 261 bp, A.fumigatus
ggacactcacgacgtcctgctggcggagagaagaagagtcgaggcttcggtcggtccaaagctgtggctgatgtgggtgatgggcgacaaacggggggcaagcctcaggtgaagaaggccactttcgagagcacaaagaagaaggaaatcggggtttcagatcttacgttgttgagcaaaatctcgaacgaggccatcaatgacaacctgaagctgcgctttgaacatgacgagatctatgtaagcattcattccccctga

SEQ ID NO: 3163 - DNA, 420 bp, A.fumigatus
  unsure (74),(133),(134),(196): Identity of nucleotide sequences at the above locations are unknown.
ctagcggacctcgagatttttgcgctactgagggcgtgcgctgatatagattcttcggatgatagacatatatncgccacgtgttggtgtccgtcaaccctttccgagaccgtgagtttataccgagccatgnngtgtcgtcaaaggcgcgtcgctgacatcgttgcttcgcagtgggtatctacaccgacaatgntctccagtcttatcgaggcaaaaatcgactcgaagtgccccccccacgtcttcgcggtcgcagaatcagcctactacaacatgaaaacttacaaggataacccatgcctgaataacttaagagaagtcggtggcaggaaaaaaccgaaacttccaaaccggattattgcaataccttggccgagggattttggaggcactgatttgtcctatcccgcttacccg

SEQ ID NO: 3164 - DNA, 366 bp, A.fumigatus
gaaggcgacgccgcggtgtcaggcagcggtgatctggcctttgatgttgcactcggtgctgacctggtaagtccacacatgattattcaaaatcatttcctggggttcgtggctgcggatctatgcctcgccatttacaatgcacagaatatacattatgcaagaaatcgtgcaacaaacctggctaatggaaagaagatttacgacgtcgaccttgtccccctcctgctgtccaccttccgcgacctcttcgaaaactatcacctccgagaattcattatcgccgcgacgctccggaaccaggataccttccagacgttcctaaaggcctgtcgtgagtgccttgcctcgatccaatccaactga

SEQ ID NO: 3165 - DNA, 297 bp, A.fumigatus
agacccaagtggctggcggcgtggttgaatgcggacgatatcgagcaggcgccgccgttctcgttccgcaacatgggcactttggcgtatattggcgacgcgagggcgctgatgcagctgccgcatgaggacggcaggcgatacaagtatctcccgcatggattgacggggcgcatggcgtggctggtgtggaactcagcgtatctgacgatgagtatcagctggcggaatcggctgcgggtggcgtttcggtggttgttgaacaatttgtttggacgggatgtatctagatattga

SEQ ID NO: 3166 - DNA, 378 bp, A.fumigatus
cttagacaggagaaaatggcctacacaaccgtctcccagcgtaaactggccgaattggacgccaaaatccccgccgaatggagactatccgcgtctcagatcccaccggggatgctgtcgcccgccgaatccatcaccaacgtcaagcagtacggccgagtcaacgtgatggacatccctcgaacctgtggcttgctctctgctcgcgagctccaaatcacagaagactatgacgtccgcggattgttacgcgccatggccgacaaccacctcacagccgaggaggtcaccactgctttctgcaaggtccgctgtccctccccctcatttcttttttttttttttttttttttttttttacaagcgaagaagcgctaa

SEQ ID NO: 3167 - DNA, 561 bp, A.fumigatus
  unsure (407): Identity of nucleotide sequences at the above locations are unknown.
cgtagtctagagagcagccatcgcgcaccaactgacccgctgcctaaccgaaccgctgttcgaccgcgccgtccagcgcgcgcgcgagctcgacgcctacctgcaccgcaccggccgccccatcgggcccttgcacgggctccccgtctccgtcaaggactgcttccacatcaaagatgtcgactccagcatcgggatcgccgccctcgtcgcccgcccggcgaacgaagaagcccccctgaatcaactcctcaccgccctggggcgcatcgtcctgaccaaaaacaacgtcccccagaccaatgggcgcctcgacagcgccaaattcgtcttccggcggacgctgaaaccggtcaaacgcgccctcacggtgggggctccccccgccgccaagggattcttggccncctgccccggttcttggtggggttccggcccgaatttcgccgggaactccccgggttcccggcaagtttttgggtgttttttggttcccacccaaaccttggggggcgtttcccctttggcggccaggaaggccggcccaattccctggtttaa

SEQ ID NO: 3168 - DNA, 558 bp, A.fumigatus
  unsure (397): Identity of nucleotide sequences at the above locations are unknown.
agagcagccatcgcgcaccaactgacccgctgcctaaccgaaccgctgttcgaccgcgccgtccagcgcgcgcgcgagctcgacgcctacctgcaccgcaccggccgccccatcgggcccttgcacgggctccccgtctccgtcaaggactgcttccacatcaaagatgtcgactccagcatcgggatcgccgccctcgtcgcccgcccggcgaacgaagaagcccccctgaatcaactcctcaccgccctggggcgcatcgtcctgaccaaaaacaacgtcccccagaccaatgggcgcctcgacagcgccaaattcgtcttccggcggacgctgaaaccggtcaaacgcgccctcacggtgggggctccccccgccgccaagggattcttggccncctgccccggttcttggtggggttccggcccgaatttcgccgggaactccccgggttcccggcaagtttttgggtgttttttggttcccacccaaaccttggggggcgtttcccctttggcggccaggaaggccggcccaattccctggtttaaagggggg

SEQ ID NO: 3169 - DNA, 714 bp, A.fumigatus
  unsure (156): Identity of nucleotide sequences at the above locations are unknown.
gagctgacaaatgatttccggttcaagactacactcggaatccccattctaatcttcatcctccacattttaaaccgcctagcggcatatactccccttgcgaatcccccggaatcgatagagtctggaaactatggcgcgccaccacgggccgcntggtggttcaagcaggctatgatatacttcttcgggcttttgggaatgaaaatatgcgtcttctttctcatccaactactgccattcatagtcaagataggtgactgggctctgcgctggacggaagggaacacagctctgcagatcatcttcgtcatgctgcttttcccagtgatcatgaacgcgatccagtactacatcatcgatactttcatcaaaagaccgctatctcgaactcacgagctgctccaggaagacgatgaagtagaagatgctttgttggatgacggtcggacaccgcacaatgcactgctgtctagcgctgaggatgctgatacatttgggccggatgaaggtattataggaaaggatttgggcaaaactcttgaaccgcctgcagggccgaacggctttcgtcatgtcgagtacgatccagcagttgatggagagtatttctccccggcgtcatcaacgtctgccagctccagcagcagtcatggcgaatatgatgcaatgtcatcttcgacaaagcttacacctcagaacaagagaccatga

SEQ ID NO: 3170 - DNA, 246 bp, A.fumigatus
  unsure (71): Identity of nucleotide sequences at the above locations are unknown.
gaattctctcattccaccgagcgggaagatgccaaaaacccccctccctgttcctggaaaaaaaccgcccnaaaaacggggcctcccccccctcccgtccaagaatggagctccctccccaccctgttgaacaaaaccaaccctcccaagttgaattggaggctgaacgcgtttgaaacaaaaaaaatccccacaaaggatcatgtggaataccaaactcggagaaaaagcccttcccgtgaataa

SEQ ID NO: 3171 - DNA, 585 bp, A.fumigatus
tttgacatgagctgctccttccagccccgcggtgaagacaccttcatcattattcatggaccccgtggctcgggaaagcgggagcttgtattagatcgggccctggtcgattacaaatataagatagtaatcgactgtaaacaaatccaagacgcgcggggagacagtgcgaaaattgctagggcagccagtcaggtaggctaccggccggttttctcatggatgaacagcatcagcagttttatcgatctcgcagcacagggcatgattgggaccaaggcagggttctcagagactttggacgcccagctaagcaacatctggcaaaacacggctaccgctttgaagaaagtgaccttggagcacaggaagaagaatgacaacgactcgcatctgaccgacgaagagtatcttgaggctcatcccgagcttcgcccagtggtggtaattgacaactacctgcacaatgcgtccgagagcagcgttgtgtacgacaaaatcaccgagtgggccgctggcctaacagccggaaacattgcccatgtcatattcctcacgacgatgtctcgtacgccaaacctttga

SEQ ID NO: 3172 - DNA, 666 bp, A.fumigatus
  unsure (74): Identity of nucleotide sequences at the above locations are unknown.
cagatctcgaattcatggcgcaccgtattgaggcggagagacaccgcgaagtacgtcgagagcaagacactagntcacgtctatgctagaatactaacatacgctcaaggcgcgggtcaacgtattatcgaacaatcggcatctgagattctcaagatgttccttttgacgccggaaactatagagcagtcgtggacccacgaacaggcttggtatctgatcaaaaggcttgcagagtccaaagatggttctctgtcatacaatgaaattgttctctccgagctcttcaaagagaatggagagatcacccttcgcgctcttgagcacgccgaactcatttcaatcgccgccgtcaacggctgcccccagagaattcggcctggaaaaccagtcctgcgcgctgttttcaagaaggtcaccgagaataaagcattgagcagtcgcatggatctcgcgatcatagcaaagaagatcaacaaagagaataagagcatcgaaaaatatgaggaagaacttagcttattgggctctctgcctaggcagccacgggaactgacagaccgaatccaatggttgcttaacaaagtatacagttctcaaaacaagattgcgaaatatgagaaggaaagtgcatacctacagaagattctccgaagcgaacattga

SEQ ID NO: 3173 - DNA, 915 bp, A.fumigatus
actcgacaggtttcttggatcggcacacccgttatcgagacacggctggcagtgtgctatgccctgaacgatcccatggaaatttctcactctctcgtggcccatgccacaaccctcgccgtccggtccggcgcttccagttccaccagcgaacggccccccgcatacaaagccgtcggcattgcgctggccgtctcgtcgggtgtcttcatcgggacctcgttcgtgctgaagaagaccggtctcctcaaggcgaacgtcaaatacaatgaagaagcgggcgaggggtacggatacctcaagaacgtctggtggtggtccgggatgatcctcatgattgtcggagagatctgcaatttcgttgcgtatgcgtttgtcgatgcgattttggtcacgccgctgggggcgctctcggtggtgatcaccaccattctctcggcgatctttctgaaagagcggctgagtttcgtgggcaaggtcggctgtttctcgtgtattatcggatcggtcgtgattgctctcaacgccccggagcaatcgtccgtcggggatatccaagatatgaagcattatgtcatcgcgccggggttcctggcgtatgcgggtgtcatcatcgtgggctgtgcgattgttgcgctctggctggggccgcggtacggcaagaagtccatgttcgtctacatcagtatctgcagtttgatcggggggttgagcgtggtggccacgcagggacttggggcggccattctggctcagatcaatgggaaatcgcagtttaaggagtggtttctctacgtgctgcttgtgtttgtcattgcaaccttactgacggagattatctacctcaatgtaatgtcttctgtgcctgggttgcaggaacgtgtgctaaccgcggaccaccacagaaagcgttga

SEQ ID NO: 3174 - DNA, 714 bp, A.fumigatus
atacatccacgtccgacgatggcaggacggcagtcttctagggaaaatgcccgtgaacaagacctatggccagcaagtagttgtccaccgtgcagaccttcacaatgcactgatcgaaaaggccatggcgctggagaacgtccaagtacgagtcaactcgaccgtcactcgggtccagttcgaccctccagccgtgaccctcgccgacggcaccatggtgcaagccgacgtagtcctcgcagcagacggaatcaaatccagcattcgggaccagttgctaggcaaggacgccaccaaggccattcccaccggagacgcagcatacaggatcatgctcccccgatgcgcaatggagaacgatccggagctgaagcagctcatcgacgagccgcaagccacgcgctggatcggaccctaccgccatatcatcgcctacccggtccgcaaccaccagctatacaacatcgtcctgctccacccggaccgcaccgacgtcgaagagtcatggacaaccaggggctcgaagcagatgatggtcgacgactatcgcggctgggaccgacgagtcacgaagctcatcgacctggtcaaggacaacgaagtcctggagtggaagctctgccagcacccgcctctaaagacgtggatcaggggccgcgtggctttgctcggcgatgcctgccatccaatgctgtaagcgatcgcgaccattag

SEQ ID NO: 3175 - DNA, 696 bp, A.fumigatus
tacatccacgtccgacgatggcaggacggcagtcttctagggaaaatgcccgtgaacaagacctatggccagcaagtagttgtccaccgtgcagaccttcacaatgcactgatcgaaaaggccatggcgctggagaacgtccaagtacgagtcaactcgaccgtcactcgggtccagttcgaccctccagccgtgaccctcgccgacggcaccatggtgcaagccgacgtagtcctcgcagcagacggaatcaaatccagcattcgggaccagttgctaggcaaggacgccaccaaggccattcccaccggagacgcagcatacaggatcatgctcccccgatgcgcaatggagaacgatccggagctgaagcagctcatcgacgagccgcaagccacgcgctggatcggaccctaccgccatatcatcgcctacccggtccgcaaccaccagctatacaacatcgtcctgctccacccggaccgcaccgacgtcgaagagtcatggacaaccaggggctcgaagcagatgatggtcgacgactatcgcggctgggaccgacgagtcacgaagctcatcgacctggtcaaggacaacgaagtcctggagtggaagctctgccagcacccgcctctaaagacgtggatcaggggccgcgtggctttgctcggcgatgcctgccatccaatgctgtaa

SEQ ID NO: 3176 - DNA, 189 bp, A.fumigatus
gcgatcgcgaccattagcatgatatctgatcatctctctaacgattgcagtccatacgtcggccaaggtgccgcccaggccgtggaagacgccgccgccctcggcgtcctcctatcctccatctcttctcggagcgaaatcccccttgccctagcctcctacgaaaagtcgcgcaaacaccgcgcatag

SEQ ID NO: 3177 - DNA, 210 bp, A.fumigatus
acagtccagcaatccgggaccgtcaaccgcgcgacgctgcatctccccgacgggccggaacagcaagcccgcgacgaccagttccgcgcttcgatgaacggggcgtcgaaccccgataaatgggctgatctggagacacagaagttcctctggggctgggatgcggagaaagcggctctggagacctgggaaggtgaattacccttttga

SEQ ID NO: 3178 - DNA, 231 bp, A.fumigatus
tcttctttatatcagtgtgcggagcttgctactgaatggtgcggctccggccagctttccaagatgcagtcctccccaaacatgcttaccaaggtacgttgctccccctctgttaccccttatccccgcgcaaaccaagccactcaactaaacaattgctttatgaatagttcgagtcgaagtcgtctcgtgcgaagggaattgcctttcaccctaaacggtcagtcctga

SEQ ID NO: 3179 - DNA, 363 bp, A.fumigatus
ccctggaacagaccatggatccttgtttcactccactcgtcgacaattcagttatgggattatcgcatgggaacgctgattgatcgctttgaagagcacgatggacctgttcgcggcatcgacttccacccgacacaacctctcttcgtctctggaggcgacgactacaagattaaggtctggagtcttcaaacccggagatgtcttttcaccttgaacgggcatctcgactacgtgcgcacggtattcttccatcgagaacttccttggatcctctctgcctccgacgatcaaacaataagaatttggaattggcagaacagatcgttgagtaagtggactccggtctcaccacggggctga

SEQ ID NO: 3180 - DNA, 234 bp, A.fumigatus
gttttgctaattgtgcctcgtcaaaaaggccgttcctggtctatccaagaacttcgggaaaaatcgtgggaagaccttcactgtctctggtgggtctgtgtcaaggagcgtaatcgcatagctacgtccaacctcgagagacaacgcttgaaggcaggctacggagaatgggaagctagggaaagagatagaaccgtgagtttctcatttctttccgagctcagaccttcgtag

SEQ ID NO: 3181 - DNA, 834 bp, A.fumigatus
  unsure (47),(324): Identity of nucleotide sequences at the above locations are unknown.
acgaaaggcaacacaagctctctgacgaatcaggtagaggtcatganacagacatgttctgatgttactgcccttacttcgttctcggagaatcatgacgtcgctcgatttgcaagcttcaaggatgacatcgcggtaaggcagcgaactccagttaccctgaaagtatcaaccgatgataggctaacaccggcgcagctcgctaagaacgttttaacatttacgatgctgttcgacggcataccgatgatataccaagggcaagaacaacatttctcaggcgccagtgacccggagaaccgcgaagccttatggctatcaggntacaacaccaacgctccgctttaccaactagccacgagactgaacaggatccgcaagcatgcagcccagatcgacccagcatttgtagactcacagaccttccccatctacacagggtctagcgagatgggtttccgcaaaggcgtcgagggccggcaactcgtaatggtcttgtcaactcaaggtatggacagcggcaaatatgagctggacatgccaataggctaccaacctggatttgtggtcacagatgtgcttaattgcgccaactattcggttaacgacatgggtcttctcaaggtcagcatggataagggcgagcctcgggtcctttttcccgctgacatgatggaaggaagtggtctatgcggatatggaaggtcgaatggaacgacgtatcttaatctgaaaaagaattcaacgcagttctcgggtggcgggctctcaaatcggcctaccgtgcccctactgttgatctgttgtttgacttgcttgatactatggtgttga

SEQ ID NO: 3182 - DNA, 207 bp, A.fumigatus
acaagtcatcaacatttgtcatgtgaagggttcttccccctttttttctgcacggtgaaccacactgatcgaaaaattgaattgaaaagctttcttctattgctgctgccgtcaaaatggcatattaatgtgcttgaggactctaccttcaaagtcactcgcgtcctccgcaaggcgccagtagacgatgtcataccagacaaatga

SEQ ID NO: 3183 - DNA, 585 bp, A.fumigatus
cagggcgccaccgcggtgctggaattctctgccatcgattctccattcgctcaacctcgaaatgtgatcgtcggtcagctggcagcgagcatcattggtgtagcgatcgggaagctctttgctttgaatccccatgcccattcgttaccccaagtcggcggagctcttgcttgtgctatcactatcgccttcatggccatcacgaatacaacgcatccgcctgccggcgccacagctctgttagctgtcacggaggtctttgaactgggctggtacctggttccggtggtgctgctggggtgtgcgctgattctctgtgtggcattattgattaacaacatccaacgacggttccccgtctactggtggactccgcatagccttgcacgtccgaaactcgaggatgttgaaagcatcgggcatgagaaagtatccagcgtcaaaccaactgaatctgaggacagtgtcacggatgaacctgaggaaataatcattcggcgtggcgaagtattgatgcctgacaacctctggatcagtgcagaagaacgggaggtgttggagagggtcagtcaacgaatacaatag

SEQ ID NO: 3184 - DNA, 219 bp, A.fumigatus
ccaatgaagatccgccccactgaacgaattttcgaaggacggccacaaggtatcttgaaagacttctttatcccttccaacatcttcttgggcctaggtcaccacagtttgttgccatcaggccacttgttcattgagactagcttctccgtactgtataaccttctacttgccgtcgaatctaacccagttcgatcttcgagtcccactaccgagtaa

SEQ ID NO: 3185 - DNA, 816 bp, A.fumigatus
aaggcttttggtcgcccctctctacctattttctccttcctccccgctatcgatccactttcgtcgaccttttttttcatctgcgttcacgaccctaggcagacttttgagcttttacctggcctctccttttacctgccaccctaccaccttccctcccccatacataccgccaaaatggtgtctgcttccaaagccgctcgtctcgccaagcgtgccgccgagggcgataagaagaagaccgccaagtcaaagaaggacgtcaagggtgacgagagccctttggttgacgctgatggcgaacctcgccctaccgaagaccagcccgctaccaccgaggagaagatgaaggaagtcgagaagctcaccgcacagatggataagcacggtctgtccgaccgtgtcaccaccggtgttctgtcctcgatggcttcctctcgcgacgtcaagatcacctccgcttccctcgtgtttcacggcaaggtcctcatcactgactccactctcgaacttaacttcggtcgtcgttacggtctgctcggtgagaacggatgtggaaagtccactcttctcaaggctatcgccactcgcgagtaccccatccctgagcacatcgatatctaccttctgaatgagggtgctcctcccagcgaccttggtgctcttgaatgggtcgtgactgaggcgcagaaccaactggaacgcatggagaagcaggctgaggagattctggaaaaggatggtccggagagccctatcctggaagacctgtatgacggtcttcaccacggggatagcgcatccgcgctagataat

SEQ ID NO: 3186 - DNA, 1191 bp, A.fumigatus
aggtccaagcggggggaaaaagggggccaatggtggggaaaagtggaaaaattagggacccagcaattgggttggtggcgtcttaggccttggggtccgtggacttttccacagggggcagctaaatgcgcagtcgtgggcacacgtgatacttcccagatctcccagcaaccgggttactcatcacgtgccgataagattggggtgatcaaaaaattgccctcaagggtcttttaccgcactctacaggaggtcgcaggttatataactgttcacattgcaatggcgacgccggcgcccgcccagacagagccttcgggcctagagaatatttctacattactggagaatctcaccagctgcttatcgagcaccgggtcgtcccttccgaaagcaaaacgcgaatcaccaagcgacgtctccatcgaacctcctcacgatggcatatcgcttcttgacaccaaaagtgacctgttactatcttacctacacaatctggttttccttatcatcttccagttgagagaggcagcctctgcggagccgaaggcagaagaaaacagccatgtcgataatggaaactcgccactgcgcgaagatattgttaaaaaacttaccgagctccgcgtgtatttggaccgaggcgtccggcctctggagggtcgactgaagtaccaggttgacaaagtcatcaaggctgcagaggacgccgacagagccgagcgcggtgcccaggcgacgacaaagagcaaggcaaagaatgcgaaatctagtagcaacagcgaatccggctctgaagagagctctggcgacagtgagagcgataatgaaggcgaagacgaagaggaggatgacattgatgagatggcttaccggccgaatatctctgcattcgcgaagggaataaagtcggaggcccagacagaggagaaggcggacaagaaaatatcaggcgacggtatctatcggcccccgagaattatgccaacagcacttcccacaaccgaacgcaaagagcagagagaccgccgtccacgcagatccaatgtcattgacgagtttgtcagcgccgaaatgtcagccgctcccatggcagagcccagcatcggtagcacgattgtccaaggaggaagacattcgaagactaggaaggaaagagagcgcgaggccgaacgtactgcatatgaataa

SEQ ID NO: 3187 - DNA, 855 bp, A.fumigatus
ccaacacgtaactccagatgccctttgcaccaagtggttataagttttaccgcaacgtcagggactatggtgccacgggtgacggaacagcggacgacaccgcggccatcaatcgagccgtttctgatggcaatcgctgccaataccgtcttgccgacaacggttgtcacgtcaaatggcaagacacagaccttttccgaggatcgaattccgagtcttacagatttgacaaccaccaccaaggtcactacgaccctgagtgagaacgagatccaaacggctacctcaaccaccactctgattcccgttatcttcccagtcacgaagggtggcttttattggtcgccagtgccggagccaactgccccggagttccccatcccctcccttcccgactttcctcccgttccctcgtcaccttgtttcaagctgggagatctgttctctcgtaactgtcctccaaacgacaacaaggcgccacagacaacacactttacccgcggtccgaattcccctagctgccgcagcaactgtggtcatctacggtccgaaacagacagctcgtcctcgagctcgtgtaccacccagaatgtgacatcgtgccctaagtgcatccttagccaggtatttgaatttctcaacctgtcctggctttatcaattaaatatttcatttttgccacgcaataacagagatgcttatctagatattcaccatagcgaaccacacaggaacagccctccctcaggcacagacaccagctgctcctcagagaaagagaaatgcatgcagcatgcgcagctttggttaagaaactcagcaccgactttgccagtaataaacccagtgatgtga

SEQ ID NO: 3188 - DNA, 252 bp, A.fumigatus
ctccagatgccctttgcaccaagtggttataagttttaccgcaacgtcagggactatggtgccacgggtgacggaacagcggacgacaccgcggccatcaatcgagccgtttctgatggcaatcgctgccaataccgtcttgccgacaacggttgtcacgtcaaatggcaagacacagaccttttccgaggatcgaattccgagtcttacagatttgacaaccaccaccaaggtcactacgaccctgagtga

SEQ ID NO: 3189 - DNA, 855 bp, A.fumigatus
gtatttcaccgtgattcatgttcgcccgctccatttctgttcgaatcagacagaattgggagttgtttcacattcagaacccatgctgccttcatttgggccacagaagttgaggaaaagaaggcctcgttcatccaacaggagcaatcggcctatgcacccagacatctgctatcccccgctggaactgcaaatgccaccagcagcaacgggaagggctctattcgagactcacagctctataagaggatcttaggacagtccctgaagcaggttggcttgtccgaaaatgctaatgaagacgcttcacaccagcctgagtcgagctcggctcgagataaaggcgcgatgccatatatcgtgcccccacgaacggagggtgaggacggttattctagcttcaaaggcttccgaggatatactggagaagaaaacgaagatttagtgcgccaggtgaccgaagtcgcagcgacagcggccgccgttgccgctcgtgatgttgctcggacacgcaagccatccgtccagcagggcactgcacgtcacagcaataagatcacaggtgatctttcgaagtccgttctggaggaccaagaagacgtcgggattgagcacacacatgctagcggcggtcatgacgcgccaaattggagcaaagctaagagctcgatcattctcctcgtggccacaatactgtacgctatcatagccgagattctcgtgaacaccgtggatgttgtcctcgagagcgttgacatagacgagaaattccttggaattaccctctttgcgcttgtccccaatactacggaatttctggtaagaccaattcaatcaatacctgcagctccatga

SEQ ID NO: 3190 - DNA, 309 bp, A.fumigatus
catagacgagaaattccttggaattaccctctttgcgcttgtccccaatactacggaatttctggtaagaccaattcaatcaatacctgcagctccatgaatctcacacctgtacagaacgctatttccttcgcgatgaacggtaacattgcattgtcaatggaaatcggttcggcctacgcattgcaagtctgtctgctccagatccccgcgctggtcctattcagtgcactctacagccgtatcctcgatccctcggaccttttgacgcattcgtcttcaccacgggagtgccggatccgcggcagt

SEQ ID NO: 3191 - DNA, 582 bp, A.fumigatus
ccttccagccccgtggtgaagactttccgctggcgtctcctggctttccagccgatcgtactactctccaacgcaatccagtatctccccagtatcttcacgaaaggccgccgcaacggcatctggatccctctcaagcgagcgccgggccactcagtccgcgccattgtttatcatcccaggacacaaacccactctggatccagggccatccatcttaacatccacggcggcggattcctaggcggactcccagaaggccagacatcattctgtcagaaagtcgcccacgaaaccggagcgattgttgtatccacttcccatagatatgcaccgcgctatacctttccaaccgcgcacgaagacgtccaggacgttgcggagtggttgatcgagaacgccgagcggctttggggcacgaatccgagatcgatgaccgtgagtggattctctgcaggcgggaatctcgcattgggcgttgcgcaggggctggcgcatacggagtttagtatcaaggcgtcagtgacgttctatgcaccggtgagtatatatattattcatcgccttcatcgactgttctaa

SEQ ID NO: 3192 - DNA, 198 bp, A.fumigatus
  unsure (11),(13),(21),(50),(190): Identity of nucleotide sequences at the above locations are unknown.
agaaggggacnanaaaaatanttagggatccaatgggctgtgtttagtanaaaacttccacgaatactctctttgttggccattgcccacgcccagaacacgaagacccatctcggccaacccggaagaaggactcgaacaccttcaactcggttgcggtggtgttcaaacacgggtgaacggcaacccntctcttga

SEQ ID NO: 3193 - DNA, 891 bp, A.fumigatus
acacagggtcccggggtcgcaagaatcagtggtggaagaagcgcaaagccggatgacttggacaccccgacatcgaacaaggacgaggcgcgatattgtcgtggcaccccccgcgcggcggccagcggtttccttcatcttctataccctacaccggagttatggaccgcgtcgctcccgcatcggacccaggttgtctacacaccagactacagctacattctgcatcggctctgcgttcgccccgggagcacaattatagaggctggggctgggagcggctcctttacacatgcatctgtccgcgcagtcttcaacggatacccctccgaggcacccgcagctaagaaaagaaggctgggcaaggtctgcagtttcgagttccatgcacagcgcgcacaacgaatccgggaagagatccacgaccacggcctggacgcactggttgaggtgacacatcgcgatgtttacgaagatggatttctcctcggggacccgaaaaccggcaaatcgcccaaagccaatgcgatcttccttgatctgccggcgccatggcttgcgctcaagcatctcgttcgcaggcccccttcgggagcggagtcgcctctcgatccctcttcgccggtatatatatgcacgttctccccttgtatcgagcaagtgcaacggacgatcaccacacttcgtgagtattcttggctctcgatatcaatggttgaggtgaatcaccaccggattgatgtcaaacgcgaacgaaccgggttagactgcgagggtgtccggggcgcgacagtcttccccaagtcggtggacgaagccgtcgcaaagatgcgcgccgtcgaagaacactcgagaagattgtcttcaccgcgggctgcaaggagcgctgct

SEQ ID NO: 3194 - DNA, 192 bp, A.fumigatus
aatcatatcgatgagaagaaaatagaatacgttcacttaccacgcaacgccttgaaccgtgttgattatagcactcttatgggatctgttttggcagcgcagatcagctctgatccctcaggagtgggcactctttcgttcacagaacttgaggaatacgaagagagtgagatgaggccggcgggcttttga

SEQ ID NO: 3195 - DNA, 207 bp, A.fumigatus
agagtttgtggcagcgctgatttgccatttccttgttcggacatcctacctaagggctgggcttcagaggggcaacctagtactctctgctttaaggataaggatgtctaccccttcgggcctggatttccgtttcacacccgcctaaaagcggacgagcgaagtaacgtgcttcgctgtgcttgctacaccgccgtgtcaaggtga

SEQ ID NO: 3196 - DNA, 198 bp, A.fumigatus
cttttcaaggatgataaggacaatttgaaatcgggcaacttcctaggaggtatgcttgcagacttgcaaggtggagttgctggtggtgaaggtcgggataatccagatgactgggaggcaaaattcaagcccgaagtcgaagatcaatatattgatggtctcacacggggctggaaggatccgcggaggcgctatcaa

SEQ ID NO: 3197 - DNA, 186 bp, A.fumigatus
gtcatggaacctgactatggagctttaagttcacggctgattcggggagcatttctcttgcagagcagtatcaacatggaagaccttagattggaggaggatgagtacctcagcttttgggtcacaaacaacgctggcatcgagcgtcttgctctgtctacacgacgggggtcgaaggaaacgagt

SEQ ID NO: 3198 - DNA, 384 bp, A.fumigatus
ttgacgctatctgagacggcagtgtctctatatgatgtcgttgcacaggattacagcggtctctttcttcaatctactagaagaagacgtctagattcactaaaatcacattccgactccctgaagcaacttcagccctctacaattcagtctgcatacacccaacagcagacccttaatatccatacatttaactatatctatggaactgtcttctttctgccgcagtctagagaccagtaccctaagtatagctccataactctctttctggccaaagatggaggatccattgaccattctggtctgtactcactggtgtgtttcagggcatgccccatcacgtggcttcactactcaccacatccacgtgggtccacgtga

SEQ ID NO: 3199 - DNA, 372 bp, A.fumigatus
ttgcgatatcgagctgcctggctaacctttcaatcggtgggagcgaaggataagattaggtgtgcagttttctcacttccctcggctcgtgagcttaaagctacgcacctagaacccaaaaagccttggccatcgagagtcgagacagccgcccatgaaggccagcctaatttattatggaagaattctcatgttgattttacaaagtacgcccatattgatggaatacttcctgaagtctggagaacatctggaccagggatttctggtacggtaaacagtgggttaggtattagccaacacatctgctatctaggctgtgagcacacgcgcgatgcttctatctatctacgaaggcacatcctcacttga

SEQ ID NO: 3200 - DNA, 468 bp, A.fumigatus
gatggattacggtacgaaagcgtccgcacaaaaggtcaaacgatactaacaaggcagatgttctcctggtgggcaaacgtggccacctccccctacctgatcggcacccagatccaggctctggtcattcaaaaccacccggagtatgttccccagccctggcacgcgactctcattgtttgggcggtccttctcattcctgtggctgtgaatatctatgcccgtcgccttctgtcgccggttgaggtaattggcggtatcatccatattctgttcttcccagccgtcctgattacgctggtcgtcttgggatctcgcaattcgtcggaattcgtctggacacatttcgagaactccatgagcggctggaagaatgacggggtcatctggtctgtgggtcttttgactgcagtctacactctgggcggtacagatttgtcttcccacagcactctgtgtttgcgctga

SEQ ID NO: 3201 - DNA, 204 bp, A.fumigatus
tctgaccgcaagcagagatatcttagtttcctgcccatgttggcattcgcagcaaccctccaagcgtcctgggaggctatcggcgcgagtatgtttgctggtttggagaacggggggccggttgttctcatttatgggctcatcctagcgattgtgggttctctgggcattgccctgtctctggcggaactcgcatcaatgtga

SEQ ID NO: 3202 - DNA, 615 bp, A.fumigatus
  unsure (6): Identity of nucleotide sequences at the above locations are unknown.
tctgtngtgtcgttctcccataatcatcagcctttaggtctccggttctcctcccgtggacgacacccctccttcattccagcaaccttgcagtcatcgatgcatctccgaaacttttctcttgcggtgatatcgacggttgtcgcatctggcgcttggtacgcttatcagggtagcaactctccgcagagccccgtgacgtccccatcgcaaacaaggtcaatagctacagacgcatcttctggaccgcacgctgaagaatctgcggaatctaccagacgtgcgatcctcgtggataatgatcagttctacacggcaacattatctggagaccagcctctctacaagcagacagacgattccgaccgccgaattctagagatgttgacgcctgaacaggcgacacagaagttgaggagaaatgaacagtcctttatggtaaatcggggcaaaggtgtcgtgcgatacgatgtcgtccaggttccgagcaactcgcccatcgaggatgatcatgcggagaagattgtcgaagtgccttcctctgtagctgcggcgaacgatggggggtcgacgagtgattggatgttttgggctgtatttgatggtcattcgtaa

SEQ ID NO: 3203 - DNA, 813 bp, A.fumigatus
gctaggggatggacaacctcggccaaactgcgcaatgttttgatctcatacgtggcccgggagctgaatacgacctacaaggctgcagctaccaatccttcacttattagcccgtcatccgaagccgtggacgcagcaattaagcaggcctttgtccgccttgataatgatatcgtgcatagtagtgtcgacaaggtcctcaaatccaattcccgccgagccgcagctgagctgcttgcgcccgccctctccggatcctgtgctttgcttgcattctatgactcgcaatctaaagacctcaaggtcgcctgtgctggtgactcaagagctgttcttggccgccgtggacctaccggaaaatggacggcaacaccactttctgaggaccagactggtggcaccccttcagagatgaagcgtctgcgggaggagcatcctggcgagccgaatgttgtgcgtaacggacggattctgggacaactggagcctagccgctcctttggagatgcattctacaagtggagcaaggagacccaggagaaaatcaaaaagcagttttttggaaggacccctcatcccctgttgaagactcctccttatgtcactgccgaacctgtcatcacgaccacgaagattgagcctagtaagggtgactttgtcgtcatggccacagacggcctctgggaaatgctgaccaatgaagaagtcgtcggacttgtgggccaatggattgaccagcagcgggctggcaacaatggaaccagtaaggcgtggctgcagagttggtttggcttggacaacaagcgcgatcat

SEQ ID NO: 3204 - DNA, 480 bp, A.fumigatus
gacaagatgtttcgctcagttcctcgtcggattcctcgacgtctccctactctctcttcgactgccggcagtccatctcatctcgccttgcgttcattcacatgcggttacccgcggatgtcatcatctccgctgccgaccgttgagcccccggtttcgacgaccttgccatcagactcatttcagttgctgtcaacagctgagaagtccgggagtgcggaggatgcactttatgagcaacaaatcaaagatgtggaggcatggtggaaatccccgcggttcgagggtatcaagagaccctactcggccgcggacgttgtcagcaaacgtggcactttgcagcagacatatccgagctctttaatggctcggcaagcctattcaatctggctaatagaaaagaaccggcaaagggaaaacccgtttcttaccaattatggtaggaccctttatactggaacccttggtcaaaagtcttaa

SEQ ID NO: 3205 - DNA, 252 bp, A.fumigatus
ttactaaatataattataagatctataataaagagttacttactattatttactattttaaagaataacaccctaaaactagagggtatactattactaattaaaattataactaattactatagcctagaatatttatatctattaagctacttaatagataataagcctattagtctaaattcctatcctactttaattttaaaattatatattaacctaggaagcaaggagttaagcctaatactctaa

SEQ ID NO: 3206 - DNA, 234 bp, A.fumigatus
acggactgcgggatgctcaccttcagcgacgaggatatcagagccaagatccgggaagagcttggcgaggatgcgtcggatatcaagttcctgccgttcagggatctggaggcgagtgtgcgggaggatgtgaggttcttgcgggggagcagacttgtccaagggaatgtgacggggtatgtgtatgaggtggagagggggcggttagtccggttggacgtgagtgatatatga

SEQ ID NO: 3207 - DNA, 423 bp, A.fumigatus
caaactggccgtcgtcacctgcatggacgcgcgcatcggtaccctccgcttccccctttctcgtctccttaccgtagtactaacagcgcagacgtcttctccgtcctcggcctcaccgaaggcgacgcacacgtcatccgcaacgcaggcggccgagccagcgaagcgctccgcagtctgataatttcccagcggttgcttgggacggaggaagtggttgtcatccatcatgtatcccctgtctgttcccatcctagtttgactagcggtactgatgatgacgatgatagacggactgcgggatgctcaccttcagcgacgaggatatcagagccaagatccgggaagagcttggcgaggatgcgtcggatatcaagttcctgccgttcagggatctggaggcgagtgtgcgggaggatgtga

SEQ ID NO: 3208 - DNA, 420 bp, A.fumigatus
gcccgcggctgcaaccgcgagtactccgccgagtgcgacttcgttttccgcgcgcgcgccaccacgtttgtttgcctcacctggttcgcgctcttcctggcctgggagatggtcgacatgcggcggtcgttcttccgcatgcagcccggctcgacgcggtatctgacgcagtggatgtctgatgtctggcggaaccagttcctgttctggtcgattgtggcggggttcgtgacgaccttccccattctgtatatcccggttttgaaccatgtggtgtttaagcacacggggatctcgtgggagtgggggattgtgtttgtggaggcggtgctgttcttcctgggggtggaactgtggaagtttgccaagagggtgtatttccgccggcagcaggggaagaacgttcagagcctggcttaa

SEQ ID NO: 3209 - DNA, 552 bp, A.fumigatus
tatacaatcttccttttcctctcttctccctttaggaatcctgacagatacccttgctatcaggagaacggacgaacataccatggataccgcaaaggaatctacatgttgccgtgcgacgagcaggagcaggatcgtctagatatattccacaagcttttcactgtggcgagagtctcggacggactgatctatgctccacatcccaccaacggccggtttctcgatttgggatgtgggacagggatttgggcgatcgatgtggccaacaagtatccagaagccttcgtcgttggggttgatttggcccccatacaacctccaaatcacccgagaaattgcgacttttatgcgccattcgactttgaaagcctttgggctcttggggaggattcgtgggatctgattcacatgcagatgggctccggcagcgttgcaagttggcccaacctctatcggaggatttattcccatctccgtcccggtgcctggtttgagcaggtcgacatggacttcgaacctctttacggcagggccgaaataagcgatgcg

SEQ ID NO: 3210 - DNA, 321 bp, A.fumigatus
  unsure (28),(41),(48),(115): Identity of nucleotide sequences at the above locations are unknown.
ccagtccacgtggtctttccttttggtnacctcgtcaacanacttggnggtttcttcttcttcttctttttttcccccaatacccgattggacttcctcgacctgatgtttctcnacgggcagggcggacagcgacctccggatggtgctttcccgccacttaacgttcgcggatttatttcgtcaggtttcaatgccttaggccgctcaagaaacaactccgatgctatggacatttatacaatcacagacaggggtccccgctgcagagagagacccggccgctggtcgttggcacgccaatggttccccaagtattaa

SEQ ID NO: 3211 - DNA, 186 bp, A.fumigatus
  unsure (25),(67),(87),(114): Identity of nucleotide sequences at the above locations are unknown.
ttgtctcataattctcaaggaatanagcacagcctgaacctgcgccgtaaggtgtatgtctgcccancctgcccgatcacccatatnaccaaaattaaagaatctactaaatancttatttctgggaagtggagaagcactgtcaccccaaccataaacctcacacagtgcaaatatcctccatag

SEQ ID NO: 3212 - DNA, 279 bp, A.fumigatus
  unsure (151),(152),(153),(154),(155),(156),(157),(158),(164),(170),(172),(173),(174),(175),(176),(177),(178),(179),(180),(187),(188),(189),(191),(192),(193),(197),(198),(199),(200),(201),(202),(203),(: Identity of nucleotide sequences at the above locations are unknown.
ggggggggtattatctttttagcactgctcctcttgggggggcgcacggtacctgttgtatctaaattacaacagcccccgtggggtgatattatgggtgggtgcgcgcgctccacaagtaagttttatctagggaagcattttgtacgannnnnnnnaccganccgacngnnnnnnnnngggcggnnngnnncggnnnnnnnnngccgctcggcatccnatgcattcgagcngactggtatcgttgcgatacttcttatgttgtctcattccgtttga

SEQ ID NO: 3213 - DNA, 285 bp, A.fumigatus
atcggcagcggcatgaacagtgacctattccctccacaggaccgatggaaggccatggcagtattcaccctggctccactcataggaacggctatcggccccatcaccggggcatttcttgttcaatacgagtcctggccgtggtgtttctatgtggtctccatcgctgccgctgttatgcagcttgccgcatttctcctacttcgtgagacatacgggcctgttctattgcgaaggaaatgtgctcgaatgcgcaagacaacaggaactctcacttcactgtaa

SEQ ID NO: 3214 - DNA, 339 bp, A.fumigatus
gtgacgtgggatggtcccaatgaccctgagaatccgaaaaactggcctgcgagtcgaaaatggatggtcttcattcctatgtccttgttcaatctcttgagctcaatgtcttcggccacggtagccccggctctggaggcaatcgccgatgatctcaagattcgttctcaaacactgcttatcatgagtctttctgtgtacctgctcggcagtgcaataatccctcttgtcagttcgcctctctccgaaatgtacggacgagtcatcatcctgtccgcttcgaatatcgtctatatcatcttcaatacactttgcgggattgccaagacgcaaaactag

SEQ ID NO: 3215 - DNA, 987 bp, A.fumigatus
  unsure (46): Identity of nucleotide sequences at the above locations are unknown.
tctgctactaccagcgtatgtatattcccccccccccccgggccgnactatcacgacagcccactaatctggcgcagctggcattggatcagatataacgccggctcggtcgctcacgccgtcttgcgccccaggggcatgtcatggactccaaggcctttggaccttggggtggggacctcattcgatcagcatgttattcgaggctaccgattccttgcacgccgatgggtaccgggcgccaagatctacctctttggcttttctcgaggcgcatacacagctcgattcctgaacgagatgctcgattacgtcggcctgctttctgcggacaacgaggaactgatccccttcgtctgggaggcgttcacgcagtggaaattctccgagggtgagaagccagaggagcgtctgggtgcaatgcgaagcttgagcgtgagtcgagagacgatgtgtcgacccgttggccaagtccacttcttgggcttgttcgatacggtcaacagcgtggccgagtttaacaaggagagcagcacgcggccaagcccgaagatcatgagacacgccgtcagtattgatgagcggaggatcaaatttcagcccgtactcttcgagagcaagttgggcacgggatcaccggacatgaagcaaagcgttgatgactggaagaaaggacccgaaaacatttatgacacagacaatgacggggagttctcaatactcgaggccgactttaaggaggtatactttgctggaaaccacggcgacgttgggggaggctggccgagcaagtcctggcccgcaagccagatccctctgacatggatggtccaagaagccatcaaggccgggcttacgttcgaaagcaacaagcttgaggtgctcggctgccaagatccagcaacatgtgggagcggtcaggacatcgtacgccaggctgagcgtcttcaccacggggctggaaggatcgacagtgtgctaactaca

SEQ ID NO: 3216 - DNA, 477 bp, A.fumigatus
aaacgtatgaatcaaaaaccgtccgttggttctcctgagtggcaccaaattcgcaagaacaatcacaaagagggtaagctgcggcaactgttttgtggggcgattcaagctaactcgatttcagtggaacgtcggcgtcgtgaagctatcaacgagggtattaatcagctagcgcgtctggtccccaactgtgacaagaacaaaggcgctatcctacagcgtacaatcgagtacatctgccagctgcatgatgagaagaaaacgatgagtgaacgatgggagcaaaataacatgactacaagtcatgctatcaacgagatcagcgcccagaattccaagttgaaattagaagttaaccgccgtggagatatcgcccagaagtggcttcagcgctgtcgcgacgcaggtctcgagttcgacgactacaacgatgctgaagagctcgagccccttgaggtcgaccagggtcaggtctga

SEQ ID NO: 3217 - DNA, 348 bp, A.fumigatus
ctttatacccttgcagaacacaaatttcacgccctcggtagtgatgtatcagtcgcataccaaccagaagatctgatccgaaatccccctcgaccctccgatgtcaccctagaattgctcctcgcatcccaaacgcacctcggccattatacttctcgctggaacccgcagaactcgcgctatatctttggtattcgagaaggcgttcacattatctcgctcgatgtaactgcagcgtacttgcggcgtgcagccaaggttgtggaagaggttgctgcccgaggtggattgattcttttcgtcggcacacgatgggctatggacccgccgggctcgaaagtgacgcgg

SEQ ID NO: 3218 - DNA, 192 bp, A.fumigatus
aattcccaactgctgccgtcattgtttctaacatcaagtgccttcttccaatttacaatgcagattctcgacagtggtgagaagattaccccagaggctttaattcccaagtttgaggtcaacagactcctcaagcaaggtaagaatcatctcctgtcaagattcagatgcacgtcttcaccgggggctcag

SEQ ID NO: 3219 - DNA, 432 bp, A.fumigatus
aggggaagtatagtttcgtatgtggtcctctttgtctttgcttgggatgaagctgcggcgctaatgatgctttggcaggtatactttggtttcacgcactgtcccgatatctgtcccgatgaactggataagatggccgagattatcgatcgggtcaaggaggcgacgaagggggagaatatcttcctgccggtgtttattacatgtgatcccgcacgcgatacgccccaggtcctgcgcgagtatctgaaggagttccatccggatattattggcttgacgggcacgtatgagcaggtgaagcatgtgtgcaagcagtaccgagtgtatttcagtacgcccaaggatgtgaagcctggggaggattacctggtggaccacagtatatacttctatctgatgggtgagtctcgctttcctcgcgtcaagtga

SEQ ID NO: 3220 - DNA, 255 bp, A.fumigatus
actgagcctgacctgtacctgtatatgtacattagacctgacctctcaaatccacgcctctattttcccccctcagtcgaagataatatcctcccctccgcatctctctccctattctccctccactccatccccccatccacaaactcctccctcttccaaatttccactttctcttttacctcctccagcacctcctctgccgccttccacgccatcccacgatgccccgcactaaccgctaaccacaattga

SEQ ID NO: 3221 - DNA, 258 bp, A.fumigatus
tactgggaagaccctccgttctcgtggaaggcggcgctgctgttcgtgctgacgggcgcggggatgatcgtttacttccgggttgagaaggagcggttggagcggaagcggatcgcggagatgagcaagggggttggacggccgaaggttgggggccctttcacgctgacggatttggatgggaaggagtttacggcggaggatttgaaggggaagtatagtttcgtatgtggtcctctttgtctttgcttgggatga

SEQ ID NO: 3222 - DNA, 552 bp, A.fumigatus
agaaccgatatcctgggcttacccattggtcaacacatctccctcgctgccactatcgagggtcagccgaaagaagttgtccgctcctacactcccatttcttcggacaatgaggccggttactttgatttgctcgtaaaggcctatccccagggtaacatttccaagtacttgaccaccttgaagattggcgataccatgaaagtgcgcggtcccaagggtgccatggtctacactcctaacatgtgccgtcacattggtatgattgctggtggtactggcatcacccccatgttgcagatcatcaaggccgttattcgcaaccgccctcgcaatggcggcaacgacaccaccaaattggacctgatcttcgccaatgtcaacccagatgacatcctccttaaggaggagctggatatgctggctgctgaggatccggacttcaacatctactacgttctgaacaaccctccccaaggctggactggtggcgttggatttgttactcccgagatgatcaaggttcgcatcatttctccgcatgctgattag

SEQ ID NO: 3223 - DNA, 183 bp, A.fumigatus
attggttctcttgctgatctcatatcttcacaggaacatctccctgcgcctgccagcgacgttaagattctgctctgcggcccccctcctatgatcagtgcgatgaagaaggctaccgagtcgctcggttacaccaaggctcgccccgtcagcaagcttgaggaccaggtcttctgcttttag

SEQ ID NO: 3224 - DNA, 1218 bp, A.fumigatus
  unsure (123): Identity of nucleotide sequences at the above locations are unknown.
ttttctcaatcaaggccgggtgcctttttcatggtccacttccgttccaaagaacttacgaaactctccccattcggcaagtggtgcaacgcctttggcatccacggcggctttatgattgancaggacgacgtcgacacctatacctgtcacgaaccgtgctctgctaatgccgccgcaatcagagacctccaagaacatcctgaagacgttccttatcgtgtgcttggcagtctcggcaagccttataaatttcaaatcgatgaaatcatgctggccaatgcatggcgtccgaactttgcccttgcagattcctacgtcagtcgtgatggacagggccgcgtgttcctcggcggtgacgctgctcatcagaaccctccacatggcggctatggcatgaacagcggcatagaggatgctatctcgctcgcgtggcgtctctcagcgttatacaaaggcatcggtggaggcaacctcattacttcatatacgaatgagcgtcgaccaaacatgatgctgcgtctcgaacgttgtgctgctcatattggtaaatttactccaatgattatgcgtactatgatggcgccgagcacagaaattttcctcgaggagagtgaggaaggagagaaggcacgagccgagatagcaacgcacctggacagcgtggggcctgaaaatatcgaccgcggagtcgaactagatctgcgatacttgaatagtgaaatcatcgtgagcgacgggacgagggagccgagattcgataacatgcgctatacgccaagtacacggccagggcatagggcaccacatgtattcttgagagatgatcagacaagtatcgtggatctctatggaacagagtggtcattgatggacttctcaaaagtcaaaagcgactctcaaacgaccaatggcttcgtcagcttggatggtgaaatgacctccccggtggcgacattcaaagctgttgccaaggcaatgcagatgccgctgacgcacgtccaactggatgccggagagaagcacgttaaggaggtgtgggaaaattacgattatgtcttagtccgtccagacgggtacgtcgcctggcgtggaggcaaagaaggagcgagggatgaatgttgtgagctgaacgagggacggataaggaacattttgagaattgcgctgggttggaagacattcttcacccaccggggctggaaggacacgcgctac

SEQ ID NO: 3225 - DNA, 627 bp, A.fumigatus
ccgctcgaccaggacgatctggaagatgagcagcaagagtttgtctgggaccgatgcttaaatgatcagatgttcgtgttccaagagcatgaactagaacgaatcctggacattatcatcaccaatatgaccccgcaacgttcaccatcacagaaaccggtgcccgcaaatctcctgttcctcagcgcgcgatatgcccattatcatgccagtccggagctgctggcggatctcctcaattcggcgacggagaagatcaatgacgtcgttgaacgacatcagtgggacatgaccatactcgcattctggatgtcaaatgctactctactcttgcattacttaaagaaggacgccggcttggtagggtcgactgtcgagtttcaactacacctggcagagcttatcaacgagatattcatcttgatcatccgcgacgctgagcgtcggatgaacaaggtgctcgacgctgcgatgctggatcatgagaccatcccaggactggaagatgtggccttccagaacgaatggaagctcttccggcccaagaataagacaaaagcccccgaacccgccgagaagcggtttcgtctaacacgcccgggaatgggacctagcgcgtcccccaac

SEQ ID NO: 3226 - DNA, 591 bp, A.fumigatus
tggcacacccgtatctgttgcgctgctgtcgtcgcagggtcggtctacaaggacgtactctcgacgaccactggttggcttggtcacgattacgcaaagagtccctggcagctaatgctatcccccatgcccgcaggccaatcccaattcctcacaacccccatcgccgcaaaaccactcagtttcagtcttgcccttgatgaccactcacacgacgacgaacatactctccaggctcattatggacgcgggctcgtggcctcgctggatgatgataacgcgtccaccatcaccgcacgtctagaggacagcgacgctcggttaatggagatgctggcggcgcaggcggcgcaccgggaacttgaatcgctggacgcggacgaggacgccattgcgagcgacgagaagcttacggacgaggagaagcgaaagatcctgcagcggagcttgaatatggcggcgagtaatggcgatgtggaccgtgtgcataagctggtggggggcaaggcgaaggactacgttgatgtgaatatggctgatgaggaggggacggttccgctgatctatgcgagctgttttgtgcgtaattaa

SEQ ID NO: 3227 - DNA, 552 bp, A.fumigatus
tctatgcgagctgttttgtgcgtaattaaaattattttcctactggttgggtgcggtactgacggagaacagggacatcaggatgttgtttcggcgctgctcgatgccggggccaatgtcgaccagcaggaccggaatcagtggagcgcgctgatgtgggcgatgacgaaccgacacaagaccattgcgaagattcttctcgatcatggtgcctcgccggacatcaagtcttcatccggcgggaccgcgttcgactttgctcagccgggaagcgagatctccgagtatttacatgagaatgggtacaatttcggaccgagtgcgatcgaagatgatttttacgattctgggttcgcacatggtcggtttgaggaagagatggcggagaatgagatgaagcggcgcatgatgatggaggagagcgctatcaatttggaggtcgatttatcgagcctgggacttgatgagaagtttgaagtgggtacaccattccgcagagacgtcaatgatgctgaccgtgtagccgctcgaccaggacgatctggaagatga

SEQ ID NO: 3228 - DNA, 372 bp, A.fumigatus
ggcatacagctgaaacattttggaaaactcccggtcattggaggaaggaactgccaatcagtcacacagactcctgcacatggggagacatttaagattggcgagcgcatctccgtcaaagcactacacaccccctgccatactcaggatagtatctgctattatatgcaggacggagacgaaaaggtggtgtttacaggtgacaccttattcattgcaggtgagacttccattctctggtgtattcgaatgaatctcacattggcaggatgtggtcgctttttcgagggaaatgctcaagagatgcacaaggcgttgaatgagactcttgcctcgctacctgatgacaccagagtctacgtaagccgctaa

SEQ ID NO: 3229 - DNA, 381 bp, A.fumigatus
tttctttccccagagctcctcaatggcttcgtcatcctccttggatcgaccactcccacctctttgtccaaacgcaatccatatacttctctctccaactcttgtaacaaccccttccggacctttggacgcttcaactgcatcttttcccccagctttgcccctatccttcgaaagctttctgcttcccgacccactcgtgtcgttcacgcggacaatatccccgactcgaattccgtgcgcaccaagcctcggttcaccgtcagctccagctctgtcatcgtcgatcttgttcgtcctagatttgctcgaagatacacctgcatccgcagtgaactcgccgacaacgcgcccgcccagtccggttcggcattgcgataa

SEQ ID NO: 3230 - DNA, 948 bp, A.fumigatus
atagcttacgtttctagtatgaaccaaaccatggagaaaatggctaaaatgacggactcggagtactcgcactttatgcgggttgcctttggccatacagctccaatgcaaccagattatggggccattggcccccttgagttcgttgatccaactttaaacgattcacagaaagaagctatacggtttgctttggcggctagggatgtggctctcatccacggacctcccgggacaggcaagactcacactttgattgagctgattctccaaatggtcaaacgaaagcttcgcgtactagtttgcggaccgtcaaacatctctgtcgacaatatcgtggagagactagctcccaacggggtaccagtagtacgcattggccatcctgctcgtttgctaccgtcagtccttgagcattccctagaagtactcactcacacgtcagaggcggcagcgatcatcaaagacgtgaggaaggagattgatgaaaaacaagctagcatccgcaaaaccaggaccggtcgggagagacgggcaatctacgatgacctgaaagaactccgtcgagagtttcgcgagcgggagtcgagatgtgtggacaacctggttcgcgaaagcaatgtcgtccttgccacgctccacggggctggcggccatcagctgaagaatcagaagtttgacgttgtcgttattgacgaagccagccaagctctggaggctcaatgctggatccccttatttgcaacgtctaaagtggtactttgcagaagaccaactgaagattccccttaccgtaaggctttcctttgccaattggagaacccagggaagaaagaggggttcaaccccaaagtaggcttgacccaatttttgcgggaaactatggcgaattttcttggtaaaacaagttttggagacaattcctctcttgaaggtgacccggtttaa

SEQ ID NO: 3231 - DNA, 195 bp, A.fumigatus
  unsure (54),(55),(61),(62),(63),(64),(65),(66),(67),(72),(73),(76),(77),(78),(80),(81),(83),(96),(146): Identity of nucleotide sequences at the above locations are unknown.
ttcttgctttgcatccgggagaagtcgcgacgtgagttctcgtattttcttttnncctccnnnnnnnttccnnttnnncnntnccttttttttgtnctctaccctgtggaactgctgtccggtcggggtccgttgggtttgccctncccgccctatcgcgaactgggccttaaaggaaaccccctgggaacctga

SEQ ID NO: 3232 - DNA, 291 bp, A.fumigatus
acccgtcaccagccaaacaccaacctaacggccaacgggaacaatatggagacccaaacttggctcattgttggcgcatctcgcggaattggccttgaatttgtgcgccagcttctgaccagcggccatcgggtcattgccactgcccgtgggcctggaagtgctctggacaccattgctcgagatgcgcctgaccgagcgactattctgacctgcgacgtgtcgaagaacgagagcatcatggtatgtatatgtatacctatctgctaccaattgcgacaaagatactaa

SEQ ID NO: 3233 - DNA, 630 bp, A.fumigatus
tataaacagcacaacctcacccatccagcagctatactccaaaactgccagcaattgcatcgacacgaattgacgagagctgacaaagatcagtcaaatgctgaaatgtcccgcacagtttgcatcaccgctgtagacggccacacgggcttcctcatcgccgagctactcctcacaaacgagaccttcaaatcccacatcaagtccgtcgcaggtctcactttgcacccccacgcagcaaaatgcaaggagctcgccaagctgggcgtcaagatcgtcccacacgagccgggccgtctgaagcacaccgtccagaccctgcagcagatcggcgccgaggccatgtgcctgattccgcccgcgcataaggaaaaattcgacatcacgatggagatgatcgaagcggcgaagaaggccaacgtcgccaatgtctgcttcgttagctcggccggctgcgatctcgctgagagagacaagcagcctcatctccggagctttattgacctggaggcagcttttatggcctccaagggcgattcttctacccagacgggacactcgccagttgttgttaggtattctccaccctctctttatccttgtctttttgcgagacaatgggcaatctga

SEQ ID NO: 3234 - DNA, 528 bp, A.fumigatus
agacgaaagcgaggggctgatgagggacgggatgcgctgcgacgggcgcagaagttgcgtattggggcacgatcaatccctggtgtaccgattgtttacgtgaaacggtctgttatgattctcgagccaatgagcacgccatctgaagaagtacgagacggagttgaaaacagaaagttccgggtgggtttgaatgatgaagcggtgttaggcaaaagaaagcggaccgaggacggtgaggagaaaaagaagaagcgagggccgaagaagcccaaaggccctaatcccttgagtgtgaagaaaccgaagaagaaaccagcagaaacggccagtggaccgaaacaggagaagcggaaggaacagaaattagacgaggcgccggacaggacaaacgatgacggcgaatcaggcgcacccaagccgaagagaagacggcgccaccataagagttccaaaggggatggaaatgacgaccacgccggtgaaccctcaaatggggcagatgctgcaacggcttcgaacgaataa

SEQ ID NO: 3235 - DNA, 363 bp, A.fumigatus
atgggtgtcgtcgcatcgcggtcttacgtatgtggatggtctctccctgtccctatgtctcctcagctgacaggaggccttgaatctagattcgagaactttgacgaatatacgcgacgccaatacaatgccaaagctccccatctgcccaaccccttcggttacgacgaggtcccgaacaagttctcggagtttgatgtattccaaaagcttcgtgttctccatcaactgtccgtttggacgttttggaaccccgatcgcattcgcgagaagatgccagagcagaaagagattgaccaaacacaatgggtgggtaaaatcccgccatcagcagtcgatcttggtcttccacagagatgctga

SEQ ID NO: 3236 - DNA, 333 bp, A.fumigatus
  unsure (11),(296): Identity of nucleotide sequences at the above locations are unknown.
gatataccttntacaggctgctcctctactattagaaatatagagttcatcaaagcattacctagcataactattactaagcttatagatggcatcacagttttaggcattagatcccgtcatcgatcaaaccattctgctatgctaacactatggttccctagattaatgaataatagtggttctgcaaacatatttgctaagattaccatctattactatttagttaatggcctgaagcctaagctacttattagaactaatatcatctgcagtgaaggatttatacttaattntaaacatagcattgcaataattagttcttatagttaa

SEQ ID NO: 3237 - DNA, 252 bp, A.fumigatus
agatctcttctactagtatatttagttagtaaactagtagtatatttaaagactaatttattagctaactataactttatctttaacctactagataaatcaaccttaaatagagctactatatatgtgtatataattaactataaattctcctttattaaagtctgtaataaaacacctactttaattatagttacttattatacttatatagggactatctctaatactaactttattactgcctactaa

SEQ ID NO: 3238 - DNA, 237 bp, A.fumigatus
tataaaaatatgtacttgtattctaacactctatccaggtgcgaatacttcaacacgactttgtatcaaaccatgcaactcgctgagaatcttatagcgccaagtcgtccaacaatgctaataacaaaaaaaaaaaaaggggggggggggggggggaatgagatcgaggcatcaatcagtatgcaattattcaacgccgcttatgcaaaaggaatcaagatgtcagagaggctctga

SEQ ID NO: 3239 - DNA, 525 bp, A.fumigatus
ctgatttctcgacaatctttatcactcctctctccgaccgcacctcgccttacctcactttcacttcaccatccacttaaccaacatcacgcacatacaatggcatcgccagctcaagcgcaggctccggcatcgacatcgaatcaacctctcacacctccagccgaaccctcatcaacaaataatacagcgaacaccaccgcctcgcaaccacctcaccctacgggaacctccaccaccgcacccaacacagcgatgccctccacaactccccagccaacgcagatcccatcgacgtcactcacagacagcggcaaatcacggcgcccacgcgatgtccgcctaatccacatgcttctcgcctccctcggggtaaccgcctaccaagagcgggtcccgctccaactcctcgatttcgcgtaccgctacacctcatgcgttcttcatgaagcggtccatcctcggacggaaggctacgcaggcggccccagaaaccgggccgagcagcaatcgtgggccagttga

SEQ ID NO: 3240 - DNA, 246 bp, A.fumigatus
  unsure (73),(233): Identity of nucleotide sequences at the above locations are unknown.
cagagtatgtgcgaattaatattccactcaattgccaacctggtcggtagctgctggttcaggttcattgtanacatattggatgctcaaaagcgaattgggacggcggacatttcctattccggtgtgattccatcggaggaagaaaaccccgctcgtccttctgtttaccccggacttgacaacgtccggcacagtctccacaaccaaaagtgggggggtccactaatgangagtatcatttga

SEQ ID NO: 3241 - DNA, 435 bp, A.fumigatus
  unsure (307),(308),(309),(330),(331): Identity of nucleotide sequences at the above locations are unknown.
acgcaacatgcaccctctcatccggttgcatctgcttgccccctttccaaagccccaaaccccaaaaagggggaaaaaggggaaaaaaccccccgtttttttttgggggttttttgggggtttaaaaccccggcccccgggccccttttaaaaaacccccccaaaaggggggggggcccaaattttccccccccaaaaggccccgggcccaaaatttttttggggaaaaaattttccccccccccccggggtttgtgccccccccccccaaaaaaccgggggggggggggggttttttttttttttnnncccccccctcccgcggccccnntaaaaaaaaaggccccccacaaaattttttgggggcccccccccggccccccccggggggggggggagaaaaacaccctcttttttttttttgtttggggggcc

SEQ ID NO: 3242 - DNA, 321 bp, A.fumigatus
gccccgggtgaagacctgtcgggccgcatcatcaacatccaccacagcttcctgccgagtttcaagggcgccaagccctaccaccaggcgtatgaccggggggtcaagatcattggtgccacggcgcactttgtgacgagtgacctggatgaggggccgatcatcgagcagaatgtcgtaagggtgaaccatgcgctgagtcccaaggagttgacgcatgcgggcagcaatgtcgagagtaatgtgctggcgacggcggtcaagtatgtgaccgagcggagggttttgctgaatgggcacaagacggttgtttttgcttaa

SEQ ID NO: 3243 - DNA, 189 bp, A.fumigatus
tcatgcagggatcaactgtatactgatatcaagatcaatgacaccctctgcgaacgataccagactcacatggctcgttatggacggaagatcaccaagagccatgacaaggtcatgaccggatcgtcagacataggtaggtttttttttttttttttttttgtgtcctccagcactgactacagctga

SEQ ID NO: 3244 - DNA, 204 bp, A.fumigatus
gggactcttccagacggcaaagaagcaatgggagatggcgatcgtggagtgatctttttcctgagtacagagtacttccaacgcgtctactatatgcaaactgcccctcgacgccttcctttcgacatcaacgcatcctgtcctctcaagcccatgaatagcgccattggcatcagtagtaaggatgacgattcactggaatag

SEQ ID NO: 3245 - DNA, 201 bp, A.fumigatus
tcgactgccatcctttggcagagcgccaggcacagagtagtatccaggttgtctggagtgacccccgctggacgtaccgtccctttcgaaagtccctatttctccacaggcatctggacgattatgtccatgacccagaccctggtctgctacgaaaagctccaaagaatatctaacaaactgtcgctgggtattctctaa

SEQ ID NO: 3246 - DNA, 270 bp, A.fumigatus
tctatgacatgcaaaagtgggaaaaaaaaggtaccttgggttttactgttgttcctgaagcttgtcccattctgtaaggcaccctactctggcttctggaaatatctcccagggtttctgcataacttgaaaaatcaacaaccacgcttgatcgtcggcacaatcagcgactgtcttatcagggcattgattggcttcggactcaaccgccaagacatttgtttacttgttatctacagccttggtcaatccaatgtcagggaatcctga

SEQ ID NO: 3247 - DNA, 429 bp, A.fumigatus
cgagtcttatctcgcattatctcgatcctaaccccattaacaggtcaatcgctcacaatgtccgtccacgccaatggaaagacgcctacccatgcctttagtcggtctccctttcgcacacgcagcaacttccaagatgcgtgtcgagcgctgctcgatccgctcgtcccgcgcttcacaccgggctgcagtcgtgtgaagatcggctcgtcagcgacccggttcgatgaaggtggcgctcagatcgagggtttcgcgcgccccctgtgggccctgggatccttgctgggcggaggctatgactatgctgaggcagctcgttggcgcgagggctttatcagcgggactgatcccgaccatccggagtactggggcgacattgaggatatggaccagcgcatggtggagatgtgtcctatcgggtttgca

SEQ ID NO: 3248 - DNA, 360 bp, A.fumigatus
cctgtcggaaatagattttgggaggccctctcaggaatatgttcgcggacaattcagcatcctgactctcaagtcaatcgtctctgcatcactcctgacaagcgctacctagcggccgcgggacacaacaatgtcaagctctatgatatcaagtcaaccaatccgaatccagtcatgacatttgacggtcacacgaacaacatcacaggagtcgcattccattgtgaggggaagtggatggttaccagctctgaggacgggacggtgaaagtgtgggacactcgtactggaagcttgcagcgcaattacgcacataaatctccagtgtcttcaccacggggctggagagcgtccgtctag

SEQ ID NO: 3249 - DNA, 735 bp, A.fumigatus
ccttcttccggggctttgtttttcccccaatcaatccacccccctaacacggatcctgtaggagacgccgacgccttcggccacatccgcaagaaggagctccaacaaagcgccaaacacctcggcctccgcgccgattcggacgtcttcatcgtcgacgatcccgcccggtttccagatagcatgacagccacctggtccgagagcgatatatcctcgttgctcgcgtccgcctttgcccccgatctcgcctctcagtcgcagtcatccgcagtcaggcatcgggtgcctggaacggggcccccaaccgcaaccatcgacgtcctgatcaccttcgacaaacatggtatcagcaaccaccctaaccactgctcgctgtaccatggtgctgtgcacttcctccgggccttgatgaaggacaaggcggggtatacgtgccccgtgacgctgtacacgcttaccacgacgagtatcctacggaagtacattggggtgttggatgcgccgtggacgatggcgagcggggcgctggggtcgatctttgctggtgcggctaagggcgggaaggaggatatgccgggtaagctgcttttcatcagtgcggtgaatgagtatcttcgcgcgcaggcggctatggtcaaggcgcataagagccagatgctctggtttcgctatgggtggattacgctggggaggtatatggtggttaatgatttgagaagggtaagggtatga

SEQ ID NO: 3250 - DNA, 534 bp, A.fumigatus
gctgaacgtacttccaggcttccagacggcttttcctacgccgaaggagccctcctcgagcctctctccgttgtcatgcgcggcatccaagtggcccgcctaaatctcggcaggggagtcgtagtgtgcggcgccggacccatcggtctcattgctcttgctgcagcgcgcgcatcaggcgcccacccgattgtcataacggacgttgagctgaggcggcttgcgtttgcgaaagagattgtgccgagctgtattacataccaggttgatctcgcgaaggatgcgcaggacaacgcactcgctattagggccctcttcggagacagcgagtacgttgcgccagaggcggtgcttgagtgcacgggggtggaaagtagtgtttgtacagcggcgtatactgcgcgccggggtggtgtggtggttgtgattggtgttgggaaggcgactatgaataacctgccctttatgcacatgtctcttgcagaggtgagattcactctgaatcttgggcgaatccgtgctaacgatggctag

SEQ ID NO: 3251 - DNA, 204 bp, A.fumigatus
attgatctgcggttcatcaatcgatatcgggacacttggccctcggccattgcatgcctcagtggtgggattttggacctgaggaagttagtaacgcatgtctttcccttggagagggcaaaggatgctctgcatttgtgtgcagatccacgcaatgggagtataaaggtaatggttgtggatgaagtcgatgcgagtgtatga

SEQ ID NO: 3252 - DNA, 246 bp, A.fumigatus
gatgcggtgaaggcgtcaccaaattcaagccaggtgaggcacagcatctcaacatatgacttacactctgacaattcccaaggcgacagggtcgcagtcgaacctggcgttccatgtgaacaatgcttcctctgtaatgatggccggtataacctctgcgaagacgtacagtttgccggagtctatccgtacgcagggaccttgcaacgatacaaagtccatcctgcgaagtggctgcacaagtaa

SEQ ID NO: 3253 - DNA, 252 bp, A.fumigatus
tattttcattctgcggtactttgtgttcttggactagttctacacgcgaatgtggaaaagggctatagtaacgagcgttgccacctgttgtcctctctggaggagaaacagtgtatattattctcccactacaggtcatacactcgcatcgacttcatccacaaccattacctttatactcccattgcgtggatctgcacacaaatgcagagcatcctttgccctctccaagggaaagacatgcgttactaa

SEQ ID NO: 3254 - DNA, 183 bp, A.fumigatus
ccaatggtttggccagcatggtctcgttatacagtctttttgacccctgtctggtattatatctgttggtctggcttcaggtccatctcttctaatatgtgggttgtctcactcacaggataccaactgcttttgaagcgcacattggatgaaccgctgtctttcactgacaatcaagcctag

SEQ ID NO: 3255 - DNA, 204 bp, A.fumigatus
gaggacgaggccaaggtcagccagatagaatggcggcaccagctggctactatggatatagaagccatcacacagcgcatgaccagccagcccactatgtggtttcaaggggtccaggaccctgccatgcgggccatccagcagggggagagccctgttattgcagtgatgcccactggtggtgacaagagcatgtgtttatag

SEQ ID NO: 3256 - DNA, 726 bp, A.fumigatus
gactggctggatcctactgcaccccccaacgccccgtggaagggtaccacagacgcgaaactggtcgcaaacgcctttctcatccgtagcctggacttgatgtgcaagatctctcggattcttgggcaagatactgatacatcccgcttcgtacgctggtccgagtcatcacggaaagaatttcaagacgagtatgtgactgcaaatggacgcatcgtcttcgactcccagactgcatacgccttggccatctgctttgacttgttgaaacctagtcaaaaaaatcatgctggcggccggctagcatatctagttcgtaagaaagagtttaagatcgggactggctttgctggaaccccgtacgtctgtgaagcactggccttgactgggaatatccagctcgcgtatgccatgctccttgaggagagatgcccgtcctggctatacccggttaccatgggtgcgactacggtctgggagcggtgggatagtatgcttgctgatggatcggttaatcctggtgaaatgacctcgtttaatcactacgcctttggcgcgattgcgaagttcctgtatgaacgggttgccgggctgcaacgggttgagcctggttggaaaaggtcctgtgttgctcctggaattggagcggaactctcgagtgctgctgctgagcatctcacgccgttcgggttgctgtcgtgttcatggaggaccggaaaaaactaa

SEQ ID NO: 3257 - DNA, 219 bp, A.fumigatus
caacgatctcagatggtcgacgcgatcagtatctctatcggttctctctttggctcgccccccgtgaccgcctttgtcgaaagtggtgctggtatctccgagggcggaaagacgggtcttacctcctgcgtaacaggtatctgcttctttatcgccgtcttcttcgcccccatcttcgcctctaatccctccttggggctactggctgcacgctggtga

SEQ ID NO: 3258 - DNA, 453 bp, A.fumigatus
tccctccttggggctactggctgcacgctggtgattgttggcgccctgatgtgcaaggcagccgccgagatcaactggcgctactacggcgacgccattcccgccttcctgaccatcgccatcatgcccttcacctactccatcgcctatggtctgattgccggtattctgagttacgtcctcatcaataccacagcctggctcattgagaagggctccgtcggtcgggtggtgcccccgaacaaggacgagtcggacccctggtcgtataaagtccccggaggatttctccctccctggctgcgacgggccgctcggggcaagaaggacttttggcgcgaggacgaggaggaatcggtggatatgggagtcgtgcctgggggatctgtctcttcgcatgaccggccggagggagagaagagtcaagtgggtgtaggaaacaaaagcctttaa

SEQ ID NO: 3259 - DNA, 324 bp, A.fumigatus
gctctacccgaattgccacaatctatgcggcgtttctttgcatgttatactcattatcagccaggtgttcctaactctatcgctaccagttgctctggcaatctgttggatattcccgactggtgtacatatagcatttattgcagcatttacctttttcacgatggtaatagtccggctcctgaatgggccgccaacaggcaggtccctgatcggtattccgcaaacaagggatccggtcaacgacgaaaccgagccgtggttttttatcaacggaatagccaccgggtattcagtatccagccaggaaagaacccctgctga

SEQ ID NO: 3260 - DNA, 423 bp, A.fumigatus
attgagtcaggcctcgttcgcgatcgaatggacgaattcaaggccgtgaggaagcagaccgtcgacaaagccacactggagatttctcggctggaaaagcgactgacacgactcacccagctattagcgagtctacctccggatcagatacaagggggcaagcgctggccaatctcatggcaaaacgaccaacggaaagcgctcgagcagactattgttagctggcaggacgacgctggcgtacctcgctgtcccttctgtcagcaggagttcaccagttatacctttcgaagacatcattgcagaacctgcgggcgggttgtgtgcggtgaccctgcgactggatgttccaatgaagttcctcttagtataacgccttgtatgttaaaccctttggccttttgtgttgttatcttacgctaa

SEQ ID NO: 3261 - DNA, 540 bp, A.fumigatus
atttcagaagctgctcgcaacgttgcagtatgttacaaatctcgatcattactgctatatctaacatcattctttcttgccagagatccaaggcggcccccttctgcggcgcagattgctgaagcctcgaaagtccgcaagcgacttactgattccttcgctcagtatgatgttgccgccaggcgtattcgtgatatgccaaccgactcaccaacacaacagcggcttcaaaaggccatataccaacaagccactaacttcttgcaccttcacatgctgccgctgaaagctttgcccaagattctcaagcacgctacaccaaacgggcgacccgcaagcgctgccagttcaattgcgactccaacgaattctgcagtgggtgatcaccgaccaagagagtccgctcttgcatccatcaagtataacggtatagctgctagcgggagtaatactagcctaacaagcgacacgagtagtgcagtctctgcttcagaagcgggtcttcaccacacgggtcgaagatccgacgcaaagcgtcta

SEQ ID NO: 3262 - DNA, 417 bp, A.fumigatus
tggcgcggctccttccagccccgtggtgaagacaagggcacagagctctattcacccacagatccgggcattctggtcaatatctataacgcgctttcgacgtatatagttccgggtcccacgctcattcccggggctgtgtcagttgtgcagtccagttcgaccatcactgcgtcgggaacgccggtaactggcagtggtagtgctccgactaccagtgccactacaacgctgtccacgacaaccagggccaccacgaccacaactacgaccacggcgggcagctcgacttcagttcaatcggtctacgggcagtgcggtggcagtggatggtctgggcccacagcctgcgttacaggagccacatgcacttcctacaacagctactactcccagtgcattccaaccgcctcctag

SEQ ID NO: 3263 - DNA, 561 bp, A.fumigatus
gtggaccaactcgccccaccggactgtattctggccaccaactcctcgtcgtacaaatccagcgagatgatccagcaggtcacccggagataccgcgtgtgtaacggccactactacatgcctccggaccagaatcatctcgagatcatgacctgcggatacacggatccctccatcattgcatttctgatggagcagtccgccgcagcgggattcgtgcccatccatgccaaggttgaatcgacagggctgatcttcaatcggatatgggctgcaatcaagcgagaatctctcctagtgatggctgaaggggtgggaacggccggagatatcgatcaactgttcaagggttggtttcatggggaggttgggccgtgtgagatgatggatcgggtggggttggatacggtgtacaatatcgagaagcattatgtggaggagagagggctggatgcgaagcctatcgagtggctgaaggagaattacgtggatcgagggcttctcggacggaaatctgggaagggattactgtctgaagaaagcaatggccacgctcagtag

SEQ ID NO: 3264 - DNA, 1011 bp, A.fumigatus
gaatgcgtttcttacggctctcgtcgatcatttgatatactgacaagcaccatggacccctctcgatctccctctccgtctttctcctccccgccctccgagatccgcatcctcactcttaactgctggggcctcaaatatctcgccaaataccgccatgaacgactatcagagatcggtcgtcaactcgctctcgctgaccctcctccccaaatcgtcggtctgcaagaatgctggacgcagcaagactacgagagcatccgccagcaaactaaccacatcctcccctacggcaagttctactttggcggcattttcggcgcaggactagccatcctctccaaatggcccattgaagaaagcaccatgtacgcctacccactcaacggccgacccacggcattcttccgcggcgactggttcgtcggcaagggcgtcgcctgcgcgcgcatccggttcggaccagaagtcggcgacgtcgcagaggtattctgcacacacctgcacgccccatatgaacgagaacccaacgactcgtatatctgtcaccgcacagcacaggcgtgggaaatcgccaagctgatgcgtggcgcggccgagcgcggacacctcgtcatcggactcggtgatttcaacatgatcccctcgagtttcgcgcaccagctcatccacgcgcatgcgcccgtccgcgatgtctggcaggtcctgcatccggactcgtctgttggcgctaccatcgacttgcccgagcagaagcggaacaggcccgtgcccacggcggagttcaacctgctcgagaacggcgctacctgcgacggcaggtttaatacctggcggtggagtaaagaggatcgcaagcgcctcgagaaaagagaggatgtggtcgtcgataggactcgccctgccccccgggggaaagagaatggattacatctttggcggggaacggcggggtacccctctgcctatcccgggccgggagggtccgtccaatccggcgggttggcatga

SEQ ID NO: 3265 - DNA, 663 bp, A.fumigatus
gctcttcccccatctcgacggcaccctcatggaactccccaaccaccccgccggatctctgccacaaagctccctgaagagtgtctcctacgccggcggcgccctcgtcgagcccctcgctgtctgcctgcacgccatccgccgctcgcacccgcccacccccgccgaagtggatctggccaccgaacagggcgaccagaccgccgcgctgatcttcggcgcaggagccatcggcctcctcctcgccgctgcactagccacctcccagcccttcacctccatcgtcatcgcggacatcgaccccgcccgtctcgagatcgcaaaatccctcaacctaggcctgaagacccatctcctccccaaaggcggcaatgccgccaacccaccccctgcgccggacgcctctgccgcagagcatgccgcgtacgccatgcagaatgcgcagcggaccgcagcggcgctgaaagaggcgaatggggttgcgtcagggtttgtgcgcgtgtacgagtgtaccggcgtgccggcgtgcgtgcaagcggggatctacgctgccagccctggcgccgtgctcgtgcagatcgggatggggaatccgattcagacgcttccggtgagtgcggcggcgctccgggaggtggatatcatcggcacgttccggtatga

SEQ ID NO: 3266 - DNA, 1278 bp, A.fumigatus
  unsure (1050),(1092),(1116): Identity of nucleotide sequences at the above locations are unknown.
cagcatcaggaatcacgacccatctctcctcccaccggctccgaagtccaagttgccatccgcgcaaccggtctctgcggctcagaccttcactactacaaccacggccgcaatggcgacttcgtcgtgcgcgagccgatgtgcctgggccacgaatcctccggcaccgtcacagctgtcggaccagacgtgacaaccctgcaggtcggtgaccgcgtcgccctcgacgtcggcctcccttgccgtacctgcaccctctgccgcactggccgctacaacatctgcccggacatgaagttccgcaacagcgctaagctcttcccccatctcgacggcaccctcatggaactccccaaccaccccgccggatctctgccacaaagctccctgaagagtgtctcctacgccggcggcgccctcgtcgagcccctcgctgtctgcctgcacgccatccgccgctcgcacccgcccacccccgccgaagtggatctggccaccgaacagggcgaccagaccgccgcgctgatcttcggcgcaggagccatcggcctcctcctcgccgctgcactagccacctcccagcccttcacctccatcgtcatcgcggacatcgaccccgcccgtctcgagatcgcaaaatccctcaacctaggcctgaagacccatctcctccccaaaggcggcaatgccgccaacccaccccctgcgccggacgcctctgccgcagagcatgccgcgtacgccatgcagaatgcgcagcggaccgcagcggcgctgaaagaggcgaatggggttgcgtcagggtttgtgcgcgtgtacgagtgtaccggcgtgccggcgtgcgtgcaagcggggatctacgctgccagccctggcgccgtgctcgtgcagatcgggatggggaatccgattcagacgcttccggtgagtgcggcggcgctccgggaggtggatatcatcggcacgttccggtatgatggccatgcgtacccggctgcaattgagttgatggctagtgggaagcttgaccatgtccagaaacaggttgtnacgcatcgcgtcagacttgaggatgggaattcggcgtttgcnctggcggggaagggactggattanactgggcagccggtggtcaaggtctccattgaaagcaaaatttggattggttgtgttcgtccgccatgtttataccccgttggcctattgaggggcccatcctgttggactggagacctacgttcccccacccgttatttgttttgttccaaatttttataa

SEQ ID NO: 3267 - DNA, 408 bp, A.fumigatus
tatctcctatccttcttttcttctcatcatctcaattgctttgtctctccctacgctctgttcttgaacatcggattcttcttacaccgcgataagagctctcaccccgctctccaactccgacatcatgccttcggctctactcattggtgccatcacccacgcgcgcaaggagtggaaagatctctcgtccattctgactctaaaggtgagctcgcgattgtggtctggtggagtgtcgactctaatgtagtgttgaaggaatttcccgaaggcaccagagacgagttcatccggaattgcaaagacggccagtacgatgatgtggtagtgatttaccgatccaatgcgtctaccaaggtgagcgtggcagtggaacgcggcgataaatgtctagttactgactga

SEQ ID NO: 3268 - DNA, 225 bp, A.fumigatus
gttcagttcaccggtccattcgacgcagagttgctctctgtccttcccaagtcattaaagtatatctgccacaatggggctggctatgacaacattgacatcccggcctgttcagagaagggtgcgatcatttatgtccttctcatacagaaaccagaaaagctgataaagcacaggaattgccgtctccagtaccccagtcgccgtgaaccacgcaactgctga

SEQ ID NO: 3269 - DNA, 186 bp, A.fumigatus
acatcggattcttcttacaccgcgataagagctctcaccccgctctccaactccgacatcatgccttcggctctactcattggtgccatcacccacgcgcgcaaggagtggaaagatctctcgtccattctgactctaaaggtgagctcgcgattgtggtctggtggagtgtcgactctaatgtag

SEQ ID NO: 3270 - DNA, 321 bp, A.fumigatus
  unsure (240): Identity of nucleotide sequences at the above locations are unknown.
cggagatggccaactctgggatcattgatccgtctgggtgtccccccgaactggcattcctggtcccgtccaaactcattctccaaccgttggataaaaatgcccccattctgcttcccccatccttggaaggagcgaaccatcccttatctaagcctcctgaatactctccggacgggcgagatcaccccttatccccctctggttgggcccccctggggctttaacttccttccgccnccgaaacttaaccattctcgcgctacatttccccccaagtgtcctccccattttaccgtctctatttcgggttatgtctcc

SEQ ID NO: 3271 - DNA, 621 bp, A.fumigatus
  unsure (37): Identity of nucleotide sequences at the above locations are unknown.
cgttacaatagctttgcctggaagggtgagaccgagnaggagtaccagtggtgcttggagcagcagctcaacgctttcaaggatggccagaagctcaacctcatcctcgacgatggtggtgatctgaccgccctcgtccacagcaagtaccctgagatgctcaagggctgctacggtgtctccgaggagaccaccactggtgttcaccacctctacagaatgctcaaggagggcaagctccttgttcccgcgatcaacgtcaacgactccgtcaccaagtccaagttcgacaacctgtacggttgccgtgagtctctcatcgatggtatcaagcgtgccaccgacgtcatgattgccggcaaggtcgccgttgttgctggttacggtgatgtcggcaagggctgtgccgatgctctccgcagcatgggtgcccgtgtcctcgtcaccgagattgaccccatcaacgcccttcaggccgctgttcagggataccaggtcgtcaccatggaggaggctgctccccagggtcagatcttcgtcaccaccaccggttgccgtgacattcttgttggcaagcactttgaggttatgcgtaacgacgccattgtttgcagtaagtga

SEQ ID NO: 3272 - DNA, 483 bp, A.fumigatus
  unsure (78): Identity of nucleotide sequences at the above locations are unknown.
ctggtttccgcgagtttcggtggctttatactgatcaacacagacattggtcacttcgacattgagattgacgttgcntggctcaaggccaacgccaagtccgtccagaacattaagccccaggttgaccgctacctgatgcccaacggccgccacatcatcctccttgccgagggtcgtctggtcaaccttggctgtgccaccggccactcttccttcgtcatgtcctgctccttctccaaccaggttcttgcccagattgctctgttcaaggccgaggacgaggcctttggcaagaagtacgtcgagttcggcaccaccggcaagaagcccgttggcgtctacgttcttcccaagatcctggacgagcaggttgctctgctccacctggagcacgtcaatgccaagctgtccaagctcactcccgttcaggccgagtaccttggtctggatattgccggtcctttcaagagcgatatgtaa

SEQ ID NO: 3273 - DNA, 210 bp, A.fumigatus
acgccaacgggcttcttgccggtggtgccgaactcgacgtacttcttgccaaaggcctcgtcctcggccttgaacagagcaatctgggcaagaacctggttggagaaggagcaggacatgacgaaggaagagtggccggtggcacagccaaggttgaccagacgaccctcggcaaggaggatgatgtggcggccgttgggcatcaggtag

SEQ ID NO: 3274 - DNA, 1170 bp, A.fumigatus
  unsure (439),(1101): Identity of nucleotide sequences at the above locations are unknown.
cttggatcaggcacggaaaaagataaggcacacttacatatcgctcttgaaaggaccggcaatatccagaccaaggtactcggcctgaacgggagtgagcttggacagcttggcattgacgtgctccaggtggagcagagcaacctgctcgtccaggatcttgggaagaacgtagacgccaacgggcttcttgccggtggtgccgaactcgacgtacttcttgccaaaggcctcgtcctcggccttgaacagagcaatctgggcaagaacctggttggagaaggagcaggacatgacgaaggaagagtggccggtggcacagccaaggttgaccagacgaccctcggcaaggaggatgatgtggcggccgttgggcatcaggtagcggtcaacctggggcttaatgttctggacggacttggcgttggccttgagccangcaacgtcaatctcaatgtcgaagtgaccaatgtctgtgttgatcagtataaagccaccgaaactcgcggaaaccagtcacttactgcaaacaatggcgtcgttacgcataacctcaaagtgcttgccaacaagaatgtcacggcaaccggtggtggtgacgaagatctgaccctggggagcagcctcctccatggtgacgacctggtatccctgaacagcggcctgaagggcgttgatggggtcaatctcggtgacgaggacacgggcacccatgctgcggagagcatcggcacagcccttgccgacatcaccgtaaccagcaacaacggcgaccttgccggcaatcatgacgtcggtggcacgcttgataccatcgatgagagactcacggcaaccgtacaggttgtcgaacttggacttggtgacggagtcgttgacgttgatcgcgggaacaaggagcttgccctccttgagcattctgtagaggtggtgaacaccagtggtggtctcctcggagacaccgtagcagcccttgagcatctcagggtacttgctgtggacgagggcggtcagatcaccaccatcgtcgaggatgaggttgagcttctggccatccttgaaagcgttgagctgctgctccaagcaccactggtactcctnctcggtctcacccttccaggcaaagctattgtaacgttagagcttgcctcgtttcaaaatagcaagtga

SEQ ID NO: 3275 - DNA, 1512 bp, A.fumigatus
attggcgcggcccttccgccccgggtgaagaccgagcagcgcacagtggaaactgagtactatgatttcctggttgttgcttcggggtacttctctcgtccgtatacgccggacatccctggacttgctgccctcgccgagaggactatccacagctccgcgcttcgcagccttgaagatttggatgcgattgttgagaagggctctgatggaggaagattgattgtcatagggggaagtatgtcgggcgtggaggcagcttcctctctcgcccttcacgtttcctcattgaggtatgcgccggggtcatccgtgcaaacggatagtttccccgaggtctaccacatatctagccggcctttctggacggtgccgacatatataccacacgcgcagaaggacaatgggactggcacagagacggtatctctgctcccgcttgatttacctatgtatgatttggcccggcggccaccagggccagttgagtatgcctttggccctgcctcggcagcgcaggtcgccaaagtgaacgattatttccaatcaattttaggagaagactatacgaacatcggccctggagatattgggtttaagggtggcgaagaggagacactgcaaccacggtgggtagctatagggaatgattacgcagagttcgtccggtcaaaagcaatcaaaactgtcatcggccgtgtttcagccgtgcatgcttcctcacctggtccggcaaaagttgacattgagctacctgggaaagagagcatgtcgctcgataatgttgcagggattgtcctggctacgggatttaggccgtttccttcgctcgcgtttctcccagaagatgttctctctgcattggagtattcccccgatgactccttcttcccgctgatcctagacccaaagggtgcttctaatgccaatatccctgatctgggttttgtcggcttctatagaggaccgtactggggcgtcatggaaatgcaggcccgaagtcttgcgcagacctgggctggagacgacacagagcatggcattcagttttccgcgacagagctggagagcaaggcacaagaaagacagaaagttcgtgaataccggagtgcggatccgaatcttcaccgaggacagttcccaatgggagactataccgggctgatggagtcattcgcacgggatctaggtatctgccgtgctcctttgacggagctcgatgaacgacctggccctgttgttccagcacgatatgtcatgtctggtccagggaccgccgatatcagaacgagtttgcaggctctgcaagagactctgcaacctagaagggaaagtgccagtccagcagtggccatggcggtctttcgagcgcttcacggcagctgggactttactcgatcaggacaagatggtatatcatccggcatttctacgttcttcccacggtatccgtccagccccgcttatgagaagtcttcaccacggggctggaaggtcgacacgtgtctatgg

SEQ ID NO: 3276 - DNA, 189 bp, A.fumigatus
tcagacctaggcattatcttctcgtggtttaaggagctggaggttaactatggccgcaagaggtatgcaaaccctaagaggattgaccatatctcggcattaattatcacgaagtgcgggtggtttccgggatctccgacccaactttcggatgaaaatgtggggaagtggagtcatttcacggggtaa

SEQ ID NO: 3277 - DNA, 1008 bp, A.fumigatus
ggatattcagcgcataactggccgaaaggcggaagagattcgttaacaagaaccagtgggcaggaggaacagccaagggctgggagaatgattcaggataagacgccttccattctggaggtggagctagtggaaaacatacccattgatgtttccacagagcctggcgctggtgacggtgagaacagcacagttttcaatgtttgggtggacatggatatcccaccggacgagtgggggaccagcccttacaagaatgggccaccgaagaagtctgtaggcaagaatgaagatgaccttccgctcaaaggaaccatggattacatcgagcacgagatcaaagacggatacctggagcctataatcaaagatgtgatcagatctcgatgtttggagaccaaaggctcccaaggccccgccgttgaccgagactcaagacctgagggaaaggcggaggatcctaacgtcatggtcatttcccttcattcatgtggcaaccttcttcatcatggtgtcagatctttggttctcaacccgtctgtcaaagctatcgcaatgatcggatgctgctataacttggtgactgagaggttgggcccggccacatacaaggttcccatactccgcactcaacatcctcgcttgacccaagatgcctgtgcgtatgaccctcatgggttccccatgtcgaaacgtctggaatcgtatgaacatattagtgggactggcgtgaaactgaatatcaccgcacgttcgatgtctctacaagcaccctacaactggggcagagaagatagcgaagcgttctttacgcggcacttctaccgagcccttctccagcgcatttttgtcgaccgtggcgtggtagagaaacccgttaaccccacggatctctatggattggaaactggtgcccctgatgcggtaggaaatcctttgattgtcggttcggtacgaaaggccggctttacgtcggttttctgcatacgttcatgccgcagtggctaa

SEQ ID NO: 3278 - DNA, 240 bp, A.fumigatus
caagtgccattttatatgcgatacatgaggtggccattggcttacaatggccacttacttagtgattacgttaatgttaagtgctgcctgcgaacgacaaggtacctaaatatcaaacgacaggataagttcggatacttaaaatcttacaaggcagtacctaggcgatctcgcctcaatctgtttcagttgagcatgtttcccagtttctcattcaacttgctagtgatgttggcataa

SEQ ID NO: 3279 - DNA, 330 bp, A.fumigatus
ggtcactttccttcaacaaccccctcctcttatcatgtgtgtgacgagatgtacctgtttaacaaaaatcagaggcggctcctagtctatttcgcggttttctatgtccttctctttatcttttgccatttcaactccgcgcgcgaccctggttcatactttttccgaccagaggaaggctatcggccgcaatacagcgtcaggagaattctggagtcgcggcacttcatatcacggttcaaccagtcaaccccccaaccgaaacagtcccttcaaaatctcacttcgggagtttcaccaaggggcccgaaggatccgcgaagcgttacg

SEQ ID NO: 3280 - DNA, 621 bp, A.fumigatus
gttcaatgggttcgcaggaagccaattgcgtgggaatgcaattcgacaaatgttttcccggtgcccatttacgttcttgggtttcgtttttcggcccacagccaaacaggggtctgcagcccggatgacttcgtcggccgcgtgttcgccagctgtatggcgatgggccgttacccgctccttccaaatcagcggaaggagttcgtacctgtggattacattgtgcatgccttgttacacatatccaagtcgaaagacaacctaggacatgcttacaatctggtgcatccggacaaaacgcatgcaattgatctgtgtacaagcttcaacctgttgaaaaccatatgtccatacccaatgcatggggttacgtacacagagtgggtgcaatctctctcactcagcccagaggaccctctctaccccctcgttccgatgctgaaggagagagttctgggtgagcggacgcgatgggaggtgtacgagaatatggtggagtatggccgcgaaaatctgcataaggcaatcaaggatgctccggatatcttggcctgtggtcctatggatcagctttttagccgatacctgcgttcctggctaccgacatcctgtgcaaactag

SEQ ID NO: 3281 - DNA, 423 bp, A.fumigatus
acctttgccacggaggaatttgttattcgcctttttggaacttggcggaaatgcggggaagcgggaccctttttaaaggtttcattcagggatgtttcagttgattgtcgagtttcttggctcaaacggttttcaactggattctttcgccgcgtatcatcacccctaccatttgcaggggacaaagaatatttccacctgccttattttggaggtgatgcgtggttagcacagcacgcacagtatcagaatcaaatggttctttccacggatatggaacgtgttttcgatattggccctgctttccgggctgaggtgaagtctcgtacgtcagggaggcatctgaccgaggtgagtaattcttcctccccaatttggctgtgttttgcatcattgcatgcctgttatgagactcgttgctga

SEQ ID NO: 3282 - DNA, 765 bp, A.fumigatus
tttactttgctaggtacggctatggtcctggaggaaaactactatgaagtgatggatttgatggactcaatgattgtctttgtcctcaagggccttcaagaacgcaaaaaatatcgggatcttatcgaaattgttcagaatcactatcccactgcacaggactttcgtatcggtctggatgaacagggaaagattcctcggatctcatttaaggaggcaaagcgaatgcttcgggatgagctcggcttcaagacagaggacacagatgacttaaggtgcgcggtgacgttaaccctacttttgtgtttctttttccatcttccagggctaacaggtcatcaaccccgtagtgaagaggaggaagcggccctgggccggcatttccgcgaatctccttacctcggtcaaactgacatctttacaattgatcaatacccggcattttgccgcccttttaatacacatccaagtccggatgctccaggattcactaactcatgggataccattgtgcgaggtcgtgagatctgctcaggcagtcagcgcattcacaaatacgaggcggtctgcaaggctatggcttcccggaatatggacccagatggcaaggagtgggagcattatgtcggggcgtttaagtctggtatgccacctcatggtggtctgggtttgggtgtcaatcggctgctgcagggtttccttgggctggacgacgtccgtgagactaccttgttcccaagagatgtacatagaaccgccccataa

SEQ ID NO: 3283 - DNA, 342 bp, A.fumigatus
agtagtaacagacgacgaccccatcaatcggttgctgccatcgatcgacttcatcgaaatagatcattgcgttggcaatcagccgtggaacggtgtcgatccaattgtcaagtagtatgtataggtatcagcgctgtctcaagggtgaaggttgctaaccatcgtcatttcagttacgaagactgcctcaacttccatcggtactggactgtagatgacttaaacatgtgtggcgaatattccgccatgcggtcgatcgtcgtcgcctcccctaacgaagtgattaagatgcccatgaatgagccagctcagggtaaaaagaagtcacagatcgaggagtag

SEQ ID NO: 3284 - DNA, 555 bp, A.fumigatus
tacgtgacccggatgggattcaagcaaatcgcttatcgcggtcctgaaacgggttctagaagcgtcgtatcgcatgtcatctccaacggtcaagctatcttcgttctcacttctcccatccgttccatggcagggacaggcgcatatgatgatgatcctgatgttactaaggcagatcggagattgttggaggaaattcacaaccatctgatcaagcacggcgacggtgtcaaggatgttgcttttcgaattgaaggcgatatcgaagctgtttggaaaagagcagtagaccatggagctgctccagttgcggccccgacaaccttgaaggatgaccggcatggttcaatcaccctggccacgatcggtacctacgaggatacagtgcactcactgatcaatcgtcacgactactccggcccctttctaccaggctatgaagtagtaacagacgacgaccccatcaatcggttgctgccatcgatcgacttcatcgaaatagatcattgcgttggcaatcagccgtggaacggtgtcgatccaattgtcaagtag

SEQ ID NO: 3285 - DNA, 264 bp, A.fumigatus
aatatttgcacccttgacagctccatagtacgttcgtcgcgagtgcaacgcagtcgttcaatatggtacaccatagcccatttgcaaggggccaaaagcattgtcacccgcataattagtcgcctcgagcctatcctagccgattttgtcgcgccaccaagcggtatgctgatcaaagtcttgtctctggaccctcaaccaaagcaaaaagagcaggctatgcaactagtggagaaagtcgaaactcgaaacggttctgcctga

SEQ ID NO: 3286 - DNA, 255 bp, A.fumigatus
tggagaaagtcgaaactcgaaacggttctgcctgattcttgggggccgaaaactctttcacgtgcgacggggaacagttttcttgcccctcttgcagacaagcaaacatcagtttggaaccgtctcaattacgcatcctctgccatgaattctaagacggaccaaaaatctgccaacggctggcagcaattttctttggatcatgatgaccaagtagcagaccgtttctcagaagattggtccttggcactgtag

SEQ ID NO: 3287 - DNA, 198 bp, A.fumigatus
gtatatcgacttttcatcgttaaattctttatctctgctaaagagcctacggtcgtcgtcaacatgtctgtcctcctcagaaagctcgtccacaatgaggcgatacgggaggatcccaaggaaatctatgggtggagagtgtatatgcttgcctgctcggtcagttgtcccacaatatccctcgtgctcagagactga

SEQ ID NO: 3288 - DNA, 243 bp, A.fumigatus
aatgaagctgttcggatggacccccgcaaagatctgcaccccactgtccaacaccccaagaaaccccaagatgagcccgaactaggagattcagtcaaccccacaaggcttcaggaagttactcccgctcagggactgacacctaccggacctcagctaccccagaaactatccgtaccccacagcatggtccccaaagaagccggaactaaaggaacttcaaccccacaagtctttgcatga

SEQ ID NO: 3289 - DNA, 546 bp, A.fumigatus
ctttcttcaggaaaatgcggggtgtttggagatatatgcctgtctcttgttgatgctacatttcctgggcatttgctccatacgaatgcagactataaatgcatgctcattcctctgttgacctttacgaagatatcgattatttctaaacctcaagaatcaaggatttccctcatcatctgcagaacaatgccaaccgttgccacgttcctagggctggccatctccggggcagcgatggcatcatgcgcagcgctgggtgcatacaacgttgacccaaactcaatttccgtctctgggctctccagcggaggcttcatgtcagcacagcttggagttgcatactcggacacattcaaggtcgggtttggggtctttgccgggggaccgtatgattgcgcacgcggtcaatcggtacgtcatggtccaaatcccagaaacagtcattttcaatttcaataccccagatatgctgacgccaaaagcagtacactacttgcatgtacaaccaaaacccatccatcacgacccccgtcgccaacatga

SEQ ID NO: 3290 - DNA, 294 bp, A.fumigatus
aatgatatagatggtgtatcagggttcaagaccggtcctactagtacaagcgcatcgcctcatctaaagtctgccagtatccagtactatgcatatctatctgagacctgcaagacgtcggccctgcacttcaccaagagcgcggcttccgctaatgaatgcgacaacaccggccgcagcgacagctggaagaatctggaagagtgtccaatgggagtagtagaggaagaaagatccattcgatggaaaccagagatcccaggaaaacagcgtggggaatcggggcagacttaa

SEQ ID NO: 3291 - DNA, 324 bp, A.fumigatus
actcaaaaagacctccccgttcaattcctctccgttgccgaacccttggacgccagacttgtcattggatcgtttggaagctctcatgcgtacaatgaacctgccttcccgttgattgtggcccgcaatcccgacgaaccagtaccgacagtggaggtttcgcgatatggcaaactgcccgagattcaccatatcttcaagtctgaccctcagagccctcccgttattgtgactctcgttttcattggaatggtgctagctgcttttccagtcctcggtggcctggtgagtcgtttcctccaaacaacgctgtccatgttctga

SEQ ID NO: 3292 - DNA, 186 bp, A.fumigatus
tggctcttcattggcgtcaacctcaaccatttgccgaccgcctttaagtctgccccgattccccacgctgttttcctgggatctctggtttccatcgaatggatctttcttcctctactactcccattggacactcttccagattcttccagctgtcgctgcggccggtgttgtcgcattcattag

SEQ ID NO: 3293 - DNA, 1494 bp, A.fumigatus
aaaattttgttaacgcccgttccattggttatacctcggtttgttcccagttgggaggattacacccgtgttttggaattggccaaacattttgagcagttgagttgcgaatttgaggaggagcgccagagagaaagacagcaacgagctgcgaagggcacccattctcgggcgtacccattagcatcatcaaagccgattgtggaagtctacaagaatgttagagacgcagtggaggagcgagagctttctggcgaaggagaggacttcatgccttcgacgacaccacgccttccgctcaatgagtcgagcatagagagcggtgaatcgctggagagaacttcggaagaagaacctaggggtgaacccgtcttgcagcgttccagcactcatccgtccacgactgaagataaagcacaaggcgatcgcccaactggatcagagggtgaggaggagatgcatagcgatgaagatcgagccttagccgaggacctccacacgactgactcgaacgatgaactggctaagctgtctccggaggacgaacagctcgatctcaaggagctcccgaaacatgagcgaagcaacctcctgaaaatgctaacgaatttctggtcagagcgctctgcgagcggttgggcatccctcgattatccccttagcatgtccgatcatgtgttcgcagattgcgatatcattgtgcgagaagacgagcctagctcccttgttgcgttcgcgcttgcctcgagcgattataaagaaaagctagccaatatccagaaacgatatgagcaacttgacgaaaaaaagtcgatctcgaaagagggctcggacgccatgaacgaggcacaggttgaacatgcactgctgaggtctactggcactcatctcaagtaccaatttcaggaagggcaggctaagatgttatgcaagatattctatgcggagcagtttgacgccctgcggaaaaagtgtggcgtggcagagcgaattgtggaatcactgtctcgttgcgctaaatgggattccaaagggggcaagacaaactctctgtttctgaagacactggatgatcggttcattctgaaatcgctttcgcctatcgagacacaggcgtttctcaaatttgctccggcgtatttccagatcatgtctgaggcgctgttccacgagctgccttctgccattgcgaagatgtttgggttttaccaggttattatcaagaatcccgccacgggaacagagttcaactggtttttgctcttgatggaaaatctcttctacgatcgagtgccgacacggatcttcgatctcaagggctcgatgagaaatcgtaaagtccagagcacgggggagcgcaatgaagtgcttttggatgagaacatggtggacttcatctatgagacaccactgtttgccatggaacactcaaagaaactgctgagccaaagcgtttggaatgataccctcttcttgggtcgccaaaatgttatg

SEQ ID NO: 3294 - DNA, 186 bp, A.fumigatus
  unsure (149),(157),(158): Identity of nucleotide sequences at the above locations are unknown.
tctgcagcttgcacagggacttatgggcaacgtaccccacctatgtgccattgctgccaggaccttttctggtctgattcctacactgcagttatctccatctacaggcctactttcaccatcgtcgctgagtccagaagtcttcaccncgaggcgnntatacacacagtcattaaaacccccgcg

SEQ ID NO: 3295 - DNA, 204 bp, A.fumigatus
gttcgctatacgcttagcgcggttccttcgacccccgtggtgaagatcctccccgcaggagatataaaaccatctatctttgttaacctgaagaaacatatgatgcactttgccataggtgacaatgctgagagccaccaggcattaattctaactagggagaaagctagaggctggggaaaaggggtgggcaggcagtattga

SEQ ID NO: 3296 - DNA, 207 bp, A.fumigatus
cgacccgatcggtcttatggggttactaggttgcccatgctttcgagacctgaggatcattattactgtgcatcttttctgcctgcaggtggtccccttaaacaatacagctatgttattataccttcatcagtatacaagccatctcttagtttcagaggcaaggtgtacctctgttataagtcttgtaagtcattcttctggtga

SEQ ID NO: 3297 - DNA, 243 bp, A.fumigatus
ctaaagacccctacaccaccaggcagtcaatcaactaattcagtgcctaaaacaccctatactactaggcagttagagaagcaagcatctgcagtgaaaaaactgcttaaggaacatactcaaagcccttttcctttactagaagcacaattagacaagattattaaaggttataaaatgacacttaatgagcttattcttatgcgggatgaaatacgcaaacatcgcgctaataatgaatag

SEQ ID NO: 3298 - DNA, 225 bp, A.fumigatus
  unsure (87),(129): Identity of nucleotide sequences at the above locations are unknown.
ggttcttcctttggttggaagcgttttgttgcggccggagcatccggggttattcagagcgggaacaaaggcgccattgtttggagntacttcccacacttttggcagggcagggtatattttggacgntggatagctctccccgagatcaatgctgacgtgagcatcaagcccttccagccgtatggacgaagcaacatactttgttccccccgaggacgataa

SEQ ID NO: 3299 - DNA, 549 bp, A.fumigatus
ttttcagtatgtctgtattccacggtgcattcgtcgctttcgtatccgttgaccatccacgtccgtcacttcttctgcgcatatgatcaggactacgttcgcgtagtctcgcggcgtctcactaacttcgtcctctcgacgctccccaaccccactggtccatcacagctcatcatcatcggctgtggtgactcccaacgcatcgtcccttatgtatcggagactgcagccgcgttccccatctacacggaccgcatggggaagatctacaagaagctgctcatgaagaggacgacgtcacacatcactcaaccgccctcttatgcgcaggtctctttcttcggtgcgcttgggaagacattcggacagatgtttcggagtgggtggcaggcttttcgaggggggagctggagccagaacggcggcgagtgggtgtttcgagggggcaagagtttctatgtccatcggatggagcatgtctcggatcatttgaccgcggaccgattgcttgaagtgctcagccttgatgagccggctcaaacgaagtag

SEQ ID NO: 3300 - DNA, 531 bp, A.fumigatus
gataccgatggtgggcaatggatggggagggttccaggctgccccgacggcgccgtggagctccaacatcgacacgccgagtatcgcgagttgtacgtgcggtggctccagtgggcgacgttgctgccttttatgcgaacacttggatcgaggaagtgcaatgtgcagaatgcgcacacatgtaacaacgagtggtggtcgtatggcgaggagaacacgcccatgattgtctcgtacatccagctgcggtaccagctcaaggtgtatctgcaggctctcttcgagcaaatccaccatacttacgacgccgctgtgtatggatttcgaacggacagatccgcagatcgcgaagatgacgcgggagaatgtcaatgctaccacgcagcagtacatgtttggcttgcggctgcttgtcatccggtgacgatacccaatgcaccgagtgggaggtgtatctgccgcagaagggccagagtgagacaaagccgtggacgtacaggtggacaaacgagacatatgctggtggactga

SEQ ID NO: 3301 - DNA, 258 bp, A.fumigatus
ttggtggctttctctctagtcgttccctccggcaatgatgaccgttccttcaactggtatgcgagtggagacactcaccaagctcgtggtaccattcaggacacgatacagccagataatacctggcagcagtctgccccgaacgaatggcatgaccacagcgtttctcttgggtcaatggagaccgcaagctacgggacaagtgaacgagggttatactggctatgggatatgtcatggaatggaaccgagtcatag

SEQ ID NO: 3302 - DNA, 480 bp, A.fumigatus
agcagactcggctctgcgctgaaatacggggccacgcatacataccagatgacacccgactcctcggagcagaatgcagaagagattttaaataaggtggaactggagacaggtgccgatgttgtgctggatgccaccggtgcggagccttgcctgaactgcggtatccatatcctcgcttctggtggaacgttcgtccaggtgggcttggggaagccaaatccttcgcttccggtctgtcagatctgcgacaaggagatcgtcttcaaagggagttttcgctatggccctggggattaccagaccgcaatcgagctgctccactctcgtcggattagactagatggcctggtcacccacgaatttccgttcactcaggcagaagacgcgtttcagaatgtcgtcagccgagcagggatcaagagtgtcatctacgggcctggtgtagacgagcatgtagcgaaacccacattgacatag

SEQ ID NO: 3303 - DNA, 678 bp, A.fumigatus
acggctatgattgtagcttacttctttctagataaacgcctccatgttaagatctatgacgccgatgaggaggtttaccaagtccccgagtcggttctccctcgcgtggatggcaaaggtggatcgagcaagaagtcggcgctcaagttcgactatcaggcgaatccgttctctttcaaggtcaagagaggcggcgaggtgctcttcgacacctccggttcgaatctgatcttccagtcgcagtacctgagcctccgcacctggttgcccgaagatcctaatctctacggtcttggcgagcacacggattctcttcgtctggagaccaccaactacacgcgtactctgtggaaccgtgacgcgtatgctattcctgagaagaccaacctgtacggcactcatcccgtgtactatgaccaccgtggccaacacggcacccacggtgtcttcttgctgaactccaacggcatggacattaagatcgacaagaccaaggatggcaagcagtacttagagtacaacactctgggaggtgtctttgacttttacttctttaccggtgccacccccaaggatgccagcatcgagtatgcgaaagtcgtcggtcttcccgctatgcagtcctactggacgttcggtgtacgtttccctgattcgatctgcggtccttccggctaa

SEQ ID NO: 3304 - DNA, 483 bp, A.fumigatus
ccctatacaggtgccgtctggcctggtgtgactgcgtatcctgactggttccaccctgacatccaaaagtactggaacgaccagtttgccaaattcttcgaccccaagaccggcgtcgacatcgacggtctgtggatcgatatgaacgaggccgccaacttctgcccttacccttgcagtgatcccgagggctacgctagggataacgacctgcctcccgccgctccccccgttcggcccagcaacccgcgcccgttgcccggattccctggtgatttccagccctcatcctcgtcgaagcgctccaccaagggatctaaagttggactgcctaatcgtgacctgatcaaccctccgtacatgatccgtaatgaagctggctcgctcagcaacaagaccatcaacaccgatatcattcatgctggtgagggatatgccgagtatcttcaccacgggggtcgaaggaaccgcgctaagcgcgca

SEQ ID NO: 3305 - DNA, 216 bp, A.fumigatus
  unsure (12): Identity of nucleotide sequences at the above locations are unknown.
attgggcacccngaggtcggattcttccggccccgtggtgaagacccaatatgtagagagggtcgcgattccttaacggcggatttgaccttggccggtaaaccgtgcaacacttacggcaccgacttgaagaatctgaaactccttgttgagtaccagaccggtacgttttcagcgttaaacggctatgattgtagcttacttctttctagataa

SEQ ID NO: 3306 - DNA, 288 bp, A.fumigatus
ttccaccaatgcagatacggctatcgtgatgtctttgaggtcgccgaggttgtctacaactacagccaggcgaagattccactggagaccatgtggaccgacattgactacatggacagacgtcgggtgttcactcttgacccggagcgattcccgctcgagaagatgcgtgagttggtgtcatatcttcacaaccacaaccaacactacatcgtcatggttgacccggccgtcagcgtgagcggtaagtttacctttccaagtatggagggggtgggtgcatattga

SEQ ID NO: 3307 - DNA, 816 bp, A.fumigatus
accgctccgacaccagctacacgacacttacccaacatgatccgtgtgctcatcaccggctccgctgacggcctgggtctcgaggccgcacgccaactggcgaaccgtggccacaccgtctacctgcacgcgcgcaacgagaagcgcgctgctgatgcgaaagccgcctgtcccggcgctgcgggagtgctcattgccgatttatcgaatctggctgaaacccgccggcttgccgatgaagccaacgcgatcggccaatttgatgctgtcattctcaacgccggcatgctgtacgggccgttccgcaagactcccgacaccggtatccccgccatggtgtttgtcaacgtggtggcaccatatatcctgacctgcttgttgcgtcgtcctaagcggctggtattcatctcttcgcagttgcaccgccagggtgacgctagtgtggaggatattttctggttcaagcgcggcgaaggaagattccaggacttcccggcatactgtgactcgaaattgcatgtccttctgcttgcaaatgccgtggccagaaggtataaagatacctccgtggtcagtgtacacccaggctggatagccaccaagctcgggggcgaaggggcacctgataaactggaagatggggtagatacctacgtgatgttggcagagggggattacgaccgaaacctgaccggaaagtattttgagccaaagagagtacttggacgtccgttgccagcttcggaggacatcaacctgcaggagaaagtggtcaaggcttgtgaagaggtgactggtctgaaactttccgcgtga

SEQ ID NO: 3308 - DNA, 957 bp, A.fumigatus
tacgcgttcccttccgtccccggcggtgtaagacatgagggcatcctagtcgccctcatcacccccttcacagacgaccagaaacatatcgatgcggcctgtctcaaagcacacatcgaccgcctcatcgcagccggcatccacgggctcgtccccggcggcagcactggcgagttcacgaccatgacgaccgccgagcgcaaggagctcaccgagctatgcatcaagttcgccgccggccgcgtcccagtcgtcgtcggcacaggaagtacctccacggctgaggccctcgagctagcgacgcacgcagcctccgtcggtgccgcagcgctgatggtcgtgccgccgttctacgaccccgtcagcctggagcagttgactgagctgatggcggagatccataccgcctcgggtctacctattatgtactataatattcctagcgcttcgggtctgaagctcactcccggcgagatagcgggattgtcgaaagttggcgtcaagtatctaaaggatacgtcgggggatgccccggccttcactgagttggtcttcgggctttcggataagattaccgctttcaatggctacgacaccctgaccttctacggacttgcggctggttgtcccggcggggtatggggagcggccaatttcattcccgagctggcggtcgagctgtacgagacggtctcggtgaagaaggacctgaagcgagggcgtgagttgtggaccaagatctggcccatctgcaagtttttggaatcgcataactatgcagccgcggtcaaggctggagtggagctgactggacaagaaacggggggtctcagaaaccctttcaagtcccttggtcctgaattgcaggcagagctgaagcagttgctgattgatgcgggtgtaagcacggtacgaatggctagtcttcacccggggtggaagttcgacggtgtctga

SEQ ID NO: 3309 - DNA, 558 bp, A.fumigatus
caatctaccgctttttcagtcaaccagcatctagtgagctatcttgcgctgtattccgatgtccgaaatccgtaccgtgatttgaccttcttggttggcgattctcctgtcctcgctcatgctcttgctgcgacaggggctctgcatcacgcaatcttgagaaatctggagttctcattgccctggtccccatacacggcgggagatggcggcacggcgctttctccggaagaggtggagcgagctgtgataagttccatggccaggcggccttcttccaaggactatgaacactttcttggcttcaagcaacgcgctcttcgtcagctttcgcttgacatctgtgatccaatcatgcggaacgataaccggacattggcagcaattatggttctcgctctcatggacgctatcgagtcaggagacggtgcgtggaagtatcatttggaaggagcgaagaaattgcttaagagccggcaacaatcagagtctccgactcaggcgcagggcatgatgaactggctggacacctttgccattgatggctgtctcctgtaa

SEQ ID NO: 3310 - DNA, 348 bp, A.fumigatus
tcaataatttccagaattcaattaatgggatccacccttgcgcgccccggctctctcacacagcctttctattcctccaccatgggcccagcggttttaaagcgtctggaagagacctcctgggtcggttgcccagcctatctgctcgaagtcatcttcttcgtcgaggctggacatttcatggctcctggcaaggatcctttctcgcaacacacaacgtcattttcctcggtctttctgcccgatgactccaagccgctccaatctcccgaggccctcctcgggcacatacaagcctttgacccggttgcgtgggccgaatcaatgcagtcttgtctctatctcgag

SEQ ID NO: 3311 - DNA, 249 bp, A.fumigatus
  unsure (106): Identity of nucleotide sequences at the above locations are unknown.
aaaggaatctgcgatcttgagatctctcttttgcttgagagcaacttgacgatggctgcagtcttttcagacaacgataacaatctggatgggacgattggcgaanagggtccatcaaagtcagaagtcgtcgcagaaaccattcgcagaaatgagatggccttcttcggttcaacgggaagtccccagaaggcacagttctttccaattgctaagggcaactggtccaacgtctggagggccaacccc

SEQ ID NO: 3312 - DNA, 267 bp, A.fumigatus
aagatcaaatattttgatacagtccatatcgcatccagtctgttgattctaaagagtggtttcctttacgttgccagtgaagcaggaaaccatcacttctaccaattcgagaagctgggagacgacgacgaagagactgaattcaacagtgaaaactttcctgcggatctctctgttacctgtgagccggtgttcttccgaccgagaggagctgaaaacctcaaccttcgtagagacgctcaactctctcaaccctttgatcgatag

SEQ ID NO: 3313 - DNA, 1260 bp, A.fumigatus
agagtggtttcctttacgttgccagtgaagcaggaaaccatcacttctaccaattcgagaagctgggagacgacgacgaagagactgaattcaacagtgaaaactttcctgcggatctctctgttacctgtgagccggtgttcttccgaccgagaggagctgaaaacctcaaccttcgtagagacgctcaactctctcaaccctttgatcgatagtaagatcgtgaaccttaacgaggacgatgctcctcaaatctacactgtgtctgggagtggcgcccggagcagcttcaggaccctcaagcacggtctggaagtctccgagattgtggaatcggagctccctagtgtgccttctgccgtttggactaccaaattgactcgtgctgatgagtttgacgcttacattattctttctttcgcaaacggtactttggttctcagcatcggtgagaccgttgaagaggtaaccgacaccggctttctttccactgcacctactttggctgttcagcagctcggtgaggattcgctgattcaggttcacccgagaggcattcgtcatatccttgcagaccggcgtgtcaatgagtggcccgctcctcaacatcgttcgattgtcgctgctgcgacaaatgagcgtcaggtagcggttgccctcagctcaggtgaaatcgtgtacttcgaaatggatgccgatggaacgctcgctgaatacgatgagagacgtcagatgtctggtacagtaacatgcctcagtttaggcgaggtgcctgaagggcgtgtgagaagttctttcttggctgtcggatgtgacgactctactgttcgcattctgagcttggatcccgactcgaccttggagaataagtcagtccaggctcttacctcggctccatcagcgttgaacatcatgtcaatggccgattcaagctcaggaggtacgacgctgtacctgcacattgggctctactccggtgtctacctccgaactgttctcgacgaggtgactggtgaactttccgatactcgtacccggttcctgggagctaagccagtcaagctattccgtgtttccgtcaaaggacaaacggctgttctcgccctcagctcccgaccatggttgggctactccgacatccagacaaaaggtttcatgctcaccccgttggattacgtgggcttggaatggggctggaatttctccagtgagcagtgtgttgaaggcatggttggtatccaggcacagaatcttcggtag

SEQ ID NO: 3314 - DNA, 240 bp, A.fumigatus
acaaccttgaagcgcctggctatttatgtcggagtcaaggaacccgccatgtgcacgcactgcgtgatcatggattacatcatcacctcctgcggcacgtcaaccgccaacacatccaccccaccctcaatctgcgacttggatggcatgttgccccgccgcatcaactcggcgcacttggacataatgggatccatgcccatcgtcgcgaccgccaccacggtctcgcccttgcagtag

SEQ ID NO: 3315 - DNA, 1281 bp, A.fumigatus
cgagtcgggctctatagtggaagcggaacgctcgggctcattcaggccctccgtgaactgaagtataagggaggggtcaccattatctccaaagaaccaaatctcatcattgacaggacaaagttgtccaaggcactcattcccgatgccgagaagatccagtggcgccctaaggagtggtacgaggccgcttccatcgagaccatctttgatgaagtgacctccgtcgatttcagcagcaagtccgtctccacgaagtccggcaagtccatcccgtacaccaagttggttcttgctaccggtggcgtgccgcgtacactgcccatgaaaggcttcaatgaccttggaaacatcttcctgctgcgcttcgtgaccgatgtgcagaacatcctcaaggcggttggcgacaagaacaagaagattgtcattgtggggagctcgttcatcggtatggaagttggcaacgccctctccaaggagaacgaggtgaccatcgtcggccaagaagaagcccccatggagcgcatcatgggcgtcgaagtcggccgcatcttccagcgcaacctggagaagaacggcgtcaagttcaagatggccaccggcgtcgaaaaggcaaccccgtcaacggccgatcccaccaaagtcggcgccgtccacctcaaagacggcactgtgctgccggcggatctggtcatcctgggcgtaggcgtccgccccgccaccgatttcctgcgagacaacccagcagtccagctcgagaaggacggctccctcaagacggacgagtactttgccgtccccggcctgaacaatgacgtcttcgccatcggcgacatcgccacgtacccatatcgcggacccggcgcagacccggtcaacggcaccgccacccgcatcgagcactggaacgtcgcacagaatgcaggccgcggcgtcggccgcgcgattgtccacgccctcaacaccggctcgctgcagtccctgcgccccaaggcgttcatccccatcttctggtccgccttgggtgcgcagctgcgctactgcgggaatgcccccactggctgggatgcactggtactcaagggcgagccggacaatgccaagttcgccgcgtactactgcaagggcgagaccgtggtggcggtcgcgacgatgggcatggatcccattatgtccaagtgcgccgagttgatgcggcggggcaacatgccatccaagtcgcagattgagggtggggtggatgtgttggcggttgacgtgccgcaggaggtgatgatgtaa

SEQ ID NO: 3316 - DNA, 414 bp, A.fumigatus
tattgtggctcagaagtaagtactggcgatccctgccagcaatctcatgcatcttggatgttgataaatgccctttgcagcgtcgcaaccggctacggacagcccccaggtaccatttatgattgggcgcttgaaccaccatctctccgagacgccgattacaatccttcggatgacttgcgaatccggttgcggattgaaaagttctgtgaccgcgtgacaaaggcactatatagcggaaagcctgacccagccgaattcatcagttcggagaaattgttaatcgtccagcttctggagagtgaactccgggagatggaagtcgactttggtcgcgacatatctagtatgaacatctggactgctgttgttgttgagccgctactaaattgtcatcttcagatatcaatatga

SEQ ID NO: 3317 - DNA, 564 bp, A.fumigatus
gccgctactaaattgtcatcttcagatatcaatatgatccatctgcgagccgcggagttgcacctgagatactttgtattccttggttctaatccacgaggtgaagatttgacaaagcttttcatcgccacgacgtcattcctcggacgagttttggacttggagacatctcctggagaactgattggccacgccaccaattatatccttcagatgatagtctctgcagcctttgcccttatgaagctcttgaagagtgatttcagccgtcatatcgacttcgatcacggcaaattactgttcaatggagccatttcggccatccgacggataagtgttatggatcatgatcgccctgttcgcctcgccgatattttggctcagatgtggaatgcaaacgaggcagcacactctccgggcgataatgtcttggagctgaaagttcgctgcagaatgagcatgagtcatgtctatgacacggtctggcgctggcggcagagattcaggcctatgcgcagcatcgaggactcacatattcgaccagccggctggaagatcaacgct

SEQ ID NO: 3318 - DNA, 810 bp, A.fumigatus
gtcgtggttcatgagagtcagtcagagaacatgaatttccaggcaaagaatttctcctatatgaccaaggcttttggtgacttcttggacgaggtccatgcaggtggtcgccagtatctccgaagcatttccgctgaactaccatccaagcttcctgccaaccttgccgcggattttcctggtctaaaggatgactttaaactcccccaggcactctcattggtgacagaaaatgcccacagctctccgttaagaatttcggggccggttactatgtggcttcattacgatgtaagttcaaataccaagcaagaggggtggaagctcagagtggctgatcgctatgcacaggtgatggcgaatgtcttatgccaaatccgagggaagaggagactggtactcttccctcccgctgacgtgcaatacttgcaagtgccaccaggagcctctagctctaccatcgatatcttccagaatatcaaagacggctctatcgtctcaattccacacacgtcgccgcaagaagctgtgctgcacagtggcgatattctatttatcccgccgatgtggctgcatactgcttctccaactggcggggtcagtgtcgcagtcaatgtattcttccgcagcctgcccaaaggatacgctgctggtcgagacgtctacggcaaccgtgacttgcaggcctatgagaaagccagaattgacattcagaagatggtgaggtcttttgacggtctaccatctgacatatctcgcttctatctgctgaggctcgcgcaagaactgaaagacaacgctggagtatga

SEQ ID NO: 3319 - DNA, 297 bp, A.fumigatus
  unsure (7),(70),(272): Identity of nucleotide sequences at the above locations are unknown.
gaagcanactgcgccacctcccagtatcaaaacctggtctgggtctatcgcacaggccacatggccgacnaagcacggtctagcacctttgcatatgccaccgagtcctatcgcagacagaaatctgtggccccaggacgactcggtttcgacgtaatcgaggagctctcctacattcaagcacaatatttcacattcgtatgggaccatctgtccaggaatgattccaacaactatgaccaggcccccagaaagtcgtgtgactggggatncaaaatcgtagaagtaccgacctaa

SEQ ID NO: 3320 - DNA, 543 bp, A.fumigatus
acgcttgcgcggtgcttccggccccgtggtgaagacaaccaggtcaaaagctacgccaactctcaggtctccctgactaagaagcttgtcagccagatcagcagtatccccaccaccgtgcagtggagctatgataataccaacacccgcgccgacgtcgcgtacgatctgttcacagctgcggatcccaaccatgtcacctacagcggggattatgaactgatgatctggtatgagattgcgttattcatgtcggactggatggctttcgctgattggcataggctcgcccgctacgggaacgtccaacccatcggctcgcagatcgccagtgtcaacattggcggccataactgggagctgtggtacggcggcagcacccagaagacgtacagctttgtctcggccaccccgatcacctccttcagtggcaatgtcatggacttctggaactatctgaccagaaatcatggataccctgcttcgagccagtacctgatcagtacgtccgccacctcaccttgctcgagcgccactgactag

SEQ ID NO: 3321 - DNA, 1320 bp, A.fumigatus
  unsure (593): Identity of nucleotide sequences at the above locations are unknown.
aagaccctccttgtagaggctcccaatgggcatgggagcctctacaaggaggttcgattttcgccaacggcaacccccatccgccgtgcacagtcgggctcgaccagtaaccccgcctcgacattcgatcacaggcgggtgcttggcaaagctgaaagcgatcggttctcttactcggctttaagtaccgattatctggagcaggcccgaacgcttctccatcgccaaagggcgagctttgagaatgagcgggcacttttcgcagaggaacggcaattgtgggagaaggagagggagctactaaaactaagaatatcagaattagaggccttgttgaagagcaaagataccctgaacaataaccattcgactcctgacacccttgtcaagttctctttgcatcccttcggtggtccattgtcccctaatctatctaatgagcgccaccgcaatcacgattatataagtgctcaggtgtgggaggggcctagccctacggctcggccgacaagggtttttcacagtgtggagaagaccgatggtcaggaccacctcgcgtcgatcaccgagcaaggagcgcatatgccactcantgcgtcgtccttagatgcggcctatccccccaagcttcgtgcagccgaactctcttcgtgtatgagtataccgttcccaatcgagaagcttgacagcaagctagatggcattactctcaaatcttcagcgctaccgcccgatgtcgtcgcccgcgtgatgacaccaccatccctttcgccaatggatgtatctccagagtctcccgaccgctcgaaattgtcttcggaacgtaagaacagcttgaagctgaaactgtccgagcttgggccacccgacgtaaatttggttagggatgctgggcacactcccatggtgctcatcgatgccgatgcggacacagagcaggcctcagttaacggtgacgcgatcccccaagtccagggcaaggaagacgagccctttgctcctagggcggcgatggttggacagcctgcggaaaactccgactcctactttccggacttacctgatgatccggccctcaaggggccgttatccctgctgaatgaagaggagcatgacagcgagttcctacaggagctggatttgaaactcctcgatcaggccaggcgagccattggtcgctcctctgatgccgatccggacgacgagaagatagcagatgcagaccctaccgagtccgttcctgagttgaaattcaagaacacgaccaatttcggcactgcgttcggaggtcttaaccacgcggctggacggaaagacgtc

SEQ ID NO: 3322 - DNA, 375 bp, A.fumigatus
atcgctagtaatttgtacggccaattaaaagtcaacgcagctccgattctgctgctttattctctgtttatgaggcttatccgcctcctattgtctgtcgaactggaagagagccgttttcataccctcatgatgcccaccactaagtcaatattgggtttatctctcgccgtcgcaagtaaagcctatgcggcaactaccctgttcaacggccttcagtctgccatcttcccgaccacgacctcagcggaatgtcttgcaagctttaacacctcccttcaatgcgatcctctggtttcccgtctgtacatgcaaacagattgggtagggtggaatgcaacaaacctgacagcgtttgtctcaccagataattga

SEQ ID NO: 3323 - DNA, 705 bp, A.fumigatus
aaagaacaaaagaaagagtattcactaacaaaactctgttgtcgtgaattagggctcctagcaacccaaccaatcctcgctcttttaaccttataccagtccttcgtctacggtgtgatgttcctcttctaccaaatgtacccggtcgccttcggggacgaccgcaactggactacaagcctaaaatatctgccacttttagcgattatcacaggcaccttcgtaggagcacttggcatcgttctccacaaccatctctacttccgccatcactgccacaacccagatggtacgtatatccccgaatcccgtctcccgcccatgatcgttggatgcgtaatggtcccggcaggaatgttctggttcgcctggacagcgtcgccagacaacgtttcatgggcgagccctatctgtgcgagtttcatgaccgggtgtggaatgtacctgctctttatccagggatggaattatataattgattgctatacgagtatggcgaatagtgcgatgggcattaacgggtcgatgaggagtgtgtttggagccgtgtttccactttttgcgaatcagatggtgggtgccctgggggttgcgaagacgacgactgttttggcggctgttagtgtcatgttggttcctgtaccggtttgcttttggcactgggggagtcttcaccacggggctggaaggatccgcggtggcgca

SEQ ID NO: 3324 - DNA, 600 bp, A.fumigatus
ggtcccctctctgagcgtttcggccgtaaatggcccatgctaataggcatcactgcatcctctcttttcgatgtgatgcccgcattaggcaccaacgtcgctaccgttctcatcggccgtatcttcggcggtctctttggagtagcgccagttgccatttttggcggagtgctcagcgattgctggcctctcgcacagcgtggcatcgccatggccttggcggtgtcgctggtattttccggccctacctggggcccggtatgcggggggttcataatgggatctccgtcccttggctggagatggactatgtgggtcgttgtcattatcgggctgggctttacactcctttgtgtgttcctttaccccgagacatatccccctgtgatcctacgggccaaattacaggctctgcgaagaaagaatgggaatctgaatatcaggactgcattggataagggggggttgagcatacagaacattatgagtgtttatttggtccgaccattctgtgaggtttcctattttcccatttttaaagactttactgagcatagatgtgattcccttgaaaagaacaaaagaaagagtattcactaa

SEQ ID NO: 3325 - DNA, 456 bp, A.fumigatus
attgaaccagccgctggatcctcgcagccccgttgtgaagacgatcgtcaacatcgcaagtatttcagcacgggggcctccgccgaaccagacaatctacgcagggacaaaggggatggtcgactcctttaccaagtgctggtcagtggtgttaccatccatatgtggtacccggttaaaatactaagcataatctacagggccaaagaactccctcccaagtatggctgtaccgtcaatgccgtcagtcctggtccaacaatgaccgagggtttcgctgctgccggcaaggagcagatgaagatccttcagccaatcattgatcagactcctgttgggccacggatggctcagccagatgagattgcctatgctgtggcctttttatgtgaggaacgtgcacgatggattaatggtgcacatctgattgcatctgggggcttgttcattgattag

SEQ ID NO: 3326 - DNA, 510 bp, A.fumigatus
  unsure (331),(399): Identity of nucleotide sequences at the above locations are unknown.
ctgcacgattgcttgaaggacggcgtgaattttatcgatatcacagaagagcacaacaccggattttacccgactctccacagcgccagctatgtgaaatatccaccgaagatgcagtatgcagaagaagtggctgctcttaacaagaatttatcgaaagaaaacatgaaggccaacctggaacgattcacatcatttcatactcgctattacaaatctcagacgggaatccgatcggcaacgtggctgttcgaccaagttcagagagttgtctctgagtctggagccgctgagtatggtgcaactgttgagcgattctctcatccatggngtcagttcagcattattgcccgaatacccggccgaacgaacaagactgtggtgctgggcgcccatcangacagcatcaatttgtttctcccgtcattcttggctgctcccggtgctgatgaccatggaaggtggactgtcaccattcttgaagcgttgcgcggcttgtgcaatcagacc

SEQ ID NO: 3327 - DNA, 198 bp, A.fumigatus
tcccgacagaccagaagcctgcatgacttcgaacaacccatgctgtccaacgctctgcaaggcggcccctcgactttttgcggcggcttccacagcaaattctcttccgcaggccagaccgaggatgttactggcggttgctcctgtcgtaaatgtaccattatacaggaagctccgatccagctgaaggaggtctaa

SEQ ID NO: 3328 - DNA, 1107 bp, A.fumigatus
atcatatccgcattttctacacacccaccttccaagatcggaattctctcaatcatggagtcaaaagaagtcgatatcacactcgaaaagcagcaagattatcaagagaaactatggaagactgcccagagcgaatggaagtctgacatcttaccacgtgccaaccatctggcacacgccagagcatctctgccgaagtcgctatcatatgctggaatgggatatgaggctgccaagcagcatatcttggacgatattatcccaggcttgaatggtagcagcatcagtcccaattactatggcttcgtcactggcggcgtaacacccgccgcgttgtttgcggataacgtggtctccgcttatgaccagaacgtccaggtgcatcttccggagcattcagttgctacagatgtcgagtatagtgcgttgggtttgttattagacctccttcagctggatcggagcttcctgtataatggtacatttacgacaggagcaaccgccagtaacatcctcggtctggcctgcggaagagaatttgctgtggaagccgccgcaaaaagtcgaggggccgccttgcagagcgttggacagcatgggttgttcgaagtcatgcaggcttctggtctgtcgggactacaggtgctctcaacgctaccccattcgtctctggtgaaagcagcgggcatcttagggatcggtcgcgcaaacgtgaagaacatctcccgtgatgataatccgcttctcttcgacctagccagactcgaaggagaattggcaagaactgaaaaggcaactatcgtcgctgtgtcatgcggtgaggtcaacaccggacacttcgcaacggctggtctcgaagaaatgcttgaaatacgcagactctgcgatgaatacggcgcctggctacatgtggatggagcctttggcatctttggccgggttctggacgatagtccggagttttcttccatcaaaaaggcctgtcagggcatcgagttagcagactccatcacgggtgatgggcataaattgctcaacgtgccgtatgactgcggttctttctctgtcgtcagtcttcaccacaaggggtcgaaggatccgcgctaa

SEQ ID NO: 3329 - DNA, 327 bp, A.fumigatus
ccagaaactattagaaatagttttgcaggcgcgggcctagttccatttaatccagatagggtactcagtcagttagatatccaactaaagacccgtacaccaccaggcagtcgatcaaccaattcagcgccaaaaacaccctatactactaggcagttagaaaagcaggcatctactgcaaaaagactacttaaggaacacacatacagccctttaccactactagaggcgcgattagacaagattattaaaggtcataaaatagctttaaatgagcttgttcttacgcgtaacgaactacacaatcatcatgccaataataaatag

SEQ ID NO: 3330 - DNA, 306 bp, A.fumigatus
ctctcaaacgacgatggtttagccacgtggttcgcaaggctatccccaactagtacggagtacgtaatatacgaaatggagatgctagccatgatccagccagttctgtcgttccaagccgtgtgctctatttcgtctatcatgaagcagggctatacgtttggacattcgcagaatgagatgactcgttttatcaggacacaaactgttgtcaactccaaccggagtattctgctatgcagtacggttaacgacgatttaggagacatgtcctatcaagttttcaccagatcaagtggtgcttga

SEQ ID NO: 3331 - DNA, 234 bp, A.fumigatus
ttcacaacgaagctggtgctaaccgtactctactgcatagatgttttgcgtatggtgctcggaaatactaaatgggcccttgatttttcattctacgtgctcaacgagctgttcgacctcgccgatgactttgaaagcctgtccggcgaccaggaggcatttacacagaagtgttcgtggggcctcgcctctacatacctggtgaaccatgctaacccccatttccggcagtga

SEQ ID NO: 3332 - DNA, 342 bp, A.fumigatus
cacccggttagttcccctccttcgatcgttgcaatgagcctttccgctaacaaatgcacagaggcgcaagccaccttcatcaacgaagcataccgcgctttgcctataaactgcaactttacagtagagcaggataaacttatgaaccatccttacattcctcgctgtctgagtatccaagctgctctgggattcaagaacaaatacacgccgcgaagctttgcatcctctataccttgggccgtcctccagcttcgccatgcgtcggttctatatgcattcttcttccagtacaacaaaggcggcaccacagaaccgcatgaccctggtgagattacctag

SEQ ID NO: 3333 - DNA, 258 bp, A.fumigatus
ctcaggcgggctttcaccacccaccagagccctcaggtcagtgatattttcggtcgcattgcctcgaccactctgacctatggatttgcagcaggtcttcatatcagtttctcaccaaacgcgtgcgctgccgtaatgcttgacggagagggacaaactcacctaaggctcaccgaacactcttacggggctgagggcggacttcatgacgagagtacgtgtctagactgcaaggttatgagtcggcgcattttctga

SEQ ID NO: 3334 - DNA, 351 bp, A.fumigatus
  unsure (240),(283),(289),(294),(295),(314),(317): Identity of nucleotide sequences at the above locations are unknown.
cccccatttccggcagtgaaatccacaagttcccttcctctcatcatcctcctctcaagcatgtctcgcgcattcctgcggttcatctgccggggtttgcgaaggatctacgcaggctacgcgaccgcagcgcctctaagcggcgatgcccgcgtctactacgcggagaattaccaaacactggaatccgccccaatccgtatcgacgcatacgagaagttcctcgcgggcgtggactcngccgtgcgtcacgctttcacacgttgccgggttcggcgaaacngaaacngccanngccgggagaaaagaactcntgnttcaacgccccgtgttgccccccgtgcttggtaa

SEQ ID NO: 3335 - DNA, 681 bp, A.fumigatus
  unsure (386): Identity of nucleotide sequences at the above locations are unknown.
aaaacaacgcaaggtcccatcgcaatgtcggaagaagcgcctaagcacgaatctccctcagtgatcagcccaatagaaaacgaggagaaaggcctggcccccaaacccctcgagcgcgtgccgcccaatggtggtgccaaggcgtgggcttgcgttgcaggctcgtttttgctacagttttgttcattcggctacgtcaatgcgtatgtttcgattctcttctcttctctcttcgtctcgtttgagaaacagcccactgaccttcccgagaacagatgtgggatcttccaattgtactaccaggagaccatgctcaaggaccaaacatcatcagccttggcgtggatcactacccttcagatcttcctgctttttatgttcggtcncgctgtcggcaaaatgattgatgtctatggatgtcgccggacgcttccaccattcagcatcggggctgtgttttccgtatgcatgctgagcttgtgcaccaagtactggcaggtcatgctggcgcagggagtcgccttcggtctggctgccgctgggctctctcttcccgctatggcgacggcgacgcagtggttctcgactaagaaagggttggccgttggcattgtgtccgcgggtagcagtctcggtaagaatggcgaacctcttcaaccaaactcacatcttgatggctaa

SEQ ID NO: 3336 - DNA, 300 bp, A.fumigatus
tctacgcccccctgtacgtcatcttccttggtttcgtcgctggcttctccttcccactccgggcttaaaaccagttccgtctcttcggtcccgaatagttcaagtgcgacaaagtcgaccggacatcttgcttcaacggctacttatcagattagcacttatgactcgactcttccctcgttttccgcttccattgcacatgtggcccctaccgttgcagctgccaatgacctgctggaggcgcccctcggaatgggtgtcttctgtgcgctccttggcggcctcatcgcaatcttttga

SEQ ID NO: 3337 - DNA, 498 bp, A.fumigatus
  unsure (170),(191),(325),(352): Identity of nucleotide sequences at the above locations are unknown.
cagcatcggatatcagaaaatggccagtcaggctcaaataaaccccaagaagcaacagggtacgccgatgagttctcatttcatttccatgcagtcacgaaggctaatctgaagcagagcttcagctccaatatacgaacttcaagaatacactcacacagatggcgcanaaaattggtgatatcgagcangaagcagaggagcataagtacattttgcttccattctaaactgctggcagcactgacctatactagacttgtcattgagacactcgaaccccttcccgaggaccgcaagtgcttccgaatgggtaaacgagttntggtcgagcgaacagtcaaggatgtgncttctgcactcaagacaaactcagatggtctgaaacaggtgctcgacgaaactgtgaagcaatatcagagcaaacaatctgaattggacgattggaaggttagtttgtcaatgccaggggttcatgttaatagtatagatgattga

SEQ ID NO: 3338 - DNA, 525 bp, A.fumigatus
tggactgagactggatccttccagccccgtggtgaagactatggtcggggaggtccctacggaggccccagaggacctccgcccaatggtaggggcgggcccatgggccccatgcgaggagccccttcaggtatgatgggacgcgggcagcggggtccaaatcctgcgggctacggttacggccccgtctctacaggcctcaatcctggttatgatgcctacaactacgggccgggcccgagaccgtcgcaacggtttggtgaaaacggtatcgactatcatgggccgtcacctgttgaaacagcgcgacggccctccccgggtcccattggcatggcagtgtcgccgccagaaaccgcgccaattggccaagcgatcgaaatgacatcgcaacccaggcacacggactctgctgtcgaactgggccccaatgcagtgccggaggaggagcagccacatgcggtgtccaacgacggacacccggagcctgtcagcccttcgagtctgtatagccgatcagcgtga

SEQ ID NO: 3339 - DNA, 189 bp, A.fumigatus
agacggggccgtaaccgtagcccgcaggatttggaccccgctgcccgcgtcccatcatacctgaaggggctcctcgcatggggcccatgggcccgcccctaccattgggcggaggtcctctggggcctccgtagggacctccccgaccatagtcttcaccacggggctggaaggatccagtctcagtcc

SEQ ID NO: 3340 - DNA, 900 bp, A.fumigatus
aaagtcgagcctaatgataacgctacagggaacgattccgaacaaatgaactatctcaacagcctctggtctaagtggatgcccgaagcctctccccgaatcgccgttgactcccatccccgcctctccggtatccaagacacgatcaacgcgaccgatgcccatgggcccgccacgagactacccgcggagttctatgacaagaaagcccgcgagtacaccaacaccatcgccgtcgacgagtggttcgcaggatatgcggagagtagggaataccggaaactcgggatcggcgccctgatgggcgacgtagtcgaccgtatggtcaacgccgctgccaacggcggctggcgcagcgagcgctccgcgtctggctcgtccacggagaacggcaaggcgatcaagttcgccatgagtgggtgccacgataccaccctcgccgctatcctgggcagcgtgggcgcctttgacgccaaatggccgcctttcacctcttcgatcgctattgaactcttctcccggatggagaaccaacctccatcgtcaccttccccgtccgccaagcaaaggagtctcgtctcgtacctcacggggcatgatgccgtgccctcgtccaacacggaccgcaccccgctttcctctctgccaaactcaacccggcaggcattgcaaaaccactacgtgcgtattcgatacaatgacgtcccggtccggattcccggctgcgcagcgaaagcggagaaccatctccctggcgacgagaccttctgcacgcttgatgcatttaagcagatcgtggataagttcacgcccaagaactggagggaggagtgtgtacagaatctgggggagggactgtacggtaaggacgatgcggagaaggctgttgccgggttctag

SEQ ID NO: 3341 - DNA, 201 bp, A.fumigatus
agacaccccgatccatgtggaatgaaaggtcggctttcttcaggcatctttggtgtgagatggaatgacttgtatgcccctggctcccgtatgttgtcttctgtcactgtgaaagaattccttggtttctgcagagaactggcctcggaacatgttgaagcaattatctttctagtgcaggtgcacctgattatgatctaa

SEQ ID NO: 3342 - DNA, 369 bp, A.fumigatus
  unsure (181): Identity of nucleotide sequences at the above locations are unknown.
ctcctcacgcaaagcaagcagtccttacagttgattctctttgtaaaatcttccctaaacgaggttgatcctcacacactccttttactgtcaattgccattgtgctacagtctctccttaaacataacactcctttaaatcggtcattcgccatgttcttttccaaactccttttcatancggcctttgcgctggctgtctcaaccctcccgcaattctatcctggtggcagcatgactaggcatgatgcaactcccacctccagcacaagcatcagccctacttccactttcgccagcaacagtgcccgccccagtgccacaaccaacaggcacggcagcgtccatatcgtttaccaacttgacccc

SEQ ID NO: 3343 - DNA, 939 bp, A.fumigatus
cctggtgtgtatccatcaaaaccaatccttaactgtgtgttttgtgttattcaatgttcatacggtgtcaatttccctcgtagcctgggaaataacacacccggatcgctctgggacaacgttgccgatcgaaccggccagaacctattcacctcgaaccggtacgggcatctcaaacgccagatctaccagagcgtacgtagagcagacttctgcggcttctggctttgtcgtggactatcagcagaagcgacccacccccgcgatgcggatctggtgctcttccactgccacggcggtggatatgtgagtttccacccgtctgccggagcgccagaacacctcttcatggcggagcttctccaacggcatgggctcacggtcgccatcttctccctggactacaccctcgccccggcagcgacattcccgaaacagcgcgacgaagcaattgccgcctacgactggatcaacaaggagctaggtgtggacgcatccaagatcgtggtgatcggcgattccgccggggggcatctgatcatgtctctactgacaggccttcaccagcgctatccgagggccaacgatggacgcagcgccgatcaccatcgagaccgacccgccggagcaatcctggtcagcccctggttgaatctatacacgtcccacccacgcacgctggcgctccactgggaggagcggctcttcaaacgctcgctagacaaatgctgcgagcaggtgatgcgggacacgcccgccgacattgccgaagtgtacggcaacttcgcagtcgacgtggcagcgcgcggttcgtggaaggagattctccccgaccgcacgtgggtctcagccggggcagagagctggtattcctgtacgacattgaagattttgtggcccatgcacggcgtgacggggcagcaatcgcgctggatgtga

SEQ ID NO: 3344 - DNA, 588 bp, A.fumigatus
  unsure (554): Identity of nucleotide sequences at the above locations are unknown.
gaaacggtggaggagaacatcatggctgcgttggtgcaaacgattccacaacaaagtagcacggtctctgtgcttcagactcgcccttcatcctcttccggctcctttgccccatctcctcagccttcgcagcagcaaaattctcgcagttccacgatgtcctggaactcgtacaatactgtgagcggatctcagggctatcgggcgggccaccaggttgtggccccctatgctttcactggcacgcctagcatacccaatgccagtttcaacacgacgcagaatagtcagtcgtggtcgccccatttgaggccagagaaccgaacttcctctgctccctcagtcccccaggggactccagtccatcctcatgccattggctccaaccctcgtttctcccaccatcctgcagctggttctgtatctacttcgtcctccaactcttccgtccaatcttaccgctccaaagacgactccgcgatcccttcgagacagtcacgcagcgacccgcctcttcgccctttatcgaccgccaacctgccgtctccttggtnttacaccgccggaatggccggaaatgcggtggaa

SEQ ID NO: 3345 - DNA, 1218 bp, A.fumigatus
  unsure (82): Identity of nucleotide sequences at the above locations are unknown.
acctgctccccttttatcacggttttccacttcgaaactttaccgacgcgacgcgaaccagggacgaattcgagcattgttntgggccggtccaagggtaatcgactggccacactctggaatcttctcgacacaggcgcatcagcaccatggccaacgctgtttagcatggccgccgagcacgactcggtgcttgcgatgaaggtacttcttttgcaggatggtgccgatacaaacgctgtggaacacactgaaggcattccgcttatggtgaccgctgtggtcaatcgttcacccaaagtagtgcgcttccttttgaccagagatggggttgatccgaacgtcaagaaccatgatggacaaacacctctcgcatacgctgcgtgcgagtgcttcaacgatattgttaagattctgctgaagtgtccccaggtggatgtcaattgcactgataacgccggatgcacgccgcttcgtttagcagcgggaaggagccatgtgttcgttgtccgaacactcctctcgaatccctgggtcgatgtcagtgtgagggataatatccttcacatgacggctctctcagctgcagtggcggctcttgctaaccgaattgcctggagccccgagaaggtcaaattgaagcatcggcggacaatacaagcactcctggagcacccggccacctcggtgaactatgacatggacccagatctcctgccgctgtatcggttcagcgctcagtacggatacgaagagatttttaagttgctttggtcgaaaggggcgggacagctcccggcagaactggatcgctccgggatattattcttcgttgcagaacacggccaagccgggatcatgaagatgttgtttgcgaatggtttcgagccggaagcacagactgatacgggccgcacgacgctctcgattgccgccgaacacaagcagctcgaggtcatctgtctgcttctctcgacgggaaaggtcgacgtgaattccaaggatcaagctggtcgcacgccgctgtggtgggccatgacccatgggtggaggaagactgggacggatgagactctgaagctgctcatcgcccatgacgctacaattccgaccatcgaaagaaggaagtggcttcaaaagtcactgtgcaacgctcttgagtatggcaactgttttctatgtcttcccacggggctggaaggatccgcgcgggcgtta

SEQ ID NO: 3346 - DNA, 213 bp, A.fumigatus
tcatgctggaaactaggtggaagatttatggttgacatagtcctgtaccttttagatgatgctaacgcagttaatcatcaaatttatcatcagctaggtgagtctgggaagttacttattctcgagtgtctagttggcttagatgtctctttatacatgggactaagggaaagagcgtctgggatgctttacatatcccatgttgttgcatag

SEQ ID NO: 3347 - DNA, 939 bp, A.fumigatus
caacttattccttccatcccggcgttaagaccaacggaggagaatgaggtgaagagtcctgatgtaccatccaaacccgctattccatctcgccctcagaagctgtcacaacaaactcctgcggtagatgcctcctctgcaacctctccaacagaaaaacgacagccgcccagcatacctgatagacccaagccacagattcctcctcggccagccaagcccattacccgtggggctggagaggaagttccagccaaagaaaagccagctgtccccattcggcccaatggaagcaagattgctgcactcagagcagggttcttgtcagatctaaattcacgtttgcagctgggtccccaagcgccaaagccccaagagaagaaagaggaggaagctccggcagaaaaagcaccactgagtgatgctcgcaagggtagggcacgtggcccatcccgacgaaagccagcttcccagaacgttagtacaaggctaccgacgatccccgaaattaggatcatcgagacttggaatgtttggcaagtcggtgaggatggcaatctcacggtcgaaaccggagtgaaggctaagcagcctgagcctgctgcacctgaagtctcgacttcgaaggacagtatggccccagccttgtcaaaaaacgttgccggagaatccaccgatccttctccgatgacggcaaccaaggaatctgcacccgagacagctgagacgataccaagcacggttggggacgctgcggctgtgtctgctacggaactcacgaagccgaacgagagtgaggtacagcaaaagtctgcagatgcgcagtctggaatcacatctagcacatcggccccggtagacgacgtcattgaagctttggctgcaactgctgacgggaaaagatcgtcggaaggctctgtgccccctgaggagcagtga

SEQ ID NO: 3348 - DNA, 1035 bp, A.fumigatus
caccccgtggtgaagactctcgatccggtcgaccgcgcattctatgcgggatatgaggatggtagcgtccagtcagttgacttctacaagagtcagtcaatacaacataccctgcacgatccttcattacattccactccgtcacaaccatcagcggaagatcgctggcttgctccgtcctccgacttcggtggtgtccactcgctttctctgtcctacgatggaatgaccttgctatctggacatcaaaacgggaaggtcctgtcatggaatgtagctcgacggaaatatgcatcaactctggcggattacacccaccccgtgacgaatatcattgcgctcccattggaaggactaccgtcttccggaaatgagttgagacgagtagcgcacaccatcgtcaagccacgttatgaccatgctctttcagagtcttcgggtacgcctgacgctgtccccgctgactatacatttagtacgcatctgctcgcctctgacacagcccaactcactttaagcgatcatcagagagatcagttttctacagctttgacacacgctttcttccccgagtcaatgatggaagaaggtcttgcggagcttgccgctctcaagcattccgggaataacggaaaccatgtctcgacgatttcgcaatcagtagtctcccagcaagcggcaattgtcgacgactcccagatcgcatcattggaagaggaaattaccacactaaagaagaaacttgccgtcaacgaggcggcgcgccaagttaccacagacgaggtgactaaactgcgctcggacctagtcaacctgcatgactacgtcaatgagctgcatcagaagcaggagcatgcccatcgcgagaagctcctgcgtcaagctcgaaaggaagagcgcgaaactcgcaggcgggaagcctggttcgctgccgagaggaaagggaagaagggtgatgccgtacttcggcgtatggaattggaagaggaagctcagaccagcgaaaccgatgatcaaagcagtgacgagcaatga

SEQ ID NO: 3349 - DNA, 240 bp, A.fumigatus
aagcgacaatcattgctcgtcactgctttgatcatcggtttcgctggtctgagcttcctcttccaattccatacgccgaagtacggcatcacccttcttccctttcctctcggcagcgaaccaggcttcccgcctgcgagtttcgcgctcttcctttcgagcttgacgcaggagcttctcgcgatgggcatgctcctgcttctgatgcagctcattgacgtagtcatgcaggttgactag

SEQ ID NO: 3350 - DNA, 426 bp, A.fumigatus
  unsure (1): Identity of nucleotide sequences at the above locations are unknown.
ngcggaaatccccgccttgggtctgggtatgattgttcttcctcggtcgtccgcggtgaacaggccagcttattcatgacaggaacatggcaatcgaaacctggagaggttgagagggccgtcagccatgctatctcggtgggatacaggcacatcgacactgcctactgctaccagaacgagacagaggtgggcaatggtatcaaggaggcgctgcaatctggaaaggtcaagcgtgaggatttgtttgtcaccaccaagctgtggtgcacataccatacacgagtagaagaggctctggacaagagcttgaagaacctgggcttggactacgtcgacctttacctgatgcactggcccctggccatgaaccctgagggtaagcatctttcaacccttgcaaaccacagaaacctaactggttga

SEQ ID NO: 3351 - DNA, 537 bp, A.fumigatus
gcatctttcaacccttgcaaaccacagaaacctaactggttgaaaggaaaccatgagctgttccccaaacaccccgatggctcccgggacattgttcactcccactcccacatcaccacctggaagagcatggagaagctcctggctactggcaaaaccaaggctattggtgtctccaactacagcaagaggtacctcgagcagctactgcccgaggcgactgttgttccggccgtcaaccagatcgaaaaccacccatctctccctcagcaggagattgtagatttctgcaaggagaaggggatccacatcaccgcatacagccctctgggaagcacaggaagccccttgttcacggcagagcctattgtcgcggttgcaaagaagagaggagtcagcccggccagcgttctcctcagctggcacagtacgtttccatttgccagtccaatttcgcttttcgcgtgcaacccactaacaataatatactgcaatagttttcacctacgggagctggacgcatccgcgcttagtgat

SEQ ID NO: 3352 - DNA, 1359 bp, A.fumigatus
aaacgtaatgagacgaagcttctaggaaagatgacgcactcacaggaaatcttggctttactggaatacctcaggatgcaacggatgaattctgtggttgcttcacatcacatcactaaagactttcccgacctcttttatgctcctgggtttaagcacatctccggcatgctctatgtgcctttgtcggccggtggcactgatttcatggtcttcttccgtcggggacatcttacagagatcaaatgggccggaaacccgtatgacaagaaacctcaaaacggccatctggaaccgcggaaaagttttcagacctggcgagaaacagtcctagaccagtctcgagaatggaccgagtccgatgtggagacggcagctgtgttgtgtctcgtttatggcaagttcattaaagtgtggcgacaaaaggaagccgcaatggagaactcgcaattgacacggctcctcctcgcaaactcggcccatgaatttcgcacgccgctgaacgctgtcatcaactatctggagatcgctttggaaggctccttggaccctgaaacccgcgacaaccttacaaaatcctactctgcatctaaatctctgatctatgtcatcaacgaccttctggatctgaccaacgctgaaaagggccagaaactcatcaaggatgaaatatttgaccttccagccactttccgagaagccactgatatgtttgagggagaggccaagcgtaagagcattcattacaaagtagtagcgcaccctggacttcccccagcggttattggcgaccagcgtcgggttcgccaggtgttcaccaatctcatttccaatgctgttcggcatacaacagcaggcagcgtgaccacggagatttggcgctctctcgagcaggcgcagccaggatgtgtggtggtccaaatgaccgttttggacacgggatcaggaatgtctcagagcacccttgaggctttgttccaagaacttgagcaggtctcgacggatgatgacaattattggtttgatccggaagaccagacgcaccctctcgactcatgcagtcaggataaacgtgtactcggcttgggtctggcgttggttgctcgaattgttcgcaacatgcacggccagttgagtgttcgatcggagaagggcaagggtagctatttcgaaatctcacttaacttcccagttccggacgacgtggcgtctggggaatcagaagagccatctgtgccggatatcgtggaaccagctgttccgattcagcaggaagtggagttcatgctcgtcgacagcaagtccacccgaggcggcgagcagcggcgtcgcagtaccggcagcgatcacagcaagggc

SEQ ID NO: 3353 - DNA, 306 bp, A.fumigatus
ctcagactcaatttgctccaggtaccagacaatcagatcttcttgctcgacaccttcgcccgacctcgattcgtcctcactcacgcggcgaacaaacagattcaggatcttcatgtacttgtcatacgtgatcttcgtcttctgacgcggtcgtgcttccgcatggtcacgcatgggactgtcaccttccctatcccgatcagccatctcgtgatcctcttcaccagcgcctgcattcgcatgagtgccttcgtcgtcgtcaacttcaacatcatccttctcgacggtgacgatgctctggcgtag

SEQ ID NO: 3354 - DNA, 189 bp, A.fumigatus
atcacatccgttctattaagcaggctcgcttctttgttgaggcctgtcatcacataccaactgccttatcttcccttaatctccctttcgggacgtttctacgaattcgtttttctcaagtcgttctctatagacacctctacttccagctgtcaccttgacctcacaatttgccttgatccgacctag

SEQ ID NO: 3355 - DNA, 984 bp, A.fumigatus
  unsure (180): Identity of nucleotide sequences at the above locations are unknown.
catgcggcgccaattctcaacttcagtgctctaatcatgagcagattcgactgtttctttgtgattcgagatgagccgaacgaagcggtggaccgtaatttggctgaccacatcgtcaacgtgcacatgaaccgtgatgaggccgtccagccagaattgagcacggaacaattgcagcgntacattcggtttgcgcgaaccttcagacccgtgttcactgaagaagctaaggctttgcttgttgagaagtacaaagagctgcgagcaaacgacgctcaaggaggcattggccgctcttcatatcggatcacagtccgtcagctcgagtctttgattcgtctctccgaggctgtcgccaaggccaactgtgtagaggagatcgtaccgagctttgtacgggaggcctatgacctcctacgccagagcatcgtcaccgtcgagaaggatgatgttgaagttgacgacgacgaaggcactcatgcgaatgcaggcgctggtgaagaggatcacgagatggctgatcgggatagggaaggtgacagtcccatgcgtgaccatgcggaagcacgaccgcgtcagaagacgaagatcacgtatgacaagtacatgaagatcctgaatctgtttgttcgccgcgtgagtgaggacgaatcgaggtcgggcgaaggtgtcgagcaagaagatctgattgtctggtacctggagcaaattgagtctgagttaaacagcgaggaagacctacagcgtgagcgtgacctggctggaaaagttttgaaaagaatggtcaaggttcgttcttcaccgacagcaagtgtctttgtcactgcttgttttactgactatcttcgacacaacaggaaaatatcctcatgccaatccgaggagagggtctggtggatgctgatggggatccgcaagaacaggttcaacggaccgtctatgtgctgcatcctaactgtgcctacgaggaggcttaagcggtag

SEQ ID NO: 3356 - DNA, 816 bp, A.fumigatus
ttcttgtgtgtgaagggaccgaaagtaggccaccttgctcatttctggcacatggttttccatgaaagcaaggatgtggctgtcatcgtcatgctcacgcagacggtcgagtcgggccgcgagaagtgtgcgcaatacttctccctagaccacgaccggccttccatgattttgcggcacgacgaggacgaccctttcgaacacaacgaggagtatgaagaagcgaatgacaacgtaatgggtgaagtcactctattggaatcgagctttgaccaaaactctcgctctgaggtccgcaaactgcgactcacattggccaacgagtcaaagatcgtctggcatttcctttttgctggctgggcggattactctaagccagaaggcgaggaccgcgaagcgctgcttcacttaattgagctctccgcgtccaaatgttcatcggataacccacggatcgtgcattgcagcgctggtgttggtcgcacgggcactttcatcgcattagaccatcttttgcgggaactggaatcggggcagctgctcaaggtgaccgactcgcaaaccgatcccgtttttgaaacggtcaaccgaatgcgagaacagcggatgatgatggtatataatgaaatgcaactacagttcatctatgaagtgctccgcgagcaggtggaccttaaacttgggaagaggacgagcaatgccgggcggagattagacgagagatctgcgaagatggccaagttatcgaacagctccgagtatctaccttcccataaacctgagttggagcccgtcaatgatggtccctcgccatga

SEQ ID NO: 3357 - DNA, 540 bp, A.fumigatus
agacgacgacccggcttcgtgtgcgatcatcctcctgaatgtttcaggggcattgttgcgacttgtcaagctgctgcacagaattgggagggaatgatggccctccgtttccttcttgggttgtctgaatccgcgtttggacctggcacaccgtacctgttgtctttcttctatcgccgtcatgaactcggtctgcgtatcgggctggttttctctgctgcgcctttggccaacacatttgcaggcgccctggcatatgggatcacgtctggccattccaagttggcccattggcgattgctgttcctagtagaaggggcgccctctatagttgcagcttttcttgcctggttttacttgccagatcacccagcgtctgcccgtttcctgactgatgaagaaaaagaggttgcacgagcgagagggctccggaagagcggagagggcgagcgggtagcaggcattgactggacggatattggccgtaccctgttggatgttaaagcctggatcgcagcggtatgttgtgcttccccttga

SEQ ID NO: 3358 - DNA, 396 bp, A.fumigatus
tatacttccttgggtactcagtgcgtcatcaccaattccctatcgtctgaccagatgctaatcaatcatctagataatcaaggatccgacacccgacgaggtatggggattgtaattctcaatctggtcggacaatgtggcccttttttgggcaccaacatcttccccgaaaacgacgcgcctcgatacgttcgaggacaatccgtttgcgccgctttcatgatatttgtgactaccctagcactcactttgcggtgtcttttggtctgggagaacaaacgcttggatcagaaatatggtaccaagaacgaggaatctaccaaaggagggcctaatggcaacgatgatggcgtggcagaggagaattatgggtctacgttccgctatgtcctatga

SEQ ID NO: 3359 - DNA, 486 bp, A.fumigatus
caggcattgactggacggatattggccgtaccctgttggatgttaaagcctggatcgcagcggtatgttgtgcttccccttgagcctcgatcaagctgtcctgatacggaattacagttgatgtacttcagctgcaacgtgagcttttcttcgctccctgtgttccttcccaagatcattaaagacatgggcttcacgtcgatcaacgcccagggtctcacagcaccgccatacttcgcttcgtttcttgttacaattgccacaacctggttagccgatcgactgcaacagcgagggctgatgattattttgttgtcgctcactggggccattggatatgtgctgcttgctacatgcacctcagttggtgtccgttatctcggcgtgtttctggccgccgtgggagtcttcccctctattgctaatatacttccttgggtactcagtgcgtcatcaccaattccctatcgtctgaccagatgctaa

SEQ ID NO: 3360 - DNA, 195 bp, A.fumigatus
acgcaatcctccaaatatgccgacagggcgaaacggaacctcgatgagaaatactcgtatctcgccggaaatgccttcgggcgagacaagaagggccgggtcaagcgagacgaccctcatgagatgcaggcgggcgcagaaggaggaggcgccgagtacactgcgtatgtgtactacgagtttgaattcaattga

SEQ ID NO: 3361 - DNA, 435 bp, A.fumigatus
cacatttggttcagtcggctggtcagttttaactcatacgtgtcgctagtccttcctgcatcgcgtcccgacatcatgtccaagtcgaacaagtacctcctcgtctcgctccccacatccatcactccctcccaccaccgcgatgacgctctcgatgctgtttctgccacggtatcacccgacaatggctccgtagcaccctttccaatcccggaattcaagatcggtactctcgacgctctggtgcagcaagccgatgagctggcgaaactcgaagcttcttgtcaaggcgtcgtcgccaaggtcggagatgcgttgaagggcgtcctcgagggagatgagacgcagatcgataagatgaaaactgtcaatgatagtatgtccactgtgtctgctgcgtctgttggggaagggggaagcctgctcgctgactga

SEQ ID NO: 3362 - DNA, 615 bp, A.fumigatus
gtactcgcaatacaaccaggtgaagaatacgctggcgactcttcaacgcaaacaaacgtgagggcatcacctctttcgcttcaacattcttctaattcatttctgatctgtagaggaaacctttccacgaaatcactcgcatcagtcgttgatccccgcactcttgtccgcgattccgaatacattgaaacgcaccttgtcgctgttcccgctcagcaagtgaaggaattcctcaagacatatgagacggtggcgcccatggtcgtgccccgatccgcgaccctcgtggcgtcggacgacgagttcaccctttacgccgtcacgacgttcaagaagcacagcccggagtttgtccaccggtgtcgtgagcacaaatggattccgcgcgatttcaagtacgtcgaaggtgggaaggaagaagagcaaaaggaggtcgagcgcgttggcggggacgagcggaagctctggggtgagacccttcggcttggtcgaacagcgtggagtgaggccgtgatggtttggatccacgtgcttgttctgcgggtgtttgttgagaccgtgctgcggtacggtctgcctctggatttcgtctgcacgatcatcagggtatgttga

SEQ ID NO: 3363 - DNA, 762 bp, A.fumigatus
  unsure (735): Identity of nucleotide sequences at the above locations are unknown.
gatgactcaggtgatcctcatcgtcgacgacgtttgttgatgatcttggtgaggacgacggaccatccttcctcgagggggctccccgagcatcatttggtggccctcccaccccgtggtgaagactcggttcacaacctcttgggctttcggaaccttgatttgtatcggacgatagatacttcttccatactgattcaatttctcgtattcgccctcacggttctgacaccttcaactccgtggttccagttcctttttgtcgccaacgcggcagtctggagaatctggtattctgttggtatcggtttcgtgctcaaccgtcagtcgaattgtaaggcctggactcgacactttgtaaaatatggcgaaagcccgcaggaggcctggaatcagtggaaaggcacttatcatatcagcatggttatgtgctacgcgagcttcattgctgccgtctggaagatgtacagttttcctgcggattggggctatggccttgtgttgctcagacacgtcttgggtgcagggctcattgccttgcaaatctggacatccgtcagcatctacgaatcccttggagagtttggttggttctacggagatttcttcttcgacgaatcgcccaaattgacgtatgacggcatttatcgtttcctgaacaaccctgagcgtgttctggggttggcaggtgtttggggcgccgtccttatcaccagcagtggggctgtcactttnccttgccctgggtgggccatattttga

SEQ ID NO: 3364 - DNA, 699 bp, A.fumigatus
  unsure (199): Identity of nucleotide sequences at the above locations are unknown.
ccccctcccccccccccccgccccccgccccccccccccgccccgcccccccccccccctccccccccccccccccccccccccccccccccccaccccccccccccctccccccgcccccccccccgcgcgcagcgcggtatcatcagccccggcgccgacgacctaggctcaaaatatggcccacccagggcaaggnaaagtgacagccccactgctggtgataaggacggcgccccaaacacctgccaaccccagaacacgctcagggttgttcaggaaacgataaatgccgtcatacgtcaatttgggcgattcgtcgaagaagaaatctccgtagaaccaaccaaactctccaagggattcgtagatgctgacggatgtccagatttgcaaggcaatgagccctgcacccaagacgtgtctgagcaacacaaggccatagccccaatccgcaggaaaactgtacatcttccagacggcagcaatgaagctcgcgtagcacataaccatgctgatatgataagtgcctttccactgattccaggcctcctgcgggctttcgccatattttacaaagtgtcgagtccaggccttacaattcgactgacggttgagcacgaaaccgataccaacagaataccagattctccagactgccgcgttggcgacaaaaaggaactggaaccacggagttga

SEQ ID NO: 3365 - DNA, 201 bp, A.fumigatus
aactgctgcacgtgcgccttgaagccctccgggtcgttattggcgtaccagtggattgccaccaagtcaatcgtgcaggtcctacagtgctcgaagaactggtccatccaccccgtccccatgttgggcggcggaccgtttgtcaccgcgggcgtcgaaatgcgcacctgggccgcgaatggctgcaggctcaccaggtag

SEQ ID NO: 3366 - DNA, 303 bp, A.fumigatus
gacctgccctcgccctcgcccagggaaagcgcggtctcgcgtataacgacggcgccctcgcaaatctcttcagcggatatagccacgtcacctggggttacaactggggctacgagcgcaacgggctcggcgcctccttggacttcaatcccatgctctggggcctgccctcctcgctggacccccagtggaccgccgccgttcacgcaaccggcgtcgaagccatcctgggcttcaacgagcctgacctcggctcccaatcgaacattagcccggccgacgcggccgccggctacctggtga

SEQ ID NO: 3367 - DNA, 798 bp, A.fumigatus
acttgcgcggatgctcgctctccagaggtgaagattctgatatctattaccatgatctttaaggccatctttcccatcctctatgcactaggacctgccctcgccctcgcccagggaaagcgcggtctcgcgtataacgacggcgccctcgcaaatctcttcagcggatatagccacgtcacctggggttacaactggggctacgagcgcaacgggctcggcgcctccttggacttcaatcccatgctctggggcctgccctcctcgctggacccccagtggaccgccgccgttcacgcaaccggcgtcgaagccatcctgggcttcaacgagcctgacctcggctcccaatcgaacattagcccggccgacgcggccgccggctacctggtgagcctgcagccattcgcggcccaggtgcgcatttcgacgcccgcggtgacaaacggtccgccgcccaacatggggacggggtggatggaccagttcttcgagcactgtaggacctgcacgattgacttggtggcaatccactggtacgccaataacgacccggagggcttcaaggcgcacgtgcagcagttctacgacaagtaccatctgccgatctggatcacggagttcgcgtccagtggctccgaggcggagcagattcagttcctgcaggcggttctgccgtggctcgatgcgcagccctatgtcgagcggtatgcctactttggtgtctttccggggttcctggtcaacgagggtggagacgggctttcgcagctgggacaggtatatgcgacttattag

SEQ ID NO: 3368 - DNA, 480 bp, A.fumigatus
ttgacgcattgcgcggatccttccggccccgtggtgaagaccccctacatccagtcctactttgcgacgacgcactgggcctaccagaaactggccgcgctcgagaagcggctccgcgatctgaagctattcaagtcgtcctcaggggacgcgtccgagcggccgtggttcgctgacggcgcgaagaacgagcatcagctgaccaccgccggtagcatacaagatgaccatatcccgttccttgcgcgcggcgtggaaatcctacacgtaatcgatgcttcccctatgacagggttcccaagtgtctggcattcaatggatgacgacggtgaacatctagatctggacacggtggaagactggagcctgctctttaccgcatttgccgccgagtggatggaattggaagacttcatgccggggaatgaggcgcggctcaaggagaagcgatctcattcggagaggaagactgaattgtga

SEQ ID NO: 3369 - DNA, 723 bp, A.fumigatus
attagaatggtcgccggctgcacatcagcccacatgctctgcgttctttcgcgcctgtcgccccgctcactcatcgcaacagccatcttcttcaccaccgccctgctgactgcaaatttcgtcaacggaggccagaatattccttcctgcccgtctggaataccctgttataccccagtgtacccgtcgaccgaggagctcgcgttcatggtcaccaccaccgctctgacactcgtgacgaactttgtaattgttccacgagtgctggaccggtcgaagaagtcgaggacgatcttttcgtacctggccgggctgcaattcggcctgggactgttcatctctggaatggctgatccggcaaaagtcctccgctttttcgccgtgcttaccgatccagctcgctgggatccttcacttgcgctcatcattctgtttggaatcggtccgtcgcttgcgacttacctgtccgtgaagcctggacagaagaagggagagaaacaaaagggagaggagtctgcgaagcctaccttggcggataactggaaactgcctacattgactatggcggatattgactggcggtttgtgactggggccgtggcgtttggtcttgcctggggcttacgaggggtatgcccgggtcctgcgattctgcgtacggtggtccagccaacatggggccttgtcgcgatgacagggtatatgttgggcaatcttttctaa

SEQ ID NO: 3370 - DNA, 372 bp, A.fumigatus
tgtccttcatcttacacccaggtacgtctctttgttgaacgcacttttccgccattgcgtgctgaggaactctgcagaggtcgctttgatatcgacatgtacgaatcgtcgttccgacttcgcggcaaaacatacgactataagattcaatacgcctctatcaagaaattcttcctgcttcctaagaacgacgagatgcacacactcattgtattaggtcttgaccctcctctacggcaaggtcagactcggtatcctttcctggttatgcagttgaaactggatgaagaaatcagcctcgaactcaacatgacagagtcagttcttccgaaatttcgttttgatgtcgaccttggaactaattctctgtag

SEQ ID NO: 3371 - DNA, 225 bp, A.fumigatus
tacgcttgcgcgggctttcggcccccttggtcaagtaccggaaaatgcaagctcgctgagagtggtttgggatggcgcccttctggcggaggtgaaacgttcacacttgatagcaacaatattggagcagcccagtggagccgggcagcgaagggatatgaactaaaaattctatcgcgctcatcgggtgttattcaattagacggatttgatcaagaggtatga

SEQ ID NO: 3372 - DNA, 711 bp, A.fumigatus
gacttcgaacgcttgagtaaggcgttcaagatttggtacggcatcaatgttgaaaatcgcgagcatgcactacgagggtggaattggggtaaagcagaattcacaaaggcaaaactcgctttcaacgttcagaatcgacctgcctttgaaatcccgtattcggaaatctcgaacacaaacctggcgggaaagaatgaagtcgcagtcgagttcgctcttacatcagacggcgacgccaatgcccaaccttctggaagcacaaagaaccgcggtcggaaagctgccgcgggtccggatgagctagtcgagatgcgtttctacatcccgggaacggctgtcaagacagagaagggcattaagacagaaaatgatgagaacggagaagaagaggaagaaggcgaggaacagaatgcggccaatctattctatgatacccttatggagaaggcagagattggtgatgtcgccggtgacacctttgctacgttccttgatgtccttcatcttacacccaggtacgtctctttgttgaacgcacttttccgccattgcgtgctgaggaactctgcagaggtcgctttgatatcgacatgtacgaatcgtcgttccgacttcgcggcaaaacatacgactataagattcaatacgcctctatcaagaaattcttcctgcttcctaagaacgacgagatgcacacactcattgtattag

SEQ ID NO: 3373 - DNA, 978 bp, A.fumigatus
agagccgggtcccttttcatattctttcccaatcttgttctctgtaggacctctcaacgcatgagcaagggttccatcgctatggatactccaccagaaaaggattggattcagctggaccatggtcaggtccgcagcggacttggcctcgtgtcatccaggacgtctgaaaggctcaatcaagttgaccggattcgagccaatggggtgggggaccacatcgcgcttcctcagctggttgtctgtggcgatcaatcggcggggaaaagctcggtgttggaaggaatcagtggaatcccgtttcctcgccaggacggagtgtgtactcggtttgctacagagatcatccttcgccacgagccaaaccatcgccgaaacaccgccaccatcctccctcatatatcccgcacggaagaggaaaaggcaaagttgagcgccttccgccgcgaggtcagtgacctcgcgcagttgcccggcattatagaagaagctgccagactgatgggggtacaagggatgaatgacttggctgatgcaccgacttttgccgcggatgtacttcgcttggagattgtcggggatactggcttgcatctgacccttgttgacctgcctggattgatttctgtgtctgaaaatgatgacgacgtgcagcttgtcggcgatctcgtgaactcatatctggagaactcgcggtcgattatccttgccgtggtccccgcaagcagcgacgtggacactcagagtatcatccaacgtgctcgtcgatttgacaaggacgggttccggactgttggaatcattaccaaaccggatctcatcaatgacggcaccgagggccgtattgcaaaattggccaacaatgcagatcggacgaaactgaggcttggattcttcctggtcaagaatccacggccgattgatttggagaaggtcttcaccacgggggtggaagcgacagcggaggtctatccccac

SEQ ID NO: 3374 - DNA, 525 bp, A.fumigatus
attccgtcaaacccccgtggccaacggcgtggtgaccggcgccgcagacgacgcacacacacacgccgtaaccgacgtcaccggcggcgccgtacaatgcgccgacgtagtccagggtaccgtggtcggctcaggcgcacacttattcgagaacttcctcgccttgaccaacacgggaatcaccgcgcccgtcttgagcgagaaggcccgatgcccaagcacccgcagcagactcgcaatctcgcccgaatgcgccgtcacactcacaaacagatccttgccatcagtgcgctcaaacatctcatccagcgcactcttactccgcgcatcctgcgccgccctcgtctccccagtcaccccattccacagctcgtcctcctcactaaacccctcttcaatcgcccacccgggaaacgaccccgcaatgtacgatcgactccgccgatgatcacacgtatgcagactaatcccctcgcgcagcccctccatcaccagcggctcaaacgccgcagcgtccttgggtaa

SEQ ID NO: 3375 - DNA, 723 bp, A.fumigatus
  unsure (36): Identity of nucleotide sequences at the above locations are unknown.
tactggtccttcctagacggcaacggcacagcaacntggtccgacgcagacctcacacccgcgggagtagcccaggcgcaaaccgcccacgacttctgggcttcactgattaccagagaggggatacacacgccagacgcgtacttcgtcagtccgctgacgcgcgcgctgcggacggcgaatatcactttcggtgggctagccttacccaaggacgctgcggcgtttgagccgctggtgatggaggggctgcgcgaggggattagtctgcatacgtgtgatcatcggcggagtcgatcgtacattgcggggtcgtttcccgggtgggcgattgaagaggggtttagtgaggaggacgagctgtggaatggggtgactggggagacgagggcggcgcaggatgcgcggagtaagagtgcgctggatgagatgtttgagcgcactgatggcaaggatctgtttgtgagtgtgacggcgcattcgggcgagattgcgagtctgctgcgggtgcttgggcatcgggccttctcgctcaagacgggcgcggtgattcccgtgttggtcaaggcgaggaagttctcgaataagtgtgcgcctgagccgaccacggtaccctggactacgtcggcgcattgtacggcgccgccggtgacgtcggttacggcgtgtgtgtgtgcgtcgtctgcggcgccggtcaccacgccgttggccacgggggtttga

SEQ ID NO: 3376 - DNA, 924 bp, A.fumigatus
aagtactttgactggtactgggcatacaccggccgcgatgagacgaaagattcctgcctcggcatgccgcacatctgggacacgtccgccgggtggaccatccgcttcgacctcgtcgacaaccagggcttctttgacgcgctcgccgccgagacgggcatcgacgcgtcgtgggtgacgtttggcgacgaaacgtccgactacgtctgcgcggatccgggcgacgtacgaccgggcctcggccatgtgccctgccggaaactctactgccagaagctgaactacccgcagaaggcctccgatgatgcgatccacgtcggcaacccgaagaagctcatcgaggcgtccctgggcaacgtcaccgctctgcgcacgtcgctcctctcgtcctacctcagcgtggggctgtccttctacgacgacgggcccaacgatggcgcggcctccgacgcggtcgtcgcctactccatgcccgtcctgcaactcgccgaggccgtcagcagcatgaaggacattaaagacatcggcgaaaaggccaaggaggaagcaaagaagcaactcatcttcaagatcctcagcatcgtcttcatggtcctcccctttgtcggggaggccctcggccccctgatcggcagcgccgcgtccatcgctcgcattgcgctcctcatcggcgaagcgggcaacggggcgctgacggtggccgacatcatcgaggacccgtcgtccgcgccgtttgcgatcctggggctgattgcgggtgttggcagcgggacgggcaagctgtccaagggggaggcactggcggatgcgtccaaggcgcggggtctgttgaaagccagcgatctggccaagtttccgcagaggtttcgggatcaggatgctttggtgcaaaagatcgtcaagagcctgtgtgcgaggaagtag

SEQ ID NO: 3377 - DNA, 228 bp, A.fumigatus
acgcaagtgctgtccttccaccgcggggtgaagaatcagttaaatagttgttcgcacaattaccttggatacatagacagcttttctggtaactctggctatcaacataaagtgacctgtactatgatttgcacgctggacgtggagcagaataacgagtaccctgtagtccgtagatggggcagttgtggacggttcctaggaactggtcgtcatctacggccctga

SEQ ID NO: 3378 - DNA, 510 bp, A.fumigatus
agaaccactcggagtagtgctcgggatcgctccctggaacgctcccatggtcttgggcctccgtgcggtggtggctccaatcgctgcagggaatgtcgccatcctgaaggcatgtgccctccgccaagcggatgcggaacgcgagattgtctctggactgactatttcgcagggatccgaattgagcccccaaacccattacctcgtcgcctcgctgtttcaggaagctggttttccccctggcgtcctgaacttcctcttgtatcgaccacaggacgcgccagatattttcgatgtgctcatcaaccaccccgccatcaagaaatgcaacttcaccgggtcgacccagtcgggcgtatcatcgcctcgcaagccgccctggccctcaagcccgtgttgttagaactgggtggtaagaacttcgccgtggtactcgatgacgccgacttagatcttgcagcccgagagatcactaaaggcgcctttctcaatgtaagcccacacatctga

SEQ ID NO: 3379 - DNA, 612 bp, A.fumigatus
cttgggtcggtgaggacaacagagctaacattgatgcagaacggtcaaatctgcatgtcgaccgacttggtcctggtcacgaccgccgtggcttcggctctcgaagacaagattctggccatcctgcaggatattaataccccctcagtgctcatctccccggcagccaaatccaaggtcgagatgctcgtatccgacgcgcacgataggggcgctcaaatccatgcacaccccatggggcacgacgcctcgccgcggagcttccctcccacagtggtaacggggttgacgcctgagatgaagctgtacgaaatcgagtccttcgggccggtggtaggcatcatggcggttgagagggaagaacagtttatggccattatcgaggcggccaagtacggattgtcgagctcgatattttcccggaatcactaccgctcccttgatctcgctggcactatcaaggcgggtgcggtccacattaattccatgaccgtgcatgacgagccgactctgcctcatggaggctatggggatagtggttggggtcggtttggcgctcgctgggggttggaggagttcatccagacgaaaatcgtcaccctgcatccatag

SEQ ID NO: 3380 - DNA, 633 bp, A.fumigatus
accccggggtatttcggggagaccctcactcatcaaggcgaccaggttctgcgcaatcgagccaaggaaatcaagcgcgtgtgtgatgaagagatccattgtggcccccgatgggcagagattatcaccaacgacgccatcggtctaatcgaggagtatggcgccctcaccactagtatagccacgggctcactgccctttatccaacacggtcatgggttggtgcttaaagaaccactcggagtagtgctcgggatcgctccctggaacgctcccatggtcttgggcctccgtgcggtggtggctccaatcgctgcagggaatgtcgccatcctgaaggcatgtgccctccgccaagcggatgcggaacgcgagattgtctctggactgactatttcgcagggatccgaattgagcccccaaacccattacctcgtcgcctcgctgtttcaggaagctggttttccccctggcgtcctgaacttcctcttgtatcgaccacaggacgcgccagatattttcgatgtgctcatcaaccaccccgccatcaagaaatgcaacttcaccgggtcgacccagtcgggcgtatcatcgcctcgcaagccgccctggccctcaagcccgtgttgttag

SEQ ID NO: 3381 - DNA, 618 bp, A.fumigatus
  unsure (10),(20): Identity of nucleotide sequences at the above locations are unknown.
cggcgttttnagtacgcggntccttccatccccgtgctgaagacacctattcctcctccaccgcgacaggatcttaagactggtctcacccctagagggtcactcgagccgtcagaatccccgcccggacccggtccatgggagtatcccctatggatgcagggtgacgattttcgtctggatgaactcctccaacccccagcgagcgccaaaccgaccccaaccactatccccatagcctccatgaggcagagtcggctcgtcatgcacggtcatggaattaatgtggaccgcacccgccttgatagtgccagcgagatcaagggagcggtagtgattccgggaaaatatcgagctcgacaatccgtacttggccgcctcgataatggccataaactgttcttccctctcaaccgccatgatgcctaccaccggcccgaaggactcgatttcgtacagcttcatctcaggcgtcaaccccgttaccactgtgggagggaagctccgcggcgaggcgtcgtgccccatggggtgtgcatggatttgagcgcccctatcgtgcgcgtcggatacgagcatctcgaccttggatttggctgccggggagatgagcactga

SEQ ID NO: 3382 - DNA, 210 bp, A.fumigatus
ttccgggaaaatatcgagctcgacaatccgtacttggccgcctcgataatggccataaactgttcttccctctcaaccgccatgatgcctaccaccggcccgaaggactcgatttcgtacagcttcatctcaggcgtcaaccccgttaccactgtgggagggaagctccgcggcgaggcgtcgtgccccatggggtgtgcatggatttga

SEQ ID NO: 3383 - DNA, 1722 bp, A.fumigatus
  unsure (1373): Identity of nucleotide sequences at the above locations are unknown.
tcactcaattgcggatccgcccatccccgtgtgaaaacgatatatactgccttctcccagggttctcatcaggcttactcgcccttgaactctcacgagagccaggaaatcattcttctttatcctgataaggccttgcagacttcgaagttagtcttcgcaccttgcggaactccccccggcatcaagtttgtggccgaaggccttgcaagaaaagccgccttgtcgaccacgagcaactcactgctttccttggccaagatctatcaagacggcatgtccaatatttccggttcgggcattcctaagaaatctcctggcgttcgagacatcttggcactctattacctctccctgtcccttcaaccgagtccctccactgccaataacgttggaatcttgcttgctggaatccagaacaatgctgccggcaagagcctccctcgttcaagcggggaagcacaacaccctgaggttcctggagtggtacccggaagtgggatttcactggcgctagcatattacaactacggattgcatctcgattcgcgacacgcacatctttataccaatctgggtagccttcttaaagacatcgggcagctccaggcggccatccgcatgtacgagcaagcggttcagtgtgatggtaactttgatattgccttggccaatctggcaaacgccgtcaaagatgcaggccgagtcaacgatgcgattacctactacaaacgtgccgtcaaagtgaaccctgaattcgctgaagcagtatgcggactggcaaatgccttgaattccgtctgcaactgggtcggacgtggaggtattgccaatgggtatggtttccgcgaccgatggcatgtcactgagcaagggatgctccgtgatgcatctacgagcgaaaccggctctggctggatacagcgcgtcgttgatatagtaaatcgacagctcaaggagggggagtcgtggggtcttggtctactgtcacctaacacgatagagcaactgtgcgttcagatcgctccggcattggagagtcgccgctccgcctgcgggtctttggccaccatactacagtcttgggctggacaaaggtgggagggttcgcggatcgtcaaattgatcgagcgtgcaaatcgttcgatcacctggcagtggtaccaggaccgctatatctacggcaaggaatacccgctaaccaaatatcaacggccgcaactcccatcggggctcacagtgcccaatgcaccaactgttctcccctttcacacatttacctgtccgctttctgcgaaacagatccgtcagatttctcaaaggaatgggcttcgaatctcgtgctcgaccctacgttctccgtggcttccagntacggtgtacccaccgccgccgcctccaaatccatatctgaaggttgggtatgtttcgtcggactttaacaatcaccctctcgcccatttaatgcaatctgtctttgggttgcacaacccgtccagggttaaggcgtactgctacgcgaccactgcaagcgacaaatccgtgcatcgtcagcagatcgagaaggaagcacccgtgttccacgacgccagctgttggcccatcgagagacttgtgaagcagatcgtcgacgatgggatccacatccttgtcaatctcaacggctacacacggggagcgcgtaacgatcttcaccagcagggcgaagctcacgcatgggag

SEQ ID NO: 3384 - DNA, 810 bp, A.fumigatus
gtcagagaagtggaccggcatcgcagcaacgaaggccccggcttcagaagaagctcgcccgcttggggtgagggacgctctcaggatggctcgagacccccgcgccgcgaattccaggagcgcacccccactgccgccgaactcgataactcatggagagccaggatgcgccccgatcagccccctgccaaggaacccagtaaccctcgttctcccgccgatactcccgcatcccctgccgcccccgcctgtcgccgtaagttgaacctccagaaacggactgtcaccgacactccgtccagccccgctcccagcactgattcgaaagctagcccattcggtggtgctcggcccatcgatactgccgctagagagagacaagttgaggagcgtcgtcaactagcgctccgtcagaagaaggaagctgaagagaaggccaaggccgagaaagccgagaagcagcgtcaatccaaggagcaggccaagagcgagaaatctgtgcctgccgccgatcccaacggcaaggacagcatggacatccctcagggcggcaagaacttcgagatcctccggcaggccggtgaggatgaaggcggcgctgccgaacaagagcaaccggaagaagctcctgccgccgctgcgggtgatgaggcctcgaagcaggctcccgccagcaagacgaacggtaactggcgaagcggaggtcctacccagcccgccgaggctgccgcagacgaagaaggctggagcactgtcagctcgaggcaacgcaacaaccgtcgtggacagtctggacgtacattcgcatag

SEQ ID NO: 3385 - DNA, 258 bp, A.fumigatus
aaccctgcgattttaccaccaggaccccttcgaagaatgcaggagcattacctggcaggttcactgaccatatacaggcacgtgacgcttctcatctctgttttccgttatctgttgtcctatgtcaccttcaactactactcctctgctgcacaggtgacatatcgtctggcatttattgcggctgccggaacatacggaattgttgtgtacaaggcacacatcgcccgaggccgcctccagggcagcgttccgtct

SEQ ID NO: 3386 - DNA, 1389 bp, A.fumigatus
  unsure (1355),(1356): Identity of nucleotide sequences at the above locations are unknown.
tacgccatgcgcgtgtccttccagccccgggtggtgaagacgatcacggatttcgtccgctaccgcaatgcgacccgggacatgaacgagcgctaccccgatgccacgcctgaggaggtagcaagagaagatgtatgtatcatttgtcgtgaagagatggctcattggcaggagcctgcgggcgttggtgagggtggggcagcacctgctcagccaaggcctcggattcccgaaagattacgtccaaagaaacttccctgtggtcacatcttacatttttcttgccttcggagttggttagaaaggcagcagaattgtcccacctgccgacgtcccgtcatggcgcctacgcgtggccgcgatccacttcccgcaaatatcaatcttggtcaaggcaacggtggcgccggtccgcaaccaaacgtgccggctggcaatcagccttttggtcagaatggaccggctgataacctaccgagagcccgtatattccaatttggaccattccggattggttttggagctggtcggggtgatctcttccgcaatttccaccaacaaattcatcaaggcaatgccccggcgcaacaagcgaataatggaatcccgcccggtgcaaggcaaattggattcgggctcggttttggacggccaacccccgcgccagtaccccaagctctcccgacaaatacgccatcgaactttgtgcagatgcaaaatcagcttcaccagatggaattgcagataatgcaggaaatcaacaacctccgtgttactgccgaacagttgcattatgtgcgactgcttcaagcagagctacaaagacttcgcaatccgcctgcagcttccagcgacccgaacaccaccataaccccagcatctactttccaaccttcttcatctttgtcagctacattacgtcggcaattcacttcggaccctcaagcatcggccattccatccggcgattctcgactcccagagggccttagcctcccagaaggctggtctctcattcccctccaatcggctggacaggggccaagcggtatctcgagtccagttcctacaactgctccagaacctatccccacggtgcaagtgcgtgagggtccctctgtcaccgagaactcggcgtcggcagcgggcatgaatggggaaagctcgagtacagttgatgcagccagatctcctacttcctcgctgcctgactggggctctgaaactcccacagcagcagcgcattcgtatattgaatcatcacctcaaaatttggacaaagagctctttgggaagccgtcagaaacaaaggaatcgtccgcatgggatgatgaagccccgaatacggacctttnntacacgcctgggcagaagcatatcgtaacccca

SEQ ID NO: 3387 - DNA, 228 bp, A.fumigatus
tggttaacaggtaaagcgggtgattgtacaaacagtgctggcacgctttcattctcggaaatcgaagcaattctaaaggatgcgtctcgcaatgccacccagacctatgacgaagcctcttcggttcaaatcgtgacatttgatgggaatcaatgggtgagctatgataactgggcttcgtttcaggctaagttggactacgcaaattcccattgcattggagggtag

SEQ ID NO: 3388 - DNA, 765 bp, A.fumigatus
tatgttccccgacccggaacaagtcataaccccggatggggaaaatttgcgtcgattgaccagcacttttgcgtgttggattgcgagactaacacttttattgcggatcacgagctctcgcgagccaatcaattgcaccccccacgtccccggatgggcggttgcgtgtggtcattgggggattccccagatgcttgggtagtagaagcagacacaggacgaccagtgcagccgcttcgtggtcatcgcgatttcggatttgcgtgcgcatggtcgccagacatgcgacacatcgctaccagcaaccaagacaagactgtgatcatttgggacgcgcgcacttggcgaatcttacaaacgatcgagtcagacgtagcggggtatcgctctgtacgattctccccggtcggtggaggcccacgaacgctgctactggccgaaccggcggaccggatcgccatcgtcaacgcgcagacgtaccagactcgacaggtccatgatttctttggagagattggcggagcggacttttcgccggagggcagcacgatctgggtggcgaacacagacgagcatttcggtgggttcatggagtttgaccgccgacaatggggccagccgtacggaccacgggggcttcccaatgagtggatacgtgaggcagacctcgacgaggacgagcgatgtgtgctcagcgagcgggagcggcagatgaggttctggtggaatctgagcgatgaagagcacgaagcattgctgttgtag

SEQ ID NO: 3389 - DNA, 669 bp, A.fumigatus
caattttgtataggtgctccggtttacttggccgctgttttggagtatctcgctgctgaaatcctggagttggctggcaacgctgcccgtgacaacaagaagactcgtatcattcctcgccatctccagcttgccattcgtaatgatgaggaattgaacaagctgcttggccacgtgacaattgcgcagggtggtgtcttgcccaacattcaccaaagtaggtttcgcactttgttctcgtcttcgctatattttctaacaaatttccagaccttctaccaaagaagactcctaagagtggaaagggtcctagccaggagctttaattgtcctatttttctttctttcctgttcgggtttctcaatcggcgtgctttggtttctcatgatgtgataacggggttctggactgggcacaattatggctctgtttttcatgcttttacttatggttgtacattatgcttacgggcattgaatgataccgacagctttcttaatgaaatttgtctttcggagacgatgggaatattagtaaatctaacgctaagtagacataagggcctgtaccttcagtcgttcttacagtacaccactaaagcatttctgcactttaacataaatgttcaaagcaacgtccaggacagaagtttcgaagtacgttattag

SEQ ID NO: 3390 - DNA, 201 bp, A.fumigatus
atgcttctcaacattcagatgcccactaagcttggacggcgtactagatccatgtatttgcgtcaattggatgagaccacaatgagttccctactcgaagatagacatggcgttctaataacgtacttcgaaacttctgtcctggacgttgctttgaacatttatgttaaagtgcagaaatgctttagtggtgtactgtaa

SEQ ID NO: 3391 - DNA, 525 bp, A.fumigatus
  unsure (18): Identity of nucleotide sequences at the above locations are unknown.
ctcggaaattctgaattntgggggacccaggacgaatatacgtcttcagaaagcgccgatgaggatgaggagggaaatgaccctgacgacaacgcggatgaggagcacaaggcggaatcggaccttgccgataagggcaaagctgaggtctcccctccaggctcaccgtcgcaacgaagcgaacagacaacccagtcttcaggatctcaagccgcctctcaatatcttccgttctccattctatccccagaccctcactccctcgaagctggggacgagccagttggtcgcaaatttccctgggggtttgccaacccgtacgaccccgaacactgcgattttgtgaagctcaaggactctgttttcaccgattggcgcactgaactccgcgaagccagtcgtgttgtttggtatgagcgctggaggaccagccgtctgaaccgcaacggcatctccgcctcgccgatgcaaaagatttacagtgggcgaatgggcccttcccatgacggccgccgaacacggtag

SEQ ID NO: 3392 - DNA, 546 bp, A.fumigatus
gcactgcgaccaagctggccctctacggtatctttggattgggtcttttgttcgtcgttcccttctaactcagtagctaatcgcatggccgctaactgtggcagtatctccgcgatcaccatcatccgcatccgcgtccttaccaccgtcgacttcttcgatctcccatactcgatgatctgggctgcgttttggagcgtcaccgagccggccctggccaacttgaacgcgtgcgtgccgatgctccgacccgtcttcaaggccgcgttcccgaccctgtttgccagccgcaaaatgtactctacgcagccggggtctggagcctccgggatcaagaacaaagctttcaagcgcatgaacgaggtcgaaagtgaccttcagctgacgaatcttacgcagttggagccggttcgaacaagccgcgaggggagaatatcggaacatggcgacgacgggtcgcacgatgatcggtcccaggatggccgttcgcaggatgagtcgacccatgtcccgaggagtgtcattgtgaacaggccttggacttag

SEQ ID NO: 3393 - DNA, 396 bp, A.fumigatus
gcgcgtttccttccagccccgtcgcgtgaagacaacgccatggtcctcgccaaactgagctatctcttcttctacctccgcatcttcgtcacaaagggcttccgcatcgccgcctgggtctgcatgggctgtgcctgtgcctactggaccggcagcatgctccagatcttcttcatctgccagcccttccagaagaactggaaccccacgctaccgggccactgcgccagccagaacgtggccttctcgaccatcggcgccttcaatctcatcacggacgtcatgatcatggtgttgcccctgcacttcatctggaagttgcagatgagcactgcgaccaagctggccctctacggtatctttggattgggtcttttgttcgtcgttcccttctaa

SEQ ID NO: 3394 - DNA, 813 bp, A.fumigatus
cggaccccatttattgtcctctgcatctatgtgtcaattcatctttttggggttttggctgacatttgtactcaattttccagtctcgaaaccagttttgcttcccactggctgcacgaaaccacactcccgttagccaacctttgtattcgacttccccagacctttcagagacgccctttcagccaatctctatattttttttttctcctagattgctgtgctcgtgtcgcgccattgcctatggaggtggccgcaagtcgagactcagctcctgttggtccgcctacagggcctgatgccacaatcaccaatggcgaccaagatcttctactggatgattcgctcatggacgatggacgttcaagtagtctgagcgacatcgacgatgtcttggataatgaaccctcggactacgaagagtcgcccaagcccgagaagttagcagcagagaatgactctgaagctgagacggagcgcatcgaagattccccgaatcattttcgcagaaccaacattgtcgtgagcagttatggccctagccccagcaaattggcccaatcgacgacgtacgatgatgccgtggacggggacgaccaaattgaggattcaccgagcaaacctcgctctaagcccaacggaatccttgaatccgccgaagacatactcggtttggaagactctacattatccgaaagttacgggaaaagaagcgcaaaacgacccgagtctggcgcggatgtggaaggcgagacgggtggacgaagcgacccgcctcaaaaaacccggcgggttcgtgaaaaagtgaattga

SEQ ID NO: 3395 - DNA, 315 bp, A.fumigatus
tcttttctatacaccatcactgagatgcgactgccatgtgcccctagccttgcactgagggcagcgcggacgccattggcgttcgcccgcaatggccagaagcactcactgcataccggcacctacaacgccgctgttataggaggtggcatcacaggtcttgcgacggccttccgcttgtcgcaggacccaaaatgcacccatatcaccctgtacgagaaacaacagcgagtcgggggctggatgatgtcggaaaccattcctctcggcgacgatgatgggaatcttcaccacggggtggaaggaccgcgattg

SEQ ID NO: 3396 - DNA, 216 bp, A.fumigatus
ttgaacatttctgagagagctgatggctacagttgctcattgatagacgagaatttacgtgtgacacatttcgaaaccgttcatgactacctaaccagagtctaccttatttacaagacaaccaacatgatgatgttctgtcattacactgctcccatggatgaattggtgagaaatcaacaaacgcccttccagccagccatcgtccacaaatga

SEQ ID NO: 3397 - DNA, 282 bp, A.fumigatus
caatgtttatttgttcttagcttatgcaagttgactgtgccgcaatttccaaaaagccagccactcattaaggaaaaatggtaccttaccatcagggcattactaatgcagaatcatgaagtaaaggaggtcatgagtcatgctgcttatctatgcctctttagtatgatgtgtatcatcatgattgcactacaagtgacggacgtactatgtacctatcaaggcaggtcattctgtgacgttgaggtcactaacgtgtgctcaggatgtgtggagatctga

SEQ ID NO: 3398 - DNA, 636 bp, A.fumigatus
caactttcgtcctcatattccgaatctatcatccgggatagcagagtgttgcgattccatgacagttatttgcgttcgggggcgatgaactacccaccatctcataacggtcaatatcctccgcagtatttgcaacaaccgcagcagctactgtataacaatgccgactcaaacgtttcgccatatgagtatggcaaacctgtcgcttacccccagactattatttcgccatactcgtcctacgggcaagcatataatatagagcagcatcaacatcaaccacaatcgcaccaccaacagcagccgccgcaacagcagccgcaacagcaatatgtgaatccatctgacgtgttccatcaaccgcttcttccccctgcctcgtcatctcaacttgcccatggctcaacccaatatggtgcccaacccatggtttctgttgcaggcaacagcaaccgttccccagctgtcgcaagcgcctcaacgtctgcacaatcaacacccgcgccatcgacacaatcggcatatcagacagccccaaccctaaacccaaggaataatgtcttcaaccagtactctcaggttgctcttccagcgccttcggttccaagttcaaattcagtagctaccgctccttct

SEQ ID NO: 3399 - DNA, 252 bp, A.fumigatus
aggtctcttctactagtatattcagttagtaaactagcagtatatttaaagactaatttactagctaactataactttatctttaacctactagatagattaaccttaaataaagccactatatatatatatatagttaactataagttctcctttattaaagtctgcaataaaacacccactctaattatagtcacttattatacttatatagggattatctctaatactaactttatcactgcctactaa

SEQ ID NO: 3400 - DNA, 396 bp, A.fumigatus
cactctactctaatcataatgtctgtctccattactgcggatactcctgtcgcttctgccaccaaaccggcagacgtctcattaggctccaagggtagaatgccagaattcagtctggctggcaaggtcgtccttgtctccggtgctgctcgtggtcttggtttaacccaggctgaagcgcttttggaggctggcgccaaagtgtacggattagatcgtctggaggagccagtgagtaaccctgttttctacaaccttgctcatggcgcatcctgtctaaccatgctggatggtgatagtccgccgagttcttcgagattcaaaagcgagccaaggaggaactggggacggagttgcactatcgtcgtattgatgtgcgtgacacggaactgttga

SEQ ID NO: 3401 - DNA, 417 bp, A.fumigatus
tccgccgagttcttcgagattcaaaagcgagccaaggaggaactggggacggagttgcactatcgtcgtattgatgtgcgtgacacggaactgttgaccagcaccgttgagcaaatcgccgatgtcgagggccgaatggatggcctgattgctgcagcagggatccaacaggaaacccctgccttggagtacacggccaaggacgcgaacaccatgtttgaggtcaacgtgacgggggtattcatgactgcccaggcagtggccaagcagatgattcgctttggtaatggtggtagcattgcactaattgcgagcatgagtggtactgtcgcaaatcgggtacgtttctaccagttcctttctagagtggaaaacggggatccccgggtttcttccctttccccgcttctgacttaa

SEQ ID NO: 3402 - DNA, 312 bp, A.fumigatus
ggtctcatttgccccgcgtacaatgccagcaaggccgctgtcatccagcttggtcgcaatctggccatggagtggggtcaatatggcatccgcgtcaacaccatctcgccgggctacattgtcacgaaaatggtcgaagatttgtttgtccagttcccggagcgccgagaagaatggcccaagcacaacatgctgggccggctgtctacccccaatgaatatcggggtgccgcagtctttcttttgagtgacgccagcagtttcatgacaggaagcgacctgcgcatcgacggtggccactgtgcgtggtaa

SEQ ID NO: 3403 - DNA, 561 bp, A.fumigatus
gtatgtctgtctctatccattaaacagccttggactgacaactgtagcgggcgcattattgccacaggcattatagaacttccgcctattcctgccggccagaacgggactatcaagctgccatctgcgcctgctaccgcaattcccgggaaggtgtggctcaccatgagcttccttcaaaagggagagacagcatgggccggaaacaactatgaagtcgcctggtaccagcagtgcctcaagtcctcctcaccacgtttctcattggccgtacttgatgaggccttgacgcactcatccacgaaaacgtcacacagaatctccggtgcctcatttagcctggaattttcacgagaaacgggcagtctctacgcctggacagccggcggcctctccctcctcgaccagtcctcatccaccggtgccatctctcccggatttccgcgcccaccgaccgacaacgacatgtcccatgacctcctcgaatggcggcgcttcggactagacactctcacctctcagctacgcaagatgcagtcttcaccactggctggaaggggg

SEQ ID NO: 3404 - DNA, 1341 bp, A.fumigatus
gctctgccaacaccagccatgggcaaggggactaggagcaatcgttccacgggcagtacggtgcagacagagaagtattcgctgggggaaaagcaagacaaactcgagggtgagctttcgttctccaccccgaacaaatggacagcggagacacccaacctatacaatctgtgcatcgctctctacgtagacggtgccaaggaccctgttcagacgatcaaccaccgtgtcgggttccgtcaggttgagatcaagaatggcaatatcactgtgaacggcgtgccggtgatgttccgcggcgtcaaccggcacgaccaccatccacgcttcggtcgagcagttcctctgtccttcctgcgcgaggacctcttaatcatgaagcggcataacgtcaatgctctccgctgctcgcactacccgtcccacccccgtctatacgaactctgcgacgagctcggcctatgggtaatggatgaggcagacctggaatgtcacggcttctacgatgccatcgctcgccccctagatatccccgagtccatggactacgaggagcgcaagaagctcaccttcgaccaggcggcgcagttcactacgaacaatcccgagtggaaagaggcgtatgtcgaccgaatggtgcagatggtgcagcgcgataagaaccattcctgtatcgtcatctggtcgctcggcaatgaggcgttttatggctctaaccaccaagccatgtacgactatgtcaagcaggttgaccccagtcgtccggtgcactacgagggagacatggaggccaagacggtcgacatgtactcgtatatgtatccatccctcgagcgactagtcggttttgctactgccgagggagacgagttcaaaaagccaatcgtgctttgcgagtatgctcacgcgatggggaatgctcctggtggcttggaagagtatatggaagcctttcgggcccaccggcgtctgcaaggagggtgggtctgggagtgggcaaaccacgggctctgggacgagaagaagggatggtatggctacggtggtgactttggcgatacgcctcacgatggcaactttgtgctggacgggctgctattcagtgaccacaccccaacgcctggtatcactgaactcaagaaggcctatgcgccggttcgggtgtggcctggtgaggacgggactctggttgtggcgaacgactacaattttgttgggttggaaggtctccaggcatcttacaagattaaggtcttgggagataggtatgtctgtctctatccattaaacagccttggactgacaactgtagcgggcgcattattgccacaggcattatag

SEQ ID NO: 3405 - DNA, 318 bp, A.fumigatus
gacgtttgtgggacctggcaatggtggggatcaaagctcaggcttgtctacttggcctctatactgttcacatttgcttctgcggagactttggcgactgagtatctggtcatgggtgtgtggtacatcaacgaagagaacgtatatgtgcttcgatcggtaaagggcgtttgtgcgtgggcaccaggatcgggttactgtgcgagaagcttgctgcgaattctggatcaaaaggtgccgaacatctgcaggtcgattatcgctcgtgaaccgccgcctttcctcggggaggcggcccctatttttttttctctataa

SEQ ID NO: 3406 - DNA, 264 bp, A.fumigatus
tctggaattgggggatacgacagagacggagcaggggaagcgggtcaaggagtggctgtcgaaacggctgttctgacgtcgagctggatgtgttatgtgtctatttataaatctcttcgtacatcgctatctgaaatcattctcagtctggtctgcatcactggatctgtgaaatcttacggaactcgggtcagatggatttgtatacatcactatccattaacatggttatacacgacatgtcaacattcacagggtagatag

SEQ ID NO: 3407 - DNA, 186 bp, A.fumigatus
ttaaagatacatagatatgtcctaccacccacccaccaagatgtagggaacgtatttcaaggaaacttaagcggatgtcttcacaccatcgactggggcaagggctcctacggccactggatcggagacgccaaagcagataacgtcctgatctggtatcacggtcagcatcactaccatttgtag

SEQ ID NO: 3408 - DNA, 648 bp, A.fumigatus
tgtaaccaatttgacaaggacataggaggaggctttgccctcccagccaacatgggctatttcaaattcttcgccaacctagtcgaccacgccgcgacacacaacaaatccctcgccatcttcagcctcacctacaccctcgccccgcaggcaacctacccaacccagctccgccaggcagttgattgcctgcgctacatcctcgccaacacctcgcaccaacccagccgcatcttcctcggtggcgactcagcgggaggcaatctcgtcggcggcgtgctgtcgcacctggcgcatccgcacccgcagattgaccctttgaacgtatccgagaacctcgcgggcgcggtcatgatcgccccctggacgctaatggacacggactttccgaaccggaagattgactctagtggggatctgatcacgcctgcggtggcgggtccgtgggcgagggcgtacctgggtacggcgaccagagacgtctatacggatttgtcgaaagcggagtctgactggtattctacgtttccggtggcgaatgtgttgatttgcgcgggggggaatgagattctgttgccgattatccaggatttcgcggagaagttcaaggtatgtacatgcttgattcttggggtgagtggttgctga

SEQ ID NO: 3409 - DNA, 1137 bp, A.fumigatus
gccatacttataacacaaaaggttggaaatgactttgttcgtggagtcttcggaggagaacgcaaacgagtctcgataggtatgctgcagcctgtttcgttaccgttccccaaggccatccgcgagtgtgcttacgtttcaactaagtctgaaatggctctcgcttgtacgcctctcgcagcttgggataattccactcgtggactggactcggccaccgctctcaagttcattgaatctctccgactactggcagacctggctggaactgcgcatgccgtggcaatctaccaggccagtcagagcatatatgacctctttgataatgtcactctcctctatgagggacgtcaaatcttcttcgggccaacatccaccgcaaagggctttttcgaacggcaaggctgggaatgccctcctcgacaaacgacaggcgactttctcacctcaatcacgaacccgcaggaacgacgcccccgcgctggtatggagaaaatcgttccacatacaccagaggattttgagaagtactggctccagtcgccagagtatcgacgcctacaggagcaaattgagagatttgagactttacatcccccaggcgacgatgagaaagctgccgctcattttcgaaagaggaagcagggcgtgcagtccaaaagcagccggaaagggtccccttacctgatcagcgtacccatgcagatcaagttgaacactcgacgagcataccaacgattatggaacgacatctcctcgaccctgtcaacggtgattggtaacgttgtcatggctctcattatcggttccgttttttatggaactgccaacactacagcaggcttgtcgtcacggggcgcaacgctgttcttcgcagttttactgaatgcattgacagcaatgtcagaaatcaacagtctgtattcccagcgcccaattgttgagaagcaagtgtcctacgccttttatcatccttcgacggaggcaatcgccggagtgataagtgacattcccgttaaatttgtccttgctgtggtcttcaacatcatcctatactttctagcgaaccttcgccgggtatgcatcacaattcttcatcctacttccttatccctttcatcatcatgtttgtcctga

SEQ ID NO: 3410 - DNA, 189 bp, A.fumigatus
tccgaaaagtgttctccattacaacggtaccaatatcttctgaaccatcccctgttccaattcctcctcactaacggcgacttcgaaggcgtctctcaaacacgcatgatgaaagaattcaaaggcgaaattgtctataaccaggaggtaagcctgcaggaatcgtgctcgcatctgcgcttgcgctaa

SEQ ID NO: 3411 - DNA, 375 bp, A.fumigatus
atgagcgctccttccagccccgtggtgaagacggcagacgcacaagggagaggtctttcgcctccacaggccgggattgtcttcaaacagttgaatgtctcgggatctggggccgcccttcagctacaggacacgcttggctcgaccttggcgttgccctttcgactcccggaactgcttcgccagaggcattctccatctcgactgatcctcaagtccttcaatggcctgatgaagagtggcgaactgttgctggtgcttggacgtccaggagcaggttgcagcaccttcctcaagacactctgcggtgagactcatggacttgatgttgatccgaaaagtgttctccattacaacggtaccaatatcttctga

SEQ ID NO: 3412 - DNA, 240 bp, A.fumigatus
gcctgcaggaatcgtgctcgcatctgcgcttgcgctaacgtcaactgttcttccttgcaggtagataagcacttcctccatctttctgtgggacagacactcgagtttgcagccgccgctcgcactccctcgcaccggtttcacgatatgtcccgggacgagtatgccaagtacgcagcgcaggtgatcatggcggtatttggcctgagccatacttataacacaaaaggttggaaatga

SEQ ID NO: 3413 - DNA, 291 bp, A.fumigatus
aagagtctctgcccctcagccacgtcccatagaccgcgatctgtgcaaatggccaacgatatcgaaacgagcttccaggccgccatcgatgcgggccaaatcaatggcgccgtgatttgtaccaccgacaccaacggtacctttgtgtacaatacggcgctgggccagcggacattgctctccggcgaaaagctcccgcagcagctaaaacaactgctctacctggccccgggcaaccaaactggtccccgctattgcggccccgcattgcgttcaagaatggattactga

SEQ ID NO: 3414 - DNA, 234 bp, A.fumigatus
ggcgcggctccttccagccccgtggtgaagacaaggcggaactgctgcaggcggaactgcgggcccatgaggtttgtttattccatgcggaggagcgttgctgatgggagttatagcttgagattccggatgtggcggttgactatgaacgggtgtcgcctcaggcgccgcaggggaccccgcctgaaggtatgtacttgtttttggctgtgtgggttctatggtccgttctaa

SEQ ID NO: 3415 - DNA, 183 bp, A.fumigatus
agttttgtcattgacgtcacgccagcacctgcatataagccatcgagcattgcgggggaaactgtgtttctgtacacctacactttccaagcagagccagctagcctttcgcccaatattggatcactagtctccctagtggaagccatgagaaagtacagaactcactttcttatgagctga

SEQ ID NO: 3416 - DNA, 561 bp, A.fumigatus
aacatgctgcggcaggcgtgctccgtcgcgcagcggaacgaggctgcagaggggagcattgtggggagcatcatgttttggattctcggatgcttcatcgccattctcgactggcttgtcacgctgttcaaccgctacgctttctgtcacattgctctgtacggaaaggcatacatccccgcggccaaggacacgtggaccatgatgcgagaccgcggcattgacgcgctcgtcaacgattgtctcatcgggcctgtgctcaccatgggctccgtgtttgtatcatacgtctgcgccttgctggcgtatctgtacctgcaattcaccaagccgagctacaacgccgatggaaacttcacggccgtcatcatggccttcgccttcgtcatcggcctgcagatctgtcaaatcttcatgactcccgtcagcagcgggatcgaaaccatcttcgtggccatgggctgggacccgcaggttatgatccgcgaccacccggatctgtactaccgaatgatacaggtatatcctcgcgtgcagcaggcgatccagccgtctgcctag

SEQ ID NO: 3417 - DNA, 195 bp, A.fumigatus
ccaaaactctcgcacagtggaatcattccgctgccctggttgtgcctgcgtttcgatctgcgtcacccgatctcgcctatcacccacggactcgctcaggcttttacctgctccttctcaaggatcgatgaatgggaaggcgttgagctctcaactggcgtgcttggtgatgcttcccccttcgtcaacccttga

SEQ ID NO: 3418 - DNA, 297 bp, A.fumigatus
attgtttactcgaccatcctcactctctggcgaccccagaactacgactgggcggagttcaagaaagtgaaactggctctggaggaactcggaggtgatctgacaaccgtacacaaccagtcgtcgaagatcctagcacccaacgcccaagaactgaaaagatggggccgcatcgccgcgttctggtccatagccacttttttgggacattgggttctatggccactccctatgtacggggcgaagtatatctttggcaaaaccgtgagtatccagccactttcatgtgaaaaatag

SEQ ID NO: 3419 - DNA, 189 bp, A.fumigatus
gctgagaaccatcgaagtggttttctttcacagcaactggaatgtgtctattgtcaggctataaatggaagctgcgtgactattctttctctaagtgtcatcattcggattaggactaagattctcagcatcgacaagatctctggactggaggagtgccatgttctgcgctatcagttcgggaggtag

SEQ ID NO: 3420 - DNA, 513 bp, A.fumigatus
gataaacacaaaacctcttcaagcgaaaaccctcaaaattcgacgccgccgaaacgattatcccacacgccgacgtcaacccgcaacgccaaacgacgtatctccttccgcagctctcgcttgtcgaccggctccgataggatttcactgaatatttcccgttatcggattatcttcagagtcgatatgtcgtacgaagagcgcgtcaatgcgcaccctaacctgggcgacgagtccgatgtcgaggaggaggccctcgtcaacgactaccgcgagcaagtgaattttgacgatggcatgagcgagctggatcggacaacatcccttggaactggttcccaaacgcaagatctccaggctcagcttgccgctgctgcaacccctcttgaataccaggccactctagagaccaagttcgcaagctatgacaactactgcagcttgttccactacatcctgaactccgaaggccctgtcgagctggaggtgccatctgtacgtccccatctctag

SEQ ID NO: 3421 - DNA, 372 bp, A.fumigatus
tactactgggcctgggatgtgatcgatgaattcatctaccagttcgaatcgttctgccgctaccgtaaccgtgtcgctcgcagcggctccaacgaagaggaagcacaactcctgcgcgaaaacccgaacacatggggctgctactccgttctcaacgttctttactctcttattcagaaatcgcaaattaacgaacaattggctgctatcaagcgcggagaggatccgctggcattcgctggcgaatacggctcccgccctctgtataagatgctgggctacttctctatcattggtctgttacgtgtccactgcttgctgggggacttcagccttgctctcaagaccctcgtcttcaccacggggctggaa

SEQ ID NO: 3422 - DNA, 1800 bp, A.fumigatus
ccccgtggggcacaattagctgtcgttgcacatataaggcatatctacactgattatgatcgtcgtctgaagactacatcgtttcataaagcccaaagcgcggttaaagagcccacgttagctaagttagtggaatggcgaggtgccgatgaaaacggaaagactgttcttgaggatgtttttcgcgaggtcattgtgatatccgatgatgatgacagtgatgccgaggaaggagaggtctctcgttcgatcaatcgagatcacagtatcgaaatcgtctctagccaccaacgagccgatgatctacaaatgaggccggtcagcttctctcatccaactgtgcaggattcccatttggacatctcagacgatgaacctccgcctggtttccgtttcattcctgaatcgccgaagaagcggcggctcgatcgccgtggcttcagcagatatcatgcttgggaccgtgccctcaaccgatacagaaaggggacttaccaccagcataggttttacgcagactctaccggccatccagggcctctgttgaccgcacgacagcccgtacaggaaaatatcacatttgacccaggagctacctgtcatccacacataacagcgctccgccacgtctctgttgacccacacatcgcatctaaaacagaagtccttcaccacggacaaaggagaactctgacacggacgttgaaggagaatcatgtaagtttgcagagaacggatgccgagcggtccggacagaagacacacataaggcctccactgatatctcatgagccatccaatccgggaacacttctgcatttaccaattccgagaagcgatgccagtcgcttggcggatcgaactgaaggggaacgcgtttcagctgatcaacggagagcgcgttttgaccagcggcttaattctccaaatactcctgtcttcgtcggtggtcccacggagatccaatggcggggcagagtcccatccggagctatgtcaaggatccctggtcctccatatcttgaaatgcagccgaacccgcaggatcacatattaccatctattgaaaccccacctttgccacagcaaataaggcgtccacccagtgcccacctagatcaacttaccaggaggataactggaggattcactattcgttcagtaacacctcgccacccggctcaggaggactcattacctcagggagaatcggatgttaggattccagcatcgaaaagaaggcgagtggccaatcacgaccctgctacttacattgagcctcgctccgatgttgcgccaattgttcctgttggtactcatgcgaaacagcaatacgttgatctggggaatgcgtcccctagatcattgacttcccagagcggggctccaatctgtaggagatacatggtacccgtcaaatccccttatcttgcagagcgctatccagagggatcccagggcccctttaactatgcacaacccgtcccagaagtcgtggttgatcaacggcattattctaactttaaaagcaaatcaacagcctgggggcatcagccgaagcaccagctggagcaataccgggtgctgcatcctcttcaaggatctcctgggcaggttcacgtttcatcagatgcctgctatgctactgcctcttcaaatgagagctgcaatgctgtctccaagctgcctgacaccgcttcagaagctggacgtgtttatgaaagtcgtcgaatccacgaagaagctggagaagcgacttatatgccagatctgcacaattggtggtctacaccacgtgcg

SEQ ID NO: 3423 - DNA, 285 bp, A.fumigatus
catcggatactcgttctagccgaccccgttcaggagctctacctgcgccaactccaggcgtacaagcccacgcccatcaagcccggcgatgctgaggcccacgtccagaagttctccgctcctgctgcgccccagtcccccgaggaggccaaccttgccaacgatttgaaggcctacgagagccaggatgttgaggttgagggtcaggccgccgccggtgaggccgcccccgttgaagagagctggttcgaggaggagcctgaggaggagaccgctcaccactag

SEQ ID NO: 3424 - DNA, 192 bp, A.fumigatus
gtaaagacaatgttcaacttaaatttcatatcatctaccgagttccagatcatggtaaggaatgtgcatgctgtgattcaagcacagtggctattgcacaatggtactgcccaatatatgcacccgcctaaccatttctcgtccattaccaaggccatgagcctcctggcgcttcgaatcaagatgagctaa

SEQ ID NO: 3425 - DNA, 333 bp, A.fumigatus
acacaagttttacgttgtataccaataccatcatcaatatgtctgacaccggccgcaaggatttcaccaccagtaggcgccccagcccaaacaacacagatcaattctcattccgcaacagaggctcaggagaagatgactcctgactcccaaaagtccaccatggacaagatgaaggaaaccgtcaccgacgctaccgaccgcctcacaggcagcgcgcaaggcgacagccaaaagtcgtactcgcagcaggcctatgactccattcgtggtggagcggacaaccagacccatggtagcagcaccgagacaatgtatgttccccccgtctga

SEQ ID NO: 3426 - DNA, 201 bp, A.fumigatus
tgtgccggttccgtgtacgtcggttccggcggatgttgtccctactggagtctgtctaagtcgggccgatacccacttcagactcttgtgcacttgtgcattcgtctagacgtctactgctccggtcacgaagtctgtattgaccaaaatggcgcgcctacagagtatggcagaatacatcgcttcactgatgtggggtag

SEQ ID NO: 3427 - DNA, 528 bp, A.fumigatus
gtacattactggcagcacggccgtatagggcgatatgttgtggaaagcccaatcatcctgggtcacgagtcatccggcattgtggtagaatgtggaagcaaatctgggtttgctgtaggcgatcgtgtcgcactggagcccggcgtcgcgtgcaatacctgcagccattgccgtgcgggcagatacaatctctgccgggagatgcgcttcgccgccactcctccctatgatgggacacttgcgacttactatctcgttccagcagagtgctgctataaactgcctccacacatctcgctaagagatggtacccttgatgagccgctcagtgtggctgtacacagttgtcggctcgcaggggaaatgcaggggaaaagcagtggtcgttttcggagcaaggccggtccgcttgctctgtgtggccctggcgcgtgcgtttggagcggcaactgtacttcttgtgaacgttgtgcccaaaagaatcgggttttggctgaaaaacgggccaccccttccttaccagatgac

SEQ ID NO: 3428 - DNA, 195 bp, A.fumigatus
tcttggtcgagtctttgtccctcctgctcacctcgaatcacccaggcggtaaaccaggcctttgtcttgcatcccggagggtcatttcactatgagcagcgcgctgtacctaccctgggatcagatcgagatgtgcttgtccgagttgtagcaaccggcttatgtggttcagatgtgggtgcatcactcccttga

SEQ ID NO: 3429 - DNA, 225 bp, A.fumigatus
gagatggtacccttgatgagccgctcagtgtggctgtacacagttgtcggctcgcaggggaaatgcaggggaaaagcagtggtcgttttcggagcaaggccggtccgcttgctctgtgtggccctggcgcgtgcgtttggagcggcaactgtacttcttgtgaacgttgtgcccaaaagaatcgggttttggctgaaaaacgggccaccccttccttaccagatg

SEQ ID NO: 3430 - DNA, 1029 bp, A.fumigatus
ggattcgaatgcacccccgttgatccttccagccccgtggtgaagacacagttggaaagaagaagaaaaagaaggggaaggtatggcacgttccaacggcccttgaggcatcgtcttttaactcgtgagcaggaggtcgatccgccggccgttgaggcaccatcaaacggctttcaggatgtcagtctgaacgatagtggggcccctcagctagacctgcctcttgatcctcctgcaggcagcaatggtggcgttggcttcaatttcggaggatggggcaaggattggaacaccggaagtaaatggggtctcgactctctcaacatgaatggcaacgccaatgccgatgatggaaatggtaccaacccttggggtcctattggcagtaagaaagacacttcaaagacccccggtggctttgatttcggggactttggagactcaggtgatgccgtgcaggaacctcctgcagaaaagaagaagcccgaagaggatatttgggctgatttcgcgcccgttagcgccaaggataagaagaagaaaaagaaagatcttgtggaggaaatccccaaggaacctgagcctgagcctgagcctaaaccgctaccagctcctgaaccagcacctgcggtagatgatagctggatggccggtctttccaagaaagaaaagcgaaaggcgaagaaaaatgctaaagttgccgaggagccgccggcccctgagcctgtcattgaagaaccgaaaacagacaacgtgtggagcacggctgaggaaaagaaggagccagaaaaggcgcctgagatggccgatgataatgactggggctggggtgttccaaccaagaagaaggacaaaaagaagaagggcgtactggagacagtcgctcccgtggagtctcccacccctgaacctcccgctcccgagcctgcccccgcagaagacgattggggaatcgcttggggatcaattggcaagaaggacaaaaagtccaaaaagggggcggttgtcgaggagcctgcacctggtctt

SEQ ID NO: 3431 - DNA, 822 bp, A.fumigatus
agaccaggtgcaggctcctcgacaaccgccccctttttggactttttgtccttcttgccaattgatccccaagcgattccccaatcgtcttctgcgggggcaggctcgggagcgggaggttcaggggtgggagactccacgggagcgactgtctccagtacgcccttcttctttttgtccttcttcttggttggaacaccccagccccagtcattatcatcggccatctcaggcgccttttctggctccttcttttcctcagccgtgctccacacgttgtctgttttcggttcttcaatgacaggctcaggggccggcggctcctcggcaactttagcatttttcttcgcctttcgcttttctttcttggaaagaccggccatccagctatcatctaccgcaggtgctggttcaggagctggtagcggtttaggctcaggctcaggctcaggttccttggggatttcctccacaagatctttctttttcttcttcttatccttggcgctaacgggcgcgaaatcagcccaaatatcctcttcgggcttcttcttttctgcaggaggttcctgcacggcatcacctgagtctccaaagtccccgaaatcaaagccaccgggggtctttgaagtgtctttcttactgccaataggaccccaagggttggtaccatttccatcatcggcattggcgttgccattcatgttgagagagtcgagaccccatttacttccggtgttccaatccttgccccatcctccgaaattgaagccaacgccaccattgctgcctgcaggaggatcaagaggcaggtctagctga

SEQ ID NO: 3432 - DNA, 219 bp, A.fumigatus
ttgggtcaacgctcgaacaagcggcctttctgcaacaattcgatcacccttctgatgcagtcactggaggcattgtctcgtcctataatggtgtttcatctcgtcactgctctttggatgaattttaaaactaacatgctacatgaggaactattctggggtctattgcagccccctacatctgcgacccctttggccgccgcccagtcatgtatgtag

SEQ ID NO: 3433 - DNA, 651 bp, A.fumigatus
aaaaggccgcaaggacgccggcaaagccgtgctcaaccggctgcatctcaaccgcacccgcaccaacaccgacctcatcgagtccgagttcacccagatctgcgagagtatcgcctccgactcccgcaccgtcgtctcctcctggcgccagctgctgttctcctcgcccacctggcgccaccgtgtgctcctcgcctgcggcatccaagccttcacccagtgctccggcacaaacgtcatacaggtctacagcccacgcatctaccgctcgctcggcctccccacctccaccaccctcatgatcaccggcgtctggggagccctcgcccagttctggaacaccgtgttcctgctgttcatcgaccgcgtcggccgccgcaagctcctcatcccttctctcctcggcatgggcgccgccctctgcgtcgaagccaccctcgcccgctactacggcaacttcggcccggacgcggactcctcggtatctgcctcacccgcagccctccgcgccgccatcgccatgttcttcgtcttctctctctttttcaccgctctcggcctcatctcctggctgtatcccgccgagatcttccccacggccatccgcgcccgcggctcgtccatcgcgaccgccacaaactggagcctcaa

SEQ ID NO: 3434 - DNA, 252 bp, A.fumigatus
gggacgcactgcgtgatcttccagccccgtggtgaagaatttatcatgacctttttacttgtcactctctgttgtatcttagccactctaggatcctttctctttggctacgattcgggggtgattgggtcaacgctcgaacaagcggcctttctgcaacaattcgatcacccttctgatgcagtcactggaggcattgtctcgtcctataatggtgtttcatctcgtcactgctctttggatgaattttaa

SEQ ID NO: 3435 - DNA, 255 bp, A.fumigatus
ggaactattctggggtctattgcagccccctacatctgcgacccctttggccgccgcccagtcatgtatgtaggcactctcctggccgctctgggggctgctctccaggctggagctacacacgttgccatgttgattgttggccgtgtgattgctggcttttccatcggcttgatggcgaccaccatcccgatctactgtgtgagcgctttccaacaaccgttatcctacacacgtgacatgctcttctgctaa

SEQ ID NO: 3436 - DNA, 795 bp, A.fumigatus
  unsure (9): Identity of nucleotide sequences at the above locations are unknown.
ctggtgtancaatgggtcgggtatggctgctctctgcacacgggtgctttttcctggcggttccccctagccatgcaagcagttcccgccgtcatcctcggcactggagtctggtttctcccagagtcgccgcgatggctgattgaaaaaggccgcaaggacgccggcaaagccgtgctcaaccggctgcatctcaaccgcacccgcaccaacaccgacctcatcgagtccgagttcacccagatctgcgagagtatcgcctccgactcccgcaccgtcgtctcctcctggcgccagctgctgttctcctcgcccacctggcgccaccgtgtgctcctcgcctgcggcatccaagccttcacccagtgctccggcacaaacgtcatacaggtctacagcccacgcatctaccgctcgctcggcctccccacctccaccaccctcatgatcaccggcgtctggggagccctcgcccagttctggaacaccgtgttcctgctgttcatcgaccgcgtcggccgccgcaagctcctcatcccttctctcctcggcatgggcgccgccctctgcgtcgaagccaccctcgcccgctactacggcaacttcggcccggacgcggactcctcggtatctgcctcacccgcagccctccgcgccgccatcgccatgttcttcgtcttctctctctttttcaccgctctcggcctcatctcctggctgtatcccgccgagatcttccccacggccatccgcgcccgcggctcgtccatcgcgaccgccacaaactggagcctc

SEQ ID NO: 3437 - DNA, 1335 bp, A.fumigatus
  unsure (1234): Identity of nucleotide sequences at the above locations are unknown.
tcgcgcgcccttccgcccctggtgaagaccgacgagagacacatccgatactgtcccgtgtccacagaaaccatggccgtgtctcatgtctggagccacggtcaaggggggcgacctgagactgggttcaacatatgtctccatcgcagatataccagactggcacgggcgttaggctgcacttcatattggatggacactccttgtatcccaacagatcaggagctgcggtacgaagcgatgggccagaataacagtaacttcctcaatagcaaggtcaccttgctagtcgaccgagacctcatggagatcaatattcatccactcactctggaggccaaggaagctatcgtggcaaccctggcagtgtgcgattggaatgttcgtgcctggacgcttctggaaggcatgcgaggccgctggaaccttcacgtcctgtgcaaagacaaccatgttatatcccttgtggacgtcctcaacgacgtcttggcatacagtaatctcacccttgtatcgccatgcttagccttacagcactacaacccgaccggccgtcgcccagtcgagggagagattcctcccgttaagatagagcaagcaacctgcctcttgaatcacagacacgccaccaaggaccgagacgtgaccatgatctggagtctggtgtgcggctcacagctcgtcaaagcctctgtggacttttggaagtccaaaatgggatcccccctggcaaccggatttctcgtctctagctctccacgtctccaggaccagcacggattcagctgggcgccgtcacgcccgaatctcctgcctcccactgcaggcacgtccagtgctgcaggccaatatcctgcctacgatggagaacttagtgtagcaggtatgattaccgaacagggcttcaaagcggaatggcttatgtgcctgatcggtcgttcccgagcgcttccgacctggctccacttgaggttctacactcaggacgaatcccagatcaggagttactatcacgtctacaacaagggcggaaactcaagaatggacatgaaaagcctatacaagctccgctccgtgatcgcaccggtgtttaaaaagtatcgttgggttgctctgctgctgcccgccgttagagatcgaggaactaatggagcaacctctccccctcggccgttccaataccagggggaagcaaagggaaccctgccggtgatagccggctcgcatgatgaanctggatgggagtggcagtttgtggcagagtgggataacaatttccgcccggcagaattcgggccgagggaagtgcggaaggtttacataccggaaatgtaa

SEQ ID NO: 3438 - DNA, 249 bp, A.fumigatus
aagagcttcaacaaaatggcgatagaattcacccaagacacactagacgagatctacgcctttgcagtcgctctcggtcgtagagccggcgaccttctcctcgagcgcatcgataagcagatcgcaagcgacggcgagactgcatacacatacacagagaaagacaatgcagtcgacattgtcacgcagacggacgagggtaacccatcgacacatccaccccgtccaccaaagaaagaaagaaagtag

SEQ ID NO: 3439 - DNA, 369 bp, A.fumigatus
tcgagaactgaaggaaccgtcaacttcacccacctcttccccacgttctgcgtctcgatcgggtttctcgtcaaccaccgcccagttatcggcgtcatctacgcccccgccatgaatcagatgttctcttcctgtgtcggccgaggcgcctggttgaatgacacccgtggcgcgcgccggctgccgctccgccgtaaccccatccccccgatgccggccacgtcgccgagggggtgtatctttgcatgtgagtgggggaaggatagacgggatatccctgggggaaacatggcgcgcaaggttgagagttttgtgagaatggcttcggagagtggggggatggtgcacggggtaaggagtctggggagt

SEQ ID NO: 3440 - DNA, 402 bp, A.fumigatus
agttggactcgatggctgaccgttgctctgtatgcgtatctaggagtctcattgactattcttggcacccttttggctgctcataacctctaccccaccctccggccatacacggcgccgttcttcgaattgtcgtactaccaaccttccgaaggggtctatgtccaaggatttgacgatgtgtactttgtcgtcagctccgccatcacgttcaccgccgtccgagcgattgccattgaatggatcttcagaccagccgccagatatgcgggattgaagcggaaggcttcaaatcgttttgccgagcaggcgtggatgtggatgtactatgcgttcttctggacgtttggaatggtttgtctcgctgcatccatccattgcctctctgaacggtggaactga

SEQ ID NO: 3441 - DNA, 315 bp, A.fumigatus
gatctcatctcctctcatcaagaactggccgagctgacattagcgcgacagactgccaagattctcaagtacttcaagttcgagctttgctgcaacatcaccttcggcctgttcatggtgaactggttgattacacgtcacattttctacccactactctgctggtctatctacaaggatgttcctgatgccatggcctacggctgctactccggtagcaacgcggaaatgatttcaaccgatgggtacccgaaccgattccgcttactttttcaacccccttcttgggacttcaatgggccccttcttgcatga

SEQ ID NO: 3442 - DNA, 336 bp, A.fumigatus
tatatctggacaaactcctattactggatggatttcaaggcaatttgggctcaatggcccgcgcggggtatctctgcaaacctgaagtggtatctgctggcacagctgtcattctggttccagcagatcctggttatcaacatggaagaaaggagaaaagatcactaccagatgttgactcaccacatcatcaccagcactctcttgacgtccgcctatatttacggtttttataacgtttcaaacgtggtcctgtgtctgatggacattgtcgacctgttgctgcctgtatgccatgagatctcatctcctctcatcaagaactggccgagctga

SEQ ID NO: 3443 - DNA, 927 bp, A.fumigatus
ccatgcatagcagtcaaacccgaagcaaacctcatcaaacgatccacatgcgtcgcaggaggcgtcaagagcagcgaatacaacacctctctccacattggcgcgctcttcatcatcttgagcgtctcgaccttggcctgtgcgttccccgtactggccacatggtttcctcgtctacgcattcccccatcagttctctttacgttcagtcatttcggaacgggcgttctcattgccaccgcatttgtccatctgctcccgactgcatttacttctctcaacaatccctgcttgtctggcttttggaccaccgactaccccgccatgcccggagccattgccctagccggcattttcctggtgacgttggtcgaaatgatcttcagtccggcacggcatgtgtgccgcggagggctcaaagtctccgagcaggagacatctctgtctgaatcgggggtctgtaactcccatgtccctgtcgccagagactcgaaaacccgggatgaggtcaaacgacctggctgcaccagggtcgaaagtcaatcgcacctgcgtgacctcggcccattggtaggcaggcaaaccagcgtgagtcggacgatcaaccgcatgggggaggaatgcgatcgcatcatgcggattgcttctgctcctgaaggcatgcgaccagttcaagaaagcaaagcaccgccaatcgaggacgtggaacgaagcgacgatctcgcccttactccagagcagaagcacaaaaaggccgtcatgcaggtgttcctgttggaaatggggattctctttcacagcgtattcatcggcatgtcactcagtgtgtcggtaggcagcgagtttgtcatcctgttgattgccatcgtattccatcgtatgttctctgccttcggacgtgttttgtatcccgctaacgtcggatag

SEQ ID NO: 3444 - DNA, 237 bp, A.fumigatus
  unsure (232): Identity of nucleotide sequences at the above locations are unknown.
tgtccttggcatacggatgcacgtaagttcctggcctcgcgttctttcaagttgctggaaatgctaattctcttcagcacacccatcggccaggctatcggcctcgcaacgcacaccctctacagcccggattcagaagtaggactgctcctggtgggcaccatgaacgcaatctcatctggtcttcttatcttcgcctccttagtcgagttgatgtcggaggactttctcnagtga

SEQ ID NO: 3445 - DNA, 225 bp, A.fumigatus
gtacgttcatcagcctcgtctaaacatcctgacgaacatgcatgtatacccttctcccgcatcgtcaacccacccctctcattctccccacttacctcccaatccccacgcacccacgtatcgccgtacgaattcggcctcgcaatcgcccttacgttcgacaccctcatcaactccccgctcagactctcccaaaagtccatcccgtacgtccccggccgcatc

SEQ ID NO: 3446 - DNA, 417 bp, A.fumigatus
acgtacctagactcgaaccccgaggctgtcattgttgggtcgccgctggatggtagtaagaatcctactgataccaagctgggggatttggttggggatatcacaggcgtgatcacgacggcgtacgggtactatgtgctgctgcccctgacagccttgactgttacggggtcaaacacgacggctgctgctcgtacagatttggagtctgctggaacatgcggtgatgtgacggttggctcgtacaatgtcaacaacctggctcccaactcgacgacgctgcccaagatcgcgcagcatattgcgcagtacctgaagagtccgacgctggtctttctgcaagaaatccaggatgatgacgggccgactgatgacggcggtatgcttcctctcaggctgactgtggccatcggctaa

SEQ ID NO: 3447 - DNA, 339 bp, A.fumigatus
cgtcagaaggaatttacatcgtccatcctagccgaagactccaccgccaagatcattgtttccggcgactttaacgagttcacctttgcacagccgcttgaaacgttcctggctgaatctgggttggaggatctcgacgaggtcgctgggattgcagccacggagcggtacacgtatctgtacgatatgaactgccaacagctggaccacatgtttgtgagcccggcgctggcaacaggagcgcagatgcaccatctgcatgtcaacacctgggtttcgttcgacgaccaggcaagcgaccatgatcctacggtggcgttgctgaacgcctgtagctag

SEQ ID NO: 3448 - DNA, 570 bp, A.fumigatus
cggcggtatgcttcctctcaggctgactgtggccatcggctaatgcatgcgccaggggtatccgccaacaagacgctctcgaccctcgtgcagtccatcgccgaccaaggcggcatccggtactcgtttgtcgatattgccccggtcaacaaggaagacggcggccagccaggcgggaatatccgcgtcgcctacctgtacgatccgtctgtgattcgcctgcgcgacgccaacactggctccaacaccgatgccaatgaggtcctccccggccccgaactcaagtataaccctggcctgatcgacccgtccaacaacgcgtggctcaacagtcgcaagccgctagccgcagcctgggaaacgctcgacggcaagaacaagttcttcacggtgaatgtgcacttcaccagtaagggcggtggatcgtcaattgagggcgatgcccggccgccagtcaacggaggcgttgccacacgcgaggcgcaggccaagctcgttgctgtacgttgtcctcgttttcaatccttgagcggtactaacgtcagaaggaatttacatcgtccatcctag

SEQ ID NO: 3449 - DNA, 696 bp, A.fumigatus
acgccatttcaatttgcctacaaatcaatgggccaagaggagctcgcgaaggaacatacgtattccatcatggccacagaaggccgcatggacagtttcaatcacttcatggttggcaagtttatgaaaacaaacgctgctcctgaccgtctccgggccctagggtacgatctggaatcggtcctcaacgacgcacaagcttctacacctccgaccatggtggacatcggcggaggtcgcggggagatgattctcgatttcaaggctgcatttccccaactccagacttcggacctgatcgtccaagagttcaatcatgacatcactgatatccccggcatcaccctagctgtgtggaactacaaggacgaaagtccccaaccgatcaagggcgcgcttatctaccatctggcgcacatccttcacaatctcccagacttggaagctttgcgcttgctgaagaagatatcggaggctatggctcctcactcgcgattgctgattcatgggtttgcgaagaataccacttacgccaagatgcacgccgccatgattgctttgttcggcggtcgagagagaagttcgaccgaatggcatcaaatggcgggcctggctgggcttcgggtgacattcgaggcgtatccggatttcggagagggcttgattgaaatgaggaaagtggaaagctctgcttag

SEQ ID NO: 3450 - DNA, 204 bp, A.fumigatus
ctgcttttctgccctttcataggcggctgcggacaggctttccaggcgattattgtttctccgcagtttgaaaagaagaacatgcttgcgcgccatcggttggtgaactcggtcttaaagtcggagattgctgctatccacgcctggacacccaaatgctacaccccagagcaatggcaggccctgcagcaaggaagcgcttga

SEQ ID NO: 3451 - DNA, 219 bp, A.fumigatus
  unsure (96): Identity of nucleotide sequences at the above locations are unknown.
agctatcaagcggaaggattcagtggttgtggcctaccgtatgcattgtggccggcaatcgtctacaggctaccagcatattcgctaactcagatntctgacgtagaccccatcatctttcgaggactgaagtccctcactctcaatgacacacagcaacagacactgctacggctcgcctcggagggcataagcgtgtactctccgcatacagctgta

SEQ ID NO: 3452 - DNA, 207 bp, A.fumigatus
tgtcccaattgctcatacagttctcacccagtgcttctggaagctcccttccatccggctcggcggcaaaagaattcagtgcttctgaccattgacctcacaaaggctgtggcagatgaagctatcaagcggaaggattcagtggttgtggcctaccgtatgcattgtggccggcaatcgtctacaggctaccagcatattcgctaa

SEQ ID NO: 3453 - DNA, 462 bp, A.fumigatus
tacgactacatgcaggtggtctacgggctcgaaacgggtgcggtctactgcgtcggggcctggtggaaaggactggccaacaaccacatgacggatgaccagcgcgccgccctctcgcccgactcggaggaattccgactgcgagtgggcggatccaagacgcaggtgctggggtggtcgttgtacacgaccctgctgtggttgttgaaggcgtgcatggccatcttctactcccgcttaacgtatgtctcgcctcgtttggaggtcgtcactgacaccgacactgacgccgataccgacgctgacgctgacgggcagggccggtctgatcaacatgcatatccgcgtgcgtgtggcctacggggccatcggggtgacctatctgattgtgattctgtcgatcctgtttggctgccatccgatgcacaagaactggcagatctatccaaatcctggccgtag

SEQ ID NO: 3454 - DNA, 510 bp, A.fumigatus
cgtatgtctcgcctcgtttggaggtcgtcactgacaccgacactgacgccgataccgacgctgacgctgacgggcagggccggtctgatcaacatgcatatccgcgtgcgtgtggcctacggggccatcggggtgacctatctgattgtgattctgtcgatcctgtttggctgccatccgatgcacaagaactggcagatctatccaaatcctggccgtaggtgccactctcttgaaaaggttgcttcgactgacgtgttagtacgctgccaacccgccatcgcgccgctcgatgtctacatgaccgtcacgctgaatgtcgcgacggatatctatctcattaccattcccacaccggtacgttcgttttcatatatatcgagccgtccgtctcacatccatagatgctcttcaaagcgcgacttccctggcgcgagaaactcgaactcttcatcctcttctctggtggaatcttcgtcatggcggccgggatcctccgctgcgttttga

SEQ ID NO: 3455 - DNA, 1461 bp, A.fumigatus
  unsure (1183),(1435): Identity of nucleotide sequences at the above locations are unknown.
ttcacaacctctctcaggctacctcccaccatgtcggacctacctccggaaaggtctcattcacgacgcaacaccaatgaccttggattggtaccaacggaaaccaaggagacgctccatgaagctggactcagcccaaatacccctgagatagggatcaattaccccgaagtcggacgtcctgccgaccccgttttcccggaggaatacaacctcgagactcaaactgggctcgtcccagcacggactcttgagtcggtccgtacgacaacctggacgggccggcagatctcgccggcggatttggaaaagggaggcgaaccggtggattttgtcacgtttacgattaatgaccccgataatccgcacaactggagccacgtataccgctggtacgtcaccattgtcgtctcaatgctcgtcgtgtgcgtcgcgtacgggtcggcattcgttaccggggggttaggcctgattgaggacaagtatcacgtttcgctcgaagtggctacgctgaccgtctccatcatggtctgtgggtttgcggttgggccgttgctctggagtcctctgtcggagatcatcggccgtcgtcccgtgtatgtcatctcgctcggactgtacaccatcttccagataccctgcgcgctttctcccaatatcggtggattgctggcctgccgtttccttagcggcgtcttctccagttccggtctgtcgctggctggcgggaccattgcggatgtctggaatatcgaagagcgcgggcatggccattgcgttcttcgccgcagcaccctactgcggtcccgtcgtgggccccatcgtatgcggctggatcaacgtcggttcgcaccgcctggacctcttcttcctggacaacatggcctttgccggcgtggtcatgatcgtcgtccggctggtaccagaaaactacgcccctgtcattctgaagcgccgcgccaaaaagctccgccaggaaaccggcaaccccaacatcatcaccgagcaggaaaaagtcaaactgagcttcagggagatcgtgcgcacgaacttcgtccgcccgatcaccatgatcctcaccgagcccgtcctcgacctgatgtgcatgtacatcgtcctcatctacgccatgctctacggcttcttcttcgccttccccgttatcttcggcgaattgtacggntacaacgacggacagatcggcctgatgttcatcccgattctgatcggcgccggtttcgcgcttctcgtcacccccctcatggagaagcagttccggcgcatctgccagtctcgcgccccgacgcccgaagaccgactcatcgcggcgcttctcggagccccctttatcccgatcgcaatgttcattctcggcgctacgtcgttcaaacatattatctgggttgggcccgcgtcgtcgggtatcgcgttcgtngcacacgccggggcaaagtaaggtaa

SEQ ID NO: 3456 - DNA, 942 bp, A.fumigatus
  unsure (669),(921): Identity of nucleotide sequences at the above locations are unknown.
ccgtctccatcatggtctgtgggtttgcggttgggccgttgctctggagtcctctgtcggagatcatcggccgtcgtcccgtgtatgtcatctcgctcggactgtacaccatcttccagataccctgcgcgctttctcccaatatcggtggattgctggcctgccgtttccttagcggcgtcttctccagttccggtctgtcgctggctggcgggaccattgcggatgtctggaatatcgaagagcgcgggcatggccattgcgttcttcgccgcagcaccctactgcggtcccgtcgtgggccccatcgtatgcggctggatcaacgtcggttcgcaccgcctggacctcttcttcctggacaacatggcctttgccggcgtggtcatgatcgtcgtccggctggtaccagaaaactacgcccctgtcattctgaagcgccgcgccaaaaagctccgccaggaaaccggcaaccccaacatcatcaccgagcaggaaaaagtcaaactgagcttcagggagatcgtgcgcacgaacttcgtccgcccgatcaccatgatcctcaccgagcccgtcctcgacctgatgtgcatgtacatcgtcctcatctacgccatgctctacggcttcttcttcgccttccccgttatcttcggcgaattgtacggntacaacgacggacagatcggcctgatgttcatcccgattctgatcggcgccggtttcgcgcttctcgtcacccccctcatggagaagcagttccggcgcatctgccagtctcgcgccccgacgcccgaagaccgactcatcgcggcgcttctcggagccccctttatcccgatcgcaatgttcattctcggcgctacgtcgttcaaacatattatctgggttgggcccgcgtcgtcgggtatcgcgttcgtngcacacgccggggcaaagtaa

SEQ ID NO: 3457 - DNA, 297 bp, A.fumigatus
cgcggtatgttccagccccggggtgaagaccctccagtgggtggcattgctaatggcgccatggtgttggacgacaaattgttcatcgacatgccttttgagagtttccaagctgccatgaagcctaaagtacaaggctccatctacctcgaggaggttttctcggctgataaccttgactttttcctgttcttctcgtccatttccgtaatgacgggccagcgaacacaggcgaactatgttgctgccaacaatgcaagtctaacccccttttcacccctgtccaggcgtttctaa

SEQ ID NO: 3458 - DNA, 495 bp, A.fumigatus
ttcatggtcgctatggctgaacgaagaagggcccgtggtctgccagcttctgtcattgatatcggcatggtcgtcggcatcggtgttattcagagatcgcagaatgacaaaggcgtcagcgcgatggagaactcgatccgacagatggactacatgcctgtgtccgaaactgacctacatcatctcctcgctgaggccatcctcgtgggccagcgagatgagtccccggaactaatcacagggttggagacatacaagccagttgagggagaggctcccttctggcaccataacgtgcgcttttcccacctcatcactgaccctgatgctgcgcaagcgggtgcggactctgctggtagcgctcagaaatcgttgaaggagatgctgctcagctctggtgggcccgaggaagcgaggaaggtcatggagaatgccctcttgcaatatctagcgtcctcactcaaggtaagtactgccctattcaaaccttcgtga

SEQ ID NO: 3459 - DNA, 711 bp, A.fumigatus
ctgtcacgcgagaccatttacaccgatgtgccgatcattgacctcggtatcgattcccttgtcgccgtccagattcggaactggacctgggccgaagctggatatgaccttccagtcttgaagatcctgggcggatcttcggtaacacagatttgcgatgaggtagtcgcatctctgtcctttgacaagagttcgattgcggccgccaaggtcgacagtcaagcagcaccggctcacaaacttcgcccgtgggataaaccatccgcagatacaaagcgaacggactctatagcacccgtgcctaggtcacagatcgctgcaaatggacccaacggcttgccgaatggggctttgaagaaagcctccaagcttgccgtaaaggtcaggcctctctggacgactcaagctggcggtaaagataccaagaaaggtcctcggccagccccgatcaggatacagccattgtccttgggtcaatatcggctatacttcctctctcaatacatggacgatgatagagtcctgaactgcaccatctcgtacgccctctccgggaagctggatgtgtccaaattggagcagtcactcattcaggtggtgcagcgtcacgaggccttgcgcacctcgttctatacagatgagaaggatgcgaagcccagtcttctaccacaagggccgaaggatccgcgcattcgcctccgaacgggcgaa

SEQ ID NO: 3460 - DNA, 204 bp, A.fumigatus
cagctttattcagccattgggcccgcacgactatataacatcggccagagatattctggtcttttgcacatgttttggataggagcatcccttcccatcattacatactttatccggaagagattcccgaagtcacggttcgtcgatgcaatccactggccgatcttctttgcaggcactggaaatctgccaccagcggtatga

SEQ ID NO: 3461 - DNA, 252 bp, A.fumigatus
ccttttctcccagatggtgttctgatatggatgcttggcaacgtgaaggatgtatgttcaagtgatcagcctgacaactttacctgcccgcaaggccgagtcaactacaacagtgcaatcttctggggtggtacgtctttgccgatcctttatcccaagtcgcacactgacagctttattcagccattgggcccgcacgactatataacatcggccagagatattctggtcttttgcacatgttttggatag

SEQ ID NO: 3462 - DNA, 285 bp, A.fumigatus
ctttccgctctccagacaagatgcaatcatgaaatactaacgggctggcaggtcattaaaggccgtagaccgcactggtgggccaagtacaattacgtgttgtccgctgctctcgactctggtgtcgctgttgccgcaattctgatattcttctcgctgatctttccgggagtcagcttgagttggtggggaaataccgtcaacagcgggacagttgatgcaaaggggacaccctggaaagaattgggtctgaatgagacgtttggcgagaggacttggtcatga

SEQ ID NO: 3463 - DNA, 543 bp, A.fumigatus
cgggcgggacgaaagattgacagccgtgtcagtttccattgcgtgtactggcccgccttcctcatggcattggatttgcccctacctcggagggtcctcattcatggtcactggaccatcaaccgggaaaagatgtcgaaatccaccgggaatgtggtgaatccctttttcgcgattgatcggtttggcgtcgacaccatgcgtttcttccttgctttccaaggtggactagcgggggatgccgactatgataactcctacattatccgcgattacaagaagctgctccaatggggcattggaaacctaacccaccgtacaattggttgtgcaaagggtaacctgcgctcgtacattgcggacgcagccgccgacaagctgcccgcgccgacgcccgaagatctggagcatcaatctcttctggagcagacacctgacaaagtggcggaacaaatggaaaagttaaacccccgtgccgctttgcaggacatcatggcgattattgagaaggtcagtgttgagagtccatatcacaacgactag

SEQ ID NO: 3464 - DNA, 279 bp, A.fumigatus
ccgcagacaaacaagtatttccacgcggcagagccatggaaaactccagccgggtcgcagcgagcgctatacaatgtcgccgagtccctacgaatttcgggtatcctattgcaaccttttatgcccagtaagtctactgaacttctcgatattcttcgtgtagacaagacagagccatcgaaacggagcttttcggccgcacgctacggttgtgatccggactatggtgagggtgtcaaaaagagtattcttttcccgcctctcattattgaagaatga

SEQ ID NO: 3465 - DNA, 1329 bp, A.fumigatus
  unsure (25): Identity of nucleotide sequences at the above locations are unknown.
tccagtcctgggtgctataataaanagtgcatgattctggccgcccacgtggtcaagcaccttatctctttctcgaccgaagcatacgcagcccatattcgcggaatacctgggccccatattggaccaggcttgggctacgcctttggcctttatgccatgcaagtgctgcagagtttgactatgaaccacgcgttgtatcgaggtatggttgtcggaggaatggccaaagcgggccttacatctcaaatcttcgccaaagcgatgaggctgtcgaatcgtgcgagagctggcggaaagcaggccaatgacaccggacccaaatctgccgaaggaagtccatccggagcagcagcaaacgatgcggcgaaggagactgccggctggagtaatggacgtatcacgacattgttgggcgtggatgtggatcgtatcgatacggcttccggcatgcttcatatgctttgggttgcacccatcggtcttatcgtcgctctaatcatcctgattgtcaacatcggctacagtgcacttgccgggtacgccctcctggttgtcggagtatttgccctggcatgggctatgcgcctcctggtgcaatttcggagggccatcaataaaatcaccgatcagcgagtcactttgacaagagaaatattgtacagtgtgaggttcgtgaagttctttggctgggaaagcagcttcctcaagcgtctcgaggctgttcgcaatcgcgagatcggctccatcaaacggctcttgtttgtccgacacgctgttgtggtgtgcatggtttctttaccaacattcgcatcactgctgtcttttgtcacttacgctctgtcggatcatagcctgtccccggatcgcatttttgcgtccttggcattgttcaatgtgcttcgcatgccactcatcatgctcaacctgactatcacacagatgaccgatgcctggactgctatgaaccgaatccaggagttccttcaggccgaggaaaagtctgacccagtcgaatgggacacaggcatggacaaggctattgaggtcgaacatgcttcatttacttgggaacaagtgcagagtaacaagggagaggagaagaagggagagaagccgaaacgtagccaggtcttgccgaaagacgcaacgcctagcagcccgtccgacgacaagagtgataccaccgagcttgtgccgttcaagctcaccgatatcaacttcgaagtgggaaggggtgaacttcttgctgtaataggaacagttggcagtggcaagagctcgttgctcggggctttggcgggcgtcttcaccacggggctggaagga

SEQ ID NO: 3466 - DNA, 1209 bp, A.fumigatus
caccagcctcgatccttccagccccgtggtgaagacatccagattgcagctactatctgtgaatggatgtacgtgcctaggcgctgggcaggtgctcaacacctcaccaaacgactgatgtttctgatccttgttttcgtcatcaatctggctcctggtgtgtttgtcttcgcctacagcaagagcatgggcatcagcaaaaccatccctttgattgttggtatcgtccactttttcgtcgcgctggcaactttcgtattcttctctgtcatgccacttggtgggcttttcggcagttacctcaagaagcatggccgtcagtatgtggctagccagacattcactgcaagcttcccacgtctgcacggcaacgatatgtggatgtcgtacggcctatgggtctgtgttttcggtgctaaactggcggaatcgtacttcttcctgaccctgtctttcaaggatccgatccggattctctcacccatgcagatacatcagtgtgcgggtgtgaaatacattgggaacgttctatgtcacaaacagccccagattcttctcggcttgatgttcttcatggacttgacgctcttcttcttggacagctatctttggtacattatttgcaacactgtcttctctgttgcgaggtcgttctacctgggtgtgtcgatctggtcgccctggagaaatatcttctcccgactgcccaagcgtatttactcaaaggttctcgccacaaccgacatggaaatcaagtacaagcctaaggtattgatttctcaagtttggaatgccatcatcatctcaatgtaccgggagcatctgctggctatagaccatgttcagaagctcctctaccaccaggttccttctgagcaggaaggcaaacggaccctgcgtgcgcccactttctttgtgtctcaagaggatcaatccttcaagactgagttcttcccgcctggtagtgaagctgagcgtcggatctcgttcttcgcgcaatcactctctacccccatgcccgagccgcttcctgtggacaacatgcctacattcaccgttctgattccccactatagcgagaagatcctcctatccctgcgtgagattatccgcgaggatgagccctactctcgtgtgacgctgctggaatacctcaaacaacttcatcctcacgagtgggactgcttcgtcaaagacaccaagatgtag

SEQ ID NO: 3467 - DNA, 771 bp, A.fumigatus
agacatacgagacttggtggcggtagtatcgttggcaaagggtatagtgatgatgggtacacggtcaccgacggatacacagacaccgcaacgacgattaccgaaaaggaagagggagaccacaagcgcaagcgcagattccgggagacggctaaacagaaacttctgcgcaaacgcaaagacgagaactgggaatgcgaatccgacgaagacgttcgtgcctaccgcaaggagaaaccggcccggatcggcggcatcaactgcgagggggatggaacctatcacggcagtgactacgacacctccaacccgcccacctcacacaacgctagcgagatgagcgaggtacgcgactatgcgtacgaacccccacgtcagagccgcaatttctcgttcactcccggaagcgaggaggtcctgagccacacgacagaggagcgccaacacctccgcgagccatctgcgagacgacacaatcgccgccgagagagacgtcgtgctcccccgaccactccgtcgcgacagggcagcccgcgcaaacgagaccgtctgtccgtgccaggtcattacaccgagcctctggatttctcgtcagcgggctccagatccgaatatcaatactccaatgtggaaacggatgacggatcggggaccaagcactaccatcatcccattccaggactcagcaagggataccgccgcgaaggcggacggaacagaagacgggacagcctgagcgacagcgacggcgacgaaacgcggtactcatga

SEQ ID NO: 3468 - DNA, 747 bp, A.fumigatus
tctggagggaaataccaggtttcaacccttcaatcaacccttcgagcagctccatattccctcccggtcgtcaccatctccctggatgatttctacctcacccatgagcaacaacagatactagccaaaacctttccttccaatcctcttctccagcatcgcggacaaccggcaactcacgatcttcctctggccgaaaaagtctttgaatctctatgtgccggccgtcctactgctatcccgcaatatgacaagtctgcttattcgggccagggcgatcgtgtacccgagagccaatgggagacagtcaacggcgacggacaagacaaaatcaaagtggttatcttcgaaggctggtgcgttggcttccgcgccctggatgaagatgtccttagggagaagtgggaggctgcggtccgccagaaagaccagggtggttataatggccgcttagggtatgtgaagtttgaagatgtcaaggccgtcaatgacgccttgaggaagtacgatgtattgaccgagttcgtatccttgccctcttggatcgctctagacgttgatgctaactgttcgagcgagccggctcgacgcattggttcatatgtgagtgctaccctccttcactctctatcatatcaataccctcttgctaaacatctccaagcgatgcgcaagacctccactttgtctacgactggagacaggaacaggagagaacgctgcgtgcaatcaaaggaacgggaatga

SEQ ID NO: 3469 - DNA, 225 bp, A.fumigatus
  unsure (149),(150),(151),(152),(153),(154),(155),(156),(157),(158),(159),(160),(161),(162),(163),(164),(165),(166),(167),(168),(169),(170),(171),(172),(173),(218): Identity of nucleotide sequences at the above locations are unknown.
tatatgacagattacccgtcttatgaactcttcactgaggcacttcgggaaggtgccttcaagcctgcgtcgaactcaacagacaccaactggcaaggcagacagctccgtctgattgtgaataaggagaggagggttgatggtcttcnnnnnnnnnnnnnnnnnnnnnnnnngggcttaaatatatatgcccactcgaccacccctctcgacactgngaattga

SEQ ID NO: 3470 - DNA, 189 bp, A.fumigatus
acatctccaagcgatgcgcaagacctccactttgtctacgactggagacaggaacaggagagaacgctgcgtgcaatcaaaggaacgggaatgaccgaggagcaggtgtctcactttgttgatggctgtacgtatgtcgaactggtggacgatcgtcggctaatatatgacagattacccgtcttatga

SEQ ID NO: 3471 - DNA, 216 bp, A.fumigatus
ccaacgtcatggtattcttctcagaacaacagatcgcggtctgctaataataatgatgacaagaattcacagaaactgggaactcatcttggaatattgacggtgctggcgcggtaccttaaagaagaatcaaacctcattatgacgatgattaattatgtcactgtggtgagcgcccaagaaacgaaagaacagccagcaactgaactggggtaa

SEQ ID NO: 3472 - DNA, 255 bp, A.fumigatus
gacatgacaattgaggcactggaaaagctgcgtctatgtaaacagattgaagctatgcagatacctgtggcgttgctgtcgtcagctagggatagtccatattggaccatctgcaatgccttgatcgaaaatgcttatctggacttcgaaatccgcaaacaagatgtgtctctcgactgcccctgggaaaactcgatcagctattcaagcagatctcgagttgtgaaccaatcaacgagttggacaccgacttag

SEQ ID NO: 3473 - DNA, 186 bp, A.fumigatus
actgacatgctgacaaagaggaaagacatctctatgccggttatgcacggctttgaagccacacgcgccatccgcgctctggagaaagagcgcgatgggtgtggaccggccacgatcattgcactgacgggactgagcagttcgcgtgacgaatccgaggccctcacgtccggggtggacttgttt

SEQ ID NO: 3474 - DNA, 1215 bp, A.fumigatus
  unsure (142): Identity of nucleotide sequences at the above locations are unknown.
gattgggcaggggtttcggtgcacttggagtccaccgaggcgtttgagagccggtcgcgccgacatggtgtggaagaacttgtgacgttgaccgtatcagatacgggcaaaggtatatcagaagcgttcttacgggggcgcntattcacaccattcgcgcaagaggatactttggcggtgggaactgggctgggtctatcgatcgttcgaagcttcgtcaaagcgttgaacgggattatcaacgtccacagccggcccggtgaaggcacgacggtcaaggtgtctcttcctctaacacgcccagatccggaggacagtctggaggacagccttccgtcgagacaggacgacacaatgaacgaagccttttcgctccgcaacagccatggcggcagacgggttgccatttttggtgtcgagcctgctgatgcctgcgaacatcgcttatggtccatcattgcacgctacctgacggactggtacggtctggagctggtttccttgtcgtcacaagagcccatcgacgtgcttttggcagacgaggatagcttggcgagcatctcaaaggaggctgtcactggcattatcctttcactcctgatcctctgcaacaagtcagttgattacagcgcgattcgggcagagtggtcaccgattgccgctttggtggacatcatccgtcgcccgtgcggtccgcacaaactggcccgttgcattaggaaatgcctcgataatggaccacgtgggggcgccacgttgccgccgcgcattgagcttcccgaacgaccccggatgagtaatggcatccctccgccatgcgcggacttgaccgaggcagatccgcttgctgcgagcggtgatcgtactcgcgccacctcgtttagagttgggaccctttcctcgtcggaggattcgggagagtcacaaagttcatccgacatcgccgacgcacttcacggcagtgatacctccatgtcgccactgcccacaccgtcggagacagcgagcaagcgcatcgagcgcaaggcacgcgtccttgtggtggacgataattcgatcaatctgaatttgatgttgacgttcatgaagaaacaagagttggaggttctggattctgcggaaaatggcaaagtggctgtggacgcggtggaaaggatgcagcagggttacgacctcattttcatgggtaggcgactcaaccccagattagactga

SEQ ID NO: 3475 - DNA, 258 bp, A.fumigatus
tatttgcttatagcgaggctcctgcttttgtcctcactctctttgaaccctctgtccttccaggcgcctccctcaaggtgggtttttctcaatatggcagtcgacgaaaagaccgatgcccagttccatgagacggtccccacgcgagatgcagatgtgggcgacgccattgaactggcccagcaggccgcttcggccaagtacagcccatggacaccgaacatgttcccgctgtaccgctgtctgaccattgcgtat

SEQ ID NO: 3476 - DNA, 486 bp, A.fumigatus
gcccgtttgaggagggtttctttttgctactatcctattccgtcctcgctttctctgtctgccaccatgaccctgtccgcagtccccgactacgaaaaccagcacatattgcagcgcaatcggctcaaaccaagagcatatttccttcccgcgacgtctatctcgctcaatggtcgctgggactttcactatgcagcctctcccgtgagcgccccagagccaacatggtccaagggcaccaagaacgccacggccgaaccccgccgggattcgaaccaatttagctcggatggcgcagactccaagacagcttgggctccgatcactgttcccggccattggcaattgcaaggctatggccgtccacactacacaaacgtcatttaccctttccccgtctgtccgccatttgtgccgacggagactcctaccatgggaggaagtgtggttataattatattattaattgtaattagtatagtataa

SEQ ID NO: 3477 - DNA, 699 bp, A.fumigatus
  unsure (2),(40): Identity of nucleotide sequences at the above locations are unknown.
angtgggaccgacactacctgtttgtccggggcgagcggntcatgatcttctctggagagtttcacccttttcgactgccagttcctggactctggtttgatgtcttccagaagattaagagtctggaattcaatgctgtctccttctatactgactggggtctcatggagggtaatcctggccacgttgtgactgacggtatctggagccttgacgagtttttcactgctgcacgtgaagccggtctctacctgatcgctcggccagggccatatatcaatgcggaaacctcggctggtggtatacccggatgggttctccgtcgaaagggcatcatccgctcaaacagtgaggattacctccgtgcgacagatacgtacatggccactctagggaagataattgccaaggcgcaaattaccaatggagggccggtgatcttggttcagccagaaaatgagtacacgacttggcccaacgtctcagagtccgagtttccgacgaccatgaatcaggaagtcatggcctatgccgagaagcagcttcgagacgctggagtagttgttccaaccgttgtaaatgacaataagaacctgggatactttgcccctgggactggactgggcgagacggatctctacgggattgacgcctatcctatgagatatgactgtgagaccattactttcaagagatga

SEQ ID NO: 3478 - DNA, 300 bp, A.fumigatus
atcaatgttccgaacatgagttcgctttcgatttcacgacgatgcatgcacatcgtttctctttctctcctggttgcctcgtcgctcgcagcaaacacggcacaatggaaatccagagccatctatcagaccatgaccgatcggttcggccgcaccgacgggtcgacaacggcgcgatgcgtcgcgtccgagaacatccgttgcggagggacatggcgaggaacaattgaccatctagattacatccaagggatggggttcgacgcggtcatgatctctcccgtcgtgaagaacgtatag

SEQ ID NO: 3479 - DNA, 201 bp, A.fumigatus
tttttcgttctctactccgtaccttactccgtactccgtaaaaatctccaaattccactgttggatatccagcatccatgggagaagcaaactatggacctcacttccatctttaccccctattcccagtccctagatttctcgttgtccaccttgggagtcagcttcttttccgcgcacagctcattttcaagtgattaa

SEQ ID NO: 3480 - DNA, 801 bp, A.fumigatus
aacatcctccttatcggcggtggtgtatcctcgacagacattgctcgcgagataggcccaattgccaaaaccgtataccaaagcacccgcaacggtgaatttgacctgagtgagtcagtacttccggaaaacggaataagaatcagcgagattgcccgatttgagttacaaaacgacaaaactttaccagaagatgcgcatttgccgttgattgtccacctcaagtcgggtcagaagctatgcagtattgatggcatcattatctgcacgggataccacattactctaccctttcttccagactatcacgacgacgtgacctccccggcggatgcgaatgaaacagttcttgtgacggatggtacgcaggtgcataaccttcacaaggatatcttctacattcccgacccgacattggtatttgtaggcgtgccgtactacacagcaacattcacgctgtttgagtttcaagccatcgccgtggcagccttcttctctggagttgcccagctgcctcccaccgaagacatgagggcggaatatcttgctcgagtcaaggcgaaggggagcggacggggattccactcactcaggaatgtggaagagcactacgtagcggatctcttggagtgggtgaataaggctcgggcttctcgcggattagccgccgttgaaggacatactaagtcatggttggaggcgaaggaagcccagagggagcgactgaaagagcttttggggggcggaacgaggagagatagtggggtgggtgagtttccggtgttggagacgtgtaggtga

SEQ ID NO: 3481 - DNA, 192 bp, A.fumigatus
acatttgacgcagtcgtcgtcgcctttggccactacctcgcgccacgaatgcctgacattcctggcttaccggaagcaaaggcactatggccgtctcggatccttcactcaaagggatacagaagacccgacggatttgaaaacaaggtgagtcagtcgggttgcggttatatggaaatcccaagatactaa

SEQ ID NO: 3482 - DNA, 339 bp, A.fumigatus
ccgcagtcgctgacgcgtttcatctctacaggcggcaaaggtggcaagggtcttggaaagggtggtgccaagcgtcaccgcaagattttgcgcgacaacatccagggtatcaccaagcccgctattcgtcgtctcgctcgtcgtggtggtgtcaagcgtatctctgccatgatctacgaggagacacgtggtgtcctcaagaccttccttgagggtgtcatccgtgacgctgtcacctacactgagcacgccaagagaaagactgtcacttcccttgacgtcgtctacgctctgaagagacaaggccgtaagtatatctctggttattgcgaattttga

SEQ ID NO: 3483 - DNA, 837 bp, A.fumigatus
  unsure (289): Identity of nucleotide sequences at the above locations are unknown.
gccttccttagcgccgcctgtggtgaaaacgccaacgggggcatgcctttcccctggccaccgaactataacacctacagtcccagcccacacatgccccctgtccaccccgcaccgatgccaggaagctgcccatgcagctacggccaggcagcgctctgcggcatccaccaacccatcagtggctacccggtccacgggatgactggcagcatcggcaacctgcactaccaaggatgtgtaaactgtccgcgggggccacagggcccggtcggagcacaaggcccantgggaccgcatggtacgtccggggcgcaaggcccacctggaccgcagggctcgcctggagtgggcgctgacggaccccaggggccggccggcaagcaaggcgttcctggcccggtgggccccgtgggtgcaactggcccggcgggaccgcagggcactgctgggcctccacgtccgagaggtgaagacggttgcaatcatgggtgcaataaaccgggcgacaaaccgggcgacaaaccagatgaaaagaaaccgcctgaaccgtccggccagggtgtgggtagggaaagcagtgatggtccgaagtacaccgacgaaccggctgtcccagcaaaccaaggagctggagtggataacgtcagcaaagggcccgtgtataacgacgaggtctctgctgcaggccagggtatcggagcggagtctgcgggagggccatcctatactggtgacccccagacgagttctcatgggatcggaagggaaaccagcgggggccctgcatatattgaagcaaagaatccctcggggcaggggattggggttgcttga

SEQ ID NO: 3484 - DNA, 588 bp, A.fumigatus
aaggccgttggtcctggctgctcttctccgtgcctcgcccctccctccaagaattgcctgccatcgactcctcttcgtcctctctgcttctccaactcattaaagtccaccatggcacagccggcgagtgtcgtcctcgacggagaagatcctcggctgcgggagaaagagcgtggcacattcgatgccgttgactacggcaccggcactgctgctatccgtccgcagcatcgcaagctgcatgatcctagtgtcaccttcgaggagtactactactatgctcaactgacccgtgccgaagaagagtcccggccgaatggcgatcaggaacggggatggctgtcgatcatcttcccgtccaagtcgggcggcggcgtccagcccttgccccaacacccgtcggaagatgccaaaacgcccagcgccggcgacgcagcgcgccagatgaccatcacggacgaggaatggaccaatgcgtcccgggcgctgcggacggccactcgaggggccatcttctatctgatcaccaccgacattctgggcccattcggtctggggtatgcctttgcgaccatgggttgggggtaa

SEQ ID NO: 3485 - DNA, 288 bp, A.fumigatus
gggggggagaataaagcgcggtatcttcgcctcctttgtcgagtaagacagaagctggaaggagtcgaatatgtgcttcaccttgcctctcctcttccccacgggacaaataaagagacgtactttggtccggctgtaaagggcacaacggccattctgaaggaagccgccaaagtccgtacggtcaagcgcgtcgtgattacttcgtccatggcggcactcataccgctcacgggggttcctgagggagaattcgtccgaggtcggtttcccataatttcagggtag

SEQ ID NO: 3486 - DNA, 594 bp, A.fumigatus
acacgcacagaggacaccggttgggacctatctgtcgacccaaatgctgacttcacaggcccagacgacgctgccacctcgttcaggctttaccgcgcctcgaagctcctagcaaacaacgccagttgggaattcaggaacaccgcgaaaccgcatttcgcgcttgtgactctccaccctgcctacgtctttggacataatcatgtgcagactagcccggaggaggtccaaggtggaaccaatggaatgctctggggaaccatcatgaccggcaaaccaatgggaaacagcactggggtacacgtccaggacgtggctgaggcacatattaaggcgcttgatgagacagtgccggacgggtccaagttcttgttggcaggtaaaagggcctcttggagcgacgttgcccgcatcgtaaagagagactatccggacattggtgccaaaattacggaggatatctctggagaacctttcccactggatacaaccgaggccgagaaggtcttgggcatgaaatggaggtcgttggaccagatggtcaaagacgtggtggaccaacagttggagttgatgagacagacatccctgtag

SEQ ID NO: 3487 - DNA, 234 bp, A.fumigatus
cagactgagcctagtgcagcgatcgtctactctgatcgacataatagaacaaatatagaacccttctacagggatgtctgtctcatcaactccaactgttggtccaccacgtctttgaccatctggtccaacgacctccatttcatgcccaagaccttctcggcctcggttgtatccagtgggaaaggttctccagagatatcctccgtaattttggcaccaatgtccggatag

SEQ ID NO: 3488 - DNA, 225 bp, A.fumigatus
  unsure (21),(31): Identity of nucleotide sequences at the above locations are unknown.
tgtgtctatttaaatgacctngcgcacgganggtatctgggtctggttgtttacctgaaattcaagttcccatcatccacgctcgttacccatacacaaacgtaccagctacaatcttcgatcaagtacactcgcttcgggtcatctatcaaacaaccactccaagatgcgttcttccgtcgtcctccttgccctctcggcccttgccgccgctcagtcttctag

SEQ ID NO: 3489 - DNA, 615 bp, A.fumigatus
aattcaagttcccatcatccacgctcgttacccatacacaaacgtaccagctacaatcttcgatcaagtacactcgcttcgggtcatctatcaaacaaccactccaagatgcgttcttccgtcgtcctccttgccctctcggcccttgccgccgctcagtcttctagccctgtggtacgtgacgatcgcttccatttgaactgcgcttcagaccatactaacatcctacaggaagctcagactacaggtgtcactgtcatcggtcctgaggttagcgctaccgaggttagcggtactgctgctaccactacttccatcagctccaccacctctcagcctgtgatcccaactgctcctaccgtcattggatccagcggcgttccctcttccttctccaccgttccttctagcagcggcgtcaagagctctaccaagactgcctcgaccgcaactgccaccgagaccacatccgagtccacctctaccaccaggtccagcgcctcctctacccggtccagcaccagcagcacgacctccaacgctgccatgcccatggcgaccggctctcttggcctgtccgtcatggctggtgctgcactggctgccttcctgtaa

SEQ ID NO: 3490 - DNA, 864 bp, A.fumigatus
tctaggctttcaggaaatggatcgtcctcagacgatgactttggtcctgctctaccatccgccgatgcgccgaagaaaaggcgacgcaagctaccgttcgagaaggtctacgtgaatgcgctacccgcctctccgcggtactcgaaatcgcttatgcacaaagagcagctatccttcgttacgatgactccctacacagactttcttatcacgtcatcaatggacggtatcgtgaagttttggaagaaaatggccgtcggagtcgagttcgttaaggaattccgagcgcatcctgcggacataaagagcgtcagcgtcagtgccgacgggaggagttttgcgacggccggtgcggacaagacgatcaagatctttgacgttatcacttttggtaggctgggtcccctgctgttgatttggttatgccagctaatcggctgcccagatttgctggccatgctctccttggacttcacaccgcgctgtgtctgctgggtacaccctcgtggcgcatccctcccattgctagccgtgacagacgaagatagtccgatgatacaggtctttgatggtcgtggagagaacaccactcccttaaacaccgtcaagtcgatccaccgcagccccgtggcagccattgccttcaacaacgcatacgactgtgtcatttcagccgaccggtccggaatggtcgagtactggcgcgcgagcgacggctcgtatgagaaaccagataatgtattcgaactcaaatcctccacgaacctcttcgaattcaagaaatccaagtcggcacccgcgtccattacaatatcaccatgtcttcaccacggggctggaaggatcgcgtctgaggtattccat

SEQ ID NO: 3491 - DNA, 747 bp, A.fumigatus
aaaattcctcttcaaccacccaggcttccaaccaaacccacatctccgaacccggatctctatttctctcgcaagatgaagtacctctccattgtcgctgcatcccttgcagccatccttccctccgtcagcgcctaccccatcaccggcgacggcgtcaactgccgctccggtcccggcaccaattaccccgtggtcaagtcgtaccccaagggccacgaggtctccatcgtctgccaagcccccggcaccgacatcaaaggtgacaagctctgggacaagacctccgacggctgctacgtcgccgattactacgtcaagaccggcaccaccaactacgtcgccaagcactgcgatagcggtagcggctccggcggcggcggcggctcctcggccagcggctccggcaaggccatcgtcgccgcagcccaaaaggagaagggactcccctacgtctggggcggcggtggctgcaagggaccctctggcggtggtttcgactgctccgggttgacccaatacgccgtctgccaggcgctgaagaaaaccataccccgcacggggccaacgcagtacaaactcgaacatgggcaaaccggattccgcgcccaacagcccaaggagggcgatttgcttttctgggctacttgcggggacttgcaaaaacaagggtggcccacgttggtattcttcattccgcccccgccgcaccacccattgcttgcgaaaaacggtaccccgtggtag

SEQ ID NO: 3492 - DNA, 435 bp, A.fumigatus
agtacctctccattgtcgctgcatcccttgcagccatccttccctccgtcagcgcctaccccatcaccggcgacggcgtcaactgccgctccggtcccggcaccaattaccccgtggtcaagtcgtaccccaagggccacgaggtctccatcgtctgccaagcccccggcaccgacatcaaaggtgacaagctctgggacaagacctccgacggctgctacgtcgccgattactacgtcaagaccggcaccaccaactacgtcgccaagcactgcgatagcggtagcggctccggcggcggcggcggctcctcggccagcggctccggcaaggccatcgtcgccgcagcccaaaaggagaagggactcccctacgtctggggcggcggtggctgcaagggaccctctggcggtggtttcgactgctccgggttga

SEQ ID NO: 3493 - DNA, 822 bp, A.fumigatus
gggaggggggggcataaaaaattcccagatcggttggttcccctaccacggggtaccgtttttcgcaagcaatgggtggtgcggcgggggcggaatgaagaataccaacgtgggccacccttgtttttgcaagtccccgcaagtagcccagaaaagcaaatcgccctccttgggctgttgggcgcggaatccggtttgcccatgttcgagtttgtactgcgttggccccgtgcggggtatggttttcttcagcgcctggcagacggcgtattgggtcaacccggagcagtcgaaaccaccgccagagggtcccttgcagccaccgccgccccagacgtaggggagtcccttctccttttgggctgcggcgacgatggccttgccggagccgctggccgaggagccgccgccgccgccggagccgctaccgctatcgcagtgcttggcgacgtagttggtggtgccggtcttgacgtagtaatcggcgacgtagcagccgtcggaggtcttgtcccagagcttgtcacctttgatgtcggtgccgggggcttggcagacgatggagacctcgtggcccttggggtacgacttgaccacggggtaattggtgccgggaccggagcggcagttgacgccgtcgccggtgatggggtaggcgctgacggagggaaggatggctgcaagggatgcagcgacaatggagaggtacttcatcttgcgagagaaatagagatccgggttcggagatgtgggtttggttggaagcctgggtggttgaagaggaattttctatgggcagatcataccatttataggcattga

SEQ ID NO: 3494 - DNA, 1269 bp, A.fumigatus
  unsure (229),(260),(337),(378),(418): Identity of nucleotide sequences at the above locations are unknown.
agcccaccgggggaccatgccggttgggccgtccagttgaatcgggcttccgtgccggggccgtccaaccggggacacctccaattgggatcgggtcatcacccctcagtgtctcaagattctgacaaaatcggcgataacagggccgaccccaccgggggcagcaggttcgcgtttgccagtttccggaagaaatacgcccgttacgacgatcgggcaaagtcgaagnagaagctggccccgtacgccattggacaganctttagcgtgatccagtacacgccggttctgaacgaccagaactccgccagtgacagcgggagggccattctcgacntgcagtacatcgttggtgtcagctcgcccattccggtcacngagttcagcaccggtggccggggtcttctcattccggacntgagccagcccgaccccaacgacaacagcaacgagccgtatctggaattcctgcagaatgtgttgaagatggaccaggataagctccctcaggtcatctccacctcctatggcgaggatgaacagaccattcccgaaaaatacgcgcgctcggtctgcaacctgtacgctcagctgggcagccgcggggtttcggtcattttctcctctggtgactccggtgttggcgcggcttgcttgaccaacgacggcaccaaccgcacgcacttccccccacagttccctgcggcctgcccctgggtgacctcggtgggtggcacgaccaagacccagcccgaggaggcggtgtacttttcgtcgggcggtttctccgacctgtgggagcgcccttcctggcaggattcggcggtcaagcgctatctcaagaagctgggccctcggtacaagggcctgtacaaccccaagggccgtgccttccccgatgttgctgcccaggccgagaactacgccgtgttcgacaagggggtgctgcaccagtttgacggaacctcgtgctcggctcccgcatttagcgctatcgtcgcattgctgaacgatgcgcgtctgcgcgctcacaagcccgtcatgggtttcctgaacccctggctgtatagcaaggccagcaagggtttcaacgatatcgtcaagggcggtagcaagggctgcgacggtcgcaaccgattcggaggtactcccaatggcagccctgtggtgccctatgccagctggaatgccactgacggctgggacccggccacgggtctagggactccggactttggcaagcttctgtctcttgctatgcggagatag

SEQ ID NO: 3495 - DNA, 486 bp, A.fumigatus
acaccgccagctcagaagcttcctgccttgtatgtagtcgactccattgtgaagaatgtgggaactccctacacacttttcctgggtcgcaatatgtatcagactttcatgaatgcctacacgctggtggactcgcaaacccgcagaaagctggacgaaatgctcaagacttggaaggaacctgttccggggtcattagatacaagacccgtctttcctccggaaattacacgcagcattgaaagcgctctgatcaaggcgagaaccgcggctctacagcaacagcaggccaggagccagcaggatatacttaaccgcggccgggttggcactcctcctcatggctggacgaacaacactacgctcaaccagagtgcgactcggctcgcgccttccacaagtcagaatgggcatgctcatcaggtccgaaatggacacacgctaaattatcacgctgcggtaaggcctatgctcgtcacaaactag

SEQ ID NO: 3496 - DNA, 249 bp, A.fumigatus
  unsure (32): Identity of nucleotide sequences at the above locations are unknown.
tatctgacacatacacagttggaccctcgatntactccaacccctcaacctttgcagcgctcggaagtggatctcgcggcattgaatcgcgacatcgtagttttgattgcagctgcccgaagtgatttcgccaataaccctctagacccttctgtgcaacagcgtctcaaagctcttttagacctgcaaggcatcctccagcgtcaagaactcgtcttcacgcccggcggctggaaggaccatgtcgag

SEQ ID NO: 3497 - DNA, 420 bp, A.fumigatus
agacaaacagctagaaggagggaaagaaagcatcccaatatccctgagtgttgctactttcgcttgaagattccctttgttccctttctccctcgccttcattctcaccttgcccacgaacaccgttgcttcacagcatacctgcctgtcatgtcgtctgggcttgcctctgatgaggtcgccgaggattacaagaactccctggaggatctcaccacgaacgacaggttccagatcagcaacttgaccgtcatagccaaagagaatactgaacatgctatggccatctccagagttttggagaaccacattcgaacagtaggtggtctttgtttctcactctcatgcatttctccttggcttttgtatctcgctcggcgctcagctgtctgtaagtttgaccggttgaaccacttctaa

SEQ ID NO: 3498 - DNA, 201 bp, A.fumigatus
ccgcggccgggttggcactcctcctcatggctggacgaacaacactacgctcaaccagagtgcgactcggctcgcgccttccacaagtcagaatgggcatgctcatcaggtccgaaatggacacacgctaaattatcacgctgcggtaaggcctatgctcgtcacaaactagctgtcgtgaatgccctttgtgatatctga

SEQ ID NO: 3499 - DNA, 1161 bp, A.fumigatus
tacaagagccgtgctcagctcagggcccctggtatcctgccccgtcgttccgtcaaccagcctgtccagactggtttgaagtgtgtcgactccatggtccccatcggccgtggtcagcgtgagttgatcattggtgaccgtcagactggtaagaccgctgttgctctcgatgctatgcttaaccagaagagatggaacaactcttccgacgagagcaagaagctctactgtatctacgttgccgttggccagaaacgttccactgtcgctcagctcgtcaagacccttgaggagaatgacgccatgaagtactccattgtcgttgctgccactgcttctgaggccgctcctctgcagtacctcgctcccttcactggctgtgccatgggtgagtggttccgtgacaacgggcgccatgctgtcatcgtctacgacaatctttccaagcagggcgtcgcttaccgtcaaatgtctctgctgctccgtcgtccccctggtcgtgaggcctaccccggtgacgttttctacctgcactcccgtctcctcgagcgtgctgccaagatgaacgacaagcacggtggtggttcccttactgctctgcccgttatcgagacccagggtggcgatgtctccgcctacattccaaccaatgttatttccatcaccgacggccagattttcctggaatccgaactcttctacaagggtatccgtcccgccattaacgtcggtctttctgtgtcccgtgtcggttccgctgcccaggtcaaggccatgaagcaggtcgctggttccctgaagctgttcttggctcagtaccgtgaagttgctgctttcgctcagttcggttccgatctcgatgcctccaccaagcagaccctcgctcgtggtgagcgtctgaccgagctcctcaagcagaagcagtactctcccatggctgtgtctgagatggttcctctcatctttgccggtgtcaacggttacctcgacggtatccccgtcaacaagatcctcacttgggagtctgacttccttgccagtgtcaagagcaaccagcccgagatccttgagaccatcgacaaggagggccaggtcagcaaggaactcgaggctcagctccgtgaagtcattgtgaacttcaacaagtctttcaacgcatag

SEQ ID NO: 3500 - DNA, 1245 bp, A.fumigatus
cgtcaggaaaaaacagtacacggtggttcaatcacccaattgccttttgctcacctatgcgttgaaagacttgttgaagttcacaatgacttcacggagctgagcctcgagttccttgctgacctggccctccttgtcgatggtctcaaggatctcgggctggttgctcttgacactggcaaggaagtcagactcccaagtgaggatcttgttgacggggataccgtcgaggtaaccgttgacaccggcaaagatgagaggaaccatctcagacacagccatgggagagtactgcttctgcttgaggagctcggtcagacgctcaccacgagcgagggtctgcttggtggaggcatcgagatcggaaccgaactgagcgaaagcagcaacttcacggtactgagccaagaacagcttcagggaaccagcgacctgcttcatggccttgacctgggcagcggaaccgacacgggacacagaaagaccgacgttaatggcgggacggatacccttgtagaagagttcggattccaggaaaatctggccgtcggtgatggaaataacattggttggaatgtaggcggagacatcgccaccctgggtctcgataacgggcagagcagtaagggaaccaccaccgtgcttgtcgttcatcttggcagcacgctcgaggagacgggagtgcaggtagaaaacgtcaccggggtaggcctcacgaccagggggacgacggagcagcagagacatttgacggtaagcgacgccctgcttggaaagattgtcgtagacgatgacagcatggcgcccgttgtcacggaaccactcacccatggcacagccagtgaagggagcgaggtactgcagaggagcggcctcagaagcagtggcagcaacgacaatggagtacttcatggcgtcattctcctcaagggtcttgacgagctgagcgacagtggaacgtttctggccaacggcaacgtagatacagtagagcttcttgctctcgtcggaagagttgttccatctcttctggttaagcatagcatcgagagcaacagcggtcttaccagtctgacggtcaccaatgatcaactcacgctgaccacggccgatggggaccatggagtcgacacacttcaaaccagtctggacaggctggttgacggaacgacggggcaggataccaggggccctgagctgagcacggctcttgtattaagccgccgggctggaaggaccacgctc

SEQ ID NO: 3501 - DNA, 285 bp, A.fumigatus
tcactaaacaataataaagcatgtttaccgccaaatgctatggacgtcctcaatcgaggtaatggagttgtatatttaggcaacaccgcctcctacagccgttgttctcatctacgctcattctttattccaggtttcatccaaatgcctgccggacttatcttcatcaccggtgctaccggctttattggcagcgctgtggccctcgaagccctcaacgcaggttactcgctgcgcatcagcatccgcaaagagtcacagatccccaaactcaagaaaattctg

SEQ ID NO: 3502 - DNA, 486 bp, A.fumigatus
acaacgctgcggaaaactacgctcctatcgcaaatcaaggccctgtatctgccccgtcccgatggcgccactgctcccaacccaggcaaaactgtgcctaccgttggccagaatgtcgccacgattccattatcggacatgtacctgaagatttgggatgtgggtggtcaaatttcgatgcgaaatctgtggcagagctactactcgagttgccacgccatcatcttcgtcgttgatagtacggacgtcggacaagatccagacattacgcgtctcccctcgaatcagaaacctggctcgttgtcgggcccatccgcgtctggaagtggccccgtcactgaagagatggcagggatcaatgcgccgggaagagagtttggacggttggatgaatgtcgccaggtactggaatcggtgttacaacactccgatgtggctggagtcccgattctcgtgctggccaacaagcaagatcgggaagattga

SEQ ID NO: 3503 - DNA, 189 bp, A.fumigatus
gtcgaagttgttcgcatcaaggagggtcttgtgcgcaaggtctttgagggtgaatccggaggcggagtgcgcgatagccgcgtgttgcctgtcagtgccttgatgggtacaggtgttcgggaagcagtggaatggattcaaagtcgagttaagtggaataaggaaggacgacctcccatcatgaaatga

SEQ ID NO: 3504 - DNA, 360 bp, A.fumigatus
ccgttggtagacatttggcttacaccaccagacttcctacatacgacagtccttgagatagccagttcccggactcctttggaggtcgactctttcgtgtctcatctagagcagagtggtgtgattccgggtttggtcaactacaccttcaaccaccgggcacggctggtcaaacctgttgtcagctttgacgcctcagccatggctcttagcttcgtccctgcagctggagagccatcacgatggagtcgctccgtggacgatgacaactatacgtatcatcatttgcgacgagatctgtatgctggggtggcagctacggggtcttcaccacggaggcggaaggtcacagtcctagac

SEQ ID NO: 3505 - DNA, 207 bp, A.fumigatus
gacatagaccaaatcatccgcagctgccatccaataccattaattgactacggagatatattgtccgtcggcttgcaagaactggactatttccccgcatatggaatcgatttttgcggggctgaggacatcgatatcaatgcgtcaatcccggtctggagtacattggtatctgaaatggcatatctatcacatcagaagaactaa

SEQ ID NO: 3506 - DNA, 204 bp, A.fumigatus
tctatatcctccttgtgcaactgtcatgcagataatataagaggccagctttgcaaaattcccaagattgcgacccccgcggagaaccgaattacttggggtacctcagagcctgaggctccgttctcgacacccacttaccaagataccaacaagattaagtcttcaccgggggctgaaggagccgctctattggcaatctaa

SEQ ID NO: 3507 - DNA, 246 bp, A.fumigatus
cggtcgcggacgcggttcttccagtccgtggtcaagaatggcgtcaaggcccgacagtctaccctcaagagcgtcaaagatgacaaggagcaccggaggacaaggatcagcaccaagagcggatatgatcgacggatggagaacaagaagaaggccctcattgcagccagccgcaacagaaagtccaaaacgcagtctacggaccctggtagcgacgacgagagctgggatggcctcgacggctag

SEQ ID NO: 3508 - DNA, 513 bp, A.fumigatus
tcccttgaattgaggcggctaatgatggaacttctgcaacaggtctatctggatgatccccttcctgctaatcgcaaacacccctctcacacggccgaatcgttttacatcgactaccccgagctggaggagacaaagcacttgaaaagagggctgggcctcgtaactaccatatcggataacccccccatgctgaattggatctacgcggatacagagacacatgagctgaagtatgggaatcggacgcagagtgtgcagcatgtagtcgggccgtgggattgggcggacgaggagacgactatcacgctggaagggaagagggcttttatggctgttcaggaagaggatgggagttgggctgtctactttgaccgggacggtgatgagttggagtgggttctcgaggaggagggtaagttggataatccgtttgcgccgataaagcttaagaggacgatggtcccgcaggttcctcaggctgagcagagtaataaaaatgataattcgtga

SEQ ID NO: 3509 - DNA, 204 bp, A.fumigatus
ggttcccctctgattgctaataaccagtctgcttcttcacttctacgtgaggtgttaccaatgacgactcttgtgccccgcgagccttactccaaggaagagctagagaagctctatccaaaggagcttcagcttcaattggtccaggtggtatgtgatgagatacaaacgtattttccgcgccgagttaatcaagcatactga

SEQ ID NO: 3510 - DNA, 1374 bp, A.fumigatus
ccagccaaccaccctcaatcgtattcgggtccttcctaccgtggtgggcattcaggttatcgtgggaactcccaaaatcatggccgcgaccagcgattttctggctctggtcactcatcctacaatactgggccgtccgggcgtggccgtttcaacagttttcaatggaatgctcgcggcggcggcggctctgtcagccctcataccactcatccggagccctcacaaagcccagcgccccttcctgcggcaggagagcagagcttctcaggggagggagacagagaccaagctttcgggtctccgagcagagatctacagaccttggatcaagggtcaaaaccatgttccgaggatgtggatttcccgaagatatcgcgacctacacagccgtccgacaccaatgccacgccgaataaaggcggcaagtttagctttgccttcaaagccaaaaccactcctgcccctgcccccaagccagttccagatttggcacagaggatgcaggctcgagaacctccacctcgtgttgctgagcctgctcgtagtagggtgcttcttggcccaccgccgcgattcaaacctgaaccacgctttgaccgccgcgatcgagacagagaccgggatcggcaccgaaatcgtgagcgggacagagggagacgcgaccgaagagattttcgacgagacccgcgtgattaccgtgagcctagagatattcgcgacaaccgaaaagaagatcgccgctttgatcagcgacacgtaggcaggaaggaagatcgtcggcaggaccctcgtccacctcgcggtcctcgggaacgttctccgggcgtgaagcaaccccaagtattaacccggccaaagcctcggcctactctcccagaggagtacgcgaagtccgattccgtttattaccgaaaaccagggaacgagtccgtcattggtgctggcacctacggaaaagtcttcaaagcaatacacgtttatacccaaaggaaggtggccctcaaaaagatacgtatggaaggcgagaaagacggcttccctgttacggctgtccgagaaatcaagcttctccagcaccttcgcaaccataatgtggtcagtttactcgaagttatggtcgagaggaatgagtgttttatggtctttgaatacctttcgcacgatctcacaggtctcattaatcacccgaccttcaccctcaccgctgctcacaagaaggatctcgccaagcaaatgtttgacggcttgaactaccttcaccaccggggcgttctacaccgtgacatcaaggcagcaaatatcctcatcagcaacaggggctccttgaagttcgtcttcaccacaaggggacggaaggatccgcgtatggtt

SEQ ID NO: 3511 - DNA, 1251 bp, A.fumigatus
agacggctcagtggcaactctggcagccagcctggccagagtcgtggtccgcaaagccaaccgtcacagaaccccccggggacgtcgccgagtctgcatgatcgacctgctcagggatcgcaagctgttgagaatgaggatagctcgagagccttggttgtgatactcaaatcacaggcccacatcttcttcctacacggcaatagccatgtcattcctctgccttttgaggttgattcggtattcgccacccctcgaggtcttctcttccagagaaaaatgcaagaggaagatactagtatttacccaatggcacctccaaattcattcatctcatcatttcttaccactgacttccgcgcctctgaatccctggaactgccctctggcaaagtcaaacgaccatcattgaccatttctcctgctcagaacaccgctttgaactgtcgagctactaaaactgcgaacttgccccgggtgttctctctcatagaccctcactctgaaatgggcctggttgtgaccaaacagtcctcacgttggttacagcgtagtatcaacagcaaaccctctggcctggatgcccttgatcctgccgacgaaattgtatatgtttctccagttaatgaactcttggggtctagccgggctctgagtaagagtccgttgaccctcgtggtaaccgtcaacttaaatactgggctgtacactctctggacgacacgatatagagaggacgagactggtccttcctccaagaaacaacggaggcgagacacagggggcacgcgatccaagcgtcgtagttcgcatttcagcatggcgacaggagcaaccacaccggctgcacgcccgtccgcggccagggagagcttcgggccccgaggcgacaactggaacgcgtctggcttctcccactcccagtactccgtcgacggcaggccggatgaggatgacctcgcatcaagattgggccaggacttcggcgatctcggtgttccgtctaagacgtcacggcgggtgagttccatgctcgctcgcactgatcttgcgagcagccaggataggatcgcattctcggatcttgctacaggaagtcaaacaggcaccgtgcctcatggaggtttgcgccaatccattggcggaaacagcactcgtgggagtttaggatttaatccacgccgttcgctgccaccggggaactggctccgtatacagcacagcaagcaatttcgtcgatgcaccggttga

SEQ ID NO: 3512 - DNA, 501 bp, A.fumigatus
cattggcagtgtgacgtgctcgttgcaagcttcgacgcgacagtgctgcgcacaacgggagtcaagcttgtacagcatttatgggccagtgatatcagcgctgaattggctgtcgacgcttcatccttggaagaactcctatctgagtacaaagagcacaaccatagctggattgtcatcgcaaaacaagatagtaaggagcgaggcttcaaagtgaggtgtctcgcccccagagaagaactggacatcaggagctctgaacttattccttggcttcggaacgagatacgtgcgcgcaatcaacgcgagggcgcacccgacctacggcagtcaagattgccaagtcagtcagatgcgattgcaggagctaatgaaagatcgagcgacgttcgcatcttggtcagccagcaccggagcaagaagacgaacagaagaaacatcgtcgagtctggtatgtcatgttcgaagaattcccatcattgcacgaataatcagaactga

SEQ ID NO: 3513 - DNA, 324 bp, A.fumigatus
tcttttgaggcagctctccttcgttctcgggaggtagtcgagaaggcaatcaacgggcccattgcggctattgacactcgagatgacctgcttgaagcgatcagggatacgcgcctgtcggatccggaaagctggcgctcagtcattcaaagtgcccctctgaccgagcgaaagtatctcagtcaagtccatgaactactcctggacctctccaatgaatgtcgcgcgaacgatggccccgacagtgtcagcaatgcctttatttacaactaccggacaggatcgtgcctgtattatgaccttgggcgtgggagtgaaaagtaa

SEQ ID NO: 3514 - DNA, 231 bp, A.fumigatus
caagcaatatacaatcatatcattactctgtctggtcgtcatatcttctattattatcgtttcaagagcacagactcatctcgattattatctacatcttcatcttcatcatcatcattgttagatcaatcatttgttgagactccagccaactggtccccagtgttatcaattatttgctccggttccgctctctccgctcccccgatcaagatcgcattttacagttga

SEQ ID NO: 3515 - DNA, 579 bp, A.fumigatus
ggctccatagagcaagaagatccccaagcttccatacaagcaaacaagcgagaaaagcaatggcttcagatacttgaccgcaaacacatccgccgtcaccagcggatcccccaccacccaaccctccacatacacaaacgccgcgagaagcaccacccccagcgcaagacacacatcgatatacgccgtcgcccactgcctcggcgcatgcgcactccccgcaatggcaaacaccagcaacaccagccccggcaccagcagcccaccccccagccagtccatcccgactttcctcgttttcctgcgctccgcaaaatcactcgggatcgagaaaaacgaggtcacggccgtcaccgcggccagaatccccccgatgaagaaataccagcgccaggtgagaaacctcccgctcaaccccgagaagaaaatccccacgaagaaacccagcgccgcgcaagcgccgtacacgctgaaaaacaagttcttccgcggcccgggggcggtacacactacctaaaatcatcatgcctgaaagcagatacgcagcgagcgctaaggcttgcactgcgcgggagatga

SEQ ID NO: 3516 - DNA, 507 bp, A.fumigatus
agcaagaagatccccaagcttccatacaagcaaacaagcgagaaaagcaatggcttcagatacttgaccgcaaacacatccgccgtcaccagcggatcccccaccacccaaccctccacatacacaaacgccgcgagaagcaccacccccagcgcaagacacacatcgatatacgccgtcgcccactgcctcggcgcatgcgcactccccgcaatggcaaacaccagcaacaccagccccggcaccagcagcccaccccccagccagtccatcccgactttcctcgttttcctgcgctccgcaaaatcactcgggatcgagaaaaacgaggtcacggccgtcaccgcggccagaatccccccgatgaagaaataccagcgccaggtgagaaacctcccgctcaaccccgagaagaaaatccccacgaagaaacccagcgccgcgcaagcgccgtacacgctgaaaaacaagttcttccgcggcccgggggcggtacacactacctaa

SEQ ID NO: 3517 - DNA, 561 bp, A.fumigatus
tgcaaaggcagcatgcaaggcatcatgaacgccagtccgctgcaaatcgtcgcgtggaccgtccccatggcgtttggaggcttgcttatctcgacagtaggcggcttcatcatgcaccgcattcccggcaccatcctcatgctcatctcctgcgtggggtacctcgggtccggcctcttctttgccctcataccggagaacggagggtactgggcctttgtcttcccgtccatgatctgcgggaccatcggaatagacatcagtttcaacgttaccaacatcttcatcacaagcaacatgccgctggagaagcaagggctggcgggggcgctgatcaactgcacgttgcacctggggattgcgctgcatctggggtttgccgacatcgtacaggtcaacaccgacgatcaagggctgcggaagagctaccaagcggttttctggttccaagttgcgctgtccgggctggggctagtggtgaacgcgatatttgtgcggattagtcgggcgaagagcgacctgaccgttgacgagaggagggctttagagagtaatctatag

SEQ ID NO: 3518 - DNA, 519 bp, A.fumigatus
gtagtgtgtaccgcccccgggccgcggaagaacttgtttttcagcgtgtacggcgcttgcgcggcgctgggtttcttcgtggggattttcttctcggggttgagcgggaggtttctcacctggcgctggtatttcttcatcggggggattctggccgcggtgacggccgtgacctcgtttttctcgatcccgagtgattttgcggagcgcaggaaaacgaggaaagtcgggatggactggctggggggtgggctgctggtgccggggctggtgttgctggtgtttgccattgcggggagtgcgcatgcgccgaggcagtgggcgacggcgtatatcgatgtgtgtcttgcgctgggggtggtgcttctcgcggcgtttgtgtatgtggagggttgggtggtgggggatccgctggtgacggcggatgtgtttgcggtcaagtatctgaagccattgcttttctcgcttgtttgcttgtatggaagcttggggatcttcttgctctatggagccttatag

SEQ ID NO: 3519 - DNA, 1389 bp, A.fumigatus
gatgtaatgatggaggccatagagcctctttggggagtccccgcagccgacattttaggtcgtgtggaaaatgctttgaacgcgggacagatgtcgatgatccgcttcgctatttcagatcatcatgtctcgcactcaatggataatcatgcaccatggatggcggaccagattaccggatggttcagtcaagagatgcttgacactttgcctgatctcgttttcgcggtgaatgtaaaggacgaacctaaagtggtggtcgcacacgatgcactcgaacaagtactctcccaggcccggactgctctccataattctattggtagggatcctgagttgtcccaacaggtcaagtttattgaagtcggaagacagaacgcttgggaagccctcaccatgtcttgctccatagactttccttccagggccttctcgaagacgacagcgtcatctacggtatcagaggtgggattactatcgaacttgacaatgagcaaagatatatgcctttatcctgaacttcgaaacctccacgccatacttcaagcgcctgcgtcgttagctttgacgcactctctggtaccgatattctcgcaggccaagccgtcctccttccaagacctgctttatccaagtccatggtatgctgcaaaaatggacatgatggaataccgcgagcaggatgatatggactgggagcagaaagagaaccttgtctactggactggatcaactacaggtgggtattcgacgacagacaattggcggtcattccagcggcagcgcctcgttctgtggactggagacaaaaatcggcctgtcactctcctgagaaagtctgattctaaaggcccctctgacaatatagtgacatgggaggcctacaattctacaatcgcgtccatctcgtcttccttgaaaatacgtatgtcagctgtcatccagtgtgaggaagacgcttttcgcgatcagaaagccgcatttggcttcgaagatgaagtcaaggatgagctcagagccagctatgcagccaagtatacccttgacctcgatgttaacggtttcagtggccgcttctatcgacttttacgctcaaattctaccgttcttaagcacacaatctacaaagaatggcatgacgactggttaattccatgggtacattacattcctgtcagcatggatctaaaagactttcccgagattgtgcgttacatgtcgaaggagccggagggcttagccttggggcagaagatcgctgatcaaagccgagactggtccaacaaagtgctgcgcaaaattgatatgaggcttgtcttttggagattgttgttggagtatgcgagagtcctggatgagaatcgggaacaaatgcattgttgctcctga

SEQ ID NO: 3520 - DNA, 516 bp, A.fumigatus
gacctgccattgagatacggccgttcttggtctggagagggaaaagtattagcgtgttgtctcgcagtcaaccagacctcaggtgggcggacaaaagggaggtgtagctatttatacggggctgcaactgccgtggggatgatccgaggagggggtggagaaccccagaaattgcggtgtctagtcggggctggtgcctgcggaactacaaaaagcgagaaagccacttaccatgtacacgtgccacttctctctgaggatcttgacctgctcctcggtcaatccagtgaaactgaacatgccgatttgactggtgatgtgttcccagttgccaggtgtgccctttgcctcgaggcgctcccgcagacccttgcgcatctccgcgatacgaccgctcatcgtgcgcaggtcctcctcccactcagcgaagagctgggggtcattgagaatgcggctagcgatgcgcgccccatacgcaggcgggttagaaatttcagagcgctgcaggatggctag

SEQ ID NO: 3521 - DNA, 414 bp, A.fumigatus
  unsure (42): Identity of nucleotide sequences at the above locations are unknown.
gcgcaccggcgccttcccatttcgtttcgggccccgggcccngacgcttcaacggccaacgccaacatcgcctcccagctagccatcctgcagcgctctgaaatttctaacccgcctgcgtatggggcgcgcatcgctagccgcattctcaatgacccccagctcttcgctgagtgggaggaggacctgcgcacgatgagcggtcgtatcgcggagatgcgcaagggtctgcgggagcgcctcgaggcaaagggcacacctggcaactgggaacacatcaccagtcaaatcggcatgttcagtttcactggattgaccgaggagcaggtcaagatcctcagagagaagtggcacgtgtacatggtaagtggctttctcgctttttgtagttccgcaggcaccagccccgactag

SEQ ID NO: 3522 - DNA, 252 bp, A.fumigatus
tccagtcatctactgcagaatttccgtggccaacatggcaaggcgtacttgttcaacactgttgtcaatgtaacccactccgaggctgtggagcgtaacatgaccaccggaaggcatatcgtccgagacatattctgcaggcaatgcgccgaactagtagggtggaagtacgacaaagcgtacgagtcgagtgagaaatacaaggaaggaaagttcattttggaggaagaattattatgtgtggtgtgttga

SEQ ID NO: 3523 - DNA, 453 bp, A.fumigatus
agagttatatgccatatctgcagagtttggggcatcatcatcatcatcatcatcatcatcgcaccttcgattcttatggggcatccaggagaagcatatatgccgatgacttcgtacgccctattgattatagggatgatttacgattggttagccaacgccagcacggtcatgtgcaaacaactggacctatggattctcttcccagaccaactaatgaccaccttcgacaccattcaagcagggaatttcttgatccgccgtatcgtgcactcatcaatccaccacatacagctccaaatcatcgaggcgcgggaatcagtcgacgcgctgatgatcaaacccttgcggattattatagccctagttactacagtcgacatgaaacatacggttcttctcttgcacttgaccgggatgccagaactgatgaacgacaaatgcaacatttag

SEQ ID NO: 3524 - DNA, 588 bp, A.fumigatus
aggtggctaacgcatgcgcggtccttccggtcctgggtgaagagttatatgccatatctgcagagtttggggcatcatcatcatcatcatcatcatcatcgcaccttcgattcttatggggcatccaggagaagcatatatgccgatgacttcgtacgccctattgattatagggatgatttacgattggttagccaacgccagcacggtcatgtgcaaacaactggacctatggattctcttcccagaccaactaatgaccaccttcgacaccattcaagcagggaatttcttgatccgccgtatcgtgcactcatcaatccaccacatacagctccaaatcatcgaggcgcgggaatcagtcgacgcgctgatgatcaaacccttgcggattattatagccctagttactacagtcgacatgaaacatacggttcttctcttgcacttgaccgggatgccagaactgatgaacgacaaatgcaacatttagggtatgatctcgaccagaatcttccttggtggaattgcctgtcttcgtttcaccaacattccctcttgattttctcttcgtttcgaacactgtga

SEQ ID NO: 3525 - DNA, 189 bp, A.fumigatus
atgatggcaacagcactcgccccgcgaattcgtccgagctcgctgaacatcttggaatcgaagaatgcgaagatcccgaatgcactaaggagaaagaacatttacgacgccatgcagcgaagcatcgccgcaggctcaactacattcgagagagtcttcaccacggggctggaaggacgaacgggcatc

SEQ ID NO: 3526 - DNA, 1398 bp, A.fumigatus
gacgactccgttttcgagattacttattcgtatattggtccttcctcacctgattttgctcttttttttttcgtttccccccccaggcagatcttttactccgtacacctcccttcgctcttccatcctcctggcttcaaccaaagtacaacaacaacaacaacaacagcatgcctcgtacccccctcacctaggtacagcatgccccatgggattcgagctccgggagatggtatcaccgggggatatacaggcgatagcctagcattgaaaatcaccattgcgactctggcgggaatcacctggtacaatgccatcgaactcgtcattctcgtcttcgtcaccttcagcaagtatcatggcacctacttctggagcttgctcgtctcctcgtctattgggctcctcccctactcggtcggcttcctcctcaagttcttccagctgaccgaccagacctggctgtccgtcaccttcatcactgttggctggtggtgcatggtcaccggccagtccatcgtcctctactcacgcctgcacctggtcgtgcgcaacccacgcatcctgcgccgcgttctcaccatgatcctcgtcgacgccgtcatcttccacatccccaccactgtgctgacctacggctccaacttggccggccccgtcgacgccccggcctacatccgcggctacaacgtgatggaaaagatccagatgaccggcttctgtatacaggaattcgtcatctccgccctctacatctgggaaaccatccgcatgctgcgcctcgacccggaccgcggcaagcgcaagatcatgtaccagctcgtcgccatcaacctcatcatcatcctcatggacctcggcctgctcgttgtcgagtacatgaacaaatacatcatggaaaccatgctcaagggcgtcatctacagcatcaagctcaagctcgagttcgccgtcctcggcaaactcgtctacctcgttcacaaccatgtctggaaatctgaccccatcggcgtcgccggcgaggactgccaccatcagcactatatcaatcacaccgccggctactcccaccccgactaccactaccccgacttcgtcgacgcgacccgcatcacatccgacctcacgcgcgctgtgcccccggcatcctcgtccgcaaacgctcgccgccgctgccacccctggatggactcggacgacatctccatcgccatgttcgagcactcggagaatgcaaccccctcgctccccgaccaggctaccggccactccgagatctcgcagtcctggagcggcgagacccagcgcgacgtcagtccgctagattttacgggttcggtgcataaacagcacaatagtataagtgtgtcagcgccggcgcccgataaaccgggttga

SEQ ID NO: 3527 - DNA, 441 bp, A.fumigatus
acaaatacatcatggaaaccatgctcaagggcgtcatctacagcatcaagctcaagctcgagttcgccgtcctcggcaaactcgtctacctcgttcacaaccatgtctggaaatctgaccccatcggcgtcgccggcgaggactgccaccatcagcactatatcaatcacaccgccggctactcccaccccgactaccactaccccgacttcgtcgacgcgacccgcatcacatccgacctcacgcgcgctgtgcccccggcatcctcgtccgcaaacgctcgccgccgctgccacccctggatggactcggacgacatctccatcgccatgttcgagcactcggagaatgcaaccccctcgctccccgaccaggctaccggccactccgagatctcgcagtcctggagcggcgagacccagcgcgacgtcagtccgctag

SEQ ID NO: 3528 - DNA, 741 bp, A.fumigatus
cctagcattgaaaatcaccattgcgactctggcgggaatcacctggtacaatgccatcgaactcgtcattctcgtcttcgtcaccttcagcaagtatcatggcacctacttctggagcttgctcgtctcctcgtctattgggctcctcccctactcggtcggcttcctcctcaagttcttccagctgaccgaccagacctggctgtccgtcaccttcatcactgttggctggtggtgcatggtcaccggccagtccatcgtcctctactcacgcctgcacctggtcgtgcgcaacccacgcatcctgcgccgcgttctcaccatgatcctcgtcgacgccgtcatcttccacatccccaccactgtgctgacctacggctccaacttggccggccccgtcgacgccccggcctacatccgcggctacaacgtgatggaaaagatccagatgaccggcttctgtatacaggaattcgtcatctccgccctctacatctgggaaaccatccgcatgctgcgcctcgacccggaccgcggcaagcgcaagatcatgtaccagctcgtcgccatcaacctcatcatcatcctcatggacctcggcctgctcgttgtcgagtacatgaacaaatacatcatggaaaccatgctcaagggcgtcatctacagcatcaagctcaagctcgagttcgccgtcctcggcaaactcgtctacctcgttcacaaccatgtctggaaatctga

SEQ ID NO: 3529 - DNA, 231 bp, A.fumigatus
atcactgcttccatgtctgctggatccttcgccggtgcaattgcggctggtttcatctccgaccgcattggacgtcgcctatccctgctcgtagcctcgctcgtctggatcaccggggcggtcatccaatgtagcgcacagaatgtggcacacctagtcgccggtcgcgtcattagcggtctttcaggtattcttcccggtcatcattcaacagaactcgacagaagctaa

SEQ ID NO: 3530 - DNA, 258 bp, A.fumigatus
aacgaggacgtgcgtgtcatgttcagtgacttcggtcgtgcaaaggtcactcggaaacggaaatcctcgggacagaagcctcaattgtcaaagtctaaggaggcagaagatggctatgcggtacgaggtcgttgtctaggtcggttgagccacgtcattgcgtggagtaattactacagtagcgaaagcaaggatctccagcgatgtggatcgtacatccccccagaggcttacttcaatgatcaaaactcaaactaa

SEQ ID NO: 3531 - DNA, 966 bp, A.fumigatus
agacccctttatctgggttccgccaaatcgaacatcggccacggggaatcagcttccggagtgacatccttggtcaaggtcctgttgatgttgaagcagaacatgatcccgccccactgcggaatcaaaacaaagatcaatcacaacttccccacggatctggcccagcgcaatgtccatattgccttcaagccaaccccctggaacagaccggtctcgggcaagcggaagatgttcatcaacaacttctctgctgcgggcggcaacaccgctctcctgatggaagatgcccccctgcgtgagatcacagggcaggatccccggaatgtgcatgtggtgtctgtgacggcacggtcgcagactgcgctgaagcgtaacatcaacgcgttgatcaagtacatcaacacgcatgcgccctcgtcgccggcgaatgagcgacggttcctggccagtctggcttatactactaccgcgcgtcgcatgcatcaccccttcagggtcaccgcagtggggtcgagcgtgaaggatatccgggaggtcctgcgtcaacgtgccgatcaggatgtcaccacccccgtccctgcgacagcccccaagactgggttcgtcttcaccggtcagggagctcagtacacagggatgggcaagcaattgtacgaggactgtgccacattcagaagcacgattcaccgactcgattgcattgctcaaagccaagggttcccctccattctaccgttgattgacgctagtatgcctgtggaagaactgagccctgtcgtgacccagctaggaaccacatgcctgcagatggctctggtcgactactggaaaggtcttggtgttcctcctgcgttggttctgggacataatctgggaaaactacccacgttgaacagttgcggcgtcttgtccacccagcgaaccaatttaccctcttggggccgtcgcgcgccatttttttag

SEQ ID NO: 3532 - DNA, 354 bp, A.fumigatus
agggtgctagataagcttaccatcaagagtattaccccccctactactgctcacggacctcctacagatgctgaatggattgtaaagaccccttatactactactgaggtacaaaggcagatggagcttattaagcagcttattaaatgcaactcccaaagtcccccaactaaggctacccgtcagcttgctaaggcagctgaatctactatgcataaagtccttctcctagatcaggagataaagggcctacatacagcaaatgagaagcagaagcgaaagcgtgcaacccctagatcttatattgctactggaggtgttctgacaggtgctgaaggccagcaacttgcctaa

SEQ ID NO: 3533 - DNA, 804 bp, A.fumigatus
aggttgcgcagctggatgctcgggcccgattggccctcccacggcgaaatcgacatcatcgagggcgtcaacacccagcccgtcaaccagatgaccctccactccacggacgggtgctccatcgccaatggcggcttcaccggcaccctgctcaccagcaactgctacgactatgcccccagccaagacaccaacgcaggatgcggcatcgctgccacctcaagccggacatacgggacggggttcaacaacgccggcggcggcatatacgcaacagagtggacctctgcaggtatcagcatctggttcttccctcgcggatccacccccacggatatccgagccggcacacccaacccgacgaattggggcccgccgctcgccaagtttgccccgggaagctgcagctttgatgcccactttagcgagatgcagattgtatgtcctttccgtccccgctccatttgtcccccttgggttttgccgcgggctgacagatggaaaacaaataaggtcttcgatacgacgttctgcggcggctgggcaggcagtgtctggggctctggtagctgtgcgtccgtggcgccctcgtgccaggatttcgtcgcgaataacccctctgcgttccgggaggcgtactggctcattgaatcgctcaaggtgtatcaggatgcgcctggggagagtaataacatgaggatgaatgccactagccatctgaatgtgcagttgcctcggaagggtggcaggcgcagtcctggtctgcatggtcgtggctttcttgagggcactggtaagtggtga

SEQ ID NO: 3534 - DNA, 603 bp, A.fumigatus
ccctccactccacggacgggtgctccatcgccaatggcggcttcaccggcaccctgctcaccagcaactgctacgactatgcccccagccaagacaccaacgcaggatgcggcatcgctgccacctcaagccggacatacgggacggggttcaacaacgccggcggcggcatatacgcaacagagtggacctctgcaggtatcagcatctggttcttccctcgcggatccacccccacggatatccgagccggcacacccaacccgacgaattggggcccgccgctcgccaagtttgccccgggaagctgcagctttgatgcccactttagcgagatgcagattgtatgtcctttccgtccccgctccatttgtcccccttgggttttgccgcgggctgacagatggaaaacaaataaggtcttcgatacgacgttctgcggcggctgggcaggcagtgtctggggctctggtagctgtgcgtccgtggcgccctcgtgccaggatttcgtcgcgaataacccctctgcgttccgggaggcgtactggctcattgaatcgctcaaggtgtatcaggatgcgcctggggagagtaataacatga

SEQ ID NO: 3535 - DNA, 411 bp, A.fumigatus
  unsure (22): Identity of nucleotide sequences at the above locations are unknown.
aagtatcggtacctgtttgacntagacggcgcgggcttcagtggtagattccttccgtttttacaaagccacagtctccccttcaagactggcttgttccgacagtggttagacgggcgggttactccctggctccactatgttccgattgatgtccgtctgcacggagtttggagcaccctggcatacttttctaaattcgacgtaccagtcacggaaggccccgacggtcagcctaaagatacaatacagcgacacgatgctcgaggcaagtatattgccgaagagggccgcaagtgggccgagaagcccctgcggaaagaggacatggagatctacttcttccgtttgctattggagtggggccgcctgacggatgataatcgagatatgcttggattcaagatttga

SEQ ID NO: 3536 - DNA, 183 bp, A.fumigatus
aaggattgggttactgttgccctcgccgttaagtcggggccggacaatcgggtggtggagatggtttctacatcaggaacgcaattcatttatggtcgtttaacaaataatgaagcagacctagagcccaccaagtaccctcagtcattctggttttggcataggcctatatcaagccagtaa

SEQ ID NO: 3537 - DNA, 243 bp, A.fumigatus
  unsure (240): Identity of nucleotide sequences at the above locations are unknown.
attctgcatgggacaatcatccagatgttttcgatgctgagcctgcctgaccttatccctactgtcgcagctgcttccatgctgtctcatctctggtcggcaactgtgtatcctttagtcacagaccaacttcatgttccaggtttatctagctctcttttcgttaattttgtctgtgatataccctttgctgtgcctgttgttctagtgggtggagtatttgactggtatagcatggantag

SEQ ID NO: 3538 - DNA, 753 bp, A.fumigatus
aaggcaggcgacgatcggaatggtgttgatcagtgtcgcttttctctccagcggtcgcattttgatctcttccggctcccgagttgtgagatggtcaccatgaagctgctctacctcacatcgtttgcctctctggccgtggccaatggcccaggatgggactggaagccccgagttcatccggttagtgttcctctcgccgggtttgtctgctgtatgctaacagcatcctgtctattacagaaagtcctgccccaaatgatccatttgtgggatcttctgcagggcgctcaacagctggaagacttcgcctatgcctaccccgagcgcaaccgcgtctttggtggacgggcccacgaggacaccgtcaactacctctaccgtgagttgaagaaaaccggctactacgacgtttacaagcagcctcaggttcaccagtggacccgagccgaccaggctctcaccgtcgacggccagtcctatgacgccacaaccatgacttacagccccagcgtaaacgccacggcgccgctggcagtggtgaacaacctgggctgcgtcgaggctgactatcccgccgatctgacgggcaagattgctctgatctcgcggggcgagtgcacctttgcgaccaaatccgtcttgagcgccaaggccggggcggcggcggcactcgtgtacaacaatatcgagggttcgatggcgggaactctgggtcttcaccacgaggcgcgaaggatccgcgataaggta

SEQ ID NO: 3539 - DNA, 258 bp, A.fumigatus
ccaagtccatacagtgtgtctatcgaacgtgaccacaagccgatccaggtttgcaagaagggccaaccttccgtcgccgtcaagatcgaaggagccaaccagcctatgtacggccgtcaactagaagagaaggacaccctctactcgcacatctcccgtgccagtatcgacaccctcaaggagttctaccgttcggacgtatctatggaggaatgggctcttattaagaagctcaagccggtgttcgacattccttga

SEQ ID NO: 3540 - DNA, 714 bp, A.fumigatus
agaaactcctgtcccaagttcgccataatgttccccaacaaaggaggttcaaggcccgcccttgggtgtcaagattcgctggccaacgctcttgagcaatcccattgccggttcccggtttattggttgttggaccttaatgccgccaaggagattattgaggaaggaagtcatgtcgaatctggagacctcttaaccaaggtttcccgtgaccacggtggtgtcagtgtccaggcttctacccttggttctttcgaggctctgctcgagttcctccgtgtctcaaagatccccgtcgccaacatttccatcggtctgttctacaagcgtgatgtgatgatgtgtggtaccatgttggaaaaggcgaaggagtacgctgtcatgctttgctttgacgtcaaggtggacaaggaagcggctgcatacgcagaggaagttggcgttaagatcttcacggccgacattatctaccacctgtttgatgacttcaccaagcacatggcagagttgaccgagaagagaaaggaagagagcaagctgcttgctgtcttcccttgtgtgctaaggcccgttgcggttttcaacaagaaagaccccatcgtcattggtctagatgttattgaaggcagcttgcgaatgcacacgccaatttctgctgtgaagaccaaccccactacgggtgctaaggagatcatcgatctcggcagagtgtaa

SEQ ID NO: 3541 - DNA, 618 bp, A.fumigatus
  unsure (476): Identity of nucleotide sequences at the above locations are unknown.
aaaatgcattcaagcgcttatgccgacatccttccgatgacgatcgggaatcgtgtatcatttgaagattgcgagctttacccagctcctgactcttgcgccgatccagcctactttccgaacgaatctcaatttcaactgcgatcgtcccatctccagagcattcctaagactcattacttccctgcgtatatgtcgtggacccacggatctcttccctcgcacactgctggtcctttgtcggtaatggagatgggtctccaccctgttctcttgagtccagatcgcgtcgcatcaccttggagcggctactcctccatctctggtgcagagagccctggcagcaccgcagatggtagctttgcacacagcaacatgatggaaccctacccgtccccaccctatgcctatgatgatccaagagattcctcagtcaaggcagaacaatattcctcaccagtgacgtctatcactanctcggtcgccttgcctcaaatacaaacctatcctgaaccccgaccgatggtgaaatcaccctactcagtgactgcgccagcacagcccaatgttttcgaagaacacaattgctctgaaaggattggaagtcttggcagctca

SEQ ID NO: 3542 - DNA, 195 bp, A.fumigatus
ctggggccattggtgtgtatatcgctcctggggataggacatgggtatatgttgacttcacaactcggttcccaggtaacctcttgggtaattagccaggaaggtggacttacggtggggtttattacccctttgttggttaatttcaagaaccctatttggtttcaggaggggaattaccggggaacaaattga

SEQ ID NO: 3543 - DNA, 381 bp, A.fumigatus
tacgatgggaatgcaattggacgcaacagcaaaaacctcaccgtcgcactctccaccctctccacacacaccaaaccgcagcccccgtcgcaggacgacgagcagaaggggagtgcaaacgaccccctcctccgcgacatccaactgccccccgagatcatcgactatgtggacgcagcgcgcaacccggacatctacacgcgggagttcgtggagctggtgcagcgcgggaaccaggatctgaagggcaagaaggaggcgtttgcgagtttccgggatgtgcttgctagggagatgaggagtgcgatgccggagtgtcggggggaggtggagagggtgcttgctgcaacggggggagccagggctgatactgagcagtaa

SEQ ID NO: 3544 - DNA, 450 bp, A.fumigatus
  unsure (378): Identity of nucleotide sequences at the above locations are unknown.
tgcaggcgccaaaacccgacaagtcgacattatgactaccgattgatcctggggcgagtggaagctttgatgactgctcgtgaggaggaggatatcctgacattggctaatcttcttcgctccgggcttgtgcgcaatctgggcaatatcacctccccgaaactcttcttacatgcgtacgctggcacgaaactgctcattgatgattatatcactcaagtcgcactttcaatccagcacatagcggctctgcagaccgctccagtccacgagagtgggttcacctcgcaggccaagctggagctcctgcatgatacgcgccaagctttcggtaaaacaactctgctcctgcaaggtggctcgatatttggggtatgncatcttggtgtggtcaaggctctgcatctgcagggtcttttggccaaaatcatcaccggatccggatcatga

SEQ ID NO: 3545 - DNA, 249 bp, A.fumigatus
attgttcgcggttccttccagccccgtggtgaagatcaagcgccaagcgttcaatctgaagtctgggaagaagagaggctcccgttctataggccagagcaattctatcccgtgcatatcggcgaattactgaattcgaaataccgggttgtgggaaagcttggctatggcgcttattctactgtatggctatgtcatgagaaggggtgtgctttggctttttcttttcgagatgatgaccagtactaa

SEQ ID NO: 3546 - DNA, 270 bp, A.fumigatus
attcgaaataccgggttgtgggaaagcttggctatggcgcttattctactgtatggctatgtcatgagaaggggtgtgctttggctttttcttttcgagatgatgaccagtactaacctggacctcgcaagtgaacaaaaatacgtagctgttaaagtcttggccagtaatcatcaggagcaagccctatctggagagttgggcatctataaacacttgagccgtctgaaatcgtcccatatcggaagtgcctatattcgcggcttgtaa

SEQ ID NO: 3547 - DNA, 366 bp, A.fumigatus
ggtactttcgaccttgtaggtccggacggcatccaccgatgtgtggtgcatccaccaatgcatatgtccttacatgagctgcgaatgcgttctagggaccggaggtttagcgagtctttgttcaaggaaaccttgctatgtatcctacaggctcttgatttccttcatagagaagggaatgttgttcataccggtatgtcccccgcaacagctgataagcgggaatatttgttggaaatgactgatggtgttacagacatcaaagcgacgaacatcttgcttcgcattgatgatgaatctatattacaagacttcgagaaagccgagcatcaaagcccaagtccagagaaattcttgggtaattaa

SEQ ID NO: 3548 - DNA, 537 bp, A.fumigatus
agaccagcctgtgacaccttccgctctggagccgtggagcagttacgagtccatgctcgcaatttgaaggaacttagtacccgggagaatgctggagaggttgaactctacgagaagggatatggaaaggatgcagcgaatgtagcgaaggatgcagtggagtacggtgcggcgaatcatttcgacgttgtcttgattgatactgccggtcgccgtcataacgaccaacgccttatgtcttcgctcgagaagttcgccaagttcgccaaaccagataagatcttcatggtcggtgaagctctggtcggtacggacagcgtgatgcaggctcgcaacttcaaccaagctttcggcactgggagaaacctcgatgggttcatcatcagtaaatgtgataccgttggtgacatggtaggtacgcttgtcagcatggtgcatgctacaggcattcctattgtttttctgggtgtaggccagcactatggtgatttgaggggcctaagtgttccttgggctgtcaatctgctgatgaagtga

SEQ ID NO: 3549 - DNA, 282 bp, A.fumigatus
aaagcccggattcctggttcttatccgctgcaggctatcgtgctgctcgtcgctcggacccgcaacatggcctttcttctcactctcgccgcgctcggatgctccgcccagggagccgtgctgccacgagcgagcatcgacagtgatgcggtggtaggatttcctcagactgttcccagtggtactaccggagaggtctatcttgcctatcagccctacctcaaggtggtgaacggttgcgttcccttccccgcagtcgatgcagagggcaacaccaagtag

SEQ ID NO: 3550 - DNA, 243 bp, A.fumigatus
  unsure (210),(213),(216),(217),(218),(219),(221),(222),(230),(231),(239): Identity of nucleotide sequences at the above locations are unknown.
gttcccccacggcacgacacgggattctgttggagtgttggggctaatatcaacagcgctggcctggccccgaccggcgcatccaacggcgactgcgccagcagcaccggccagatctacgtgcgcgggaccacatatggtaattactacgcccttatgtactcatggtattgtcttcaccacggggctggaagaatcgcgcgtcagtcnccnagnnnntnncaaagggnngtcaattnaaaa

SEQ ID NO: 3551 - DNA, 405 bp, A.fumigatus
gaaagaagaaacagcagcagcagcaggagtctaagcctcagcctgaacctgaaccagcagagccagaacaacaagaagaaaacgaagagaatcctcccgacaacaccaaggaagatcctcggcctcaacgagatacccacgacgtcagcgccaacggcgaagccacagaagaagaccaggagccagaacaaccacaaccacaacaagaacaaccccgcccccgcagaagaaagcctcaaccgcagagataccgccccgactcagacacagaaagcatcccccgcccggaaatggacaacaacaccgcaatggagaagccccgccgccgtcgccagcgtccccagatgcaacaacaacaacaacagcaacaagacggcggcccattgggcgggctcggtggtgtga

SEQ ID NO: 3552 - DNA, 828 bp, A.fumigatus
tctctttttctttcttccaccatgtccgatcaggaaaacaacagccgtccctcaagtccgactccgaacccaacccagacagaagagggtgcccctccaacacctaagacagatacccagaccccgacaaagaagcctccaaagctaggaaagaagaaacagcagcagcagcaggagtctaagcctcagcctgaacctgaaccagcagagccagaacaacaagaagaaaacgaagagaatcctcccgacaacaccaaggaagatcctcggcctcaacgagatacccacgacgtcagcgccaacggcgaagccacagaagaagaccaggagccagaacaaccacaaccacaacaagaacaaccccgcccccgcagaagaaagcctcaaccgcagagataccgccccgactcagacacagaaagcatcccccgcccggaaatggacaacaacaccgcaatggagaagccccgccgccgtcgccagcgtccccagatgcaacaacaacaacaacagcaacaagacggcggcccattgggcgggctcggtggtgtgaaccaggtcggtgatctcgtccagaataccgcaggcaacgcggtgaacggtgtgacggggtcagcgggcaaagccgtgggcgggctgctgggtggaaacaaaggggagaaagaggatgggggccgagacgagcagttgcggctaacgctggatctgaatctggatattgaggtgcagctcaaggcgaagattcatggtgatttgacgctgggattattgtatgtcttttttcgccgtttcccttaccctgatggtatgataaagtgtgggtgctaa

SEQ ID NO: 3553 - DNA, 1026 bp, A.fumigatus
cacctcaggcaaaacactgttgaccgccttagcccttttctggtcgctctccgcagttgggaaaatctcaaaagaatgctgcagggacgagactgttttgagtatcattcaatcatcggtcaaacgatactcaccatgtcgcctcgactgtcaaggaagctgacgcagcttcctactctcttcctgggtcttccatcgctcactatcactggcaatgtgtctgtacgatctttcggcataaaatcattaaatccacctaaaccctctcggttcaatatcggtcctgaattacctgtgcttaagtcgacttccacggctgctttggaacgaaaggcgaatactctacctcttcggaccggtgccatcgctatcaagaaaggaatgaccgctgtatacgatgccgaaactgggaaacgcatcgcttgcactgttctgcaactcgatcgagtacaagtcgtctcacacaagacaagacagacgcatgggtataatgccgttcaggtcggtgccggttggaagcatcccagcaatgtgacaaagtcactcttaggccatttttcgactaacggtgtctcgccaaagagacacgtttacgagttccgtgtcaaagatgagagtggcctcttacctgtcggccaaacaatcaatgcagactggtttcaagaatgtcagtatgtcgatgcccggtcttactctaagggtaaggggtttgccggtgtgatgaagcgacacggcttccaccgacaggaccgcagtcacggtgtcagtttaacacatcggtcacttggttcagccgggcctattcaaggtggtggttccagagtgtatcccggaaagaaaatggcgggaaacatgggtaatgagcaaaataccgtgcagaacttgaaagttctcaaggttgatgcagacaacagtattgtcgttgtcaacggtatgttttccgctacccaacgttcaatacagcattgtaaatggttgatattcatcttgttgcacgttccgtcagcgggcctaaaggatgcgtag

SEQ ID NO: 3554 - DNA, 210 bp, A.fumigatus
ctttttgctgactcggtaagttattcggtcaattccaactatgggaccgctgacgacctgaaagccctggcgtcagctcttcatgacaggggcatgtatctcatggtcgatgttgttgccaatcacatggttcgctggatcagcccattgatgtgctgcttgctgattgaaccagggatatgccggtgcaggcgattcggtcgactatag

SEQ ID NO: 3555 - DNA, 321 bp, A.fumigatus
ttgaaccagggatatgccggtgcaggcgattcggtcgactatagtgtcttcaaccccttcaactcccagacctccttccacccattgtgcttcatcagcaattacgataatcagacagacgtggaaaattgctggttgggggacaattcggttcctttacccgatcttgatactacaaatccggatgttcaaaagatttggtacaattgggtgaactctttagtgtctaattattccagtaaggacggactcttggtatctgcacaaaaacaagaattgactgatatgctacagtcgacggcctacgaattgacactgtga

SEQ ID NO: 3556 - DNA, 480 bp, A.fumigatus
atccccgctcgcaggtataccaaggacatggccctcgctaaaaacgccgcagcattcatcatcctctccgatggaatcccaatcatctacgccggccaggagcaacattacagcggcggcgcggatcccgcaaaccgtgaggcactctggctatccggctactcgacaacgagtgacctatacaagctcatcgcgacagcaaacgccatccggagtcacgccctaagcaatgacccgggatccgtgacttataacgtacgacgctctcactcccggaaagaacatacgatcaagcagggctactcaaccccaataaataccccatctaacaaatatacctccaccatctccattgcgaaaaagccccaacggaccccaaatattcaccgtcctcccgaaactcggtggctcctggaaacctcttacacgccctcattggggttgaacacggctattaagggccgaacacaactgaaatga

SEQ ID NO: 3557 - DNA, 711 bp, A.fumigatus
  unsure (675): Identity of nucleotide sequences at the above locations are unknown.
gtctctcagacactggacactccgccgcgccttaccccgacagaccagggtccggttcccggccggtttatccacagggttactcaatggccgacccaccccccagtttggcttttgggatcaaccccaatatccgtgcgaatgcgcccaactacaaccggggccgcgtcttacggcccaggccttcagaattatcgtaacccaggccccggggtaccaccatcggttggaccgatgagtccgacaggtgtgcatagcccatcgggaacaccgaaactcgatatcggttactcagcgccacttgatcagcctcctaacactgatgctcggagacgccctcaacggctcgatggtgcacccccggaccggaagcctgtgcgaactgctgcctcccctcactcccaggcaagctcgatgggatcgccccggccgcaagcctcaccttctgctgcgtcgttcccccagtcgtctggaacgtcaactcccaacccctccggaacccccgcgagcgcagcaagccaaaagcccacaacacaaccttccaaaccctccgcagggggtctgcccggcaagggtccaaagacattcgaagaaatgggagtccctactgcccagaaggatagtgattgcgtaagtttttcatttcttccggatcgttgcaacgaacctaacctntgccttatcataacagccgggatggaaggtatgcgt

SEQ ID NO: 3558 - DNA, 507 bp, A.fumigatus
  unsure (4): Identity of nucleotide sequences at the above locations are unknown.
ccanatgtacccccgaccgacgagcaaagagaagccagtttggagcgagcccgaatcgctgttctgtcgtccaacgacccggagatgcagttggcctgggctcaggacgctctcgcctacgttgaggtcgcggtgcaaaacgaggctcgtctctccttgattcagcctcccaggccgcagactcctcccgtggagcgtcagttgaagctcgatgcgatgaacattgtgaacttcttggcggatcaataccaccccaaggccgatttcatcagaggcatgtggctagagttcgggaaattcggacatcgcgtggacaagaaggcagcttttcgcgcctatacgagagctgcggacaggggatatgctcgggcggagtatcgtatcggaatgcagtttgagagttctggagaaccggagaaggctatcaaacactacgaaaagggagtcgcccttgctgactccgcttcttactacgtatgttcaggacagcttttccgtcacaaatga

SEQ ID NO: 3559 - DNA, 186 bp, A.fumigatus
taccacggtcggcagcgtttaggcatgatgatcctccttggccagcatggtcagcggcaggattaccatatggggttggattatatcagccttgctgcgcaatcttgcgacgagaatgcgccccagggtgcctatgtacgtgactttcttctcattcactctcttaacgctctgagtctgacatga

SEQ ID NO: 3560 - DNA, 837 bp, A.fumigatus
  unsure (615),(616): Identity of nucleotide sequences at the above locations are unknown.
catgacgttcgacaggtttatggcatgctcttggcacgggaactcccgcaggtcaatgtaccagaaagctacctccccctggatcttaatgctgctcgtgtcaacattgaaaaggcagcctatcacggatttgccaaagctcaggttaagatgggcgccgcttatgaacttggtcaactcggctgcgacttcaaccctgcactatccttacactacaacgcgctggctgcgcgtcaaggggagccggaagcggagatggcgattagcaaatggtttctctgcggtcatgaaggcgttttcgagaagaacgacgagttggccttcaaatttgctcatcgcgctgcgctcagtggattcccgacagccgaatttgcgcttggatatttttacgaggttggtatttacgtcgatgtcgaccttaaggaagccagaagctggtacgccaaggcagcagcgaatgggaataaagacgctacaagccggattgacagcatctcacggtcgaagaccctgtcgaggaaggatcacgaaaatgtcgcgatcgcccgcatcaagtcgcgctacgggtcgcaccagcgtgagatttctctagaatcaacgcaagagaacctcgannatgccgatccatccaggatgagtctctcagacactggacactccgccgcgccttaccccgacagaccagggtccggttcccggccggtttatccacagggttactcaatggccgacccaccccccagtttggcttttgggatcaaccccaatatccgtgcgaatgcgcccaactacaaccggggccgcgtcttacggcccaggccttcagaattatcgtaa

SEQ ID NO: 3561 - DNA, 189 bp, A.fumigatus
tttgctcaaaccttggttctaatacagtctggctcgaccataagatatcgaagctcatccttgtcgcatctaaggtttaccaaggattgtgtgaaatggcctaatatggttatcggttccattcgcctggcactatacccaaatgttaactgtactttcctcccaataaaatcccggcagtacaactag

SEQ ID NO: 3562 - DNA, 204 bp, A.fumigatus
  unsure (13): Identity of nucleotide sequences at the above locations are unknown.
gaagataggtgtnagagaggtgttccttctaaggcatgtattaagatcaggcacgtagacatctggaatttattcctatgcctagatagtaagattattaactatcttactactattaacaggctagatactatgatctttaaaggccttatagataatttattagttaaaggctttctcctgtataggtctaattacctataa

SEQ ID NO: 3563 - DNA, 1167 bp, A.fumigatus
  unsure (1086),(1136): Identity of nucleotide sequences at the above locations are unknown.
gtccctaaagatacttatgccggatggtttctgatgtgcacgatgcaggaagtcaaaaccgacgcaggccagaacctgtccgaatacaaagagaaccaggatgtgaccgcaccacccgatcccatcgctgagggtaccacgtccgacgtgccgatccacggcgagaaaacaaatattctgttccaccctacaccaactatttcctacaagcccatgtttgaccagttggaaaagcgcgcgaccggagtctgcttggggtctctttgttggtgtactcttcctcggccatgtttttggtggctcgctatgggggtctcatacccttggcctgtttgcactacaactgggatctggttatggatgaaagaggtcatccggagtggacgtgaaatggaatggagcagtgagcagctacgagggcagacagtaagtttcaccactctgtacgtgtccaaggaacatttactaagtcaagccaaccaggctacggccaacttgttgccggaatctgtcgaatggatgaatactttccttggtgtcgtctggggcctgctgaaccccgatatgttggcacccatcgctgatactatcgaggacatcatgcaagcgtctgcgccaagtgtcgtggagaacgttcgtatcgctgaaatcgaccaaggcaacaaccctatacgtattctgagcatgcgggctcttccagacgagcacgtgcagcaactgaaagacaacatctgcgaagagaataagaaaaacaaggatcctcaggaggcagcagctgctgaagagggtggcagctactacaacctcgaggcttcttttgcataccatgcaaagccgagtggccaaagtgcttcctccaaagcacgtaacatgcatatgcaggttgtattcttcctggggattcaaggtctattcggagtgcctttcccggtgtttgtagaactgattgaaatggttggaactatacgcctgagactacagatgatgccagaagccccttttatgaaggagattacctacagtcttgttggtatcccgcatatcaaagccggctgcatgccgatggtgagacatggtatcaacgtnctcaatctacccgtgatctccaactttgtcaactatgcccatcgcactgnctgcaggctttcgcagcacccaaatcaatga

SEQ ID NO: 3564 - DNA, 1680 bp, A.fumigatus
  unsure (1367),(1511),(1585): Identity of nucleotide sequences at the above locations are unknown.
aaacgcttatccggcgactccctcccaatggcggggattcaaaagcagctgagaaacatgcggcgaaacaaaaaggcggaagaggacaaaatcaaagcaatggccgctgaaatggagtcagaagaggagcggaagctcaaggctaagggatcaatgacgcctaaagcatctgcagggtctcaagctccctcggcgactcaaggcgccaaggttgatgaccagctatggactacgaaatacgccccgacggctattaatatgatatgcggcaacaagggcgctgttgagaagctccaaacttggcttcataattggcacaagaatgccaagttcaacttttcaaggcctggaaaagatgggtctggggtctatcgcgccgtgatgatccatggacctcctgggatagggaaaacgacggcagcgcatctggtagctaaacttgaaggctatgatgtcgtcgaaacgaacgcgagtgatacgaggagtaagaagctcgtggaaagcaatcttcttgatatcttagacacaacctccctgcaaggttatttttccggcgaaggcaagaagatcgagagtacgaaaaagaacctagttctcataatggatgaagttgacggaatgtccgctggagatcgaggtggtgtgggagctttagtttccctggcgaagaaaacccacatacccttgattctaatctgcaacgagcgaaggttgccgaaaatgaagcccttcgatcacgtcacttatgagttgcctttcaggcgcccgacagctgaacaaatcagagctagactttcgactatctgcttcagggaaggcttaaagattccacccccagtattggatagtctcattgaagggaccaacgccgatattcggcaagtcatcaacatgctttcaacagtcaaattagaccagcagcaacttgactttgacacaggaaaggaaatgtccaaagcatggcagaagcatgtgatcctgaagccgtgggacattgtcagcaagatcttaaatgctcagaccttctctcccaactctcaaaccactctgggtgacaaaatcgagctgtatttcaatgatcacgagttcagttatctgatgcttcaagagaactacctgagaaccagaccagcgctagctggcaattaccagggcaaggaacagaagctgaaactgcttgaattggcggacaatgctgcctctagtatcagtgatggagatctcgtcgataggatgattcatggaacgcagcagcaatggagccttatgccgactcatgctgttttcagttttgttcgccccgcaagcttcatttacggcaatatggtggagcggcccggcttcaccagctggctggggcagaatantaaacaaggtatgtctccgtggtgcagtatttgcgtttccaacattaatatggcatgtgcagggaaactctggcgttatgtcaaggaaattcagggccacatgcgtctccgtgcttcgggtgaccgcgacgagatcagacagcnatacatcccgctcctctggaacaaattggttcgcaaattgatggatgaaggcaaagaaagcgtcgaagatgtcnttggacttcatgggacagttatttcctcacgcgccgatgactgggatgctctcgtcgagcttggcctgggtcctatggaagaattcaacgtttag

SEQ ID NO: 3565 - DNA, 672 bp, A.fumigatus
agacgtatgcgctggggtcggtgggacgtcgtcctgttcctgtccggcatgctcatggctgaagccgatctgatcaacggtacatgggagcgcccatccgtatacgaaaagcctgtgcatcgcggccggtccaccctctcccgcctctcaagccgcaaattctggattgccctcttcatcttcggcctctatctcggctccgctccgaacacaggctacaaatggaccccattctacatgtggacgtggaaaatcacccccaagacctaccccgaaccccaccgctttccgcagacgctcggtgcagtcctgattgtcttcagcataaatcactccaaggatatccagaaactttttgttaaccgactgtcgcaatatctaggcaaaatctcctttgccttttacatcgtacacggacctatcctgcattccctgggctactcgcttatgccgaatatctggaaaatcaccggcaagcagaccgatttccagtactgcctgggttttctcatcgggtggctcatttgcttgcccgtttccctctgggcgggtgacgtcttctggcgcgcagtcgacatccctagcgtcaaattcgcccggtgggtggaggataaagtgcttgtcaagatgaccgggcagcaaaattcaacgccgaacgcacatattcgctag

SEQ ID NO: 3566 - DNA, 249 bp, A.fumigatus
agacagcgagagattggagcgcagccgatatcaaaacccttgcgacaagagcaacaaggtctcacgtatgctagccaaatcagtcgaaaacagctgcaccgatttgaaccgtggccaagtgattataccattaagcacgtgctacgcaacaaccgctctggaatccttattgccagtgagttcaagccccggcctcgtaccttcgttcccggcgctgactgcttccaaaggtggccaccgtggtggtga

SEQ ID NO: 3567 - DNA, 192 bp, A.fumigatus
cagactgtccaggccagcgagatcactgatgccaacccatggctgtggatgactggctgggcaaactacctccaggggatcagcgagcagaacttgctagactgtgtagagacacctaataaagaacccatggatgccacagagcagtgtgtgcaggttatctgggtgaccatggagcagctggcctgttag

SEQ ID NO: 3568 - DNA, 240 bp, A.fumigatus
ctcagttttaaccatattaataagcttaacttccttaaggcctacccaaaggcttatacagcaatctttttattagataatatcaaaagtagcttctcagtaactaggttaatactattaaatctagagcaagtactcagtcagcttaatatccagcttaaaacccctataccaccaggcagccaatcaacagattctatcctaaaaacaccttataatctcaagcagttgaagaagtag

SEQ ID NO: 3569 - DNA, 225 bp, A.fumigatus
  unsure (41),(42),(100),(207): Identity of nucleotide sequences at the above locations are unknown.
cagggcaggccccctagcacagcccccaatcccatggaacnntcagacgacgaccccacagacgaagcatgggctatgaccgatattaaaaagcatgccnaaagttttatgttgagctgcttgactaacgccattgcaaccttgaatacaagagtgcacctgtgtgcgccatggctttgcttggctagggggaacaccgctggcggnacccccagagtaatcctt

SEQ ID NO: 3570 - DNA, 261 bp, A.fumigatus
aacatgattatattactaaatctagttattcttgcgctgcggacattgcaattacttatggcctataatatgacagtcactgcagcgcgggggtgcctgttaagggtattgttctgtatctactgcctggatagctttgttagcctgattcctctgttaaataaactcctggccttcctagatagagaatccctctgtagcttctatctgcctcctagattacttcctattttgaagctgcttctcatgtgcagcatgtag

SEQ ID NO: 3571 - DNA, 375 bp, A.fumigatus
actttagaatcggatcatttcgtttgcgtgagacaaaaactcaatgaagatgacaagccccaagtcattatcgtcaacctcaaaaacaacaatgaaactatcaagcggccgatcaatgcggacagtgcgattatgcactggtccagaaacatcatcgccctcagagctcagggtcgaacaattcagatcttcgacctttccgcaaagcagaagctcaagtctgctgtcatgaatgaagatgttgtctactggaagtggttcagtgaaacgagtctaggtttggtcaccgacgcatcggtctaccactgggacgtttttgatccaacccagaaccagcctctcaaaatttttgacagacttccaaacctgagtgta

SEQ ID NO: 3572 - DNA, 573 bp, A.fumigatus
ggggcggtaggttgccaagttttcgagcgccttccttgggatttttggggtagaacaggccctggggacgtccgcggggtcctcaccaccgtcgccagcggcctgctctacaccctcgacctggactccggcgccaacgcctggatcggataccaggccatggccggcatcgggatcggcctggccatccaggtccccatgatggccagccaggcggtcgtccgcgtggaggatctctccaccgtttccgccatcgtcctcttcttccaatgcatgggtggggcgatcttcgtgcaggcgggtcaggccgccttcaccaacaagctggtccaggaggtgcagcgccacttgccgaacatcagtgcggcgcgggtcacgtcgacgggcgccacggagctgcaatccgagttccacggccatgagctccaggtgattctcgaggcgtatgtggctgggctgaaggacgcctttattgtggcgattgtgttggcggggattgcgaccttgttgtcttttggctcggggtggaggagtgtgaagagcaagaaggaggagcccaaggcgcagccttga

SEQ ID NO: 3573 - DNA, 354 bp, A.fumigatus
tcttgtcgagccgaactgcctgatgtattcgaggcaaccccatcagttctgcaatcgcgacgagccgccgtattgtcagccacgccttctgtaagtttcctagtccgatatgactacagaatcagcatgtgttcatcccgcttgatcaaatcagagatgcgaatctcacagtcgcgcaaaatgtacggccattgcaagaccttctcccgttgcaagcaatcgatcatggcacaagacagtactctccatggtatttatgatttggcgacaaaggtcagcccgcttctggcattttctgagctgatcttcactgttttcgctctgttgcggaagctgttgggccatgatcgctag

SEQ ID NO: 3574 - DNA, 1083 bp, A.fumigatus
  unsure (428): Identity of nucleotide sequences at the above locations are unknown.
acgcggtacttccaccctgtcgtgaagattggctcgttgggaatgcttattatggactatctacaggtgagccggcaggcctcggagggaagacgtgcagctcgattgtcccgcggtctgagttatttcgtaaagggcagttctagctttgtcgactctcagccctcgtgttcaggcagttctgcccctacgctcagcactcccgcgtcgtccgctatgagagccaaccacctctcggccgggtcctctcacagtttcgaacttccatccaaacgctctcacagcatcgacgcgcgctccagcagctcggtatcggactcaaaagccgacaatggcgaccagaacaattcttccgggcctgacacaccactcccggattggtgggcgggaagcagaaggaaggggttgaagttagacgaatcacatancagctcctgggcgtatcggagagccgccaatcttctccgcgaaagtctcgagttggatgccgatggtggtgtcatcttcttggaggtcactaacagccacatgctggatttcgagaccggaagtgattgctcgggcgagaacggacccgcggctcctgtattggctgtctctaccagagacgaaccttttgccccatggcccggctcgacagtgctgtaccctgctgcaaatctcgacagcgggtttctacaccagctgttacgtcgatacaccaagggcaagctttggtcctttcatcgagatgggattctctctagctccgatgacgaaaaaccgaatggaaatcgcagcatgaaacccgccgagccgcctcggggcagtggcaagaagtggaaacagacggaaaacgccatgttgaatctcttctttccgaacgcgactcaggtaatgttcgttcctttgtggaacgccgccaattcccagtggtttgcgggttgcttctgttggaacacagtagagacgcgtgtcttcagcccttctgtcgagctgagttcggttctgggcttcggatcatccatcatggcagagtgcaaccgggtccagtccctgatctccgatcggcagaagggcgattttattgggagtatctcgtaa

SEQ ID NO: 3575 - DNA, 297 bp, A.fumigatus
gtattagagacggagaaagcgagcttggttcatcgaccggtcattgacatcattgggtatagacatgaacttcgcagtcctctccacggcattttggcggccaccgagtttttacactccacggaccttgatgaattccaactgtctctgcttgagacgatcaacgcgtgcggtcggacactgttggatactatgaatcaagtcctagacttcagcaagattatctcccttgagaggacctggcgtcagctcaagagacatactcttcacctcggtactggacggggccgcgcttaa

SEQ ID NO: 3576 - DNA, 963 bp, A.fumigatus
cgctgggacaaatgttggagggagccaaacggttatggtttggcaaacctgcccgagggaaggagggttccgggcttagaagaactcattattcaactagaggccaagccagggggtttttcgttcacggaacaaccggccacaaagttcacgagcggactaacaaaaaggaactgggaggaggctggggatcccttggcaacaacgggtatgtcttttaagcggaagcttgccggagactgtgccagagtagaaggttgtgtacaccggtccagggctgacagaagaaaacaggaagaaatcttttcctcctcgtacagcgcatccatttatatttcccgtatcctcaaactgccagaaaataagcgaaaggtcttcgtcatcggcgagacgggcattgagcaagagcttcaaacggagaacgtcccattcattggaggcacagatcctgcgtatcgtcgcgaagtgagacctgatgactacaaacttattgcagccggcgacccatcgttacttgaccccgaggtcggagttgttctcgtaggactggacttccatctgaactacctgaagctggctctagcatatcactacatcaaacgtggtgcggttttccttgcgaccaatatcgattccacacttccgaactcaggtgcactgttccccggcgcgggttccatgagtgcgccgcttatcatgatgctgggtgaggagcctgtctcactaggcaagcctaaccaggcaatgatggacgcgattgagggaaaattcaagttcgatagatctcggacgtgcatggtgggagaccgcgccaacactgacatccggtttgggttagaaggcaagctcggaggcactttgggtgtcctcactggagtcagctcaaaggatgacttcctaactgggcctattagaccttcggtgtacctagacaaactttccgaccttttggaagcgaagtga

SEQ ID NO: 3577 - DNA, 600 bp, A.fumigatus
tccgaaaaaagacgggttcgccccctcatctgtaaagttcccgtgtcccaaaaccattccaggccggggaagaattgtgggtttcttcccgccggtgggacctccacaagttcaacggaacactttgcaagagaagaaaccgccgccatggcttcggttgcctggtcagcgatgcgacagccgctccctctgctcctgcagacctttcaggggctcaccaccaagaacgaggatttttggttcagggcatgtccatattttggccgagtctgctatgctgcaggtaccgtgctgttccaagagggcgacttacctgacgggttttacctcctcgagtcgggcatgctccgcgctgaatatgagctacctcaaggccgttatttcgaactgatcgtcgggggacggccgtgtggcgagctgccgtttttcagcgaaacccgacggactgcgacggtcaaggcggaacaggactgcgtgacctggtgtctgaatgccgataaatggaagcagttgagggaagaagagcccgagatcgctcaggaattgttgacagtgagcttgaaattgacgagtgagagaatggacagcatcacatcgtaa

SEQ ID NO: 3578 - DNA, 216 bp, A.fumigatus
gcaacaatgttcgcaacatcccgcagtcaggtctctggacctaaccttggtaaattgatgaaagcaaccaagatggcccacctttgtgaagcattgtctggctgctgcatgaatacgaatatcatcaagaccgttcttttacccgatatgtacttgtgtatttattactcttcaattgctagctccgaacccgtatatgcagccaagccaggctag

SEQ ID NO: 3579 - DNA, 873 bp, A.fumigatus
ctgcgggatgttgcgaacattgttgcctatgtcagcttgtctctcttagtgaatgtagagtgccctgtcaccatggagtcaatccccctctccccgttcgacctacaaggttccttctccaacatcccctacgccttcttctacgagaacacgcagtgtgaaaatgactttatgccctttgacttcctcaagggctcgttgtgggctagtcttcagcgattccccattctgacaggccgcctgcgagccaggagcaccgggcacattgtcgtcgaggtcgacgcaggtaatcctaaccagcccgatatccgggagacgctctgcgactctgtccactggtcgcagctcaaggagtctagttttgcctgggatgcgtggccggcgggtgtcgcgaccgtgggacctgtagccactgctgcggcggatggggagatcaaactgctgaatatccatgtaatgcgactggcacagaacagtggggtcattctttttatcaacatcccccattacgtggtggacggggtggggtattttgcttttatcaatcactgggcggagaccatgcggatgcagcagcagcagcaggagcaggagaatgaggctagaagtagattcagctttgatcgtggcatcatccagaggtacttacctacggagcgagctccgttggatcccctcacggcgtcgatctacggtcagcggaacctgctcgtcgattggcttgcatggctctccccgacgacgctgggaggtctactctccaagaccgccgccatggcacggggtgaggctcatctatttcggattcctcgagcctctctcgaccagggtcttcaccacggggctgaaaggatacacggtggtctattgaaa

SEQ ID NO: 3580 - DNA, 267 bp, A.fumigatus
acggttcgtatcgatcaaaccttaatgcctcccctctggctgcgagacttttcaggattggacagctactacttcatacaatgccactaccacgccgagctgaatagcagacagccacctaaggcaaccgtgccagtgtctgcctctcagcacttctacatcatggcccagagggcactgatacgacagtcaaagaagtcgtggctccctggactgctgcgaacgcacagagccatcggtcaaatgctcaactacggttataactaa

SEQ ID NO: 3581 - DNA, 846 bp, A.fumigatus
ctcattgttgcttgcccaaactacccccgcaaagcacagcgaagcccaatttttgattcccgatggaagggtttggcagtgagatcgactttccttcagacggccccggacccttccgcgtacgacgtttttcggtgtccatttcctcgctgcaatgctagataccggcgcaaggagcatctgaatcgccatgaacgatcgaaacacatcaatcagcaggcttttgtctgttccagatgcggtcgtaagtttcaacgaaggtatctacatgcttacgctcaccctcttatcacaaccaaccccctaacgctagacgtcaaaatcagtgataccctacgacgtcatgtacagaagcagcacaaaataacagagcctctaaatcgcgcgcgccgagcatgtgcgggttgccaggcaggcaagtctcggtgtgaagggggcgtgccatgcgaagagtgtgttcgtcgcaacatccactgttctctccaagaccgtcctagtattgcagaagatcaacaaacccgatcgtcgaccgcaccttcgtcatctctacaccgtgaacattcacagttatattgggataagacgaagaagtgggttgatcgatatttcgacatcttccatcggcggtggccgttcatccatcgaggatcattcaatgtgcgccgggagaccccgttgcttctccagtcaatgatagttataggcatgtggacctcaggggaacagtctgcacagtctgcggcagtcgagctttatgatcaacttgactccgctattcaagatcaaagggtatgtttggaacaccaatccatgatgtttctgatttactcatgtagtgaatcatag

SEQ ID NO: 3582 - DNA, 264 bp, A.fumigatus
ttagtaataatggcacataggagtacaagactcatgattcctagaatgctgactgaggtgaagactgctgctggccgcccaccggcatcccaccaaacaaactacgacatctataatctgtacatgaatgcaccgttcccggtaacctttgctagccgttactgcgagaaaagtcctgccttgataaaccactgtgttgctcttcaaaccctatgtgccattatctcaatctcggatgtaagccagatttccctatcagcctag

SEQ ID NO: 3583 - DNA, 990 bp, A.fumigatus
  unsure (9): Identity of nucleotide sequences at the above locations are unknown.
attcattcntataccctgtgggattactttgcgagcatcttcaccaacaatgcaaaaaaatggcgtgacttgggtaagcagctggagcttcatgcaacgctcttcttctggtggttgggcgtggaaaattcgttcttgcccactatgaagaatcaccacgttgatggaaattccgccacccgccgttgggaaaactctgtaaacaagatcatcatctccattttcgtctggaccatcttgaaccttatcgaaaagataatcattcaactcatcgctatcagcttccacttgcgtacctatgctgatcggattgaaatcaataagttccagattggcagtctcaccaagctatatgccttttcaaaagcaaaaatcgaggctgatgatgacgaattcgaggagaaaaatgatcagagtggcagcggcaccaagacaccgttgcgcgttcccatgcaatatgccggaaaggcgcagcgtattgccaagggcgccctgaacaaagtcacggatgtggcgggtgcagtcgctgctgatttcaccggccgcaaggctacaagcagcagccacccctaccaggttgttttgaccctgctgcgcaccactaccggctgtcaggttctggcaaggcggctctaccgcacttttgtgcgagatgggtttgaaaccgtgttttccggggatttgaaagaggcattcgacaacaacgaggaagctgaggccgcattcaccatgttcgacaaggatatgaatggcgatatctccatggaagagctagaggcagtctgtgtggagatcggacgggagcgtaaatcgatcactgcctctctgaaagatctcgattcggtcgtatcaagacttgacaatgtgctggagttcttcgtcatcgtcatcgcgctcattgtcttcttgtcgctgatctccacatcggccgctggtgttcttacctctgcaggctccagtatccttgcattgtcctggttgttctccgcc

SEQ ID NO: 3584 - DNA, 189 bp, A.fumigatus
tgggacttgaccatgactaacgtcgtacagacaacggttaatctgaagaaggtggaattaccggtgaagcagatcgtatcaggcaagaaaatcaaaccgtcgggtactctgctcaatccgcagagcttagattactattaccagtttgcggaggttgaaaaactggtcaatcccaggagcaagttgtag

SEQ ID NO: 3585 - DNA, 210 bp, A.fumigatus
cactaccatccgaaggatacgatctcggcggcgatgaagaccaccatgcttaccggtgcagtgggtctttttgcgtcagccgtccagaacaccctcactaggaagaacgttggaccctggggtgtcttcgtgcgaagcggcgggacaatcggtgttttcggtacggatgcacatctaatagatcaattggtctacggaatctttttctga

SEQ ID NO: 3586 - DNA, 207 bp, A.fumigatus
atcaattggtctacggaatctttttctgacagttgctctccagccgcaatgggtggtacctacgagtttgtgaagaacgcctcggccaacctgcgggagaaggacgaccactacaacgtagcccttggcggtttcttctctggagctattctgggtcttcgaggtctgttatattttctaggaatacgcacatacggcaattgctga

SEQ ID NO: 3587 - DNA, 369 bp, A.fumigatus
ttttgggcattagctcggacattccccgcccttctgggttacggggctgctctggcgacggccatgggcgccttcgagttcactggcggaaccctgtggggtaaaaaggcacaaagcgatctagatgaatttgaccgccgtacacaggtcagaaaagcgtacagaactccggcggagcagacatttgccgagttgggtgagggacgaggtgtgttattatctaaactctcaggacatcgtagttatggtggctttactaaattatttgcactaggtatctacggccccggttacgcagagaggcgcgcagagagactcaaggagacatacggcattgaggttcccacatccgccgcacccgcatcataa

SEQ ID NO: 3588 - DNA, 402 bp, A.fumigatus
  unsure (243): Identity of nucleotide sequences at the above locations are unknown.
agagcacggttgacacctagtcttttgtgcctttcccctttcgaacgacccaccctcccccccgccccccccacacccccctccgccccactcgaccccccacagctccccaccctcccccccccccccccctcccccccccggccgcccccccccccccccccccctcccccccccgcccccccccccccccctgctcgcccccccccaccccccctcccgccccccccccccccccccctntatttccctccgaaaactgtcaaaggttatcccccccgccccccccccccccccccccccccccccccccccccccccctccccccccccccgccccccccccccccccccccctcccccccccccccccccccccccccccccccccccccccccccc

SEQ ID NO: 3589 - DNA, 510 bp, A.fumigatus
  unsure (160): Identity of nucleotide sequences at the above locations are unknown.
ggggggggggggggggggggggggggggggggggggggggggggagggggggggggggggggggggcggggggggggggagggggggggggggggggggggggggggggggggggggggggcgggggggataacctttgacagttttcggagggaaatanagggggggggggggggggggcgggagggggggtgggggggggcgagcaggggggggggggggggcgggggggggaggggggggggggggggggggcggccgggggggggaggggggggggggggggagggtggggagctgtggggggtcgagtggggcggaggggggtgtggggggggcgggggggagggtgggtcgttcgaaaggggaaaggcacaaaagactaggtgtcaaccgtgctcttcactggcatgtggctgttgtaagaacatcgtctacatcaggcacaagaatgacagacaggttaggaagttaaaggccacacatattttaagctcgagagtcatttaa

SEQ ID NO: 3590 - DNA, 192 bp, A.fumigatus
cactcccccagcggctcaaatctgtcgatctggatctccgatgccagcaagccgcctgaccctcatgacgccgatggagagatggcagaattcacccccggaggaggaagcagttccggagtcagccatcttgaatgccatatcctcttgggaggtagcaccgcgttcagaaaacgaagacgccatgtttga

SEQ ID NO: 3591 - DNA, 969 bp, A.fumigatus
  unsure (956): Identity of nucleotide sequences at the above locations are unknown.
ggagaccaagcagaagcgtcggcaccagacgtcaactgtgtagacaggcagaaagagtccaagcagttcgtcagaagaggcgtccggatattgaaggagtggtttcgcgaccaccgcgatttcccgtatccctccgaagatgagaaagcgcgcttggttcgtgagactggattttcacgaaagcgcatgtcaacatggtttgccaatgcacgccgccgccagaaggagagatttgacactcccccagcggctcaaatctgtcgatctggatctccgatgccagcaagccgcctgaccctcatgacgccgatggagagatggcagaattcacccccggaggaggaagcagttccggagtcagccatcttgaatgccatatcctcttgggaggtagcaccgcgttcagaaaacgaagacgccatgtttgattcgttcctgaatctcgacgagacatcgtcgcatctcggttcttctctctctagcatgggaagtaggcgatcagagagctcgacaagcgtctcctccgcatggagccaccactccggcgacagctcactaccgttcccgcttcatcacccccgtccgcgggtccggagaagaactcggcctagaggcccaatgaacgaagggcaataccaatgtacgttctgcacacagtctttcaagaagaagcacgattggctccgacatgagaagagtgttcacctccaactcgacgcctggatctgcactccagatctcaacgacctccagcccggcaacttaccatcggggtgtcgattctgcgatcatagggcgtcgtcgatagatcactggaatgaccacgagttcgaggtatgcgcgcagaagcccattgcagatcgttctttcagtcggaaggactatctttggcagcacttgcgcaagtttcatggatgtaccaaactgcccattgagaatctggatcagtggcgtantgccaggagcgac

SEQ ID NO: 3592 - DNA, 426 bp, A.fumigatus
aaccatggctatccccatgcctccatctctgcttcggaaacatcccagaggactttctttatgcttgcaatggcagccagcgctgaggagaccaaccgtcaatccaacgcgggtcgcagatccgtgatctcgccaagcgaggcaccaccggaggctgaacaatccgatgtttaccagacaccgcctcctgggctgaaggaatggctcttcattctcattttatgctcaacgcagcttttcgttcaaggcgccttcggatacatcctcattcccttgcatatcgtggggcaaaccttcggtcagggcccgtccgaggccacccggatgacctggcatgtgggcggttatagcttgacggtgggcacatttatcctgattgcgggaaagctcggcgatctgtacggctccaagcgcatccttgtcctg

SEQ ID NO: 3593 - DNA, 432 bp, A.fumigatus
gagagatttatctacgcagctatcttcaagctggttatcggcaggcggggaaagctgactgtctggatcattcctgaatttgtcagttcttgcatgcacaaaataaatacaccctacctcttcgccacaacttcctctttgctccgaagattgcatatgaacatcccctcttttctcctccgactgcgcctgcgctgtctccatcctactactccgcttcacatcccttccactctccgtagcatcatccccaacaaccccaccttctctcatcgacacttccacagcactcgtatcatcatgtcggacgttgtgcttcaactgacagctcccaacgggcgcaagtactcgcagccgattggtttattcatcaacaatgagtttgttccgtccaagtcaggcgagaagttcgccacgatcaatccttcgtaa

SEQ ID NO: 3594 - DNA, 219 bp, A.fumigatus
cgtccttcaggaaaaccatactctgtcgcatttaatgatgacctcggagaagtcatcaacaccatcagatactgtgccggatgggccgacaaggtccacggacagacgatcagcaccacttcagcgaaattcgcttacacgctccgtcagccgatcggtgtggtcggccagatcatcccctggacgtcatcgccacgggggcggaagaatccgcgctaa

SEQ ID NO: 3595 - DNA, 246 bp, A.fumigatus
cggaacagggacgagtctgaaattgcttccgtctatgctgcgggggaggaggatattgatatcgccgtcaaggcagcccggaaggctcttaaggatccttcctggaagatgttgccagctaccgatcgggggaacctgatgttgaagctggcggatctggtagagcagcaccgggagactttggcgaccattgagacttgggataacggtgtgcttccactttttggtctgcctgcctcgggttga

SEQ ID NO: 3596 - DNA, 927 bp, A.fumigatus
ctgactgctggaggcttcctcgatcgcggagaggacatcgaaggcacgattgccgcgctgcagcggctgatgacgtacagtacccttgtgggcatataccccgagtggcatccgcggctgtttggcccactgagtcgattcagctggtctggtgcagcggggagagcgtatattgtgcgattcgtccaggagaaaatcagaggcctctctgtgaaggctgatcccgggcaagtggagcggggccctctggcgacgcagaactttgtcgagaagatgatgctggctcgagacaaggatccggaaaaggtgacggattaccatgtgttcatgatggggttgtcgaacgtcattgctggttcagacacgactgccatcagtctgtccgccatcatgtatcacctcctgcgttatcccgcggtcatggagaaacttcggcgcgagatcgacgcgtttgccacggacggaaagtgcagtgacagcgtcaccttcagggagagccaggagatgccatatttccaggccgtgatcaaggaggcactgcgcatgcacagtgccacgggcttgccgctgtggaaggtggttcccgacggcggggccgagatcaatggctatttctttccggctggcacggtggtggggatcaacacctgggtggcccattacgatgaagaagtcttcccagatgcgacgactttccggccagagcgatggatcgaggcggaaagtaatcccgagaaactcaaagccatgaccgagatgtacatgccaattagtctcaaccacttctctcgtataccgcatactgacgacggtaattcggccttggggactaaggacgtgttctggaaaacacttcttccttcctggaaatttcgaaatttgatccccccaaatcgtcccgagaaccttgaattccattaccacgaa

SEQ ID NO: 3597 - DNA, 282 bp, A.fumigatus
tggatgatggatgctgagcggacggtagcggaaacgcgcaagcggttctcgagcctctactccatgacctcgctggtgcattacgaggcgtttgtggatcggtgtgcggatctcttctgcatgcggctgcgggagttcgcggcccgtggcgaagagttcaacctcggccattggttccagtgctatgcgtttgatgtgatcggcgatattacctacgggcagcggtttggtgagtggcatacaagggtgcaatggcatgggcgagtacgcgcgactgactga

SEQ ID NO: 3598 - DNA, 573 bp, A.fumigatus
  unsure (213),(227),(234),(238),(261),(262): Identity of nucleotide sequences at the above locations are unknown.
cgaattccaacaattggccgtggggggcgggggttggaatgttcaattttcccaattttccacgacatatatattcccatgagggattacgggagtaggatcccagataaacaatcaaaactccatttcctttcattaacatcaacaacaaaaatgttcttcatcatcgtcatcccgatggtcatcctcctttaccctttcctgagcacgctntacacaacctccgncacccgntccntccgccgaaccccaggcccttcnntcacccgcctcacaaaactctggtacttctaccgcgtgcgcgctggccacttcgaaacagacaatatcgccctgcaccggcgctacgggcccgtcgtccgcatcgccccagaccactatagtatctccgggagcgccgccataaaaaccgtctacgggacggggagcaagttcaccaagtccgcctggtacgaggggtggaagcacccggacccaaatcagtggacgctgttccctgaccggaacattaagcggcacggtatgcatcatcctcgttgttcccttggctcggatcactgctgtgatggatga

SEQ ID NO: 3599 - DNA, 435 bp, A.fumigatus
aacgttgtacttccggccctgtcgtgtagactagtcatgcgcagctgtggcctcagcggcatgaaagcctacattcgcaagaccatcggactcggcaatatctttgccgacctggtgcgaagtcgatcggatctattcgagatcatcaccaaacctgcattctgcttgactgtcttccggatcaagagccctagccttcaatcaaatgccgagtcctcggtgcctcggattgacgacgcttcaaacgccataactaaggaggtctacgagctcgtcaattcgcggggagagatcttcatcacctcgtctgttattgcaggcgtatatgccatcagggtggtaagcgccaacccggcagccgaggagaagtacctccgacgtgcgtttgaaattttggttcaaacagccgaagaagtgctccagaagcagcagtaa

SEQ ID NO: 3600 - DNA, 348 bp, A.fumigatus
agctgccatcgtaaggacaccaaatttttcgaagctcaacctaactggagaaatgtggctcacaactccagtcgagtactagtgacaggagccactggcttcatcggggcccatgtggtagacagcctgttggatcgaggcattaccgtgcgcggggccacacggtcgttgtccaagggggagcagatgagagctgctcgaccggaccacgcttccaggctcgagtttgttcaaatcgaggatttttcgaaactgggggggtttgaccatgtcatggagggagttgacgcagtcattcacgttgctaccgtatgtctatcgccatgccattccacacaagatgattaa

SEQ ID NO: 3601 - DNA, 237 bp, A.fumigatus
acatacggtagcaacgtgaatgactgcgtcaactccctccatgacatggtcaaacccccccagtttcgaaaaatcctcgatttgaacaaactcgagcctggaagcgtggtccggtcgagcagctctcatctgctcccccttggacaacgaccgtgtggccccgcgcacggtaatgcctcgatccaacaggctgtctaccacatgggccccgatgaagccagtggctcctgtcactag

SEQ ID NO: 3602 - DNA, 486 bp, A.fumigatus
gttcagcttgaagctcaaaagacaccccatcgcaacccagaatgtccaacgcctccattcgaatgcaatttagctgtcgaatttaccatgtcactccgcaaaacgtcttgtcgagcatgtgtggcggccaagcgtcggtgtgaccacagggtgcccagttgctctcgctgttgcaagagatctattgcatgtcactatccatatccgcctccacaggctaagggagataaaactacaccactggatgactatgtagggtccagtctccagttggatcccacgctcttgagcgcatgtggtccttctctgacggactccatacaaacaaccatgatctccgaccgaggagatgacccaatgtggttcccaaaaggaaccccgacttccaatcaactctggaactttcctcaagaaatgtcagctggcgtcctcttcccagctcagcagatggttttgcttcagcattaccccgactggaacgcatag

SEQ ID NO: 3603 - DNA, 846 bp, A.fumigatus
  unsure (670): Identity of nucleotide sequences at the above locations are unknown.
gacttaccagaatcccagcgctggatattctacatcaacttccccttcatcggagtgggaaccctggctatcctccttttcctcaagctcaacatcatcccgacctccctggccgagaaactccgcaaaatcgacttcgtcggcactgtcttgttcgtcggcagcctggcctcgttcctgatcccgttgacatggggcggtgttctgtacccctggaattcatggcggacccttgtccctctaatcatcggcgcctgtggcctggctgtgtttgcttactacgaggtaaggttcgcagcggacccaattattccgccaacgatcttccagaaccgtaccgcaactgtatcctttcttggaagtctcctacagggacttgtgctctggtgtgccctctactatctgcccttgtactacgaggctgtgaaagaatacagtccgattgtttccggagtcgctctattcccggagactttcacggtagcccctagcgcgatggtagtgggtatcctcaccacaagatggggccattacaggtgggcgatctggctcggatggctcctctcaacgctcggcgtcggtctcatctgcttcatcaaagtcgacacgagcattcccgcctggatattcttgaacattgttcccggcattggcctgggtctgcttttcncgtccttagggttcgcaattcaagcctcagccacgagcgatactctcgccatcgccgtcggcatgttcagtttcttccgagccatgggccaagcgattggtgtggctattggtggcgtcttgttccaaaaacgcctgtatcacaatctgctccagtacccgtctctcgcgccccga

SEQ ID NO: 3604 - DNA, 882 bp, A.fumigatus
tgccctctatggcacatttcactgagcccgcgcgcagtcttccaaccaaacttcgcctctttctcgagcatcttcggtcgacgaccgctcgtactagttgctctcgccttcttcttcgtgggaacggttgtagccgccgtagccaagaatttcacctacttgctcgttggccgatcgattcagggtgtgggaggcggaggactgatcgccctgagtgaggtgattgtcactgacctcgtccccttgcgtctacgaggccagtattttggtatattgtccgccatgtggagcgtgggttcagtcaccgggcctattcttggaggcggattctctcaggacgtcagctgggtaagcttcttttctggtggatggacgagatcggacaaagtaggacttaccagaatcccagcgctggatattctacatcaacttccccttcatcggagtgggaaccctggctatcctccttttcctcaagctcaacatcatcccgacctccctggccgagaaactccgcaaaatcgacttcgtcggcactgtcttgttcgtcggcagcctggcctcgttcctgatcccgttgacatggggcggtgttctgtacccctggaattcatggcggacccttgtccctctaatcatcggcgcctgtggcctggctgtgtttgcttactacgaggtaaggttcgcagcggacccaattattccgccaacgatcttccagaaccgtaccgcaactgtatcctttcttggaagtctcctacagggacttgtgctctggtgtgccctctactatctgcccttgtactacgaggctgtgaaagaatacagtccgattgtttccggagtcgctctattcccggagactttcacggtagcccctag

SEQ ID NO: 3605 - DNA, 207 bp, A.fumigatus
acgaagaaattgtctcgaggaattgtggcagtgtggtatatcaccaagtgcccagagtcgcaacagcatctagatgagttaagaggtgcttcttccgctccgatcagcttttacaagattaaatctcacttttccttccactgcgatctgctgcaagcattggaatgcacagaattctactccgatgagctttccaaagagccatga

SEQ ID NO: 3606 - DNA, 699 bp, A.fumigatus
  unsure (38),(56),(58),(139),(219),(438): Identity of nucleotide sequences at the above locations are unknown.
aattggcccccgatcatatgcgactttgcttgcagaanagacacggtgggcagtantngtccttggtaccaacccagtttacaccagccactcggtccggtcaacatgtcctcgacagctcttcccaagcgcgttgcgntgcatcgcaacccaaccacggagtcctccgtcccaagctccgtctctcactctcctttcgacagtcttcgtcagtccctntcatcgacgtcgctctcctcaatggcttcggatgccgagaagaccagcagcaagatgattgacacctatggtaacgagttcaaaattcccgattacaccatcaagcagatccgggatgccatccctgctcactgctaccaacgctcggctgccacgagtttgtactatgtcttccgggacatggccatccttgcgagtgtcttctatgtcttccacaantatgtcacccccgagaccgtgccctccatgccggtgcgcgtcgtcctgtggaccatttataccgtcgttcaaggtctagtcggcaccggtgtttgggttctggcgcacgagtgcggtcaccaggctttctccacttccaaggtcttgaacgacactgttggatggatctgccactctcttctgctcgtcccttacttctcctggaagatctctcacggcaagcaccacgtcttcacgcccggcggctggaagatcagcgtc

SEQ ID NO: 3607 - DNA, 507 bp, A.fumigatus
ctcaggggttacgcattgcagcaggcgaaaccggtcatgttacgcaactccatccataaaccgcaagttctctgctcggacgatcccattctgacctacgggttcatcaatctgatcaacatgtttgagaaactgacccccaacctgtacgactggatctctgccggtggcggggagggcttttgcgagatgcctcccatatcctccatccagtcgagtctctgcaaacccatgtcgctagacggggtagtagaaatccagagagtcgacatcctcgtcacacagcagtggctgcaggcgatgatctggaaactctccatggcgcacgtctcgcagcccgggtcgcgagaggatgccgtccttcccttccatctcccactcttggtaggaaaggccgtgatggatgtaatcggtgctgcatcccagggttcaatcgatgcccacggaattggcatggtgagtttagattcccatcctcctagtctgctaacccgaccaatccactga

SEQ ID NO: 3608 - DNA, 462 bp, A.fumigatus
ctgagttgcatttccttccaggaacaaaagctcttcgacataggaatggctgtcgcagacgttacccgctcgctaggctcaaaagcctcccatcatctcgccgaatcagccgttgacccccgcgaactcctctggggcctgctcagcatcctgtcccgcatccgcggctccccctcatacctctttcccaccctcctcaatcgctcaaagagcatcctcggcctcgactgctccattagcatgagcaattttctccccctcatcaccgcacctccctcgggacccacgccatcctggcgcgaccaaagccagagtagatgggacctgcttactgccgcagagccagagacagaggaatcggaccatgccgcttctgttcctgtctctgttcccgcctcggtatcgcatatcccatcccccatgacatttcacgatacccatcttcttcgggcggcacggtaa

SEQ ID NO: 3609 - DNA, 201 bp, A.fumigatus
atagggcattttcgtcaaccaaatattatcttcttggcatacctctttaagtcacgtatgattggaacattgggggatggagaaagatacatgccgtacggtggtggtagtctgtgcttactagattctaactgtgagatggagattatcctttatttttcgagcaagggtacgcttctgaataatgcaactgaagagtag

SEQ ID NO: 3610 - DNA, 600 bp, A.fumigatus
agcgcgtttccttcgagccccgtggtgaagacgccgaccggagtggctgctagtgcgggcgaccccgaggacaaggaggtgctgaattaccatatccttcttattgagaatatgaaccactacatcgaagaagtggatgtgcgcggcctccctgtcctggagcgatggcgcgatcgagcgcagcaagactacgaggaacacctaaagctgtacctggacctggtgatccagcgaccactaggtaagctgctggagtttatcgatgcggctgaaggcctgatggctgggggcgggaaccccgcggacattgccagccgtcccagccactcccggtctgttgccaagaaggtgttggcgatgtatgacagcaaagagattcggcgcgggattgaattgttgaagaaacgagtggacaaacactttggggatgcagacgacccggggctaagtcgcagcctggtcttgaaagtgcttcgagcgtgcgaacggcggtacgaggaagcgtatgatcgaacgcggcacgtgttggatgcagtctacgaggggcaacttgatctggaatggcggaaggaagatgtcattgccatgttcaaccggtag

SEQ ID NO: 3611 - DNA, 1104 bp, A.fumigatus
  unsure (873),(1033),(1085): Identity of nucleotide sequences at the above locations are unknown.
tcgactctggcccagaagagaaagaaaagaagatgcttacgcaaaatactcatcacaccgctcctccgtcaccctctgacagtcaaacccgtatatctcgcgctgcacatccgcatccgcccacttatccggcacggggcccttccccgtcccctgcctcagcgcggcaaactgcctgtcgcgctcttccttggccgcgccctcgcccagatgcagcgcccgccccgacgcagccgccagctcgaccagcgcatatgcccggtccttgcgcacactctcatacaccttcagcgccttggtgatgctcgccggcgaggggtccggcatgcggcgcagggcgatggcgatcgtcgcgccgtcctcgatcgcctgcgcggcgccctgtgcgagatgcggcagggtggggtggcaggcgtcgccgacgagggcggtctgttcgtggacccaggtggggaggggttcgtggacgcgcagcttccactcgcagacttcgccttcgggcacgtagttgagcatgcgctggacgagggggcagaagtcggcgaagacacggagcatggcggccttggagcccttggtggtgtaggtggcgttggtggcggcggcgaagttggtgtcgggctgggtggtggagaggttgtagatggtgttgttggagaccgggtaggcgatgatgtggcggcgctcgccgatccagcggatcacccggttgctgttgatgatggcttgcagctcggggtcgtcctggcattggtccttgtgaatcatgatgcggtaggcggcctggttggtgtccttgacggtggcggtgatgccgagcgtttgcagcatcgcgacgcgcgtcttggacttgatgccgtcggcggcgagtangacgtccgcctcgaccgggtagggggcgctgccgtctcgggggacggctgtaaaggttgcacgcggggcgaacgaggtcacatcctccgcggccgtggaaaaatggaacttgatttggtcggggcaaccccaaacaccccttgtacaaggcgttggccancaaatgcggtgggcgaccatgttgagggtatccgtatgtttcgccgaagtanccgagttgaacgtgcccga

SEQ ID NO: 3612 - DNA, 429 bp, A.fumigatus
cagtcaaacccgtatatctcgcgctgcacatccgcatccgcccacttatccggcacggggcccttccccgtcccctgcctcagcgcggcaaactgcctgtcgcgctcttccttggccgcgccctcgcccagatgcagcgcccgccccgacgcagccgccagctcgaccagcgcatatgcccggtccttgcgcacactctcatacaccttcagcgccttggtgatgctcgccggcgaggggtccggcatgcggcgcagggcgatggcgatcgtcgcgccgtcctcgatcgcctgcgcggcgccctgtgcgagatgcggcagggtggggtggcaggcgtcgccgacgagggcggtctgttcgtggacccaggtggggaggggttcgtggacgcgcagcttccactcgcagacttcgccttcgggcacgtag

SEQ ID NO: 3613 - DNA, 996 bp, A.fumigatus
  unsure (160): Identity of nucleotide sequences at the above locations are unknown.
tggccaacgccttgtacaaggggtgtttggggttgccccgaccaaatcaagttccatttttccacggccgcggaggatgtgacctcgttcgccccgcgtgcaacctttacagccgtcccccgagacggcagcgccccctacccggtcgaggcggacgtcntactcgccgccgacggcatcaagtccaagacgcgcgtcgcgatgctgcaaacgctcggcatcaccgccaccgtcaaggacaccaaccaggccgcctaccgcatcatgattcacaaggaccaatgccaggacgaccccgagctgcaagccatcatcaacagcaaccgggtgatccgctggatcggcgagcgccgccacatcatcgcctacccggtctccaacaacaccatctacaacctctccaccacccagcccgacaccaacttcgccgccgccaccaacgccacctacaccaccaagggctccaaggccgccatgctccgtgtcttcgccgacttctgccccctcgtccagcgcatgctcaactacgtgcccgaaggcgaagtctgcgagtggaagctgcgcgtccacgaacccctccccacctgggtccacgaacagaccgccctcgtcggcgacgcctgccaccccaccctgccgcatctcgcacagggcgccgcgcaggcgatcgaggacggcgcgacgatcgccatcgccctgcgccgcatgccggacccctcgccggcgagcatcaccaaggcgctgaaggtgtatgagagtgtgcgcaaggaccgggcatatgcgctggtcgagctggcggctgcgtcggggcgggcgctgcatctgggcgagggcgcggccaaggaagagcgcgacaggcagtttgccgcgctgaggcaggggacggggaagggccccgtgccggataagtgggcggatgcggatgtgcagcgcgagatatacgggtttgactgtcagagggtgacggaggagcggtgtgatgagtattttgcgtaa

SEQ ID NO: 3614 - DNA, 414 bp, A.fumigatus
tccgctggatcggcgagcgccgccacatcatcgcctacccggtctccaacaacaccatctacaacctctccaccacccagcccgacaccaacttcgccgccgccaccaacgccacctacaccaccaagggctccaaggccgccatgctccgtgtcttcgccgacttctgccccctcgtccagcgcatgctcaactacgtgcccgaaggcgaagtctgcgagtggaagctgcgcgtccacgaacccctccccacctgggtccacgaacagaccgccctcgtcggcgacgcctgccaccccaccctgccgcatctcgcacagggcgccgcgcaggcgatcgaggacggcgcgacgatcgccatcgccctgcgccgcatgccggacccctcgccggcgagcatcaccaaggcgctga

SEQ ID NO: 3615 - DNA, 828 bp, A.fumigatus
  unsure (21),(73),(233): Identity of nucleotide sequences at the above locations are unknown.
ctcgggcacgttcaactcggntacttcggcgaaacatacggataccctcaacatggtcgcccaccgcatttgntggccaacgccttgtacaaggggtgtttggggttgccccgaccaaatcaagttccatttttccacggccgcggaggatgtgacctcgttcgccccgcgtgcaacctttacagccgtcccccgagacggcagcgccccctacccggtcgaggcggacgtcntactcgccgccgacggcatcaagtccaagacgcgcgtcgcgatgctgcaaacgctcggcatcaccgccaccgtcaaggacaccaaccaggccgcctaccgcatcatgattcacaaggaccaatgccaggacgaccccgagctgcaagccatcatcaacagcaaccgggtgatccgctggatcggcgagcgccgccacatcatcgcctacccggtctccaacaacaccatctacaacctctccaccacccagcccgacaccaacttcgccgccgccaccaacgccacctacaccaccaagggctccaaggccgccatgctccgtgtcttcgccgacttctgccccctcgtccagcgcatgctcaactacgtgcccgaaggcgaagtctgcgagtggaagctgcgcgtccacgaacccctccccacctgggtccacgaacagaccgccctcgtcggcgacgcctgccaccccaccctgccgcatctcgcacagggcgccgcgcaggcgatcgaggacggcgcgacgatcgccatcgccctgcgccgcatgccggacccctcgccggcgagcatcaccaaggcgctgaaggtgtatga

SEQ ID NO: 3616 - DNA, 213 bp, A.fumigatus
ctttggcactcggcacgacagaggagaactcacattcccaaccccacgacgcagtacgtcgcataccagaaactcacatcccctcccttcgcccccgtcgcgggcggataccacggcgcaactaccatgtacaggttcgagaggatggagaagccgacgaccacgttccacgccttgtacccagagggtggaatgttgtgccgtttacggtga

SEQ ID NO: 3617 - DNA, 315 bp, A.fumigatus
gacatgcttggatcttccgctatgcgatactcatatcggcagaatcctgtcaaaacgttgcgatggagcgcgccgctctccctcctgctcgtagcaaccctatacatgctcgccaacatcgcctatttctccgccgcatcaaaggaagagatcctcggctcaaaggtcgtggcggcgagtatcttcttccagaaagtcttcggcacgagcagcgcgtcacgagccctgaacttcttgatctgtctcagcgcgttcgggaacctgcttgccgttcttatcgggcagtcccgtctcctccgagaatgcggaaggtaa

SEQ ID NO: 3618 - DNA, 294 bp, A.fumigatus
agcgtcgccgtccctaacgagaccagacaaggagtcctcccgttcaccaagttctggacctcgacccgtccattcggcacgccgcttgggccctacgcgctgaaatgggccttgaccgtcctcatgattctagctccaccagccggtgacgccttcaattttggtgcgatcttttcccccacaaatatccacgtctatactgacgttcgcagtcgtcgacctgggcgtctaccccaccaatgcattcgccttattcctcgccattggactattgctcacccgtcgtcaccgtaa

SEQ ID NO: 3619 - DNA, 639 bp, A.fumigatus
cggattagcattggtatcaccggcctagttgtccttgggggacacaccaagatcgaagatcccaaggccaattttcgcgacgcctttgcgggtagttcctctgcctcggtgtatggtgccacaaacgccctggtcaaggtggccttctcgtacgcgggattcgaaaatgcgttcaacgtggtgaacgaagtcaaggtaggacatgcttggatcttccgctatgcgatactcatatcggcagaatcctgtcaaaacgttgcgatggagcgcgccgctctccctcctgctcgtagcaaccctatacatgctcgccaacatcgcctatttctccgccgcatcaaaggaagagatcctcggctcaaaggtcgtggcggcgagtatcttcttccagaaagtcttcggcacgagcagcgcgtcacgagccctgaacttcttgatctgtctcagcgcgttcgggaacctgcttgccgttcttatcgggcagtcccgtctcctccgagaatgcggaaggtaagtcaatgccatgcatgggctgaagcgtcgccgtccctaacgagaccagacaaggagtcctcccgttcaccaagttctggacctcgacccgtccattcggcacgccgcttgggccctacgcgctga

SEQ ID NO: 3620 - DNA, 435 bp, A.fumigatus
catcgcctccgattccgaaatactggcaacagtgccatggatgacacccaaatagagcatccaagacctatcccaatcttctattgctgttatctactccgctcgactgtgagacatgcctctctctatatcggatccacgcccaatcccgcaagacgactgattcagcacaatggtgtcgtcaagggcggcgcccgtcggactgccgccgagaagctgaggccgtgggagatggttctggtggtcgaaggttttatgagtcggctggcagctctgcagtttgagtacgtctcgcactatttatcttgcgtacagaatctaacattcccaaagatgggcttggcaaaatccttggtactcacgccacttacgatcagaagaaagctcagctctcgcggaggtcaagcacaggagaatgaggaaagcaaaatctga

SEQ ID NO: 3621 - DNA, 264 bp, A.fumigatus
aagacagctttcaggatgaaatttagatattttaaatacttagttatgctatttagactgaccaacacaccagcattattcaaaagatttattaaggaagtactacacaaggttctgcactgctttgtggtagtctacctagataatatcttaatcttttcagaaaataaagaagaatatgtagaatatattagagaggttctacaagaactccagaaggcaaatatcaggttgaaacttaagaagtgtgaattccacgtctaa

SEQ ID NO: 3622 - DNA, 243 bp, A.fumigatus
tttattgggcttatgaactattatcagcaattcatcaaaggatatataaaaattatgatgctattctttgaactacttaagaagggaaaggagtttgagtggactacagagtgcgaaatagtattcactagaatcaaagaaaaaattataaccgcaccaatcctagtgcaatataatctagataaggagacaaccatcaagactaacgcaactgactatacaattagaatgagaatgacttaa

SEQ ID NO: 3623 - DNA, 384 bp, A.fumigatus
ctccatgtggaacctctgttaatcaagccactcactagcattctagttagatacatggaagctgacctaacctgctacctgggcaaaggacattgtattgcgttggcatcctcttgtatttattcgacgttatctttcttgtgtgcatggaatcatgcaatcatgctgttctctccctttttatgcccctttctctctgcttccctggtctggatatcatacagaagggtcgatgataacagatggtttctggttagctccatgggttatttcaagattttaaccaacactttaaaaagaaatctgtattattatgattattattattattattactatctgactatcttgatgcatgacgcggctggtctaggtttgagttga

SEQ ID NO: 3624 - DNA, 231 bp, A.fumigatus
gatcgatcgaactgccttcggacgtccagcgccaatgaagaggttcatcattatggtgggattcacaagcgtacagtggaaatgaacagcttacacaagtcagcttcgcctcagacacggcaaggtgacatggctgcgaagatatccctgaatctctttctggaggtgatctacatcaactccacagccattgataatatggagcctctgctaactctgatcggctcataa

SEQ ID NO: 3625 - DNA, 468 bp, A.fumigatus
gagttggcccatggcttgaggtacaccacctttggttactctcaccttcgggttcaggccctcaatagttcgagttcggcatatgtcccgactagcggagagaccaagcctgcgccaacctatggtgagatcggtagtgccgccgactacctgtatcccgagggtctcaaaagaattaccaagtttatttacccttggctcaactcgaccgacctcgaggattcttctgacgacccgaactacggctgggaggactcggagtacattcccgaaggcgctagggatgggtctcctcaacccctcctgaaggctggcggcgctcctggtggtaaccctaccctttatcaggatcttgttagggtgtcggccaccataaccaacactggtaacgtcgccggttatgaagtccctcaattggtgagtgacccgcatgttccttgcgttgcaatttggctaactcgcttctag

SEQ ID NO: 3626 - DNA, 234 bp, A.fumigatus
tatgtttcactgggcggaccgaacgagcctcgggtcgttctgcgcaagttcgaccgaatcttcctggctcctggggagcaaaaggtttggaccacgactcttaaccgtcgtgatctcgccaattgggatgtggaggctcaggactgggtcatcacaaagtaccccaagaaagtgcacgtcggcagctcctcgcgtaagctgcctctgagagcgcctctgccccgtgtctactag

SEQ ID NO: 3627 - DNA, 1809 bp, A.fumigatus
  unsure (850),(1728): Identity of nucleotide sequences at the above locations are unknown.
gccattcgaaggaccccagccaaagcaggccaaagctgcaccacagatcctgaacttaacattatttgcttttcaagcctcgttcacagtgattgtgcaggctgttgtcgctccgctgttgacggtttatcaggaggccgatgggcttgccaaacagagagcgatactggaacccttgggggtctctttgattcagccatcgaagtttttgggaaatgggactcccctgagcttgaacccgccgctgaaaacgctttggtcgaatttaaagatcagttctcggacgtctttggtcaagcattgatgggagcagcaaaggaagaagtctccttccgagtgactgctcttgaagggtttctacgtctgtccatcctgagagattacttccaagataacgaaatcggcttgtttgtgcaatacttggatgaaatcctattaaaagaagaatgtgcgggccggggtgacttgaagaagaaagccatcgcagctttggctgaaatatcgaagcacaagccacgattgatcatggatataacattccctgccttcgttgctactctgcccgactctgacgaagggccaaacaccgactatataacgacacttgagaaccttgcacagatcagtgtcgaaagagatattttcgagacattagtccgacgtctactcagcaagctgaccatattgcttcaaaaggaacgcgctggatctatagcataccctcgcgcgattctcatgaccattctgtatgtgatgaaacagaggaatctggataaagatccaaacctggaactctactatgacaagattgtaagaggcctctgccgtggtgttgcagacgcggccacangaaagtctacgaatcggatcttgaatgacgcagttgtcattgatattcttggaaggcttctgcaaagtcattggttcggtgtctgtcgaagcaaaaaccaagatgaaattgcacagaacgtctacactctgtttgctagctcgagtacatttacgccggtgccgttctcgcaagcagcaaatgaggatcaacagcgtacaatgattatctcaacatatcttcttgcagggcttccggcagactgcgcacacctcccgtatagcggccgcgacttggcacctctcctttcagaccttgtgactcgatcattgacggagtgcgagccaccaacccatcttgcgtttcttcgtcattctgccttgctcgtgaacaaatttcttccaagacccgaacttagcgtcgctacgaacatattgaacaagctgttctctgctggtgctgaggagaaaaaggtaccttcgggaacaattaagacgatattttggctctcgaaggctctcatcatacgtcttgctccaacgaccacggaaatactgacctctcttttgtcactactttcgtcgcatgatgagttgacaagtaccactgctgctcgcggcttcgctattctccttaaggacgacgacgtcctttcagctgacaatggtgcaaacatcagacttctggcaaaacagcgtgtcttcacgacattgacacccctaatctcgaaccgcattcgcgaggtcaatgtcgcaggcgatgactcgtctacgcccgcacacataaaaccagcacatctcactgccttatcaggtatactttcaacaatttcgccttcattggtcatgccggagctcccgacactgctttctcttctcctggcaagctgggatctgcanaacgcagactcacagggcgtccgtgctgcaacactagagactctcgcccgtattatcccggaaaatggccgtcgcatttaa

SEQ ID NO: 3628 - DNA, 1260 bp, A.fumigatus
  unsure (1166): Identity of nucleotide sequences at the above locations are unknown.
ggaaacatcctcggaagtcacgccgactcatgcgcagctaaacgtttctccgggatgcaactacaacctcagaagcactacaattacatcctaggtagtatgttaagtatcaagtttctacctcttcatccagatgtgaatcgtacatcaaaatcggcctgtatgccatcaagtaccccaatgtccagcagtaccatggcctccccgatcatggacaccgtctctgaacaaccacccccagaagaacccatcagcaaccccgaccacatcgatggagtggcatatctctacggccatcctttgctcaactccctatctccgcctctccaccaaacaatataccaaagtctcggtctgaattggacccagatccctctctccagcgtctacgggacatcagaaacctaccctccaccatacacccgctcacccccgattcccaaattcctcgcgtccatcaagtccaaccccaagttcgtcggctcctccgtgaccatgccatggaaagtcactatcatgccacacctcgacgacctcaccgaggacgcccgacaggccggcgcctgcaacaccatcttcctccgcccggaagccgatggcaggacgtcctacgtcggcaccaacacagactgcatcggcatccgcgaggctcttctccagaattccaccggcgagaaggcattccgcaacaagcccgccctcatcgtcggcggaggcggcaccgcccgcacagcaatctacgtgatgcgcaagtggctgggctgcagcaagatctacgtcgtcaatcgggatgcggccgaagtagctgccattcttgaggaggaccgccagcgcaatcccagctccgacaaggctccgctcatccatgtgacggatcgcacggttgcggctcgtctggagcctcccgcggtcattgtctcggggatccccaattaccctcccaaaacgccgggggagctccaagccagggaagtgctgcaagtgtttctaggggaggccccggcaacgacggcaacccccaaaggcgtgattctggagatgtgctatcaccctgtcccgtggacggagattgcgcagctggcctccacggctgggtggaaggtgattcttggttcggaggcgttgatctggcagggcctggagcaggcacggctgtggactggtanggacgtggttgcggagcctggcctagtagagaaagtcaaagaggtggtgggcaagttgattgctgaacgggtgccgtccaagtcaaatttataa

SEQ ID NO: 3629 - DNA, 201 bp, A.fumigatus
  unsure (6),(111): Identity of nucleotide sequences at the above locations are unknown.
gaggcntggtcacaacgggaatccgcctggaatcccgagacggatccgatcgaagaggcgcgcttggccagtcggttgtatttggtatttaggcccgttgggccatcaganactgagaccgggagacagacgcaggagaggactgtgagcgaggtgtggaagcgcgtgagggagctggattatacacgacctggtgcatag

SEQ ID NO: 3630 - DNA, 291 bp, A.fumigatus
  unsure (36): Identity of nucleotide sequences at the above locations are unknown.
ctttctctactaggccaggctccgcaaccacgtccntaccagtccacagccgtgcctgctccaggccctgccagatcaacgcctccgaaccaagaatcaccttccacccagccgtggaggccagctgcgcaatctccgtccacgggacagggtgatagcacatctccagaatcacgcctttgggggttgccgtcgttgccggggcctcccctagaaacacttgcagcacttccctggcttggagctcccccggcgttttgggagggtaattggggatccccgagacaatga

SEQ ID NO: 3631 - DNA, 303 bp, A.fumigatus
ctggcccggtcgggtttggctggaccaggggcctcgttgagcgccgggttcgcttttggcattccgccaatcatcaagtatggtagcaaggacttacaagaacgttttcttcctgatctcctcaccggaaggaaacgtggctgcattgccatcacagagccagaagcgggaagcgatgtcgccaatatcaccaccactgccacgaagactccagatggaaagtactacatcatcaatgggacaaagaaatggtaccttctagaagatatactacaattgatggaagtttctaatacccattag

SEQ ID NO: 3632 - DNA, 411 bp, A.fumigatus
tcggtcgagagatcttatctgaatctaaatcaagaccagctcgatcttgatactctgtcaagccaacgcaccatggctgaggtctctcccaaccccattcccttctcagagcccccgtacttgcggggtctcccatcgccatactacaccgccagtcatcgccgattccagaaagcttgccgcgcattcttatgggagcacctcctcagccatgcaatggactgggagaaggcgggtacagtccccgaacatgtctttaatgatttctgcaagcataacatgttgctgccgaatctgcccgctccgttgcccgtggattggctgaagaagctgggaattcatgatattctcggggtgaaagttgaggagtgggattatctacataccggaatctactgcgatgaggtatga

SEQ ID NO: 3633 - DNA, 192 bp, A.fumigatus
agcatactcattgtatgtatggtaggcgcagccgggtgctggatgtgggtacaggtcgagacgcctgagtggatccaggaagttgaaccgcgctacgctagtgtcaatgttcaacttaccttcattgcattgtggacccgtcagtccttcggacaaggttttcaactcgccattaggcgatacattgcccca

SEQ ID NO: 3634 - DNA, 495 bp, A.fumigatus
ctgctcaactcctccgctatacttctccaagtacaagctgctctcatcgtacagccaactgcaacgccgcagcagatactcgtaggcactcaaatccactattccctgcaagctatcagcctggctgctttcctcaccgcattcaccatcctcgagattaacaagggcgatcatccgcgactgacatcgctgcatggcatcttaggactaattacctacatctgcatcatcctccaagcactgctgggacttgttcagtatttcttccctgtcaagatccttggcagtgctgatgcgggcaaaagactgtacaagtaccaccgccattttggatacttgctgcttgtcttggaactggcgaccgtgtcagcggcaacccagacgacgtataatgtggctgtcctgcacattccgctttggggcgttcttgttgcagcggtattaattgtcgctggagtcggtgccaggatcaagaagcacaagctgggcttttag

SEQ ID NO: 3635 - DNA, 291 bp, A.fumigatus
acccagccaacctattattttaagctgcaagcatcttaccatcagacttctggctggatctctaatctttcctcgataacacatatctccacctcgaagaccttctggaagacgctcaccgacttctacagtaatatcatactcatggcctctgccacaggagtccctcaagaacatcctcagaccattgaggccagagaagatgagccattattgggtagaccaggggcagtgacgcaaagagaaagcgatcctatttaccgcaatttaatcaaaggtaggcgctgctga

SEQ ID NO: 3636 - DNA, 873 bp, A.fumigatus
atcgcgtgtccttccagccccgtggtgaagaccaacgtgggcggctccctcctgatgggtttcttccttgaagacaagaatctcttccgcgaagaatggagtcaaccgccccctcgtaaccccagcgaagacagcgacgctgcgcgccaatacgcacagaaccataaatcggtcaagaagaccatcccgctctacatcggcctcaccaccggcttctgcggcagcttcacctcattctcctccttcatccgtgatgtcttcctcgccctgacaaacgacctccccgacccctccgtctcatcaatcacttcccgaaatggcggttacagcttcatggccctcctcgccgtcctcctcaccaccgtcgccctcagcctctcagcactcatctgcggcgcccacctcgccctcgccttcgacggcttcactccatccttccccttccgtctcacccgccgcgtcatcgacccgctcttcgtcctgctgggctggggctgctggcttggcgccgtcttcctagctatctggccaccagatcgctccggcagcagcatcaatgccccagacacctggcgcgggcgcgccgttttcgccatcgtcttcgccccgctcggctgtctcctgcggtactatctttcggtctacctcaacccgcgcgtgcctgcgttcccgctggggacttttaccgtgaatatcttcggcacgatcgtgctggccatgtgctttgatctgcagcgggtggacggggtcgggactgtgattggggcagatgcgcgctcggcgccgtatgcgatcctcacgagttgtcaggtgctccagggcgtcacggatggcttctgtcttcacagcgccgctggaaggaacacccccccc

SEQ ID NO: 3637 - DNA, 474 bp, A.fumigatus
tgtcttcctcgccctgacaaacgacctccccgacccctccgtctcatcaatcacttcccgaaatggcggttacagcttcatggccctcctcgccgtcctcctcaccaccgtcgccctcagcctctcagcactcatctgcggcgcccacctcgccctcgccttcgacggcttcactccatccttccccttccgtctcacccgccgcgtcatcgacccgctcttcgtcctgctgggctggggctgctggcttggcgccgtcttcctagctatctggccaccagatcgctccggcagcagcatcaatgccccagacacctggcgcgggcgcgccgttttcgccatcgtcttcgccccgctcggctgtctcctgcggtactatctttcggtctacctcaacccgcgcgtgcctgcgttcccgctggggacttttaccgtgaatatcttcggcacgatcgtgctggccatgtgctttga

SEQ ID NO: 3638 - DNA, 231 bp, A.fumigatus
gtgaggggttgtggtgccctgataagtcgatatagtcagtttgagccgtgccgctatggctctgcttgcttttcgggcggagcgccacatgaatttgtaggtgtatggcttattgccacgccgtcggggatttccgcccccctcgcccattcttatcctattgtggggaagctgaccttcatcgtcactgaccacgcagatgcagttaccatcatccctgccctcatctaa

SEQ ID NO: 3639 - DNA, 498 bp, A.fumigatus
cctaatcttacgcagctcgtcctatatgccgccctgcacagtctgtataacatctacctacattctctctctcgcttccccggccccaaactctggcaaaccagctacatcttccgccacattgccagcatcagaggcactctcgacgtatctatcaaggcattccataccgaatacggaccggtggtccgctattcacccgacgaactctccttcatctccgcggaagcgtggagggacatctacgggtttcgcgagaacgcccttcccaaggacccatccttatacggcctcatccagctctctcgggataagagcccgagcatcttcacagcagaccaggatcatcatccgcgcgtccgaaaggctctctcttacgcgttctcagagaaagcgatccgcgaccaggagcctttcgtcaaacactatgttgacctgcttatccagcgactgcgaggcatcgccgacgcagaggataacagggtcgatattgtgtag

SEQ ID NO: 3640 - DNA, 789 bp, A.fumigatus
gaggaatccactctcacatcccttttcacgcaatcatcaaggattcccaggcagatgtcgttcctcatggagagctcagctgtcggtcaaccgtcacctctcagcttcagtaacacccttaatgctcttctgggtgcagtaaggactcagttcacaaccccaggagtgaaaaggctgacacataacctaatcttacgcagctcgtcctatatgccgccctgcacagtctgtataacatctacctacattctctctctcgcttccccggccccaaactctggcaaaccagctacatcttccgccacattgccagcatcagaggcactctcgacgtatctatcaaggcattccataccgaatacggaccggtggtccgctattcacccgacgaactctccttcatctccgcggaagcgtggagggacatctacgggtttcgcgagaacgcccttcccaaggacccatccttatacggcctcatccagctctctcgggataagagcccgagcatcttcacagcagaccaggatcatcatccgcgcgtccgaaaggctctctcttacgcgttctcagagaaagcgatccgcgaccaggagcctttcgtcaaacactatgttgacctgcttatccagcgactgcgaggcatcgccgacgcagaggataacagggtcgatattgtgtagtggtaccactttaccacctttgatattatcggcgacatggccattggtagatcattcgactgcctccgtcttctaccaaaggagtcggcggatccgcgctaagaat

SEQ ID NO: 3641 - DNA, 183 bp, A.fumigatus
ctaactttgctgagtagctcctgtgtgatcctggacccaatctattctgtagataagagtttcattttatcgcatctgcgtgtctgggtatacagtgtggataattggaactacgatgattggggtaggccgcatcgggcaagacagctggggtatatgacacccctgaacaatctacattga

SEQ ID NO: 3642 - DNA, 195 bp, A.fumigatus
accctgacccttcccaaacccctggtggagtttggaaaccgcccgatgatcctgcaccaggtcgagagcttggctgctgccggtgtcacagatattgttctggccgtcaactaccgtccggatgtcatggtcgcggccctcaagaaggtacaccgatcccttctcttgcacgggctgatacgttcatgtggctaa

SEQ ID NO: 3643 - DNA, 183 bp, A.fumigatus
tctgcaattgtcgcccgcagtacgaagaacaatacaacgtcagaaatcgagttctccgtcgagtccgaaaccctcggtaccgctgggtcccctgaaactggcaaaaaaaaatttggggcaaggaagaattctccccttcttccgttctcaacttccgataacaacttgggaataaccccttta

SEQ ID NO: 3644 - DNA, 558 bp, A.fumigatus
actggtggaaacggaatgggcatttccccgcaaattgaacagtgggtgacactcttaattttcggtgcgcttgctcgagctcctcggaatcgtatgcccggtgtctccggagaacaatatgccgtgcacatgcgcgatgtggtgatggccatggttggcctcacacacaccatgaacaccagagtcggcaaggatttcgtccgcggtgtcagtggtggtgagcgtaagcgtgtcagtatcgctgaggccacgctcagtggcagccctctgcagtgctgggacaacagcacccgtggtctggacagcgcgaacgcgctcgaattttgcaagactctgaacctgatgaccaagtacgccggcgctaccgttgccgtggctatttaccaagcctcccagagtgcgtacgatgtaagtagcatatctctacccctgtctgctgctctagcgctaattcgattactaggtattcgacaaagtgactgttctgtacgaaggaagacagatctactttggacgcaccgacgaagccaaggaattctttaccaacatgggatttga

SEQ ID NO: 3645 - DNA, 348 bp, A.fumigatus
gtattcgacaaagtgactgttctgtacgaaggaagacagatctactttggacgcaccgacgaagccaaggaattctttaccaacatgggatttgaatgtccggaacgtcagacaaccgctgatttcttgacttctctcaccagtcctgccgagcgtgtggtgaagcccgggtttgagggcaaggtcccgcagacccctgacgaatttgtgcgagcttggaagagcagcgaagcctacgccaagttgatgagagaaatcgaagagtacgatcgggagttcccaattggtggcgagtcgctcaaccagtttatcgagtctcgcagagccatgcaggcgaagaaccagtaa

SEQ ID NO: 3646 - DNA, 1083 bp, A.fumigatus
  unsure (738),(1022): Identity of nucleotide sequences at the above locations are unknown.
ctttattatggccttggttatcggaagtgttttctacaacctgccggacgacacaagcagtttctacgctcgtggtgctttgcttttctttgccgtgctgctcaacgccttttccagtgccctcgaggtgagtcaaattggctaatgtgggactatcaccagccagctgattgtctccagattttgacactctatgctcaacgtcccatcgttgagaagcaagctcgctacgcaatgtatcaccccttcgctgaagctatagcctcgatgctctgtgacatgccttataagatcaccaacgccatcatcttcaatcttacactctacttcatgacgaatcttcgccgcgaaccgggcgccttttttgtcttcttgctcttctctttcgtcaccacattaaccatgtccatgcttttccgtacgatggccgcttcgtcccggaccctgtcccaggccctggtgcccgccgctatcctcattttgggtcttgtgatctataccggcttcacgattccgacccgcaatatgctaggctggtcgcgttggatgaactatatcgatcccatcgcatacggatttgagagtttgatggttaacgaattccacaaccggcaggtcttgtgtccagactctgcatttgtcccctcgagcggtgcatacgacagccagcccttggcttatcgggtctgctcgacagtgggctcagtttctggctctcgttacgtccaaggcgacgantacctcaaccagagcttccagtactataagagccaccagtggaggaacctgggtatcatgtttggtttcatgttcttcttcatgttcacctacttgactgccaccgagtacatctcggaatcgaagtctaagggtgaagtgctactgttccgacgaggccacgcacagcccaccggctcccatgacgttgagaagagccctgaggtgtcttccgctgcgaagacggacgaggccagtagtaaagaggctaccggagctatacagagacaagaggcaatctttcnaatggaaggatgtgtgctacgatatcgtcttctaccacagagggtcgaaggatccgcccga

SEQ ID NO: 3647 - DNA, 408 bp, A.fumigatus
gagaaatcgaagagtacgatcgggagttcccaattggtggcgagtcgctcaaccagtttatcgagtctcgcagagccatgcaggcgaagaaccagtaagtcagaagcgttctcaactcaggtaccatgtgctaaatctcttcgcaggcgagtcaaatccccctacaccatttccgtatggcagcagatcgagctgtgcatgatccggggcttccaacgtctcaagggcgattccagtttgaccatgtcccagttgattggtaactttattatggccttggttatcggaagtgttttctacaacctgccggacgacacaagcagtttctacgctcgtggtgctttgcttttctttgccgtgctgctcaacgccttttccagtgccctcgaggtgagtcaaattggctaa

SEQ ID NO: 3648 - DNA, 639 bp, A.fumigatus
agatttgattcagccaacagctccaatatcataaccaaaccagtcatggacagactattctccaaaagcacttccccccagcccgtctacacctttgccctcgacagctcgggggaaacaatcacctgcgcaggccgaccagccttccagctcgcgacgcagaaatccaaaccgcatctcaccgtctcgcgtctcccgccgccaggaccatggtcccccgcgcctgtccccgtcggaacctgcaccgtccacaagttcccctctagcaaggtggacatcacacttcacgggcaggaattcatgctcaagcgcgatctcctcaaaagcgataaccaccacttcgattacccgccgctagggcacttcaagtggaagcccgatgcatggggcgggagtaagctggagttgtttgacagtggccggcggttgttagcacgctacgacaagaagctctcgttgaccgggaaggggcagcagatcgaagtgtttgtgccgggggacgagcggttcgtggagatggtgattgtgacggcgttggcgatgaggcattatatcgaggtggagaataaggatatccagaaagtgacggacattcttgagtcttcaccacggggctggaaggatgcgcgggtaggctat

SEQ ID NO: 3649 - DNA, 219 bp, A.fumigatus
  unsure (121): Identity of nucleotide sequences at the above locations are unknown.
tgccttcctgtcacaatccctggcaacacttgcggtggctcctcccactttctttcggggttcccactgaaaccccactgttctcccgtgacaccccaaatttccaaccccaagtccatcncttatgctttccctgccactttgcttcctacctttgttcccctgggtttgtccattaaaatccgccctccgggtccaatttcgggaaaattcaccctc

SEQ ID NO: 3650 - DNA, 1239 bp, A.fumigatus
gtgctctcgtatacgggcctctggtcatcgttgcctcggttggcgttgtttgggggcctatattatggctttgaatggttcctgcttgttcggtggtctgccacgatccctgtgctcgaattccctgctgatttgttgttctacaacttcgctatgccccttgccatacggtctatcaagccctctgatggcttacataagctttacaactggtggttccataaatgcgcccggttcttacgactcagcagctttttctttggtgaaaggcacaccgatgaagaaggttatcatgtgagacggacttggtttgatcttctttcaggaaagaaaggcgacactgaacaccccatcgtcggtgaacctgagcgtcgccgcgccgacgaaaagcagcttgctgcttacttcgtccgggacggcaagtttgtacgggctccggcttccgatcaagtgcgtattccaaagggcaagccagtgttcttggaggtcaccgacaacaacgagcgggttgatggcgcaccggatccggacgagggtctacacggtcgtgccaacgacatgttcactaaggtctacatcccaccctccttcaggaccagaattgcggcgttcatcttcctgatctgggtctttgccgctactaccggggtaggcaccacaattattcccctagtaattggccgaaaaatcatgttggcatgctttcccgatcggccgctaaatgatatctacgcgttctctttgggcatctgcattgtcggaagtgttgcctatctcatgttctattgccggaccttcttggctacgatccaggatcgtcttcgtccctaccttcgttcgccacaacaggctttgctcggattcggaaatgccgcactcagcggtctgcgactagcttacatagtgctcgcattctcggttctactgccgtccttgtttgctctagtcatggagctttacgtgattgttcctgtgcatacgtacctgggtggaacacgggcgcacatcatccactttgtgcaaaactggacgcttggggtgctgtatgttcaaatggctatcaagtttgctctatggcattctacttcgcgacctgcagcggccctcaacggtgttttccggaacggctggctgaaaaccaatgtccgtcttgccacccgagccaataatgccttcctgtcacaatccctggcaacacttgcggtggctcctcccactttctttcggggttcccactga

SEQ ID NO: 3651 - DNA, 513 bp, A.fumigatus
cagcgagctttcctcgcgcgaactaccctcaagatgccctcggacgacgatctcaaggcacacgctgcctctaaccaagatttctatgctctgcttgacatcccaccggctgcttcggagtcggaaatccgccgtgcgtacaggcggacagccctcaaataccaccctgacaagatcgcaaacccaacacagacagacatcgacaaattccacctattacagattgcctacgatgtactctctgatccctccatacggcaactctacgataatgcgcgagaagcgcgcgaaagaaaaaagcgtgagctggagatgatggacgcggcaaaaaggaagatgaaggaggacttagaagctcgagagcgtgccggtgcagttgcgatgggaggtgcacaacgaggcgtcaagaggacctggatgtctgccggcatggctggagcggacgacgatgatgatgagttcttcggccggacattgaacgttttgtatcgacacgccggaattactcacccg

SEQ ID NO: 3652 - DNA, 738 bp, A.fumigatus
catgagcaagggcgccacatccaatgtcgatatcataccgcctccctccctgagccatggggacgtcccatttacctacatgtatgcctctttgcaccacatgctcattcacattcaccaacactaaccgagccaagttaccgtcagaacccaaccgtccgacaatcagtcgacacctccggcaacctcaccaccgtcaacacctcccaagccgccaaagtccacacctatctactgcccttcgacgcaccagtgcctaccaagccccgcgagaatcttgcacccatccacacccttgatccaaccttacgagaaaccattgccctcgtcgaagacctcttcaaagagcgcccagcttggactcgccgcggccttcgcaacaacctcaaaaccccggaacagcgctacgccctccgccacgccgtgccttatgtcggctacatcttccgctcagggccctggcgcgacgccatcatcaagttcggccatgacccgcgcacctcccccgcctaccgcatctaccaaaccgtcatgttccgcatcctatccggcacctcggagctcgcccgcgacgccggcagcggcagacggcacaccatcccacgacccaacgaggtccccacaggcaccgacgccttcacccctttaccaacagacacacacctcttcaccggcactccgcccctcccaccagaaggccgcatgtggatgttctgcgacatcaccgacccgctcctg

SEQ ID NO: 3653 - DNA, 612 bp, A.fumigatus
ccgagccaagttaccgtcagaacccaaccgtccgacaatcagtcgacacctccggcaacctcaccaccgtcaacacctcccaagccgccaaagtccacacctatctactgcccttcgacgcaccagtgcctaccaagccccgcgagaatcttgcacccatccacacccttgatccaaccttacgagaaaccattgccctcgtcgaagacctcttcaaagagcgcccagcttggactcgccgcggccttcgcaacaacctcaaaaccccggaacagcgctacgccctccgccacgccgtgccttatgtcggctacatcttccgctcagggccctggcgcgacgccatcatcaagttcggccatgacccgcgcacctcccccgcctaccgcatctaccaaaccgtcatgttccgcatcctatccggcacctcggagctcgcccgcgacgccggcagcggcagacggcacaccatcccacgacccaacgaggtccccacaggcaccgacgccttcacccctttaccaacagacacacacctcttcaccggcactccgcccctcccaccagaaggccgcatgtggatgttctgcgacatcaccgacccgctcctgc

SEQ ID NO: 3654 - DNA, 816 bp, A.fumigatus
catgtggtaggtttgcaaatggttccttccatattcccttctgccgttcaaatagaattactctctcgattgttccatcgagatctgtcaaacccggagcatcggaccaaccttcacctgcactaccacctcacctaccctggtcaagctgcaagtcaaaccgacacggccgtttccgcacctgaagatggctccacagtaccacagactgtatctttctttgaagaggactcgtccaacgtcttatttcccaaagatccgcaggtccataagccgattacggttgagcaaatgctcaccaagaagctgcgctgggtgacccttggcggtcaatatgactggactgctaaagaatatccttcggggcccccgccctgcattcccctgctgatattggccaagctgctgcgcacagctttccctcaaacaaaagcagaggcagccatcttgaatgtttattctcctggcgacacactgagccctcatcgggatgtcagtgaggagtgtgatgtaggcttgatcagtatcagttttggctgcgatggcctctttctgatcagccatgatgatgggactgattgtgagatcatccgtcttcgctcgggggacgcagtgtacatggatggcacctctcgctttgcatggcacgcagtaccgaaaattgtccctggcacttgcccggattggttggctgattggccatgtaaatccgagacacctgataagacagcatttggcaagtggaggggctggatggccggcaagcgggtaaatctgaacgtccgacaaatgtctgcaactgactctcatgggtga

SEQ ID NO: 3655 - DNA, 186 bp, A.fumigatus
atacagaatagtctcgattcctcatacctgagactgccggggccattctcggaagcggccggatctcttttttacggcccagacattgctgcggaccctgattttggcgagaccttactgcggtatttgaccttctccagttatggccctaatatgtatggccgattgtccgctggttcctactga

SEQ ID NO: 3656 - DNA, 189 bp, A.fumigatus
tcctgtctatttagctatcatgctgactatagccgccactcacacgactgcaactcttctaactacaattatataccaaatctgcaaacactggatttggttgagcctcttcggggaagagatttgctcagtgattccaggaccttgcctaagactaaggcggggttcaccgaaattacgttttattga

SEQ ID NO: 3657 - DNA, 231 bp, A.fumigatus
gctgtctttgagtttctcatcgtattcgtctccggctttggcttcctgtttgacttgttagctttcatgatgtttatttacacttactccgtacagacttgttggcctgacgatacataccttgtctttgctaaagcgattacatccgaacttgtatcagatctgacgtgtcaatgtcacctgattagtccaaatgtcttttctcccgaatccggtgctgtctcgttgtaa

SEQ ID NO: 3658 - DNA, 480 bp, A.fumigatus
gagcatcccttgagcgtacgtctcagatatcctcgattgtctcttgcgcacatattgttgaccgtacatctacagttgagcccatcagtcactatgccttccatgcacgatcgtatccgcgaggacctcatcatcaaagagcgcgctctgtggacggccttgacctcagcagaccccgggccggctatcgagaaactctcccaccaagaagtcaacatgatatttcctcaaacacccatcttaacgctggagggcgagaacaagatccaggatgctgtcaagccacccttccaccgattcgatacctactctctggacgaagtgcgggtgatcatcatcgatctcatggcgggtacggttacgtaccgggtcactgctaccagaggaaacaagacgtaccgtgcaaatggctcgacgacctggcaacaggcttcggatggagaatggcggattatttgtcaccaggaaacattggtgtaa

SEQ ID NO: 3659 - DNA, 303 bp, A.fumigatus
gtcggtggtacggtccagacatgctcatactccctaacgcagttactcatatcccgcttcgtcaacggtatcggcactgggattatgtcaacattagtgcctgtctaccaagcagagctatgtgaggcgcggaaacggggaaaattggtgtgcagcctaccgcttgccgttggggttgggattgtcctcgcctattggtttgactatggtatgacctatgttacggggtcaatcagttggcgattacctatcgcttgtcaggaaatattcgccgtgcttgtagtcattttagttgctgggtaa

SEQ ID NO: 3660 - DNA, 237 bp, A.fumigatus
ctctgtgcttttccaggctataatcagggtgtcttctccggaatcatcaacaatgaagactttctgaatatcgtcaaccacccacgcgcgggcatgctcggattcctcgtgtcaatctacaatctgggctgcttcttcggtacttttattgcctttatgacaacagacaggcttgggttccaaaagtctatgtggttttcgatggtctatgtagtagtgagtgcagcccgcgaatga

SEQ ID NO: 3661 - DNA, 486 bp, A.fumigatus
ctatggtatgacctatgttacggggtcaatcagttggcgattacctatcgcttgtcaggaaatattcgccgtgcttgtagtcattttagttgctgggtaagtcggccagttccgtgtacaactgcacttgaatttatattggtcagatctaacgggtgtgacaggctcccagaaagtccccggtggttatacaggaaaggtcgtaacgaggaagcactgcaggttttgtgtgaggtgtatgaccgggcacctgatcacccgaaggtccttgccgagtcggaaggaatcttacaagcactcgagttggaaagcgcgcgtggagaatacagatggtctcagatcttccttaagagagatgatttgcagactggtcgacgggttcttatggcttacgggctccagttcatcaaccaaatgggcggtaccaatatcatcgttgtaagtgacccgcatgcacgtttgcaggcggttcgaactgacaagtag

SEQ ID NO: 3662 - DNA, 228 bp, A.fumigatus
cgtcttcatttattcggcgttgcgaattggctacttgtcagttcgaaccgcctgcaaacgtgcatgcgggtcacttacaacgatgatattggtaccgcccatttggttgatgaactggagcccgtaagccataagaacccgtcgaccagtctgcaaatcatctctcttaaggaagatctgagaccatctgtattctccacgcgcgctttccaactcgagtgcttgtaa

SEQ ID NO: 3663 - DNA, 690 bp, A.fumigatus
tcggtaattaggtcagagcgcttggacagtgttggtcagaaagcccgactcccgcggagcgtacaagccttgtatcttcggccacttcggcggaagcctgaatttggtctgccagtctgcgatcttcaactcaggtcttatagcgttcgcaacttggagttttttgctgactttgctctacgagctgcatattacctggaacttcctgtttctgggccggttcccctgccacggatcgttgagcgctggactttcccgcgaagcaatttcgttcacaaaaaaagtcaggagaacttcgagcggataacccttcgccggttgattcagattaaagatgggcatccccaagctgtacaggcatggctggcttttttgcgtaaacatgcattttacggagttggtatgaaagcaaatgtgtgggatcacgaaagcctcggtatggcctcctcccgctatacttattgcctgaccaaaattgtgtcaagtctatatgcttacggattgttaaatctagacgtggcccggaacatggatgaatcactgcccgatatcgagaagtcgcttgaaccgtacctctcacattttggttatcggagtgacggatcggatcagagcgcagtatttgatcttttagaaagtgagcgtttcactcataacaagagccccttgacagacattcgcaagggttaa

SEQ ID NO: 3664 - DNA, 459 bp, A.fumigatus
  unsure (419),(425),(428): Identity of nucleotide sequences at the above locations are unknown.
ccaataatagatatcctcggagtacctgacgagactgtctgggaatatggagaagccctccgcaggatggccgtcgagaaggagcttcatcatgtcaagtttatccgactgtttgagcttctcgaacacccctggattcctctgaccagcgctgaacaagccaagtcatattacctggcacatgcgcaatgcctccgaagagagttgatgtaccggttcgaggaccgcagcttcgacgctgatgcggctatccgcagtgacaatgatacctgcctcacatatcgcgggtacatcaagttcctgaccaaagacctggctcctcaaatggacacgcagtatacgagtaaaaaggccagagcagctcatatcgcccagattgctcgtagcatgatcgtccgcggaaagatgtttgctgcgtnttctcnctnagagcagacaaggataccgcaaaaggtgtag

SEQ ID NO: 3665 - DNA, 645 bp, A.fumigatus
ggaacacgtcgcaatgaggcctctctgcagcagccattgagcgaagttgatcggcacgagcagcctgccgcaagcgacaacacacagtccgggttggacattcctcctgtaaccgtctccaccccccaaagtagcgacaatccgcttgttgaatcaaaggaggcagtcccagttacgttcaaagacgagggcaaagggaccaaggatgacccctcgcacctcctagccgaggccctcgaaaccaccaacggagaggagaacagtcccatctccgaagacgaagcaacagcgattgctgtcctgaaagtcatcgaacgttatggggtgaactttgagaagactggcgagtcctggcagggtctgacctcgttcattcccaccgtggttgagcaagtcaaaaagcgggaagctgttcggatgatcctcccggctttcccgttcaagtcccccaatgctcgagacaaggtcttgggtgtgatgccagatctcggagaggagctcgcgttatatcatttgaatgggctgtgcgagaacattggaagagtctacgaaccgggtgcagatgtatatatcagctcggatggactcgtatacaatggcaagtctctcctgcactcaccacggtttcaccgtgctaaccaataa

SEQ ID NO: 3666 - DNA, 735 bp, A.fumigatus
  unsure (2): Identity of nucleotide sequences at the above locations are unknown.
tnttcgctccaccgcggatccttccagccccgtggtgaagacggcaacatccccctcctcgcactaaccatcctctcctcctcctggacaacaggctcaaacgccgtcgggattaccaacctggtcagtggaaccgctgctgcaggcgtgaccgggccccgcgagcgcgaaacggtaatcactcaagaaatccccgtcaaggtcctccacgaaagcgcagtcgaaggcctccacgagccgcgctgccgcgatccagacgtgcacatcatcctcccgagcctggcacacctgaaaagcatctcggagcggttctcgaagctagcgggggacgcgcgacccgctgccagcggcgggattgtgtcctcgacgctgacgtcgcccaagctcgagttatcagcaaatatgcatggctcgttgaggctggcgattgcgaccgatgcgctgcgcatctctagtgtgtggagtgatctcgtgaacccgccgctggatccggcggggatgtcgcagcgtgagattgagcagttgcccagtgaaaggatgcgggcgctggggagtgatgacgaggcggggtgggctaaggtgcggatcgatgctaaggattggagtcgggtgttgagtattgggcggctgagcccgaaggtggttgcctgtgagttgtactacggtggttgtctatgcttgcgactctacgcttgtgctaatacgcctactcgactgtccaggttttatccatga

SEQ ID NO: 3667 - DNA, 246 bp, A.fumigatus
actttttgtaacaaaccctgtgttggagccgaatacccagtctaccttaccaaaacccctcttttgtttaccatacagtacggtgatgccttatctatctggatggtcactggacgctccgctgacagtaatgccacctgctgtaaggggtacattctgtctgacgagagagatcggcacatatcttcatacttgtggattcctctcaaactgatgttggtctttgaaaattctgattctccttaa

SEQ ID NO: 3668 - DNA, 219 bp, A.fumigatus
gcagccatggtcgctccaagacataatgcttatgcagaggagagcgcagaggtcgaggtgctgtacgccaacctcgagaagctcaagctcctcaccaagaagattcagggctccctggtccgcctcgagaccgggggtaacgtcgtaaagcatgcgataggtcctatctacagcaatacacaatcttcactacagagcggcaggaccgcgctatggtta

SEQ ID NO: 3669 - DNA, 213 bp, A.fumigatus
cactgttctgtcggatatattgatatatatatatattatatctctctctcagcccaaaaggtctccagacaaatgactctaagtcacggcatacgttcatctgaactgctggcatgtactctgactgatgataagaaggctagttgcacgtcagtgattgaaatatctgctgacattgacatatataaggctggatgggttcttacaatttga

SEQ ID NO: 3670 - DNA, 189 bp, A.fumigatus
cagctgtatctttctgacctatgcctcttaaatgcctgcaggtttagcttcaacatcaatactgtactatttacaagcacccatgcagatttctgggagctagcaaaccttccatacgatgttccaatactgcagcggctaggtaggccgcacctacagagaagaagaatggctttgcatattcactag

SEQ ID NO: 3671 - DNA, 525 bp, A.fumigatus
  unsure (500): Identity of nucleotide sequences at the above locations are unknown.
aattggttccaaaaccgacgagcaaaggcaaagcagcaaaagagacaggaggagtttgagagaatgcaaaaggccaaagcagaggctgaggaagctgctcggaataaggccgacagcgcggacgacacatctgactcaaaccaaagcgattcgacgaccaaggaggagaccgataaagccaacgacacaaagacatcggagtcgggcgggccaggcgagcagacgaagacatcgacctcatctcgatcgaagcatcagaaaacaaggagtgagtcggctcgagaggccactttcgcctcattgcagagagctctcaatgctgccgtggcggctcgtgagcactacggcagcgagtgcgagcaggatcggaatgacggcaacagtgttggaggatctgcctccccaacgacatttcccctgagcgctcggggtaatgaccatgatgactcggaaagcgcccacagtgctctcaacacccctttcttcggcgtcttcacacngcggcgggcgaaggacagtagcacg

SEQ ID NO: 3672 - DNA, 540 bp, A.fumigatus
gaatacctactcggatcggcagctcgtggtgaaaaacatctctaccgtcgacacctcccctattcgactatcctaactttccccaattcctctgccatgaactacctacaccacccatacgccttcggcggtcataatgcggttcaattcgatcaatccatagcctacgaccctgccatggcacaccatgccatggtgcaccccatggatggctacctataccctcacccaccatacgagatggttgactactatcatcaaccgatcatggactacgaagaatacgcggagaatctgtcccgtccaaggttgaccaaagaacaagtagagacgctggaggctcaatttcaggctcaccccaagccaagcagcaatgtgaagcgtcaattggccgctcagacaaatctgagcttgcctcgggttgctgtcagtttaatcctaagaagaatgcaatatgtgacatgcgctgacccgggaatagaattggttccaaaaccgacgagcaaaggcaaagcagcaaaagagacaggaggagtttga

SEQ ID NO: 3673 - DNA, 999 bp, A.fumigatus
accgggaacgagtataacgggcgcatgggcttgcgtatatcgtccatattcgtgattatggtcggctcgatgttgggtgctgtgtttccggtctttgcacggagctttagcacctctaagtttctcagacgggcctttttcgttgcaaagtactttggctccggtgtcattattgctactgccttcatccatcttttgggaccggcagaagaagcattgactaatgagtgtctcactggtcccattactgaatactcatgggtcgaaggtatcatcctcatgaccattgttgtgctgttcttcgttgagttgatggtgatgcggtacgcacgcttcggtcatggccacttggatgatttgggacacgatgatcatacgcatccatctcttgatgcccccccagcaaccgtggagtccaaaagccacatgcctggagaggaccatctcggacactcccgcgagcatcgcgacactgagtcaggtagaaaggcttccttaatcgaggagtattccgctcagttgacatcggttttcatcctggagttcggtatcatcttccattcgatcttcattggcctgaccttggcggtatccggagaagaatttatcacgctctacattgtcttggtcttccaccaaactttcgaaggtctgggtctgggttcccgcctggcaacgatcccttggcccaactcgaaacgcttcactccctacctactgggaattgcatacggcctctctacgcctcttgccattgctatcggactgggggtccgtaacagctaccctcccgaaggttacaccactcttgttgtcaacggagttttcgactccatttccgccggcattctcatctacactgctcttgtggagctcatggcgcacgagttcatgttcagtccatcgatgcgcaaggcaccaatccgaaccgtccttgctgcatttggtctgttgtgtttgggtgcgttgctgatggcgttacttggaaaatgggcctaa

SEQ ID NO: 3674 - DNA, 219 bp, A.fumigatus
gtgagattatatcccctcagtcagctgtgcctggattcaaactccacttccctcttcccatcatccacagatcaggcaggattcgaggttcaggaggccatgcacattttcgacgatatctcgtcagcagttattttcatggatcagctagtgagacagggctctactatgaagtacatgaagctgccactatgtcccatagaatacactacagcctga

SEQ ID NO: 3675 - DNA, 237 bp, A.fumigatus
gagtgttccgtgtttagtccgaaccacgaaaatgggatcctcatgggcgaatcaaacaccttcaaattctacgcattttcaatgcggacagactctaaattgaccattgactatctgggaatttccgcggctatcctgatattcgacgccgacgcgatcgccggttttgaagaaatacttgtttgtgatatgagcagattccactgcatcagctggtcgaagcaaatacatgaatag

SEQ ID NO: 3676 - DNA, 261 bp, A.fumigatus
ctcattcttgcagagtacaactcttttgacgacgacccttggattctgaaattggtcgaatatacaaaacaggctatagacgatcagcgtgtaaagattctgggaatctgctatgggcatcagatcatcggacgcgcgctcggagccaaggttggccgaaatgacgcgggatgggagattgcggtatgcgacgtggatctgacggagcagggaaagaagttgtttggaaaggataagctggtatgtcatttatttctataa

SEQ ID NO: 3677 - DNA, 195 bp, A.fumigatus
ccggatctagtaagtagccgcatctccatacgcctggccttggtccttagttctacgtgtgcaattctattagcggatggaccatttgagtcccgcggtttttttttttattttttttttttttttttttttttttccatctctaactcattcttgcagagtacaactcttttgacgacgacccttggattctga

SEQ ID NO: 3678 - DNA, 300 bp, A.fumigatus
cagcaaattcaacaaatgcatcgagacatcgtattcgactacccaccgaacgtcgttccacttggatcttcccctcgctgcgccgtacaggggatgtataggccggggcatttcatcactgttcagggccacccggaattcaaacaagatattgtgtcggagattgtcaagttacggatgtcaatgggtgccttctccaaagaacaaggcgaggatgcactggctcgagcagggaaggatcatgatggcattgctattggcgttgctttcctgaagtttttgctgggagacattcaatag

SEQ ID NO: 3679 - DNA, 465 bp, A.fumigatus
  unsure (40),(198): Identity of nucleotide sequences at the above locations are unknown.
catctgcagtccatcctgctgttcccggactgcgttaacnccgataccctcgactacgcctactcaggcacccagaactggagcggcagttttcggcccgcgaaccgctgcccggccggcatgaagcgcatcccgcagctgcggttctccgttcgctacgatctgcgcaagctgctgccgaatgggtggtccggcacnccgccgctggagttggcgtgtggctcgtcgtactgctggcacggcgatttcattaatggatgggttcctgaggcggcgcagaatatgctgaaggcgacggataagcgggagtttatgcagattgatgggccgctgggtggaggcaaggatgggtccaagtgtggagcgaagaatgcgcacgatcaggatcctaaccatggcacgagcgattatgaggagagtgtcaagatgatgtcgagcaagaggagtattggccagcgtcggtga

SEQ ID NO: 3680 - DNA, 408 bp, A.fumigatus
tccgttccagtctggtgtccctcatcctccgtcacttcacttgcaaagcataattcctctcatcgtcctttagaatcagtgtactcacccgacagcatcatgacagcacgctacgcggacgttcacaagaacccccaaggcccaggggatgctcgcccaacagccatgcagatcatccatgacgagggcctcgaaggaaaactggccgactcctcgatcctgatcaccggcgcatcctcaggcatcggcgtcgagaccgccaaagccctcttcaccaccggcgcaaccctctacctcacagccagaaacctccccaaagccaaacacgccctcggcgacatggcttcctcgccgcgcgtacacctcctcgaattggaccttgagtccctcgccagcgtgcgcggtctt

SEQ ID NO: 3681 - DNA, 252 bp, A.fumigatus
atcagttccactgacgacacctcagatggctggttctccgagcagtcggatatgtggcccggccaggccatgaacctcaaggtcaaccagatcctgcaccacgagaagtccaagtaccaggatgtgcttgtcttcgagagcaccgactacggcaccgttctcgttctggacaacgtcatccaatgcaccgagcgggatgagttctcgtatgtatgcccgcccagcgcacattgttcgtccggcggcttctaa

SEQ ID NO: 3682 - DNA, 372 bp, A.fumigatus
acctcaaggtcaaccagatcctgcaccacgagaagtccaagtaccaggatgtgcttgtcttcgagagcaccgactacggcaccgttctcgttctggacaacgtcatccaatgcaccgagcgggatgagttctcgtatgtatgcccgcccagcgcacattgttcgtccggcggcttctaatcatgtagttttatgttactgcaggtaccaggagatgatcactcacctggccatgaactcccacccgaaccccaagaaggttctggtcatcggtggtggagatggtggtgtcctccgtgaggtcgtcatgcacgagtccgtcgaggatgccatcctgtgcgacattgacgaggtatcattctatctaccatag

SEQ ID NO: 3683 - DNA, 186 bp, A.fumigatus
atggtgtcgatcgctgatttggtgaaggctgtcatccgtgtctccaagaaatatcttcccggcatgagcatcggcttccaacaccccaacgtgaaggtccacattggcgacaggttccagtttctcaagggagcgcaaagaacgaattccgatgtcctcagtccctggacagctcttgacccttga

SEQ ID NO: 3684 - DNA, 231 bp, A.fumigatus
  unsure (24),(31),(90),(129): Identity of nucleotide sequences at the above locations are unknown.
ttatccagggaacgtccccatttntttcagngtgacctacagaatataggttctgaaatgatattcgcaggattcagtcaaaagtgtggntccatccggagacctatgcaagtaactgttagccaaggnttcattaaaccgtgcactcagtcagtccgttccaaaaacctaccattccgcgcctttcacgtaattaagaggtgggtctattctattgctctcttctgctga

SEQ ID NO: 3685 - DNA, 717 bp, A.fumigatus
ttgcggatccgtccaccctctcgtggtgaagaccgcgacctcatcccgacttacaatgccagtggctatggaaacatccaccgtcaagttgatgaccaaagcgacgagtctcaattctctgggatcttcgaaagggccgttgagactcgcaacaagggtcagctccatgcttatttctggagaaataccactgcgtctcccattcctcctagtatcaattctgttcttgaagtattccctgtccaacatcacaacaacacacccagggtcctacacattgacgaaggaaatgcgcatcatggcgttggcggctacaatgcccctggctatgaaaagaaagatgatatgcccagctatggcaacgcctctgctcagcaccacgatgtctcagttaagtctatcgatgttggcagttccgatatcgaagcccatgggaacacagatcctgcttgcactggtggcacatatgatgctcatcacgatgtggagacgatcggaagccatacgtccgaaagcctcaatgctcgcactcccgtcgctcaagcctacgtccaagctgtcgaagaacctgcaaagaaaccaactcctacctttgccaaacaatcggacggaggtagaagaaaaaatggcaaccatggccaaagctggtatgtcctcgttctcgtcaatcccttcccaccacagtggacttctaatgacctttatcgaatatgctag

SEQ ID NO: 3686 - DNA, 1191 bp, A.fumigatus
atacataattgcggatccgtccaccctctcgtggtgaagaccgcgacctcatcccgacttacaatgccagtggctatggaaacatccaccgtcaagttgatgaccaaagcgacgagtctcaattctctgggatcttcgaaagggccgttgagactcgcaacaagggtcagctccatgcttatttctggagaaataccactgcgtctcccattcctcctagtatcaattctgttcttgaagtattccctgtccaacatcacaacaacacacccagggtcctacacattgacgaaggaaatgcgcatcatggcgttggcggctacaatgcccctggctatgaaaagaaagatgatatgcccagctatggcaacgcctctgctcagcaccacgatgtctcagttaagtctatcgatgttggcagttccgatatcgaagcccatgggaacacagatcctgcttgcactggtggcacatatgatgctcatcacgatgtggagacgatcggaagccatacgtccgaaagcctcaatgctcgcactcccgtcgctcaagcctacgtccaagctgtcgaagaacctgcaaagaaaccaactcctacctttgccaaacaatcggacggaggtagaagaaaaaatggcaaccatggccaaagctggtatgtcctcgttctcgtcaatcccttcccaccacagtggacttctaatgacctttatcgaatatgctaggagcgagccagttcattcagacttatccggagagaaagacgaaagttccgaaacacagtccacttcccaaaggaattcgggtgacaacactcctccatccgcaaatatcgaatcctttattgaccctgcacttaccgaatcgactcggaacaatgttcccaaatctgggtctgccaacatgacatctcatacggctcacaatgccgaaaaggcgtacgggacacctgctgacagccaggaggcacagctggcgtatccctctagcagtcagggcgttcctacttccatgcaagaccagtcccaagaagactcgaatggtttggctgttctcaatcgtcctatgaacaaccaggcacaccagtccccaaccatgcaacaatcgcaacaccgatcttcgagctccgatgcggctccaaataatcttgatccaagcctatattctgcaacggggccggaaagtccaaat

SEQ ID NO: 3687 - DNA, 768 bp, A.fumigatus
gctacttggcttggaataactagtggcccattgtgcaatcaatcggtccattctactgtctgctttgtctactctcggttacacgccgaccggctggcaggggaagcacttcggataatgatgaactcactcaaattacttgtcgtctctccagagatcaaccccagtaatcgaaaagcgaggtcaataccagtcctcaatcccttcgaccgatatggccgggtattcttcttctcgtggcttggcttcatggttgcattcctgtcatggtatgcgtttccacctctggtaaggcaatggtctcctatacggcaagcacttggaaacgtggcacaattgactgagaatggctgtctagttaacggtgaccattcgcaaagatcttcatatgacacagcaacaagtcgcaaactcgaacattgttgctcttctggctacgtaagtattgaacggaaagttctttcggaattcaaccatgctgacgagcccaggttccttgttcgattcatcgctgggccactatgtgaccgcttcggacctcgacttgtctttatcggcctcttgctttgtggctctattcctacagctatggctggtctagtgaccacccctaatggtttaatcgctttgcgtttcttcgttggcatccttggtggcacatttgtcccttgccaagtatggtgcaccggtttcttcgataagaacattgtgggaaccgccaactctctggccgcaggctggggtaatgcgggaggtggaatcacatag

SEQ ID NO: 3688 - DNA, 702 bp, A.fumigatus
  unsure (135),(681),(699): Identity of nucleotide sequences at the above locations are unknown.
gacgcccccggcccgggtagatctacggccatgggtctctctgacatctgtcctcgcagtttcgtcatgcctgctatctacgactcgcttgttcactctcagggtctcgcaccacataaagcttggcgcgttgcntacattgtcccattcataatcatcgtcgtcctggctctgtgcatgctgctcatatgcgaggatacccctactggcaaatggtcggagcgccacatctggatgaaggagaataatgaatcccaagccaatatcgtcaacctcatgtcaggcagcccctctacccgcccatctggtcctccatctatcaatatatccactccgcaatctgagaagaagggtgcccagacacctcagatggtcgatcctgaagctcaagctgttggacaggttgacatcctcagagcagacaccgtggtggcccccagccgcaaggaggtcatgaacgttcttctcagtctctccacggccgctgtcgccatcccatacgcctgttcctttggatccgagctggctatcaactccattctgggcgaattctattcaaagaacttccctgacatgagccaaaccgaatcgggccgctgggcagccatgttcggtcttctcaatgtcgtcttccgtcctgctggtggattcattgcagtcttcaccacgggggtggaagantcagcgctctcattggcnctc

SEQ ID NO: 3689 - DNA, 897 bp, A.fumigatus
atgtcgtggggcggggccgtctccctcgtcttcccagatggcttcaagctctccttctccggcgactgccgcccatcgaccaacttcgccaccatcggtcgcgactcaaccgtgctcatccacgaagccaccttccaagacgacatggccgtctccgccatcgcaaagaaacactccaccacctccgaagccctcgaagtcggccgcatgatgcaagcccgtactgtcgtcctcacccacttcagccagcggtaccaaaaagtcgcacacgtcgaccacggcgccggcgccggcaccgcaaaaccagaacccgaacccaagcccgcccccatgacgcgagtggacctcgacgtgcccgacgatgaacccgaacccgctcccgagcctgtaccctccaccctaaccgtcacccccgcggaaaacgaaaacaaaccacccctccaagcccccgtcaccgccgcctttgactacatgcgcatccgtgtcggcgacatccccatcgcgcaggccttcgcccccgccatcgagaagctgttcgacatcctcgagcgcgcctctgcagtcgaagcaaacaagcagaagaaaatccgtgaagcggctgacgccctggcaaaagagaagaagcagaagcaaaagaagaagggggccgctggggctgagccgttatcctctgccactcccgccgccgctaccggcgaggccatggatattgaccagggtcgatctgtgtggagcgctagcgaaagcgagaatggatggggctcgaacgacgacgagtggatggatcggttttggcgtgggaagcacagtcggagtcggagtcatagtaggagtaagagcgcgagcggacggcgctcgagcccgagtattcggacgaagagtggtgatgctgtttag

SEQ ID NO: 3690 - DNA, 687 bp, A.fumigatus
ccgtcacccccgcggaaaacgaaaacaaaccacccctccaagcccccgtcaccgccgcctttgactacatgcgcatccgtgtcggcgacatccccatcgcgcaggccttcgcccccgccatcgagaagctgttcgacatcctcgagcgcgcctctgcagtcgaagcaaacaagcagaagaaaatccgtgaagcggctgacgccctggcaaaagagaagaagcagaagcaaaagaagaagggggccgctggggctgagccgttatcctctgccactcccgccgccgctaccggcgaggccatggatattgaccagggtcgatctgtgtggagcgctagcgaaagcgagaatggatggggctcgaacgacgacgagtggatggatcggttttggcgtgggaagcacagtcggagtcggagtcatagtaggagtaagagcgcgagcggacggcgctcgagcccgagtattcggacgaagagtggtgatgctgtttagattagaatattccatgatagacggaagtcctgagcgaatacatatacggacagaattgtatccgtggtttcatttcgcactatgggtgcatgcatttacgcaagtctattattgttggttattgaccagccagcgactatattacaaactgtgcttgttttcaaccacaggcgggccgaaggatcatatgcac

SEQ ID NO: 3691 - DNA, 219 bp, A.fumigatus
aagtcaagggaatgggcaaaggtggcaggaaagggcggcattggtatcttggaagcacaacctgaggatattgccctggtttggcacaccagtgggacaactggtagacccaaagcggaatggcttactacccctgaaaagaaggccatcatactgatcgcaatatgggaacaggtccggttaacacacaagaaccttgtcacaaccatgagtgagtaa

SEQ ID NO: 3692 - DNA, 927 bp, A.fumigatus
tcaatcacagaatatatccgggatacatatctgttaactcccgaggaccgaacgtacttagtgatgcccctattccacgttcatgggctgctggccggcctcctcgcccctctcttttcaggaggctctgttatagtacctctcaagttctctgcctccgagttctggcaagatttcgtgactcaccaggcaaactggtacacggctgtgcctacgatccaccagatcctcctaaagacccctctgccgaatcccattcccaggatccgcttcatccgctcatgctcgtcgcccctttcccccaagacttttgaagacctggaaagaactttcaaggcccccgttctggaagcgtacgcgatgacagaggccgcccaccaaatgacgagtaaccctctcccacccggaagacgccggcctggcagtgtcggcatcggacaaggcgtagaggtcaagatcctcgaccaagcgggcgaagaagtgcctcagggcaaagagggggagatttgcgtccgtggcgagaacgtgaccaaggggtacttgaacaacccggcagccaacaagtcgtctttcaccaaggacggtttcttccgcacgggcgaccaggggaagaaggaccgcgacggctacattatcatcaccggtcgcatcaaggagctcatcaacaagggcggagagaaaatcagccctatcgagcttgacaacacgctgttgtctcacccccaggttgcggaagccgtctgtttcgctatcccggatgagggccactatggagaggatattggagccgcggttgtgttgaaaagtgccggctctgcaaccgaggcggatctcaaggcatggatggctggaaagctggccaaattcaagaccccgaagcaggtattccaatgccccttgtgcccaacgtattttcctgagcaatga

SEQ ID NO: 3693 - DNA, 540 bp, A.fumigatus
accaaacggacatatctcgttcgcacacttcaaggcatcgcccaccataagtctctgcgaatgaccttcctttccggtgccgtgaacgtctgcggcgcgggcctagtgcatgatcccgcccacccaaaggaccacaagaccatgtaccagataatctcctcggccgttgtcaacagccctcccccctcgtacatcatcaaactcctccacagcagccacaagcccctatacattcccgcgaacggccaccgctcgaccccgtcgcagcccacggataccaaggaagacatgatggaaatcttccagacggacgtcacgggccaaacacgcgaatatcgtaaacttatgggtcggcgcaactacgtggccatcgtcgcctacgaccccgaggtcgtaaacaccatgtacggccagaacatgtcccatggcagcggcaagcttaatctcgccgtcgactttatggtgcaaggcgacggcacctatgggaatgtgatcaagtatggacccgtcattgtcccaagcctggagcatgggaaatga

SEQ ID NO: 3694 - DNA, 216 bp, A.fumigatus
aggatgacaatgaatctttgcttacgacgagcgcaggtctgggttatcccagagaccaacgaggtctttacgaattatgaaccataccttcagcgaatggatttttacaagcaaaagcgatttatttgcgagattactggtcattcggggttgacattcttcgaagcccttaggagcgaagtacgtcatctgattcttgtgggttcagtcttttga

SEQ ID NO: 3695 - DNA, 492 bp, A.fumigatus
attcacgacttaccgcaggatggacgcgtcttcgatctcgctggacgtttatgcacgggacgaataatacctagcaacaagacacgacggggtgggttcgcgagtggcgtcgaaaaaggaaggtatcgaaaagaggccaaagagtcgtgcggggaagaaaaaaggcgcgaaaggaagagaaaggcgcgaggagacgaggatagtagaggcggaggagtaggaggagaggaaaatgaagagttgaagagcaaaagaaaggagaggcggttgccgcgaccaaaagaagcgacggcagaaccaagccccatcacatttgaggatcattgcggcaagaggcccagtagtcaggaattaggatggagtgggagagcgagctccgaggcatacaacaacggtgattggcccagaggaggaggacaggacccggacaagaccttcagcgtcgggcggagagtattttcgaacgttaaagtacggtacggacaaggctaa

SEQ ID NO: 3696 - DNA, 549 bp, A.fumigatus
ccgttgtttccaggctattgtggtactacccaggctcattgtcgctctccagactgtcagctcgacttcggtcattgcgacgctcatgaaaccccagagggccctcccgtcgaagatatacctcgaccacatgtcggtgccgtaccatatggcccgcacgtcattcgctcgtgtgccagatcaggcactattgccttgacttatgatgacggtccgaacagatacactgctgaccttctcgacctgttggatcggtatgacgcaaaggcgacgttctttatctctggaattaataattccaagggccctatagatcatccggatctcccatgggcctctttgattcaacgcatgcaacgcactaaacatcagattgcgagtcacacctggtcgcaccaagatctcagtaaagttacaccagagcaacggcgacagcaaatcctgaagaatgaagctgcgttccgcaacgttttggggaaaattccgacctatatgcgtccaccgtactcgagctgcctccccgaaacgggctgcttgaacgacatgggt

SEQ ID NO: 3697 - DNA, 252 bp, A.fumigatus
caatggcagctgttcaataaacatcagtccttgctgtactctagtctgaagagttccatgccggacccagagtcgcaggttatgactgtgatttatggccatgattcgaaaaactccctgtccctcaagacgtataccaagggcctggactctgggtgcgtcaagggtggaaagttgacggctatggttgtcgaagacgggggaaagcagagcatcgtccaggtgagatgtcgcgatcgtcggaaggagtaa

SEQ ID NO: 3698 - DNA, 402 bp, A.fumigatus
gaccatgctctggctggggccttgctgggttggcgccctcaacaccgacacattcgacaagatccccatatcccgcctcacaccccacgatatccaacagcagcccggcgccgtaccagccctaatcatcatcgtcgccatcctatgcggtatcgtcatcacccaggccatcgcctttcgcaacgaaggccgtctgccaaaaatgcttgccatctacggcgtcctgaccgccatcgttctcgcgctcctagttgtgccacacatgaacctccgcatccaccactacatcctcagcttgctctttctccccgggacgaccttgcagacgcggccaagtctgttgtattcgggactcctgatgggattgttcatcaacggaatcgcccgctgggggttcgatag

SEQ ID NO: 3699 - DNA, 768 bp, A.fumigatus
gataagaccatgctctggctggggccttgctgggttggcgccctcaacaccgacacattcgacaagatccccatatcccgcctcacaccccacgatatccaacagcagcccggcgccgtaccagccctaatcatcatcgtcgccatcctatgcggtatcgtcatcacccaggccatcgcctttcgcaacgaaggccgtctgccaaaaatgcttgccatctacggcgtcctgaccgccatcgttctcgcgctcctagttgtgccacacatgaacctccgcatccaccactacatcctcagcttgctctttctccccgggacgaccttgcagacgcggccaagtctgttgtattcgggactcctgatgggattgttcatcaacggaatcgcccgctgggggttcgatagtattctccagacgcctgccgcgttgctcgacggcgcgcagctgggaagtgcgcttccgcagatctccacgcctctggttgtatctgcgcaggagatcgtcttcactttcctgaagaatttgacttccgaggcggatggcatcagtgtgcttgtcaatgacgtggagaggttccgtgctttccggtcaggggatgggtcagtagaatccttcaattggacgagacggcgggcagaagaacctgaatatttccgcttcgggtatataaaattgaatgcgttgggtggactgtggtatgaagattttacaaagccagtcgtttgggacgttgatgggagttggaatcgctcggctccgacttag

SEQ ID NO: 3700 - DNA, 621 bp, A.fumigatus
gaaactttgtccaatgcatcgatccatgattttatcattctagaataccgtgacacaattggaggtcgcgcttggcacacgaattttggcaaggacgaaaatggagacccttatgttgtggagctgggtgccaactgggtatgttattcctcgttttacgtcgaaccaaccaaccactctgacgttgaacagatccaaggcattggaaccccagatgggccacagaaccctatctggacactagccaaagaattcaacctcaagaatacattttccgactatgacaacgtctccacttacaatgagaacggatattccgactactcgcatctcttcgatgagtttgacgccgccgacgaaattgccaatgccgcggccggcacaattctactggaaaatttactagatcaaacagctcagacagggctcgctttggctggctggaaacccaaaaagaccgacatggaggcgcaggctgttgaatggtggaattggggtaagtctgcttccaccttcaacaggaatgaaattaacagcgcagacttcgaggacacttattcaccactcgagagctctctggtatttggctacgccgggagtaacttgacctggaatggcttt

SEQ ID NO: 3701 - DNA, 225 bp, A.fumigatus
tccccatcctattatactgtcctcgacccgaaggctagactccgtatgacagtgcctgctctacgcttcctgtgcggcttagtaggcccaaaccatgtacgacgcaaacggctttcacaatgtctactttttctcccttcccatggggagcgcaaggcgaaaagcaacgctacgtccaagctcgcgggtgcgattattgtctctcttgtgatcattcttcttcta

SEQ ID NO: 3702 - DNA, 258 bp, A.fumigatus
gagacaacgaaaataattttgtatttaaaagtggctaaacagcatcaggaaggcaagactggaaaaattagtttacccgatgacgaccccgaggcgataaacatcatggtccagcatctgtatgggcaaaactacgaagacaccagaccagatttggaagactatggggaggatcgtgccctactaaacctaaaagtatatgcgattgccgataaatacaatatcacttctctcgaagagtcggcgaaagctgcattc

SEQ ID NO: 3703 - DNA, 270 bp, A.fumigatus
aaaaggccaaatcccgggcttattgttccctttcatcggtatctccctttcattccaatcccgatcccgatcaatggttcgccaacatctttatctctttcaacccaatataatatcgtcattatggtcaagctcgctattctccctcttgctgttcttgctgccttggctccctttgccgccgcagataactgtaagactgggctcaactactgtggttataacctgctgaacattggtatgcaaacgttccactcccgtccgacttga

SEQ ID NO: 3704 - DNA, 291 bp, A.fumigatus
ttaactcaaaaatatagcagtcgatatttctctccctgttttctcacgtggtcattgaatcaaagtagtaccattggatgttttcacaagcttgagtgtctagatctcttcgatcacctaacagtggataatagagtttactacgtatgggtgaatcattgctttgaatgtaaactcacatgcccactctcagagtctagctatttcgcctctttgtcatacactactggagtccattgttatagaaggtggcgggagttagaatcaaaaagttatccttgggtgctatag

SEQ ID NO: 3705 - DNA, 201 bp, A.fumigatus
tgcgtccccctgaagcagcggggatggtccgatcaggcatccgctcccagctacgatcgtattctgtctccgaccgccgcaaccgacgcgacctgctctcagacgacgtatgacttcgcagcttcgagttcggcggtgatatctcgtccgtgtaggcgatgccgtactcgtcgacatagacggccagcacgggcttcatga

SEQ ID NO: 3706 - DNA, 393 bp, A.fumigatus
tgtccggtccttacgatcaatactcccagcagcaaggctacggccagggccagggtcaataccagcagggaggatacccccaaggtggctacggacaacagccttactctagccagcaatacggccaggagtatggccaacagcatggtcagcaacacggtcaatacggaggctctggtgactactacaaccagcagcgcaattacaaccaggatcagtacggccagcacccgcagagccaatacggccaacatggccaacacgaccaccagtatggtcaacaacaccaaggccaggggtcatacgggcagcctgggtatgtcacctgccccaccactctcttctcacagtcataaacttccggtaacatcagctgacattttctctctctag

SEQ ID NO: 3707 - DNA, 333 bp, A.fumigatus
  unsure (118): Identity of nucleotide sequences at the above locations are unknown.
catcagctgacattttctctctctagctacaatgaccagaacgctcccggtggagcccaagaaggcgaacgaagactccgcggtgctatcgcaggcggtctcgccggtggatttgcangccccaaaactgaccaccgtattctccgtaccatcggaggcgccatcatgggatccgtcctggaagacgccgtcaagaagcacaagcacaaggatggttcctccggacacagcaactacggtggctctcagtacggaagtcaccaaggcgggcatggttcgtcaagcggtggtggtctgatggataacttgggcggcttcttcaacaagaaataa

SEQ ID NO: 3708 - DNA, 435 bp, A.fumigatus
gtcaatcacacattgtctcctcttgagagttccatcttatccactttctattattccaacacaatacccaacacaataatgtccggtccttacgatcaatactcccagcagcaaggctacggccagggccagggtcaataccagcagggaggatacccccaaggtggctacggacaacagccttactctagccagcaatacggccaggagtatggccaacagcatggtcagcaacacggtcaatacggaggctctggtgactactacaaccagcagcgcaattacaaccaggatcagtacggccagcacccgcagagccaatacggccaacatggccaacacgaccaccagtatggtcaacaacaccaaggccaggggtcatacgggcagcctgggtatgtcacctgccccaccactctcttctcacagtcataa

SEQ ID NO: 3709 - DNA, 606 bp, A.fumigatus
aagatgataggcaatctcgccttgttaacctggcttgtgttttcctttttgaagtttggttcctgtatcttcattgacggcgaactcaatctatatggattctctccgtatcctggcgatcggactacagaaactaacacactgactgtcagtgttcacgggctggtccatgctacagctagcacgtttacgcatacgtcagcagtaccttccagaactatgtctgtagccgattcaatatcctcgacagctccctcttcaagcattagcggagcgtcgagtctgggatggcatcccgtggctatcacactcacaaaaaaaccgactccccactggaattataacataactgtgccgaagagttctgccaagtattccagctctactactccgactttgaccgtgagcacggcggaatccagtgcacgtgaagcctccgacatggagacgaccggcttctggaaagaccagagcacaccaacaacaataacagccctttctaataacaccatgatatcatctagcgctgatggttccaggtctccgcttattttttcggcggtcatgctattcggcgtcaatcttttgactggagttcttttgtga

SEQ ID NO: 3710 - DNA, 195 bp, A.fumigatus
tgttggaaaatgagcttgtcggatggggacgaagcttgtgagacccggttcgataattggtctgaagcgacccctattctccaggataattataagtatgtggtcatccgaaacatcacccattttctgcacacatccacttccatggcggagtatcatttatatcacatctttcgaggacagaataagctgtaa

SEQ ID NO: 3711 - DNA, 1428 bp, A.fumigatus
agcagttttgccgcggactcggattggcagtcggaggaatcgggacgtttcgacgacgcagaggaatctatgttagacgagcaacctccccactcgcgttcggcgcactcatccaagcggcgccgttcaaatgattggccgctccaacccggcgaagagaatcctgcaccaaaggacaatggaaatcattgctggccgttcaagaactcgagttatggctcaccgcgtcgaactggacggcagggaggtggcggggataaatcgagccgtggccgaccgtctcgcttcatcgaggcgcacatgaacgacagcgtgagcgaaaagccgcctagtatcttcatacgcggtgacgcgggcgcatccgagcagaatgattgcggtgcaggtcagaggcaatccggtatctttcggtttggaagggcgattgcatcggcgttcaatccgtttggggtctgggggaatgtgtctgatatctggcgcggctcgcagtccgagcatcggccggaaggagacgcgagagcccgggcggagaaggcgtatgcagagcttaagaaggcaggctacaagggaactgtcaagggaagctatatgcagggcatgcagacgagtgcgcctgttgcggaacagcattctcggagagcgagtcaggcgcagtcggatggcagcaagactttggggcgtcactcgagacagaattccacagaaggatacgggtctggaagctcgattcggagttcattacaggaactacgcaaggccaagtcgtcgctaggcattccctacatcaagcgaggatctgaggacttggatcgccccgaagtgcgcaaatcgcgatcccgcaaggagctacagaggcaggccaagctgctgaagcgggtcagtgaccttgaggggaagcttgaacgtgcaagacgcgagctgcgcgaattgacgggcgaaaaggaggaggagccggtaaggacactctgccaggagagaacctatcatcggccgtttgtgcctggagccctcccaacgcttccctcagagcgattctacgaaaataatgccacaacagtgcctgattcgcaagcagtcgagctagcggctttgtccgagacgtcagggaatatccaacgaatggctgagagccagggaaacggattggcgactgtggaaagcccatccctcaagagaaagtcgccggacccaaagtcagtccgtgacaaggtccatcaaatgactgaggattctcctaacaagaaatctctgtatgaagaacccgcccgttctgacgaaaccaacacaccccgaaaagcgaccaaaatgggaaagagtgacagtcccggatctgtcgaacggaagcgggctcaggatcaatcccagccagaagagcacgaatgtccaggagtcctcacctcggagctgccaatcgccgttattctccac

SEQ ID NO: 3712 - DNA, 372 bp, A.fumigatus
ctgaaggtcgccgagatcaaaatcattgggagccctgatccagcagatgtccataaaatgctcgtgcctcagctgcgcagtgtgaaaaaggccgccgatgagtgtcacacccgtgctctccagatggacaagaaattcgaggaatggctgtggttcgcagccgatctccattcgaactgtgtccaagagcagtccagtaatgaagaaagactcttggccacaaaagtcaacatgtctgtcgcccaacggcagttcgactctcagaagaacaccgttgaagaagcgaagaagatatcggagaagctaggaaagcagctcgatgtcgcttctgaagcctacaagaaggcttccgatagcttcccttccgggtaa

SEQ ID NO: 3713 - DNA, 348 bp, A.fumigatus
cctaagggcggatccggccagcctcgtggtgaagactctactctcctcttactttccgctatcttcttcactactggaggactaaaagacgcgaaaatggtggaccagaaggaattgctggctgccttagaagtccaacataagcgagacaatcggcctggtatcaccagaaaggctgtcgctgaaatcaaaagctcagctatctttcaggtgaactgggaagaccttctcaagtcagctccgatttcaatcaacgcgctcggtgcggctcttgtggcctcctcatcggagacagccaccacaatcgagttcacgcccccgaagggcggcttcaagttcttgcagtaa

SEQ ID NO: 3714 - DNA, 390 bp, A.fumigatus
ggatgtcgtcaacggaggcaaaaatgcccaaagagtggagaggcgcctcctccacctcccccagcgccccccaagcccaagagtcctcttccccaatacagcgatgacccggcatacgttcaggtcaagccagccatggtctatctgacagtcctgaatgccctgctgacctcagggaaggacggtggtgtcaactgggagagtgccgttgattcgccagataagccggacaagactgcttcctttacctccaaaatgctgaaggataccctggagagattcgaggagtcggctactgagaaccctcacagtcagaagctcctggaagttctccagaccgctactgaggtaaagctgttccgagacagaaatcatggtcgtctctcgtaa

SEQ ID NO: 3715 - DNA, 1128 bp, A.fumigatus
ccgactcagggcgaaaagaaattggattgtgatggcactcgcctgttggcacagatgaaccaatgcattgcaaatgctcgcgagggacgacagcttgcaggttcgcccgaacggttggacaagagcatcgaggccttcgcggctcgagtgggcccttccatggatgactccggtctcagggcgattgctgcagttggccaacagcggcctcacgtcctgcgcgaatcgggtcatcaaagagtggtgacctggccgcacttcgacgaaggaaacgagtatttaaagcaggacgtgcaggtctcccacctggtcgacaatctcatctccgtagtcagtcagacgtgtttccgctttccacagatggacatccttcagatcggcacattgggaggttctgttcactctgtactgagggagatgggcaggagcttccggtcattcacctatgcagcgccctctcaaccgacagatggacctggccttgagcggcctggcgaggtgcagcacagaaccttcgatgtcgatcgaaatcccctcgagcagggctaccaggatcatgcctatgatatggtccttttcaccaccgcgagattccccctagaggttgcagtggcccatatccgtcgcttgctcaagcctcgaggattcctggtcttaatggtacgaacgaaccctaatatcacgcatttgaatcttttattcggtcatcctgcgagatgcactgagacatgctccggtgagcaagtgatcactaaggagcactggattgagctactgtctacaaacgggttccgggtggagtcgctcgatgcaccccccgagatggcaggccaccagggcttctctctccttctttgccgtgcatcgggcgaatacaaagaaccatcgcctcgcggagacctgctgctggtaggcggtggcgataaaaatgcagactgcgtcatatcagagcttgctgaattggtgcaaggcaaatttgaccaggttcttcgatcgccatccctggatctgatggagatcaccgttcggtctgaactgacggctctaatcctggtcgacgatcaagatctcaccgaagccagcctgagcgccctgcggagactgattacccccacaagccgggcttaa

SEQ ID NO: 3716 - DNA, 246 bp, A.fumigatus
  unsure (84): Identity of nucleotide sequences at the above locations are unknown.
cttcgtcaagtaatctacttatacaccacgccaatgtccgaggacacagctcaggatatctccacactggtctcacaggagctntccaagaccccctacgagtgctcttctctcacccggctcagcggaggaacggccaatttcgtctatcgagtgttctcgctcggccactccaggatgggacgaaaaccattgttattacacacggagaggaatttgttgcttcgaatcgagacttcaagctga

SEQ ID NO: 3717 - DNA, 516 bp, A.fumigatus
ccgaagctgttcgaagagactattttaaaagccttgaatgacttccccgctacaactgatacggacacggacaacaataccagctgcacagtcaagacccctcgtctggttcaattcaaccgtgacactaatactcagatcctcgaagacctgcccggagcgttggacctaaagtcttttatgctccttcccacaaactcgcaaaatgtctcgcgcgaactggccgcgtctattggccgtgcgttggggaaatggttgctctctttccacacttgggcctcagaagagtctcagaaagaactggccaagacgatggagaagaatgaggtcatgcgcgatatcaagttcatggtcaactatgacaatgtcgttaagatggttgatcagtttccaaatttgctcaaagagagccagcatatccttggcgaagtaaagaatgtggcagcggcggagctgggtcggaaagatgggaaggagtttggaataattcacggagacttttggtcaggaaagtaa

SEQ ID NO: 3718 - DNA, 516 bp, A.fumigatus
ttcacggagacttttggtcaggaaagtaagttaatatatctgtttacctggcgtacgttcgatgagattgatgagaccagcgttttgataccaagcaccgcattggatcagcaaaatgatattcctctcttggtaacggactgggaattatgccactgcggttcccgagcgctcgatctgggccagatggtggccgagctctaccagctcaagcattttttgaacatcgatgcaggagtctggctcattgaggggctgcttgatggctacggccccgtggatgaagacatggctttccgcatcgccatccatatcggcgttcacttcatttgctggggcagcaccattcccggctggggtaccaatgaccaagttgaaggagtggtcaagcttggaagagacctcgttgtcaagggctggcagaaggatcgggactggtttggggaaggttggttgaagtgcttgttccctgtggcttacaactggagcgatcagaaagaagacatacgagcatga

SEQ ID NO: 3719 - DNA, 1383 bp, A.fumigatus
  unsure (6),(1261): Identity of nucleotide sequences at the above locations are unknown.
gattcncagccagcaacaagcccgcagtctccaaatcccaaaatcgctctctcgggcagttttctcaatggggtcctctccaagcacgccgtggttgaccattctatcttttctacgcctttccgagggcaggaattcggccatcagcaagaagaaattacgaacgcaggtccgcggtcacgagcaccatctttaggatcatactcctccagttacgtcataaaagctccaacgagtcctttggttcaccaggcaatcaacactgatctggacttctcactgaaaagcgagttcagcgagcatcctccagcttcggatatagccagtcgccgtcgcacactgcctccagagacatttcggaatcttcaggattcctctccgtcttattcacgtgtaataaacatcaacactggtcatgcgcctggaagctttcacgattcattatcgttccaagcgcgtcaatcacgaaaaccattgacctcgtcatacagtcttcaactggcctcatcagtccaacatccgtcctggagagccaggagaccctcacttgccggcgaactatcctgcaagacccatgctccgctggtaggatcttacgaggagtcgatcctccgcggaagaatgtctatgaatccgtccaagccactcgacttcactgcccagattggtgtgctaggcaaaggaaactgcaagtcgagtctcaaatgcccaccacacgtcacggtgcccttccctgcggtcttctacagttaccctacttctggaaaggggcgctccatttcagacgataatcctagcccctacgtgggtctgattgatctcgagaattccttacctaaggataactcttacgtcactcgccgccaccggcatcaccgaagccctgctggtgcatccaagggccaaaggactgatgtcgacgttggaccggaatatcagacccaggaagctctacgcatgagggagaagcgaaatcgacgagccgattcacccaaatgcccaccaggcggatgctatcgtataccgcaacaaggccagctgcaaatcatgataaaaaatccgaacaagacggctgtcaaactcttccttgtgccttacgatcttagcgaaatggagcctggcaccaaaactttcatacgccaaagaagctactcggcgggccccataattgatatgcctttgtccgccaggaagaacttggggactgatcgaccggaggcttccttgagcgtatccgaaaatcccaaagacaagcctgtantacgctatttgatccacttgaacatttgttgtccttcaaagggtcgtttttatctctactcgagtattcgtgtcgtttttgcaaatcgggtgcctgacggcaaagagaagttgcgatcttaa

SEQ ID NO: 3720 - DNA, 345 bp, A.fumigatus
gagcgcgtgtccttccagcccccgtggttgaagacggcgtatctcaacggaatcttatacctgatggtagctacgttcccggatgtctggacgacgatctatcatgaatccgaatcgattggatcgctgaactatctttctctcacagttggaatgactatcgcaatgcagctggggactcggatcgccggccgcgtttaccaacgactgtgtgctaataatggaggggtggctaggcctgaatttcgcttgcccattctttgtgcaggagcatgcattgtccccatcggactcttctggtacggttggagtgcccggcagagcattcactggatcatgccgtaa

SEQ ID NO: 3721 - DNA, 204 bp, A.fumigatus
cggttgattcccttctccgatcgaagtaatagtcgcgatggaatggccaagtatattgggctacttttccaggccaatgtggctggttacgtggctttcttttctataaatacggtcattaacttgcttacttgttctatgacctacgttgtctgcggcaagaaaaacacagcatgtcccgttttcccagcggaacttgattaa

SEQ ID NO: 3722 - DNA, 969 bp, A.fumigatus
  unsure (25),(31),(46): Identity of nucleotide sequences at the above locations are unknown.
caggaaccacccaccagccgagacngtcaangccaaaccccacagntcggcctcaggctcccacgcctactctctctttttggcttccgcgtttgttgttcgcttcccccactggattcaacatccaggctcgtcaacgcggttatctcatgtcctggatccaatggtgcaccatcagagggacgccaatttctggccatgtcgatccccttatcatcagcagcaaccccgcgtggcactcgcagtctgaacgttcccgcaacgcagaacaccgcgcccgtcatcaaatttcgatgcctcttcactcatgatgtccgacgcaaagcgaagcgctggcacgatgggttcctccgctatcatacattcaataagcgggtcatggtctacgataccaccggctattttatcggagatttgcattggcgacaggacgacgggattcaggacggagacgagctggagctggacaaaggcgtgctgatccaagtttgtgagccggtggagcagacacagacagacctgtcgacgctgtacaacaataagaagaaggcgcaggattcaccgacccaagcagcggaaccgtcagctcccacacttcgtgcctctgctccggtccggtcctcgatatcctcccaacagccgcggtccctcaatgatctcctaggcattcgaaaaacacatgctggcttgtctgtttcgccctacgaggaacgtcaacgacagaaacagaaggaagacaatcggctagcgtctgagagagcggcaaagcgtcaaaagaccaccccggctcatgtaccgactgagcaacaaccaagacgctcggtcgccaatcccccggtgctcatcgatttgtctgattcaccagatgagaacgcgccagaaagacgacagaagccgaacaaactcccagaaaacgtctctctgcagaagaagaacccagggtcaaatggcctgtgtacttcgccacgg

SEQ ID NO: 3723 - DNA, 267 bp, A.fumigatus
  unsure (97): Identity of nucleotide sequences at the above locations are unknown.
ctggtaagccgccgatgggtggttctagagtggccgaagctgaccgaggctgatagctactccaagggtctggactcttctcctgctcctgacgaanccgttactatccagctcaatcgtgctctcacatttctcaagactcatcaatttgacgcagccctccacgatctcgagacagtcttggcagactccaatccctccgaaaaaacgcttttccgcaaagcccaagctctctaccatctgcagagatttcctgaatccgggtga

SEQ ID NO: 3724 - DNA, 447 bp, A.fumigatus
cttttagcagacaaaccaagatcgctgatggcaaggcttcaatacattaaatcaagcatcgttatcagttacctgcgttccgtcaacctgagcgtacatgctccttccaacagcatgtcctgtccatacgacaaacccatagttgacatcacccagtatgtattccactaccagatcgacgaccaaaaggcctggtcagctgcacgcgtggccctgctagacgccatgggatgcgccatcgaaaccctctccacgagcgaagagtgccagaaactactgggcccgactgtgccaggtacagaggtcccgaatggcttccgactaccgggaacgaatctcagtctggacccggtcaagggcgcattcgacatgggcactttgatccgatacctggatcataatgatgcgctaagcggcgcagaatggggacatccctctggtagctag

SEQ ID NO: 3725 - DNA, 603 bp, A.fumigatus
  unsure (336),(377),(481),(552),(585): Identity of nucleotide sequences at the above locations are unknown.
gcggcgcagaatggggacatccctctggtagctagactcttccttcatatcggagtgagtagcactgacgacagggggaaagataacctaggcgccatcctcgcagtcgcagactggctatgtcgcgcctccgcatcagggagatacaagcataccgggcccccactcacgatgcgcacgttgctcaccgcgctcataaaagcatacgagatccaaggctgctaccagatcaggaacgccttcaacgccttcggcatcgatcacgtcatccttgtcaagctggcctcggccgccgtggtcgcctggctcctcggcctaacagaggaaaagacgcangcgacactctcgcatgtctggatggacggccattcgagcanggtttaccggacgggcgcgaacacgatcccgcggaaaggttgggcggctggagatgcatgtatgcgcgccgtgcatctggctctgcttgtgcgtgctggacaanctggagcaccgacgccgctgagttcgttgccctttgggttctatgcccggactttggggcgaatgggttcnaaatgcaacggccgttcggggtgggaccatcanaataccttggtcaattga

SEQ ID NO: 3726 - DNA, 1026 bp, A.fumigatus
  unsure (796),(959): Identity of nucleotide sequences at the above locations are unknown.
gggtcctccattgcttcatctccgagtcgtcggccgcgggacgagcataactcctcaaactcttctcgctccgtgacaccgggttcagattcgccgtcacccgcgctgccgaggcagccgtctgcaagatcaatgaggcggcggctgattcggctcaagaggaaacatgagaaagtgttacagaagtattattccaccggcacatcgtattccgaaccgatatcatcgcttgtgtattctctcgcatccgaacttggtcgggaagataacgacctcctgtggttggccattgtcggcgtctctagcttggaactcagtggtcgtacaatgtccggtgttggcatctccaatccatcagagtccggagggtctgctggctggggtggagagcggggagagcgcattcgtcaaatactacgagacgaagtccatcgattgaacccgcccgacccgtacgagcgagaccgagatatcagaggagagatcaacggcgtgatccccacaaccgccaaatcgccaacagataagtccattcgattatctccagaaccccgtttcattctaatccgccactggtcactctacgaaagcatgctacatagtccctatctggcatcacgactacatgtttggaccgagaatggtcgcaagcgattgcacaagctccttgcgaagatgggaatcagcttgagccagtgccatcagaactacactcacatggatatggaactgaagcgagtgctgcggcaacggcttctcaagtatgcacctatgtacggcctgaaaggactcgtcncgcccgacgcatctggtcatgtctccttccgcgaggggtggggcttctggcgctgctggggctggaaagcctgtctttccgcaacggacgtgggcgtcattataggcgcgatcctcgaggttgggccaaaaagaaaccccccgcgccaacctgggactcaatnacgtctgtctcggcccacggggccctacccaaggggaacggcccctgatggctccccccgattctga

SEQ ID NO: 3727 - DNA, 957 bp, A.fumigatus
cccaatcaaaagccacaatctgcaacgatattcaaggacatgggaccaccaagatcaggtgcttcaaagaaacccacatcatcaaagaatgcaccaggtcgcgatagccgaaaagaaaagaaacggccgcagcagagcaaacaggaaacagcaacgccgcgacatgaccaaactggtcaggatgggaagcagatcgatctctgcgccaccatcccgctgactctccagcaactgctgctgaacgtattcaagacagctttgcttacaagtgatgggccgcatgactatggctatgaccatgagtgtcaaagtgaacatagaacacaaacgcctagggcagacaccgacagcgaacctgaagctcggacggccgcccccgcgggcaaagatgaaatagatatcaagtctgtggtccagaccatcaagtcccattcgtataatcgggattttgaatcggcgtatgctgatgccaatgaggacttcttgcgcgcttatgcgctgcgatggagtgcgtcccgcgcgctggggtacgcggggatcttcaagtctgtgttgcggatgttgttagatggaggtgatggagctcaggtccaggtgaaggcgaaggagaagcagatgcaccatatcgtctgtattggcggcggagccggcgcagagatcatggcgctggcgactgcctggagggatatgatggacgagaacgcgctctcggatagagttggtacggttacgttggaggacgaaagcggtggccagagtcagaatcaaaaccaagatacagcggtagctgtgacctcgtttccgcggccagggatgactgttacggctgtggatatcgccgactggtcaagtgtcgtggaccggttggcgcggacaatccggtctcccgctgttccggcacggactctcatcttgcccattgtgactcagcccgaggcagaaaagacgcccagaaag

SEQ ID NO: 3728 - DNA, 213 bp, A.fumigatus
catagtcacctgagagtgactggtggtgaggtcggagcccagtccgctctggctcccaagattggtcctctcggtctgtcccccaagaagattggtgaagatattgccaagagcactggtgactgggtaagaactcaaaaggagtcaaaagatgaagagtaccggatcgctaatatgatttttgtgcgaccttatagaagggtctccgtgtga

SEQ ID NO: 3729 - DNA, 252 bp, A.fumigatus
gaattgatcgatgatcgtgtcccaatgcctcgattcatcgtttgtgacgccggcggatctcaagcgcgtttcctcttgtccaagttgaacccctctactacacatacgacaggaggttacggtggaggcgtgacgtcgcagactatcttcactgatgatgtctcgttgcagacgttcatggaccatttgatgaagtatgttatccgtaaatgttttacaaatgtcatgaatgaggctaacccaccaatctag

SEQ ID NO: 3730 - DNA, 378 bp, A.fumigatus
aagggtctccgtgtgactgtcaagctcaccatccagaaccgtcaggccacggtctctgtcgtgccttccgcttcctctctggtcattaaggccctcaaggagcctcctcgtgaccgcaagaaggagaagaacatcaagcacaacaagtccattcccttcgatgagatcgttgagattgctcgcaagatgcgtcaccgctctctcgccaaggagctccgtggcaccgtccttgagatcctcggtactgctttctccgtcggttgccaggtcgatggccgcagccctaaggatgtctctgacgacatcaaggctggtgagatcgatggtaagtcctgttgtcttcacccacggggatgggccggatccgcgcttaagtat

SEQ ID NO: 3731 - DNA, 729 bp, A.fumigatus
  unsure (36): Identity of nucleotide sequences at the above locations are unknown.
acattgcgcggttccttccggctcctgggcgagaanaggactgcgcgggcggtacatcatgcccggcaaggcaacctgcccaccgccctatccatcttcacatcggtgcttaaagctcgccgttccctccccccacctccgcctgacgccaaaccctttgtcctcccatccatccccaaatcaactcgagaccccttcgtctcactctacaactctattaaaaccatgttggtccccgccgaataccccccccccctcccatcgggcgacgaacctccgctccgcactaccgcctccgcctgcgaagaggcaggcctcatgacatacatcggcgagatcatctacgcgtcctcctccagggaaaccggtctcgcctggacgcgtgacgcagtcgacctggccgaatccaccatccttgagctcggtggcttcgaagaccataacccccaacaccgctgcgccgagtgtctccgcgtgggtctggagaattggaagacaatggtctcccagctggttgcgcaggcggaaagagaggaacgcgagagcatcgagaaagccaagcattcctggttcggaggcgagaagcagatggaagctaaagcccttgagcgaaagcgatgggaggccgagcggttgattctcgacgataggatcaagaaactctggcctatcatcgacggggggtcgggtttggagggtatcgcgcccaatagttctctgtttatttga

SEQ ID NO: 3732 - DNA, 315 bp, A.fumigatus
catacatcggcgagatcatctacgcgtcctcctccagggaaaccggtctcgcctggacgcgtgacgcagtcgacctggccgaatccaccatccttgagctcggtggcttcgaagaccataacccccaacaccgctgcgccgagtgtctccgcgtgggtctggagaattggaagacaatggtctcccagctggttgcgcaggcggaaagagaggaacgcgagagcatcgagaaagccaagcattcctggttcggaggcgagaagcagatggaagctaaagcccttgagcgaaagcgatgggaggccgagcggttga

SEQ ID NO: 3733 - DNA, 1074 bp, A.fumigatus
catggtttttttgttgaaatgttgttcgtttccattactgctgcattactgctagctgtgcttgacaccctgccagcaggaatgcaagcccaggatgccgagggctggtacaaggcccatccgggcatggcgcgtatcagccaggtgaaccaagatacgcatcaaattgtcgatgaattcggccgtacgcggttcttccacggaaccaatgtcgtgatgaaggagccaccgtggtatcggccgttcgagtgggcgcctggtgtctcatcgtttggcgagcaagatgtccagaatctgcacgccttaggtctgaacattgtgcggttaggccacagctgggccggcgcagaacctgtgcgtgggcagtacaaccagacatttctagatatcatgaagaagcagaccaagttggctgaggactacggcctctatgttttggtggacgtgcatcaagacgtcctggcgcggcagttttgtggccacggcgtacctgatgtaagtagaatgcgtggccctgttggcaccgctgcgactgacatggctgtgcagtggtttgtgaaggaggactgggtaccgggctggaagatgtacccctttcctctcaagccaacaccgttccccgtggataataaggggttcccctcgccgcagtcgctttgtggcaccgtcgactggtctctgagctacacatcggcggcagtgtgtaatgcatttgggcgattgtacaacaactacgacgggctgggcgatgcgttcgcggcgtactggaaaaagctggcgtctgagtatgtcgagacgaccaacgtggtcgggtataacctgctgaatgagccgtgggtgggcgactcgatggccgacccgaccctgctggtgccaggggttgccgaccacaaggtcctcgaaggcctctggaaccgcgccgcaaagcagatccgtaccgtcgacaatgacacgctcctctggttcgaaagtgccaccattgaactctggtccgggttcaacaatgtccctcctgggaaacggctcgacttcagtccactcattccccctactacagccccaccgcagctgtcg

SEQ ID NO: 3734 - DNA, 255 bp, A.fumigatus
  unsure (41): Identity of nucleotide sequences at the above locations are unknown.
gcgcggtacctgccagctcggcggttgaagaccagcagccncgaagcccaggttcacaacaacgacttcatcggcgccgcctcgtataacatcttcgtcggagtttccgttgcgaccatcttcggcgccgcgtttttcttcgacctgttctggccggaaagacacgagagtaaatctgttcggctggcgtggaagatatctggggtggtggtatccgtgatgatgctcgcgtcggctctgaccatgaccgtatga

SEQ ID NO: 3735 - DNA, 561 bp, A.fumigatus
ttgcctacaagagccacgacacatacggacttggttctccgagctcgagagatgggcatcgaatccaaagttatcccgaacgcgtcaatcatgtccggcattggctgcaccggtctgcaactctacaatttcggacaaactgtgagcatggtgttcttcacggagaactggaagccgacctcttactacgaccgggtcaaagaaaacgttcagttgggtctccacacattagtcctcttggatatcaaggtcaaggagcaatcgtatgagaacatggctagaggacggaggatatttgaacctccaaggtacatgaccgttgcccaatgtgcgagccaaatgctggaaaccgaggaagaacgaaaggaaggtgtctttggacccgacagccttgcggttggagctgctagagtcggcggtcctgaccagaaactgggtgtgggcactcttcaagaactgtcagaggtggacatgggacccgcttgcacagcttggggttgcttggaagaaaagcacatgatctggagccgatttatttcaaaaaaatttgctgggggataa

SEQ ID NO: 3736 - DNA, 231 bp, A.fumigatus
cagttcttgaagagtgcccacacccagtttctggtcaggaccgccgactctagcagctccaaccgcaaggctgtcgggtccaaagacaccttcctttcgttcttcctcggtttccagcatttggctcgcacattgggcaacggtcatgtaccttggaggttcaaatatcctccgtcctctagccatgttctcatacgattgctccttgaccttgatatccaagaggactaa

SEQ ID NO: 3737 - DNA, 444 bp, A.fumigatus
caggcacctggacatcgtcgctgcagctcaccaagaacggatcccgccacgggcacggtgatctggaaggccgggccccttgtgcccaacgcgcccaaacactacggtctgacggcattcgcggcaactctgaacgagatcacgcccatcgaggagaagcgactgccggtgacggactcgcggctgcggccggatcagcgggcgctggaggacggggatgtggaccgtgcggagcaagtcaaggtgcagctggaggaagcgcaacgggcgcggcggcgcgagatggaggcggcgggcgagagctggacgccgcgctggttcaagcgggtggatgcggatgaagatgcggaggatgtctgggccctgaagccgggcaaggatggctactgggaggaacgggcccggggaacctggacaggtgtggtgcccgtattcgaggcgtag

SEQ ID NO: 3738 - DNA, 489 bp, A.fumigatus
  unsure (68): Identity of nucleotide sequences at the above locations are unknown.
ccggtcggtaaaatgccagtgctgaacgagacgacgggccagaagagcgtttcgaccttcaaggccgncggcatgttctcgggccgcagcgaggaggtcatcactaaggcagtcgatccgtacaacaacgagctgccgctagggctgacaggcacctggacatcgtcgctgcagctcaccaagaacggatcccgccacgggcacggtgatctggaaggccgggccccttgtgcccaacgcgcccaaacactacggtctgacggcattcgcggcaactctgaacgagatcacgcccatcgaggagaagcgactgccggtgacggactcgcggctgcggccggatcagcgggcgctggaggacggggatgtggaccgtgcggagcaagtcaaggtgcagctggaggaagcgcaacgggcgcggcggcgcgagatggaggcggcgggcgagagctggacgccgcgctggttcaagcgggtggatgcggatga

SEQ ID NO: 3739 - DNA, 360 bp, A.fumigatus
ctgtacggtcaggtggatatcatgatcgctgggcagttcctgcatctcttctcttgggagggccaaaaacaggctggcaagcgcattgtggccctgtccaagcgtggaacggtcttgattggatatcagcagtcacggcgccgagcccgggagtatatgcgtccatggggaatgatgttctaccacaaccgagatagttttctgcagatgtggcgggaaatttcacttgagactagcacggactggaaggtggaagccaccgaggtcgatttggcggaatgggggatggaggccgaggacactgaatggatgccagcagatcgccaagggctcaactttgttctcacccgagtgcattag

SEQ ID NO: 3740 - DNA, 501 bp, A.fumigatus
aagaaaaaaaaatcctcgctaaaccccgcccacagcaagctctacgaagctaccacctccgacgaagaccatgtcaagctgtccgtctactcccccccggacctgcagcgtcctacgttcgaggaggcgacatcgcacgagttcacgcccacgcatatcggcgcctcgttcggccctagttggtcgacgcactggttccggattcggctgacggtcccgcgcgatatgctcgacaaagaacgattggagttccattgggatgcaaataatgaaggcttggtgtggacggatgatggtcggccggtgcaggggttgactggtggcggggagcggatccagtgggttattcctgatgcgtggcgcgatggcaaggagcatacgttttacattgagatggcgtgcaatgccatgtttgggaatgcgcctggcggcgactcaattcagccgcctgcgccggataagtactatacgctccatacggcgcgcattaatgccgtcaac

SEQ ID NO: 3741 - DNA, 456 bp, A.fumigatus
  unsure (215): Identity of nucleotide sequences at the above locations are unknown.
gagatctcagatgatctcatggaatgctggagcacactcgtgacgcaaccaaagccatcagctctccaacaagcccagcaactggcctatgtcaaatacacagccccagtcccagatgcagatgcagatgcagatgggactccttcaggagaacacagggccaaccgcacgatcatcacctgcgagtcacgcggtctgatcctctccgcaggaantacaggcttccgcacctgggaagcggccctgcatctgggttcattcctctccacgcccgccgggcaggctctcgtgcgcgggaagcgggtcatcgagctcggcgccggcacgggcttcttatccatgttctgcgcgaaatatctcggcgtgcagagcatggtcgcgacggaccgcgagctgggcctcatccagaatatccgcgactgcagtcttcaccacggggctggaaggacacgcgct

SEQ ID NO: 3742 - DNA, 369 bp, A.fumigatus
cccgaccggcccaaacatttgtattattacataatagttcaagcatttgcacaatggaggaaatcggttgaaggcaatatgtcccttggattgtcttctgttgaggatgacagtgacggtcagaatgataattacgtctccttcgacaaactggtcgcgcaatacttccagcaggttgaaccccacctgctagaattccccgatggcaggaccatgatcaaatctgccgctcaatcagccctctaccaacgcatgttcaacgaggcggccctgtggccgattcctcccctgaactaccgggctcgtgttctaaagaatatcttgtctatactggaagagtcaatttcggaccctgaagaggatgtatga

SEQ ID NO: 3743 - DNA, 345 bp, A.fumigatus
cgtaacaaacagaatcagccttttatatacacctttcttttcgaccctcaagcgccgtcgctgaacgatgtctccttttacaaaagcattcatcgccaactcgctccgctccagagaccattgagcaaatccacatcacctgcaaatgctgcagaacgcatttctatgtcggaaaatgcgattgacttcaacaaacgcttttcaaccaagaacctcccggtctacgatctcatttacgaccccacaaatctgaccatccgatcttctattccgaacattccggacctcggatactactctctggagaactcgccattgtcccgcgtcgagagtctcaacaattaa

SEQ ID NO: 3744 - DNA, 270 bp, A.fumigatus
ccaatcatcatggaactggaacgcagtgaaaatgtcattatcgtcactcatcaggctgttttgcgttgcatctatgcgtacttccttaatattcctcaggagcagagtccgtggatggaggttcctcttcatactttgatcaagctcacacctcgtgcgtacggcaccgaagaacagcgcttcaaagctgacatacccgctgtttccacgtggcgtgcaaagggcacctcagcgaagcatcaggaattccccaccgaagtaaagcattga

SEQ ID NO: 3745 - DNA, 1011 bp, A.fumigatus
ctaatccttattgctcacaggttcgttgactgccctgggcacgatattctcatgagtaccatgttgtcaggtgccgccgtcatggacgccgcccttttgctgattgccggaaacgaagcttgcccccagcctcagacttcggagcacttagcagctattgaaatcatgaagctcagccatatcatcattctgcagaacaaggttgatctgatgagagaagacggtgctctgcaacattaccaatcaatcctgaagttcattcgtggtactgttgccgatggctctcctattattcccatctctgctcagctcaagtacaacatcgacgctgtcaacgaataccttgtctcgcacatcccagttcccgtccgtgacttcactgcttcgcctcacatgattgtcattcgttccttcgacgtcaacaaacccggtgcggagatcgatgagttgaagggtggtgttgcaggtggctctatcctcactggtgtgctgaagctgaacgacgagattgaaattcgccccggtctcgttaccaaggatgagaacggaaagattcagtgccgccccatcttctcccgtgtcgtctcgctcttcgctgagcacaacgatctgaagttcgctgtccctggtggtctaatcggtgtcggaacccgtgtcgaccctaccctgtgccgtgccgatcgtcttgttggtttcgtcctgggtcaccgtggccgtttgccagccatctacactgaactggaggtcaactacttcctcctgcgtcgtctgctcggtgtcaagaccgccgacggcaagcaggccaaggtcgccaagctcaccaagaacgaagtcctcatggttaacatcggctctacggctactggtgctaaggttatgggtgtgaaggctgatgctgccaagctcagcttgaccagcccggcttgtacagagattggagagaagattgctatcagccggagaattgacaagcattggcgtctgatcggctgggccaatattgtcgcgtaa

SEQ ID NO: 3746 - DNA, 192 bp, A.fumigatus
caaattatgtggccgttgataaactattactggttgctacttgctacataccaggaacattcgccacaatacccaagaaagtctaacggtctggagattatacaatttcgtgataatcttcctctgatacttggaatactctcgcgatactatctggcgagtgttaagcctgctcaaacactgaccggttga

SEQ ID NO: 3747 - DNA, 216 bp, A.fumigatus
tcgtctgaagttcaggccctgtggtggatgtctctcacactcctttgtatggatgactccatcgaggctgtggctgggacttctgactttgacctgctttctgcatttaagtttctttcaacccctccactgaaagcatatttttcaagagcaacagcaaatgaagttgacagacttagaaggcttgcatggtgtgtatacaggaaaaatacgtga

SEQ ID NO: 3748 - DNA, 183 bp, A.fumigatus
cagtggttagcttcatcatcaccagtcactttcgtctactaccatcccctagatgactacgaatttgcccagaagcttaactattctgtcttgagagattatacatatctcgtaacagtatcacgagtgtggtatatagactatattaacagaatatctctcctagacagaaatcagacgcag

SEQ ID NO: 3749 - DNA, 555 bp, A.fumigatus
catgcgctgatctcggccccggcggtgaagactctgtacacgaacgagtcgacgagtggcgacacccatattccttctcttgaaatcagctatgccagtctcgccgccgtggaaaatttctttctgtcctcatcaatagtgaccgagtgggttgtagggaactttatcaacgccgacttcggtgtcgccgctgctctatcgggcgacgtggaccttagcaaccggtttgacagaatggcgactgccatgacggattatctgcggtatggtccgaatacccagtctgcacagggagagatatatcagaccgagccatttgtattcatccgctggggctacttcgttgttccgattattactgaggggcttgcgattttgttcgccatctcgactatttacaacaatcgccggagccgtcgcgttcccctgtggaagtcttcaaccctcgctgtattggcctgtcagcatgaggcgggccttggacttctacagaccagcagcaaggatattaacgagatccaacatgaagcaaataaggctgaggcacggctgtaa

SEQ ID NO: 3750 - DNA, 777 bp, A.fumigatus
agacttatattaggtttctttttcttcttcctggctgcctacatcatctgcagcgagctagtccgtgcaaaaccctccaaaggggaaatcttggtttttcctcgagggaagataccggcatttgtcaagaagtcgcggcgcgacggcgatctggaaggagctccgaccttcgagaagcagcagcttgataatgcgggtcatgacagcaccgcggcaatcgtcaagcaaacctcgatcttccactggcaagatgtatgctacgacatcaaagtcaaaggagagacacgccgaatcctggatcatatcgatggatgggtcaagccaggaacgctaacagcattgatgggtgtgactggggctggtaaaacatcgctgttggacgtcctggctaatcgtgttaccatgggtgtgatcacgggcgagatgctagttgacggtcgcatgagagatgactcctttcaacggaaaactggttatgttcaacagcaggacctgcacttggaaacaagtaccgtccgcgaggctcttatcttcagcgctacgctccggcagccagcgagcacaccgcacaaggagaagctagcctatgttgaggaagtaatcaagatgctgaacatggaagagtacgcggaggcggttgttggagttcttggtgaaggcctccatgtcgagcagagaaagcggttgacgattggtgttgagcttgccgccaacccggcgctgctctgcttcttcgacgagcccacttctgggtctgatagccgaacacctggttca

SEQ ID NO: 3751 - DNA, 1050 bp, A.fumigatus
tgtctctccctagatgttgaatctacaactcctgaaggatcgcctgcacctaattacattccactgggaggttcgcagcagcagcagcaggcgaatggcgcatcctcgacgactcccgctcaagcagcgcctgacacttccagtatcttgaaagctctggcagatatggcaaaacagaacacaacgacgccagccgctccagcgacgactaatccactaaatgcattgaacatgcagggtacagtttcacagcccgtgacctcgtccgtagaccaggcttcacaggttcaagctggacaatctggtgtaaatccttatgccgctggcactatggcgacgccgttcgcggctctgaataatcttgctcagaatccggcattaatcccgtctcaaagccagagtcagactcctccaaacccactcgctgccgcggccaaccccctggctgcactgctgccgcaggcgacctcagccgcagctcagccaactcctagtatagcgccggatgctctacagcagcagctccagcttttgcaacttttagccgcacagggaattccgcaggagcagtgggccactgccctgcagattctcagcttgtctaatgctacaaacatggccaatgtgaatcctgggcaggcagttggcttcaacctaccgggtcaagcagctgctgcctggggtagccgtccagattcacagtcacgtgattttgatcgaggcgatcgtgaacgagatcgcgactacatgcgctctcctccaggccagtatcgtcgcagatctcggtcgcctgggtgggaccgacgtcgtgatgtgtcgcctcctcgccgccgtgatagccctgtttatggagagtatcatggtgattctcttggtcgtcggggagacatgcgtggtcgacgaggcaatgattaccgtcagcgcagcccgcccgggcgtagacggcgttctcctaccccccctcgaaaggacccgacactgcctcctccaggccctaagtttatcgagtgggattattctatcggacaaggaaacatcaaaggtttgtag

SEQ ID NO: 3752 - DNA, 303 bp, A.fumigatus
gagaacgccgtctacgcccgggcgggctgcgctgacggtaatcattgcctcgtcgaccacgcatgtctccccgacgaccaagagaatcaccatgatactctccataaacagggctatcacggcggcgaggaggcgacacatcacgacgtcggtcccacccaggcgaccgagatctgcgacgatactggcctggaggagagcgcatgtagtcgcgatctcgttcacgatcgcctcgatcaaaatcacgtgactgtgaatctggacggctaccccaggcagcagctgcttgacccggtaggttga

SEQ ID NO: 3753 - DNA, 252 bp, A.fumigatus
ttatttgctaacacccaccagctagaggagcagatgcaactttccatccaaaacagctacgaccgtgcaggaaacgtcattcgtaacgctgacgctgagattgctcgtactcgttccatactcgcctcgattgatgacttggagaatgagctcgccaaaataggacatatcagagaaattgtgaaagcttatcgtggcaggatagagagtcttgaccaacgtattgaccaagctgcccgccgaagacactga

SEQ ID NO: 3754 - DNA, 213 bp, A.fumigatus
agagtcttgaccaacgtattgaccaagctgcccgccgaagacactgacgccgcatatactaccatctcattctcacaccgcatatcagcatctatactggtcgcccacacatactctaactcttacgaattatacgaaactaacgacatgaaatctttcgccccggaggctgtcgcatatcagttgccagactaccgattgactgacgaatga

SEQ ID NO: 3755 - DNA, 264 bp, A.fumigatus
ctgatcaacactaactgtggtgtccgtggatttctcggaactaatttgaattcttacaggtttccacgttcttcgcttcatcagcgcgaccctcgcgcctcttctctcttcgattcctacggcggtggttctcgaccggccagccgctcaccggccagcgtgggcggatatagttatgggggctactctgcctcgaatgccgatgggtacatgaacgggggctccacaggtggtttccgaaaggcaacccctaatgcgaagtga

SEQ ID NO: 3756 - DNA, 216 bp, A.fumigatus
tactaccggcagctcacgctcgccattggcgatgaaattcgagatacatctaccatctcagagctcaacgatgcattcgacaacactcgcgtgcgacttcgtggtaacatgactcgcatgctccgcatggccgagcgtacgggcgttggctggcgtgcatggctgggtttcttcctggctgttttcctgatcttcgcatacgtgtggctgacttag

SEQ ID NO: 3757 - DNA, 276 bp, A.fumigatus
gcactcccctctcacatacctgatgtcacgcaggtgactaactccagtatagagggcatgggggtgaccgtcgactcggatggttcctacccctactccacctacgagggtagcgactttgccaagaaccttgccgctcctgacatcgatttcggagtattccacctgtataccgaggactgtgagtattgttccaccctcgtcgtcactggactgtcaattgacgcatcgtaccagggggcatcaaagacaacagctggggcaacggctgggtga

SEQ ID NO: 3758 - DNA, 528 bp, A.fumigatus
agacataacctgcagaaagccggcttgaagatcctgcgaacttggggttttaatgatgtgaattccaaaccgagctctggcaccgtctatttccagcttcatgatccatcaactggcaccacgaccatcaacactggcgcagacggtctccaacggcttgactacgtggtatctgcggcggagaagcgcggaatcaagttacttatcccattggtcaataactgggacgactacggcggcatgaatgcgtacgtcaaggcgtatggcggcagcaagacagaatggtataccaactccaagatccagagcgtgtatcaggcatatattaaggcggtagtttcgcgctaccgggactctcctgctatcatggcttgggagttgtcaaatgaagctcgttgccaagggtgcagtactgatgttatttacaactggaccgccaaaaccagcgcatacatcaagtctcttgatccaaatcacatggttgccacaggcgatggtacgctaagcactcccctctcacatacctga

SEQ ID NO: 3759 - DNA, 303 bp, A.fumigatus
cgcatcgtaccagggggcatcaaagacaacagctggggcaacggctgggtgacatcccacgctaaggtttgtaaggctgccggaaagccatgcctgttcgaggagtatggccttaaggatgaccattgctcggcctcgctcacctggcaaaagacctctgtgtcttctggaatggctgccgatttgttctggcagtacggacagacgctgtcgaccggcccatcacccaatgatcacttcaccatttactacggcaccagtgactggcaatgtggtgtagctgatcatctcagcacactttag

SEQ ID NO: 3760 - DNA, 273 bp, A.fumigatus
caatatcaacctttcttttcactatctgcagcacggataggaacaccagccatgaaaaaagctggaggggcgtcgctctgcaccttcccctcatcttgcccgcagcacgccaccgccgcacaacagctcatcatgcatcataacgccatgaccgtccaggatccctctctcctgatttgcacccttcctggaaaatgggtcctcttcacactacttcgtactactgcaaaagcagtgatgcttctccactgcttagtttcattcttgtcttga

SEQ ID NO: 3761 - DNA, 1158 bp, A.fumigatus
  unsure (32),(33),(42),(45): Identity of nucleotide sequences at the above locations are unknown.
ccacaggtatcgtttcgcttcgtgcactatannattgatggnccngggaccggagtggccactttggttgcctgcgctcaggccggcgctgacgccgtcgaccccgccaccgacagcatgtccggtatgacgtctcagcccagcgttggtgctatccttgcttctctcgagggcaccgagcacgaccccaagctcaatctggcccacgttcgtgccattgactcctattggcagcagctgcgcttgctgtactcgccgttcgaggctggtctgaccggccctgaccctgaggtctacgagcacgaaattcccggtggtcagctgaccaacctcctcttccaggccagtcagctcggcctgggtcagcagtgggccgagaccaacaaggcatatgagtcggccaacgacctgctcggcgacattgtcaacgtcacccccacctccaaggttgtcggtgacttggctcagttcatggtctccaacaagctgactcccgaggacgttgtcgcccgtgctggcgagctggacttccccggctctgtccttgaattcctcgagggtctcatgggccagcccttcggtggcttccccgagcctctgcgatccaaggctctgcgtggccgccgcaagctcgacaagcgccccggtctctacctggagcctctggacctggccaagatcaagaaccagattcgggagaagtatggctccgccactgagtacgacgtggccagttacgccatgtaccccaaggtctttgaggactacaagaagttcgtgcagaagtttggtgatctctccatcctgcctacccgctacttcctggccaagcccgagatcggcgaggaattccacgtagagctggagcagggtaaggtcctgatcctcaagttgctggctatcggccccctgtccgagcagaccggtcagcgtgaggtcttctacgaggtcaatggtgaggtccgtcaggtcaccgtcgacgacaacaaggcctctgtcgataacaccgcccgccccaaggccgacattggcgacagcagccaaatcggtgctcctatgagcggtgtcgtcgttgaaatccgtgtccacgaaggctcggaggtcaagaagggtgaccccgttgccgttctgagcgccatgcagatggtgcagtttcgt

SEQ ID NO: 3762 - DNA, 345 bp, A.fumigatus
  unsure (14),(29),(34): Identity of nucleotide sequences at the above locations are unknown.
tcgttcccccggcnggataacctgacctntattntcagcacccccagtggcgaagactacaccttcccctttgaccgtctgggtggtcgcatcccgaccctgctgatctccccctgggttgccaaggcacaggtcgagcagaagggtaagaatgctcacggcgagactgtgtcctactcggctgcatcgattctgcggactctgggctacctctgggactttgagccctttacccctcgcgtcgagcatgcggcgtcatttgagcacttgattcgtctccatgctcggaaggacactcccactgcgctcccttctgcagtgcctttcaggaatagaaacgtgtag

SEQ ID NO: 3763 - DNA, 900 bp, A.fumigatus
tatttgtgtattgaaatgcatgtgttgaagagatcatgttgcggggattgtgtttgcggagattctagggctaagcaggggctaactgaacccgttccagtgtttatccaaccacaatccctcaccgccagccagagctcagatctcctatcagctcaaatctcctgcccatccctttctccctcaccctctccagactcggcaactttcatctctcatcctcagtcgattctctcagctgagccctctggatcagacttctgcgaccctcgacagctcacagtcgaatcgtcagttggagctcctgcagagttaccgccattgcctactctttcctgcaatgaggaggaacctaaggttgttttgggtagcgcaactgtgacattgccggtccacgagggcctatcgccatcattctcgagctcctccgaagatcctctcggttcattgcccacttttgacagtttctctgaccttgattcggaggacgagtttgccaacaagctcgttgacttccaccctattggaaacacctacttccagggagataaacggcaacgtctaggcacgtacctccttgatgaggacgagttcttgagtgaacgcagcttggaagatctggacgatcaagaggcctttgcccaatccggtcttccctccgtggagtcctctgactttctcgcagtcgggggtgatgctacacagagcactgaggaaatgagctcgaagaagagagtcacttctcgcaggtcgcttaagaaggcgagcacgtcggagagcagctcggacagccttgccaaagaagactcgggcttccgccaccagccggtctggtcactccgacacgacttccaccgtccagcattcgactgcttcttcgcgtcagaactcgaccgccca

SEQ ID NO: 3764 - DNA, 696 bp, A.fumigatus
ctaacatctgttcaaagtcagacacagcaacccataacaatggacgcaacatacaccatggcacagaccccagtgcagggacagccatcatttgcatactacccaacagagtcgcaatcgcggcagcaacatttcaccagtcacccgtccgagatgcagtactatggacaagtgtcgtcttacccacagcaacaagctcagcaacagcacagcatgcaagaacaacagccagtctatgctgctcaacctatgttgaacatgcatcagatggccacaaccaatgccttcaggggtgccctcagcatgaccccgattgcctccccacagccgacccatctcaagcctaccatcatcgtacagcaggactccccagctctcatgcctctggacacgagattcgtcagcaatgacttctatgggttcccttcgaccccaccgctgtctacatctggaagcaccatcagcagccctccgtccagcaatggctctcttcataccccaatcaatgattgcttcttctcatttgagaaggtggaaggggtgaaggaaggttgcgagagcgatgtgcactgtgagctcctggccaacaccgactggtcgcggtctgactcgcctcctttgacacctggtgagtcaaatgattttttgatgttcagtctagtgttttgttcccatcttttaatatttgtgtattga

SEQ ID NO: 3765 - DNA, 657 bp, A.fumigatus
gacgaatccttcaggctgcacaattcatttcaaaactccatagtttaccacaagaaggtatacgcatcaaacagcgagatggcggacggttctcgtctgccagaatcggcaacaagcacaacaatggagaccaacacgaatgaacacgcaaaggtcctcagtccagatgcggaaacggtaccctcgtcatcggtgacagcaacttcttctgaattgagtctcgatggccggtggggagagcgggatcaaggggagcccgtttcccgccgtggcgccatggaggattttgaggagatgaggagggaactgacccaactgagtctgagacgaacgcggtcggtgggaaaggatgcccatcggttgcgatcccgggcctccgggcgagccagtcaagttcacgatgaggagaaggcaatcgacgaggaggattcgacgatcgacggtgacggtgacggttaccagggtggatttgatctcggcgagttcctgatgggttggtctttggaacggagaacgaccacttgtaaaccggcgaacaaagtcggtgtcttgttcaaacattctcacggggaaaggtgttcaaacgggaacctccttttgtgtcgaactcctccgcgaatgctgttgttggcacattttggcccggtatctgtttag

SEQ ID NO: 3766 - DNA, 1656 bp, A.fumigatus
ggtttgaccttccaaacaccaccgaacacggacatccagaaaatgacgaacccacgagcggcgaagagagggaggttgtcgaacatacagcctgcagacaaggatggtgatatccaaatgcgagatgacggccagaatccccactcggttgcatcgtcacctaccggccagggcgcatcgcccactacctcgaaaacatttcgacaacaacctgagccagacgggggtgaagacacagccatgaacggggcgggagataactcagcgagcgtggagactccttcgcggaacggccttcgatcgagcggacgtcaacggaagccaccacagagatacgaggaagaagttctcaacaccccgtcgtcagtgaagagaaccagatcatctgttggacaatctgagcggacgccacgtagcaccaggagaagtagattggtgccggcaacggaagaggctgaggagaattcaccgcagcatcagagggaaggactagccagaacgaggtctaagagggcctccgccagatacgctcccaccgagaagcaggatcaagaagatcaacctgagagccgagaacagtcgctacagtctccgaccccggacgattaccaagatggattggacgaccttgtttcaatgcaactacagcaagacaccactcaccaggatgcgatcgagtatgacgacagtatggtcacatccaatcctctgcccgactatgcagaacgctttttgaggcttgttcagggaggccttagcgaagaactacggcttctgacaaaggtgcttctcaaaaagctcaatggaaagcaacttattccgttgaaagggctagagagtgaatacaccaaggtgcgtcagctcattgagcagaccgtcaccgctggtgaaggtaactcaatgctgctccttgggtctcgtggctgtggcaaaactgccatcgtggagacgataatatcgtcgctgaagagagagcacatgaatgaatttcatgtggttcgactcaacggcttcctacacacagacgatcgacttgcgctgcgggagatgtggcgccaactcggtcgagagaccaacaccgaagaagaggcaggcaaagtgagtacctacgccgacaccatggcaattctacttgctctcctgtctcatccggaggaattgttcggtccttctggaaacccgaaggctatcacggcagccaagtccatcatcatcattcttgatgaatttgacctgttcgcgacccatccccgacagactttgctctacaatctatttgacatcgcacaagctcgcaaagccccaatccctgtgctggggcttaccacgaaagttgatgtgaccgagatgttggaaaagcgtgtcaagagtcggttcagtcatcgatatgtctacgttccacttcccagaagttttgaaactttctcggaaatttgtttcgcggcgttgaacttggaggacgatgagaagcaatgcttctttgacgaagtcgcacccgggaagggaaacacgctattggagggatggaggacatatctacaggtatattctttcctgggttcggcctgcttgtcagaagacactaactcacatctaataggccctctgggccgacgaatcgtgtctacacgccggcggatggaaggtatgaagtgc

SEQ ID NO: 3767 - DNA, 258 bp, A.fumigatus
caccaatcattattccgtcccagcatggaagggaaatactcgtccgatccagaatgggcatctatcaagcccattgagctcaatgatggcagcgacttcggtgccatgccgttggccaccatttcctattccccggaatatctcgaggccacttcttacctgcgagctgtaatggccgccaatgaaatgtctgagcgagcgctgagactgacgggagacatcatctccatgaacccagcgcattacactgtttggtaa

SEQ ID NO: 3768 - DNA, 501 bp, A.fumigatus
agtcgctctgaagcatctcaaaaactaccagatatggtaagtattaggttctgttacaccttgcatcccttctatctgacacacttcaacaggcaccaccgccaagttctcatgtcttcgcgggcacatttccccactcttccgcccagagagcaggactttctgatggaaatgtttgcccaggatgccaagaactatcacgtctggacataccgccactggctcgtccgacatttcaagctctgggatcatccgcgcgagatccaggatgtggaggcgctcctgaaagctgacgtccggaacaactccgcctggaaccaccggtacatgctccgctttggaccgcgcgatgaaaacgagtttgatgccggtctacacaataccacggggccatcctcggagaagggccgcctgccagttgtcgacgaggatctggtcgactctgagctgcagtactcgcagagtaggatactcgaagctcccgagaaccgcagtccatga

SEQ ID NO: 3769 - DNA, 453 bp, A.fumigatus
atgcggggagatatggaaaatggtgcatcgtctattattgcagtcctcttcctcactcagttgaatgtctacttctataatcatctgcgtcgtattcctgaaaagtatagggacatggcatctgtaacccctctacccacctttgataacctcaccatcgacccctcaggaccaccagggaacgcatggggtctatttgggaagaacaacgagctggggatgctgaaccttctcactcccgagacagtgcgcagggcagcagcagaggagattcgagacggcgtacgattctcgcttgatctgccactcgaccgaattaagaaccccagtttcgggcgcaagccgtttgcacgggagttggtaaacaaggcgccacggattgtcaatgatgatatccttgtcttcaatacgcagtgtagcacgcaatgggatggatttaggcattatggttag

SEQ ID NO: 3770 - DNA, 387 bp, A.fumigatus
  unsure (352): Identity of nucleotide sequences at the above locations are unknown.
cagcctctagcatgggtcaagcacggcgggattgtcggaagaggcgtgctaattgactacgcctcatgggcaacgaagaactcgatccccctcagccctttcaccacaaccaagatccccctctctgcaatcaagcagatcgtcgaagaaaacgacatccgatttcgccccggagatatcctcttcctccgcacaggcttcacagccgcctacgacaagctctccccggacgaagagctggccatctctcagcgtgaaacgcctcaatttgcaggtcttgaagccggagaagctactctccgttggctgtgggagaatcagtttgctgccgtaacgagtgactcgcctagtntcgagccttcacccatcgcgggccctcaaggtcgc

SEQ ID NO: 3771 - DNA, 192 bp, A.fumigatus
cagacggattgtgcggcagggaaccatagacacaagcgctactttaatgggcattcactggaggacttgaaaatctcccctgtgatcggcattgacggtaagtctgccatatataattcgacttacttccaactaacagcctctagcatgggtcaagcacggcgggattgtcggaagaggcgtgctaattga

SEQ ID NO: 3772 - DNA, 1080 bp, A.fumigatus
gatgtattccttgacggcggcaaggtcatcgacgagaatctgccagggctagaacagccgaagccgaaagcgagagcaccggctgaccctgctgtatcttcccaaggccagtatgcggcattcaacccgcactccggtagtactaatcagtaccctctgtcacaacacaatgttgccggggatggtacaccgaaccagtttgatagtgccgggttccaattcgacctacccggtaacccaccatcagcttcccctgtccggactcaaggcagtgtggaccatggctacaatgggcaacaggatgcttacgagggtccgttaaataatcagtatatggagcaacagggaagtggagggcctgctgttgcagcctatgagaacggacctccccgaccgtacagggtcaatcagcctgaatatgcaaaccagcaaccggagatggtcaatgagatgaatgagctcgattctcaacagaatccggacggtctgcctcgtcaccctgcgcctttccgtccagggcacgatcaggggagcaagccgcctcctgtgcggcagtacgacaatagtaacacaacgggatctccaacctccacggttccacaggcccagcctatcgctcagccagaccccgcgcctgctcctgttactcaccaagagcttgagcgcttacagcaagtggtacggagcaaagctgctgaccagaaaactcaacttcttttggcacagaaattggttgaagcctcaacggtccttgtcgaaaatagcaggatggatccaaaaactaaagctagggctagagaaaaatacatcatggacgcgcacaagatcgtcaaaaagctggtatccagtggttatgcagatgctcagttctacctcgcggattgttacggccagggtttgttgggcttgccggtagacccgaaggaagctttcaacctctatcattccgcagccaagcaagggcacgcgcaatccgcttatcgggttgccgtgtgttgcgagattggccaagaagaaggcggtggaacgaagcgagatccctttaaggcagtgcaatggtacaaacgcgctgcttcctag

SEQ ID NO: 3773 - DNA, 1395 bp, A.fumigatus
  unsure (76): Identity of nucleotide sequences at the above locations are unknown.
attgcagcttgggatggaaacctcacttatgccaagctcaatgagttgtcctcgcttcttgcgttctatctgacanaactgggcgtgggacctggtctccttgtgccaattgacttggacaaatcctcgtggcaaattgtcgctatcttagcggttctgagagccggtggtatttgccttccagtcgacgcagctcaaccatatgagttcattgaaaagctgttgattgacaaagacattcaggtcgctcttgcgtccccaaacaaagcgcagcttctggaacgcacaattccttatgtcgtccccgtgggaaggtcactttttgactacctccctcgttttgatgatgtgccgcacgtctcacataaggcaatggaccatgcttacgttgtgttcactggcggtagtgtcaaggaaccaaaaggtgttatgctccagcatcttacagttttgacacgggctgagaatttcgcatcggctctggaactgaataaagcgaccaaggtgtaccagtccgcgacgtatacatctgacatgttcctcaatgtgctttttggtacaatgatgcgaggtggttgtgtttgtattccagccaacgatggattcaacaacctcccacgatcgatcaatgcctcccgagcaaacacagttgttatgactccgtcactcgcatctctgttgcagccatctgaggtccctgaggtgcagctactggcactatatggtgagatcctgacaaaccaggtcagaactatttggtcagaaaaagttcgcacgcattctttgtatggagcagccgagtgctcttcaagttgcattcatgcttctgactgccaaaccttgggtgaggcaaggaaccttggacttgcggctgggtgcataacttggcttgttaatccttcggaccacgaccttctggttccgattggtagtgtcggtgaagttgtcattgagggtcccgtcatcgcttctggttacttgttgcataacgggcatgtcaagggaggcttcattgaaaatcctgtttggagaatgaactttgagcgtgacgaacccagcaatgacctcgagaaacgtgacgaaagctcaactctgacccgacggatgttcaagaccggggacttggcccgctacaattcggatggcatattggtctacatgggaagaaaggaaagacagacccagagattgcaagcggatatatgggacgtccaacagtgcatcgacacgttttcgttacctggccatccttgcgttgtggagccgattcgctgcttagatgacgatgaatccgtggagcacctggctgtctttgtccaattcgcctcaactcacttggagaaggctgatggccagagatctgtaatcggacaaccctccccccaatttttttga

SEQ ID NO: 3774 - DNA, 1212 bp, A.fumigatus
aaaatgcccagccaaagtaggtcgtcatcaagtcattgggcgggacagtcaccgtcgtctctcttggaggaaagttttggcggcatcaacatgaacggcggatctccactgaacgggaacttcaactttgcctcgaacgggtttcctttcggcatcaactttgcgccgtctccccctcagaacaatatgaaagcggaagcgacgcagcgtcacgtcctcaccgttcatcccacttcactgaagtcccgcgtagaaacacaaattcccatccggctgactctctatccaatgccctccggcgtcaagaaattacgactgcctacccacaccatctcgaagccgaaattccttgctcctccgtctgcggatcgttcggctgataccttgcaactgcatacgagtcttgtctgcactagcgcgatgcaggatcagacgaaactgaggaaggcatttgcacgagcaaggggcgagacgcggtaccgcgcctcgagctctagcccgaatgccacggaagaattaccagaagatgacaagcccttggacggcggggaggtgaaaatctgcgctggatgcatacagcgtgaacggaagcgcgctttcagaaagaagcagagaaaaccggaggaggatgagttgtttcaaaaggacgaggagaagcgagtgatcgtctttaacaccaacgagatcaaagattgggcagagccctccaagcatgctatgccaggctacactgatgctcctgcgccagttattcccgctggagcaatgcaagtcgaacttccaatgcgaattgcatgctactgcaggcaccagaacgaaaagctcgggtttcaggtcattttcacagtcaaagaccatatggataatgtcattgcccaggcaatcacaaactccatcatgatcacggatgatcacaagacgcacgctcccccggctcctcccgccccgggcccttctccatccctccctgatgggacacagttgcctggagtaggcgtctttccgtcaggccttcccgtcgagaccgcgaagtcgccagtccagtcgttccgatcatcctcgactacggatctacagggtcttcagcaacggttcaactcgcagtatcagatgtcgacaggctccttcaccacctccgctcagaatggccagaacggccagaagaacgccaccgcaaggtcttcaccacgggcctggaaggtccgcgattgg

SEQ ID NO: 3775 - DNA, 228 bp, A.fumigatus
gggtctgggactatttacaccccagagctaaccggctttcaaactagaacccgccctttcaagggaattaacttagatgagtatagtggcggtttgtcgttcaaggctaaaccagaagtaaaatctcattggttgtgtgatgtactatgtattagaattgccggatcccgatggatccacttgcttatcacacgagcagcacttctcaataattcggaagtcagctga

SEQ ID NO: 3776 - DNA, 216 bp, A.fumigatus
  unsure (37),(62),(101),(126),(152),(155),(179),(187): Identity of nucleotide sequences at the above locations are unknown.
cttcccagcgttggtgttaccatccccggcaccgganacaaggtgatttccacgcctaccantatggtcaccagcgtgagacggactgccacctcggccgntggcaccggtaatggcgctggttcntccacatctttccccaccagcggcantgntgaggagcagctcagctacattgnttttgttntgaagagcctgctgcagtatattgcttag

SEQ ID NO: 3777 - DNA, 1029 bp, A.fumigatus
tggcttcgcgactccacgaaccaactatccggttatcaggctctagccaaaaaggacaaagccctccacaacctcattttgggtgccattaacacccaggctgagtttgtcattcagtcgccatactgcaatgcctttcaaccccctccacccagtggccttaagccaacaccgaatgggcaggacgacaaggttcatccggcatatgagccctctgttgtgttcgaatgcaagtacgagctcgattcattggcacatttcctggccctgggaacccagttcttcgaaaacacgggatcaacggagttcctcaccgaacgttggtacatggctctgaacacccttctcagcgttttggatgcgcagtcacagccgacgttcaacgaggagggccaatttgtcaccaaccagtacacgttccagcgcacaaccaccgcgggcactgaaactttgagtctggggggcattggcaatccattgaataatggcacgggtctcattcgaagcgcattccgtcccagtgacgacgctactattctcggctacttcatcccgcccaatgcgatgatgtccgtccagctgaagaagaccgcggatgtgatcaaggcggcaggagggagtgcggacctggtcaaaaagcttcggcagcgaggggaggagcttgatcacgctgtcagagagcacggcgtggtccaccactcaaaatacggcgatgtctttgctttcgaagtggacggctatggctcacggatcctcatggacgatgccaacattccgtccctgctttcgctgcctctgctcggctacgttgatgagaaagatcaggtctatcgcaacacgcgcaagatgatactcgacaagagcggcaacccatattatctgacaggcttcgcgttccatggcatcggtggacctcacagtaagtttatctcgtctccttctatcaacctttccatgaacaaaggagacgctaaccatgattcgtatgcagtcggttttgcagaacgcttgggccaatgtcactcctaa

SEQ ID NO: 3778 - DNA, 207 bp, A.fumigatus
gaaaatgtccgttggcttatcaagctcgccttcgaagtgcgcctcaggacttcgccaattgtcattgcccgcaagcatacctttgatgcatctgcctttgggaaggtaagcggcattctcaaggtcgatgatctgaacccgttcaaccgtggtatttttaccactgggctggcattcaaccataatattgtctggcttgatatctag

SEQ ID NO: 3779 - DNA, 366 bp, A.fumigatus
cagtgcatctacgctatgctcgggcgggtcatcttcggtcctgacgaggattttagaaaacatcagacccagggtgcactgcctgctctcattcgcctgcaacgtcaagtgtcgtactttggagactcagagggaatcaacggccttctgaagcacattaccgatgatgagatcagttgccaggtcctgaggatgctatgggatggaaggtctgacgaacacatcccatacaaaccattctgcaagtggcccgaaatcgtcgatccgatattcaaagatctcattcaacaactcacaaatctggatccgaccaaacgaattacagcatgccaggcattggagcatccatggttccgcgattactag

SEQ ID NO: 3780 - DNA, 207 bp, A.fumigatus
cgcggatccttcgacccccgtggtgaaaacttcaaaatagagctgcatcgcctgctcaatattgaagtcggccagctgcaagtactgagtcgccagcgaagtgttcgagccggtgatctctgtgaactgagcaaccacgtcgctttccatgatggaagagtgaaactgaagatagtagaggtaaggaagggaagaagggcgatgtga

SEQ ID NO: 3781 - DNA, 192 bp, A.fumigatus
aaggtgtcgcgtagaaaaggaatcatgcctctttcggatgaagcccccgatcccaacccttcaaagttattgtataactgcgggcacatggcaagcgtatatctattggaggaccttagaacttacctcatcgacttcctttcaatccagctctttccgaaaacacaagatatcatcgagcgtatctggtaa

SEQ ID NO: 3782 - DNA, 297 bp, A.fumigatus
atagctttctgtattttactccatgcattctatatatataccattccacagactatattctccactgaagaggggaagaagctcatcacatttagcatactatacgactatgcaagtaggcataccagcttctatttaatagctgatccattaggggcttatgcagtctatctcaataatcttagaatctcttatcatggtcatactctttctacctactcttcatctattagaaaactaacttgcagctgggcggtcaatagaaccatgctgtatattatttcctacatagtctaa

SEQ ID NO: 3783 - DNA, 366 bp, A.fumigatus
cagtctgacctccagctcaacagcatcagtcttgaacaatttgttgctgattatgttatggagtctgaaaatgtacaaaggctcgagcagtcgcaattttctgaacaaccggagactgtgctaaactcattgtgcagcaatggatcaacagaagacctacaatccgagaaagtgccctcggtgaaagttgcgatcccacgactcgctcgtccgaggaccaccagcaaccggcgcatcaggacggcatgtgcggcgtgcagggaacaaaaggccaagtgcagtgaacatcgaccatgccttcgctgcatcagtttcggcatcgcttgcacgacgctcgaaagtaagcacgaaagtaggcaaaggtga

SEQ ID NO: 3784 - DNA, 204 bp, A.fumigatus
gaattcataatagcgggtatcctgaatgttagaccgatgcacccttccctacctaggattcttttgccacaagatcaccgatgtttgatgtcctgggccatgaaccaaacagcggcccgctgcaatgatgtgaacaacggatcagttaaccagaatcacaatgaggattcatatatccttcaggacattttgatccagaactga

SEQ ID NO: 3785 - DNA, 258 bp, A.fumigatus
tcttgtggcaaaagaatcctaggtagggaagggtgcatcggtctaacattcaggatacccgctattatgaattctcattctagagtggcctctatcgccagtagaaccgtgtcgacaaagaccgctagtaccactgggcctctcatctttgatgaagtaatattgtataaggcttcattcgtttctatcattactgtccaatctgcccatgattctaatgttaatgcatcaagtcctaccatcaatctaagagattga

SEQ ID NO: 3786 - DNA, 255 bp, A.fumigatus
tcatgtatgtccatctttctgcctcccaccagtcgaaagctagtgctaataatctacagcctcttcctctgcgtcgccgcgtaccttattttcggctcctggctcaactacaaccgctacggtgcccgtggctgggacctcctcccgcacggcgacaccctccgtgacattccgtatattttccaggactggctccgacgggtcattaatacgctccaagggagcgggtcgagaggcggttacagcgcggtttga

SEQ ID NO: 3787 - DNA, 267 bp, A.fumigatus
tctgggccggagttttgggtcatcaacgcagatgagatgctcgaaaagcccgcggccatgttcgaggcgttctgcgcaagtgtcggactcgataatgatccctccatgctgtgctgggacaccgacgtggaccacaagattgcacgggacgcgttcgagaaatggcgtggtttccacaacgatgcgatcgagtcgaagggtctgatggcgaaggaacctgtagcactccctttttcctcaccattccttgcaaaccgaagaaactga

SEQ ID NO: 3788 - DNA, 756 bp, A.fumigatus
  unsure (576): Identity of nucleotide sequences at the above locations are unknown.
gcacggtatgcgatggagtccgcctgccataccggccaaatgtgcgtttacgatacagttgaagataagggatggcgtgttgcactttcaacccaccggatcgaggccgtaatttccgacgtcctcgaggtatatgaagacatccctccttgcgcacccgaggaagagtgctatgattgcgagttgtggaagttcttcaaaagcaatgggtctgaaagcacgacaacttcgactactaccactaccaccgctcctaccacaacccggacatcgacatgcaagacccccggctggtggggctgtttggacgaaagcacgaccactacgaccaccacttctacgacgacgacgacgacgacgacgtcaacatgtaaaactccggggtggttcggctgcaaagacccgactacaacgacagaggcaacggccgccccctctgtcacaaccagcatacccacgccaactacatatccaacttcatctacctccacatgcaaagatcctggatggtttggttgtcgtgatcctcccagcacgacagcgtccatcacgtcgtcaccttcgacaacatccacntgcgatgatccgggtttcttctggggttgctatgacgagtcaacaacggcaactcatcccatcacgtccggaccgagcgcgccatactcgactccctcccctacgcacgaacacacatgtacttccagtattttcttcggtttgatttgtgttgggtcgaccggcaccgaactacgctag

SEQ ID NO: 3789 - DNA, 186 bp, A.fumigatus
ttagtggcagaatcgatgatttgcattgaagtcatcggctttattgaggctgcaatctataaacggtttcctagtcgggcgtctgagaggatagaggtaccaaatgggggcattatcgatgacctttcgattctatttgctcgtccaaagatttgctcgttcctcatcccaaactgctcatcatga

SEQ ID NO: 3790 - DNA, 216 bp, A.fumigatus
ccacatccatgtcgcttttgcgggaaatcatcttggactaactcatattatatcataacactgccactgcatggtggacaaaacctctatagcgctattgtgaatgtgcagttgaacagaggaattccgaagttcatgttagcctcttccgtctcactcggttgcctcaagattactataatagaatcgcatccatctttcctctatcttcaataa

SEQ ID NO: 3791 - DNA, 273 bp, A.fumigatus
acagagttacccgaagtcaatgatatactacctccgggagtcactcacgaagaacacactttcctcggccctgacaagaacccgctgatcctctcaatcttccgcaaggagagtccgccagactcttttccacagaaacgaccagccatctaccatatccatggtggaggcatgatcatgggcaaccgcttctgcacactaagcggcctgctcgaattcgttcgcgaacataacgctatctgcaccacgatcgaataccgccttgcgcctaaa

SEQ ID NO: 3792 - DNA, 378 bp, A.fumigatus
actcttttactacaacaatttgaactgactcgggactcccagaactcgtctcgtccttcatccacccccatggagccgtcctcaagcccacactcggctcagtccttcagctttgcagacgtcttccctggcggaaacgagctcgaaatccctctcggtcatcctttcgactcggtctacgagttctcgccgccaagtccctataacgctaccaccatcccagacctctacgctttgaacacctcctacagcgtccccatcccgtcctactcctcatcctacgagacccagtttgcattcactccgagcttcgaagattcgttgctcgctcaatactcgctcagcaccagcgcgtcctcatccgactctcccaagtaa

SEQ ID NO: 3793 - DNA, 258 bp, A.fumigatus
ctctggacctccagattatccaaaccctatgcgtgcgaagactgtggaaaggccttcacccgatccgctgacctcaaacggcaccagagcagcgtccattatccggtctaccaagattgtcccgtggaggactgcccgcggaaggatcgcaatggcttcccgcgccgagaccatctcattgagcatcttcgctcatcccatcacatggatctgccaaagcgccggatgacgaagcgagtctcgaaggcgtctgcctga

SEQ ID NO: 3794 - DNA, 489 bp, A.fumigatus
ccgaggcagctgggtcacttcggcctgggggtccgaaacttgcaggacatggttacgttttacacaacaactgtcaacgtagtgccgagcgacttcctgtacgttgagaaagacggcaacaagaaggacgttgctctcttcgcgcacatcgatcgcggcgcagactacgtcgaccaccacagtttcttcatgagcaccaatcccacctcgcatgtacaccattgctcgtttgaggtgcatgactttgacacgcagaatttaggacaccagtggctggcacacaaggggtatgagcctgtgtggggtgtcggacgacacatcctcgggtcgcagctgtttgattactggtgggataccactgggaacatgattgagcactatgcggatggggatttggtgaatgaggagacgccggtcgggtatgggcccgcgggcgatgagtcgttggctgtctggggcccgcaggtgcctaagtggtttttagactag

SEQ ID NO: 3795 - DNA, 231 bp, A.fumigatus
tcgatgctctacaatgaatattatggtgctcgagccgttgatgataacagtacagtcaaaactaggatgactgttctactcctgattcatcaattggagtatgttatcatgattggtcgtgtactacataccgagcatatcttgctaggctggcgacaagaatgtccccgcgccgatcggccctggaacggagaggttatggatgcagctgatcattgggcaacgaagtga

SEQ ID NO: 3796 - DNA, 918 bp, A.fumigatus
  unsure (879): Identity of nucleotide sequences at the above locations are unknown.
tgggttctctggaggaggagcgccagacacaagggttttttggcagctcgagtgctaccagtttcatgcgtcagatcaagacggctgtggaaaagaggagtgggctcgcccgaccgccgaacatccgagtctatactgggaactgcgccgcaatcgagtcctctttccaaccggaccaaaagaccgtccatcatatccaactatgtgcttccaccaaggaaaactgccgatagccttatggacgtgtactggggctttgtgtttcctctctatccgctggtagatagcattcaattgcgagcggagtatagcaagctctggactggagaaacgctcgactcggacgagaatatgctcatgtgcacattcaatgtcatttttgctttggcctgtcagctggctgatttcatcccgcctaacgagcgtgaagcatctgcagatgcattcttctctcgagcgaaagacctactacacttcaacctctggcacggcggctctgctgctttgattcaatgccttctgttgatggcccaatacctgcaaagcaccgactctgcacaccagtgctggattgtcactgggctggcgattcgcaacgctcaaagtctgggcctgcaccttccacagaccattgcccgtctaccgagcttccaagaacagcaactagcacggaaaatctggcatgggtgtgttcttatggacagggttatctcaatgacattcggacgaccagctatgatctccaaggcatcctgtggcgctgttcccctcccggctacagtggacgaggagtatattcccgcatctctgggtgatgaagtgagacaacccgccggccgtccttccgtcatggctttctacgcaaagtcccctgagctntgcgcgatcttaaccgctggtaagcgactagcgtcaaaa

SEQ ID NO: 3797 - DNA, 360 bp, A.fumigatus
tttgcctacccgcacagccagaaatacatcaattcctacggagtacacaacaattaccactgcatgatatatatcatattaatgagtagcccatctcctcgccacccaccctcagacgaagtgtcaggaaaacgtccgaaacgacgtaaagtcgcggtcgcgtgcgatgagtgtcgcactcggaaggtccggtgcgacggcatccaacccggtaggtctcgctggcttttcttccgacttccgtgtcaatgttgcttcggaacaagaaccgtcttgctgacggcgttctctcattcctcgggctttagtctgtgggccgtgtatgaagcgatcggatgcgcgatgtgtttacactggtga

SEQ ID NO: 3798 - DNA, 372 bp, A.fumigatus
cagcgcggtaccttccagccccggggtgaagacgaaaccccggtttctttctgtgccctgttcactggccctcatggaaggagtgaagatgttagacactatgaaagcattttggtgattgcaagtggatttgggatcgcagcagcaattccatacatgaagtcgatgatctatggttattacacccggaccataaaggctcgccggttgcatctggtatggcaggtatggtcgagggccgaaattaccgccgctgagcatttgttaaacaaccttctcgaggatgatcacaaggatcatggctatgttcgtattaccatgttgcgggacagcctctggacagctgacaatgaccgtggctttagatcttga

SEQ ID NO: 3799 - DNA, 195 bp, A.fumigatus
cttatcttagggagtggtcttgagacattctggcagccagctgctgctgctctgggaagactctgcaggcaacaatatgtgtcttgggtgatgtgttgggaaacttacttaaggggatttagcccgtcaaatgtgcgaaaacattcccaaaccgagaccgcattttatacagggggtgaagtgatgaacttcccc

SEQ ID NO: 3800 - DNA, 261 bp, A.fumigatus
agacctgttatagctattcttgaacttggtgcttggttcggtgcattatactctggtctcctatgcgagaggatctcccgcaagtataccatcttagcgaatgtcgctatcttctgcattggcgttgtgattcagacaacggccgcaaccaagggtgggaattcatcgcacatcctcggtggccgttttatcactggtatgggagtaggaaggtatgcatatttctcaagaggaagaagtacgttcaatcgcaggtgctaa

SEQ ID NO: 3801 - DNA, 600 bp, A.fumigatus
tgcgcaacagatcgcaccaccggaagtcagaggttctctggtcgcactgcagcaacttgccatcaccttcggaatcatggtaagtctgatgatcgatccttcgttgtccttgtcaagacacaggcattaattgatatttccgcaggtttctttctggtaggttcatatcttctaccaatgactttcttccctgacgagtataggatcaactacggcacaaatcatattggtggcacaggcccaactcagaaagacgccgcatggctcctaccacttgccttacagctggtgccggccgttattcttggagcaggcatgatctttatgccattttcaccacgttggcttattcaccatgaccgagaagacgaagccaaaaaggtcctcacgagtctgcgtggcctgcctgccgatgatccacttctgcaactcgagttcctcgagatcaaagcccagagtcttttcgagaagcggaccgagaaggagaaatttcctcacctggaacgaaccaacacttggagctatatcaagctggaggctgcgggatttgctagcctcttcactagttggccgatgttcaggcgtgtcatggtagctaca

SEQ ID NO: 3802 - DNA, 318 bp, A.fumigatus
gacagtccgtttcgcatgaaaacgtcagtcggaaccccaactgcttctgtcatgccttcagaggacagcagaatagagccacttccgccggaagttgtggcgaagattaaatcttctacatccattatcaatctaaacagagtggttgtggaactcgtcaagaatgcgctggatgcaaatgcacgtacggtctcggtaacggttgatttccaccgcgggggatgtgttgttgaggatgacggggatggaatacccccagcagagtttgagtcggatggaggactagggaaagcacatcgtacgtgggcctcgtcctga

SEQ ID NO: 3803 - DNA, 204 bp, A.fumigatus
  unsure (68): Identity of nucleotide sequences at the above locations are unknown.
cccagagatgccccagacataacacgtaacatgtcacgtgatacatgttgtcaactgcaacagttgtntccctctcgacaacttttccagaccttaggcaacaagcatggaaacgacacggatctgtcgctcctgatttataaagctgatttctcaagtggtgttgctgtaatactcgagatccgatgctacatcatagtctaa

SEQ ID NO: 3804 - DNA, 627 bp, A.fumigatus
gttgcattggccgatacgacgactatcatagacacttcgctgacagcttctcttcccttagcgggcaaccgatggcatatcgaatgcttttgttgcagcacatgcggcacgcttctcgactcggacgcacacctactgcttctcggagacggatcgttgatctgcagcaattgtacctacagttgtagctcatgtggaaacaagattgaagacttggccattttgacgggtgaacaagccttctgcgctcagtgcttccggtgccgaaactgcaagagaaaaattgagaacttgcgctatgcgcgaacttcccagggtatcttctgtatggactgccatgaatcgctaatgcaacgccggaggaaaaagaaggctggtgtacccacaagtaaaaagccagggcccggcgtgaagcttgacaagtcgctgccctcccttccgcccgaagaacccgagccgcatcgcgcaccaaatgactcgatcctagatcattatctggatgatgcaacatctcgtgaggccccagacagtgggaggaatgagcgccccccgatttctcgccagcacaccgataatcaaggtaagctcatgatttggaatatgcggatcacacgctccgatcgctga

SEQ ID NO: 3805 - DNA, 633 bp, A.fumigatus
ctctgcgtactagctgataatctgatactcccctcgagtacctaccgaagcagccgtcactcagtcgtaccacgtgaagcggaagcggagagcggaggagaattcctcatacctgtcgcgtttgacccctcggaagaaggacggtcctcgcgcactcagtcgcctccaacagctcacagccaccatcctccggctggaagcgcgtcaccccatatcgcgtaccaggaaagaggacgggagcggaccgacgttgattccagtcgttggcgtggagacgatgtcggagccagtgcaagcgcatcacctcgttctactgataatctccagcggggcacgtcaaaccggagctccagagctgatctacccatcaattccaaggagacgagcaccttttcaacacctagtccggagtctaccaagtcgagcgggatagtcaaggacagttcaattgtcgactctgctgggtcgagaaccttggatagttctgtgaccgccccatctcgtccgtcgaacgagcttcgtgagctacatgagaaaggcggttcggtagattctacgcgctcattttcatctccaagcaccgcgcaacctcatccgagtcttcaccacggggctggaaagtgcggctccatt

SEQ ID NO: 3806 - DNA, 303 bp, A.fumigatus
tattatttccctcttctgtccatcatttgttcttaccccgctgacagattggttgtgcagttgagcgatgaatgggctgactctcagatgcccgtcgacggcactaatggctgcctccgggcattcacacaactcaaaacacaatattcgaagctgaaggttattctctcagtcggaggaggaggcaagggaagtgagaattttgctgctgtagcgggaagtcaaagcagtctggagacctttgtacggaccgcgaagggactcgtagatgagtttggactcgatgggattgatagtatgtag

SEQ ID NO: 3807 - DNA, 642 bp, A.fumigatus
cgacttgcagtcgattgggagcacccttcaacccccgccgagggttcagattatgtccgtcttctcgcgcggttgcgtgaagtcctaccctcaccgcggtatgtgctggccacctgccttccagctggtgagtgggccctgcgaaatatagatctgtgcaaggcacagaactatgtcgacctgatcaacatcatggcgtatgatttctccgggccgtggaccagcgaaacaggacaccaggcacagctgtatagcccatctcgagacccaacggggggcatctcgtgtcagtcggccatcgcgtatgtcatcgcgcaaggcgtcaaccccaagaagattctactcgggatcccagcgtatggtcgctcgttcctaggcagtaatcacatcggtcagcgttacagtggttgtggaggggaggatggtgtctttgactactgcgacctaccgcggcccggtgcaaaagagtattccgatgaaaagtccggcgctgcctggtgtgttggcggcgacggtgggtttgtcacatacgacaccccggagacggtgcaacaaaaggcccaaatttgcgaccaagaccaaactgggcggtcctatttaatggcacaacggaggggatgcacgaggaacccgtttccctga

SEQ ID NO: 3808 - DNA, 219 bp, A.fumigatus
tctgaaccctcggcgggggttgaagggtgctcccaatcgactgcaagtcgtcagcatcaacctaagcagctcgaacgtacggtactacatactatcaatcccatcgagtccaaactcatctacgagtcccttcgcggtccgtacaaaggtctccagactgctttgacttcccgctacagcagcaaaattctcacttcccttgcctcctcctccgactga

SEQ ID NO: 3809 - DNA, 306 bp, A.fumigatus
agaagcctcgtcactcgtcctgttgaaaaatggcgcatcgaaaagggatacatcttctgtcagaaagtggccgccttggacattgatctgcagatactgttatcccatatctcatttgaccgtgacgtgacttacagtgccgtgccgcgcatggtctgggtggtaaaacgcgtcactgttccatctcgattcgggtatctggctccatgcttcccggccttcaagtatcattttccacagcttttcaacgttactggcatctccgggccctcggaatcccatgccaataatggcaatagatattga

SEQ ID NO: 3810 - DNA, 306 bp, A.fumigatus
tctcctaccatgcctatcaactccttcgaagggactggggaaccggtccagctcccttctgcccctgatgttgacatcgaggatggagcctcgaactcgttggacgacgcgtcaatatctattgccattattggcatgggattccgagggcccggagatgccagtaacgttgaaaagctgtggaaaatgatacttgaaggccgggaagcatggagccagatacccgaatcgagatggaacagtgacgcgttttaccacccagaccatgcgcggcacggcactgtaagtcacgtcacggtcaaatga

SEQ ID NO: 3811 - DNA, 693 bp, A.fumigatus
aacagttctggcattcttcagggggagaaagtagggacaatttttcaaattggggtgcacacaaaatttatgagaccagtgggtttgaggaccgaagtttcgggcgagaacaacacggcaacatatcattttgtcgaaggcgacattgactcggtgccgggccctggcatcgcaggattctatgacggaccctactacagctattacaagtttccccggtcgctttctgatcctgacggcagcgaggaggaatccttgcttgaagcatacaatctcctctatgatatcatcgacgaggacggtccctttgatggtatcctcggcttctcgcacggaggaaccctggcttcgggctttctcattcattatgcgaagacatatccgcatgaaccacctctctttcgatgtgccatattcatcaattctctaccaccgttccgcatggactccggtgagaaccctgtaatcgactcagaccttgacggctatatcaaggtaccgactgtaagcatcgctggggcgaaggattccttgttcgagtattcgcttgcattgtacaggctgtgtgatccatcaaggtccacgtggatagtacacagcaaggcccacgatattcctaacgataaaaaaaatgttgctttgatggctgcagggatccgcaagttagctatcgaagctctggcgatatggtga

SEQ ID NO: 3812 - DNA, 918 bp, A.fumigatus
cttagcgcggatccttcgccccccgtggtagaagacgacactgcacctgatgagaccaccccggctggtcttcttagcgtcctcgcaacacatgcagtgtttggggctatacatggaagtacccagagcctctctgaccaacatcccagctacgaggaggctacagttctctggaatacgtacgtgcaaaatgtcgagcctctttgcaaggtgcttcatgttcccactgtcgcaaaattggtcgacacaattgcaaaacaacctgctgcggcctcgaagagtgtcgaatgcctgctttttgccatctactatattgcggtgttcttcatgtcagacgccgactgtcttcagcagtttaatcaaacgaaaacccaaaagatgtcgaggtatcgaaccgctgtctgccaggcgcttgtcaatgcgtcgtggctgaagacaaccgcgatgccagtactacaggcctacactctcttcctcattgccatgcgcactcaagtcgattctcacacgttttggatattgacaggcgttgcgattcgcctcgcacagcgcatggggctgcaccgtgatggtgaaagcctaggactgccaccgttcgaggtccagatgcgacggcggctcttttggcaactgcttccactggacggctatgcgggccaggtctgcggcactgggatctccatatcgcctactagctgggataccaagccaccgctgaacattaacgatgaccagatcttccctggtatgacgcagaagcctcaagagcagaggggcgcttccgaaatgatattctgcttgtcgcggattgaactgtccaatttttacatccgaacgggtatcgaaatgaaagaaattggtggtactatacaattcaaggatgcaaaagaaattgagaggctcgtccactatgtctaa

SEQ ID NO: 3813 - DNA, 579 bp, A.fumigatus
aagaaattggtggtactatacaattcaaggatgcaaaagaaattgagaggctcgtccactatgtctaatatctcatctgagacaaagtttcttcgctactgcgaaatcctggaccccctgcacgttttcaccatggggattgtacgatctgccaccaatgccgttcgattgcgtgctcaaatgcccctactgctgaagcaaaccattaccgacgcgcaaaggagatgcctctgcgctctcgcagaaaagatcctcgatacaaacagcgccatctaccgcaaccccagcatgaatagattccggtggcagatgcaagccttcttcttgtgggatgcccttctctgtattttgctaagcctgacacaagtcggattctactcgacgtcggagctaaacagtacctggaacagggtcgcagaagtttatgcgaatcacgaatatcttatcaaacgcaagaaagccctgcatgtcaccattggcaggttaactctcaaggcctggattgccaatcctccgagtaactcgtccccagaaccggctttcataaccacgctgcgcgcccaacatgaaccgaaagtc

SEQ ID NO: 3814 - DNA, 666 bp, A.fumigatus
ctcttccatttagtctacaagctggcagcttacctgcctccttctattgtgtcatttgtggaagataaagtgatttccattcggcgcttcctcgaggacaacggcattctgcccaagaaggaagaaagctcgaccggcgaatccaaggctgtgaccgaagctcgcgagggtcttgaaaagaccaagaccagccttgcggaactatacacgcagttgaaaaaccatcaagccgaccttgaaaccgactatggaaaggcaggtgttttccgcgctcttaaaggcgtttgcatctccaaagattccggggagtacacgtatgagcattgcttcttgggcgagaccaaacagattcccaagaaaggtggtgcaactattcggatgggtaaattcggtcgtatcggatccgtcattatagacaacgtcaacgagaccggcgtgattgtgcccgaggagcgggtttctcttgagtacacgaacgggcagacctgctggaacggaccagctcggtccaccacagtcatcttggagtgtggcgaagaaaatgagatcctcaaagtgacagaggacgagaagtgtgtctactccatgatcgtcaccaccccggcggtatgtccgggaggagaagaagaaggcgatgtggcaccaaggcgcaaggatgaactgtag

SEQ ID NO: 3815 - DNA, 237 bp, A.fumigatus
acgtgcgatcttccagcggcgtgtgtcagacgggaggagtatggtgccagagaagatgtgggcaatctcggaaacagcgcccgcgaccgagatctggatgaaattgccaaacctgatgacaacacatcgggagtcaactgggagcagtgggaaaatgaggaggacgagaccgacgcaggttcgtgcttgatctatttcattgcgtatgccggttcggttgctgactcttccatttag

SEQ ID NO: 3816 - DNA, 252 bp, A.fumigatus
tcccaattgaagcccactttacagccccgtggtgaagacacccgcctctatgaattagcctatgtggcatacgggatatcctatcgcggagtgtggattccccgattgaattgctgggatacaatacggcaaatggcaaactacattaagacccagggtaagtggaggctactgaattgtacaaaggatgatgcaccaaacccggcagctcaatcctcagcctgtgtgaggattatgaccatagaggattag

SEQ ID NO: 3817 - DNA, 186 bp, A.fumigatus
ctcataccggcagcccgtctagatgacacgatattgaatgttgatatctgtttgatgatcggctatcctcgaaatatctacaacaatgttcggtctacttatgctctccgcgacctcgtcactcacggatggctagggtatcagtgtcatcgggagcgcggagggacagtcgacaccaaacaatga

SEQ ID NO: 3818 - DNA, 237 bp, A.fumigatus
gaggaagaatacgacccgaagctttggatcgaagcaactgtcaaaaaggaaatgctgtctgtgccctttgatcagttcgttcagttgcagctttgcttctgttggtgcaccgttagtgtttatcttactacatctggcaacacttgcatgtaccaagagtgcttgagcgaaacgcagttggcaattctcaacgtgttggggtggagagcgcaacccgcgaactggctactcacgtaa

SEQ ID NO: 3819 - DNA, 624 bp, A.fumigatus
aagcccaaactccgcttggcagcaagaaaccgtccaaaacgggcttcgtgccccaccacatctaccagaaacagtcaatctggtaccactacgtacgccagaaatatggcctcccgctggacagccgccacctctacacgaagacggactgggagttctttgcgatggcggtcgccagcgagcgcacgcgcagcgagatcctcgagtcagtcgccaaatgggtcaacgagaccgtcaccgaccggccgttcacggatctccacaatacagaggggcgcggcgagttccccggccccaatttcttcgcgcggccggtcgtcggcggccattttgcgttcttggcgctgcagcgtgcttgtggcggacgggcgatggaggcgctggcgttcctcgatgataactccgatcgggagacgctgcaggagtggatggcggctgctgccaaagccgtggaggagttgcagacgcagtctgatatttgggggtatgggtccgacaatggggagctgtaagataaaaaaaaactgcagtgaactcccagtttgggagctgttggctatggtactccgttggatatgtcccatgtatcttttgattatggcgttgatagtggcctctgtataa

SEQ ID NO: 3820 - DNA, 633 bp, A.fumigatus
  unsure (87): Identity of nucleotide sequences at the above locations are unknown.
tatcctgatccttgcgcccgcggtgaagacggtcctggactaccatctacaacctatacgccgacgcccagctctgcttccacctgngaaggcaccgactccttcccggcctccctcctgaaagcccaaactccgcttggcagcaagaaaccgtccaaaacgggcttcgtgccccaccacatctaccagaaacagtcaatctggtaccactacgtacgccagaaatatggcctcccgctggacagccgccacctctacacgaagacggactgggagttctttgcgatggcggtcgccagcgagcgcacgcgcagcgagatcctcgagtcagtcgccaaatgggtcaacgagaccgtcaccgaccggccgttcacggatctccacaatacagaggggcgcggcgagttccccggccccaatttcttcgcgcggccggtcgtcggcggccattttgcgttcttggcgctgcagcgtgcttgtggcggacgggcgatggaggcgctggcgttcctcgatgataactccgatcgggagacgctgcaggagtggatggcggctgctgccaaagccgtggaggagttgcagacgcagtctgatatttgggggtatgggtccgacaatggggagctgtaa

SEQ ID NO: 3821 - DNA, 705 bp, A.fumigatus
aaccgcgcagggtccaagttcggtggcggtggtgttgcatcgcactccgcaacgaacgcagaccgtcgcgagcgtcttcgcaagctcgccctcgagacaatcgacctcgacaaagacccctacttcttcaagaaccatgtcggaagcttcgaatgccgtctctgcttgacagtccaccagaacgatggctcatatctggcccatacccagggccgcaagcaccagacaaacctggccagacgtgccgcgcgggagcagcgcgagggcaaaaatcaagatccggcgatgttgcccggcgcgatgggtgtgcaggttaagaaacaggctatcaagatcggacggcccggttacaagattaccaagattagggatcccttgacgaggcagctcggcctgctgttccagttacagtatcaggagattacgcctggggtcaagccccgagtacggtttatgtctgccttcgagcagaaggtagaggagccgcccgacaagaacttccagtatctcgttgtcgctgccgagccatatcagacgtgtggtttcaaattgcaggccagagagatcgaccgcagagagggtcgctattggacctggtttgatgaggacagcaaggagttttggattcagatcatgttcaaaaccgagcgagaagagcgatttagtggtgttccgggtctggcaccaatgggacccaaaacttaa

SEQ ID NO: 3822 - DNA, 255 bp, A.fumigatus
ttttcggaatgggacttttcccgcgaatacactttaaaaacccattctctttcattgggctactttctacgtggcatagcttatctactttctgtttacaagaatgtgctatttcatagatgcatggctcttcaaggttccactttcatcgtggatacattgaggcccggtgagcgccatatgtacgacctagctaaaagacaaaacagccagtcaagccatggtctgcacgcttcggagtatgaaagaagttga

SEQ ID NO: 3823 - DNA, 183 bp, A.fumigatus
ctagcaaagatgtgttgtataagaaaggaatctaaagggaataatactattatctttgtatgtttacaagaaattaatagtaagataggagccatggctattaaagataagtatctatttctctcccctctttgtatatttatttattaccttaataaagctttaaagctattaaagggctag

SEQ ID NO: 3824 - DNA, 1248 bp, A.fumigatus
gcgcagtgtctgaacttgtctgaagcacttttaccaatccagaacacaaccgacacgcttgacgagtttttgcgccatatcgtggcgaaagtatacgagcctcacattgacttgtaccttgcagaagagctcgaccacttccggaaaaagtctgcagctgtagtggatgagtgggataggcaactgtcagagcaggctgcttcgactgaatcatttctgatgtccaatgtcaatcgacaggctgacaagcgtgactttttgacttcgtttaaaaaagtgattatggcgcctgtcaacattctccccagcttttcgagctccaagtcaagcgaaacgaaatccgatcatgagtccatcggtagcgaaccgtcctcggcgctcaagagcccgaacaggttttccactattgcatcccctgctcttacccctacggttgaggcccctcctaccacagaacttgcagctaaggcggccgtcatgaaatcaaagttggagggcatccggtctctgtttagtatcgaaatcgctcttagcgtaattcactcggccaagtccagcctcgaccgtgccgcccaatttgtgaagataggaggtgagactggagcggcggccaaacagcaatgtgaggcaattttcgtttcgctcttacgaattttgggacatcagcaccttattgttggtttcaacaaagcagtcgaccatctatccaactatagacctcgtgaacaaggcgagcgcgaccaagcaggggttgagcctctagttaccttcttggagctcgtgaatgttggtgaccttatattgcaaatgatggatgtcttctacgagcaagagcttgttggggccaagatcaccgatcgcaatgattttctcgatcctgccgtgaaggaaaagaagaaattcgagcagatcctggacgaacgtgtcgctgccggattgaacaaaggtatcgatgtcctcatggaggaagtagattatatcctcgcgaccagacagcaggctactgacttcaaccccgatgcctctacggatccataccgaaagaccatggatgtagctgtcagtgaggcggccgcggctgtggttgacgtcgtttcgtcacatacacagatgttggtagggagcaccgacaagagcacgctagatgtcttcaaccaggaggtcggtttaagacttttcacagcgttgtgtaagcatttgaagcgtcagaggatcagcatcgaagggtccttgaagcttataaggtga

SEQ ID NO: 3825 - DNA, 183 bp, A.fumigatus
agccttcgctgtaaatatgttggattctcttgtcttgttcttctaccctctgaaagaggatggccacgattgagattttattccacctttatcctctttgatctcgtgttcgagcctactgaggagcttcttaactgtctattaatagctctgggagcgtatactaagaaggttctccagtga

SEQ ID NO: 3826 - DNA, 204 bp, A.fumigatus
ccaggattacctatgatccatgtactgtgtagttctaccctgtacgttcccaaattggtatctggtaagaaacaaggtacggaaagcaggtcgcagggcaagtaccggccgtcgatcactcgccatatggaccgggtctacggagcgtctacggagctgtcgtttggccttctaattgcagtaggtaaatcactggtagcctga

SEQ ID NO: 3827 - DNA, 333 bp, A.fumigatus
gtaatcctggctattattttcctgggattttgtcttagttgcccactcttgattattaatttcgttttccttttcacctttctgcctttgtccggttttgagattatcctaatttatctcagttatgttgttgtgcttggatattatgagatacagtaccctcatagcatggcaagaatagccttaatttcaggattaacattcaagcaatctagagaaataatgtacaggctttgttttttgtccacctttcaagctggtttttgtttaattaaattaggtggcatcatgagttgcggccttcatcaagcaacaaacctatatacggactag

SEQ ID NO: 3828 - DNA, 426 bp, A.fumigatus
actcgttgccatagtcgacgctctcccaacctcgctgccgcaataaacaagatgcacattgcacaactttcgaattctagtgcgtcacattcaaaaagttcacagtcgcatagcacaagcgcatatggaccccgcccttctacttcagcgactaatatgactgatttgagtgaagaaacgagctctgtcaacgcaaagcaggcgaacccccaactactcacgcagtacttgaacaaggatcacggcctgcttgttcagaaaactacggcattggcagtgtctcaaaatgtgaatgcccatgcgttcctcgctggtgtcgaaggcatgctgaacagaccgtatctgagcgatatcaatcatggtgacgacaagatgcaggccctggcccagcacgcaaagctgggaaaatttgacaagcatatgtga

SEQ ID NO: 3829 - DNA, 282 bp, A.fumigatus
aattcgaaagttgtgcaatgtgcatcttgtttattgcggcagcgaggttgggagagcgtcgactatggcaacgagttcacatggtttagctcaactgtccctactgatatagaggagcccttacctctcttgatgcgtttccaaatcgttctcgctctgttgaccgtggaacgagtcctcacctaccgaacgctggctggtttcgtcagcgataataaccttgaactaagcgtggcaggcacagagaaacgcgtactcctcgctacgaccagtagcccatga

SEQ ID NO: 3830 - DNA, 495 bp, A.fumigatus
  unsure (15),(47),(82),(83): Identity of nucleotide sequences at the above locations are unknown.
cacggtgaagatgcngatttggccttgcaacgcgaaactcattcganatcgcataaaacgacatatgtctcaaccagtgtannccgcgcccctgagtttctcctgcgtgcgggagaatactctgcgcctgtagatatgtgggctgttggtgccatggcagttgaaatcgcgaccctgaagccgttgttccctggtggcaacgaggttgaccaggtctggcgcatatgtgagataatgggcagtcctggcaactggtacagcaagtcaggcaccaagctgggtggtggtgagtggagggaaggctctcgcttggctcagaagctagggttcacatttccaaaggtacggagattcgtcttggtcacggagctcgagagaattgctaacgtcggtcgaacagatggcgcctcattctatggagagcatcctgcagcctcctcactggcctgcatctttgagccatttcgtgacttggtgcctgatgtgggaccctaa

SEQ ID NO: 3831 - DNA, 1074 bp, A.fumigatus
ggttcacatttccaaaggtacggagattcgtcttggtcacggagctcgagagaattgctaacgtcggtcgaacagatggcgcctcattctatggagagcatcctgcagcctcctcactggcctgcatctttgagccatttcgtgacttggtgcctgatgtgggaccctaagaacagaccaacttccacacaggcattgaatcacgagtacttcgcagatgctgtggatcctttgcggccaaaatcttccacctcgcggctgcttggccgcaaacagtcggataggagcttcagatctcccactcctcagtcgagcgactcccccagcgtgtcatcaaagccttcatggtttagaagatcgctgattggaagatcggaaagcccagccccagctttagaaactgaccaggctgtccgaccgtctgttgtgtcgtacaacactacacccgatctgcaagccaacaagaccagacctgctgccgctaagcgcgccacgtgggccaatggggctcctatgcctatcctcccttcaatccgaccagtctctcccttgtctaatgcagttacagctcaggcgagctcgactcttgctcatggtggggataatgcccagtccggtgctgcaaaagcgagcaagaagattggccgacaactgtctctgaactcccacggtaatcactatgccgatgttcacaggcaagaggcagagcgaacgctcaacggagccgggactacgaacgctacactcaaccagaaagagagcttcttctctcacctccgcaagagggctcgccgactctccggtcgcaaccaggccaatctggcgaccgatgatatcgaagccaacgctggctgtatgccgtggtcaaaccgttcttcgctcgctttggactctgtgaatgcgggagatgcgaagcagaattccgacttgaacgacttggacagggctttgcagaatgtcaagtactcgctggactcggccgctctcggaaacgtccctgtccaaatcacttcgacgggggatgtcagtaagccacagttcttcaccacgaacagccggcccgcgcttacgaac

SEQ ID NO: 3832 - DNA, 408 bp, A.fumigatus
  unsure (395): Identity of nucleotide sequences at the above locations are unknown.
tcatcatctggtatttctaatgcgttgctctcgttatggacgttgactaacagacacagctgcttcaccgactgcgcggcggccactgttctggcatacgaggctgccgaagcggacgtcctccttcgcccgccccgcaagccgaaaaaggaacggctggtcaactggaagctcatcctccaggcatatggagtgattggcatgctggagactctgacatcgtttgccatggcgtactggtatctgcagcgcaatggcatcccattctcagctctgtggttcaagttcggcgtggtcccagccaacgtcgatcctgactggtacactgcgcgactgaacgaagccagttccgtctatttcatcaacttggttgtcatgtatgctgcaccccatancgcgtgtacgaga

SEQ ID NO: 3833 - DNA, 447 bp, A.fumigatus
tctccatgcgcgggcgccggctcctgtggtagaagaacgtggatgttagcagattgcttacaatcaagggcgcccctggatatcctcatcgaccgctgcacgcatgtcgtgaatgttgacggcaatgtgcaggctctgaacgccagtacgctcacccgactgaagcagattaaagaccaatggtcaaatgaaggcaaacgcgtgatcctcctagccaggaaaactttctcagcgggccaaatacagagttcgcccttgtcccacctgttcgaagccgaagtgatgaaccagatcaagactggtcttgtcttagtgggtctggtcggtatcgttgatcctcctcgagacgagattccagacgtggtcagaacattgaggcgggcagggatcagaatcttcatggtaggcgtcgcctcaagcccattcatctataagtctggcgattag

SEQ ID NO: 3834 - DNA, 612 bp, A.fumigatus
agtgagtggtacaaggtaacgggtgacttcggcctgacagctctcgagatcgcgcggcagtgcggtattgttactgcaggagtgactgtagacgatgcaacggccctaaagagatatccctcagtcaatgacaaattcaatgagaagtcccgatcgcctgcaattagcctcagcgggcgtgaactgatggctctgaacgaacatcagtgggatcaactcggtcagtacgaggaaatcgtcttctggagaacgactccagagcagaaactgcggattgttcgtgaattccaagcacgcgaggagatcgtaggcatgaccggcgacggcgtcaatgacgccccgtcgctcaaggcggctgatattggcatcgcgctgggaagcgggtcagatattgccattgaggcgtctgacatggttctcctggactctttctcggcgattgtcgaggccgtgcagtatggacgagttgtttttgataacttgaagaagaccatcatctacctgcttccggctggctcctggtccgagttctggcccgtcatgaccagtgtggtgtttggtcttccgcaggttttgtcctcgtttctgatgatcatcatctggtatttctaa

SEQ ID NO: 3835 - DNA, 276 bp, A.fumigatus
atgatggtcttcttcaagttatcaaaaacaactcgtccatactgcacggcctcgacaatcgccgagaaagagtccaggagaaccatgtcagacgcctcaatggcaatatctgacccgcttcccagcgcgatgccaatatcagccgccttgagcgacggggcgtcattgacgccgtcgccggtcatgcctacgatctcctcgcgtgcttggaattcacgaacaatccgcagtttctgctctggagtcgttctccagaagacgatttcctcgtactga

SEQ ID NO: 3836 - DNA, 195 bp, A.fumigatus
ctcaagggagttttggtaattgtatgtctttcgtactgcgctgagatccctgaacgacaatcatcagccatgtcttctgctgtagcagagttggagaattatctccagtctatgctggctctcaagcccccaggcgtctctggatctaagatcaacagcatcacgtcgctttgtacagccaacgttcaggtatga

SEQ ID NO: 3837 - DNA, 189 bp, A.fumigatus
  unsure (181): Identity of nucleotide sequences at the above locations are unknown.
tgggggtgtgctttaaaagggccctttattcctaagggactggttaatattcccggtcccaagacggccagtattcgtgcattcggttacgccaccaggaatgttcattgggggccagccttgccagttgggtggccctgcctggagcgtggtttctaccatggtagagttacagagtctnagcaatag

SEQ ID NO: 3838 - DNA, 693 bp, A.fumigatus
gggctgaaagcgtacgccgccgaccttccatcaagccacgcaagtttcgtattatcgaacaactgctctgtctatcatctcggatcgtgcgaactcctgtccatcatgcgggaggtgaacttcagcattcccaatgttaacaaagcctatgtcaatattagtacaaccctatatgaccggcgggccctcgattgcacatcaaccttacccctcataaactctctcaatcatcttgcatatctcactacatcctctgcccgtattcgcgatattctcaccgtcgatggcggcattgaaagacttgtgtgcatcctcaaagaaggccggagcagggatctcatggagatgtggaagtggagtctggcctttcaatgtgttgtgaatatcggagtgagaggttcggaaagtgtgagaacaagggttgtcgaggccgatatggtgccggtaattgcaacgatcctggataactacatcaaggttgtcgacaaggcacgagcccgggccgattccgagtctcaaagacagtcatccagacatcattcgaaagctgtgccaacatcaaatgatgtatctggacgtccgtccttcctggaacagccattgacagctgaacagcgtacctctcgtcgccacgccccccctagtctcgaaatcccacccgttttagacagcgggccctggaagatcagatag

SEQ ID NO: 3839 - DNA, 222 bp, A.fumigatus
atcgagatggattcatacttcacacggtaccacgaagtcaagacggccgaggtggagaagggcctcgacatccatatggggtacatggacaatgctgttatgagctatgcctgctttggggtctatgaggagctagcaaaatatctcgtccagcgttatcccaataactttcggttgcaaaagtactaccctgcacaactgacccgcgaacagttccaatga

SEQ ID NO: 3840 - DNA, 321 bp, A.fumigatus
tttgtcgtaaaaagttggctccaaataaacgaccttgttgtagagccttggcagagtgatttcactatgaatcacttccatgcgatgccgtacgacaaggctctgaagcgtggcgcgaagagcctgcacttttcgacgtttcccatccttcccaacaagtctcatgtacttggtccactcggcatggtcattggacagagggttcgaccatggcttcagatcaaaaaagttgaccactatgggtttcaacttcctaagatcttgatcgtctctcgcctctatcttcctcttttcttgaagaacagcttcggtagcctctga

SEQ ID NO: 3841 - DNA, 1983 bp, A.fumigatus
  unsure (73): Identity of nucleotide sequences at the above locations are unknown.
gattctgccttggcagtcatccttggcaacacggtgtcaagttccttccatacccgcttttgtaccggggaangagaagtcagacgtgaaaaatgtgcgagccttgttgagatggcggcgacagctgctggccagtcttcgatgccttggaagagctattttgatcgtctcggccgttctggaatgacttttacaaggtgcatcaaagcttgcgaggataatagaggctcgtataagatacctccaccacctacacgacacagtggtcgctctggcgtcgcatatcccaggccacctcctcagcttgtgcggctcacctcggggacattgattgttgtacctcccaacttggttgaccactgggaagaacaaattgctcggcacagccaagggcttaaagttctcgtcttacgaaacatgtcgaatgctactcccaattcggatgacctcttgcagtacgacattatcttgttttcaagatggcgtttcgaccaggaggccggcgaagcagtcaacaacagacgcggcgtcttcaacaacacaatggagtctccattgtttagccttcattggcttcgtatcatcattgacgaaggccacaacgtagctggatctagccaaacttcaagaacaagataccttctggacaaattgcatattgagcgccgttggattgtgtctggaacaccgtccagcggcctttatggagtggaggtgagcttggcttcacacgaaacgaataccagcagcgacaccgatctatcagaggctaccgaagctgttcttcaagaaaagaggaagatagaggcgagagacgatcaagatcttaggaagttgaaacccatagtggtcaacttttttgatctgaagccatggtcgaaccctctgtccaatgaccatgccgagtggaccaagtacatgagacttgttgggaaggatgggaaacgtcgaaaagtgcaggctcttcgcgccacgcttcagagccttgtcgtacggcatcgcatggaagtgattcatagtgaaatcactctgccaaggctctacaacaaggtcgtttatttggagccaactttttacgacaaactaaacctaaacctgtttatattcgttttggcagtcaacgcaataacatcagaacgggaaggtgatgattacatgttccatacaaagaataagaagcatttgaggactttgatcaacaatctccggcaggctgggttttggtgggcaggctcgaatctggacctttctgcgaccgtgaagaatgctctggaatacctggagaaaaagagagctcatatgagacaggaggatatcacaactttgactgaggggatagagatagccgaaaaggcattctccagcggaccatggaatgcatttaggcagctgaatgaactgggtgtctacgttcgcgattttccttctcatgctcgaggcttgtgggcacttgacccttcgaaaccagacgctgagcccctccatatgggcatctaccaggcttgtcgcgcgcagcaatttgtcaaagaacacttgaaatcggtggacccagccgaaggcctcgctggagcgggcataaaagcccgccgtgagcaaacagaagctgcaaagaggcaaggccctgagttaggctttgcaaccttcccaaaggcttcgaagaaggcgccgaagaagtcattctccaaaggtctaatgaagtctctaccaccggactctcccctgacacagaccaagttgcttggtacgacatcggccaagctgtcgtatctacttagtcgggttatggaattgcacagtgaggagacgattattattttctatgatagcacgaattcgggcgtttggattgccgagggtcttgatctgcttggcattgaatacagcatgtatgcgagtacgcttagtcccgagctccggacgagttacttgaatcttttgcgagaaagcgaagaaaatccgataattttgatgggcctgcgttaa

SEQ ID NO: 3842 - DNA, 369 bp, A.fumigatus
accgtctacgtgacaatggtcatgtacggaccgacagcattcctgaccaagatctcactcctctggattatgaccagagtgttcagcccctatcgcaaagccgtttttttcatctacatcttcctagtaatcatgcttctctactacatccccgccgtgatcgtcaaaatccgcatctgcaacccaatcggtaaattttgggacgatagtataaacggcagctgcctggaccagtcggcaatcatcctcgccgacgcagtcgtcagcgtcgttagcgacgccatcatcctcatcctccctctcccgctgacactgagcctccaaatgtctatgcgcaagaaggtgcgcgtgacgggccccctcggcgct

SEQ ID NO: 3843 - DNA, 219 bp, A.fumigatus
ccatacctgcacatcttagaatccagaggttacccaacggtgcaactgactctcaacgttgcctttcacattattatgaatgaccatgtccactcttcccatgtaatttgtctgactgccgtctggccgcaaatcacaagaattatcactatcaagaaatatcactctctggaagccatgtcgaagcctagcataaactactatctgtccagttcctga

SEQ ID NO: 3844 - DNA, 1530 bp, A.fumigatus
  unsure (446): Identity of nucleotide sequences at the above locations are unknown.
cgtaccaaaggtgggttgcacagtcccttcaagaggtatgaggaacccggtcgctcaactcagcacagactacgtgattccactctcactccatccaagccgaaatcattctttttcagctcatatgccacattaacagctgtagttcgtgaagcgagctatgcgacgttgcccccgataacgattcgcggtcgatccttccactttgctcctctgggaccgattgccatcattctggccaacctcgtagtggtcctcgttttctgcttctacaaactggatacgacgaataaatggaaatgggaagacgtcggctatcgaaccggctttgttgccatttcccagctgccattgatctttctgctggcgggaagacaaaacatcattggattgtttgttgggttgagctacaaacgcctgaactggttccaccgttggatttctangactctatggttgactgcgactattcacatgggcttctggttccgaaactgggcccgatatgactatatcacgtatgagctgcagaacgacgtcctgacacaacgaggatttgctgcatggtgcatcctgacattcatcgtcatctcatcggcggcgccaattcgaagactgagctatgaactgttcgtcttgcagcatctggtgacgttcgctgggttccttgctgcagtctggcttcatgcgcgggcggaggtcaaggcttgggtgtggatttccataggatttctggtgtttgatcgggtagctcggtatgtgtgggcagcatatgccaacctgtcaattttccatgcgtcgaaatcaaatccgcatcctctttgggcgaacgtcgcaactttcactccattaccgggtaacgtcactcggattacagtcgagaatccaggtgttcggtggaagcccggacagcatgtgtttctcacttgtcactccatcgtgcctctgcagagtcacccattcaccatcacttcgattccggacgacggtaagatggaattctttgtgcgagccgaaaagggtggtacaaggcggttcttccgttacgcctcgaagcaccatcttgccctcggatccggcgaggtttcaactgcccaacgacctcgcacggtgtttatcgacggtccatacggcaggatccgggccctgaggcaatttgacagcgttgttctcctcgcaggcggcatgggagccacttttaccattcccctattgcgagacatcgttgcagggtggaaagcagaatgtgctggaaattctacacgccgcattgcggcgaccaagcgaattcgatttgtgtgggtcatcaagtcccgcgctcaactcagctggttcgaaactcagatccagtctgtattatccgacgtcgacaaatgtcgacaggcccaacctgatatgatcagagaatgggaagtgagtatctacatcacttgcgaattagaaactggaacaccaaccaaccgaaaaacccctggtctacaaaccgccatcttcctcccaacgaaaaccccaaagggcattgaacccccc

SEQ ID NO: 3845 - DNA, 474 bp, A.fumigatus
agagaaattttttcacacttcggaaatctcacctaccctcacattcttattgatctagcgtttatggtgtcggactcgaaggatgatacgttgggaatgctgacgcgtatgctcgaggaggtccaaaacgatcctgatcccaagatgacgttcggagaaatttcggtcatacaaaaggattttgggcagaaggtgcagcaggatgtggaaagcagacatggatttgctgcacaggcgggacggaggaaactgatggcccaggcgaggaattggctgctgagtgctaccctacgcccgacgcatagctgggtttactggagagacgccgatgttgagactgctcctcgaactatcctggaggacttgatgcggcatgacaaagatgtcattgtacccagtaggttgtaccctctggatttttgcgatttgcgatctaataggcctggcaatagatgtctggcgaccactccctga

SEQ ID NO: 3846 - DNA, 447 bp, A.fumigatus
tgcggcatgacaaagatgtcattgtacccagtaggttgtaccctctggatttttgcgatttgcgatctaataggcctggcaatagatgtctggcgaccactccctgactggttgggtggggaacagccctatgacttgaactcatggcaggagtcggagacggctttggctctggctgaaacattggacgaggatgcggtgattgtagagggatatgccgagtatgctacctggcggcctcatctcgcctaccttcgtgatccatttggtgatcctgacatggaaatggagttggatggtgtcgggggtgtcagtatcttagccaaggcaaaggtatttcgttctggagttcattttcccgctttcagtttcgagaagcacgccgaaactgaagcgtttgggaaagtaagtgtcgtcttgattccttgtgcggtgcgcaaatgctaa

SEQ ID NO: 3847 - DNA, 288 bp, A.fumigatus
atggctaagcgaatgggattatcggtcatcggtcttcctcactacacgatctggcacctttatgaacccagcgtagacgaccttagacacatggaagaaatggagcaggagcggaaggctagggagagggaagagaaggagcaagccgaacgagctgagcgcatgaaggccctcttcgtggaacccgggccgcaatgggatatcgacaaagctttcgtgcaggattcaatccaaactgacaaagaggggcgttttcaacacgccacagacggacaattgtcaaatcta

SEQ ID NO: 3848 - DNA, 663 bp, A.fumigatus
  unsure (8): Identity of nucleotide sequences at the above locations are unknown.
tgttatgnttgccggggagcacccaaattgtgtcgtaattttcaaactaattgcattacactgtcaagggttcttttgctcttaacccaggtgagctatgtttaccatctgttctcaaatgatggcgccatcgccaacgcagctgccaacgtcggatctcatttcatcttgaacaacctctttaccctcgcctggatccttttatggactcgcggccacttctgggcctcagaagtcatgctggccgcaaactacctcaatcagcatgctgcctactggcgtcaccgaaccctgccgacgtttgtacatctatcggcaatcgcaggcccctacgcctggacgctgatggcacttttctggaatggagccgtcgcagttggcagcaatagtttccccgctcgtattgctgccaatatcttcatctggttgattttcgccttcggctcgacccacatcttggcgacccaagatgacctcttgggctactgtctgacgttcttgactcttggtaagtctggcctaccttgtatgggagagacacagaggctgactctttgcagccttggccatcgagcaactagcaatcaaggtcattgctctgcaatggatctttgcctttgtcatcttcgcagtcttcctcgtcgagtcgatttacctctctag

SEQ ID NO: 3849 - DNA, 216 bp, A.fumigatus
ctctttgcagccttggccatcgagcaactagcaatcaaggtcattgctctgcaatggatctttgcctttgtcatcttcgcagtcttcctcgtcgagtcgatttacctctctagcaccaagtactccggtcgcgactcgctattccgtagaattacggagcctgagcctactgaccgcgagagagagcctctgctcaacagtgccgccaatccttga

SEQ ID NO: 3850 - DNA, 189 bp, A.fumigatus
ttattgatgtgcaccaagtctcatgaactgtatcatgtgctctcccctctccatttgctccccctaccttccagtctattaccacttactcaaatatccgataataacccctctgactggctaaaacttattgattatctgcttgaacttaccttctgctgcgttgtcctactatattgcctaccttaa

SEQ ID NO: 3851 - DNA, 447 bp, A.fumigatus
gtatcgggacggatatcgggggctcgatccgcatcccagctgccttgcagggtctttactctatctgtccgacaacaggccgtgtcccgtgggactgttctttgtgagattcatcaaaaccatgcgtcccggaagaacggctggactgacgcgcattacagtatgcatcagcactaccttgttcccccagtcgcagggcccatggctcgaagcatcacgacaattgagtactttatgcagtcacttctcgattcgaacccctgggacatcgaccccggttgcatacccattccgtggaggaaggagttagcggccatgcctgaccgtaaactcaagttgggggtcatcttcgacgacggagtggtcaagccacagccgcctataactcgtgctctacgcgaagtaacaagaaaacttgcagcagctggccatgaaggtattctctga

SEQ ID NO: 3852 - DNA, 276 bp, A.fumigatus
tggtatgcgtgctgcctcagtctgtctacgtctgctgacaagactcagatgtctgactcatacaatcacatcttcggccaatctatcaacgcgttcaaccacgagctcatctccggcggcagctctggaggcgaaggtgctctgctcggtgcgcgagggagcattctaggtatcgggacggatatcgggggctcgatccgcatcccagctgccttgcagggtctttactctatctgtccgacaacaggccgtgtcccgtgggactgttctttgtga

SEQ ID NO: 3853 - DNA, 915 bp, A.fumigatus
  unsure (21),(33): Identity of nucleotide sequences at the above locations are unknown.
tttacgcatcacttttgcccnccgtcagctaanatcgaccacggcctgtacgacggaacgcttctccgcatattcggcgagcacttccaggcttaccaagacaatgttcctgtggaccgcttcacttcattcaaagactttgcattccacatctggcagatggacaagtcgcgcacgctgtcgttctggaagcaatctgagaagcaccctattgccttcgaattccccagcagcagtggcaccgaaccacgtatcaactctgtgcatgtccacaccatcaaccttgagtttgatgcgttcgccaagtccaccggtgccactgtctccatcatcttccagtccatcttccagctctggctggcgctgcgcagcaaccaacgcgacgtcgctttcgactacctctacaccggtcgcaacattgacctgcctgaccctcaaaccatcaacggcacctgtgcaaacttccttcccatgcggtcgaaagtggacccgtcaatgcctgtgtcggaattccttcgtcaaacccaggatgaattctggcagtacaccgaaaacagtacggtcggcatggacgagatccacgaagcctgtgaaacgacgcgtgaaggattctcgaacaaaactctcttcctcttccagccatttgaaccggccccggcgacagcaaagcaatatgagaagtggattgtgatggccaagtcccaggtgacgatgccgcagccatatgcggtcgtatttgaggttgtcaagacagcggatgtcaacgagtataagctcaagtttgcctttgacaaacgtgtttatgagaaagaacaagtacagggggaggcacaggtgattgagaagttgttggccaaggtcatggagaatgctgaggcgtctgtgggtgatgttctgggatcgtttcgctcttga

SEQ ID NO: 3854 - DNA, 690 bp, A.fumigatus
  unsure (20),(32): Identity of nucleotide sequences at the above locations are unknown.
ttacgcatcacttttgcccnccgtcagctaanatcgaccacggcctgtacgacggaacgcttctccgcatattcggcgagcacttccaggcttaccaagacaatgttcctgtggaccgcttcacttcattcaaagactttgcattccacatctggcagatggacaagtcgcgcacgctgtcgttctggaagcaatctgagaagcaccctattgccttcgaattccccagcagcagtggcaccgaaccacgtatcaactctgtgcatgtccacaccatcaaccttgagtttgatgcgttcgccaagtccaccggtgccactgtctccatcatcttccagtccatcttccagctctggctggcgctgcgcagcaaccaacgcgacgtcgctttcgactacctctacaccggtcgcaacattgacctgcctgaccctcaaaccatcaacggcacctgtgcaaacttccttcccatgcggtcgaaagtggacccgtcaatgcctgtgtcggaattccttcgtcaaacccaggatgaattctggcagtacaccgaaaacagtacggtcggcatggacgagatccacgaagcctgtgaaacgacgcgtgaaggattctcgaacaaaactctcttcctcttccagccatttgaaccggccccggcgacagcaaagcaatatgagaagtggattgtga

SEQ ID NO: 3855 - DNA, 204 bp, A.fumigatus
tcccccagtaataattgcggatccggcctgctccgaggtgaagacctagtactctactatcaattcgacgtgcgggccttgcgcaagcttgagatatggtatatagccatcattacatcccttgtgtctattcctgcgatcgtctttttatttatccatacacccgagaaagggcccatgtatggtggcgtaactgtaagttag

SEQ ID NO: 3856 - DNA, 1194 bp, A.fumigatus
  unsure (808): Identity of nucleotide sequences at the above locations are unknown.
gcattggaccctccggtagcaaccctggatgagttcgtcaagcaggtgcttcccgccgacatcctgtccaagaaagatctcacggtcacccctccgagcgccgacatcaacctgcctcgctccagtgtacacggtggcttgggagagacggatatgctgaagctgcttgagacctaccgcaagcagattgacatctccggcaagtcatacctgggaaccggctactaccccaccattgttcccccggttatcctccgcaacattctggaaaaccccgcttggtacaccagctacacaccctaccagcctgaaatcagtcaaggccgtctggaatcgctcctgaacttccagaccttgaccgccgatctgaccggcttgccattcgccaatgcttccgtcctggatgaggctaccgctgccgccgaggccatgaccatgtctctggccaccctccccatggctaagcagaagaagcccggcaaggcgtatgtggtgtcccatctgtgccaccctcagaccattgccgtcatgcagtctcgcgctgaaggattcgggatcaatctggtggtgggtgacatcatggcgaacgactttgagctggtgaagaaacagggtgacaacctcattggtgttctcgcgcaataccccgataccgagggtggtgtgtacgatttccaggctctgagcgacagcatccacgccgctggtggcaccttcagcgttgctaccgatctcctcgcattgaccctcctcaaggctcccggtgagttcggtgcggatatcgcgtttgggaatgcccaaagattcngtgtccctatgggattcggtggtcctcacgcagctttctttgcctgcgccgacaagtacaagcggaaggttccatggacggttgttcggggggtccaaggaacgtctgggcaaccggggcttgaagatggtttcggcagacccgggaaaaacacatccgtcggggaaaaggccactagcaacatttgcaccgctcaagctctgcttgccaacatgagtgccatatatgcggtataccacggtcccggccggcctcaagtcgatcgctcagcgtgtcatggccatgacatcgacgctgcaggagaagctcactgccttgggttacaatgttcctgtcaagggcagcgctattttcgacaccctgactgtcgagtttggcagcagtga

SEQ ID NO: 3857 - DNA, 282 bp, A.fumigatus
ggagatcggcatcaagtccattccccccaacttggaacggacctccccctatcttacccacccggtgttcaacacacaccattccgaaaccgaaatgctacgatacatccgccacctcgagtcgaaagatctgtctctcgctcattccatgattcctcttggctcctgcacgatgaagctcaacgcaaccaccgagatgatccccgtctcctggcccgagttctcccagatccaccccttcatgcccgccgacaaagccaaggggtacacgcagatgattga

SEQ ID NO: 3858 - DNA, 1266 bp, A.fumigatus
gtgccatatatgcggtataccacggtcccggccggcctcaagtcgatcgctcagcgtgtcatggccatgacatcgacgctgcaggagaagctcactgccttgggttacaatgttcctgtcaagggcagcgctattttcgacaccctgactgtcgagtttggcagcagtgaggaggctgatgccctgattgcgaccgctcaggagcagaacatcttcatccgccgcgtgtcttccagcaaggtcggtatctctcttgatgagaccgttggtcgcgaagaggtcaagtccctcttgcaggtgtttgccaagcacgctggcaagggcgaggttgagctctctgaggagatcggcatcaagtccattccccccaacttggaacggacctccccctatcttacccacccggtgttcaacacacaccattccgaaaccgaaatgctacgatacatccgccacctcgagtcgaaagatctgtctctcgctcattccatgattcctcttggctcctgcacgatgaagctcaacgcaaccaccgagatgatccccgtctcctggcccgagttctcccagatccaccccttcatgcccgccgacaaagccaaggggtacacgcagatgattgacgacctcgaacggcagctcgccgacatcaccggcatggccgagatcaccgtgcaacccaactctggtgctcaaggcgagtttgctggtctgcgtgtcatcaagaagtaccatgaagccaacggaggcgagaagcgcaatatctgcttgatccctgtctcggctcatggcaccaaccccgccagtgccgccatggccggtatgcgtgtggtctcgatcaagtgcgacaccaagaccggcaacttggacctggctgacctcaaggccaaatgcgagaaacacaaggatgaacttgcagccatcatgatcacctaccctagcacctttggtgtgtacgagccaggtgttaaggaggcctgtgagattgtccaccagcacggcggacaggtctacatggatggcgccaacatgaacgcgcagatcggtctgtgctctcccggtgagattggtgccgatgtgtgccacttgaacctgcacaagacgttctgcattccccacggcggtggtggccccggcgtgggtcccattggcgttgccgagcacctgcgtcctttcctgccttcgcacccggccagtgagtacctgcaatccaagcgtgcggcgacctcgtcgccccccatcagcgctgctccttggggtagcgcc

SEQ ID NO: 3859 - DNA, 828 bp, A.fumigatus
ggcgctaccccaaggagcagcgctgatggggggcgacgaggtcgccgcacgcttggattgcaggtactcactggccgggtgcgaaggcaggaaaggacgcaggtgctcggcaacgccaatgggacccacgccggggccaccaccgccgtggggaatgcagaacgtcttgtgcaggttcaagtggcacacatcggcaccaatctcaccgggagagcacagaccgatctgcgcgttcatgttggcgccatccatgtagacctgtccgccgtgctggtggacaatctcacaggcctccttaacacctggctcgtacacaccaaaggtgctagggtaggtgatcatgatggctgcaagttcatccttgtgtttctcgcatttggccttgaggtcagccaggtccaagttgccggtcttggtgtcgcacttgatcgagaccacacgcataccggccatggcggcactggcggggttggtgccatgagccgagacagggatcaagcagatattgcgcttctcgcctccgttggcttcatggtacttcttgatgacacgcagaccagcaaactcgccttgagcaccagagttgggttgcacggtgatctcggccatgccggtgatgtcggcgagctgccgttcgaggtcgtcaatcatctgcgtgtaccccttggctttgtcggcgggcatgaaggggtggatctgggagaactcgggccaggagacggggatcatctcggtggttgcgttgagcttcatcgtgcaggagccaagaggaatcatggaatgagcgagagacagatctttcgactcgaggtggcggatgtatcgtag

SEQ ID NO: 3860 - DNA, 870 bp, A.fumigatus
  unsure (267): Identity of nucleotide sequences at the above locations are unknown.
gcgatcgacttgaggccggccgggaccgtggtataccgcatatatggcactcatgttggcaagcagagcttgagcggtgcaaatgttgctagtggccttttccccgacggatgtgtttttcccgggtctgccgaaaccatcttcaagccccggttgcccagacgttccttggaccccccgaacaaccgtccatggaaccttccgcttgtacttgtcggcgcaggcaaagaaagctgcgtgaggaccaccgaatcccatagggacacngaatctttgggcattcccaaacgcgatatccgcaccgaactcaccgggagccttgaggagggtcaatgcgaggagatcggtagcaacgctgaaggtgccaccagcggcgtggatgctgtcgctcagagcctggaaatcgtacacaccaccctcggtatcggggtattgcgcgagaacaccaatgaggttgtcaccctgtttcttcaccagctcaaagtcgttcgccatgatgtcacccaccaccagattgatcccgaatccttcagcgcgagactgcatgacggcaatggtctgagggtggcacagatgggacaccacatacgccttgccgggcttcttctgcttagccatggggagggtggccagagacatggtcatggcctcggcggcagcggtagcctcatccaggacggaagcattggcgaatggcaagccggtcagatcggcggtcaaggtctggaagttcaggagcgattccagacggccttgactgatttcaggctggtagggtgtgtagctggtgtaccaagcggggttttccagaatgttgcggaggataaccgggggaacaatggtggggtagtagccggttcccaggtatga

SEQ ID NO: 3861 - DNA, 186 bp, A.fumigatus
tttatggatcgcaagaatgccttgaagacaaccagccacattatacaggggatactgcatcatttcactgctgagctccagattggccaatctgagcttttaactacagccaacacggcctatgttattgtggctgatgatcccagagaatcgttcgactggcaattgaaaatcattaacacctga

SEQ ID NO: 3862 - DNA, 576 bp, A.fumigatus
  unsure (427): Identity of nucleotide sequences at the above locations are unknown.
agtggactaatagtcctccttggccaacataagtctcccgctaagacatccactgtagaccttgagccctttgtacgaaaggtcgtgctcaacgccatggtgaaaatcgtctgcgagattctgtgcaagcccggattcaaagaattttacctggaaaagcaccgatggtacgtggaaaagctgtggcggtacgttggacgtcttgtcccagacatacccaactaccagaccgagggccgcaccaggatcgcgcaaataatcgcaaaggggcagggtctctcagtcgacatgcttctgactcctctggaatatgtgcattatttcccggaaagcgatgatgtctttgacccgattgagatggtcaacatggacccaaccaacgacagatctccgggcgagctccggcgcttgtggttcagaatcaaantagcctacacgcccgtcacctacattcgtgcaaactttgaagaatcatcgaataccgagcttgtcttccggagtgaggtgctgctgatgcccgagaacagtgcggcactcatcccggagtccctgatatctggccttgatgggaactga

SEQ ID NO: 3863 - DNA, 369 bp, A.fumigatus
ggcgtcaattaccttcttgcccctgttaacttcggaatcctccttgctttcccgcggttacgcgtctgggccgcaccagcgggttttgtgacaatgtccctggccctggcgctcagctcgttgtccacgaccacaacggagttgatcatctcccagggtgttttctacggccttggcgcgagtgtcgcgtacacgccgaccatcatattcatggatgagtggtttgcgagacggaaggggcttgcgtttgggattatgtgggtgagtatcccaactctctgcagcttatattaccatactaaaaaaaaaagaaggcaggaacaggtctcgccggtgtcgtacttccagttgtgctacaatggcttctga

SEQ ID NO: 3864 - DNA, 345 bp, A.fumigatus
ttctgcgacgaggcgctgagcaccgagggaggagagtacactgctcttgtgactacccccattaagcgcgagaatgtcaacgatcgctggacagtggcatacactgccgtaggtgaaagtttcacgtttggcgacaaggagatccctgcgaagccggaagatttcgaatttgcgagcaggttttggtctctcgctgagaagttgctggcagagggcaagatcaagccgcaccggcccagggtgtgtccggatggattaaagggtgtgctgaatggcctgcagctcatgagagagggcaaggtcagcggagaaaagttggtgtacaatgttgctgagacgccttga

SEQ ID NO: 3865 - DNA, 213 bp, A.fumigatus
aaaaaaaagaaggcaggaacaggtctcgccggtgtcgtacttccagttgtgctacaatggcttctgaatacgtacggataccgcgtcaccttgcgcgcctgggctgtgatcctcttcgtgcttgcggcgcctctgctttattttgtgaaaccggcgcgtgcctatctcggcgtcgtccagcatgcgcacgttcaacctctctttcgtccttga

SEQ ID NO: 3866 - DNA, 336 bp, A.fumigatus
gtccacatgccgaatgcatgggtatggccagctaatatgtcccagggtcgtcccatgcgtgtccgtaacaacgcatacattcagaactgggaggagaaccgccgagaggagatgaaggagcttacatccaagggaatcatccctgtcgagcacgattttgagaacctcggtgacgatgttgatgacgagactctggacaacgctcgcccgttcctgatgggtaaggtttccgctgtggtctcggagaagaagcccgccaaggctatcgtcgacgagatcgtctcggacgctgctgctctcttgaagcagggcaacaggatgcttgccaagctgtag

SEQ ID NO: 3867 - DNA, 891 bp, A.fumigatus
cgtagtgtttcttcggtagagcaaatccgtaccaccgtcaccgatctggtcaagatcaaccaccccgtcctggtggcaggtatgaatgtggccgctggtcccaagctggccgccgctgtcaccaatgctggtggcctgggtgtcattggtggtgtcggctacacacctgaaatgctccgtgaacagattgcagagctgaagagctacctgcatgacaagaacgcaccttttggtgtcgatcttctgcttcctcaggtcggaggaagcgctcgtaagaccaagtcagaactccttcctttttatatatactctatgctaggacccaggatgctgacacgtcttttttctagctacgactacaccaagggcaagcttaacgagctggtcgatatcatcattcaggaaggcgccaagctcttcgtatccgctgtcggtgtgcctcccaagcacgtcgtggaaaaacttcacgccgctggtgtcctttacatgaacatgattggtcaccccaagcacgttcagaaggcccttgatgctggtgccgacatcatctgcgctcagggtggtgagggcggtggtcacactggtgatgtacctaccaccatcctcatccctactgttgccaagctgtgccagggcaagaagagccctatgactggccagcccgtgcaggtcgttgccgctggtggtctgttcaatggcaactccctcgccgctgctctgatgctgggtgcctccgctgtctggatcggtacccgctttatcctttccgatgaggccggtgctcctgttgctcaccaggaggctgtgcgcaccgccggttttgaggacaatgttcgcactatcatcttcactgtaagtccacatgccgaatgcatgggtatggccagctaa

SEQ ID NO: 3868 - DNA, 933 bp, A.fumigatus
  unsure (19),(68),(69),(80),(115),(119),(145),(148),(198),(218),(256),(280),(305),(306),(339),(372),(373),(381),(396),(403),(421),(428),(463),(466),(473),(478),(524),(559),(584),(585),(597),(608),(619): Identity of nucleotide sequences at the above locations are unknown.
caaccaaaaaaaaacacanaaaaccacaacccaccaaccaaaaaaaaaaaccccaccaacacccaaannaaaaccaacanaaccccaccaaacccccacacaccaaaaaaaaaanccanaaaccaccaacaacaacccacaaaanaanaaaacaaaacccccccaaaacaacccaaaaaaacaccccccaaaaaaaanaaccaccaccaaaaaccaancccaaaaaaaaacaacccccaaaaaaaaaaaaaacccncaaccaaaacccaacccccaccanacaaaacaccaccaaaaaaacacannccccaaaaacccaaaccccacccaaaaccaaancacaccaaacaaaacaaacccacaaaaaaaacnnacaaaaancaacaaccccccaancaacaanccaaacaaaacaaaaccncaaaacnaaaccaaaaaaaaaaccccaccaccacccaaccanaanacccaanaaaancaaccaaacccaaaaccccccccccccaaaaaacccacccccaaancacaacaaccaaacacccaacccccaaccaccacncccaacacccccacacaaacaacanncacccccaaccncccaaaacccnacacaatcacnacannnannncnacaancnnncanacnnaaacaccgtccacccctccccctcccccatctggcccgcgcgactgctgctttcgccgcgccgtctcccactccaaccattccctccaatcgctaaactcctggccgtcggctggccgccccttctcgccccagatatacttccggccgaattcggcgcgcttgaaggcgtgcggttcggcgacggcgtggatgcatgcgggggtgctggttgttacggcgcgggcgtaggcattgccgcgggagccggcgccgatgaccaggaaacggaggctacgcccttttga

SEQ ID NO: 3869 - DNA, 876 bp, A.fumigatus
  unsure (18),(67),(68),(79),(114),(118),(144),(147),(197),(217),(255),(279),(304),(305),(338),(371),(372),(380),(395),(402),(420),(427),(462),(465),(472),(477),(523),(558),(583),(584),(596),(607),(618): Identity of nucleotide sequences at the above locations are unknown.
aaccaaaaaaaaacacanaaaaccacaacccaccaaccaaaaaaaaaaaccccaccaacacccaaannaaaaccaacanaaccccaccaaacccccacacaccaaaaaaaaaanccanaaaccaccaacaacaacccacaaaanaanaaaacaaaacccccccaaaacaacccaaaaaaacaccccccaaaaaaaanaaccaccaccaaaaaccaancccaaaaaaaaacaacccccaaaaaaaaaaaaaacccncaaccaaaacccaacccccaccanacaaaacaccaccaaaaaaacacannccccaaaaacccaaaccccacccaaaaccaaancacaccaaacaaaacaaacccacaaaaaaaacnnacaaaaancaacaaccccccaancaacaanccaaacaaaacaaaaccncaaaacnaaaccaaaaaaaaaaccccaccaccacccaaccanaanacccaanaaaancaaccaaacccaaaaccccccccccccaaaaaacccacccccaaancacaacaaccaaacacccaacccccaaccaccacncccaacacccccacacaaacaacanncacccccaaccncccaaaacccnacacaatcacnacannnannncnacaancnnncanacnnaaacaccgtccacccctccccctcccccatctggcccgcgcgactgctgctttcgccgcgccgtctcccactccaaccattccctccaatcgctaaactcctggccgtcggctggccgccccttctcgccccagatatacttccggccgaattcggcgcgcttgaaggcgtgcggttcggcgacggcgtggatgcatgcgggggtgctggttgttacggcgcgggcgtag

SEQ ID NO: 3870 - DNA, 741 bp, A.fumigatus
  unsure (17),(66),(67),(78),(113),(117),(143),(146),(196),(216),(254),(278),(303),(304),(337),(370),(371),(379),(394),(401),(419),(426),(461),(464),(471),(476),(522),(557),(582),(583),(595),(606),(617): Identity of nucleotide sequences at the above locations are unknown.
accaaaaaaaaacacanaaaaccacaacccaccaaccaaaaaaaaaaaccccaccaacacccaaannaaaaccaacanaaccccaccaaacccccacacaccaaaaaaaaaanccanaaaccaccaacaacaacccacaaaanaanaaaacaaaacccccccaaaacaacccaaaaaaacaccccccaaaaaaaanaaccaccaccaaaaaccaancccaaaaaaaaacaacccccaaaaaaaaaaaaaacccncaaccaaaacccaacccccaccanacaaaacaccaccaaaaaaacacannccccaaaaacccaaaccccacccaaaaccaaancacaccaaacaaaacaaacccacaaaaaaaacnnacaaaaancaacaaccccccaancaacaanccaaacaaaacaaaaccncaaaacnaaaccaaaaaaaaaaccccaccaccacccaaccanaanacccaanaaaancaaccaaacccaaaaccccccccccccaaaaaacccacccccaaancacaacaaccaaacacccaacccccaaccaccacncccaacacccccacacaaacaacanncacccccaaccncccaaaacccnacacaatcacnacannnannncnacaancnnncanacnnaaacaccgtccacccctccccctcccccatctggcccgcgcgactgctgctttcgccgcgccgtctcccactccaaccattccctccaatcgctaa

SEQ ID NO: 3871 - DNA, 996 bp, A.fumigatus
acgaggaccgtcgtaaagctcctcgtgcacgtacagccgtttttacatcatgcagatttggctcgagcagaggaaggagaggatcccaatctttgcgaacgtcagtcgaatgcgcatcagctaacaaacgaggtacattacctttggaatgaccgcatcgatgttgacatcgtcgcagacgatcgccgggtcgttcccccccagctccagcgtcacccgcttcagggtcttcgcacaactcgccatgacgcgcttgcccgtgagaatcgagccggtgaaactgatcttgtcgatgcccgggtgctccgtgatcatcgggccgaggtcatcgcctccgctcagcgcctggaccaccccgggcgggaagcactgcgccgccagctcggcgagcttcaggccgcaatacggcgtaaacggggagggcttgacgatcacggtgttccccgtgtacacggcggggacgatcttgccgacggccagcaggacgggaaagttccacggcacgatggccccgcagacgccgagcggggtgtaccgctggatgatctggtgttcgtccgtgtcttcgatgaccgtttcggggatctcgattgtcgggatggttcgagcccactgcacggccattccgacctcgacggtggactggctgagcggcttgccttgttcttgcgtcatgagccgggccagtgcctccttgtttgcttcgatcttgtcggcgaagtggttgagagcggtgcgacgctcggcgaacgaggtcttggaccatttgcggaacgcttggcgagcggattcaacggctcgatcgaggtcctcttgagtcgaaacgggaacctcggggttgggctgcctgttcgcaggattgatgccgtgacgggtttgcgaggtcgtggtcaactcattgttgatcacattgtggaaagtctggactggttagtagacggcgaccgaggggaacgcataattaccgtaatgtccaaagacatgatgatgaattga

SEQ ID NO: 3872 - DNA, 693 bp, A.fumigatus
caaacgaggtacattacctttggaatgaccgcatcgatgttgacatcgtcgcagacgatcgccgggtcgttcccccccagctccagcgtcacccgcttcagggtcttcgcacaactcgccatgacgcgcttgcccgtgagaatcgagccggtgaaactgatcttgtcgatgcccgggtgctccgtgatcatcgggccgaggtcatcgcctccgctcagcgcctggaccaccccgggcgggaagcactgcgccgccagctcggcgagcttcaggccgcaatacggcgtaaacggggagggcttgacgatcacggtgttccccgtgtacacggcggggacgatcttgccgacggccagcaggacgggaaagttccacggcacgatggccccgcagacgccgagcggggtgtaccgctggatgatctggtgttcgtccgtgtcttcgatgaccgtttcggggatctcgattgtcgggatggttcgagcccactgcacggccattccgacctcgacggtggactggctgagcggcttgccttgttcttgcgtcatgagccgggccagtgcctccttgtttgcttcgatcttgtcggcgaagtggttgagagcggtgcgacgctcggcgaacgaggtcttggaccatttgcggaacgcttggcgagcggattcaacggctcgatcgaggtcctcttga

SEQ ID NO: 3873 - DNA, 810 bp, A.fumigatus
ccagtccagactttccacaatgtgatcaacaatgagttgaccacgacctcgcaaacccgtcacggcatcaatcctgcgaacaggcagcccaaccccgaggttcccgtttcgactcaagaggacctcgatcgagccgttgaatccgctcgccaagcgttccgcaaatggtccaagacctcgttcgccgagcgtcgcaccgctctcaaccacttcgccgacaagatcgaagcaaacaaggaggcactggcccggctcatgacgcaagaacaaggcaagccgctcagccagtccaccgtcgaggtcggaatggccgtgcagtgggctcgaaccatcccgacaatcgagatccccgaaacggtcatcgaagacacggacgaacaccagatcatccagcggtacaccccgctcggcgtctgcggggccatcgtgccgtggaactttcccgtcctgctggccgtcggcaagatcgtccccgccgtgtacacggggaacaccgtgatcgtcaagccctccccgtttacgccgtattgcggcctgaagctcgccgagctggcggcgcagtgcttcccgcccggggtggtccaggcgctgagcggaggcgatgacctcggcccgatgatcacggagcacccgggcatcgacaagatcagtttcaccggctcgattctcacgggcaagcgcgtcatggcgagttgtgcgaagaccctgaagcgggtgacgctggagctgggggggaacgacccggcgatcgtctgcgacgatgtcaacatcgatgcggtcattccaaaggtaatgtacctcgtttgttag

SEQ ID NO: 3874 - DNA, 687 bp, A.fumigatus
ctcaagtgcgagtacggtgctttcgacaacgagcacgtagtgcttcccctcacaaagtatgatcatatcattgaccgcgactctccccgccccggccagcaggccttcgagaagatgacagctggtctctacctgggagagatcttccgtctggccctgattgatcttctggacagcagaccaggactgatcttccagaatcaggacaccagcaagctgcggaagccgtacttgctggacgcttccttcctggctgccatcgaggaggatccctacgagaacttgcaggaaacgcaggagctgttcgagcgcgaattgaacatcaagcccactctggccgagcttgagatgattcgtcgtctggccgagctgatcggtacgcgtgcagctcgtctgtcagcttgcggtgtggccgctatctgcaaaaagaagaacatcgagagctgccacgttggtgcagacggctccgtcttcaccaagtaccctcacttcaaggctcgcggtgcccaggctttgcgagagatcctggactgggccccgaacgagaaggacaaggtcaccattatggcggccgaggatggttctggtgtcggtgccgcgctgatcgccgcgctgaccctcaagcgtgtcaaggccggcaacctggctggtatccggaacaaagacgaaatgcagaaattgctttaa

SEQ ID NO: 3875 - DNA, 183 bp, A.fumigatus
  unsure (34): Identity of nucleotide sequences at the above locations are unknown.
agagctgtcatcaaacggtgcggggacatgtctncggtctctttacttcaattctacccccaatatcttttctacctgacctactgtccatgtggcataattcaaacagctgaactacaccgtaaaatgtggcagacccttgcctacaaaataaggaaaatggaaagaaacttaaaatcttaa

SEQ ID NO: 3876 - DNA, 216 bp, A.fumigatus
aatgctcgttattgttacgaatattataaccattgttattatgagggagttcccttttggattgagagaatacaggcggattatcagtccaacgatttgtaccttactacggagttgtgtatgtacgttatcctagaccccaccaaggcctctagaccaggaaatacctctttatttaagacaagagtaccaaatagagccgacaacaataagtga

SEQ ID NO: 3877 - DNA, 1029 bp, A.fumigatus
gctccgggtgacagactagcaggggatgttttcaacatccttggtgccgtccttcagggcgtgctacctacaatgatcatccttgccgtctactacacccgcgcagacattgttcttttgggccaatgcttctactaccggggattcacgctgcgagataaactgtctaatcccacttctcccgcagatatcaactctgaagaagagccttcgcagactagaaaggcaacggagcatacctctctactgcctcccaagtctaacggccactcacatcacgtcctggcacaagagcctcactatcagtcaggccaggcgggaccagcagcagcagcaactacttcacaagtgcggccgttaccatcgcatccggaccaccggcgacactctgcaacatcctttcgggagataatccatttgaacgtcgacgggacgcatctgtcacccgcaacacccttcattgaaccaacttccaaggaatatttgtctgctcgacgcatttccactcttcagactgtcctttttaacttgaccaccattgcacttgtctgcgccgcaggagtcctgggctggtatgtcagccctagctcttccaaaaacgaagaatcagacttgcctggagatgaccgcgattcatcctctcttaccttcgacaccgtaggccaggtgtttggctatctatgcgccgccctgtatcttggctcacgcctgcctcagattcttctcaactaccggcgcaaatctacggagggggtttccttgctatttttcctcttcgcatgcatcggcaacctgacctacgtactctctatcctggcttattcccccgtttgcaagcgacactctcatcaccctcacgactgtcgccctggagaagccgctgcgctctacggccgatatgtacttgttaatttgtcgtggttgatagggagctttgggactctcttgcttgacatgtgtattttcattcaatttttcttgtacaaagagaatggagacggcatagatgggagtagtgcctgtgactga

SEQ ID NO: 3878 - DNA, 198 bp, A.fumigatus
cagcgatacaaatcggaaatggatggaaaaaaggcgcttgtttggaagtattccctaggagttctgctggttggtttgctgattatgattctctgtacgcaaaatgcatatataggcgagaaagaagagaaggctatcgtgaaattcgttagaaagatatcttttcttcattttacagccatgcaagaatttccatag

SEQ ID NO: 3879 - DNA, 588 bp, A.fumigatus
  unsure (4),(39): Identity of nucleotide sequences at the above locations are unknown.
cagnctgccattcagttcccggtcccgtccggcgcggantacgcttttactctggatcctctgttcgctccgattgacccatctgcatcaaaagtttctgtgatgtcaacaaagattgaactcgtccttcgcaaaaagacagcgggccagaaatggggagcattagaagcgtcgtcgtcaagtgccaaacttgctgatcgacaggcgattataggagccacccccgccgccgaaagcgggccgtcctacccgacctcatctcgccgtggcgctaaagattgggataaagtcgcatcagcgctgacagcgaagaagtcaaaaggcaagggtaaggagcggagcgcggaaaaagacgcaaaagctggtgatgacagtggcgatgattccgatggcgcggattccatcgactctgactacggcactggcgatccagtggatgctttctttaagaaactgtatgccaacgcggacccagacacccgtcgggccatggtgaaaagttacgtggagagccagggcacgtctttgagcaccaactggaaggaagtgagccaaggcaaagtggaagcacggccacccagtgactag

SEQ ID NO: 3880 - DNA, 345 bp, A.fumigatus
ccttgctggctatctttctgtccaattgcctttagtgttgaggactcttccgaagcgattttgttgtttgcaattgctaagaaccatcgtttcttgacagacgtactactccttaccctcatcactatgatcgttaccggcgtctacgtctacctccccgaccatctcagatccatctacggccatctctattactactgggcgggcgaacgcccgtttgtctcgacgggtctgccttccatcggcgcggtattccgcgataatagcaccaaaaccctagagatggtgtatgacacggtcaaagatgctgccgcaacagccactggtccaatcgctgaattgtaa

SEQ ID NO: 3881 - DNA, 1806 bp, A.fumigatus
  unsure (28),(1506): Identity of nucleotide sequences at the above locations are unknown.
cccccgccggaggacagtcattctattntcagtcggcggtcggtgcgcagtattcccagtatcattgtcaatgatgttgggtctcggcctggatcgcggccgggctctcgaccgggctctcggtggtctgagcgcaaatggagcgctttgagagggaaacggtctggagagtttgacaggaggccggagtcaccgccgcctccacctcaaatcgagagaccgttcaacaagatctcgctcgatatcccgaacggttcacttgacggcctcggaccgcagtccatgcgattttcgaaacgtggcagtcttatcaaagaggaggataggcagcgcctccagcgtgagatctcgaagcatgaattgccgcagcaagaccagccgcagccagcggcagaatcatcaatagaacagtcagagcagaccgagacgggtgaaacaagtgcaccagtgaccgtagcggaggagaacagtgcggagccagaactctatggggcgcaacgacgccggacgaaaccattgtcgtatttgcgcgcgaggcacagcagcgttccaagcagagcgatctcggccgacgaggacatgctttcgcgtcgagttaggttgatgtacgagaaaggcgacgagaacgtgaccgattcggaggtggccaagtcccttgcaatggagaatggtgtgctgtgggaggaagttgcacccacaccgacggaggcttctgccgtatctggacgcagcgcgagtggtggggagtcagttgggcctgaaagcagcaacggttctggcccaaagagggagccccacgaactggccggtggtattgaatactggcaaaatatcaaggcaggcgatgtcgatcggtacggcttcattcgaagtactactttcaattcggccgacggtacggagcatagtccgatccagcgcgtttctaccagcctgcttctggcgtcagaaacaccgcgacggaaacattccatccgacctccatcagctcttgggggcaaccgatctttttcgggccgatcaccaacacgcaaaatatctgcgccatctatgcgtccctcgtcatcgcaaagcacatacagtgccactctccgacggtcaacatctcgattccgccaggcggctaatcatcttccgcataatcgcgatcggcggtttaaggacgaggcgcgtgacatgctgacacttccaagcgatgcggcggcttctggaacgggacgggactccgccgtagctcgcgcgatgcgcaagaaagagtggcaacgtgaggacaagtggacaaagatggccaagcctacccggagaaccgcactcggcggcgggatgacttttgaattcgacacgcagagtcctaagctgatcgagcggacatggaagggtatacccgaccgatggcgcgctacggcctggtacgcattcttagaggcaagcgccaagcggcgcagcgacagcccaacggaacaggagcttgtcgaggcttacaatgaattccagctcatctcgtcncctgacgatgtacagatcgatattgacgtcccgagaacgattaccagtcacattatgttccgccgccgttatcgtggtgggcaaaggctgttgttccgtgtgctgcacgcaatgtccttgtatttccccgatactggctatgtacagggtatggcggcgcttgcggcgaacctcctcgcctactacgatgaagaacatgcgttcatcatgcttgtccgactttgggagctaccacgaatggagcgggtgtcccaatctgggttctctgggtctgaatggaacccccccaatgaactttga

SEQ ID NO: 3882 - DNA, 237 bp, A.fumigatus
ttggcggcagaacatatttcggagcctaccatggattttatcttaatactcatttgcattctactattttcatccattattgtattatcgtacgaactgatcttcgaaattgaaacgagagacacctccagtgagtctcttattgtcattttattccacttgtcctattctaggtataagaatctcatactatccgttaacgccaagtggttcgagtcgcattatgctgcattttaa

SEQ ID NO: 3883 - DNA, 339 bp, A.fumigatus
tttcttgataccaagcagcctggtttcttttcccttcaagataaccactggcggtatagaagtccctttagaactgatacattcaataattgtaacctattcgcggttcccttggataactgtacgaggtctctcactatgttctactgcagtaataaccttagatattatacagagtcccattgcaaagctagtttcgtcaaagttccagatatcatcttcatgtatgctgtgttcttgaatagctttgcatacagtctcaaaccactgtctgataaccttaggatcctcctattttgccctctggtatgtaatcctttaattatatcttgtacgtag

SEQ ID NO: 3884 - DNA, 525 bp, A.fumigatus
gcgagggcggtcatagtcgcgctctcgatccctgtctctgtctctgtccctgtccctgtccctatccctgtccctgtctctgtccctgtccctggttcgactgcgatcacggtccctagatcgatcccagtcacggtatctttcgcgctcttctcgtctccggcgctcatatctttcctgtcgttccttttctcgttgctcttcaagtcgccgttcctcttcccgctggcgctcacgctctgcacgtcgctgctcctcacgctctttccgtcttgccctttcttcctcctccttttggcgttcgatctcgcgcttcttgcgttcctcttcggcctttcgacgagcttcttgctcttcgagttctctctgtttgcgcaccgtctcctgccattctcgttcgcgtatctcacgcttagctcttatctccgcagcgaaatcctcgtctgttttgttgccggcttgctcctctttcgcagcgagctcgtctccgacttgctgacgacggatctccctgacagaatctaa

SEQ ID NO: 3885 - DNA, 483 bp, A.fumigatus
tcgcgctctcgatccctgtctctgtctctgtccctgtccctgtccctatccctgtccctgtctctgtccctgtccctggttcgactgcgatcacggtccctagatcgatcccagtcacggtatctttcgcgctcttctcgtctccggcgctcatatctttcctgtcgttccttttctcgttgctcttcaagtcgccgttcctcttcccgctggcgctcacgctctgcacgtcgctgctcctcacgctctttccgtcttgccctttcttcctcctccttttggcgttcgatctcgcgcttcttgcgttcctcttcggcctttcgacgagcttcttgctcttcgagttctctctgtttgcgcaccgtctcctgccattctcgttcgcgtatctcacgcttagctcttatctccgcagcgaaatcctcgtctgttttgttgccggcttgctcctctttcgcagcgagctcgtctccgacttgctga

SEQ ID NO: 3886 - DNA, 426 bp, A.fumigatus
gagctaagcgtgagatacgcgaacgagaatggcaggagacggtgcgcaaacagagagaactcgaagagcaagaagctcgtcgaaaggccgaagaggaacgcaagaagcgcgagatcgaacgccaaaaggaggaggaagaaagggcaagacggaaagagcgtgaggagcagcgacgtgcagagcgtgagcgccagcgggaagaggaacggcgacttgaagagcaacgagaaaaggaacgacaggaaagatatgagcgccggagacgagaagagcgcgaaagataccgtgactgggatcgatctagggaccgtgatcgcagtcgaaccagggacagggacagagacagggacagggatagggacagggacagggacagagacagagacagggatcgagagcgcgactatgaccgccctcgctcaatag

SEQ ID NO: 3887 - DNA, 969 bp, A.fumigatus
agaccggagcttctatcccgtgaacgaggaaaagccgcgacattgatagagggtgcagttgatcggagcgacgtctacaagaaagccgaaaagcttattgatgcgctggcctcaaatcacctgcagttcatcttagattctgtcagggagatccgtcgtcagcaagtcggagacgagctcgctgcgaaagaggagcaagccggcaacaaaacagacgaggatttcgctgcggagataagagctaagcgtgagatacgcgaacgagaatggcaggagacggtgcgcaaacagagagaactcgaagagcaagaagctcgtcgaaaggccgaagaggaacgcaagaagcgcgagatcgaacgccaaaaggaggaggaagaaagggcaagacggaaagagcgtgaggagcagcgacgtgcagagcgtgagcgccagcgggaagaggaacggcgacttgaagagcaacgagaaaaggaacgacaggaaagatatgagcgccggagacgagaagagcgcgaaagataccgtgactgggatcgatctagggaccgtgatcgcagtcgaaccagggacagggacagagacagggacagggatagggacagggacagggacagagacagagacagggatcgagagcgcgactatgaccgccctcgctcaataggctaccgatcaccgcgatatcgcgattcgaggagagagaagtccgttactccgaaggagccaacgcaggcgcctccaccgcctccaccgcctcctgttgccgtagatgataagtcgctggaagaggccgctctccaactgctgcttaaagagggcgaggaacttgccgctaaggcgcgccagaaaccggaatttgactttgaagaagctgaggccatcgagaacggtcttaagcccccgccgactaaagcaaaaggcgcaacagaatcgagtattcctcttcaccacgggatgacggaacgcgtc

SEQ ID NO: 3888 - DNA, 1644 bp, A.fumigatus
gcgcaaatgcggatcttctacggcgtgtggcaaatatacatgcctgggtcttgcggacgttttttgaggattcgcaaggtcaaatgtgatgaggcctatccggcgtgccgtcggtgtctttcgactggtcgcacctgcgatggatatggcatctggggtggcggaagctccaacaggcctacgaaaccttcagctgtggctgtgaattctgcgcttgtcgtcagaccaatgatagattcccgactgccaacgaggatcaccaatgaagagggccgctatcttcagtggttcaaagaacgcaccgtgtcgaagatgtcaggctcatttttctcggaattctggagcgggttggtcattcaggccggtatgagcgaaccctcagtgctgcatgctgtccttgctctgagttcggtccacaggcaaggcgtcttgaccgatggtggtgtcaaggcgggggacatggaaatgataacattgacccggtatagtaaggcgatcaatttcctgcagcctcatttcaaggcaaagaaccggactgcctttcggacggctctcatcgtctgcattctgttcattgcgctagagctgcttcggggccattttgcatcggcgcgaatccaccttcaacaaggcttaaacctcctggaagggtctggtctgttgagaagacagggtggcgttcttgtagggcaaagtcaagtgtatgttgatgactggattgtgcatgcactatcgaggttgcacattcaactcgagctactaaagcaagtccaccgtggttcttccctacggctcgagatccccttcttggaatgcaaatcgttaacatttccctccgtgaaagaagcgtggtcttggcttcaccacctgatgggaaaagcttttaatttgaatcgagaagttcgtgaacagttctgcacagagagcaatctcccagcagagctgctccgccgtcagcgatccgtccatgagaatcttacctgctggctgaacacatacaaccacacaatccaaggcagtatgcggaaagatcaggcgcaaatctacgggctgcttcgcacatatcacaccatgataactatcatggtggcaacttgtcttcatcccggcgatgagatgatcttcgaccttcataccgaccaatttctggagatgatcaccacgctggcacagctctggaaattcctctcaacattttctgccttcggctctcggccggcccagtttttcatgtcccgttcgattggggatttgggttggattgctccactatactatacagccatcaaatgtcgcgtgcaccggattcgacttcatgcgatccggctgctggaaggcagcttccacagagaaggcttctgggattcgcaaatcctggcattcgtggcgcgaaaggtgatggagatcgaggaggtcgacttttatcaacttctcgattcaagggatgactttgagctgcattgccctccagaccaggaagatttgcttttcccgcccctgcctggatcttgcagactatctgatgtggaagtgaggctgttgggtgatcctgtcaatacgatttcaattctctgtagcccgaatgaccagggaacagatcgcaaaatatgcgttgcaagttacgatgtcgcattctaccgatga

SEQ ID NO: 3889 - DNA, 321 bp, A.fumigatus
  unsure (210): Identity of nucleotide sequences at the above locations are unknown.
aacacttactgcaagacagaagaacatcgaacctctcgtgtgactatgaccccgtccacgtatgacatgcatatgcgatcccagcagatacgctggtctctgcgtgctagtgctaaaaactatacatcccagtcagattcaactttcggacacgtcaagctggaagcatctccgcgagtgttcatcgactgcgaaacgggaacaggccancatcggactacgatgtccaaattgacccctatcgtcactcaggatactctcaacccggaaaccaccattaatcatgcttgccctcttttaaaagatgacacggttccatga

SEQ ID NO: 3890 - DNA, 1029 bp, A.fumigatus
  unsure (185): Identity of nucleotide sequences at the above locations are unknown.
atattaatccctttgagattgcacgtagaccaggatgccgtggactttatctgccgtttctttgagtttagggacgataatgcacccacaccgagttcaccagccgacattccgttcttgcaacgagtggaagttaacgctgtgcctgtcaaacttgacttcaagcccaagcgcgtagactacgntgggctccgatcaggccggacaaccgagttcatgaacttctttgtccttgatggcgcggatatggtcatgcgtcacgtcatcatttatggagtgtccggctttgataaactgggtcagacgctcaatgacatatggatgccagacatcaagagaaatcaacttccgggtgtccttgctggcctggctcccatcagatctctggtcaatgtgggaggcggtgttaaagacctcgtcgtggttcctatgcgagagtatcgcaaggacggccggattgtccgaagcatccagaaaggggcgctcgcttttgccaagaccacttcgaatgaactcgtgaagcttggtgccaagcttgccattggcactcaaacggttttgcaaggagcggaggagatgctgaccgcaccgactgcgacgacactgggctctgaagaagacatgattgacgaagaggaggcgaacaagatttcgccctacgcggatcaacccgtgggtgtggtacaaggcctccggggtgcgtttcgcggcttggaaagggacttgcttctcgcacgggacgccattgttgctgttcctggcgaaatcgtggagagtgggagcgcgaaagctgccgctaaggctgttctcaaacgtgctccaaccgtcatcctccgaccagcgattggagtctccaaggccgttgggcagacgctcctcggggctggaaacactttggacccgagcaatcgccgaaagatagaagatgtaagtgtcatggtgaagtatgtctctcgagtatgcttgctgacttctctgcttagaaatataaacgccattaagacagtcggtcatattgggcagctttga

SEQ ID NO: 3891 - DNA, 405 bp, A.fumigatus
ggtactcaacgatcgataccagataattgccaaaatagggtacggagtaacttcaacagtgtggctcgcgaaagacttgatgtaggtacagtgaatttgcttcagcccaacgagatgatgatcgatttgaataacacgcctcaaaccagtgcatcaatatacgtcgttttaaaagtctacgtaacggggcaatgtcgcgaccacgagcgagaactgcacatctacaagcagattaatcaggtggaaacaaaccatcccggtagaaatttcattcgcaaacttcgcgaccatttctatatccaaggccctcatggccgccacgtctgcctggttcacgagcctctcggaacgagtgcagatgttctggtgaagtcttcaccacggggctggaaggagccgcgccat

SEQ ID NO: 3892 - DNA, 459 bp, A.fumigatus
atccgtcgccctcatatccatcattgtgtagccaccttatgcttacatgccctactagccgcgggctctttcgcgctcatttttatgatgcagcgggccgcgcgaaacgcttggactatttgtgtccccggtgctcacaggggcttcaccatcttcctaccctccgcttcttgccgccgacgagtctcgccgctgtctagtctgagaaccacggttgtgccgcgtcgaacagctatgtcgtcctcgcagtggacgtgcacccccaggacttttcccacgtcaggcttcgagctacttgaccagtccattgagcttgacgaggaaacactcccgacttaccgacccgagaaatactacccagtcacccagggtgaggtactcaacgatcgataccagataattgccaaaatagggtacggagtaacttcaacagtgtggctcgcgaaagacttgatgtag

SEQ ID NO: 3893 - DNA, 447 bp, A.fumigatus
gacgagtgcatcgttgagtatagacaaccaatcaaatatgtgcaagcaggcaagcataaacatcggcggctaacaagacccagcgggtttatctgcaggatacccacagtacacgcctgctcccccctggatacaaaccagcccaccggggcacggctgcatcacccacactccgttatcgcacagcccgaagcttgccccgttgcacgcggcccctccccccgaacagcgcgcgccggccgtgggacagctacctgtgggagccgtcgtgctactcgtcgtcgttgtggacgacgtcgtcgaggttgtcgtgacactcgtcgaggtcgtcggggcactcgtcgtgctggacgtagtggtagtaggagtggacgtagaggtagtcgtcgaagcagtagtgggactcacagtcgtcgaccccgaccccgacccggaccccgaacctag

SEQ ID NO: 3894 - DNA, 747 bp, A.fumigatus
cgccgctcgcaccccagccagaaacccgctattggccataacctggctgacgtcccaggccatcacgcccccaaaggacgagaagcccttggtgtacgcgatgatctgcgccagcgcctccaccgaaacgtacccgcttcccgcggcggtcgagctccccggcacgccgaggaagaccttgacgttcttgttgcgcgagacggacttggcccaggtgtcccaggtggcgaagttgaagttgttctgggacgtggagccggggttgtacgcctgcaggccgcagtagttgttgtagaactggacccagatggcgtcgaaggagacggcgccgtcgagcatgggcccgtcggcggcgtccgggtaggggcattgcggggcggcggtgaggtactattgcttggaggggtcggaactgaacaaggagcggagctggttggcgaaggccggcatgttggcgacgggggactcaaagtccaagtcgaagccgtccacggccgctttgccgaaggggcggagagtggaggggttgttgctgggagggccgaaggtctgccagacgctgttggctccggcgatggcggcggactcactggtgaagccgccttcggtgtaggttgcaccgccaatggagaggaggatggtcttgccgagggattgacagatggggatgtcttctctgttgggcgtttagtggtttgcacgttactggagggggtggaagggagtactctatctgaggacagctga

SEQ ID NO: 3895 - DNA, 699 bp, A.fumigatus
aggcacaaacctcctcagctgtcctcagatagagtactcccttccaccccctccagtaacgtgcaaaccactaaacgcccaacagagaagacatccccatctgtcaatccctcggcaagaccatcctcctctccattggcggtgcaacctacaccgaaggcggcttcaccagtgagtccgccgccatcgccggagccaacagcgtctggcagaccttcggccctcccagcaacaacccctccactctccgccccttcggcaaagcggccgtggacggcttcgacttggactttgagtcccccgtcgccaacatgccggccttcgccaaccagctccgctccttgttcagttccgacccctccaagcaatagtacctcaccgccgccccgcaatgcccctacccggacgccgccgacgggcccatgctcgacggcgccgtctccttcgacgccatctgggtccagttctacaacaactactgcggcctgcaggcgtacaaccccggctccacgtcccagaacaacttcaacttcgccacctgggacacctgggccaagtccgtctcgcgcaacaagaacgtcaaggtcttcctcggcgtgccggggagctcgaccgccgcgggaagcgggtacgtttcggtggaggcgctggcgcagatcatcgcgtacaccaagggcttctcgtcctttgggggcgtga

SEQ ID NO: 3896 - DNA, 204 bp, A.fumigatus
cgggtttctggctggggtgcgagcggcgctaggttcggggtccgggtcggggtcggggtcgacgactgtgagtcccactactgcttcgacgactacctctacgtccactcctactaccactacgtccagcacgacgagtgccccgacgacctcgacgagtgtcacgacaacctcgacgacgtcgtccacaacgacgacgagtag

SEQ ID NO: 3897 - DNA, 297 bp, A.fumigatus
acgcccaacagagaagacatccccatctgtcaatccctcggcaagaccatcctcctctccattggcggtgcaacctacaccgaaggcggcttcaccagtgagtccgccgccatcgccggagccaacagcgtctggcagaccttcggccctcccagcaacaacccctccactctccgccccttcggcaaagcggccgtggacggcttcgacttggactttgagtcccccgtcgccaacatgccggccttcgccaaccagctccgctccttgttcagttccgacccctccaagcaatag

SEQ ID NO: 3898 - DNA, 768 bp, A.fumigatus
tacctcaccgccgccccgcaatgcccctacccggacgccgccgacgggcccatgctcgacggcgccgtctccttcgacgccatctgggtccagttctacaacaactactgcggcctgcaggcgtacaaccccggctccacgtcccagaacaacttcaacttcgccacctgggacacctgggccaagtccgtctcgcgcaacaagaacgtcaaggtcttcctcggcgtgccggggagctcgaccgccgcgggaagcgggtacgtttcggtggaggcgctggcgcagatcatcgcgtacaccaagggcttctcgtcctttgggggcgtgatggcctgggacgtcagccaggttatggccaatagcgggtttctggctggggtgcgagcggcgctaggttcggggtccgggtcggggtcggggtcgacgactgtgagtcccactactgcttcgacgactacctctacgtccactcctactaccactacgtccagcacgacgagtgccccgacgacctcgacgagtgtcacgacaacctcgacgacgtcgtccacaacgacgacgagtagcacgacggctcccacaggtagctgtcccacggccggcgcgcgctgttcggggggaggggccgcgtgcaacggggcaagcttcgggctgtgcgataacggagtgtgggtgatgcagccgtgccccggtgggctggtttgtatccaggggggagcaggcgtgtactgtgggtatcctgcagataaacccgctgggtcttgttag

SEQ ID NO: 3899 - DNA, 420 bp, A.fumigatus
caaacccaacagaacaaaaccaactccgccgtccagctcatccacaaacccaccggcatagtggtaaaatcccaagccacccgctcccggtcccagaatgagaaaatcgctcggcagatcctcgctgataaagtagaggagttgctaaagggcgatgcgagccggaatgccatccgggcagagcgtgcacgcaagaagaaggcgagcaagatgaagaagacacggcggaagtatcgtgagttaggaaagggggcgcaaaatgagaagcatgaagatggagacgaggtcgacgtagaagatgatacgggggatggttctgaggtccaaggagcgccgcatgtctctcgctgcgatgctgaagattctaccacccagaaaacttgtgataatcacgccgctgagcagaagcagctcggatga

SEQ ID NO: 3900 - DNA, 318 bp, A.fumigatus
  unsure (8),(165),(166),(265): Identity of nucleotide sequences at the above locations are unknown.
caaccacnaagccaacctcatctcccaagtcaagagcatcccccaggacacgagctctctacggatcgaagagaacacccctcagaacaagaagggtcatccccaacgaccagtttaccaacatccgcgaactggatatggacggggggtaccacaaaggcctcnncgaataaaaaattgcccctgcactgggcccctcaaacgggtttgaagatcacctccgccgcgggccgtaagttctccaaaaccccccttcaacctggcnagggtcccgttaaaagcacctccgctccttatccttccacctccggggcttaa

SEQ ID NO: 3901 - DNA, 444 bp, A.fumigatus
  unsure (241),(398),(399): Identity of nucleotide sequences at the above locations are unknown.
cgcagtcattacctatccacctgccttaaggggcggttttggtcacttccctccaggaggacaactcaacaaattggggtcactttaaggaaacccagtggtcagcctacgcaatggcctgctttcactcaactacgcgccgctacggtagacgctactcagaacggtctaaatttcagcggatcctcaacacccaccgtgcgggtactagggccgaacagcgaagatcatgacaaccacnaagccaacctcatctcccaagtcaagagcatcccccaggacacgagctctctacggatcgaagagaacacccctcagaacaagaagggtcatccccaacgaccagtttaccaacatccgcgaactggatatggacggggggtaccacaaaggcctcnncgaataaaaaattgcccctgcactgggcccctcaaacgggtttga

SEQ ID NO: 3902 - DNA, 222 bp, A.fumigatus
tggagtgtcgtccaaattcaatatcgccttatcagctcatccttatcacttatcttatcattgtttgtttgctctgtttgttgtctgtgtgtttcgtgcctgaggcagcatggaatttgcagccaggattatatgatcaacttgatcaactccattcactccctcagcctaggatatggtaattatatcctgggttccatggaaggctattcacttctttga

SEQ ID NO: 3903 - DNA, 249 bp, A.fumigatus
tcccttaggcgacgaagccccctacatcccttggtcagggcccctttcagtgctaccccaaggtcagagatgtcagccactactgctgagaaggcctctaccggccgtactctcgagaagaagcctgtcaagttcagcaatctgctacgtatgtctcttccccatcatgaatcatacgcaacaccagcaatacttgcagcctatcatccgattctaattcaattggaaatacagtcggtgcaggattga

SEQ ID NO: 3904 - DNA, 687 bp, A.fumigatus
acccacagaatatcaaggtctcattcccgtgggcctggattgaggcctccacccaaaggcgcggtcttattgttcgtcgcgtccgaggcggaattccgtgccaaggtacttggtgcccccgacttcctggcgggtattgctggaggtatgacgggtggtgttgcgcaagcatatgcgaccatgggtttctgtacctgcatgaagaccgttgagatcaccaagcataagatggctgctcagggtgtcaagcccccgggtacgtttgctacgttcatggatatctaccgtaaggaaggtattcgcggtatcaaccgcggtgtgaacgcggtggctatccgccaaaccacgaactggggttctcgctttggtctctcccgtctggcggagaccgctatccgtaaggtgaccaacaaggacgagaaccaaaaactgagcgccatcgaaaaggtcattgcctctggtctgggaggtggtctctccgcatggaaccagcccattgaagttatccgggtcgagatgcaaagcaagaaggaagaccccaaccggcctaagaacctgactgttggcaagacctttaaatacatctacgagacgaacggtattaagggtctctatcgtggtgttactcctcgtattggtcttgggatctggcagaccgtctgcatggttgctcttggtgatatgtaa

SEQ ID NO: 3905 - DNA, 462 bp, A.fumigatus
gtggaattcataggagcgacggcttcgctcaagggtggctctgggctgtctgggttcgctatgagcaagtttgcaatccgggctctatcccagtcactcgcgcgggaatttggtccccagggtgtccatgtttctcatgccatcattgacggcatcattgatactgagaagaccaaggaatatagccgggaggtcccggattccaaaatcgatccccaatgggtgagtggtcagcggacgagccacaagagtccaatattgattccggatttcagattgcggaatcatactggttcctacacacccagcccaggacatcgttcacgcatgaactggaccttcggccatcctcggaaacgtggtaaagccattgcagctgttttcatggtagacggattgtgtccgtgctctgggtacaggacagggccacaatcgcaagtcccgagtccatatgaacaatag

SEQ ID NO: 3906 - DNA, 303 bp, A.fumigatus
gagggattatatgaaggctctccctccctctgtcaagtatgggactcgttcaagaaagacccagctatcaaaatgacctcacgtattgtttctttatctcctgatcattcggaaatcaacatgaaggcggaaagtcagacacaggctcagaagccagaggatatggaccaaaagaaagaagagccaatgccgcctgtccgtcaggatgcctttggtgatgaggagtttgcggaggtcaagtacaaagttctcaagtggtggtccgtttctcgacctttcgctcacataccccggaggagatga

SEQ ID NO: 3907 - DNA, 474 bp, A.fumigatus
  unsure (103),(236),(300),(367): Identity of nucleotide sequences at the above locations are unknown.
ttactaactccttcaaacaggcaaggaggactgctcatggtcgctgagactatctctctgggcatcctctcacttcctgcggctgttggaaccgtcggattancaccaggccttgccatcctcatcagtatgggcatcctcgccagctacaacggttacgttattggacaaatcaaactgcgatttcctcatattactagcatgtctgatgcgggagaagtcctgctgggcccgtntgggagggaactcctgaatgcaacacagatactgttgttgatcttcatcatggcaagtcatatnttgacattcactgtggcgttcaatgtcatgaacggtcatgctacttgctccattgtctttggggtcntgggaaccgtgatttcctgtctgctctccctgcctcgcaagttggagaaagtctcgtggctgtcgcttgtgtgtaatttgtgctgccgtgggaccggtaccggttaa

SEQ ID NO: 3908 - DNA, 1521 bp, A.fumigatus
atgcaatgcgcggacggcccagctcccgaggtgaagagaaagggcaagaaactcatgaaccatctccagccttggactaagaacccagatttcatcggccatccgaagttagaatacctcaaacaggtcgtactcaatcacttcatggatcgtggagaagggacggcagccaatggagaccaaagtcagtctgcgacacgaatcatgatatttgtgcatttccgtgatagcgctgaggaagtggtcagagttctaaagcggcacgagcctttgattcgaccccacgtgtttgtagggcagagcagtgcgaaaggatcagagggaatggatcaaaagacacagttaagcattgtgcagaagttcaagaaaggcacatataatactatcgtcgcgacctcgataggtgaagaaggtctcgatattggcgaggtcgatctcattgtctgctatgactcttcggcgtcgcccattcgcatgctccagcgcatgggacgtactggccgtaagagagctggtaatattgtgctgcttctgatgcagggtaaagaagaggagtcctatattaaggccaaagacaattatgagaaaatgcagcagatgatagccagcggtactcgtttcacctttcatgacgacaaatcccctcgcattttgcccccaggagttcgtcctgtggctgagaaaaggcaaatcgatattccggtggagaatacgcaggctgatttaccagagcccagaaggagagcaaggcccccaaaaaggccgccgaagaagttccatatgccagatgacgtcgagactggttttgcaaaggcgtccagtctaactgggaaagtgacgaagaaagcagaaactaagagagccgtccgcaaaccgactccagagcctgtggaggttcccgccctggaagaagttctccttacgccaagacagcaacaggatcttgagcgacgctattgtcatattgcaggcacaagtccagagttcatccggaacccacgtgttgacgcctaccctcgcctgcaatctgttcctaggccgacaaaagctgttaaacatggttccttgacctcccgcatgattggtactctccaaaaaatgggtaaggtcagtgttgattgtgaaagccgatataggaaagtgttggctctggattcaagcaaggagattgtggactcagttctgtctcgcgacccgtggcccccagcgaagaacagtggaaggctgggggaaaaaacacacgccttcaaaaggccgtcggccactccgcggccaaacaatgtacatgtgcgggaggacgagaatgaggacaattgcactcccgaactggtgtctccagagaaattgatgtcatcttttctggagcctcataccgaaagacccctatattcatcacaaagaagccaagatgcttttgaacttgatttccctgatgttgagacacttctcaatcgtagcgcagagcggcatgtttctcgcaaacggaacagatttgttctcgatgacgacagtgacgaataa

SEQ ID NO: 3909 - DNA, 414 bp, A.fumigatus
gcatctggtatgcacagaaggcgtcaggggatataccggccgggccggacggacttttgcttggtcgctgtctccgcaaaggataattctagccacaacatatacatgtacggaggcaagggcgcaaacgagttatacgacgaaatatacgtgctttctatcccgtccttcacctggacgaaaatctccgagggaaagtcgccacgttacgggcacacctgtcacctagtagccaaccgacagatgttgacggtgggaggagcgtcgtctgacgacctttctacctgcgactgggaatacagaggcgtcgctatctacgacatgtcgacatcaacatggggcagtgtatatgatgcgtttgctgcagattacgcggtccccgcaaaagtgtaccaagtgatcggtggagggtga

SEQ ID NO: 3910 - DNA, 405 bp, A.fumigatus
cttgctttaaagcaccgttccgagaagtctcagagacaacgcatcatcgtcttttcctgctcccctatcgaagaagacgaaaagacactggtgaagctggctaagaagatgaagaagaataacgtctcgatcgatgtcattgcctttggagacctggagtccgatcaaaccaagaaattggaggcgttcgtggagaatgtcaagggtggcgacggctctaacctagccattatccccccgggtccgaacctgctcagtgaggagcttcaggccacgcctattttgggcggcgaggcgggagtaggcggcgccggtgcggaaggtggtgacggcggctttaatttcgaggacgctgctgaaaacgaccctgagctcgttcttcaaccacgggggctggaaggacac

SEQ ID NO: 3911 - DNA, 348 bp, A.fumigatus
cagaaacggagactatacgtgagaattccttggtttttccaagctttgataagctctgacgctcaagggctgacaacttgcagctcaacacgatggcaggcacaggtcgatgctgtcagcgtcattcacagcgccaaaatgcgcgcgcatccacagtctgctgttgggctcatgagtatgggtggcaagggtcctgaagttctttcgacatttacctccgactttggcagcattctcgccggtctgcaccgtaccaagattcatggtactgcccatctcagctccagtatacaggtggctggtgtatgtgatttgtcctcagtctcaagtttcgtcgatggatactga

SEQ ID NO: 3912 - DNA, 1266 bp, A.fumigatus
gcacgcggtacttccagcccctgcgtgaagacagagacatcgatgtcgtctataaattatgctccctccggggaggattcgctgtgctccattcgccccgttctccgagtgtcgtctcgtcgccggaaatcgtcctttggcaatctcacacggcgatggttatccattaactccgccgtccagaccagcattgcccagcctgctggctcacaacccgggcgtaaatgtgttgaacatgcacgaagtgtaggacctacacaaacacagagagtagaaagcaccagcgataaaggtggaaaccattacactgtaccgagcgaaacgggccactgtgcggactacgagtcgtcaacatcgctgcatagatctgaaactcggagcgaagattcgcagaatgctacaagagaaaaccggagacctttcaacctcttcgcgaacacgcaaacgtcaacgacgaattccccggccaaggacaaggcgatcggagtcatggaaagcttgtcgattagagatcggaaaaaattgagatataggctttatctttcgcggatgggcagggaccatgggtcacgagataatgggggccggtggaccaaagtgggagactttttggaagcgatgcaacaggagtctcggttgtggcccaagaaggggccggtgcagaaggagctccttttgccggaggaaacagtagccctcatggcgggcatcacggacatggcgatgaaggagaatgtctggtatgtgcctgttcgcaacgggtgtcgtgttcatgtgctgcaccccctcgagagcgaagggcagcataggaaggtcattctgtcaggatcaaagcggagtgtggaattggtcggggatcacatcatgcggacacggatgttacaggaacagggtgatcctctagtcgacataaggaaaccccccgttccggtttacccttccatcgaggccatgcgacgcaagaatcttcccgttccacttgtccgaggtgtctgggacttttaccaggcgttcaagcaacctgcaccactacacacacttctcaactcgtccgccaatatatcgagtgtcagagagttcgccgaacatgtagaggaattgaccaggtctcggccgtcctcaaaagtcattagagggaaaccgggtactcatcaccgtgagcgagtggctgctgcacttgtcgctcttttccaaaacgacgcaaaccgcgaatatttttcaaccgcggcattgaacagagcactgtcatttctgttcgacaatgaa

SEQ ID NO: 3913 - DNA, 684 bp, A.fumigatus
gcggtatttttaatagacgtacactggcagccccgcggtgaagacaaactcgctaaaaatatctattcgatggatgcttatatattcatgacactgaggctaccgcacctttttcaacttgttccgtttgcgacccagcacgtcgcgcccctcgtcaatctccaccatggcctctcgcttcgcctcgccaacttccttgagggcaccggttcgcaccaggcgaccctcgatactgacgccctcctcgctccactcctccatctgccggccgacgcgctcctcgatcgccagcacaagctgcacatcccgctgtccgaccagcgtgacggcctcgccgcggcggcccgcacgcgccgtacgaccgacacggtgcacgtagtcgtccgggttgcggggcacatcgtagttgatgaccaggctgacggtagggatatcgagaccacgcgaggcgacgtccgtggcgacgaggatgcgggccgcggaggcgcggaagcgggcgaggttggcgttccgctcggactggggaaggagactatgcagggaggtgacgcggtgggagaggcggcggagcatgcgctcgagcaggtcggcggtcttggtgtgattgcagaagacgatggcaggtttggaggcgttgccctcggtggagaggaggacgtgcaggaaggcttcgcgatgcgttag

SEQ ID NO: 3914 - DNA, 669 bp, A.fumigatus
aagtggattgatcacgtgagacttacaccgcctttgcgcggtcgcctttttttgccgaagaatttcgaagaatttcagcatcgcaaaagatatccaacaagcacaatgacgtcccccgttccctcagagccggtatctgaggatacacatgattcatctagcggttctgaagtagaaccatccaaaacctctacccgagcccccaaaagacgacgactctccgaatcctctgacgactctgacgactcgtacgttgcgccggcgccgctccccaccctttcccgtatcaaaaagaagggtgcaccagatgcgaaaccggcagctccagcaggtcaagataacccagtgctgatccgtgatgcgttggaaattgggctgcgggaggaagcgtcgtcgtttgctgcgttgaatgtcgcgccgtggctggttgggtcgctgacgacgatggcggtcaggaagccaacggcgattcaaaaggcgtgtataccggagattctcaaggggagggactgtatcggtggaagccggactggttccggtaagacgattgcgttctccgttccgatgctacagaagtgggcggaagatccgtttgggatatctggggttgtgttaactccgacgaggtatgcttccctgcgcgatggaatggagatagatcggtattga

SEQ ID NO: 3915 - DNA, 567 bp, A.fumigatus
cgcatcgcgaagccttcctgcacgtcctcctctccaccgagggcaacgcctccaaacctgccatcgtcttctgcaatcacaccaagaccgccgacctgctcgagcgcatgctccgccgcctctcccaccgcgtcacctccctgcatagtctccttccccagtccgagcggaacgccaacctcgcccgcttccgcgcctccgcggcccgcatcctcgtcgccacggacgtcgcctcgcgtggtctcgatatccctaccgtcagcctggtcatcaactacgatgtgccccgcaacccggacgactacgtgcaccgtgtcggtcgtacggcgcgtgcgggccgccgcggcgaggccgtcacgctggtcggacagcgggatgtgcagcttgtgctggcgatcgaggagcgcgtcggccggcagatggaggagtggagcgaggagggcgtcagtatcgagggtcgcctggtgcgaaccggtgccctcaaggaagttggcgaggcgaagcgagaggccatggtggagattgacgaggggcgcgacgtgctgggtcgcaaacggaacaagttga

SEQ ID NO: 3916 - DNA, 1068 bp, A.fumigatus
gtgtgcagagaacttgccttgcagattttcgaacagatcaaggccatctcggctccgcagagcatgaagcccgttctcatcaccggcggaacggacatgcgacctcaggccattgctctggcggggagaccgcatgtggtgattgcgactcccggccgcttggcagaccacatcaagtcgtccggcgaagatacagtgtgcggcctcaagcgggtgcgcatggtcgttctcgacgaagccgaccgactgctcgccagcgggccgggtagcatgctccccgacgtcgaaacgtgcctctccgctatgcctccctccagcgagcggcagactctccttttcaccgcgacagtcacccccgaagtgcgcgccctgaagaacatgccccgctccgccaacaaaccgcctgtcttcgtgaccgagatctccacggagaatcagggcacgatccccccgacgctcaaacagacatacctcaaggtgccgctaacgcatcgcgaagccttcctgcacgtcctcctctccaccgagggcaacgcctccaaacctgccatcgtcttctgcaatcacaccaagaccgccgacctgctcgagcgcatgctccgccgcctctcccaccgcgtcacctccctgcatagtctccttccccagtccgagcggaacgccaacctcgcccgcttccgcgcctccgcggcccgcatcctcgtcgccacggacgtcgcctcgcgtggtctcgatatccctaccgtcagcctggtcatcaactacgatgtgccccgcaacccggacgactacgtgcaccgtgtcggtcgtacggcgcgtgcgggccgccgcggcgaggccgtcacgctggtcggacagcgggatgtgcagcttgtgctggcgatcgaggagcgcgtcggccggcagatggaggagtggagcgaggagggcgtcagtatcgagggtcgcctggtgcgaaccggtgccctcaaggaagttggcgaggcgaagcgagaggccatggtggagattgacgaggggcgcgacgtgctgggtcgcaaacggaacaagttgaaaaaggtgcggtag

SEQ ID NO: 3917 - DNA, 954 bp, A.fumigatus
acgagcgatatgtatccgtacgattttgatgcagaaggtgcggatgatgagcgtacgcctctggtcgggtccacgcgtgtgtcacgaagccggcatggcggtcgacgccccggcagtgccagtttgcgtcaaatggagtatatgcagcaacggcaacgcagctatttttcacgctacagtatctgtctcatcattggcttcctgctacttttggccattggaggcgctacctcatttattatcgggattacaaagccgctggtggacgtgcaagtgcttgccatccagaacgtgctcgcttcggagcaggagatcatgttagacctcagagtgcaggccgtgaatcccaatcttttctccgtggctgtcgatgatatggatgtgaacttcttcgccaaaagccgatttgtgggaacagacaagctctggcgcgatcacagctcggatccggacgggtttccccgcgttgaacaaagcaggaaacgcgcagaactgactcgacttgcaccctgtggcagggataccgaatgcacgcctgatgtgcttgccggagagtccctcaagatcactggaggcgtcgacaagggcactgatcctataccgactgaccctgctggtgatcctcagaccatgctgctcggccgtgtttttcactttgattcgcccctcgcgttcgagccgtctccctggaaccacatatccaccacatccaaaggtcagatccgcctcgctcgacctggcaacaaaaccgaagaaggcggcacggagcggtgggagcgggtacttcagcatccctttgagttgattgttcgcggagtcatcaagtatcagctacccttgagctctaggtattactcctcgcctgtgagctctagcgtaaaggtggtacccaatgatgacaatcatgatcttcccctcgggagtggcagatcagcggccatagtcggggggata

SEQ ID NO: 3918 - DNA, 252 bp, A.fumigatus
cggcaattcaatctctgtaagcttatgatcatcgacagcagtctactagaacgttggccttggccaattctaacactactgcctaggactaccgcctatcagcgagcttcgtcttcggctgcctttgctgaagctcagtcccaagcaaagaggttcgaaagtgaggcttatgagaaagctacctcgaaggtctgttctccaccagggtcatcaaaccgtctgctcataaaggatcttgcaggaagattatga

SEQ ID NO: 3919 - DNA, 867 bp, A.fumigatus
aggatcttgcaggaagattatgaccggatgtgccaggatgccatcgatgccgcagaggccagtggttcggtagctccaatgatcagcagtccagaccagttgcaacatgagcccgaagagggtgcctggacagggggagaatcgatcggtccgttcaaaggatgtctccatgtgtttgatggacttcattccactatctataagtccaagcgtgaggatggagctgtagttgcggtcaaagttaccatcccccatctcttgactccaccacatgacgctgagcgcgaggttcgacttttgagagaagccgcgagtcctcatgttataagtctgctggactcgctcaaggttgacggaggaagactcatcctggtcttcccctacttaaaatatgacctggagcatttgctccgccgtgatatgctcactgcaacgctaataaaggcccatttgcacgacatgttcagcgcgttggcacaccttcatgagctgggaatcattcatcgggatgtcaaaccctctaacattctgttggactcgcctgacggcccggcgtacctggcggactttggtatcgcatggaaagaaggggacaagggctccgagccggctgacaagaaaattaccgatgtaggaaccacatcttatcgagcgcctgagatcctgtttgggttcaagggatacgggacagctttggatctgtgggccgctggttgtgttgtggccgaagctgtcgctgtcgggcacaagcagctgtttgattccgggcctgtggggagcgatctgacgcttgttcagtcgattttcaagaccctgggaaccccagatgagagtacctggcccgtacgtcatccgtctatactgagt

SEQ ID NO: 3920 - DNA, 534 bp, A.fumigatus
ggctggaaggacagagctaatatctatggacagattcactcggctgatgagctggtgctgacggaattgattctggagaacgtcctgtccgaatacgagcctgaagaaattgttgcgctcttgtccgcatttgtcttccaggagaagacagagaacgttcctactttgacccctcgcctggagaagggcaaggaggcgattattcggatcgccgagaaggtaaacgacctccaaatccaatatcaggtcattcagtctagcgaggacagcaacgacttcgccagccagccccgctttggtctggcggaggtagtttacgaatgggccaagggcatgtccttcaaccgcatcacagacttgacggatgtgatggaaggtaccattgttcggacgattactcgactagatgagacttgtcgcgaagtgaggaacgcggcgaagctggttggagatccgacgttgtacgcgaagatgcaacatgcgcaggagctgatcaagcgcgatgtcatctttgcagcatctttgtacatgtag

SEQ ID NO: 3921 - DNA, 576 bp, A.fumigatus
ttgtttagcgcggatgccgcgacccccgtggtgaagacacaagctaattcgaaacacacagaggcgattaaattcgcggacaaggagctttcgaaactttgcgcttcctggactagccctatctgggatgagatggactgggctcggatcaaagagctacaagtgcgggacatattagaaaaacggcaagcacaggcagctatcactcaatcatgccgttgcttacagtgcccgtctttcatgaagcacgtgagttgccatcgcctgtataactggttcctcgtaaactacattgttactgactttgggcagttcgagatgcagcacgatgaatggcaggtgaaggagaatatctctcagctaaaacagctcatgtcggaccaaaacctgcaactactaccggactacgagcagcgtatccaagttctaagagacctagggttcattgatgagcaatctcgagttcaactgaagggcaaagtcgcatgtgaggtgagtcatcaaatattctgtgaggctggaaggacagagctaatatctatggacagattcactcggctgatgagctggtgctga

SEQ ID NO: 3922 - DNA, 777 bp, A.fumigatus
tacctcccgatgtacttccagaccgtgctgcaggctcccccgatcgtcagcggcgtatacgtcctccccttggttctgagcatctccgtggtctccgcaggcacaggcatcatcatcaaaaagacaggtcgctaccgcgagctgatcgtcggcggcttgggcctcatgacccttggcttcggccttctcatcgacatgaaatattacgcctcctggccccgcatcatcatctaccagatcatcgccggtgtaggcgttggcccgctcttccaggccccccttgtcgcgttccaggccaacatccaccgctctgacatggcaaccgccaccgcaaccttcgccttcctccgccaggcctcctccgccatctccgttgtcctgggcacagtcgtctaccagaacgacctcgcgcgccaacagcccgccatcgaggccgccacaggccccgaaaccgcagctatactcgctggctcctttgctggctccactggctcacttgtcaagtctctccccgaggctgcccgcatcgtcgtcctcgagtccttcacgcatagcctgagcaggctgtggatcttctacacggctgtcggcggcttcggcttcctcgtcagtctcttcatccggcccgtcgagctgagcaaggcgcacacctttacgaagaccggcttggcggagcaggagcgcgcccggaaggagatcctcgcggagcagaaggctgaggctgaagctgcggcggcagccaagcggactgatccattgccaaaggcggaggtataa

SEQ ID NO: 3923 - DNA, 237 bp, A.fumigatus
atcctacttccaacacctgactgcttagcagcagagtatgaatccctttccaaatcaatattattaacacctccttgttcgtgtcttccccactctctctcttcttcctccctgtcaactctcctctctccctctctcacttacttcctcactgcctcactctacttcttttcctccccacttgtgaagtatttcctgaaacttttcccccctctgttctcttcgctgttgctgtga

SEQ ID NO: 3924 - DNA, 312 bp, A.fumigatus
ccatgcagtgcatatccttcttgggatttgattggtctcaattccagaactttgactgacctctgtcgcagtatgtattccgccgaccaattcatgaaccctgggcccgctccgcgcccccctaccgaccgtccaaagctctcactcccttcgaatccctccggcgtagccacttcattcagtcaaatgagtctcaattctccaagtactcctggatctgccaatctgtcactatttcccaacactagcagcccgtccctctcacagaccaagacaaaccagaccggccagggggcgttgccgtcgtcttaa

SEQ ID NO: 3925 - DNA, 555 bp, A.fumigatus
acccctggccgccaactccacataggagaccacacttcattcttcccccgccataattgcagcaccctccgtctcccttcgagctcctcctggatcatcaagtccgaaaggattagactcgtcgcagcgatgaataccacccttccatcctggaaggatcggacgcaaaaccagttcggcaagctccagatccaagtcccatggcgcaccatacaacttctcgtgccgcaccgtatgcgacggaagattcggtccaagctgcgcagtcggatctcgcctacctcatcgatatcctcgttgcagacgtcattctcacctgtcgatacactcaggtcgctgcaaagtcatagatggacgctctatgactttcagtatcttttgctgctgattgtcggcatattctcgctgagcgttatggaatcacctggaccattggcaaagaccgccgcgtttacgctacttctcatctctctccttctcccgattacgcgccagttcttcttgccattcctcccgattgcaggatggcttatatttttctacgcttgccagtaa

SEQ ID NO: 3926 - DNA, 657 bp, A.fumigatus
gcgttatggaatcacctggaccattggcaaagaccgccgcgtttacgctacttctcatctctctccttctcccgattacgcgccagttcttcttgccattcctcccgattgcaggatggcttatatttttctacgcttgccagtaagttcacctccttagggacaatcacgatatgtgatgagtacttatgtcttcctgaaaggttcatcccgagcgactggcgccctgcaatctgggttcgcgtgctgccggctctggaaaacattctctacggtgctaatatcagtaacatcctttccgctcaccaaaatgtggtgcttgacgttttggcgtggcttccctacggaatctgccattatggcgcgccatttgtgtgctcagcgatcatgttcatctttggtcctcccggcaccgtcccccttttcgctcgaacttttggatacatcagcatggctgcagtcaccattcagctgtttttcccctgctctcctccgtggtacgaaaatctgtatggtttggctccggctgattactccatgccgggtaatcctgcgggccttgctcgcatcgatgagctttttgggatagacttgtacacatcgggcttcagacaatctcccggcattcgcgcggggatgaggaacgcgtcggaaaca

SEQ ID NO: 3927 - DNA, 810 bp, A.fumigatus
agtgaggaaaaattcttctcgcgtgatgtcacccacgtcgtcacctctcgtcccatcccgcctgaaatcgacacagtacctcctgcagaattgaacgctacatctgctgatcagacaccggttgataccgtcaacccgtccttgcttgagaaaaccgcagacacacatctccatatgtccttgaagactgaccagcgacgtgagccaagcaatatggatgttttataccgggctcgccggatgaaaatgaagatatgggctcttgagaagttgcaacgtatgattgctgctataaatgacggggatcccggtggtcacagcagtcattcgcgcatccataatgctgttggtggaaacactaaggcccgcggcgagtcagacctatctcaggtcttacggaaggagctcgtcagcggtccttcggacagggaccctctgtcgtccttgaaggagctggtgttgttcaaagggccgttcatctatatccacgatatggatgaaaagaccaagcctgtcatggtgcgagaatatcctaaagttgcaaggagacaggatggtatctggccacaattcagaagcgccccgctggggaaatgccctttcattgacgaacctcccagcaagaaagagattgaaaggcaacgggcacgccaacaagagaaggagaagaaacttgctccgaaagctcctgccgttaaagaagtacctaaatttgacgcaccagatgtaggccccgtgaacttggacaatcgtcttcaccacggggctggaaggatcagcgctcttcatttccagggtcttcaaaggggt

SEQ ID NO: 3928 - DNA, 330 bp, A.fumigatus
gcaaaagagaccatttgcgaccaggctagcgtcgaggcgaaactatgcgaagcagatcaaataggttccttcattctggctgccaacgcgagcgaggcatccaaattccctattatatctcaggcggtgcatctgaaaaatccgactgcaattaattaccctgtcaagaagacaggcttctattgcgtcagcacttacggatattctgggaaggattacaaagcggcagttgagttcagaaattcatatggtgaacttccggctgcgcaaattgcaaaacttccgttctacggtggcttgactattgtctatgccgtcattggagtgtag

SEQ ID NO: 3929 - DNA, 525 bp, A.fumigatus
ccagtagcagatttccagaatcggcacggtttgaatatcggtgcaaaggtgctgatggtgatcgtcgctgtcctaaatgcgggacgcaattctttctcatttttccttttgctcatcgtttgcatgggatacggcgtggtcaagccctctttgggccggaccatggtctatgttcgtatcctggcaatcacccacttcgttttcggtgtcatctatgctgttgcaagtctatcaattacacccgatagcgctgggccactggtcctcctcatcgtgctccccctggctggtacactgactgcattttatgtgtggacactgaactccttaaacgcaaccatgaaggatctgatcgaccgaaagcagaaggtcaaagcaatgatgtacaagaagctctggtggtgtattctgggcagcatcatcgtgatcttcggcttctttttcatcaactcattcgcttttgctcgtcgtagcgaagcaagattcggcccagagcagtctacaccagcggtggagatcaatgtt

SEQ ID NO: 3930 - DNA, 1254 bp, A.fumigatus
  unsure (113): Identity of nucleotide sequences at the above locations are unknown.
gtggatgcaaaacccgctcaagaggtcataacaccggcctccatggaaacacctagcaagaaagagccagcacctggaaagcttggaaagtggtctcgattcgccggtttgtntagtccgcttccaggaagcccagcgaaggaatcggagcaccaatttggaaccaaatcaccagctccccaaccttcgaccaatgatgcggatcaggaagggttccagcgcatcttacaaatgcttggaggaagcaaatcgcgcaacgcgacaccccaaatcgacagcgcgcaggctcctcgcccaaccgtggcgcaagtcgattcagctctgaatgctctctcttctccttccaaggactcagtgagacggccagaaaccatggcagtgccggatacccatcctcacagcacggttccctcaattccagaaaacatgcacgcacacgactcccctttcaaggaccctcagcctcgtgacagagagcatcttcttcgtttaatgcaacaggtcagggtgagcccggtcgctccacaatctcacggactacagggtcaacctcaaagtgccggtccagctcctggtgtaatgaacgtgccggaagtattgtcccgccccccgggcatcccgactgctcagaaaggacacaatttcttggatgaccccgctattgccaacatgcaaagaccagatgctgatcagcttcggagaagacctgccaatggaccgcctatgggttactttgatgaggtcccatttccccaaggcggtcatatgccaatcacccctggtggctccaggcctcctcaagggcagggccatcctggcatgggtattcagcgaccaccgggctttgagcatcttccacctccgggatggaatggtcctcagatgcctccgcagcagggtggcggccccagccccttggttcctcctcccggcattccaaccccaacacgaggtgtcaacccgaacttcatgatgccacctatgcatggcaacgttccgcctcccaatgaacgccagcctttcccacgcggtgcgggcccccttccaccagggatgatgccccctcctggatacatgaacgtccccccgccatccgctttcccacctatgccacataatagtgacgctctcctgggacttggtcatggccagggcccttttgagggtaatcctggtccacaaggacctcccccatcctccagacatcttttggacatgtttggccaagttggtggcccagggcagttccggtaa

SEQ ID NO: 3931 - DNA, 186 bp, A.fumigatus
tacacagcaccaatcgaatacatgccgattgatgatgttgagacgctcgaccggtatcgtccaggaggataccatccggtaactgtcggagggcagctgggtggtagatattctatcgtccataggcttggcttcggttcatactcaacgatctggctggcaagaaaccaggacgccggacgatag

SEQ ID NO: 3932 - DNA, 453 bp, A.fumigatus
gaatcgtccggacacctttctagcgtagtcgtcgtctatttcgatatcagtatagaggtcaggtgctccactgtgccaggacttggagcacacgtcgccatgcgatttcactgtgcatacaatcatgtatgttgctctccattattcaaaaggttggtcaatctcaagtcctgcacgactatctccgcatacattcaaccgtggagaactatgaatttctgccgttaccgtcccaggctcgtcttggtcagttcgtcgcgtctcatgaagttagccttccaccctaactgcactacactaagttcgaacccatattattatacatctcataccggcaggatgggatcaaaagtcgccgaggaaaactgtgatacacagcaccaatcgaatacatgccgattgatgatgttgagacgctcgaccggtatcgtccaggaggataccatccggtaa

SEQ ID NO: 3933 - DNA, 390 bp, A.fumigatus
gcttggcttcggttcatactcaacgatctggctggcaagaaaccaggacgccggacgatagtcgctataaagataccggtcgcaacacgtggttctactgagacgcgacaaatcgatatcctacgctggttaaataaaacagggttgggagaaaaggctcatcccggggcagcatacatcccgtcaatattagatagcttttctctttctgggcctaatggcgtgcaccattgttatgtcactgaacccggaatgacgagtctaggagaagctaaagatgcctcctctattcgcctttttcagctgcctgttgctcgggctatggctgcccaacttgtccaggcagtggcattcctacattcccaaggtattgttcacggcggtaactga

SEQ ID NO: 3934 - DNA, 279 bp, A.fumigatus
tggagagcaacatacatgattgtatgcacagtgaaatcgcatggcgacgtgtgctccaagtcctggcacagtggagcacctgacctctatactgatatcgaaatagacgacgactacgctagaaaggtgtccggacgattcctatcagctaatcaacccattttccgcaatttcacgcgtatatatgcgtatatatgcgttttctgtgttgctcagcgaactcaatatgatgctttggcactacccctgttgctgcgccttcgaaacctaatgttctag

SEQ ID NO: 3935 - DNA, 228 bp, A.fumigatus
caaggcgcagactcggtaattgctacggtcactcgggcagatgggagtgctgaatccaccttccgtgctttatttctcgtaggtgctgacggcaggaagtcgacgacccggaagctacttggcacccaattcaagggccatagctggcctgagcgtctggtggccatagatgttcggataaagatgctgagtttgacgagaatcctccggacctcgctttttgtagtc

SEQ ID NO: 3936 - DNA, 738 bp, A.fumigatus
atcctcaaaggctataagactattatcactcttcccgagaagatgtccgctgagaaagtctctgtactgcgggctttgaacgctactattatccgtacgcctaacgaggctgcctacgactcccccgaatcccatatcggcgtcgccaagcgtctcgagaaggagatccccaatgcgcatatcttagaccaatacggaaacgtgaacaatccattagcgcacgagctcggcactgcggaagagatctggactcaaactaatggcaagatcagtgctatcgtcgcaggtgcgggtaccggtggcactatcactggcctggcgcgaggcctgaagaagcacaatcccaatgtgaaggtcattgcagctgatcctcacggttctatcctggctgttccggccgatctgaacaaggagcatgaaaatgagccctacaaggttgaaggtatcgggtatgatttcattccgcaagtgcttgaccagagcgtcgtggacaagtggtacaagactggggacagggagtcattccaatacgctcggcgattgatcgccgaggaaggtcttcttgttggtgggagcagtggaagcgcgatctcagcgctggtacaggccgcagcagatcacaccttcaccaaagacgatgtagtagttgtgattctgcctgatagtatccggagctatctcacaaaggtacaatccaggccctggctatctctttttgtcaaatctgacaggtcatag

SEQ ID NO: 3937 - DNA, 351 bp, A.fumigatus
tttgccgacgacgactggcttgccgcaaatgatctgctgccctcgttatcctccgaaactacgttggtatcgcagagtgtgcaaccagaggcaccaaaggataaattcgctggagcgaatgttaaatccttgagactgaagcccatcacaaccgtccggtccaacatcccctgtgagaatgctatcgagattatgcgcgatagaggatttgatcaacttcccgtccttgcaccctctggaaagaagcttgttggactggtcactttgggaaatgtcctcagtcggctgacacacggacgcgctacgaagaagagcttggtcgcagatgtcatgttcgacttcggcaagatc

SEQ ID NO: 3938 - DNA, 339 bp, A.fumigatus
ttgaagcttgatatcctgatttctatatggcctttcctggggcctatcgctcatacaatgtcgtccaaaacgtccccaaccgtgcctccagtggcccttgatgctatcactcaacacatcggcaataccccacttgtgcgcttaaatcgcgtaccaaagagccttggagttgaagcgactgtatatgcgaagttggaatactttaatgccgggggtagcgtgaaagacagaatcgccctgcgcatgattgaagaagccgagagatcggggcgcatcaagcctggtgataccctgattgaacctaccagtggtaacacgttagttgcgccatctccttaa

SEQ ID NO: 3939 - DNA, 750 bp, A.fumigatus
  unsure (22): Identity of nucleotide sequences at the above locations are unknown.
attggcggcaaggcccgcgacntggagcccttcaagcgctttcctacctggatgtggcgcaaccgcgagatgcaggatctcgtcgagtggatgcgcaaccgcaacgccaaactgcccaacgagaagaaggccggggtctacggcttggacctctacagcatgggcgcgtcgatccgcgccgtcatcgattacctggaccgcgtggatccacccgcgggcaaggaggctcgccgccggtacggctgcctccagccctgggtggacgaaccgtccgcgtacgggctggcctcgctccgggggatggaggactgcgagagcggcgtgctgcagatgctgcgcgacctgctggacaagcgcctgcaatacgcgcagcacgatgtgcgtgatggggaggagttccacagcggcgagcagaatgcgtttgtcgtccgcgacgcggaacggtactacaaggccatgtactacagttccgcctcctcgtggaccctgcgtgacacacacatgtttgatactctgcggcggctgttccggcacaagcccgctggtgccaaggccatcgtctgggcgcacaactcgcactgcggcgatgcgcgctataccagtatgggcacgcaccgcaacgaggtgaatatcggccagttgatccgggagaattttggccgtgagaatgtcgcaatcctcggatgtggcacgcatactggcaccgtggccgccgcccacgaatgggacgacgatatgcaggtgatgtag

SEQ ID NO: 3940 - DNA, 360 bp, A.fumigatus
  unsure (329),(346): Identity of nucleotide sequences at the above locations are unknown.
gtgcggccgtcccgtgatgacagctgggagaccattgcccacgatacggggatccccagctttgtgattgatctgcgcaaggaacacctcgatccagcttcgcgtacggcgatggccgctgaaaacagtcgactggagcggttcattggggtcatctatcgtccggatacggagcgtatctcgcactactcgcaggcatatctccacaaccaattcgacgcgtatatctggttcgacgttactgaagccgtgaaaccactggagaaggtgcagccaaagactcccttaggacaggacgagacctatccctttgttgtatcggtgtcgtnttctcctcatggccatnagcaccaaaggcga

SEQ ID NO: 3941 - DNA, 627 bp, A.fumigatus
  unsure (21): Identity of nucleotide sequences at the above locations are unknown.
ttggcggcaaggcccgcgacntggagcccttcaagcgctttcctacctggatgtggcgcaaccgcgagatgcaggatctcgtcgagtggatgcgcaaccgcaacgccaaactgcccaacgagaagaaggccggggtctacggcttggacctctacagcatgggcgcgtcgatccgcgccgtcatcgattacctggaccgcgtggatccacccgcgggcaaggaggctcgccgccggtacggctgcctccagccctgggtggacgaaccgtccgcgtacgggctggcctcgctccgggggatggaggactgcgagagcggcgtgctgcagatgctgcgcgacctgctggacaagcgcctgcaatacgcgcagcacgatgtgcgtgatggggaggagttccacagcggcgagcagaatgcgtttgtcgtccgcgacgcggaacggtactacaaggccatgtactacagttccgcctcctcgtggaccctgcgtgacacacacatgtttgatactctgcggcggctgttccggcacaagcccgctggtgccaaggccatcgtctgggcgcacaactcgcactgcggcgatgcgcgctataccagtatgggcacgcaccgcaacgaggtga

SEQ ID NO: 3942 - DNA, 711 bp, A.fumigatus
accgctccagtcgactgttttcagcggccatcgccgtacgcgaagctggatcgaggtgttccttgcgcagatcaatcacaaagctggggatccccgtatcgtgggcaatggtctcccagctgtcatcacgggacggccgcacctacatcacctgcatatcgtcgtcccattcgtgggcggcggccacggtgccagtatgcgtgccacatccgaggattgcgacattctcacggccaaaattctcccggatcaactggccgatattcacctcgttgcggtgcgtgcccatactggtatagcgcgcatcgccgcagtgcgagttgtgcgcccagacgatggccttggcaccagcgggcttgtgccggaacagccgccgcagagtatcaaacatgtgtgtgtcacgcagggtccacgaggaggcggaactgtagtacatggccttgtagtaccgttccgcgtcgcggacgacaaacgcattctgctcgccgctgtggaactcctccccatcacgcacatcgtgctgcgcgtattgcaggcgcttgtccagcaggtcgcgcagcatctgcagcacgccgctctcgcagtcctccatcccccggagcgaggccagcccgtacgcggacggttcgtccacccagggctggaggcagccgtaccggcggcgagcctccttgcccgcgggtggatccacgcggtccaggtaatcgatga

SEQ ID NO: 3943 - DNA, 1035 bp, A.fumigatus
  unsure (1014): Identity of nucleotide sequences at the above locations are unknown.
gggagtctttggctgcaccttctccagtggtttcacggcttcagtaacgtcgaaccagatatacgcgtcgaattggttgtggagatatgcctgcgagtagtgcgagatacgctccgtatccggacgatagatgaccccaatgaaccgctccagtcgactgttttcagcggccatcgccgtacgcgaagctggatcgaggtgttccttgcgcagatcaatcacaaagctggggatccccgtatcgtgggcaatggtctcccagctgtcatcacgggacggccgcacctacatcacctgcatatcgtcgtcccattcgtgggcggcggccacggtgccagtatgcgtgccacatccgaggattgcgacattctcacggccaaaattctcccggatcaactggccgatattcacctcgttgcggtgcgtgcccatactggtatagcgcgcatcgccgcagtgcgagttgtgcgcccagacgatggccttggcaccagcgggcttgtgccggaacagccgccgcagagtatcaaacatgtgtgtgtcacgcagggtccacgaggaggcggaactgtagtacatggccttgtagtaccgttccgcgtcgcggacgacaaacgcattctgctcgccgctgtggaactcctccccatcacgcacatcgtgctgcgcgtattgcaggcgcttgtccagcaggtcgcgcagcatctgcagcacgccgctctcgcagtcctccatcccccggagcgaggccagcccgtacgcggacggttcgtccacccagggctggaggcagccgtaccggcggcgagcctccttgcccgcgggtggatccacgcggtccaggtaatcgatgacggcgcggatcgacgcgcccatgctgtagaggtccaagccgtagaccccggccttcttctcgttgggcagtttggcgttgcggttgcgcatccactcgacgagatcctgcatctcgcggttgcgccacatccaggtaggaaagcgcttgaagggctccangtcgcgggccttgccgccaat

SEQ ID NO: 3944 - DNA, 561 bp, A.fumigatus
  unsure (10): Identity of nucleotide sequences at the above locations are unknown.
aagtcctcgnaacaattcccttctttactttcttacgggcaatcttgcggttttggcgctatctttgtggagctgtacttcatcatgacttctctgtggacgaacaagatttactacatgttcggattcctcttcctctgttatgggctcatgatcatgaccactgcggccaccacggtcctgttggtttactttttgttgtgcgctgaaaactaccggtggcattggagggctttcgctggagccggaatgactggcttctacgttttcatcaatgcctttattttctggatcactcgagtgagcttcggtggactcacaggggcagtcctctatgtgggctactcggccttgattggttttctggttttcatcttaacaggtatgttgttcgtccttgaaccaggctggagggtttggagttggtgtttaactcattttgcacaggttcgattggattcttcgccagctgggcgtttgtgcaacgcatctacggctcgatcaaggtcgactaaccttcggacattatttatgccattcaaagtcataattatcaggtag

SEQ ID NO: 3945 - DNA, 648 bp, A.fumigatus
ccccagacccagtggtgccacatcggcaaacgcagcctcgaccgcgccatcgccctgtaccgcaaaacctacccaggcggccgcaacgacaccatcaccatcaaatggcgccccttttatctcaaccccaaccggcacggacgcagtgtgcccaagtctgttcttatagatgaacgtctgaaggacaagacgcccgagcagcgtgccgcgatggtcaagcgtgtggaaaagatcgcccagtcggtaggggtccgcatcaactatggagggatgattgggccggacacgcgcgatgcgcatcgcctggtttacctgagtcgggaggatcctgcaattagctcggagattcatggggagctggtggagaggctgctcgaggcgttccatgaacgcgcgatggatatcactcggccggaggtgttgaaggaggcggcggctgcggcggggattgaggctgcggtggtggagaggtggctggccgaggatgttggcaatgttgtcgatgaggaggcaaggaagtatagagaggttgaagggattaagggggttccgaggtttcggttccaaggcaagtatgagtgggatggagaggatctgcaagagtgtatggagatcatgggcaaggtgaaggcagaggaggggagttaa

SEQ ID NO: 3946 - DNA, 396 bp, A.fumigatus
acctttctttctgatgatgtatttgtggagcaacggattgatgcgcctttcagcccccatgcggatcatgacaaacttaactacctccacgcctacatatccttctcctacagggaccgtaccccttatctgagtgtctatcttcaatccttcgagacaggggactgggcagttggtaagccgatttacctcccaaacaagacgttcattggctcccttattatggatgtcatcctgacaatacaccagcaaacttatccgaatcaaaggtcaagtgtcaggatgcggcctgtcaacccacagctttacctccagatctgtcaaagacaggggtatattattccggtctccactgatgaacagctcgggacttacttccgggctgtaacccgatga

SEQ ID NO: 3947 - DNA, 411 bp, A.fumigatus
ccatttatgtatgactacttggtaacaatgggttctcattcaccgctaaaattcgaatacatgcgcctctctggactgggtcttttcagcccttgcatcacaagctctttatcattgacacctgaccagccggatgcatttacttctccttgcagcacacacgcctctcagagtatcgccacgccaaagtcgcatgaccaaagacaagtaatggctgaccaagttggcttccaccgtcttttcagatccctagcgtttatccttagcgctgaggcacatgcaagcccttacatccagcaacgtcaagacgatgatactctgaacattccaccaatattcctgggcagccccacctctgctgcaatggctatcaacccctgtatggcagtatccgtggaggagtccggttga

SEQ ID NO: 3948 - DNA, 195 bp, A.fumigatus
ttatgtacttggtttacaaggacagtgattggacgaactcggtatctcaggaagcttgaattatggagaggtgacatcactgtcttagctacagactacagtttactaccacaccgttacgctaatactttgactgagagaatgattctcatctcgatcaatcttcaccacaaggccgaagatccgcgcaaggtc

SEQ ID NO: 3949 - DNA, 339 bp, A.fumigatus
cccggtcgtagatggggccggcaaccagcccagtcagctgacggaggaagcattggatggagcctatccaagagatctgcaagaggaggctttgaagagctcgccgctctcagagtaggtttggaagacggcaagtgtgttgatcatgccccatgcattgaagaagagaacaaagccggcggcaacctgcagctataccatgagtccgccattaggaggctgtcagcgcaggcctacaactatggcttgttgattcatctccatctcccgaatatgatgcatggaatcagcagcgatctcgcccatgagtactccaagatcgtcttcaccgggggctga

SEQ ID NO: 3950 - DNA, 978 bp, A.fumigatus
  unsure (430),(513),(517): Identity of nucleotide sequences at the above locations are unknown.
ggacgcggatttccacccgtggtgaagaccgataatagcggcaatcgaccatggaccccgccatcctcgacggttactccaggacctgggatgtcctactcaccagtggtagaaaatcgtccttacaactatggtgccccgcctccgccaacaaccagctatgagcgtcctcacaacgtatacccgtctcaaacttcagaaggcatggctctgggattttccccgcagacaaagccacaacagtacgacaatgagtataacaactctggacctccaccttacacccagcactcctatggctcgccacagtcatatcccccataccctacacatgacacctatcctgcgcacccgcccactcagccgccatatccacaggatcgaaaagatgaaagaggcttcatgggagcggttgctggaggtgctgtangggcctacgccggtcatcaagtccatcatggcgtcttgggcactatcggaggagcgatcactggatctgtcgccgaagacgcnatcnagaagcacaagaagaagaagaagaaagaaaagaaagaaggcaaatggggacatggtcgccggtcctcatcctcatcctcgtcatcggacagtgacaacggtcgggctcatcatcaacaacatcctcctgcggcggcttctctccgaagcaacttttccgcctcgtcgacggagaattacctcgagcacgaatatgagctgacagctagatgccgttcgatctcaggggaaatgcatcggtcgagtatctctctgaactcggtcctctccaaccacttcggttcttttgtatgggcacgtggcggtaattttggagcgtcggcgagaaatgtgcatcttgctgaaggcggaagagtacttgacgctgagctggccgacggaaacggccattggaagagggcatgggtgagattggatgagcggatcacgaaccagaacggacatcttgtattcctggattga

SEQ ID NO: 3951 - DNA, 369 bp, A.fumigatus
cagttcgagagcagtgacgtgaacattatggcctcatcggcaatatcaggagctgatctgcgatcgtttactgaatacttgaaagggtgtaaacggatactggcactcttaggggctggtatatccgcatcttctggacttcccacatttcgaggagccggcggtctttggcgatcttatgatgccaccgatttggcgactcctgaggcattcgaggccaatccggacctagtatggcagttttacagctaccggagacacatggcactcaaagcgaaccctaaccgcgcgcaccacgcccttgcagagcttgcaaggaagaatagggattttatcacactcacacagaatgttgatggtactgtctaa

SEQ ID NO: 3952 - DNA, 657 bp, A.fumigatus
acaaggctgacgagtggacgcttcgatgtaggtctttcacaacgtgcaaatcatccctcggaacagctccacctcctccacgggtcacttttcacggtcaaatgtacctcattctactgcaactatgtgcgcgaaaatgactttaccgatccgatagtccccgagcttgccattccgaaaggtgttccggacttgagtccatctgctgaagataagactggcgaggaggcctcaaaggcgctatccaacgcattaagaatggaggaaacggaactggacatatcagacgagaacgtcccgctccctgccttgagtcaggatgtcctgccacattgtccagaatgtaaagaagggcttttgcggccaggcgtggtctggtttggagaaggtttacccttacatacgctagaaacggtggacaagtggttaaattctggtcccgtggatttgatcttggtgattggaacaagttcgagagtctacccagctgcaggctacgttgataaggcgcgtgcgagaggggcccgagtcgctgtggtcaatatggatcgcaatgatgttgggtattctggcttgaaaaaaggtgattggtttttccaaggagacgcgggtgttatagtcccggagatattgcagggtgtcattggagacatttag

SEQ ID NO: 3953 - DNA, 225 bp, A.fumigatus
tttgcacgttgtgaaagacctacatcgaagcgtccactcgtcagccttgttcaactagactacaccagcactaggatatgcagtttagacagtaccatcaacattctgtgtgagtgtgataaaatccctattcttccttgcaagctctgcaagggcgtggtgcgcgcggttagggttcgctttgagtgccatgtgtctccggtagctgtaaaactgccatactag

SEQ ID NO: 3954 - DNA, 189 bp, A.fumigatus
gatcgccaaagaccgccggctcctcgaaatgtgggaagtccagaagatgcggatataccagcccctaagagtgccagtatccgtttacaccctttcaagtattcagtaaacgatcgcagatcagctcctgatattgccgatgaggccataatgttcacgtcactgctctcgaactgctatgtttcatga

SEQ ID NO: 3955 - DNA, 243 bp, A.fumigatus
agcccagaatccctaaatgtctccaatgacaccctgcaatatctccgggactataacacccgcgtctccttggaaaaaccaatcaccttttttcaagccagaatacccaacatcattgcgatccatattgaccacagcgactcgggcccctctcgcacgcgccttatcaacgtagcctgcagctgggtagactctcgaacttgttccaatcaccaagatcaaatccacgggaccagaatttaa

SEQ ID NO: 3956 - DNA, 624 bp, A.fumigatus
gttacgcaataccttctgcccctgtcgttagcacatcctctttcggaggtggttggacgcaggccggtgtacggtgctacgcttctgcttgccttcatcttcgtcataccctgcgcggtttccaagaatcttggcacccttatcgtctgccgagcgatcgatggtatcgcgttcagtgctccaatgacgttggtcggcggtactctggctgatctgtggaggaatgaggagcgtggtgtccccatggctgcattctctgccagccccttcatcggacccgccatcggtcctcttgtgggtggttatctctgccacgctggttggagatggctttactggatccagctcattctggcctttgttgcctgggtcctaattacctttactgtcccggagacctatgcgccaatgattttgctgaagagagcgaagaaattaaggaagagtgaaaacgatccgaagtacgtcacagagaccgaattggacgctcgccccatgggagaaagattgcgtctcttccttctccgtccattccagctcctgtttttggaacccattgttctgttcatctccatttatatgtccgtcttgtatggcttgctatacatgttcttcgttgcgtaa

SEQ ID NO: 3957 - DNA, 327 bp, A.fumigatus
ttacctcggtatgttttcttcaatttcctcaacgatggtatagtgcttattgttaccacagtggatacataccagcatcaggcagcctctgcccttgctgcaaagactttcctccgttccatgtggggtgcttccacagtactgttcacggagcagatgtatgaccgcttgaacgaccgatgggccagcacattgctagcctttattgccctcgcttgctgcgcgattccctacgtcttctacttcaaaggcgcttccatccgtcggtactcgaaatttgccttcgcggacgacgaggagcagcagggaccgggagagaagcattag

SEQ ID NO: 3958 - DNA, 381 bp, A.fumigatus
cagctcatttccaggtatcccattgtctaccaaaaaggaaagggatggggttcaggtcctactggtctgatgttcattcctttggccattggtgtcttgtgtagcgctgcctgtgctcctttcgtcaacaagcactatcttacacttgttaagaagcacggtgggaagcctcccgctgaagcgcgtctgatccctatgatgctttcctgctggtttatccccattggtctctttatcttcgcctggacatcataccccgacatccactggattggcccttgcattggtggcctccccgttggatttggcttcatcttcttgtacaactccgcgaataattacctcggtatgttttcttcaatttcctcaacgatggtatag

SEQ ID NO: 3959 - DNA, 276 bp, A.fumigatus
atatgcagtgagaataatgttattcctatctatatacctacttattctttatatctactgcaacctctagatattagctgcttttcaccattaaagtgtgtatataggtatttagtggaaactaagatataccttaggtttaattatattaacaagcttgactttcttaaagccttccctcaggcatatatagagatctatattactagtaatatctgcagtggtttctctgctactagattagttctatataatctagagagggtacttagctag

SEQ ID NO: 3960 - DNA, 213 bp, A.fumigatus
attatgacattcactgcagcgtggtggtgcttatatatgtggtttaactgcaggaagccctggatccctagacatagtatcttaagctttaaagacctaattctcttactagaatcactcctggcctttctagatagaaagaacctctacagcattaagctacctagtagatctcttatattttttaagctatttcttatacatagcttgtaa

SEQ ID NO: 3961 - DNA, 309 bp, A.fumigatus
aagatgatatttcctagttatacagccagtagtagtaggaataaagagattctaaagctaataaaggcttatattattactagtctaaccatttggactaacttcaatcctctagttgcttgggagggttggatcttaataccacccctctatatagacctttcctttaaagataatataaggaggaagcacctaactagaggcattaatatacttaatagaagtaacctattcccgattgcctggctatacaagaggtgttttcctatagatattagctctagttactactttagtagtagctactaa

SEQ ID NO: 3962 - DNA, 366 bp, A.fumigatus
agaaccggccctccaccatatggcaaccgtgcaggatggcgacctcgagcagctgaggatttcggcgacggtggcgcgttccccgagatcctggttgcgcagtatcctctcgacatgggccgcaagggtactgcgacgacatcgaacgcgctcgcggtgcaggttgacgcggaaggcaaagtcaagtacgacgcgatcgcccgccggggtcacagtgagaaccgcatcgtccatgcttcctttcaaggatctgattccgctccggcagcgggtggatatgggagaaatctcgctagaccgtccgtcggaggaagaggtccaggcgcagatggagaagaccaagaatgcgctggcgagcctggttga

SEQ ID NO: 3963 - DNA, 918 bp, A.fumigatus
ctatcttggtttacgatgtatagagaaccggccctccaccatatggcaaccgtgcaggatggcgacctcgagcagctgaggatttcggcgacggtggcgcgttccccgagatcctggttgcgcagtatcctctcgacatgggccgcaagggtactgcgacgacatcgaacgcgctcgcggtgcaggttgacgcggaaggcaaagtcaagtacgacgcgatcgcccgccggggtcacagtgagaaccgcatcgtccatgcttcctttcaaggatctgattccgctccggcagcgggtggatatgggagaaatctcgctagaccgtccgtcggaggaagaggtccaggcgcagatggagaagaccaagaatgcgctggcgagcctggttgagggtgctgtggcggcgcagaagccgaagaacgtcaagggtggtcggagggcagagcctacgtttgtccggtacacgcctgccaaccagatgggagatactacgcggaagaacgatcggatcatgaagatcgtcgagaggcagcaggatcccatggagccgcccaagttcaagcacaagaagatcccccgcggcccgccctcgccacccccgcccattatgcattctccgcctcgaaagctgacggcagaagaccaggaggcctggcggattccacctcccgtatcgaattggaaaaatcccaagggttacacggtcccgctggacaaacgtctcgctgcggacggacggggactacaggatgttactatcaacgacaagttcgctcagtttgccgaggccctatttactgcggaccgacatgcccgtgaggaggtacggctgcgcgcacagatgcaacagaagctggcggagaaggagaaccctcagcaggaggattttcaccaaggccaggccgtccgcgatacccat

SEQ ID NO: 3964 - DNA, 264 bp, A.fumigatus
tgtgacggttcctgtcgctgcgttggtggaccacggccagctagtgatatcaaaggacacagtcaaggtcggtatcatccggtgacgttgctatggacttcattaaccgtttgtaagttccaaattctcggcttctacgatcccgcgcctcttctgccgaagaagctgaagatctggtatacgtatcgcggaaacgagcatttcgtggaagcaaacgattcagagggcattgcatgtcctatgcgcacccatctagttggctga

SEQ ID NO: 3965 - DNA, 201 bp, A.fumigatus
ggtggaaagtggggaaacggaatgcagttaagaccttgctatttaaactttcgcattaacttttacatctttttttcggcccaccccgataaatttaatttgaaacccatggatttacaccattgttgggccctttcaattaagcgcctcaatacttgggcttttgttgatttgacggccaggaggaaaattgttccacct

SEQ ID NO: 3966 - DNA, 1140 bp, A.fumigatus
gcctgggttctaattcccagtgaaggggtacaagttgagccagaagcgactgatttgttcgaatcagcggattcgatggcacgcccttcgctttcgccatccaatcccctcggattcacgccatggcccgtcactgttatcacggcggtcgtgtatcttgcactggtggtaccgttacttgtcgtacaccatgtcgtaccttcggctcctagctcgagcccgaagggactgaatctcaccgaagcctgggctgacctgcaggagctcacgcacgggttccacccgtacaactctcaccgtaacgatgaggtgcacgagtggcttctgaaacggatcctcgagcttatcgacagcgcaccacccgcgagcgagtatggatctgttggcgaggagaagccagacatcgttgtctttgacgatacgcagtcgaaccttactttctccggccgcggctcgggcctcggggtgtatttcgagagtaccaatatcatggtgtatatccggggctgggaagaggacagggagcgctggtgggaagacccacacggccggccggcgggcaagggcggcgtcctggtgaacgcacactacgacagcgtgtcgacgggatacggggccaccgacgacggggtgggtgtggtctcatgcctccagctgatcaagtacttcaccacgccggggcatgtcccgcggcgcgggctggtgctgctcttcaacaacggagaggaggattttttgaacggcgcgcgcgtgtacagccagcaccccatctcgcagctgccgcatacgtttctgaacctcgagggagcgggcgcgggtgggcgggcgacgctgttccgcagctcggacgcggaggtcacgaaaccgtacatgcgagcccctcatccgtttgggtccgtgttaagcgcgaacgggttcgaggcgggcctgatcagcagccagacggattatgtggtttttgaaggcgatctgggcctgcgcggcctggacgtcgcgttcatggagccccgcgctcggtaccatacggacgaggacgatgcgcggcatacgagcttggcttccgtgtggcatatgctgtctgctgcggttgccacgacggagggactgtcttcaccacggggctggaaggagccgcgccaa

SEQ ID NO: 3967 - DNA, 546 bp, A.fumigatus
cgatacgcagtcgaaccttactttctccggccgcggctcgggcctcggggtgtatttcgagagtaccaatatcatggtgtatatccggggctgggaagaggacagggagcgctggtgggaagacccacacggccggccggcgggcaagggcggcgtcctggtgaacgcacactacgacagcgtgtcgacgggatacggggccaccgacgacggggtgggtgtggtctcatgcctccagctgatcaagtacttcaccacgccggggcatgtcccgcggcgcgggctggtgctgctcttcaacaacggagaggaggattttttgaacggcgcgcgcgtgtacagccagcaccccatctcgcagctgccgcatacgtttctgaacctcgagggagcgggcgcgggtgggcgggcgacgctgttccgcagctcggacgcggaggtcacgaaaccgtacatgcgagcccctcatccgtttgggtccgtgttaagcgcgaacgggttcgaggcgggcctgatcagcagccagacggattatgtggtttttga

SEQ ID NO: 3968 - DNA, 927 bp, A.fumigatus
  unsure (783),(816): Identity of nucleotide sequences at the above locations are unknown.
ttcctaattcaagccgactttgtgaccgatgcaagcaggcaagatattgtcaggtcgtccgctcgcaatctaaaacttcttacagccattgcccaggcatttattcaggcggtcaaacagttttgcacccacaccagcctggcttaccagtggatgagatatctgccggattttgaatggggctctcaagaccgatattggaaagcattgcctggcgagattcgccgccagctccaactaactgacacgatgtggacaaggagccacctcaacatgcgttgcattgcagacgtgcgattgctgcccagtagcatgtgcgataagtatggaaagccattgcttccagacctagacacggaacagtatctgtcgcctcactatgcactcaaagacttgaactctttgagagactacggcctccagctgatgaacaggcacgaatttgttgacaggctgcggcaagatatcaagagtgactcttcattgatgcgaaatcccaacaccaacgaagactggcattccgctgtggcgaaatatcttatgggtgtgttggggcctaagaaccccaaaacggccgagaagataaagaagattaagctcatcccgttaatgggagggcattggagaagctcttcggcccttgatatatttccggtatattttacccgggcgcaagggcatgctattccgactgatgggatattggacttgattgcgcccagtgcagaaatcaatccagatcgaaaacagctgtttgttctgctgggcgttcaggaggcttcngtgcgcgacattcgccgggaaatcatacttcgnagcgcgtcatgggctcatggacttgaaacttcccaatcttatttgaggtcctttatcttactgctcaactggatcgaaagcaccgacagcccagtccctattcgcttttaa

SEQ ID NO: 3969 - DNA, 936 bp, A.fumigatus
cgggtttgtcgatccacaagtcttgcgaagaacttatacacaggcaccgctcgcttcgtcttcgaactccttcagaatgctgacgacaactcatacaacgtggcgaggtctaggtccgccgacccatttgtttcttttcgcgtcgacaaccgacggataattgttgagtgcaatgaagacggatttacccacgagaacttggtggctatttgcaacgttggaaaaagctccaagacgggtgctcaggggtatatcggggagaaggggatcgggttcaagtctgtattcatggtggcttggaaagttcatatccagtcgcgcgatctatccttctcgtttcgacataacgtgggagactccgggatgggtatgatctctcccatctgggaggaaagtgaagaagtgttaccccgtcctctgacacggattactttgtatcttcatgagactgggtcggccgcagacctggctacccagcgggaaaccacccttcaacagtttcgggagctgaaggctgcgttcttgctgttcatgaagaacctacgaagaattgaggtcaaactctgtgacagccttgataaggagatctcacggacaaccttctcaatgcggtgcgaggacgaaggtcgagtcgcactgaagcaggagatcgtgcaggatggggacctgcaggaatgcacccaatactaccacacgacaaaactcacggcgtcgaacataccgaggagcgagaaccgagaatatacggatgtggagctggcgacgaaagcctattcggaaacgaacatcattctggcatttcccttgacacgcgattccgtgcctatcatcgaaaaacacgaagtctttgcgtttctgccaatacgaaacatgggcctgccagtgagtagcccgtcttgcaccggcatgttttctaacctcgttcctagttcctaa

SEQ ID NO: 3970 - DNA, 318 bp, A.fumigatus
atactctttctcacagtcagggcacaaggtggaaagacgccacaggtcactgcgtcacccttgtcagcaacagatattacaagagataatatggcgtctggaatgacgcagtcgagcactagaaatcttttagaatggctgaagaacatctgcttggaacgtgacaactaccagtgtattgtgacaaagctttgggatcctgtggctgttaaccctcaagaacaatgcaagatgactggcaacactcagctcgcgcatataatcccattttctatgggacattggggcaatgatcagaaggttagtttctgtccctag

SEQ ID NO: 3971 - DNA, 303 bp, A.fumigatus
attgttatatacttactcgaccaggacacagataacacatataagattaagacatacccatggcatcagaatttctgtgaccaattctacgagaagcccataaccttcaccacgcacaacggctcagaattgcctagtaaattccttcttgaaactcatgctgcgatcgcggagattctacatgcgtcggggcagggggagaaaattgatgaactcctccgtgagtgggaggatattggatgcctggcatctgatggaagtacagatctcgagagccttcttttacttctgagtgtccattag

SEQ ID NO: 3972 - DNA, 783 bp, A.fumigatus
ttgaacttggtcaatgatacagtatccttcctctccaagcagagcacaccggattcttccgatgaaacccagctcccaaccatcgactccattaagcccagaatccgcgaagaaagacaagcagaatcgaaggccgtctcgcaaccggatgcgcagcccacacagcacgaggccctatctgcctcagaagccgctctgaagtcgccccaagaacttgaagacgaagctggccaggaagccgccttcaaccccgagactggcgagatcaactgggactgcccatgcctgggcggcatggctcacggtccttgcggcgaggagttcaaggctgcgttcagctgctttgtgtactccacggaagaacccaagggcatggactgcattgacaagttcaagttcgttcaatctgacctttctgcataccattcagagtgcagtcatgtgctaacattacgttataggggcatgcaagagtgcttccggaggtaccccgatgtctacggtgccgagctcgaagatgacgacgaggccgacgccgcagctgccaccgcagccggcgtctcagaacccagcgaacagcctgcttcccctaccgtcagcgcccccaccgccgagatagatgcctcctctgactccgaaggaaaggagggccgcgccaaagacgttcacgcccaggtgaagtcggaggttgccgagaaggccgaacaggctgagagcgacgacctcgttcccaaggcctggcacgacaccgaaggcaccaaggcgcagcagacagagaaatga

SEQ ID NO: 3973 - DNA, 573 bp, A.fumigatus
catgcctctcgtgggctttggcctctggaaggtcaacaaagagacttgcgccgaccagatctaccatgccatcaaggctggttaccgtctcttcgacggcgcctgcggtcagtagcccctcatattctatctccagcgaaaaggcagagcgacagagtcctgaccatcgcagattacggcaacgaggtcgaggctggcaagggtgttgcccgtgccattcaggaaggaattgtgaagcgtgaagagctcttcattgtgtccaagctctggaacagcttccacgacggtgaccgcgtcgagcccatctgccgcaagcagctggccgactggggccttgactacttcgacctgttcattgtccacttccccattgcgctcaagtatgtcgatcctgccgtccggtaccctcccgggtggttgtccgagaacaacaagctggagttcagcaacgcctccattcaggagacctggaccgccatggaatcgctggtcgacaagaagctggcccgcagcattggtgtcagcaacttcagcgctcagttgttgatggatctgctgcgctacgctcgtatc

SEQ ID NO: 3974 - DNA, 216 bp, A.fumigatus
gagtctccttatccgtcacaggatcaaaatcgattcaaatctgccgaatttactgtattcacaatgactaccccatccatcaagctcaacagcggttatgacatgcctctcgtgggctttggcctctggaaggtcaacaaagagacttgcgccgaccagatctaccatgccatcaaggctggttaccgtctcttcgacggcgcctgcggtcagtag

SEQ ID NO: 3975 - DNA, 381 bp, A.fumigatus
  unsure (305): Identity of nucleotide sequences at the above locations are unknown.
gccccttttaacaaaccgggggttggcgttcaggacagtagcaatgttttgaaccaattctttggttcctggttcgcaacccttggaggaattcggaaataccccagagcgaatgggcccttcggattccgttccacgaccattccaagggaggtgggtcccaaccaaaacacgctatttcggtaccatcaccacgaccatcagacgtcagcatcccgcgagtcgcacccacccacgggcttcgagggcttgatggacccggatgatctgatgaacaagatcgtgggcagcatgcccgacgatcntggcatgaatggggcaggacccgatcatgccagtgccgcctacgcagataccaatgcaactgaggcgggccaatga

SEQ ID NO: 3976 - DNA, 531 bp, A.fumigatus
aggtcgaggtttgtactgtcaaatatgccttccagacaagaggtcgcctactttggagctggccctgctcccctgcccacctcggtcgtcgaggcgggcgcaaaggccttcgtcaactacaatgactgcggtctcggactcggcgaaatttcgcatcgctctcctaccgcaaacaagatcctggaagataccaaggcgagcctgacaacgctcctcgatattcccgatgactacgagatcctgttcatgcagggaggtggaagtggacagttcacctcagtcgtacagaaccttgttggagtctgggtagaacgccgaacaactgaaataccagaggcccgagaattttcggcttaccgaaaaataaaggatgaacttggttcttttgcagaatatcaccagaatggaaggttccgggaaggaaatttgaatctgggaataacattcttcccccggggttccattggtccctttgaaaaagggagcttccagggagggcttcacccgtcctggcgtggggttgccacaaac

SEQ ID NO: 3977 - DNA, 690 bp, A.fumigatus
  unsure (655),(684): Identity of nucleotide sequences at the above locations are unknown.
ctgggacctatattgatgccatatatcacacgtctattgtactcaatggcgtcgagtactactttggccaggggatacaaacatctgtccctggcagtacacatcacggacagccaatggagaagttgcttctcgggaaaaccgagctcccaatcgacgtggtcgaagagtatatccagtcgcttgcgtcaatctatacgccagaggtatggcgctcttactcactctcgcattaggcataggctaaagcatccccgacagtcgtatgacctctttctgcacaattgcaacaatttcacacaggatctggcaatgttcctggtcggaaagagcatcccagaacacattcaaaacttgcctcagaagttcttgagcaccccctttgggcagatgatgaagccgcagattgagcaggcactacgcggtgtgacgcagactgcagcgccggctcctcagccgcttcccagggcaccagtcacaactgcagcgccaacgcaccctggcactgtacgacaggtcagcaacgtcaaccagctcgaggaactgctggaatcagcagtcaaatcgtgtgcagttatgtttttcacctcagcgacatgtccaccgtgcaagaaagtgtatcctacttacgggcaagaaccagaggagtcagatntcaccgagcggcaagcaagagcaagcaanaaaagg

SEQ ID NO: 3978 - DNA, 339 bp, A.fumigatus
tgcacatcagacactcctaagcaggctcaaaaccgtctcaggtccatcatggaaggtaccgagtttgccgagcgactgtcgcccattttcgctcgcataaacatactcgtgacatacttgcaaggtttcgacgtcaaaaggaaggtctatgtcaatcctcttggcagtctgaacgacaagtttctcagaggcagtatcctgttccaatgtgtttttgacactaagcgacgggacgtctttgcagctgccggtcggtatgaccggttggtgcaagattttccttccgaaggtccagcgagctgctttaaacacaagcagttggctttaaatttgactggg

SEQ ID NO: 3979 - DNA, 1191 bp, A.fumigatus
aggaacgactgtcgggcattttggcccctgtggagaagacatctgtggtacatgtactcgttgggtataatattcttcgagatgtgccaccctttgcccacgggtatggaacgcgaccagactctacgggcgattcgagaagaacatcatactcttccacctaccttccactactcggaaaaggcagtgcaggggaacatcatcgaatctctattgagtcatgacccgaaggaacgaccatctgcctcggaacttcttcagagcggcaagattcctctccaggttgaagaagagacgtttagacgagcaatcgtgcacctcctctctgatccgaatgcgcccgactacaagaagattctttcggccatcttttcgcagtcgcccaaaaaatatgaagatattgcctgggatgtggactcgcgtgctgctcctgctgccaatgagttactcgttcagagtttagtcaaagagcgactgaccgccatattccgccgacatggggcggttgagactactaggcaaatgctgttccctcgttcccaacactacagaagcggagccgttcgactacttgacgcgtcgggtaatcagcttcagctgccattcgacctcacattgccgaacgcacgctctatctctagacaggacccgtcactagagaaaacattcgcttttggcacagtctatcgagagatgccccatggcagcgagcccagaactcacaaagaagttgactttgatattgtatcgcacaatactcttgacctcgcgttgaaggaagcggaagttatcaaggtcctcgacgagatcattgaagagttcccaccgctaaggtcgtcaccaatgagttttctcataaatcactccgaccttctgcagctcatcatggagttctgccgcatcaccccctctcaggtacccttggtcaaggaaattatcagcaagttaaattttggcaaatggacgatgcagaagatcagaagtgaactccgatcgccagccattggagttgcctctacatcgttggatgacttggccagatttgatttcagaggttcgtttcactttgccacttacgagacagcggctaatgcacatcagacactcctaagcaggctcaaaaccgtctcaggtccatcatggaaggtaccgagtttgccgagcgactgtcgcccattttcgctcgcataa

SEQ ID NO: 3980 - DNA, 213 bp, A.fumigatus
gggcggaactatccaattccatgccttgcattttcttgtctcacttccgctggcttttgggtcactcccagtacaggtatcacctgcaggagggtcgtattgcagcatacgattgcatggttcgttcagctagcaaacatcaaaatcaatgggcgttggtggaactctgtgactagcgtgtctttagctgcaagtgatgagaaggctggctga

SEQ ID NO: 3981 - DNA, 183 bp, A.fumigatus
gaagataataaagggtggaataaagtagctatctatactaattactttcataatagttatatactcttaattagtattactaggagagaaagaaggcttcttaaactctctagtaactatctattaatctttattaattctaatctggaagcctgtctcattaaagttatagaggtcttatag

SEQ ID NO: 3982 - DNA, 465 bp, A.fumigatus
ttcgcagcgcgtttcctgcttgccccggggtgtagacaagaagtcaaggaaacgatcggcgtcaccgtgccgctatcgactttccttgcccgtgccaccgacctggcgaacgaagacctcccccgttccccccgcagcaagccctcggcagacgagctctttgatgagattctcggcgctgagcctatcaagacatccccgggcgattacgttcccgagctgaatgccctggaggcagttgagtatgagtccgctcagcccgtcaaggaagacatcatcgacattctcagcggcaaggttccaaagaaggcgccccgtaaggcatccatggaggaataccccgccggctctgctacgaatgtgtttagtttgaccgttcctgttggtgatgagacgagggctagggttttcttggaccgggtgaagaccctgttgactgtggagcctggaaggcttgtcctatag

SEQ ID NO: 3983 - DNA, 1251 bp, A.fumigatus
ttcgcaaatcgcggatcgttccatggcggctttgtgaaaacggctgatcagatcggggaccttgagtcccgatgcgcggcactccagtcagaactagactctgcaacgcctacttcactattgcgaaagaatcaggaccctacatcgtggttacctcgatctcctgcccgccatatactcgagggccaccgaaaccctgtcacatgtgttgcgttccacccagtgttttcttccctcgcatccggctcagacgatacaacgatcaagatctgggattgggagctcggggaactagaacggactgtcaaggggcacaccaaggcggtgctagacgtcgattatggtggaccccgtggcggaacacttctggcgtcctgttcatccgatctaacaatcaagttgtgggatccatctgataactacaagaatataagaaccttgccaggtcatgatcacagtgtctcctcagtgagattcatcccatctggcgcggcaggctcccctatgtcggggaatctattggtttccgcatcacgcgataagactttgcggatatgggatgtaacgaccggatattgtgtgaagacattgtcaggacatgtggactgggtacgagccgttgcgccatctatcgacggaaggttcctcttggctgcgggcgatgaccggattcctcgcttgtgggatctatcatctgcggaaaccaaatcgacattcctcgggcacgaacatgttattgaatgtgttgctattgctcctgctgccagctatccacatcttgcggttctttccggcttgaagaaaccgccgccggcttcctcgtcagctgaatttttcgccactgggtctcgggacaaaactatccggctatgggattcccgaggcaatcttatcaaaacgcttgtgggccatgacaactgggtacgtgcgctcgcttttcatccaggcggtaaacatcttctgtcggttgcagacgacaagactatccgctgctgggatttgacccaggaatgcaaatgcgtcagggtcatctctgatgctcacggacattttgtcacatgcctccgatgggcgccaccattaatcaaagatgggggagccaatggagaagctgagaccaatggcacaccggcggccacctcgacaacaaatggagtcagaccagatcccaacgtggccaccaagatctcgatcagatgtgtcattgccaccggcagtgttgaccagaaagtgcgaattttcgcgacctga

SEQ ID NO: 3984 - DNA, 426 bp, A.fumigatus
ttgcacaattttctcagctgcatcagcatgttgctcaaaccacgcatgccagtcttgcctcctttgccgtcactgacaaccatcttattgtgcgtgacaagctgtttatacagcctcgcttgcagagcagaaaagcgacatttgatgacacgctcttgcttatcaggcagatccttctcgacatctttcttcagacgtctaagcaggaagggccgaagaaccttgtgcaaacgacgaatgaccagcagctgttcttcttcggagagttccatgcggtcctggcctccagtatttgcaaatggcgtgttgaaccactcatcgaacgacttgaccgacttgaagatgtttggcaagacgaagttaagtagcgcccacaactcgggcagattattttgcaagggggtaccagtcaaaatcagacgataa

SEQ ID NO: 3985 - DNA, 1500 bp, A.fumigatus
tttcgctctacaacaaacaacctgaatggtattttggcagacgagatgggtcttggaaagactattcaaaccatcagtttgatcacatacattattgagaagaagaagaacaacggccccttcttggttatcgtgcctctcagtactctgacaaactggaatctggagttcgaaaagtgggcgccaagtgtctccagggttgtctacaagggacccccaaatgcgcgcaaacagcagcagcagcaaatccgctggggtaacttccaagtcctgttgaccacatatgagtacatcatcaaggaccgcccgatcttgagcaagatcaagtggacacacatgattgttgacgaaggtcaccgtatgaagaacacacagtctaagctgagtagcaccttgtctcagtactatacgagccgttatcgtctgattttgactggtacccccttgcaaaataatctgcccgagttgtgggcgctacttaacttcgtcttgccaaacatcttcaagtcggtcaagtcgttcgatgagtggttcaacacgccatttgcaaatactggaggccaggaccgcatggaactctccgaagaagaacagctgctggtcattcgtcgtttgcacaaggttcttcggcccttcctgcttagacgtctgaagaaagatgtcgagaaggatctgcctgataagcaagagcgtgtcatcaaatgtcgcttttctgctctgcaagcgaggctgtataaacagcttgtcacgcacaataagatggttgtcagtgacggcaaaggaggcaagactggcatgcgtggtttgagcaacatgctgatgcagctgagaaaattgtgcaatcatccattcgttttcgagcccgttgaggatcaaatgaatccgggacgtgggaccaacgatctgatttggcgaaccgcaggcaaatttgaacttttggataggattctcccgaagttcagggccacgggtcaccgcgtgttaatgttcttccagatgactcagatcatgaacattatggaggatttccttcgccttcggggtatgaaataccttcgtcttgatggttcaaccaagtccgatgatcgttcggacctgttgaagctgttcaatgcgccgggctccgagtatttctgtttcttgctttcgacgcgtgccggtggtcttggtctcaacctgcagactgcagacactgtcatcatcttcgattcggactggaatcctcaccaagatttgcaagctcaggatcgtgctcaccgtatcggccagaagaacgaggtccgcatcctgcgtctgatcagctcaaattcagttgaagagaaaatccttgagcgtgcgcagttcaagttggacatggatggcaaggtcatccaggccggaaagttcgacaacaagtccacaaacgaagagcgcgatgctctcctccgaacgcttctcgaaagtgcggaggctgctgaccagcttggtgaacaagacgaaatggccgacgacgaccgtcta

SEQ ID NO: 3986 - DNA, 900 bp, A.fumigatus
  unsure (673): Identity of nucleotide sequences at the above locations are unknown.
gttcgcagcgcggttcctgccagcctcgtggcgaagacacccagcggtgatgactcgctgaagcttaaggcactgatcgagtacaagatgcttcatcttctgcccaagcagaggcttttccgaaaacagattcagaatgaaatgtttcactttgataatctcggcatgactgccaatcgatctagccaccgtcgcatgaagaagcagtctcttcgtgaagcccgaatcactgagaagttggagaagcagcaacgcgatgcccgcgaaactcgggagaagaagaagcaatacgatcaactacaagccattttgaatcatggtgctgaattgcagaacgccgctaaccagcagcgcacgcgtatgcagaagcttggtcgtatgatgcttcagcaccaccagcatatggagcgtgaggagcagaaacgtgtcgaacgaactgccaaacaacgtcttcaggctcttaaggccaacgatgaagagacttacatgaagcttttgggacaggccaaagattcgcgtatctctcacctcctcaaacagaccgatggctttctcaaacaacttgctgcttcagtcaaggagcagcaacgcagccaagctgaacggtatggggaagatgagcatctcttcgaagatgatgatgaagaagatgtcggatccgatgacgacgaanaaggcgggcgacggaagattgattactatgctgttgctcaccgtatcaaggaagaggttaccgaacagcctaagattcttgttggggggtacctgaaggagtaccagatgaagggtctgcagtggatgatttcgctctacaacaaacaacctgaatggtattttggcagacgagatgggtcttggaaagactattcaaaccatcagtttgatcacatacattattga

SEQ ID NO: 3987 - DNA, 237 bp, A.fumigatus
atcctcgtccatctcccgtctttcttctttctcttccctctcgcggacatgaattccttccacaagcatgtctccttcgatgcctacctcctccccctgctcatcttcgttgcgcgtcgctccctgagccttggctgctcgttgcgcattctccatgcgctgtcgaaccagtctcgcaattgcattttccgtcctcacattaagaattttcattttctcatcaaggtcacgctttag

SEQ ID NO: 3988 - DNA, 687 bp, A.fumigatus
tcgaagccaacggtacttctcggagccctggaattctactttccatcgcctttcttctacttcttttcctctaacacaatgtcgctgaatcacacctctcttgatgcggcggcaacagaacgcaaagcccgtcttgcgaagcttgcagctctaaagagaaagcaaccggaaccggagacactcacagaggcgcgtgctggagaccatgagcctgaggatgccgctccggatgtcacaagaaaatacctgtccggacgtaatttcgatgcagaaactcgaggccccaaactggggttcgatcaagcgccaacagaaggagcgaagacgctcgaagcgcaagctgctgagatagcgaaggctacggcggagcaggcgaagaaggatgaggagaaggaccaaccgatcgacctgttcaagttgcagccaaagaagcctaattgggacctaaagcgtgaccttgatgagaaaatgaaaattcttaatgtgaggacggaaaatgcaattgcgagactggttcgacagcgcatggagaatgcgcaacgagcagccaaggctcagggagcgacgcgcaacgaagatgagcagggggaggaggtaggcatcgaaggagacatgcttgtggaaggaattcatgtccgcgagagggaagagaaagaagaaagacgggagatggacgaggattcatga

SEQ ID NO: 3989 - DNA, 399 bp, A.fumigatus
gaatcatccatcatcactaataccgaaccagtccagatttcgacacttgagcccctctttcttcctttcgccatttatttcttcgttctctttcttccacccccccgatcaattcctgattttgagttggctgaatacctcccctttcgcccccttttcttcgatagactcttttttttcccccgtgtcctcacaatcaaccgtcaaactgttctccttcgcctttcgtcggatttcctcttctctgcgatcctctcttggcctgactgccgctgctgcgtcctcactacatcaaaagtcctccccccctacctcggttctatcacatccgctatcgacgccgtcgcgcgtcaattcaacctctgcttccagaatggtgcacacaaaagttgtcagtaa

SEQ ID NO: 3990 - DNA, 360 bp, A.fumigatus
gtatctacccctcctgcaacaccaaaaaccattgattgtctgctttgttggttgtacgtgttactgacgtggtatcctttcaaaatagttatcggctccggccccgctgcccacaccgcagctatctatctgtcgagagcggaactcaaacctgttctctatgagggtatgctggccaatggaacggccgctggcggccagctcaccactacgaccgacatcgagaacttccccgggttccccgatggcattggtggcgcggagctcatggagaacatgcgcaagcagtccatccggttcggcacagaggtgatcactgagactagtcttcaaccacagggggtcgaaggaccagcgata

SEQ ID NO: 3991 - DNA, 387 bp, A.fumigatus
ttggtgccttgcataaagatcgcaatgtccagtgtctctcctttagcaggacgtctctgtcagatcttcacagcccgtaattacactcttttctcggtggggatattatctgttgggctctttgttactgccgcttcccaaagcctgccggtcttcctatttggacgtgcactatctggttgtggcagtgcgggtgttatggtcacatcgttcattttcatccttgaccttgcaagcaagaggagaagaggtctcttcattggcttgttgaatgtcggagtgacgacgggtatctcttgcggtgcgctacttgccggattgctgacgccagtctttggatgggtatgtcatcttccactcagatcatcggaaacgatacggagctga

SEQ ID NO: 3992 - DNA, 489 bp, A.fumigatus
agattcggcggtgagaagatcaccgatatgctcatcgccattctcaatacctgctccaaggaggagctcgaagacgagactcctacctccgtgtcaccttctgctccgtctcctccgctcccaatggacgtggagagcagcgaattcaaaagacgggcgatcaagaacaagattcttgccatcggacgtctctcgcgtgtcttccaggtgttgcgggaggagtctgagagagttacggaactcaagacagctgctggtggccgtctcccagctggtaccctgatgcttggcgccgaaggaatcaaacaggctattaccaactttgaggacgctcgcaaggttgacttgcagaacgagcgtcttccaccgtctcacgaggaggtcatcaagagaagcgaagaggaaagacgggctgccctcgagcgtgcgcaacaggaggcagacaatgataccggcttggctaccgtcgcccggagaattagcatgtaa

SEQ ID NO: 3993 - DNA, 273 bp, A.fumigatus
ggaccggacgttagatcgtccacttcatccacactgattgaacacgcaagcgctctgttctcgaattttaaccagcgtttatctgctctttacttctatcatgccatgtacggccctatagaacagtcttctctcgagtcgggtaggtcgcagctagggtatctcccgaaccttttcaggcccgcacacagccatcgactagagcagtcacctctcctcaaccccgcaagatttcgacacaaagtactctattctttcttctttgaggcttaa

SEQ ID NO: 3994 - DNA, 1041 bp, A.fumigatus
tcaaggttattcctcccaaggaatggtaggaatttttcggacccttctgttgtttcaaagttggttctgatcgtttctcaacctaggcttgatgctcaaccgcccttggacgaagccgtcaagaaaatccgcgtgaagaatccgatcatgcaggaattccacggctctcacggcacttatactcaggcaaacatcgaacgacaacggacgtacaatcttcctcaatggaaagccctgtgcgaggagagcagtcatcagccgcctgctcggcgaggcgagagacgtcggaatcaagaacgagtcacacgtacccctgcggctcccaagcctcagaccaccacgtcaaattcgcaaaagcgtggacctggtcggccaccaaagcgagccaaccaggtgaaagtgaaggaagagccgcctgcggacgatgttctcgagaaaacgaaaccggaaggtcctccaacgcccgtatcacccgagtctaaccctgttgagacgaagtcggaggaactgagcgatggcgagtcattaccgggacttaagcccaagggtagacagcccaagtccgtaactgcgcgaagaaagcacaacaagggcgacaacatcgattccgtcgatgaagaagcattcaaaaacttcgactaccgcatccacgatcaggaagaatatacgcaagaacgttgtgaggagctcgagactgcctattggaaatcgctcatgttcaacaacccgttatacggagcggatatgcccggttctctgttcgacgacagcactacgtcgtggaacgtcgccaagttacccaacttgctggatgtcattggacaaaaggttccgggcgtcaacactgcctacctttatctgggaatgtggaaggctactttcgcatggcatctggaagacgtggatctctacagcatcaactacattcattttggtgcaccgaaacaatggtacagtatctcgcaagaggacgctcctcgcttcgaacaggttatgaagagtaagttggcaccgctccagccatattctgcgctgtggtga

SEQ ID NO: 3995 - DNA, 510 bp, A.fumigatus
agagtaagttggcaccgctccagccatattctgcgctgtggtgatactgacacgttctcctcaggcatctggcccagcgatgcaaaatcctgcgaccagtttcttcgccacaagacctacctcgtctcgccaagtatcttgaagtcccagtacggtattactgtgaataagttggttcattacgagggcgaattcgtcatcacctatccgtacggctaccactctggcttcaatctggggtacaactgtgctgagtctgtcaatttcgcgacggagaaatggctcgactatggtcgagtggccaagaaatgcaactgtgaagcggacagtgtctggattgacgtcgacgaaatcgaacggaagctgcgcggggaggcgacacccgaatactacgatgacttcgacagcgatatggacgtgattgaaggtgcttcggatctcttgactccgccccgcagtgtgcctgagaaaaagtccacccgcggtcgggaaacgccagcatcctggtga

SEQ ID NO: 3996 - DNA, 255 bp, A.fumigatus
gacaacaaactcaccatgagcgtccaacttcccccagtcacacaccgcaagcgcgccttcccccagggcgaactcgaagccgcctcaaccctcaaactcggagccgatcaaaacacacataccctctcgctgtcggaggcacggctcgtcatcaataaggtgctggagaataagcgccgcggggggaagaaatacgaagaaccggagtacgtcgccctgcgttgggttgcccgtcacccaatctttccactgtga

SEQ ID NO: 3997 - DNA, 216 bp, A.fumigatus
gccatgggtcattattatcaactcattaatggaattgtgtttgtcctctctggcccggggttcgcccacgagactaacattgccaattctctgggacagctactcatgcacgcagcgatgtacatccaatcaaccacccctgctcactacgttcttcacttcatgattgattatcgccaactaacaaacccctctatcagcacaatcagactttaa

SEQ ID NO: 3998 - DNA, 690 bp, A.fumigatus
  unsure (173),(589),(661),(667): Identity of nucleotide sequences at the above locations are unknown.
tcgaaggctcggtgtggtacctctaacagcactgtgcctttgaacaatattcccagccggagcgcccttattccatggcgtaaactagcgcgcggttatcgccaagtccagcctccagttgccccggttgaagattgtggctggcagtcatgtcttggtggactcggatcatntgagtccaaaccctccggcaatgacgatagtcaaccttcgcttgggtggaaggcgaccctgctcaatgcaactttgcatcttcctcccccgacaattgtgaatgccttgttcttgcgccggatgtcaccaaccatgcagctgtcattggcagtctgctcgacccggggagcccctctatcaaactccgcgccgcaagcttctctcctgggtcaactctcccacgacacgggcaagtatagcaatgaatacctgttcagcactgacaattctttattcggctggcgggggctgtggaacttcggccccgacccgcgccatcccaaggagaactcatcaccacagttatcactactatcagccggcgcagaagcatattactcccccgtctcttcgctcatcggcatgtcaactgggntacggttcagcaccctaccagcagccaccgagatgccttcatcatcatcatccgcatcgagcacaaccatantgtccnacagcgctgaaaagccagagtag

SEQ ID NO: 3999 - DNA, 321 bp, A.fumigatus
  unsure (139): Identity of nucleotide sequences at the above locations are unknown.
tttgagacatcattgacaatgcttgacttcatggactacatccaactggcattcgccgaggcgaccaactggaaccgcgacaactcatattcgtccctgacagccacggcgcaatgtatgtggattacctcatatttanactctgataatcatagtctcaatttgactgcatacagcattactcgacttctcgacaccggagcgcctacgcgtgcatctttcctccctagccactcctcatttcgcgaacagttaaacccctcggcacattggattgatcgaaggctcggtgtggtacctctaacagcactgtgcctttga

SEQ ID NO: 4000 - DNA, 405 bp, A.fumigatus
aagatgtgcgcaccgaattcgctgatagtcggtaagtcaccccggagatatgcacttctacaatgtgcaatacagctgcggaaacatcatcgcgagcttcaatcgctgatatttaatagtcttttctttggcaaaactaaagtaatggctgttgccctcggccacaaccccgagaacgaggccgcgcccaacctgcataagctctctccctacctgacaggtgccgtcggtcttctcttcacctctcgcgatcccgagtccgtcctcagctacttcgacgccttccgccccctcgacttcgcccgtgccggcacagtcagcacccgctccttcagcatccccaatggcctggtttactcccgtggcggtgagattcctgcgtccgaagacgaacccgtcagccgt

SEQ ID NO: 4001 - DNA, 207 bp, A.fumigatus
tatcttaaaatgcctcgttcaaagcgcgccaggatcgttcacgagtcgaaggtcaccaagaaatcccacaaggaacagaccagaagactttatgccaatatccgcgaatgtgtcgagaaatatgatcacctatttgttttctctgtcgacaacatgcgtaacacctatttgaaagatgtgcgcaccgaattcgctgatagtcggtaa

SEQ ID NO: 4002 - DNA, 228 bp, A.fumigatus
tatctgattactgatgaaatagaattgggccgtggcaggatcaattcaacattggactccactatcaatccccactcgtggactgaagtttcgaatgtgctgttcctgtctcagcctctgggtgtcggtatgcatcagaccacgggcgctcttcaattttccagactctcgactcacaatactgcaatgcaggattttcctacagcgaggcagaacccggctcgctga

SEQ ID NO: 4003 - DNA, 600 bp, A.fumigatus
gtctcactgaacgcgggcaatgtggccgatatgggcaagactgactcttatcaggtaactggtatcgcatgggctcaggggcaattcatgggcctgtccactccaatggtacctccgttcccgatttctgattacggcacaggctgcatgggcgccattgccgccctcacaggtctctaccaccgtgcgaagaccggcggatcctaccacggaatggcctctctgatgcattatgacctcttgctctttgccgtgggcaaatatccagatgctgtgcaggagaagatgcgggctgctcaacccccggaatttttcaagcttcggcactgcgacagtgtggaccgcatctcctcgactgtcctaaagatcatgcaggcgcggtttccacatctctatgtagcccccgacgtggctggacaggaggcgctcacagaaaaatggttctccaaggcgtacaatgccgacattgaggttgtcaaacctatcgtggagattgacggcgtggacaacagcttctcgcgcgccagccgaccgaacggctccgatcgacctagctgggaggacttcaagctgcccgaagaggattacaagaaggcttaa

SEQ ID NO: 4004 - DNA, 291 bp, A.fumigatus
ataaatcattcagatagcctctcacaaaccaatagacaacccagttcaactcgtcgcaccctatccgagcccagcataatcaaaatgtcctacaaaatcaccacagacccaaccctctccccaccattcgcaaacgccatgatctccttcatggaatccttctaccaaatcagcgacgatgaatcccagcacgagcaatacgttgccagcttcacgtccgacgcaacactaatcatggggcctaaggtcccaaacggagcggacggtagcctgccctctcacaaagactaa

SEQ ID NO: 4005 - DNA, 606 bp, A.fumigatus
accaccaggagcaccatggagattgaccaggtcaaaccagagcgccatgacatcgctcccgatggtgatctcattctgctttacaagaagcatgcaaaccgacctgtcgagttgcgagtctcaacaaccatcttgaaatcccaatcgatctacttcgaagccttgagtgggaggtggcttgagacccttcctgtccggccggacggactgcgtgagatggccttcgagagattcgatccggatgccatgctgatcatcatgaaggctgcgcacttgaagttccaagggatcccggatgagctgaatgtgaagctgcttcacaaaattgccaagtatgtgcacatgttcgacatgttcccagccgtttgtactctggctcgcccctggatccagtacgtaaggatgttcgttgaccaatgtaacagtacagagcttgcgggttaccttctgggaatcatgtgggtgttcaacctcaaagagcaattcaagaaggcaactcggtctatagtcgtcgattgcaatgcggtggatattgatttgtctcgaacactcattgaccagagcagtcttcaccacggggctggaaggatccgcggtggcgttata

SEQ ID NO: 4006 - DNA, 399 bp, A.fumigatus
actctccgtgtatcagagacattctgtcttcgtctctggcaatcggacactcaaccactctaccgtactggcccatacgccgccctcaatttgaatttggactttgctcggaagactcggaattgcctacttgaacttctcctgcagcagcgcaaatggatcgcgaccaatttagggccgctgcgcatgcggcgatcgatgaaagtgtgtagcctgcattatgatgtcaattctgtgctaaaaattgctttcatagtcatcgactacttcgacggtctcccctcccagcgtgttgttccgaccattgaaccaggttatcttcgccccttgattcccgaaaatcctccggaagaaccagagcaatgtctcaggtattcgcggcgcgtggaagatccatgt

SEQ ID NO: 4007 - DNA, 219 bp, A.fumigatus
ttagttgggccgaattaccaccccatcgggacggcgagtatgatggctcgggaactagggggcgtcgtcgactcaaggctcaaggtttacggcacggagaatgtcagagttgtagatgcgtcggtgattccgctgcaggtgagcggacatctcacggcgacgttgtatgcggtggctgagagagcggcggatattatattggatgggagagaagattga

SEQ ID NO: 4008 - DNA, 762 bp, A.fumigatus
gcatactatcgcggtatcctgccagctcccgaggtgaagacgtctgggtccaagtacccctctccgattctatcgctgcgggtgatcacgtctggtgtcgcgcgggaagacaagcacatcgcggtgggcatgcagtcgggcctgttatcgatcaagacccggctgtcgggccagcagaagatccgggagcgggaacgacgcaaggagatgcaggcattgcttgaaggcaagctggaagagcacgaccggaaggtggccaagcagaaaaaactgcgcgggtcaggctgggagaagcggctgcgcgggcgggatttcatcggcgaaggcgtggagatcgtgatcgagggccaggacaagaagaagcgcaagaaggagcagacgtgggagtacgacctgcgcaaggcgcggtactcggcggcgctggaccaggtgctggcgtcgagcgacaagacggcgcagctgacgctgttcacggcgctgcggcaccgctccgcgctgcgggccgcgctgcagggccgcgacgaggagacgctgcagccggtgctgcagtgggtgcacaggaacatcacggagccgcggctggtgacgctgtgcgtggaggtcgccatgaacgtgttggacatctactcgggcaatctgggacagtcggcgcagatcgacaagatggtggagcgcctgcatcggcgggtgcgcgaggaggtggaaatggcgcatcaggcgtgtcagaccaaggggatgctggatatgttgcaggccgtatag

SEQ ID NO: 4009 - DNA, 837 bp, A.fumigatus
aggcaagctggaagagcacgaccggaaggtggccaagcagaaaaaactgcgcgggtcaggctgggagaagcggctgcgcgggcgggatttcatcggcgaaggcgtggagatcgtgatcgagggccaggacaagaagaagcgcaagaaggagcagacgtgggagtacgacctgcgcaaggcgcggtactcggcggcgctggaccaggtgctggcgtcgagcgacaagacggcgcagctgacgctgttcacggcgctgcggcaccgctccgcgctgcgggccgcgctgcagggccgcgacgaggagacgctgcagccggtgctgcagtgggtgcacaggaacatcacggagccgcggctggtgacgctgtgcgtggaggtcgccatgaacgtgttggacatctactcgggcaatctgggacagtcggcgcagatcgacaagatggtggagcgcctgcatcggcgggtgcgcgaggaggtggaaatggcgcatcaggcgtgtcagaccaaggggatgctggatatgttgcaggccgtatagcacgcacgcgcgcgagagtacagcgagcaatagcaagcattttacgcagaggtcaaaaagtgtttatctacttagacttgttacattacggatacctggaaggagttagggaattcatcgttcattatttttttttttttttttttttttttttttttgtctttcttcaatcttctctcccatccaatataatatccgccgctctctcagccaccgcatacaacgtcgccgtgagatgtccgctcacctgcagcggaatcaccgacgcatctacaactctgacattctccgtgccgtaa

SEQ ID NO: 4010 - DNA, 1314 bp, A.fumigatus
tttcaaaaaatgcagaaattttacctatccacgtacgcgaagcccagcctgggtggactcgcaaccgggagtatcactcatggctacggccaatggatgcctgagaacatcaggcttcgccgagcctggctatctcaccttctggacaaggcgaagccagaaattccccggaagttgagagatggccaggagaaccctgtcgaggcattgaggaacctaattgagaacaactccactctctatatgcttgcccattccatgttcgacgaggtccctgaaaaggctccatacgacagggacccaaccacgctcaagaaacaagtccgaaactacaaaaccatgttatatctcttcaataccctgttgactgaagtgcccgagtactttctggtaaacgaccccgacgtacccagcggtcttattgggttcccattcaatgtcatcgttgactggccgatgggcacgcagagtggtcgtcaattcttccttgatcccagagtgaatgggtgtctgaaagccatcttgaataaatggaatgatttcctcagcgaccccacgggagggaccgggcaggagggtggtggcaatcaagcactaattgatgctggttggagttcagacattgcggtccaacagttggagaagaaggcaaatgacgctacccccggtagtaagaggaagtttacagaactgttcatacaccccgagggtggtacgcaggaaaattttttcaaatacgcctgttgggacgatttctttacccgcaagtttaggcccggcgttcgtcctgtaggagacggggcggttgtcaatgcttgtgaatcattccctctttcgttcgacaccgacgtctcaggccgcacgaccttctggcttaagggtatgccatattcgctacacgatatgctaggagccacgcaggatgatagagtcagccagtatgttgacaaatttgtcggcgggactgtgtatcaggccttcctgagtgcggactcctaccactgctggaatgctcctgtcagcggtacggttgtataccagtctcgcatcgatggaacatactttgccgaaacgcctgcttcgggattcggaggctcgagtggacctgatccagctggcccagacatgtcacaacgttatatcacccatgtagcagcacggggtgttcttattgtcaacacaaatgtccccaatggctcacaggttgggtttgtgggcttcataccggttggaatgtctgaggtatccacctgccggtgggaggataaaattgtcgaagggtgcactattacaaagggagaagacattggggca

SEQ ID NO: 4011 - DNA, 252 bp, A.fumigatus
tgcttgattgccaccaccctcctgcccggtccctcccgtggggtcgctgaggaaatcattccatttattcaagatggctttcagacacccattcactctgggatcaaggaagaattgacgaccactctgcgtgcccatcggccagtcaacgatgacattgaatgggaacccaataagaccgctgggtacgtcggggtcgtttaccagaaagtactcgggcacttcagtcaacagggtattgaagagatataa

SEQ ID NO: 4012 - DNA, 552 bp, A.fumigatus
gcccgcaacaagtcgggaagacttcaagctttcattactgagtatgatcctttcctgatgccgaacctcatgacatacatttatactcgagggcaaaacggaaaggtgaacggttttgcagccttgcgatggatcggtgagaagaatggatatcacgttgatccgtgtatcgctgccccgagagcgccgaaggggattagcgatctgttaatattcgcctcgatggcttggctgaggcagattggcatctcactcctgagctttggctatgaaccctccgactcgttggcagaggtgtcgggaatgcctagtcctctcgcacatttaacccgccaaatctatcgatatacattccaacggctcccaatcggcgggaagaaggcgtattttgacaagttcaagccggatgaggagcaggattcacccctctatcttatatttccgtcgacgatcccagaaccacggccgatcatcgctatggcccatgttgctaacatcagtatccgcaaactgtggtttcatcaccgttccaagcctgcggtcccgcaatga

SEQ ID NO: 4013 - DNA, 321 bp, A.fumigatus
gtccaaagccagaccatcatggcatgcacaactacctttctcgatctcccggcagagattcacctcctgatctgcgagtaccttgaccctgcctcggcagtggctttgaaaagcgcaagtaagtacctccggtccatcatcaccgttgacatggacgagcttgagcttgaatactgggaagtgttctacatcaccctcgaaatgtggccagagcgagtgcccctaaaccacaatgaatgtttgagtgacatagatggtatgatccttacacttacatacctgcagatacggcaatcacttcttctgcactggatgctgtaa

SEQ ID NO: 4014 - DNA, 222 bp, A.fumigatus
atcgccagaaccagaatagtgatgggaacccatgacaatcgtttctggactattccctggtgggttggacattttatatactccggcgagtgcggcaacaaggtggtccgcgacgtctggtactgtaatggcgtgggttccgagggttccgagggttctggatacggcgatttggtcgcaaggtcgccgtcgtcggcatcatcaggccccgggcgcttgtag

SEQ ID NO: 4015 - DNA, 783 bp, A.fumigatus
  unsure (659): Identity of nucleotide sequences at the above locations are unknown.
gtgggtttttgctccgatgaaaacacaacgtgcatactgatggtcatagtggcgccgaaactgcggatgggccccctcgagcctcgggtcctggtcggaaacgtgtccaccgaattcgccaacccggcctacctcatcacccattgctcgacccccgtcacgctggccatggacccggaggcggccgggagcacctgcttggacctggaactggtcggacaggcgtaccacaactaccaggcgtacatctctgcctggagcgacctggccaagacgaacaacgggacgacgtcaaccctcgcagcgcggccgcccccgaccggctcgctgtacgataacaccaccgtgacagggagctggattgacattggcaatatgactgaattgtcgctccggtacggccgaatggtcaacaacgtcaccgccgcaatgcctcatgccggagtgatcgccgccgcggccgacccgcgcaatggtatccgccagccggccgatgtgaccggcgaaggcaacttcgagatcgaggcctcggtgccttcgccggccgtcaacgtcctctgtgtcgggatgacggaagaagagctcacccccttggtatacgagaggttggccgaccggcacaacttcaatccgctgaactgggattacgaagggacccnattcgtccccgtcgaacggttccatcgaacagtcgtcgatgaactcttcgggtgggatcccaccggccaacgccgaagtccagcaaaaccccgcccggtgtttgggaaattggcccctccgcca

SEQ ID NO: 4016 - DNA, 975 bp, A.fumigatus
aatccattaacagtcggggtccatccgttgccatcttttcctgtcggtttagataaatttagaaccgccgtcagggcgtcggaatcgcagcagtcgaaacaatatcttctgcctccggtgtccgagttgcttcgtcgagatgacaccactaacaaaaacaataatcataatgataatgaagaccactctttccttcccaaatcgtggaatccctttgaccgcagtccttcacccgaccgcgactatatccgctatcagcccgcctcttcgacaaacgatgatcccgcttctccgccggcaccccgcgagcccgcgcttggcttaggcatcaccaataccttccctcaatctccctacaagcgcccggggcctgatgatgccgacgacggcgaccttgcgaccaaatcgccgtatccagaaccctcggaaccctcggaacccacgccattacagtaccagacgtcgcggaccaccttgttgccgcactcgccggagtatataaaatgtccaacccaccagggaatagtccagaaacgattgtcatgggttcccatcactattctggttctggcgatctactccaccatcttctccggcatctacctggtgcttgcgctggtgaaaccgcgctatggcaaaaagatcggcgaggacggtggcctggcgccttccacagccagcctacttagtgcactcttcgcgaagaccattgagctgtcatacgtgacggtctgcgtggcgtttctggggcaagtcctgagtcgtcgagcgatcaccaaggggtcgcgcggaatcaccatctccgacatgagcatgcgcacttggatcatgcagccaggctccctcattgtgcactgggagactgtgcggtactctgcgctcacggtattgggtgtgatcacgttgaccgcgacgttggtggcgatgctttataccacggcagcagaggcgctaggtgggtttttgctccgatga

SEQ ID NO: 4017 - DNA, 252 bp, A.fumigatus
cttacaatgctggtgccctcggtgcctttgctcaacctcattaacgatggccggaagctgagcatgctgagaaacgctacatggaccctgagcaacttctgccgtggcaagacgccccagcccgattggactacagtaagtttctccaggctatgctctgatgacaacgtcacttttctaacgcttcccagattgcccctgctcttcctgtgcttgccaaactcatctatatgctcgatgatgaggtcctga

SEQ ID NO: 4018 - DNA, 939 bp, A.fumigatus
caacgtcacttttctaacgcttcccagattgcccctgctcttcctgtgcttgccaaactcatctatatgctcgatgatgaggtcctgattgatgcttgctgggccatctcctacctgtctgatgggtccaacgataagattcaggcggtcatcgaggccggcatccctcgtcgtctcgttgagctgctcatgcacgcttctacctctgttcagaccccagcccttcgctctgttggaaacatcgttactggtgacgacgtccaaacacaggtcatcatcaactgtggagctcttcctgccctcctctctctcttgagttccaccaaggatggcatccgcaaggaagcctgctggaccatctccaacatcaccgccggcaattctagccagatccagtctgtgatcgatgctggtatcatccctcctctgatcaatttgcttgccaacggcgacttcaagacccgcaaggaagcttgctgggccatctcgaatgccacttcaggtggactgcagaagcctgaccagatccgctacctggttagtcaaggatgcatcaagcctctgtgcgacctcctcgcttgcccggataacaagattatccaggttgctctggatggcttggagaacattctcaaggtcggagagatggacaaagaggccgctcagactggtgaggctcgcgtcaaccggtatgccttgttcatcgaagaggctggtggtatggagaagatccacgactgccagaacaatgccaacgaggagatctacatgaaggcctacaacatcattgagaaatacttctctgatgaggaagaggccggcggtgacattgatgagcttgcccctcagcagacgcaaactggtttcgccctcggaaccaaccagcagcaacctggcggattcaactttgccaacggcggtgactccatggatatgtaa

SEQ ID NO: 4019 - DNA, 252 bp, A.fumigatus
tttcatttgaattttttttttataaacgcggagatttctcgccaactaaagttcgaaccccatccattgttctctatcaggtacagccctgctatttacctctctaaaacagtgaatcaatggcaatatgttcacatcaatccgatcaacacctgtccaaaggtttgccacaccaagttaattagaccatgcctgaacgtactacccttcaaaaaacaaccgatgatcggtcgactcccaccatctgtgtag

SEQ ID NO: 4020 - DNA, 987 bp, A.fumigatus
cttgatacgcatagcgcggatccttccgcccccgtggtgaagatggtctcggggcactacgttttctccaagctcattgtcgacggtaaaccgacccaggactttgagtacatccgcaggaacaccaacaactacatgccgaccctcccctccgagatcctcagcaatgacttccgctgcaacaagggctcgatgcagtccgccgccaataccaaggtatacaaggtggcccccggcacggagctcggctttcagcttgcgtacggcgccgagatgaagcacccgggtcctctgcagatctacatgtccaaggctcccggcgacgtcaggtcgtacgacggctccggcgactggttcaaggtccaccaggaagggctctgcgccgacacctccaaggggatcaaggacgaggattggtgcacatggggcaaggataccgcgtctttcaagatcccccaagacacgccggccggacagtatcttgtccgcgtggagcatattggcctgcaccgaggcttcctcggcgaggccgagttctacttcacctgcgcccagatcgaggtgacgggttcggggtcgggatcgccgagtcctaccgttaagatccctggagtgtacaagcctgatgacccgaacgtccactttaacatctggtatcctactcctacggcgtacagcctccccggcccgtccgtctggactggtggctcggcaggaggcgccagtcctactgcgccggctgtcaacaacaatgctgttcaagccgctcccacgaccatgacgactgtctcatccccagccaacccaactgcaggagcagaggcagaagcagattgtggtagctcagaatcttcgtccgctgtggccccggagggcaccctcaagaaatgggaacagtgcggtggtctgaactggactggttctggctcgtgtgaggcgcgcactacctgccaccagtacaacccttactactaccagtgtatctag

SEQ ID NO: 4021 - DNA, 303 bp, A.fumigatus
caatccttacctctaaggttgaagttgataaagcattcaattcccatcctatcacggcacttgaccatcggaggtgctgacctatcagtcaccatcaatgtggtactcccgcatcaacctacctctaaaggttcagcgtatcctgagttccttagatggtgcttttgcggtggaatggtgtggttttgctctaaccagactgctagtttgtacccatggacattaaaaagccatgtctcccctcagtatagttcggtgttccagcttcggctttccatctacgattgcgtcaatacagattga

SEQ ID NO: 4022 - DNA, 558 bp, A.fumigatus
  unsure (268),(494): Identity of nucleotide sequences at the above locations are unknown.
gcttgtgtcttcgccaacgctgctattgttcaatttaagctgacaattcaggccgtgcgttatctgagaaatgcatacccgagcgataaactcgtcttcagggtagtcaccctcttggaacctcccaaagccctcatgataccgtatctagaggcagagcgttctggcaagcgggacgtcactgctccgaagcggactgcgttcgttcaattctacaagaacacaacagcagaatttcgcgaggtccatattgagttggacaccggcnagatcacgaaagagaaggacctcgcgggaaggcactcatatgtcgacccggaggagatgcaggctgctgaggatgcttgcattgcctcaacagaggtgcaggaggcaatccggttgctagaacttccggaggaggctgtcgtctgtattgagccttggacgtatgggactgacggaatgaacgatatgtcggagcgaatcattatggtatggtactcggtcacgtncgaaagtgcagtagtgactttctatacagtgctacttttacatgcgtcttgggaaccacggtga

SEQ ID NO: 4023 - DNA, 432 bp, A.fumigatus
cgcctgtggctggtagaacgcacgtttttggcctggctgagaacatcgctagcttttgcttccattgggatcgcagtgacccagctcttccgcctgaacgcgaccaacgcaccgtcttccgacgtatcttctcaacagtttccttctctcctttcaccccctttctatgattccgcaacaatacagatcacgtctgaatcccaacgactgcggaatattggcaaacctctcggaacgacgttcatcgggatcgccctgatgatccttctgattgggttccaccgctattttgagagtcagtactggatcatcaggggtaaatttccagcgagccgtggaagtgttgctctggtagcaatcgttgcggctgctttgatcgtaacctcttttgtcgtcatactcgcaatttcgccaagtgctaccgagagttaa

SEQ ID NO: 4024 - DNA, 900 bp, A.fumigatus
agccttgctgaccgggaccgtagaagacagcgggctgcatgtactgcatttaaagttagcaactgtgctccattttacgagccaacatttaatgatccgaaaatcagggatacataccggctggggcattccagcggcagcggcggcctgctgctgacggatggtgttgcgagcctgaatgctggcctcgagctggcttctgcggacatccttgcgctgggcaagagccacatacagaggcttgccgttgaccattctctggttcatttcggtgacggccttggaggcctcatcggggctgctgaagcagacgaaaccgaagcccttgctctttccaagaatcttcttctctgtcttcttgggctcctcctcggactccttgggcttctcctcggtcttctcctcaccctccttctcgttctccttgttcgactccttctctttctccttctcggactcggaggtctcgccggtagtgacggtgtcacgcatgaccttcgcggaggtgatggtgccgaaggggctgaagagctcgcgcagcttttcgtcatcaacgtcatcagtgaggttcttcacgtaaagattgacaccctggtacttggaggccttctccaagcgagcggcctcgtactgcttgcggagctcctcctcacgttcgtgcttcttctgggcacggccaacgtaaagcttttggcccttgatctccttgtcgttcatctcgtcaacggcggcctgcgcgctatcgtgggtggagaagttgacgaagccgaaaccacggctcttaccctcctggtcgcggctcaaagtggcggaggtgatctcaccgaacttctcgaacatcttgcggaactcctcatcggtgacttcttggttcatgttcttgatgtagaacttggttga

SEQ ID NO: 4025 - DNA, 642 bp, A.fumigatus
atgcagtacatgcagcccgctgtcttctacggtcccggtcagcaaggcttcatccctgctggtcagcgcggcggcatgccttttgctcccccagcccggtatggtgatgggcatccctggcggacgcccccggccagtaccccggtcccttccctggtcagcagggtggacgtggcatgggccctaaccagcagattcttcccaacttccaaggtattccccatgggcgccatgcagggccccggtggcattcctaacggtatgggttaccctcagatggctcaggtacagttcggacgcggtgctggtggccgtggtcaggtgcctggaatgcccatgggtcagggtattcgtggtcccggttacgggcagggccgtggtggcgcccccgtccagggaggccttcgtccccagggtggtcgcggtcagccagccggtggtcctcctgccgccggtcgcgaggaggttcccgccactggtggtctcactgcccagactctcagcgctgtcccccctcctcaacagaagcagatgctgggtgaggctctgtaccccaagattcaagctcagcagcccgagctggctggcaagatcactggtatgcttctggagatggacaacaatgaattgcttggcctgtaa

SEQ ID NO: 4026 - DNA, 1071 bp, A.fumigatus
gtcagagcaagtttgaggagaggaaggcccatttcaaccaagttctacatcaagaacatgaaccaagaagtcaccgatgaggagttccgcaagatgttcgagaagttcggtgagatcacctccgccactttgagccgcgaccaggagggtaagagccgtggtttcggcttcgtcaacttctccacccacgatagcgcgcaggccgccgttgacgagatgaacgacaaggagatcaagggccaaaagctttacgttggccgtgcccagaagaagcacgaacgtgaggaggagctccgcaagcagtacgaggccgctcgcttggagaaggcctccaagtaccagggtgtcaatctttacgtgaagaacctcactgatgacgttgatgacgaaaagctgcgcgagctcttcagccccttcggcaccatcacctccgcgaaggtcatgcgtgacaccgtcactaccggcgagacctccgagtccgagaaggagaaagagaaggagtcgaacaaggagaacgagaaggagggtgaggagaagaccgaggagaagcccaaggagtccgaggaggagcccaagaagacagagaagaagattcttggaaagagcaagggcttcggtttcgtctgcttcagcagccccgatgaggcctccaaggccgtcaccgaaatgaaccagagaatggtcaacggcaagcctctgtatgtggctcttgcccagcgcaaggatgtccgcagaagccagctcgaggccagcattcaggctcgcaacaccatccgtcagcagcaggccgccgctgccgctggaatgccccagccggtatgtatccctgattttcggatcattaaatgttggctcgtaaaatggagcacagttgctaactttaaatgcagtacatgcagcccgctgtcttctacggtcccggtcagcaaggcttcatccctgctggtcagcgcggcggcatgccttttgctcccccagcccggtatggtgatgggcatccctggcggacgcccccggccagtaccccggtcccttccctggtcagcagggtggacgtggcatgggccctaa

SEQ ID NO: 4027 - DNA, 255 bp, A.fumigatus
gaatacagagtctctgacaggtcctatccagattataggtatttgtggtttggtttggtttggttttggtttggttttggttttattatctactctgtacgtcacactcggcggatggtgtggatgggacggacaattgtcattattggatggccgacgactatctggcttaaagagattactatcggcatcgagattgtgagaattaatcgtcatacgcaaccggtccttagtcggccatgttcgtgtagttga

SEQ ID NO: 4028 - DNA, 204 bp, A.fumigatus
cacaatggcgtccacagacaaaccccagatcctccttctctgcctctcattccgcgactttctcgacgagacctactccccacttttaacaccccgggtaaattagccgctgttcaaccccctaaaatcgaatttggcgcattccgcgccttgtgcttgacctccttcaaaggaggtattattgcccacataggcctcacttga

SEQ ID NO: 4029 - DNA, 339 bp, A.fumigatus
tggccaaggatggagagtcggagggcctgttcgaggaagccttgcaaacaacagttttggaaaacattctgccttgcttacttcaagttcggggccgcattccgtccttcctcactttccttggaagacactcatcagttgagacagttctctctcttcggtaagttgtttgtcgatgatgacatttgtcgttcgagtttccttcatctctttgatgtccagttagttgtacgggacatcttgggtgacatcgtcatgtcgttctccaagcttacggactaccccacactagtggcgcatagaagtgtaaagctgcagatctggggtaagatgctcatt

SEQ ID NO: 4030 - DNA, 579 bp, A.fumigatus
ccttcctgtttgccctatcttattctaacatggtggcctaggaaacaccagaaacgtcacgatcgaccctacggttgcacattccctaagtgcagcaagacatttggcagcaaggcggactggaagcggcacgaaaactcgcagcactatcacatccaaagctggtactgtaccttgtgcgatccgaccaaggggaaacgatacgcgagatggtattatcgtcaagaggtcttcgtgcagcatctgaaaacacatcatcacgtcgataatgaaggagcgagagttgcggtcgcgaataaccttgtgggagagaatggacagtctcgattttggtgcggcttctgtagggagattattcctcttcatagccagggtcgagaagcgtggaatgagcgcttcgaccatatcgattttgagcactttcgtagagggcagcggatcgaagactgggtgcactgttgccattcgagcgatgatcaagaatgcgaggaatcaaagggacgaaacatggccagtggaagcgatgagagcccgttccccacagattttttacacacgcgccagaatccacttattgtt

SEQ ID NO: 4031 - DNA, 234 bp, A.fumigatus
tacggaagcaggttccagagactgaacgtcctgatcaacaatgcctcaaaacagtatatgaataagaacttcgccgatatcgacctgaataaggtggaggatatcttccggaccaacatcatccagatgatggctctgacgaaatatgctctgccatttctgtcaaagggtgactcgttagtattcctcaaaccgcagcatgcgcaattaactcatcgtacttatatcaatagc

SEQ ID NO: 4032 - DNA, 216 bp, A.fumigatus
cgagcgtatagctccggcatcggccgagctgttgccattctgatggcacgggaaggggccgatatcacaattgtccattttcccgaggagatagacgacgctgaagagaccaagagagccattgaacatgaaaagagatcatgtctacttgtcgctggagacctcagggcccacaatatgtgtcgacgagctgtggaggagcatatgaacaagtaa

SEQ ID NO: 4033 - DNA, 369 bp, A.fumigatus
tatctaagaactcgcaaaggtcccactcaaccttccgatgtagaggctcaaacaaaaacttcactcgtctacagcaacctagcaatctcttcgaaatggcgtctcagatgggtaaggaaggtacttttcaaccgcctcaggcaccgcagagtcaacaaaaaccggggtcagtgctccgtccctacaggggtgacccttaacgactccggtactaaggacctgatcatcagactcgaaaagcatatggttcctcccagcgaagccacgaaactggagtcaaaaggtcactttgtcgagtatgtaggctctggcaaattgaaagacaagaaggttctcatcactggcggagagtatgtccatcagttttag

SEQ ID NO: 4034 - DNA, 291 bp, A.fumigatus
agccgtcgaaggatgtgtctgcggcgctgcgcgccaagcggtagaagaaaagcgaccccagcattgttcgagggcgagggcgcgtatctggggccctgggcaaagtaccaggacgacgaccgtgtctattatgaggaagctgccttatcatatcaggaactggggaacgatcaagaatttgttggaggatcatttcttattctttctctttccaactttcttaatcctttaccttggttttattttaactttctttatccacccctttttccaaccttactttcttccctt

SEQ ID NO: 4035 - DNA, 1473 bp, A.fumigatus
  unsure (621): Identity of nucleotide sequences at the above locations are unknown.
gtgaccaaaacctcgcgaggacgccacgtcctgagtcatcggtactcgttcttcgtcttcaataacctcatggtcttctcgctcttgtcggccgcatggacatttgtggccgctgtcgtcgacgcgaagaaccatgacgaggacgcctggcaagcgatcaaggatggcgcgttgtaccaaaaggtcatgagcgccttgtgccaagtgtctcccttctgggtgacgtggctactgcagcgcaacctcggagcggccatcgacctcgtgcagctggtcactctcttctgggtttggttctccaagacctttgtcgctcccacgccccggcaggccatcgaatggaccgcgcccccgccgtttgattatgcgagctactacaactactttctgttgtattcgaccgttgcgttgtgttttgcgacgatgcagcccatcgtccttcccgtcactgcgttgtatttcggattggacgctatgttgaagaagtatctgttgctctatgtgtttgtgacgaagacagaatcgggcggccagttttggcgcgccctgttcaaccggctggtctttgcgaccatcctctccaatgtagtcattgcgctggtggccaagaccaagggcacntggaccatggtctactgtgtggttccgctgccattcctgatgctggcattcaagttctactgcatgaagacattcgacgacgagatcaaatactacaaccgagcgaacctgaccgatgcggaggcgtttgctgtcgacaaatcgggcagaaaagggtctgaccggctcagctccaagttcggccatcctgccctgtacaagcctctgatcaccccgatggtgcacgctaaggcggccgatgcactcaaacaaatctatcgtggtcgactcggcgcctcggacgtccatggcgaatactcggacattgcaatggatcccatgtcagcaacgcaaccgggcaaggccatggacgccggccaatcggcccccttcgaggttgttcccgagaatcatcttgacttctcctacttcaaagatcgtcccgatttccgtgacgagtttggtgggggcatctatggccgtcccgaggacttgatgactgaacggtcccatacgccgcgtagccacctggccgaatggtcaccggccacgtcccgcgcgtcgtcgcctacgccgtcgctgccgtcgctctctggattgaaaatgcccgaaggctacgacccgatcgcgaacgatatccaccctgccttccggactcctctctcgcgtgaggagagtgcggcgatgggcaccggtctgtatcatcaccggagcgcgagcgagtctcagcagcttctaagccaggcacaggtacctgggaccagcgagatcacacctgctcccctgagccgatggcggactggaggatacgggcctgttgagcaggacgatcccaacttcacctcgtatgagcagtaccgtcatgcgcggtag

SEQ ID NO: 4036 - DNA, 639 bp, A.fumigatus
actatccctcccagatctgactggtatgcgacggctctccctccaactccgtcaaacacgaaacaagcgaaggctttgccccgccacgtggtggaacgcgttcacaattatgccatctcacttcttgagaaggagactaagatgtacacggaggcgcagcaggcctcgtcctcttcctctcacaaattctacacgaccatcatgtcgaccggtaccctcagcgacaagatttcggctttgacgcttgctgtgcaagagtcgccagtgcacaacaccaagcaactagagaatttgattggcctaggcaggaagcgcagtcgcgctcaggctgtggaagttctgagatcgctgaaggatatgtttgcccagggtacattgcttccgagtgatcggagattgaagagttttggaaaccagccagctctcatggcggcattccaaggagctggaagcaaatggtcggaaggcgaccctcttcctggaggtttgcaaaacagccatctcatcatgtgggcatatgagcacttcctgaatgaccaatactttgaggttctgaagatcttggaagtgtggtgcaatgatgagattgagttctcccgctccagaacccgcagttatgtctatgagctgctgaaatga

SEQ ID NO: 4037 - DNA, 861 bp, A.fumigatus
tcgaagtcaaccacgagcgtattgtcagtctggccatttcacgacgcttcaatggccaagggcaaaggaaagagctcctccggagcaaatgcagtcccagtggctgattccaagtctgctggggaatctcttcctcagcttgaggagggtgcatttgctggcttgcgacagaaaatcgaacagaaattgaaggatgagcaggctgccaaacaaaacaaggcgaagaacaagaagaatcagaacttggacaaatctacgccgaagaaggagaaggaatctgcaccgaagtccgaaccgaaacgtgaagccaagagcgataagaacaacaaaggcaagaaacgtgaccgcaacggagaagtgatcgctagggaagagaagaagcttggtggaaaccaggatgacactttacgccaggagattttggcgctgggtggtaccgaagaagactttgatctgctggcgggcgtggaatccgagtctgaagtggaagtcacagagacacagaagaagtcgaagaacaagtctgatgaggattcgctgaggaaggaattatccgcaatgctagctgctgctggtcaagttgtgcccgacgatattgaggacgaaaacgaggtggctgccgcatttggctctgaaggagaggacgaggaggaaaaagaagaggaggaagacgacactcagcagagcgaggatggcgatcagtcagaagaagaggaggaagcctcttcggcgccagtttccagaaacgttgagcctcccaagaaggagaaggccaaagagccagccgccgagaatatcttccccaaagaattctcgaaactagtgagtatatccaagttcttgctcctcgaaatgtactaa

SEQ ID NO: 4038 - DNA, 774 bp, A.fumigatus
acttcaaaattgggaacggcggccactgctcgcgggatattttatccttcatgggcctggcatacttctattactccgatatttccaaacattgggtcccggcaggggttggcatcgtcggttaagctgttcaatcccaagtcgtttaccttgaccatcggttcttgcatctttacgttcgaaggaatcgggctcatcctccccattcaatcgtccatgaaacacccggagaaattcgacgggctcctctatactgtcatgatcatcatcaccgtgctcttcaccgcggtcggcgctctttcctacggcgcctttggctccgacacgaagatcgaagtcatcaacaatcttccccaaggagacaagtttgtgaacgctatgcaattcctgtactcgatggcgatcttaattggtgtcccggtacagctgttccccgccgttcggatcatggagggcaaactgtttggtcaggtgtccggcaagcgagacccttggatcaaatggaaaaagaacggcttccgatcgttgatcgtgctggcttgcgccgtgatgtccgctgtcggtgctgctgacttggacaagtttgtctcattgatcggctcgtttgcttgtgtgcctctggtttacatttatccggcgtacttgcactggaagggggtcgcagactcccccttggctaaatttggcgaccttacaatggtggtgctgggattcgtctttatgatttatacgacgttgtcaactgctgcagtatggattcaagggcataagtaa

SEQ ID NO: 4039 - DNA, 255 bp, A.fumigatus
aatggtgtggtgtctctaaggttagggataggggtggtggtagtagtaacctgtattatagcattaataatatgctcttacctagtaattatctactataatacctctaactttatcttaagttccctaatctattactttaatataatgacttccttaacttttacctacatagcctatttatatttttacttaatctttattacctcttctctgtataaggagttactattatatattatctctaggagataa

SEQ ID NO: 4040 - DNA, 267 bp, A.fumigatus
actatctgtgtaatcagcgctgccgagtcgcctttcggcggcgtcagagagagtggactggggagagaaggcagcaagtatggcttacaagagtaccagaacattaaaagtgccactcttggtaatttgcaggccggatgggtttcaccaggcttggtggatctgtaccgttttgagagaatgaggttgagccctgtggtagttgggacgttctggttgggttgcttcctgttgaagccaacccaaaatgtcccttatgctaggtag

SEQ ID NO: 4041 - DNA, 354 bp, A.fumigatus
tgccacatattaccttcagtgaaaagttggcggccacggcacgatttgcatatatcaagtgtgaagcctcatactatcattgtttcatgctttcagacatttttatctactttgaccgctacgtctcacctttggcttctgggtcttcctcttcatgcattgacggcggtctacttcgtttcaattgccgacgaccctctcgatatcttcttctgtgtttatagtgcttgcagcatctctttgcattggcctaattttttttttactcttgagaatgatccttatcccctcattgctggtcagtccatctctatgtgcgacggagatctgaccactcttcgcacgcctacctaa

SEQ ID NO: 4042 - DNA, 249 bp, A.fumigatus
ctcttggtttgcttttgggatctgatgccacatattaccttcagtgaaaagttggcggccacggcacgatttgcatatatcaagtgtgaagcctcatactatcattgtttcatgctttcagacatttttatctactttgaccgctacgtctcacctttggcttctgggtcttcctcttcatgcattgacggcggtctacttcgtttcaattgccgacgaccctctcgatatcttcttctgtgtttatag

SEQ ID NO: 4043 - DNA, 231 bp, A.fumigatus
gcggcggagagcttgtacactttatctgccctacccctagcatactcccatagacatctccggcatgaggacaataaatttccgctgacaatcaatacttattacaaatggaatatgattgggaagattgagaacgtcgaaacattgtcgtttaaattatgcgatatcatcagtcataaacagctttatctccaaaacacaccgccacccaagatggtctaccatagatga

SEQ ID NO: 4044 - DNA, 681 bp, A.fumigatus
aattctgacgaagaggacgagataatcttcgatgttgaggaggaagaacgggttacagtcacgcccgaggcggggagcacatcatccgcatcagaagggaacagggatgctgtctccgaggaagcgagggagcagatgcacgccgaagcggaaggcgaggctgaattcgagatggatatctcccagactacatcgcagaatactgcgttaacaacggcaacaccacaaccatcagcgacagcaacagcagcagcagcaacaccgacactgcggcaccgacatcagagtggccctactgctgtaacagactccacagcaattgccactggctccgcgacctcaacttccaagctccaagaaacagagcagacgctcgatgcccaccgtgccgagcaagaagacctcaccacctccctgctttcccttgcgacgcagctcaaggcttcttcgcaggcattccattccagtctggaggcggagaagtcggtgttggcgcgcgcggtcgaaggtctcgaccggacgaccaccaatatgggcgccgctgagaagaggatggggatgttgcggcgcatgactgaggggaaaggctggttggggcggatgatgctatatgcttggattttcggtctgtggattgtggcagtgttgattgtgtttctcggaccgaagttgcgactttga

SEQ ID NO: 4045 - DNA, 219 bp, A.fumigatus
gtattgattgtcagcggaaatttattgtcctcatgccggagatgtctatgggagtatgctaggggtagggcagataaagtgtacaagctctccgccgcttactcatccatggcctgcgatctacagccaagtgacagcatctctgtctccaactttagagcatcagcctcctcactttccccaaccacgttctcaataggtcagggagcgcaaaaatga

SEQ ID NO: 4046 - DNA, 798 bp, A.fumigatus
ctgaaggttgacatatctttctctccagttgtcacagttttgctggtcaactctgataatgcctctgcttccgatctgaattccgaattcaaaactgcaggaatagtcgactacgcttacacaccctccacctccgcagcaccaagcacctggcctacattgcagactttgatcaataacgggactcggctgatggtcttcgtggcgtccttagactccaacacagatgccccttaccttatggatgaattctcgtttttattcgaaaatccctacgacgtgacgtcgccttccaacttcagctgcaatcccgaccggccagccagcgtgaagaatgacctctccgctgcgatctcgtccaaccgcctgcccctcatgaaccatttcctgtatgccacaaccatcctgaatattgagtatcccaactccacgtacgtgacgaccacaaatgcgccctctggcggagtggggaatctaggagacaccgcgacgaagtgccagagcgcttacggccgtcagccggcctttatattggtggatttctttgacaagggcccagccatcgataccgtggataagctgaataatgtcacttcacctgttgggcgcaccaacctcacaacgagctccagctcgagcacgacacaaacaagctctgcctcaacctattcgaacgtctttaaggggttggttgagctagtacagcaggcgaagtcgggctcaaatcccagtatgggcgactgggtttgggtggggggtgattggggaagtcttctcggcggcggtataacaatgtaa

SEQ ID NO: 4047 - DNA, 207 bp, A.fumigatus
  unsure (75),(140),(150),(178): Identity of nucleotide sequences at the above locations are unknown.
tgcaacatccgtctgcgtatgtactccctgccccaggtgagagacgtcattccaaagtacggctcggctgaaagnttttcttttcttcccttctatttcatcttcttttcgtttcccagtcgggctgaaactgaaatctncgtgggattncaccttttggggtacagagggaagagcnctttcagaaggccacaaccgacctcgtaa

SEQ ID NO: 4048 - DNA, 1122 bp, A.fumigatus
atctcagccatggaagctatctatggcttcgatcggatgtccatagacgagcccgccccggaggcgccggcagaagcaccagcagaagaaccagtagtgatacgtccttgtgcttactgcagcgaggatattgaaggtgaacaagtacgcccttgcaaagaatgcggttgttattgctgcacagagtgcatccgacaaattttcctgatggcttgcaaggatgaagcccagatgccgccccgctgctgccagcccattccgctggctgttgcacgcagacatctttctgatgaggagatcgccttgtacaagttgaaatttgaggagtggagaacagtcaaccgctgctattgccccgtttccacctgctccggcttcattccccccagctacatacagcaacaatggaagaatcttgtggcttccagcggcttttataggcagttggcagccagtggggctacaccgtctcttccagtaagcccgttgtacatctcattccccgtgctctgcccgaagtgctttgctcaggtatgttggaaatgcaagaaactgtaccaccacggctcgacttgtcaggcgtcggatatcgaccctgaattggcgcagactttgcaaaacctgggaattaaacgatgccccaagtgccgtgctgcagtccgaaggatgcttggctgtcgtcacatgcagtgccgttgcggtgcacaatggtgctggtattgttgccgggctatcgaggtctgcaaagcgaatatttgtgacaaggggcgggaggccgagatagatgttcatgaggacaatgctgaggagattgccactcaggttgacgagggagaggctaaagaagaggaggacgaggacgaggacgctgagggtgactctgatgatgaggcttattggagtcgttatggtggctggatatctgatccagatgagacagacgatgagcaaaacgaccaggcagcgtacgaggatgatgacaacaagaatcaagcgcctgaaatgccgctcgctagacctgtcgagcacaatcactttgctgctgaggccggtagcgatgtcgaccttgacgctaggtccgactgggaggaggtgtttaaacgctggcagcgaaggattaat

SEQ ID NO: 4049 - DNA, 411 bp, A.fumigatus
gcagagagctcgactgaagatcagaccttacccgcagagtggaatgctaacgatacacattcttttcgatatgcccattcacaatcctccatgcagttcttgctgaagatcggtcggttagggaataatgccgttgtccttgccttggccctaggcgatgacaaaacttcttcatttgatctgctagtgaaggactacatttccgactccgcctttcctattacatccgcagatgacctggcaaggaccctgagggatgtgttcatttccgaagcgcggctgaatgacttgattgggctgtttaaagtgaacgtgattctgaagctagctcctggtttgtacaaggaaggatacgaagacaccactcaagccctacgaagaaagacaacaagaaaggccaccacaacatga

SEQ ID NO: 4050 - DNA, 552 bp, A.fumigatus
ctcctggtttgtacaaggaaggatacgaagacaccactcaagccctacgaagaaagacaacaagaaaggccaccacaacatgatcccttaagggatgatacactacctcaacctgcacgtccttatccgtttgatgatcctctggcggcaggtcctcgtcgaccagcgccaccaggtgattttgctcccccaggatttgaagatgaatatgagatctacagacctcctcgaggatatccccaggggaatggtggccgtaatcctttgagtattggcgatagagatttgtatcctgccggcctcggtccgaatgatcctattcgaggaggcgtcggtcctggtcttggagggggaggtggtggcggaatgcacccaacattcgacgatcccttgttcggtggtcgtcgagacgatggttataatccgcaagcaccccctggatctagatatgatcctgtaggtccgggaggtgcgccatccgggcgaggacgtggtccgtttggaggaggctctggaggaggatttggaggatttggcggtgacatcatttag

SEQ ID NO: 4051 - DNA, 774 bp, A.fumigatus
gcgaccggcccatacccagcgctagatctcatctcgctttatggcctaggtccggttgcgaaatcggttgcaaggatggatcctgttactggggagaagatcaacaggctcaggaagtcttatgagggcaagctgaagggtttgggactcgcaggaagaaacaaacccgtgaagcacgacccctctgctcctggtgggctccgacatctaaccatgtggcccgaggaggagtggcataaccagaaagttcatgggaaggaaatcaaggtcgccgatgttgattcggcatcgcataaccttcaaatgaaggcgatgcatatggagccgggcacagttccaaacaacgaatactgggaggacgtcttgggtcacgacaagccatcgaaacatgcgggccatggggacggaaagaaagcagctacgcttcctaataccgcccgatcgcctagtcaagcgaatgaaacaccacttcctacggagccggaacgcgctcgccctagtcgcgggcgcaagaggcattatgacgacaacagcttcgtcgggtatggcgaaggctttgccgatgacgatgatgacgccgcattctattccaacagtgaaggaatgggaaagaagaaacgaaagaaggtaagatcacatgccatttgggatgggtcgtggacacgactgatcgtacttgttttcctaaaggagcatgtttcaaaggttcccacaccgctgcccgatagaggcggtagctacggcgtcggtatgtttggaattggagcgaggtag

SEQ ID NO: 4052 - DNA, 228 bp, A.fumigatus
aacagtgtcaaacagtggatctcgaccaactatgcttctatgactggcgccgcagcaacggccaccggcaactcgggctctgggtccggatccaagggatctgattctcagggccctgcgtcgagctccagctcacaaggagctgctgctgctcctgctgccactggtgccattgcggctagcattgtgggtgctgccggtgtccttggtattgccctggctctgtag

SEQ ID NO: 4053 - DNA, 705 bp, A.fumigatus
cttgtgattttcactgtgtctcgaagccaactcgcgttcgtgtcctgcaaaggcctagaatcgccttctgattctgacgtcagtgccactaattgcctgcactacctacctactgtatatttctcttcttcctatttcggtccttctggggcttcagaccctcgaccccatatcccggtcgagctcataatttatcccctgaaatggcgcttttatttcttaaacaaaagctttttccgaccaaaggaaaacaaccccgaccagatacatatggttcgtttgaacgcggctatgtacccaagtatatacgacgctaaccaggccccaggcaagcctcttttatcagcaagcgattccgacaccctagacagcgatatggatcaagatatcgaagctcaacgatcatatcgtacttttcacacgcctcgagccgactccgactccgtttcatcgggttcctctaccccccgatcacgtatcaaccctcgaatcatctcggatgccatcctgggtctgtccgatggcctcactgtcccctttgcgttgagcgctggtctctctgcgctgggaaacaccaaagtcgtcgtgctaggtggactcgccgagctggcagctggagccatctccatgggtttgggtggatacgtcggagccaagagtgaggcgtacgttttcccgctcacttccttgttatacgaagggtaa

SEQ ID NO: 4054 - DNA, 1026 bp, A.fumigatus
cgaaggattgggcgaaactggggggggggttccgctttcggggctgtggtgcaaggggccggaccagttcggatcatattgggcggttcaccccgggaggcaaggtgcgcatcatctcaagtaacggcgtgttgtactacaggaacaatttttatgcgtaccggggaaccgatggagtacgatccgaacgggcaactcgcgtggctcatatccgagctgcaggccggtgagacagcgggccagcgcgtgtggctcatcgcgcacattcccacaggaggtaccgataccctgcacgactactcgcactacctcgaccagatcatccagcggtacgacgcgaccatcgccgccctgttgttcggccacacgcacaccgacgtcttgcaggtctcgtacgccgacccggcgcacccaagcgcggactccgcatccgctgttgggtacattaccccctcgttgaccccaacttcaggacccccagccttccgcatttacgacatcgacccggtaactttcgccgtgctagactacaccgtgtacaccgcaaacgtctccaccgaggccacgcctcaatggacaaaatactactccgccaaggaaagctacggctccctcatcaccccacccgtcaccgaccccaccgcagaactcaccccggccttctggcacaacgtcacggttttaatggaaaccgacaactccgtctttcaggcgtggtgggcgcgcacaacacgggggtttaaagtgcgcgaatgcaacgcgcagtgcgcgcgcgatcagatctgctcgttgagggccgcggacgcccagtacggctgtgtgcgcggcaccctgtccattaccaagcgcgatggcctgaacctcgccggtgttgcccctgcctctgcctctggcccacaagtgcacgtgcattccactcggccgcagtgcgaggagggcgggctggcgagggtgttagcggccgtcatacgggagacggatgacttgcaggggctgcttttgcagcgggctgagctgtatatctaa

SEQ ID NO: 4055 - DNA, 222 bp, A.fumigatus
tatggcgcggcaccttccagccccgtggtgaagacccccctgtccccatttcccttcttccccccgacaatcccactgcgcatgcttcccgtcacgcagatgcagcgggccctcctccccctcaacctcaaactcaagactcggaccgagatccaggacgctgatctcgctatcactgaggaggagactcctccgtcgagaagggtattggtgcgcgtctag

SEQ ID NO: 4056 - DNA, 207 bp, A.fumigatus
atccgcacacagaatggtcatattcgtaagggcaacattgtgtctgagaaccttatcctaaaccaggaggtcaaagctccgcagacgatctcccctttgttcaacgatctggatggacgtcaacagggcagttacacctgtatctgggacgtccacttcaatatcgtggcgtgtcagcagaagcaaacgaccatgctgcgattgtag

SEQ ID NO: 4057 - DNA, 273 bp, A.fumigatus
accacgaaaaagcaatatgaggctgacgttagcttccaaccgcataatatagccgcgacgcgccgatcaccatccatccttgaccaagagcggttccaaacgagcgcgggcgagatgcttacctcggctatcctggtgccatcgctcctgacggctgtcccggcatcatcagctagtagtctccttcgctacgatgcgacactggacaagggacggatcgaatgcgtctaccccatcagcgggcaatatgcccttatgcaacgagtcctatag

SEQ ID NO: 4058 - DNA, 252 bp, A.fumigatus
acgcgccaacttcatcaaaatttggcccgtacaaatggaacatggatgacgcgtggacgtgcttacattgttctacgcaatgtttatatctccttccatgctggcttccacttctacagtaacctgtggcggatgggcaccctaaacgtggaccagaacgcgagagttgcgatcatcaagggcggccggtcagtcgatagtctgactcccagcgactacagtgtctgggacgttaccgggcggcaagcctga

SEQ ID NO: 4059 - DNA, 195 bp, A.fumigatus
accttggaaatgggcctcgatcttttgggttatcaaaaaatccactggtggggggagatagaaggtgtttttatggaatatatcttccttttgcggggcttgggtggaacctggaaacaaggtacctcgtacaccgaggctggttattttcctcaaaatatcgtgtccaagagcctcgtgcacgctttgtattga

SEQ ID NO: 4060 - DNA, 747 bp, A.fumigatus
ccaacgtctggtaagctgcaggcaggcacgaaatcgaccagcgaagaggctaaccagccgcagcacggatgccgtccttgtctcgattcccgttcccctgctcgccaaagtccgattagcattgcgccggtacgcacatcagtcctaggcggaaagttggcagacgcgagcactaacgagaaaataaaaatgaaaacagaaaactcgtcatcggcgtcctcctctgtggcggtgtcttcgtcatgtgcgccgccctcctccgctgcatcctctccctgcgaagcatcaacaacatcaacaccagcaccatctgggccatccgcgaaaccgtatgtgccttctccactcccaatcaagatgtttgccccactaacagctcaccaccagttcgttgcactcatcgccgtcaacgccccctgcatcaaacccctcttcagctcctccgtctggctcggctcctccaaagacccctcctccaaaaacgcacatcgctacggcgaaagcggcagctactccctctccgtctttggcaaatccaaacccgatcccctcgtgtcgcacacgagtaaactgggcgaccacgccagcgacgagttcatcctccgcgagcagcgagagaatgggccgacatacgtcaatgatgtgagtggtggccatggccagcacacggatgaggagtcgggcaagttcagcggcggagggatacaggttaccacgatgtatgaggtgagaacgggacgggcgtag

SEQ ID NO: 4061 - DNA, 378 bp, A.fumigatus
acaggccaacatggcgccaacattggcttaacgaatgctcagcgggccgccatgaccccggaccaggtcaagagtcttgtcatcggctccaagtgtctgcttgctggatgggtgtgctatgtgacactcatctggtgtctcaaggcctgcatgttattcttctacaaccgcttgacgtacgtgttccccgttaacccttcagccccagtgctaaccatgatagactgggtctcatgcaccagaagctcgtcaagatcaaacgcggtgctgtgcgcgttggcctatgtcgcggtcattttcacaattttcttccttggccttccgatacaaaagcattggcagatatacccggatcccggaggtaagcgtcattgctga

SEQ ID NO: 4062 - DNA, 1269 bp, A.fumigatus
ctcgtatgtaccaacttacaaatcaagaccagcagggaattctggggccgagttgagcgcattatactgatggtagctctcacagtgtcctcttcacacaccaagcacgctctagaagacctccatcccaatatcgcagtgttccgacaccccgatcatcttcccgatcgtcaaggattggcatcctcgattacctcctctctccaaaacctgaccttggacactgtttcgcttgcaaagatgtccggtgatgcgctcaagggcctgtatggcatgagtgatgatgtgatcctctactgggcccaccatgagaaattgtgcttgatcgatggcagaatcgccttcatgggaggcttggatatgtgctttggccgatgggatacctatcaacacgctatcgctgatgtccatcccaccaatttggacgacattgtcttccctggtcaggactataacaatgctagagtcctcgacttccaggatgttgtacactgggagaagaaccagctggatcggaaacgtacctcccgtatgggatggtccgatatctcagtgagtttgcacgggccggtcgtggaagatttgcgtcggcatttcgtagagcgttggaacttcatctacgacacgaagtaccaggttcgcaaggatgcaagatacgccagacttgtcttgcctggccgaccgggctctccctccccccaacaatacaatgcccaacagtcggcgccgcatcatcaaccccggccgcaacagcaggctccgggcctctcgggttatccctcacagccgagcgttggcggacaaggaacaccaggctaccagtcttcgcctagctacgccggctactctccatcgcagagcggcggtcaccaatcgacttatacttatacaggggattcgttccctcctccacctccgggaccgcctcccagtcaacacaacccagctcctccgtctcagtttcaagctcaaggtcatgggcaagctccttatttccctcctccacctactcaggagggatcgcactcccagacaaggggctttgacgactcctatgagttagctcgtggccaaggcgactccgaccggggatcaggcttcattcctcgccgtctcaaggatgagctcacaggatacggcaacatcattcgcggacaattggcgggaacagtccaaccataccaggatcgtctgacttcctttgggcgccacagctctcagccgcgaaagcaacatgtcctgtcagattgtggcgcgcttgggcgaatt

SEQ ID NO: 4063 - DNA, 210 bp, A.fumigatus
ctttttgtagaagtatccggccgtgtgaatcagcaaatgaattatgatcgctgctactctgtagactgctatgcaactcaggaaaagggagggaaaatcaaggcttccaaagacctcctgtgctttgcacaaatactcatcaatgatttcacctcaagtctgcctaatggcaccaaaactttttttagtaccgatggacgcgaaatatga

SEQ ID NO: 4064 - DNA, 444 bp, A.fumigatus
ctcttctaccaggcatcttgggtacggcatctctctaaggattaccccacgttggcgttccacgcttcgatcaacaactcctttggtaaaggttctttgatccagcttctgaggcaattctcctctttgcactcggaccggaagcagatctctgtgggattgattggttatcctaacaccggcaaatcgtccatcatcaatactctgcgaaaaaagaaagtttgcaacgtggctcccatccctggagagaccaaggtttggcagtatgtgactttgatgaagagaatctatctcatcgactgccctggtgtggttccaccaaaccagaacgacacggagcaagatattctccttcgtggcgtcgtccgtatcgagaatgttcacaaccctgaacattctcgtcttcaccacggggctggaaggtcagacggtagtgcattcaat

SEQ ID NO: 4065 - DNA, 846 bp, A.fumigatus
cttaatggaagagatgcgaagaaggtcaagcatctgaacatgttcaaggatggcaagcctcgacgtgacgctgctggaaacatcacagtcgccgcctcataccagtcacgagatgcaccaacggctcggattgaacccaaccgtaaatggttcggtgacacgagagtgatttctcaggaggcgttaacatccttccgcgaggcggtcgctgaacgtgcctcggacccgtactcggttctcctcaagaccaacaagcttcccatgagcttaatcagagacaatgttcacactgtgaatggactgaagcagcatgaagcgaagatggccattgagactgctcctttcagtgatacattcggtcccaaggctcaaagaaagcgagtcaagctgggtgttgcatctctggaagacctggctgggcagaccgccaagatgcatgacgcctatgttgaaaagacggatcaagctactgacgaagatggaacaatcatcgcttctggcgatgtgtccaccgacgacaagacttttagtgaagcacccactgctcgagagtccgtcttctcgaaagggcagagcaagcgaatctggaacgagctgtacaaggttatcgattcttcagatgttgtcatccacgtgcttgacgctcgtgaccctgaaggcactcgctgtcggagtgttgagaagtatattcgagaggaagctccccataagcatttgatctttgtgcttaacaagtgtgatcttgttcctacgagtgtggcggtaagtaaactctctgttcattcattcctaccctcgaacctgttgcacaatacgatcatcacattacatcttcatgctccttaa

SEQ ID NO: 4066 - DNA, 258 bp, A.fumigatus
agatcaggcttaatgctggaattaggtccctgtcgcatcaagactggaggcaatctcacagagagaaacccttattcttggacaagaaactcatcgatgatatttgtcgaccagccggtgggaacagggctttcatatgtggattcttgccaggatatcccaacaacttccgagattgctgcggaagatatgtatatctttctgcaaatcttcatgacggaatctttcctgaacgccgacatattccctttcacatag

SEQ ID NO: 4067 - DNA, 1128 bp, A.fumigatus
tctaatcgcggatgcggcggcctcgtggtgaagatcctcttcaatcacgactcggcttcattcagcacaatctggatgagaaacacctcccgcgtagccgactcgctcccgcaccctcaagcccgcgctctccaacgcccatcaggaagcaccatcgcctcactctgtaaaacctacagtctccgccatgagaccatcgaacttgacgcaggcagcgccttccccctcgcaaccctgcacttcatcgactgtgaccccaccgcgcgcagccccagcgggaatgtgctgctgtatttccacggcggggggtacattacccccctatctaccggccacttcaagttcgcgcgtgcagccgcacaaaggctcaccgcgaaatgcgtcctgctcgagtacaccctcgcgccggaactcaagtacccgggccaactggcgcaggcggcggcggctctgcggtacctgttgcagcaccatgatgccgcggaggtaacgatagcgggcgactctgcgggtgggaacctcgcgctgggcgtgctggcgcatctgcgggacccgcacccgcttgttcggcctgtctttgagggggatctgcgacagcaggagcagaagctctgcgcggtgctctgtgtcagtccgcgctgtgcgaatacgtgcgatgctgagagctatacgtataatgcttcgaaggatatcgttagtagggcgttgatggaggtgttcaattcgcactgggagcctgtgaaggaggaggtgtgggcgacgccgctggctgggacgaaggagttctgggggtctgttcctgcgaagaaggtgttgctcctcgcgggcacggacgaggtttatgtggatgatatccggcggtttggggagttgctcggttcgtcgagtcaggctgccagcaccgagctggtcctgtgtgctgaagagacacatgcgcaggctatccgtgacgtagcggtgaataattgggatggtgtcatgctaaaggttgctctcaactggctacagaatctggggacgctaaatgaccggggattaccgctgccaccaaactcgaagggagtttgcgcggtatggaacgacactatcaacgttatgacagattctgacacgcggcatgcccgttga

SEQ ID NO: 4068 - DNA, 312 bp, A.fumigatus
ggcggaccactaacagcacctcagctcctctacaacggtctctacttctcccccgagcgtgagttcctcgaggcttccatcactgcttcccagaagaccgtcaacggacaggtccgttgccgcgcctacaagggcagcatctccattctcggccgttcctccgagactgagaagctgtacgacatgtctgagtccagcatggacgagatcggtgactttgctcccaccgagactaccggtttcattggcgtgtccgccatccgcctgaagaagtacggccagatgaagcaggccaacggcgagaagatgtaa

SEQ ID NO: 4069 - DNA, 222 bp, A.fumigatus
cctgcgcatgtgtctcttcagcacacaggaccagctcggtgctggcagcctgactcgacgaaccgagcaactccccaaaccgccggatatcatccacataaacctcgtccgtgcccgcgaggagcaacaccttcttcgcaggaacagacccccagaactccttcgtcccagccagcggcgtcgcccacacctcctccttcacaggctcccagtgcgaattga

SEQ ID NO: 4070 - DNA, 408 bp, A.fumigatus
caggggtgcaaggtcggaaaagatggaaaggtcttttcgtatggcaactctttctataccggacagatccccagctcggctgcattgaccaagcgtgacttctccgaccctgtgactgctctcaagggaactacaaatacactacagctgcccatcactgtggatagcgcgtcgtccgagagcacagaggagaaggagtcgtatgttttcaaaggggtctctggcactgtctctgatcccaaagccaaactggtatactttgtcaaagacgatggaaccctcgccttggcatggagagttgagaccgacattgatagcaactggctgttgacctacatcgatgccaagagcggcgaggagatccacggtgtggtggactatgttgctgaagccgactaccaagtatag

SEQ ID NO: 4071 - DNA, 375 bp, A.fumigatus
  unsure (203): Identity of nucleotide sequences at the above locations are unknown.
ctgacatggtgcagcgcatggggcattaatgacccaacagagggcgagcggacggtgatcaaggatccttgggactcggtcgcgtcggaattcacctggatcagtgatggcagcacaaattataccacttcgcgcggcaacaacggcatcgcgcaatccactcccagcggtgggtcgagctacctgaacaactacccccctancagctcgagcctgtcattcaagtatccctatagtgtgagctcgcccccgccatcatcctacctcgactcctcgatcctccagctctcctacgcggacaatttctaccctgatctgccttaccccctgtgcttccccgacgaggccggtaccttcgagttctacactcgcggc

SEQ ID NO: 4072 - DNA, 519 bp, A.fumigatus
atccggcatcgttcttcgccagatcacatcctcaacatgcgcggccttcttctggctggggctcttgccctacctgcttctgtctttgcccatcccgctcaccagtcttacggactcaatcgtcgtactgttgatctgaatgctttccgcttgaagtccctggccaagtacgtcaatgccacagagaccgtcattgaggccccgtcctcctttgcccctttcaagccgcaaagctatgtggaggtggcgacgcaacatgtcaagatgattgcccctgatgcgactttccgcgtggtcgacgatcactatgttggtgacaacggcgttgcccatgtccatttccgccagacggccaacggtctcgatatcgacaatgctgacttcaatgtcaacgtacgttatgattcggtgccgtgtatctctcttgctgacaggggtgcaaggtcggaaaagatggaaaggtcttttcgtatggcaactctttctataccggacagatccccagctcggctgcattga

SEQ ID NO: 4073 - DNA, 363 bp, A.fumigatus
tcgcggttccttccaggccgtgttgaagacggtgggatcgctaccggagctgaggtgatcaagacagaggaagagcagaagatgttcggaggtgtcgctggagacgcctttgatccctgctaccaccagctctgtgacgacgtaagcaatgtcaacctcactgcctgggaggtgaataccaaggtacgagttgatttctgtgtctacactcgaagacgattgctgatatgtacacagctggtcgcacactcgattgccacgtacgctcggtcattcgatggcttcccgaagaggatcaaggtcgaatctatgaagaagggtgacgagcaaagaaagtatcatgggcactctcttctgtactga

SEQ ID NO: 4074 - DNA, 909 bp, A.fumigatus
  unsure (3),(7),(60): Identity of nucleotide sequences at the above locations are unknown.
ttnggtnacgtcgtcttccgagagcttgcatctaacaagtcattagacggccgttcggcntcatcctcgtccgaggaacgcaagtactggggcttcctcgtcttcatcaaggtcctcggtgaatgccccctgcagctggcttctgttgtattcaccaagaacctcgttaggtgcctgacgaaccagctcgccgtcgaggaccgatacctgcaccggatggccgtcaaggccgccaaatcgatccaggcccgcgttgcaaaggatcccgaattcgccgcggcgtctgtcatcgggctcatgggctcagccggttccgtcaccttcgaccaagccaccaagacgaagacgatcgaaaagatcgttgtcgaggcaaacctcgacgcactgaagcagatcgtgcctttctttgagaagctcatcgcgagccggggggcggacgatgccaaagcagcagcagcaagccgacagtctcttgccggtctgctcttgtccattgtgagatcccgagcttcggcgaacgacgagtctcaggatggcctgcaagcagttctggagcagattctgttcacgtttgtgcggttcggctatttcttgcccaaggacgaggcggctgttcagccggccttgactcaacagagccaggagcttttccggaacagaatcagctcgtgtctgaacagtcttattgccaacccaaagtatgccactacccttccgtacgctgttgtaaagaagatccgcgacgccgccaagtcggaagagtatggaaagttcattatcaacatggacgagactctgcgtgactcggtcaagactgctttcaagtctttgaagaagctgtccagcatggtaagtatcgcgacatttccgacagttccctttgtactgactgaaacaggaaaagaatga

SEQ ID NO: 4075 - DNA, 339 bp, A.fumigatus
ctgaaacaggaaaagaatgaggtctcaggcgtcgaggcgttcaagcttctgtattcgatgacaatcctgcaagtgtacaatggtgatgccgatgcagtgtccatgcttgacgagcttgatttctgctataccaagtttctgggcgacaagaaatcaaaagacgaggaagcctccgatgcttctgacgcgctggtggaaattcttctgagtttcgcgtcgaagcagtcacaactcttccgccgtatgagtgagcaggtattcggcgcttttgctgacaaggtcaccgagaatggcctggagtcccttgtatctgtatgtccactccctcctgagatttag

SEQ ID NO: 4076 - DNA, 207 bp, A.fumigatus
actttgcgatgcttccggttaaagatcacggagctcgaatttattcgcgatatacatgccttcattgtctgtgaatccagctatacccatcctgctctgttcgatagtctggatagattcggaataatgtgctcggtctggtgtttgtgcaacttcttacttcagatcaatgtctttagtatcctatatttacctacaaatgtttga

SEQ ID NO: 4077 - DNA, 564 bp, A.fumigatus
acaatgttcattggcattcgcggcgtgcttgttcgatatgcgagttcggccagtggctttacaaatctgaaccggagtctttcgttaaagtccaactactccatgcgaaaagcttcatggggcggtcgaagctcggtagctaacaaggagaacgagagtttcccagaggaagacgagaatcagagcggagacgaaagtgatgctggtactgaacgtaggaccagctacactggaacatacacggacagcatgacatacggaaccgagagcgtcgtctccgccgatcgtagagtgagcgcggccagttccacgaacatgcccactgcagccccacactccattccagaagactctgaagatgatgaacaacaagaggaggagcacggaacggcggacgaggatgaggacgatgctcagacgaccaagggaaatgagtcggcggatgatcagcaggaaggagaaactggcgcagacggtgatgatcttgtgtcaacaaaaatggtactctatggacagcacagtgacagtggactcggtgcggagattgcaagcgcagcgggctaa

SEQ ID NO: 4078 - DNA, 183 bp, A.fumigatus
agcaacattgcttctgctcccacaacaggttccgatgcctccattcctccatcccaacccgtcgcgatcagacaggcgcgctctaacacacctttccgctccgagtcgtccgatgacaacccgctgacgcctagaaacgattcagggcctctggcctttgatggcagagctggcatgccatga

SEQ ID NO: 4079 - DNA, 183 bp, A.fumigatus
  unsure (10),(89): Identity of nucleotide sequences at the above locations are unknown.
atcgggtatntcgttcaagttgacttggtccagcataacctttacacggacgcgacaacccctttgcgggtcgtcaacaagtatgaatntacgccgcatcccgtcagttattgctccgaagagtgcttcgtggcttggattgcgttcgtcatcgtcgtcttcgactcccatcttaaggactga

SEQ ID NO: 4080 - DNA, 198 bp, A.fumigatus
cacgacgccaagctggtctgggtggctcgtacagtattcattcacttgcccatggttaaatatacccaccactcaatggcggagggcaacatggagatggaggtcattcaggttgatattgtctgcatggatactgattgtggacattcattcgtcgacggtttgacatcttttccaactcaaatttccgattcctga

SEQ ID NO: 4081 - DNA, 693 bp, A.fumigatus
ctcgaggatgctgattctaaccgcggtgctgcgaggcgatctcgtgtggcaatcgatgcaactgctgagcattccgatactgaaagaagcactaagggcaggtgcgctgtctccatgcatcagccgactcctcttgcgcttccaggacgccccaacttcagcaatgtcagctcgccaagaggttctgctcaccatcacggttccaagcaggcacagggtgcgcaacttcagacttcgagctcacatgtgcgcgacaagggtggcccagttcatgcttccaccccacagaatcgtggtaccagtgtgtacaataagaagatcgacctgctctccttcgatccccttcttgactacacgtccagcgatctgagccgttctggtcaacagattatctccgatcccaaagagcgtgccaagcgtgacgagttcttgcgtggtctacatgacatgtttgcagctactactgcgccgggaaagaccaacacggtgcccgccgatacggacgtcttcgccagtcagcctcgcaccaaacgcgtgcaacccaagtctcgtcgcctgttccaggaccgtcctgccgctcttaaatctgctcctgatggtggtacggagaccaacgctttggatgccgatcagattcgccagcagagtgtccgtatctacaaccttgctgctgacgccgtcaaggacttctga

SEQ ID NO: 4082 - DNA, 486 bp, A.fumigatus
ccccagttccgcccatgttcccccttcccgaggccggggcaggccttacccagccgtaacatcaaccccctacaagggggcaaggcccaagctggttttcccccggtgtcaccaacagcggttcttcccggcgaaggcttggactggatgaacactttcctgcagtcctgcaccgaatgcggcatcagcgccctcgccgtgcaatggtacggtaactccgccgaggagttcaagacctttgtcaacaaggccatctcgttcgcttccgagaagggcctcgagagtgtctggatcaccgagtttgccctcagcaacgacatcaacaccggcgcgttgtccagcgagtccgagcagttcctcaccgaggttttcccctggttggactcgcagcccatggtcgcccgctatgcctacttcatgtgtgcgaacaattacctcctcagcggaagtggttttacgtccactggacatgtttatgtttcttag

SEQ ID NO: 4083 - DNA, 435 bp, A.fumigatus
ataacgcttgccgtgcatccttccagccccgtggtgaagacaatcatgttctgcacgcttttctcgcacgtcggattcgccgtcaacgtcacgtcgattctgctgtctatctcaactatcttgggtggcgtgatgagcctgaacgtcaacgacgtcctgcaggccatcaaccacctgtcaccgatcaagtactcgatcgccaacctggcgccgtacgcgatgcgcgaccagcatttcacatgcactgcgtcgcagctcttggcgaacgggacctgcccgatccagaccgggcagcaagtgctacagctgtacaatctagacaagaacgcgcccatgaacgtgatggcgcttggcatctgcacgatcatttaccggttggtggcgtatgcgatgctcaaggtgatgcgcgagggattttggcgccgcctgcgctag

SEQ ID NO: 4084 - DNA, 273 bp, A.fumigatus
tggcagctgcttgagaacgaggtcaactgcgtctctcagtgccccactgatgatacaactgtcgttgactggtcagaaactaaggccgctctaccccgactctgctatttgctaatcaacaattttggctctctgtgtcattgtagtgatctccacactgctctggtccaatggcgactgcgttatgatccacctgtctgtgcgatttatgtccgtcaggacggcactcgcataatggagaaatgcaccgtccgttctcgagaccaactttaa

SEQ ID NO: 4085 - DNA, 234 bp, A.fumigatus
  unsure (14),(33),(65): Identity of nucleotide sequences at the above locations are unknown.
cattccttcggtcncggtcagcacttcaatganatcaaacaacagacacctatcaagcggcgtanccaattgggaacagccatgcaagatctcagtgtgtatagtgtgtatgcagcctggaacatccagtccaagtgcactatggaagtatggccttgtcttgaagcaactctgtcccaaatacagctggctgcatcaaggacttgccattggccaactgtcagactctcgtag

SEQ ID NO: 4086 - DNA, 207 bp, A.fumigatus
atattcaacgtatacaatggcctagagctcccgaattcgcaagatctcattagcaaaacactagaagtcttgagccttgtcaacccttcccggattgcctatgtggggttcgtcaagcttgtggcgcgagattccgctgaccgcaacttcactatttttgccacttggcaacccaccggtgtcctgcgagagctcgctgtcctctag

SEQ ID NO: 4087 - DNA, 1464 bp, A.fumigatus
cgaaccattaaggaaggcccaaaacacagccatgggaaacttttggctcaagagggtttcagcgatgttttaaccaagcctcggcgtgagacacctcttaagggtatatcataccactcgagtcacaacacctctcggcaaggagcttcgtctgctatcccgtggtctcagcccgctgccgatgccagcgaatccaccgctgtttttggtggtctatccactccgaaggcgaagaagcaggggtttttcaagaagattttcgaatcagccaagaccggtgccgctaatgccagaagcagtatcgctgtgggaaacagtggtggatcctattcacgtacgaaaggcagggcaatatctccgattagacgtgacacgactcgcgacgcagggactggcacggtagactgggtgcaggttcgacgtgatgtgaatcgagcaagctcgccgagccgcaacgagcgcatcgaaagggccgagcgctgccagatgatggaccaccccgtaatctacgcggtggaggagcttcacgagactgccgaaggtgatgaaagtattgacgggctgccgatcagcgagcccaccaacttcaacacggtcaacttgaacctcgtcgataaaagtgctcggtttgtcaacagccttccaccgatgaccaaccccatgagccttgcgcagggctatgtgtgccgaccttacaagagcgatgtgcagagattgcgggctatcttcacttgggtcagtgaaaagattgcctgggacgagcccgtagaagagatcggaattgacttgaaacggattctgcaaacgagacgagggagccctcaggaagtcgcgtttctcgtcaaggaaatgtgtgcggcagtcggtcttcatgctgaagtagtgcaagggtttctcaaaacacccggtgaattgttcgagctggacagtctttcgcgaccaaaccactggtggaatacagtcttggtggatggcgaatggcgcgttatcgactgtgcactagcaaacccgaccaacccccgaaggaaccagttcgtaaccagtggctcgtcaacagccgaaagctggtatttcttggcacgtccgcttgagatctgctatactcatgtcccattgtatcctgaggagcaacacatatgtccacccatctctcccgatgtgttgctagcccttcatacagcgtgcccaccttatttcaagttgaacctgcagtttccagactatgataccagcctgatcagaattgaaggtctggagcttctgcaaatccgccttctcgtgccaccggacgtggaatgtgccgcagaagtcgaggcgcccgctttcgctcgtgatgccgacggtgacttctttgaaagtggggaggttattcgcaagcgcgccctggtgcagccagactgggtcggcggtcagaagcgcttcactgtcaaagctgtttgttttctatcagaggcagcggccagg

SEQ ID NO: 4088 - DNA, 240 bp, A.fumigatus
ccgcagccatcaacccaagatttgaccagcaggatttcgggagtcaccagcgtagaagcgggtacgcaaataaagcaagtgggaaaggatgagcagccgatcgatttgagcgatgaaaagaacgtggaaatgttcatgaagcacttcagtggatggagtcagaggatgcgagaagacgcggctactatgaacctgtacggttatgtcgatttaccaaagggtgaagcatatagaggatag

SEQ ID NO: 4089 - DNA, 1125 bp, A.fumigatus
  unsure (33): Identity of nucleotide sequences at the above locations are unknown.
aaaattagcaaacgcacggcacccaacagtttntacaaagccgccatgaccgagcggatgtcttcctggtcacccaccgatcttaaggcacggggtgtccccagccgggagttgatcaatctctacaagcgatggggtgaaggcggttacggactcatatctactggtaacatcatgatcgcttacgaccggctggaagcccccggcaaccccattattgacctggagaatcccttccacggggaacgtttcgacgccttccgcgagctggcctcgcaagccaagagacatggcagcctgatcatcggccaggtcagtcatccgggccggcaaacagaggaaagactccagcccaaccctgtctccgccagcgacgttcagctcgacaaggagatcatggggatgcaatttgccaagccacacgctgcgtccaaggacgagatcacagacttcatccggcggtggacgcatgccgctgtgtacctgcacaaggctggctatgatggtatccagttgcacggcgcgcatgggtaccttctcgcacagtttctgtcgcagacgacgaatcgccgcaccgatgagtacggcgggagtctggagaaccgcgcgcggctgattgtggagatcgcgcagtctattcggaaggagctacctgcgtcgactggtttcatcctgggcatcaaaatcaactcggttgagttccaagctggaggtttcaccgcggacgaagcacgcgagctgtgccagattttagaggagaacgagtttgattttgtcgagttgtcagggggcacatatgagtttattgcgtttagccacaagagagactccaccaagcagcgggagtcgttctttttggaatttgcatccctaatcacgccagctctgagtaagacgaagagctatgtgaccggtggcttgcgtacagcgtccggtatggtgggcgccttggagacggtggatggcgttggactcgctcgacccgcatgccaggagatccgtttgccgcgtgacatcctggatggcaaagtgaccgcagccatcaacccaagatttgaccagcaggatttcgggagtcaccagcgtagaagcgggtacgcaaataaagcaagtgggaaaggatga

SEQ ID NO: 4090 - DNA, 579 bp, A.fumigatus
ctccttccgaatagactgcgcgatctccacaatcagccgcgcgcggttctccagactcccgccgtactcatcggtgcggcgattcgtcgtctgcgacagaaactgtgcgagaaggtacccatgcgcgccgtgcaactggataccatcatagccagccttgtgcaggtacacagcggcatgcgtccaccgccggatgaagtctgtgatctcgtccttggacgcagcgtgtggcttggcaaattgcatccccatgatctccttgtcgagctgaacgtcgctggcggagacagggttgggctggagtctttcctctgtttgccggcccggatgactgacctggccgatgatcaggctgccatgtctcttggcttgcgaggccagctcgcggaaggcgtcgaaacgttccccgtggaagggattctccaggtcaataatggggttgccgggggcttccagccggtcgtaagcgatcatgatgttaccagtagatatgagtccgtaaccgccttcaccccatcgcttgtagagattgatcaactcccggctggggacaccccgtgccttaagatcggtgggtga

SEQ ID NO: 4091 - DNA, 477 bp, A.fumigatus
tcccaccaccaaaacaagacgaggaaaataagagggaaaagcaacatgccatctgcacaaccaccagcgtcccttgcctccagctcctccgaaccctcctattctcccattcccgccagcgcaagcacaacagcagaggacggacatactcgctcctccaccacccccaccggcccctcatcctccaagcaagcggccgcctcaggcacagcgacagaccgggataaaccacgcctcacggaacaagaaaagaaaaacaaccacatcgcctcggagcagaagcgacgcgccgcgattagagagggcttcgatcggcttacggagctggttccagggctggaagggcagggccggagcgagagcgtcgtgcttcgcaagacagtggatttcatacacatgaagctacaggagaggcaggagctaattgctgagatcgagagcagaggcggacatatcgatgatgcgtttcgaacgtga

SEQ ID NO: 4092 - DNA, 195 bp, A.fumigatus
ccttactacaaacctctctcttcttccttcaatgacactgcttctaaacagcttcctctttcctattcctctttcctactagacttgtatttctctattatcctgctcgcagttactactcaatcatacatcgccgcgtcaatccataactgtcttcaccgcggggctggaaggagccgtctattgaaagaccat

SEQ ID NO: 4093 - DNA, 513 bp, A.fumigatus
aagggatactcggagtgctgggcgaacggcatctaccactgtctcttctgcgacggctacgaggaacgtggccaggagaccgtgggtgtcctggctctggggcccatcgcgaaccctgcgcgcgctctgcatttggctcgcatggccctccggctttccgagtccgtcaccatctacacgaatggcaatgagcagctggccaaggagatccagcaggccgccgaggaatcccctgtcggtgcctcgggactgaaattcgaggctcgacccatccggcgattcgaaaagggcgatgtcgccaagaccgtcattgttcatcttggggagtcggagtcgaaaacggagggctttttggtacgttgtccagtttactcgacagagatatccttgctaaccgcggcaaaccgctcaggtgtacaacccccaaacggaggtcaatggaccgtttgccaagcagctcgccttgaatatgacagaaggaggggatatcctgaccacgccgcccttctatga

SEQ ID NO: 4094 - DNA, 276 bp, A.fumigatus
ccgcggcaaaccgctcaggtgtacaacccccaaacggaggtcaatggaccgtttgccaagcagctcgccttgaatatgacagaaggaggggatatcctgaccacgccgcccttctatgagaccagtgtgcccggagtatttgccgtgggggattgtgccacgccgttaaaggccgtcacgcccgcggtgtcgatgggatctttggccgctggcggtctcgtggctcagctgcaggctcaggcattgccggagtttcgtctcgatcaggagctatag

SEQ ID NO: 4095 - DNA, 357 bp, A.fumigatus
cacccccaagacggcagacagatcttcaacgacagcaacagcaccatggcaacctccaccccctccttcgaatacaacatctccttcacgacccccgccaacccaccgtcctgtgagcccaagctcacggcaaaggatctttggaccggcatcgcccgagtggcagatgctccccaggaatatgcgccgtacgtctccaagtgcgaggtgctctcgcgcaacggccacgctctcgagcgcaaactgaccatggccaacggggcggtccacaagagcgacggggagatcatgtatcaagatgtgtggattgcagatcgtttactggtagttttgtctcttccagcagtccttccacca

SEQ ID NO: 4096 - DNA, 774 bp, A.fumigatus
caacagactaccttcgtcatgcagaccaggcccctttcgataaacgccatctggcatctcgttcttccgctgctggctacctcggccacagcagctccataccaaacccgcatcctcgccacggggactacctttaatgctccagacccctacggcccctggtccttgactccctctgccaacaaacccggtccagatctggcctacatcaaaaccagcaacaccggcaccggcaaggtggaagtccacctcgcctccagggcctccaactaccagacccgcacgctggaggtgggcacgactttctttcccgaagacaatggcgtctggcagctgattgatgccgacggtgatggccgtgatgacctcgtgtacatcaagacccgcaacacaggcaccggccgagtggaggtgcacattgccacggcggcgtccaacttccagacccgcatcaaggacgtcggcacgactttcttgcccgaagacaacgggacctggcagatggccgactttgacggcgatggcatcctcgacctgatctacatcaagactcgcaataccggaaccggacgggtagaggtgcatgtcgcctctggcgcatcgaactaccagactcgcatccaggaagtcggcacgaccttctaccccgaggacaacggagtgtggcagatgattgatttcaacagagatgggaagctggacctggtgtatatcaagacccggaacacggggaccggccgtgtggaggtccatgttgcgtccggggcgtcaaca

SEQ ID NO: 4097 - DNA, 507 bp, A.fumigatus
  unsure (16),(158): Identity of nucleotide sequences at the above locations are unknown.
atgagcatccggactntcaacccggagaccgttcccatcctgctggatttcgatacaggcgattgggttcactttttcattaccaacaatataaccttcgaaaaggtgcatttcccgcgcaatctgaccccggtcatgcatcggatgcacttgcacgngcatgactttgccattctcgctcagggcagaggcgagtttgacccgagcatagtcccgaagctggataatcttccccgccgcgacgtggtgaacgtcgatactggcagctatgtctggattgccttccaggtcaacaacccgggggcatggctgctgcattgccacatcgccttccatgtcagtagtgggctctccttgcagttcatcgagcagcccaagaaggtcaagccgctcatggaggcggccggtgtgttgggggagtttcacgatcgatgcgcgaaatggacagaatattacgacagcgtgaacatccctgataaccataccatcgacgactcgggcatctag

SEQ ID NO: 4098 - DNA, 1281 bp, A.fumigatus
ctattcctcttgtcaaagggtaatgggctgatgactccccaagacaagaacttcatcacgcggattcaattgcaacagctggtggcggccgcaggtaatgttgcggatacggacttggaggctgtcttagcggaggacttttactaccaggtttacagccagattcgtggtgcgcctcggcagcatccgcatcagcctcttggccactttgcgcagacctacctgcttcagactggtaaccgccttggtggccatggtcgaaggaatctccagagtgccgacaaccatatgcaaaggatgcagcagcaggttcagcgtgcagttgaagcggcgaaagcgaaaccgaagaacaagcagttgatcatcgagggcagtctgggcaagatctctttcagcaatgccaaagcgccgaagccaatactcaacatcaagcgccccgagacctcagacggagccaaggccgccaagaagcaaccaacggacctgagccccagcgatcggaagtctatactgatgaatattgaaaatgtgtacagtaccttgatggagatggaagatatggagcgtaccatgcctcctctgcctgacgagaatgacgctgaagccatccagaagcacttggaatggcgccagaagatccgttccttgaaccaaaagttgtggcaagaactgaaggtcatggagcctattgttcctaacactgacactccacatccatttattgctttcctgtcttatcccaagggcaagaaggctattccacgcattttccgtcacattgaccaagaacagcgagtcacaatccttacaatgatcgttgtccacttggacaccttggatgtggttcgaagcgcacagcctattccaggcgagaaccagccttcgctcgcggttagagaagccattgacctgttctctcaggccgttatgcccagcctcctgggatatgtgaacgaggcgccgttcaacatcattattggtcttctgggtcttgtgattgcgcagactcacgtgcagctagtggccaggactcgcattggtttgggaatattgactatgttgctcagccgtgcagaaattgtaaaggaggctgggcaggccgcggaacgtgactggcaacaatgggttgagaaattcaacgtcctgttcgacacactcgagccaatctttggcgagattttccccgcctcgattaacgctggcgacgatatgtatgtatggcagtttttggcagcgggtcttcaccacggggctggaaggatccacggggtgcgaaagtct

SEQ ID NO: 4099 - DNA, 660 bp, A.fumigatus
aggatgaccggggtcttttggaccattccttttttcaggtttcacccggcgacaaaatcaacaggttttgggagtgccgagatggataacaaaattgaggcggatggcaaacccagcacatggaagaagcacagcaggatacgcatcgatgggctaaacatcgatcatctcaatcggggggtacaaggccccttttcttggatatatgagggaaccgttgatatcgttgccgacatcatgtttccagcggaaaatgatgaaagtctggcgcaagtaatggccggcctctacgaccggttagaagcaaccgtcatatccaaccaatatcaggaaccagactcacgccgtcaacctggaatggatggtactgcttcgagcgacgataaacgctttttagtcactgatctacggcttcagttgaacaacgttagggcagtggtgcctttgtttaaccgagatctttcgtacataaacaacgcgctgatacgccccattgtggcctacatcaattcgagacgaactttcattcccatccattgccgtcttgtcaaacgacttgccgattttgacggtagttggacgacctttgacagcgggctcatggatgacctttcggccgcggtaagcttcccacgcgcgattggtattcatacatactaa

SEQ ID NO: 4100 - DNA, 183 bp, A.fumigatus
aacaattaccgtttagagcaaaccctcgctttctccatttcgatcttgttaccagtgtcccatctctctgtgttgagctctgagattctacagctcttagtggccaagatccttagaaagaagacacagtgtaagcgtcaaaactatacacagatgccagtgctgtttcagtattatcagtaa

SEQ ID NO: 4101 - DNA, 195 bp, A.fumigatus
ccggtgcgcgctccaagttcatcgtggtggattatagggagagttatctctcatgatgtagacctccccaacgaggacggtacaacctacagccatggaaatggcaatgatgggaaggttcactcgcgcaaagtcaaggctgcggacgcgaatatgctttctcgcaagaatatcccgccaaagcagaccggctaa

SEQ ID NO: 4102 - DNA, 267 bp, A.fumigatus
gtccctttgccgcaaaggtgtacaggtgttcgcaggagacatttccccacagttacagcggttgtgtcacacatgccatttgcacttgtacctttctccttgcccatgttgttcttcgaacaagccttagtcaccaaggggtgggtccccgtcttcgcttacggatgggaccattgggtggacaagacggggaccgtcggagctattggaggcatgggctttgtttcggtgattctatgtaacgtgagttgcgaagctctacattga

SEQ ID NO: 4103 - DNA, 393 bp, A.fumigatus
cgcagtaggacttgctcaactaatctgtcacgtttactccagtttgctggcaccaatatcggtaccaccattctcctttcccgggtcatacaagcatggaagcagatcaacgacgagcacggcaccttcatcagtgaccggacattttgggcgaccgtgtacagtatggcgatcggagtcaactacggtgcctttagcaccgcttttagtgcatcgttagccggtctgctttggcgggatattcttgcgagaaagcatattcgcgtccgcagccttgactttgcgcgagtgaaccttcccatcattgccatttccatggctgtaggttgtaccgtcctcgttggggaggtctacatcatgagagataactctccctataatccaccacgatga

SEQ ID NO: 4104 - DNA, 189 bp, A.fumigatus
ctgcgacttgctggtatggttaaattaagtttcgcggtcgcagtccatcactcagacagctttaaacattcgaaccgtattcctaataacagtcagatgtattcctgcgaaataaccccttgggttcctgtaagagacggtgagttgatgatggcatataacggctggaatcccatggaacagccatga

SEQ ID NO: 4105 - DNA, 519 bp, A.fumigatus
cggtggaatacaataatgacgtttgtacgctttcgcaaatatatatacgcaggacgtgcaatgctctctcgagacgacaaagtaaaaacccaaaaccagaccaacatgtattctcgcaagcttctgaacttccctctgcgacactttgcgacgcgcactccaatcctccgctcggcgcggccccaccagccatggcagaccaggacaatgtctttgatgcaacggggccaaagacaccctggcgctggctttccctccttgtctcgagcgcttaccgacctcgagtccttcctgagtcgccccgtgggcagccatgatctactgggccaatatcctcggtttgacgtccgcgagaccaaagacagttatcgtctcgacggagagcttccgggagtggacaagaaagacattgatattgaactgagcgacgacaacgtcctgaccatcaagggacgctcggagcgagagtcaacatcggaagatcccgaccaatcctgtcttcaccacgggggtcgaagc

SEQ ID NO: 4106 - DNA, 207 bp, A.fumigatus
ggaagcagtcaacgtggagcaggctttcgagggtatgtttttttttttttttttggcttgaacatgaacagagaacgctatgctaatatgctgaaagtcatcgcccgaagcgccctggctcaagaagaggctgaggagttcaacggcgaattcagcgatcccatcaacatccacctcgatagtgaccgtgatggttgtgcttgttga

SEQ ID NO: 4107 - DNA, 213 bp, A.fumigatus
atctgggatactgcgggtcaagagcgatttcagtctttaggtgttgcattctaccggggtgcggattgttgtgttctggtatacgacgtgaataattccaagagcttcgaggctctcgacagttggcgcgatgaattcctcatccaagttagcccccgcgacccggagagctttcctttcgtacgatcccacctgcccctaactgacctctga

SEQ ID NO: 4108 - DNA, 210 bp, A.fumigatus
tgtgcaaacgggcagatggtaaccattttgcaggttgtgatcggcaacaagattgatgtggaggaaagcaagcggatgattttttcgaaacgcgccatgactttttgccaatccaagggcaacatcccttacttcgagacaagcgctaaggaagcagtcaacgtggagcaggctttcgagggtatgtttttttttttttttttggcttga

SEQ ID NO: 4109 - DNA, 1113 bp, A.fumigatus
  unsure (1105),(1110): Identity of nucleotide sequences at the above locations are unknown.
atttcgccagatccacgagcattcagggtaagttcaattccgtccttgtggctaggtatattgctagtcagccgctccagggcggttttcgctgcttcgtggattgtaattgatcattctcttgtcccctccttcagatggcacgaacatgatcccctcgagctcgtggattccgtttacacatgcattgaagaagcgatgaagactttcctggctctaggccatagcaaatcagatattgaagccattgggattaccagtcaacgagagacaacactttgctgggattgggaaaccggcgagccgttacacaacgcgatcgcatggcctgataccagaaccaagaatctggttcgtgagctcaaagagcaagaggggtcggatgaactaccggctatctgcggtctacctctctccacatacccttcttctgtctcactagtgtggcttcttcgccatagccccaaagttaagcaggcttatgacgaaggacgacttgcttttggaactgttgactcgtggcttctgtacaacctcaacggcgggccgcaagctgggcgtcatgtcaccgacgttaccaatgcatccagaacgatgttcatgaatctcgaagccctgcaatatgatgatagactgctcaacttctttggtatcgacaagacaaagatcaggctccccaagattcttccctcgtcagatcctgacggctatggatacgtccggtttggacctcttgacggaataccgatcacgagttgcttgggcgatcagtccgcagctttagtcggtcactgcgcctttacaccaggcacagcgaagaacacatatggcaccggttgcttcctgctctacaacgtcggtgagaaacccgtaatttcgaagcacggcttgcttgccactgttggcttccaactgggtaaaaatcgaaagccggtgtacgcccttgaaggaagtgttgccgtcgccggaagtggtatttccttcctcatgaacaacctcgggttcttccgtgattcgcgcaaagttagtgatcttgccgctactgttcccgacagcggaggttgcgtttttgtcactgcgtcttcaccagccaggggcgaaggancatgngta

SEQ ID NO: 4110 - DNA, 273 bp, A.fumigatus
  unsure (69): Identity of nucleotide sequences at the above locations are unknown.
ggcacaaggcccaggcccttcgatctgaccgagaatgattttgctgtcaaagagcaacatgcgcacatngagatttgcgcatctcaatcgcatgacggcaaccgctcgctactgcaaaatgaaaatcgccgaggcgacaacctgaaagaccgcttcattggtgccatcgatcagggcaccacgagttcacgatttattatcttcgattgcacaggtgttcctgtggccaagtatcagactgaatttcgccagatccacgagcattcagggtaa

SEQ ID NO: 4111 - DNA, 303 bp, A.fumigatus
agacgcagtgacaaaaacgcaacctccgctgtcgggaacagtagcggcaagatcactaactttgcgcgaatcacggaagaacccgaggttgttcatgaggaaggaaataccacttccggcgacggcaacacttccttcaagggcgtacaccggctttcgatttttacccagttggaagccaacagtggcaagcaagccgtgcttcgaaattacgggtttctcaccgacgttgtagagcaggaagcaaccggtgccatatgtgttcttcgctgtgcctggtgtaaaggcgcagtgaccgactaa

SEQ ID NO: 4112 - DNA, 264 bp, A.fumigatus
agcatgtgggccggggcgtttctcaaagcacaagaaccatcaagtcgagatattgcgtgctcgggtcgggcatgtcttataaatcgtcgtttcctacaatgtagtcagtttctttgcaatccgaataggataccactagcattgcagtcaattgacccgtattcgatcttttgtgaggttatagtcaggtcgaacaagagagaaaggagaggacagtgtagaaagccaatcgcaccatggcccccgggatacaagactcgctga

SEQ ID NO: 4113 - DNA, 213 bp, A.fumigatus
cctacagtggtgaagacttggtattccaaatataacgaggtgaaagataacaacagtgcgtggtcggagttagggaatcaagaagttttcttttggaaaataactactatcaagaatggtaatctctcagtctcagttaacgtgctgcgaatagaaaagtctcacaactgcacagctgcggcacgcgtggagatttggaaggacgagggatga

SEQ ID NO: 4114 - DNA, 183 bp, A.fumigatus
ctagtaaaggtgtattgtataagaaaggaatctaaagggaataatactattatcttcgcatgtttacaagaaattaatagtaagatagaagccatggctattaaagataagtatctatttctctcccctctttatacgcttatttatcgtcttaataaaactttaaagctattaaagggctag

SEQ ID NO: 4115 - DNA, 228 bp, A.fumigatus
agcattttctgtacgggacgtgcaatatgcttcggcttcgtggcccagaagcccatctatctggctctgggcggtcatttttcctcacagtacgaggctttgagatttgtcgagctctcatatacccagaacctacttttctttgccggccggaatggatgttttcacaaggaggatctgggacgagcatgccaacaacgactggcacccaaaagaatcattgtttga

SEQ ID NO: 4116 - DNA, 195 bp, A.fumigatus
tcatccgacattgccagagaattctcatcctacaatcctgatcaagactcttatcctgaagtcgagtactccgaagttatgtctgacgacgccgcattgttaaggtggtttgatgagattgtgagttcctccttcactcaaggcatgctcaacagctcacaccaatcaagtacaaatggggtttctgttttgtga

SEQ ID NO: 4117 - DNA, 549 bp, A.fumigatus
cgatgtgtatgttcccccttcaacctgcgtcgaccatcactgtggcgacacgagactgacggtaacagtgcctacccaacctacaccgatcgtcccggcatgcccgtggtcgccaagctccccaatggcaagtacatctacacctacgaatatggctccttcttcggcaccgacagctactctttccccgtctactaccgtatctcatccgacccggagaacttcctgtcggctcctcaccagcgcctggtcacgaccacgggctatgtccccacctcgtcgccgtatgttgtctggaccccgtacggcggcgtcaacggcaccatcatcgtgagcgcatattcctccagcagcgtgttcatcaaccaggcgctgggagagggcccatggagggagatcccgactggggagccgaacgcgtatacacggtcgctgcgggttctgaagaaggacccaaagatgatcctgattaatggcgctggggagctgaatggagagaacaacaaggttactgtgaccttgctgaacctggaggaagcacttcgttag

SEQ ID NO: 4118 - DNA, 537 bp, A.fumigatus
ccacggggtgggagccctttcctgaaggtttcagtaagtttccgtgggagtaaacatatcgttccagtccagtttctaaccatccgtgacagtaatggcaagttgatctgctactactccgaccagagagccaacgccacccacggccagaagatggtccaccaggtttcgacggatctgaagaactgggatcctgtcgttgacgatgtgtatgttcccccttcaacctgcgtcgaccatcactgtggcgacacgagactgacggtaacagtgcctacccaacctacaccgatcgtcccggcatgcccgtggtcgccaagctccccaatggcaagtacatctacacctacgaatatggctccttcttcggcaccgacagctactctttccccgtctactaccgtatctcatccgacccggagaacttcctgtcggctcctcaccagcgcctggtcacgaccacgggctatgtccccacctcgtcgccgtatgttgtctggaccccgtacggcggcgtcaacggcaccatcatcgtga

SEQ ID NO: 4119 - DNA, 894 bp, A.fumigatus
  unsure (100),(107),(116),(320): Identity of nucleotide sequences at the above locations are unknown.
gttgaaaccaaatggaccttcctttggcggagtttgtgttcaatgacatttcatgcgctaacaaggagtatcaattctggtattcatgcggagatgcggntgggggntggatattntggtttcctgtttggggaaccagcaatccaaatctcgctcgataaatgtgaagatctgatggatagcttgatcgaatgtgccgaggaccaagctgatctcttggcggaacacgccgtggaggtttcggatgtgatgttactgccttcgtacgaggaagttacccgtggatgtcagacggtatggacttctctggccgacgtccntgagtttgggagccttgaatatgagctcgatcgcgctgttgacagacttatctgcatcaccacaatattgcggaatctttcgttcactgagtcaaactttgggttactatcaaccgcccccgttgtacagttcatatcaaccattatccgctatttagggactcgaaacatgctgtttcgaacccatcagaacacattggatttcatgaaggacgctgtcatctatttgagcaatttggcacatgtgatacagttaccaagcaaagaggaagccctttgtctattgaacttcctattgtcttttgctccctttccacctccaacattgggcacggacggcgtcatgtttacctcttacaatgcctcgattcacaaatacacacccgccgccgtcgacagcttggctaagctcctggccagagatgaccccaacaggacattctttaaagcgatattctccggtgatggagcgcccggttcgcagcatgaattgctgacccgtgctttcggactagctatttgtccagtccctggtgtccaccacagggggcgaaaggtccgcgctaagcgttag

SEQ ID NO: 4120 - DNA, 789 bp, A.fumigatus
gatgtcggccaatttacttggattccgattcccatagtcgggggtcgcccaatcaacctggtccagttgtatgcgacgatcatgaagctgggtgggtcaaagaaggtaagcgcttcaaatatgtggcgggtagtagcacaacaacttcagtttcttccgatgcaatttcatatggctgtacaggagattcgggagcactatcaaaggaacctcgctgcgtacgaacaggctttcctcagcacgcaacagaagcagtttgccgatcaaatgcagcaaaactcactgccgcgacagccaagcgattcttcggctgtccagtttcagtcaccaacagtcaaacaggcccaggggttcgaagtacctcaaccagttggtgcctctcctggtagcatgtcggtagcaaacaacgcgcaacaaagccttccaaatggcttcgcgaccccaactcaagtcaaagcgtcgaacaaacaacaacagcatcgactaagtgtatcccgccagtctcagcctccagcaaccccgcaggattgtactggccaattaccaaaccaatcgcctgctcagtcaacaaaacctctagggggaacaccgggaaagtcggccaagtcattcgagcaaccctctgatcaacctttgaaacatccgatacaagatcctttcaaaccaatggttttgcctgagagcaacttacacggtccgatagttttggatgaaatgtaccagcttggggaagaaattactaggttgaaaccaaatggaccttcctttggcggagtttgtgttcaatga

SEQ ID NO: 4121 - DNA, 480 bp, A.fumigatus
acatcaagtgggaaggccggccccaagcgtgctgacaagagcaacggatttgaccttctctgctctggacaaaccccccgtaccgaagtcgagaaggccgagtacgagcgcgtcttcgaggaagtccctgctcctttcacccaagaggagcgtgacagctggctgtccaagatgggggaggttgccgtctcgtccgatgctttcgtaagtgatttgaccactctatttcgcgtttttgtagcttgtactgatgcagaatcaaacagttccccttcatcgacaacgtgttccgtgcagctcgttcgggtgccaagtacatcgctgcccccagcggtagccagaacgacggccccgtctttgagacggccgagaagcttggtatcgtcttcgtcgaacagggcacccgtctgttccaccactaggtgtgaggagtttactactgtcttagtaggcgatgataccgcagtgatgtttgcgtag

SEQ ID NO: 4122 - DNA, 774 bp, A.fumigatus
catttcggacctcaggataatcgccgacctgtcaacggcgacggcttcggtgtagggttctacactgaccccaagctaggtccagagccctgcatattcacctcgacacttccagcctggaactgtgagaacctggagcgtctggcttctaagacatgctcgaacctcatcttcgcgcatgtccgtgccacgacggaggggacgctgtccgacactaactgccacccattccagcatcagactctgatgtggatgcacaatggcaacgtcggcggctggcactacatcaaacggacgctagccgactcgctcgcggacaagtggtatctcggcgtaaagggcggcacagatagtgaatgggcatttgcgctattccttgaccttctggagaaggaaggggttgatcccagctcgaatcccgggccagagggctttggacaggcactactgcggaaagtgatggtcaagaccatcgcaaagatcaatgagttcatccgcgatattcccaagcgacataatgtttccggggtggagacgcgcagtttactcaattttgctgtgacggacggccataccgtggtttgtacgcgttatatcagcagcaagactgacgagcccgctagtctgtatttctcgtcggggacgaaatggaaagaaaggaaggacaaaggccacttcaagatggagcgccacgacaaaggggcaaatattgttttggtggctagtgagcccaccccttcgaacgccgtgagccaatccattcatcctttgtga

SEQ ID NO: 4123 - DNA, 705 bp, A.fumigatus
atcggggtgctcacaatctctcaacagtcaacgaagagaagcaccggcggtcgtgtatggcccagttatatacgccaatacaccggcgcgaacatatacgactacgcttggtcaggtgcggtctgcgatgctgttgtcgcaaacactgtccgcaacggcatcaagcagaatcaaatccctacgtttctggaggataacatctatgtcagtgacataaccggacagcccaccctaatcaatccaccagatgaaacagtctacgccatctggatcggcaccaacgacatcggctacggaggctttctcaccgaagtacaaccagcaggaatgtctctgacgtacatgaccgattgtgtctacgcacaacttgatcgactgtacgcgataggcgcgcgagcctttgtgcttatgaacatggcgccattagacttgactcccttgtatgctcttccgcagaatggcggctccttggacgcgcagtattggaccgataaagcggcttatgactccaatatcactcggtccagcgagaaaatgcgccagtatgtgacaatggtcaatgccatatatgactaccaaacgccatatgatgtcgtcgtcgcgaatcgatacccgcatagcagatttgctgtttacgatgtgcatgccttggtgggattgcgattttccagtaccccacccctaggctgtggcaccttcgactga

SEQ ID NO: 4124 - DNA, 216 bp, A.fumigatus
  unsure (131),(173),(179),(204),(213): Identity of nucleotide sequences at the above locations are unknown.
ttgaatgctataggtgaagttgatcaaatatttgcacctggcaccgcactgcggctgattgagttcgtctttcagctctcaggccgcaccatcatttccgacctcgtggtcaaatttgggggagcgtgccnaaaccgcggtacttttatccccggttattccggaacgggcantggacnaaaggccctgccagatctgggttantgtggcacntaa

SEQ ID NO: 4125 - DNA, 195 bp, A.fumigatus
atctgctccaatgaaaataatatgggttatgaacttcccgaatcgttcggtccgcattctcatatgcgtgttcccaacgtactcctagcttttactactttttttggcaatgtcctcaaaaatagtgcctataaccatatactccggcgaaacaatgagtatggaaacatggtaacttcttgtcaatgtggatga

SEQ ID NO: 4126 - DNA, 384 bp, A.fumigatus
agtgctctcgaacaggaaggagaaaaaattatcgccatgccgccccctggattattcggacgtctgatccagaataaacgcagactactctgggagaagagagagggggtggacgccaccctcattgtggccgatgtgaagtttggggttcatagcatgattctcggggcggaaagtcctatactacaatcgcgctttcaggcaagccttcgcaaatcagggctacgggagattatcatcgaagaagcggatatacacacggtgtggagaactctgatgctcatatacctcgggtactactccacaagcccatgcccaaaagttgctacgtcaggtgcgttcatatcctcgtcttcaaccacgggggctggaaggaaccgcgct

SEQ ID NO: 4127 - DNA, 564 bp, A.fumigatus
gcggtccggcagtcccgtggtgaagacggtatgctcatcgcccataagttttgggagaatgctatgaatattttacttttccaggagaaagattcactctcaccgcttgttcggatactaactaagctacgtcttcctcaggtcatctgcgagaaagttgagaagtcggacattgctactatcgacaagaagaagtacctagtacctgcggaccttacagttggccagtttgtctatgtcattcgcaagcgcatcaagctctctcccgagaaggccatcttcatcttcgtcgatgaggtcctgccaccaaccgcggcactcatgagcagcatctatgaagaacataaggatgaggatggtttcctgtacatcacgtgtgttattccccctctttcgtcccttaggacatgtattaacagccgttcagatactctggcgagaacactttcggtgactgctgagtatcaatgggtccttcttagcaaatggaattctccgcaccgtcaaggtgttcgattcacgaacctacgtttcaagttcgtgtcgaagtcgattgatccatga

SEQ ID NO: 4128 - DNA, 378 bp, A.fumigatus
  unsure (6),(15): Identity of nucleotide sequences at the above locations are unknown.
gcgccnattttccanccccgtggtgaagacgtggcctcttacgatcagatcaagtctttgccatatctgagagcggtcattgatgagagtctccggttgtatccaccaatctcccatggcctcccccgagagacgccaaaagagggcatgatgatcatggatcagtgggtgcctggaaacactactgtttcaatgtccgcgtatgttgctcatcgagatcctgccgttttcgatcaaccggagtcttttgtacccgaaagatggctaggagagcaaggggcgggccctgcaaacccgttttatcgccttctcagctggcgcacgaggctgtattgggcgcccgatctcttacctacaagccagcatcctcctagctaa

SEQ ID NO: 4129 - DNA, 228 bp, A.fumigatus
gagagcaaggggcgggccctgcaaacccgttttatcgccttctcagctggcgcacgaggctgtattgggcgcccgatctcttacctacaagccagcatcctcctagctaacctggtgcatcaatatgactttgagatgtgggatccaaagtggaagcccagcacgcgggaaacaatgaatccgatcatgggtcccatgccggtgaggatccataaacgcagcacatag

SEQ ID NO: 4130 - DNA, 213 bp, A.fumigatus
gcgaatactttcgatccctggctgtcaggtcgacatgacgtagcggtctgcgaggccggctgccgtcacgttggtctcgatatcaagggcaaggatcaggctaatcccagtgctatgatcctttctggatctatgcttcttcgccaccttggcttggacgaccacgcaaacagaatctccaaggccgtgtatgatgtgattggtgaagggtaa

SEQ ID NO: 4131 - DNA, 579 bp, A.fumigatus
  unsure (10): Identity of nucleotide sequences at the above locations are unknown.
ctcgaatcanttctcagtttccggctcaagatagcaattctcaacgatcccatcaattcttcaagggctttcaaatgcacctttaaacgccaaacccacgcgaaagtcagtcgagctcgtttgaagcatcgcccgctggcccagttaccagccccaatagctgctcaagccccttttgcaacaactgcggcgggacccaagcgcaagaacacgcaaaagccggcacctatgagcgtggaggaggcagcccgcattgctgcggaggaggacaagcgtcggcggaacacggctgctagcgcgcgattccgcgtcaagaagaagctccgggaacaagcgctggagaagacagtcaaggagaccaccgagaagaatgccgctcttgaggcccgcgtgaccgcgctggagctggagaatcaatggctgaagaacctgatcacagagaagaacggcaaatcggcggaggagaccaagaagtccgagaccgacattgcaaacatgttcaagaagttcctttcgtctcagaaggccgacgctgaacggagtagttccgagtccaagatcggtgttggcactgcgtga

SEQ ID NO: 4132 - DNA, 1437 bp, A.fumigatus
agaggaaccattgcatgtgctgctgactcgcatgcatacgcattgcttgatgtggagcatcagcaaaagatccctctgtttcccatatcctcatctaacgaagcgttcgaatcgggccacgtggaagatatgccctcagccccgtctccaacgtctcaaggaacccgcagtcatgccaggagtcctagttcgaatacacttctcggtatgcttcaaccaaatcctccgcaccttcagcatgatcggtcgcgctctgcgacacctgaactctccccagattctgggacaccgagacgatcagtttcgcgagaccgaagtcgcagtgcatcgccgcgagcatctactgaaatccgagcaggtgagccacagcctggctctgtcagtgatacaaaaccgcttcctcccctgccgaagcagctaaaacctcacattgcgtctccaacgccgtcagaatttctgttagttaccgggacagaagaaaaagaacctggagttggcatgtttgtcaatctagatggggacgttgtaccacgtgggacactcaatttccatcgctaccctgagtacattgtaatcgatagcggcgaagggaataaccttgtcgattcgagggagaaaacgcacgatcaatacatcctcgcggtcatagagacagacgaagacgggaaacgttgcaagtggttggaaattcaaccgtgggacgttgatccaagggaggaggagaattgtaagagctggctagaggtaccttcgaccgaggacatgccgccatgtcctgtgggaatctgtcatacaataagctccagccaacttgaattcggtgaactgggaaacttgctacagatggtccgcttgaagacgccctccttgtctccttatctacccgtgacagatccaaggacccaggcttccattgagcagcttcagaaggagaaggaattgttcgagtctcaagagttgactgattccgatggagtaaggaggggcgacgggtcgccggagcaggggtgggaagcagaacgcaataatgaaaaaaccaaattcgcgcgggctctgggtcaggctcaaagcagcttggtgatgtggtctgggcgtcggatttggcgagtggttagaaatccattaacaacacaacttgatagtgctttgcaagctgcccaaggctcgaaggatctcatgtacgaagatttgaaaagggattctattctggatgtttttgaggaaattcaggccccccagccgcgctctgaaaccgagttcttgggtctcaattttctaaaacaaaagtcaagcctccttctttttggtgacctgctcttcagggatgcagctgctccaaaggaggccgccggccaagtaacggaaagggtgctgaataactggaaggtttggatcccccgaatggttctcttgttgattccccaacccaaaggggcc

SEQ ID NO: 4133 - DNA, 597 bp, A.fumigatus
caagctgaccattcgacaggatacagcatccccctgttggactcggacgtgtcagtcgcaaagaaaatgtttgatgtgaacgtcttcggtgtcgttacagtaactcaagcattcgcacctcttctcattgcatcgaaagggacaattatcaatatcgggtccgtgcttggcaaaatgccgctcccatggcaagcatactacaacgcaagtaaagccgcagttgctctcctcaccgaccaaatgcgtattgaactttctccttggggagttagagcgatcctcgtcaataccggtgcagtcagaacgaagttcttcgataatcttccaaacaccccggtcctaccagaaagttccctgtactaccctgccaaggatgtaattgagccagcactggctggaagtgaggtggagaaaaatgccatggatgtcaactcctatgctgaggctgtcgtcaacaacgcaacaagatctagtcccaaaaagcatctctggattggaggaggagctcttctgacctggttggcttcgactttcggttggtcaaccatttgggtaggatcattcccttatccaaaaccaacaggtctaccttactga

SEQ ID NO: 4134 - DNA, 1044 bp, A.fumigatus
gctggtaaagaatggtatgtggtttcagcgatccgtctttcccgctcgaggttccatcgtactgaattttttgcagctcaatttaccggaagcccgattgaactccacccccagttcaacccgatgatcggcccttcgccgtacgttcagatcaatatgggagcgcggtacacgccatgtatgaagaacgtggacaagatccagaattcgcaggtggagttcctgttcccgtgtcccaacgcaacatcaactgctgattttgtatgcaccctctccgagctgtgcggtttcgatggagttcccaacccggttcccggcggcaccctggacgatcgccctgagccaaatcaatggttccgcttcatcattcccatgttccttcacacggggatcattcacatcggcttcaacttgttggttcaaatgacaatggctgctgatatggagagaacggtgggatggtggcggttcgcctttgtctacttggccagcggtatctggggtttcgtgctcggcggaaactacgctgctcagggcgagagttcttgtggttgctcgggcagtctatttggcatcctggctctctatatattggaccttctctatacttggggtgaacggtcgagtccatgggctgagcttgtgatcatggtacttggcatcgccatttctttcgtgctcgggttgcttccggggttagacaatttttcacacattggaggcttcatcatgggtctggcatctggtctctgcattatgagatctcctaatgcccttcgcgaacgcattggtcttgcccgtaacccatacgtggccatgactggtgccgcgggtgccactgctgacccaggaaacaaggtcaccaaccctggctcgaccattgctgaatttttcaaggctcacaagggctctaagagctcgaaagactctagtgctttgggtttcttcaagggtcgtaaaccactatggtgggcctggtggttggtgcgactcggggtcttcaccacggggctggaaggatcagcgctggtgctgtgccatacc

SEQ ID NO: 4135 - DNA, 765 bp, A.fumigatus
cctgtctgtgacgcctgcgccgtgttcctccattcccgagtagtcagcctcagacttccgcattactgcctcatcagcgctgggtgtcctggtctcatcttccaggcttcccacggtcgttatacctgtcacatacctcgcccgaatcgaggccacaactgctgtttcaaaatgccgaacccatctcagttattcctccttgctgatcacatcaagttgtcactgttggagcggcaacgagcgatctcgttgaatctggagcccaatagtcaggatggagaaatctcccgctctctagaatctctacgggaaggcattgaatcggtagaatcggaagtatcgcgtttgggggaagcgaacgatgttgccgccattgatcttaaagatcaactccattatctacagtcacaatatcgagacctttcatcccaatttcacgaacaagacgattcggtcttggactcggatttcagtaatgtcaagaagtcgtctcctgacctgaaacagcctattccacagcatccgccttccaagtctgtccgattcatggattccgcagcggaagacgctgatgaaaatcgtcgcaacctcttccagccataccgcgactctccttctcctccaagtccggaccactccaacatgtccaatcaacagatttatgaccatcacgctgagaccctccgtgagcaggatgaacagttggatcggctgggggagtcaatcgggcgacagcaccagctcagcattcagattggcgcatga

SEQ ID NO: 4136 - DNA, 309 bp, A.fumigatus
ccctgttttttttcccgttttatccaggagcatgtaaagcaattgtgtcccagcttgagaacaacctgtcccgactgccaaaccacagtctttcgaaaagtgctgagggatcatattgaaacttgcccggaggcaatacatgcatgtgccgcatccaaatatggatgcccagttaaagacaagcgggccgacctggcgacacatgagcaagcatgtccactcatcgctataggcccttatttcgaagctcagaatgcccggcttgattccctgggtgttcaacacgccgtggaaggtccgtatttgcgt

SEQ ID NO: 4137 - DNA, 339 bp, A.fumigatus
gcgctgcgtgtcccgcatgcgcctattaaacggagccatttgtctgaaagcgacagataccggacgcttttgccgactatgaacctcgaggagcttctgatgatggagtcgagctgcgaccgtgaggagatcgttgacctgcgtgctctggagtatgtctcgaattatgacgaccaccttatgtgtgcaatatgccactgtccatttattcgaccagttcgcttgcagtgcgatcatgttttttgtcaaaaatgcctgaattccgccattaacacgtttgccgctggtcgagatgaattcacatgtccgagctgccgcacaacgactcgagatgtctaa

SEQ ID NO: 4138 - DNA, 414 bp, A.fumigatus
ggaagagcgatcatgggagcgaccgcctcctcaaccacgacctacgttgacagccccgccgcaactatcccggggcggccgtggaggtcgtggagggcgccattcgaatcactacacgcgcggtggccattccggaggccgccgttcatcgaatacaccgaacaagcccaacggtttccgccagctgaatcccagcataagtgccacggaactatctctacaggcgcagcacgcacagtacctgttgcacgatcacttgtaccagcaaatccaaatcctgcaagcacaggagcaggaattgcgattgcaattgcaaaaccaggcgctgctcacagggagaccccctccagtgctcatccgccagccgttcatacagtttcccattcctcagcagcagccgcagccgcagcctga

SEQ ID NO: 4139 - DNA, 1485 bp, A.fumigatus
tttttgccccgttttgagcaggtttccccgtactcttcattttttaacatttcggctgtagggcttggagggacattaagttcctatacatggatctgcctgattatcaattttctgcaaacgcgggaacctcctgtactcccgagtctccaagcacgacctcacaagaaacgagtgacaacagacggcctagtttgctcgttcgacgatgatcttagctccctcgtggggtatgggcgaaaaaacaagcagacgcttggggagctgctcttccaattcttcaggtattatggccatgagctcgactatgagaagtacgtgatatctgtgcgggaaggccggttgatatcgaaagaggagaaggggtggcaccttctccagaacaatcgtctctgcgtcgaagagccattcaacacgtcgaggaatctgggcaatacagcggatgacacatcatttcgaggcgtccacatggagttgcgtagggctttcaaggcagtgtccgagggcaacctcgaggattgctgtgagcagtatgaatacccgcctgaggaagagcgatcatgggagcgaccgcctcctcaaccacgacctacgttgacagccccgccgcaactatcccggggcggccgtggaggtcgtggagggcgccattcgaatcactacacgcgcggtggccattccggaggccgccgttcatcgaatacaccgaacaagcccaacggtttccgccagctgaatcccagcataagtgccacggaactatctctacaggcgcagcacgcacagtacctgttgcacgatcacttgtaccagcaaatccaaatcctgcaagcacaggagcaggaattgcgattgcaattgcaaaaccaggcgctgctcacagggagaccccctccagtgctcatccgccagccgttcatacagtttcccattcctcagcagcagccgcagccgcagcctgaatcgagtgtagatgacgggtctcggtctaggtccgggactcatccgcctctcagcgcgagtctacgtccgcaggcgtacaacaattccgcctatcttccggtcgctgtcactcccgcacagggaagtagcacgaatcccccgtcaccctcagccgtgtctgctcttcccgagctccgacgtacaccgcgtcgccagtccatagcaaatggctctcctggtcgatcacttagggcgcactcacagccggcacgacctgcgaactccccggctttcccgagctttgctccgctgtattccgtctctcagcctgtcgacaattcccaactcccgaaacagcgcaacaattctatatctcccccggaaggaaaccagagcgaggacgagaattcctttatgcccagcagtctccctaacgtgtcgcgtgcaccgtatctggatgaaaaccgaccgtctgagtacatggggtactatttggcaacgtcttcacacacgggcctggcaggatcggcgattgagttaggg

SEQ ID NO: 4140 - DNA, 624 bp, A.fumigatus
tcacagggcgtcgatatcctctgttctgataaaacgggaaccttgacggccaacaagttgagcattcgagagccatatgtggcagagggtgtggacgtcgactggatgtttgccgtggccgccctagcatcatctcataatatcgaatcgcttgatcccatcgataaagttaccattctcacgctaaggcagtatcccagagcaagagaaattcttcgacggggttggaagacggaaaaatatatcccattcgaccccgtttcgaaacgaatcgtgacggtggccacctgtgatggaatcaggtatacctgtaccaagggcgcccccaaggcagtgctttcccttaccaactgtcctaaagaagttgccgatgtctacaagaacaaggcgcaggaatttgcccacagaagcttccgatccttgggtgttgcggttcaaaaagaaggagaggattggacactacttggtatgcttcccatgttcgatccacctcgggaagaatacgcgcatacgatcaatgaagcccagaatcttggaatcagtgtcaagatgcttacaggtgatgcattggctattgcccaaggagacatgcaaaatgctcgcactgggaaccaaggtgtataa

SEQ ID NO: 4141 - DNA, 903 bp, A.fumigatus
cggtggccacctgtgatggaatcaggtatacctgtaccaagggcgcccccaaggcagtgctttcccttaccaactgtcctaaagaagttgccgatgtctacaagaacaaggcgcaggaatttgcccacagaagcttccgatccttgggtgttgcggttcaaaaagaaggagaggattggacactacttggtatgcttcccatgttcgatccacctcgggaagaatacgcgcatacgatcaatgaagcccagaatcttggaatcagtgtcaagatgcttacaggtgatgcattggctattgcccaaggagacatgcaaaatgctcgcactgggaaccaaggtgtataattccgataagctcattcatggtggcctgagtggtgtcatggcaagtgatctggttgaaaaagccgacggcttcgcggaagtcttcccagaacataaatatcaggtggtgcaaatgctccaggagcgaggacatctgacagcaatgactggtgacggagtgaacgatgcgccgtcgttgaagaaagctgattgcggtattgcggtagaaggcgcaaccgaggcagcgcaatctgcgtcggacattgtgttcttggagcccggattgtctaccatcattgactcgatcaaggtggctcggcagattttccaccgcatgaagtcctacatccagtaccgtatcgcgctttgcttgcacctggagatctacctggtgacgtctatgatcatcctcaacgaaagcatccgcgtggagttgattgtcttccttgctctttttgctgatctggctactgtagcagtggcctatgataatgcctcctttgaactgcgtcctgtggagtggcagcttcccaagatctggttcatctccgtgcttctgggcctgtcttcaccacgg

SEQ ID NO: 4142 - DNA, 672 bp, A.fumigatus
atcatcgttggtgaaggccaagtggttcctgctgatgccaagattatctgcgattacaatgaccccaatggttgggaagaatttcaaagaatgcaggaacaaggcgacctcagtagcacttctgagtccgatgtcgaggacaatgagaaagagggcaaggaagggaagggtgaacaagagtcctccagaaaacgcagccaccccatccttgcctgcgaccattcggccatcacaggagagtctcttgctgtcgatcgctatatgggtcaattgatctactataccaccggttgcaagcgcggcaaggcctatgcagttgtccagagcggtgcgaagacttctttcgttggcaaaaccgcctctatggttctggcagctaagggggctggccattttgaaattgtcatggaccagattggtacatctcttttggttattgtcatggcatggattctggctgcctggattggaggcttcttccgccatatccccattgcttcgcctcctcagcagacgcttcttcactatacactgtcgctactgattatcggtgtccccgtcggtcttcctgtcgttaccaccaccaccatggcggttggagcggcttatctggcaaagaagaaggctattgtgcaaaaactaactgcgattgaatcacttgctgtaggttga

SEQ ID NO: 4143 - DNA, 240 bp, A.fumigatus
  unsure (77),(143),(167),(170),(205): Identity of nucleotide sequences at the above locations are unknown.
ccggggcttccttcagttccggcatttctgaatgacattgattcgaacatgctgaaaaatttcttcattcgattganctcgagtcatttcacaattgatttttgcttccgcaaccagcacagtaaattccttgaaccggtcanattcgagtggtctactgaactgcngcntacgtttgaaggctctactacttcgctcgggacanccgtcacttccccatcgaggcatagagaaacctga

SEQ ID NO: 4144 - DNA, 1164 bp, A.fumigatus
  unsure (1),(67),(91),(94),(129): Identity of nucleotide sequences at the above locations are unknown.
nctcgagtcatttcacaattgatttttgcttccgcaaccagcacagtaaattccttgaaccggtcanattcgagtggtctactgaactgcngcntacgtttgaaggctctactacttcgctcgggacanccgtcacttccccatcgaggcatagagaaacctgacatcgtgccgaataaccagggcgcgagctctgacatacttgctgcggcttccatgctctatcagaacgggatggcagggtctgacatcaacccgggattcggacagcagcaattcccgtccatgtcagagctcaatttcaatcactctattgcaaacggtcacggtaagaatcagcagtccagcaaccacatatcttccaaacagccaaactcttcccatacgcgcctgcctgttggcttccatacctcggagatgctattcgatgttcgcgaacccatttcccccgaacagcaagcatcagcaaaaatacgcccgctccactggggctctgatgttagttttatggagcaaggttacatcgcgccgcctgatcaaccaaatgaagaagagcgaacaaaagagttgcttggaaatttggagtgccttgaacctcaaagcagcgctgcgaatactcgagcacctagcccggagcggacagcaggtggttacaactctcactggggagagtccggcgggccagttccgctcaacagcctacaaagagaatacaaccccgacctagatgactattcgcaaccaaagaaaagacagaggacttcgatcaagcaagaagatgacgagcaatccgatgcagatagcacgagaccaagatcaagacggtcaaagagctcggctagtggcaaagcgaggcggacatcaaatgacacaatccgaaagccaaagctgcagcaaggagcaaaagccccccgtgagaatctcacggaagagcaaaagaggaacaatcacattctgtccgaacaaaagcgaaggaacctcattcggcaaggctttgatgacttatgttcacttgtgcctgggctgaaaggcgggggcttcagcaagagcgcaatgctcactcaggctgctgactggcttgaggatattttaagagggaacgaaatcctcaaagcacaactagcagaactgaagacgatgaacggcttagtgatgccccgatga

SEQ ID NO: 4145 - DNA, 1368 bp, A.fumigatus
gggacgttgccaatggacaaaggccgcaaaatcttatggggacattcaatctgcgtatgcataggtgagcatcccgataggttactattcggccaagctgatgggcgcaggactgatcatgcaacattcactttcggagacccgcagtctccgttttacaccatgcatactttctcgacggatgagctgtctatcgcaagagcacaccctatgaaacctcacagcagtgtctctgtgatgatgctgaaactggaggatcggaagcgtcggctgccgcccaacgacggactggtcaccctgttgttctcccgactggctgcaatgctagctatcagcgaagcagaggaagtagcaaagcaacatcacctttcatcaaccgaagcgagcaaagtggaaggcaacgcgctgaagcgagcagctgcacaagagtcctgcaggcttctctggaataacgagaagcgcctgtacgagctccagcacccttcgcactgcaaacagccaccgcctgctctcgtcggcgcagctggattcggtgcagcgggtattcccctttctccagtgcggtcgaagtacgcggggatcctccacatctcagtctcgactccatcaagcgactcccaatcccgtcagcccccaacgatcatcgtgacgacgcccctatcccccaacgcgttggaggccgccccccaggcggccacgccacgcacctctacccttccgttgaccgactcggacgagccgctggcgtcacttgaccttggtacaatgacgctgtcgatttccgcgacggcaatcattaacactattccgtcattgtacgccattgactccctggtagccgccatgctggccgtggctgcttcagatgagacgaccaatcctgtcctggcggacatggccttgtatgaccccaagcaggaatcgcatcacttttcttcactctccaatcctgccggcggcggcgtgttcacaggtgaattagtagcgacactcgcagaacgcgaagacgccaaggagagcgaccggctgatggccaagattaaatcgtccacgttcaagccaggcactcccactgccagcaacagcaatgacaagcggtccttctggtcatggagacgcccaaagcctgcaaaacccaagagcaaaagcaaacagatcatgatcgagcagttcgatctagaaaagtacggacggtacgggtctagttcttccagggaaggacaaaagctgcccggcccgacgaggggtatcctgcggcttttgttctttggcttgaatattattgtgaaaacgcttacagtgttggtgaaggttgtggcttggttgttagtgagcattactcggtgcgtgacgagtgagaagttttag

SEQ ID NO: 4146 - DNA, 402 bp, A.fumigatus
agtgcaagtgcaccagaaagtgggacggcactagggagtgtaagtgcaccagggagtgcaagtgcactaggaattgcgagtgcaccagggagtgtaagtgcaccagggagtgtaagtgcaccagggagtgcaagtgcactaggaagtgcgagtacaccagggagtgtaagtgcaccagggagtgcgagtgcactagggagtgtaagtgcaccaggaattgcaagtgcactagggagtgcgggtaaaccaggaacttttgtggtcgctctccctggtgtgtccgcactcgctggtgtgtccgcacttcctagcattaaatatcccggtcgttgcaacagtatgacattgaatttccatagatatacaagactaccaacctctctagctcccattgatttgtaa

SEQ ID NO: 4147 - DNA, 423 bp, A.fumigatus
tgttatagtatagccagttacaaatcaatgggagctagagaggttggtagtcttgtatatctatggaaattcaatgtcatactgttgcaacgaccgggatatttaatgctaggaagtgcggacacaccagcgagtgcggacacaccagggagagcgaccacaaaagttcctggtttacccgcactccctagtgcacttgcaattcctggtgcacttacactccctagtgcactcgcactccctggtgcacttacactccctggtgtactcgcacttcctagtgcacttgcactccctggtgcacttacactccctggtgcacttacactccctggtgcactcgcaattcctagtgcacttgcactccctggtgcacttacactccctagtgccgtcccactttctggtgcacttgcactctaa

SEQ ID NO: 4148 - DNA, 267 bp, A.fumigatus
atccccagaatgctgaatgcggggctagatgaatgggtgtttagccaggaacagcggcaggtgtttatgacttgggattgcctgcaagacataacctatgccaaattttctttaagctttaatatttatttatttatatttttatttattcatttttattttattttttattctttattttttagtttattttttgttgttttttatttttatttttattttttttttgatgcctgcgtccgttcaacaacattacacaaagcctga

SEQ ID NO: 4149 - DNA, 882 bp, A.fumigatus
cggggttcgaagtgtgacagagtgaagccatgcagtgcctgttgtcttcgaggcacgccgtccgagtgcgaatatggcaccagcaagcgagaccaccattacatccagcagtcggctctgatcgacagtctgatgaaaacatgcgaggacctgaagaagcagctggccgaagcgcgcgcgttggccaatcttccgccggtaaagccggaggagccattctcagtctcgtcgccagaggaccaccgcgagaagacggtggacgaggagcggtcgcaaaacccggagtctcgagcttcttcctcgttgatcaaacagtcggccgacccagcaggtcgatccttcgcgcaaaccaccaataccccatgcacgaccgatcggtcgtctcgatcgctcagtgacgacaagcgcatcctgaccgaccccgcggtcgcgagctcgtttgtggaagtgttcgtcgagcgtctcattgacaatttcagcccacagccagcctccgtctatggcggcacggttgccctgcgcgaggcatctcgcatgcgcattctgtcgccgatgctgtgtaccgcattcgaggctgcctccttgaccttcgccgggcgacgcgagcagatccgcgaggtggaagccgtcggacatgcccgctacgtccgggtgctccgacaactgcaaaccgccctgaacgaccccaagcagaacaagtcgacggaagtgatggtcgttgtattactcttcaccatcatcgaggtccgtggcgtcagcccttgccgcatccgattcccactaaccagtcgggcaggccttcaagcacagcaccaaagattccctgctgaagcaccaactcgggcgatgatgtcagcgcgacccgacgactcggtacggatc

SEQ ID NO: 4150 - DNA, 312 bp, A.fumigatus
gcttcactgagaatgcagttaaaaggccacccatctaactctacacaatatgttttaaatcgaccttgtatctttcatgtgcgaaggatatcttctatcactactcttctcgttctcttaacgtactacttgggggaagggctaatgtttcacgtgattcacctcaatgtcatctatctcagattgtattcgttaccctcagaaacagaccagctctatatgtctcatactcttcctatcaccatccaaattcacacttatcgtattttgtctacattgcaatgtaccttggtgctagttcgctgcggatga

SEQ ID NO: 4151 - DNA, 804 bp, A.fumigatus
tcccgcaatttaaacccggggagcgcccctttttggtccgttattccaaggttccattcaggggagttcaaagatcattcggcatccaaagattgggttgttcgtcacccgaatttggaaggtaacggcagggggattggttttcccacatcgagctactttgatcgacttccaccgccctctaccaatccttccatgatcggaatgtctcctcggccatctccaattgctccttattctgctaatgctacaccacctctacacgaaatgtcaccgaatccttccacgacatctctacctacccagtcaaccggcgcccatcctctgcctcagcgtgccccaggccatggcggtcttcaaaagcgggtcatcgacaagacgcagatctccgagccaacttttgtctcgtgcacatctaacgtgccgactgtgggtcttccccctggcgcaagcttaagtaacggcatggagacgccaccaatcccgcctatgaacccacgacggcgccgccagaccaccacccagaccatcattggcgctctcaagggcgagaagcacgagtcgcaccatccggcctcgacggtcagcagtccccctgaggaacatagcaccttcaacgacaacaacaacaagcggcccaagtccaaacataacaagctccgcaagacttccagcgagggcggtagtctgaactccaaggcccgacaccaagcgatggcggctgctgctgctcctctgccccctgcaccggctgtcccgcaatacgcgccgcccaatgtccccatagaaggtggaatgttctag

SEQ ID NO: 4152 - DNA, 198 bp, A.fumigatus
cttgggccgtttcgtccgcttccaaactggggcacagccttactaactgatagttggtctctgcagatgtgggactatcaaagatacaccggtgacccttggagcgacattgaatgcagggggaccctccccggcaccgtaccttgccgagacggcagcgtctacatgcctgggacacccgaccatggtgtggtttag

SEQ ID NO: 4153 - DNA, 495 bp, A.fumigatus
ttcctaactccttggctgtttgaacatagcgactcgcttcgacgccatatccacaacgaacatgatggccttcctaaaccacaccatggtcgggtgtcccaggcatgtagacgctgccgtctcggcaaggtacggtgccggggagggtccccctgcattcaatgtcgctccaagggtcaccggtgtatctttgatagtcccacatctgcagagaccaactatcagttagtaaggctgtgccccagtttggaagcggacgaaacggcccaagtcaagcaatacgtccacctctactttgctcggttccatccacactggcccattcttcatcgagccacatttagcattccaaacgagcccccgctgctgcttcagacggtcttgatgatcggtctatgggttagcggcaagacatctgcgcggaatgccgccgtggatctgcactccaagctaggcctgtcaatccacgaacaaagggtgcgttaccgaccttga

SEQ ID NO: 4154 - DNA, 333 bp, A.fumigatus
aacaagaatcacgaggaaattacggatactttttcactaaagatccagggagtaaaatggcaaaagtattctttacaccgtggaaggatcatttgcaattactcactgtccggaatcaattctaccctccgcccgcctatgatgggcccgacttgcgcccaaatgcctgcgctacggtacgtaatttggacattacgcttgaatatcatgattaacggccccaaggttgcagtctggaagcttcgtggcaacctccctcatccggttgaggctaccgccttattaacggacgcgattcttcacgacgatgcgcagaaaaattccatatttttg

SEQ ID NO: 4155 - DNA, 1140 bp, A.fumigatus
catgcatgcgagtatattgggccaattacgtgcgcgccagcaaagaagcagtcagtttacctcacaattctccgtcgtccctaccgatactttttacgcagctatctaacttttgttatctgtactttaggtcgacctggtatattcaatcaaagggacacagcagaaatttgggctggtggtgatggaagatcgcatcgcgaaagacttgcagcggctacaggcggagcatctgaagcttctagcaagcaaaacatgctagcagagatgtacaggcccccgtttgacatcatgtcacggttaccttgggatctcgcgcggcaggagggtcgtgagaatgagaagtggctgcttgtcaacatacaggatcagtccatattcgactgtcaagtactgaacagagacttgtggaaagatcccgcagtcaaggaaaccgtcaaagaacatttcatattcttgcagtattccaaggatgattcacgggcgacgccttatctacaatactatttccaagcgagcgatgtctccgagaactacccccacatagccatcgttgatccccggacgggcgagcaaatgaaagtttggtcggggccacctgtggtcaagcctgcggaatttctcatgcagcttcatgaattcctcgaccgttacagtctcaagcataacgtgcggaatccggtggcgaagcgaaaaccggaaaagagggaaaaaagtatcgacacgatgaccgaggaagaaatgctggagatggccatgagaaatagcctgggagacgaggtagcacaagctcacagagtgatggatccggacgatttgacccgcagtaccgaggacgtcaagggcaaaggcaaggccgccccaactgatgatgttcttatggatgagggtgatctagccgaggaaccagtggaagaagcatcgtcactgttctggtccattccggataaccggcctcatactgagccaccagccgatcctgctactactacacgtattcaatttcgccatccgtccggaagggtcattcgtcgctttgctctggtcgatcctgtcagaaggatttatgaatggctcaaggctgatcccccgttaccggaaaaggcaggcattgagtttgagctcaactctatgggccgc

SEQ ID NO: 4156 - DNA, 735 bp, A.fumigatus
gagcaggactatgtgaaagcgacctcgcccatcatgcatttcctgacttatgcggacaactatgcgattggctatttcaagaagcagggattcaccaaggaaatcacgctcgacaagtctatatggatgggttatatcaaggattacgagggcggaaccatcatgcaatgtaccatgcttcccaagatccgatacttggaagcaggtcgcatgcttctgaagcagaaggaagcggtgcaagccaaaatcagggcattcagccgttcgcatatcatccatcctccgccaagggaatggaagaacggaccttgcaagatcgatcccctgagtatcccagccatcaaggaatccggatggtcaccggatatggacgaattggcgcggcaaccgcgccatgggccgaactacaatcagctcctgcacttgctcaacgacatgcaaaaccacagtgctgcgtggccattcactcagcctgtcaaccgcgatgaagttcctgattactacgaagttatcaaagagccgatggacttatcgacgatggaagagaagcacgagaaggacatgtacccgaccccgcaagatttcatcaaagatgccatgttgatctttgacaattgccggaaatacaacaatgagaacacaccgtatgcgaagagcgcgaataaactggaaaaatttatgtggcagcagattcgcaacatcccggagtggtcggtaagtgtctctcttggatag

SEQ ID NO: 4157 - DNA, 243 bp, A.fumigatus
agtattatgcagacaatgtggtctttctccatcatcctagaatccgtatgcgtgcttccccagctccttctactccgccagactaccgttcctacggtcatcgactcatactatctcctggctctgggctcttaccgcgcgttttacatactgaactggtttgtgagaggcttcggtcctgaagaaacactgggatccaatcgctatgatatttggtatcgttcaaactgccttctacgttga

SEQ ID NO: 4158 - DNA, 471 bp, A.fumigatus
gaggcttcggtcctgaagaaacactgggatccaatcgctatgatatttggtatcgttcaaactgccttctacgttgattttgcttgggtctactattctcgtcagcgcgtcaagcttcgaaatggtggtgtggtcgattcggaagattatagcaaaagttggatagttaacaaggtgttcaatatccgacggcgacgagaaagcctggacgaagagcagaaccttaccggagaaggaatggaaggggagagcggtgatggtggtgataggcctcgcaacaaccgctggggtgctcgcggcatttccatctcagcggacgatatgttggacgagcacacccggcgcaagcccggggatgcggataacgaaggcttggagggatttctggaggatgaggataacagtatggacgatcaaactggtgggcggagcccattgcatcacacatcggtcacgtccaatcgtgactga

SEQ ID NO: 4159 - DNA, 216 bp, A.fumigatus
ggtggtctgatctccgatgaagcgactatgggagggccaggtactctgaacggaggcacccctgcaaaggatactgatggggatggaattcccgatgaagcggagaagcagctgggaacagatcccaacaccaacgattctatgaaactgcatagtagtggctatacatatctggaggtgtgggccaactcgttggttccgtccacctaccactga

SEQ ID NO: 4160 - DNA, 1146 bp, A.fumigatus
gtcacctttctctcctttggttgctgtactgaccatccagcactggctgccacctgcccgagtgtgcgttcatccccccagctccagtccatcaccacactcccagaccccttctcttggtatccactgcagaagactggtcgtgtcagcactctctccgactggcaatgccgtcaaagccacattagcagcctcctccagcagctcgaactcggcaccaagcctcccgccccctccagtgtaacctccaccttcagccaaaacaaactcaccatcaccgccaccaatgccggaaacaccatctccttcacagcaaccatcacctacccctcctcaggagaaggcccctaccccgcgatgatcgcctacggagggctgagcatcccgctcccaccgggggtcgcagccatcaccttcgacaacagccaaatcgcgcagcaaaacgaccaaagcagccgcggccagggctttttttacactctatacggcgccaaccattccgccggcgcactaatggcctgggcctgggccacatcgctcatcatcgaccgtctcgaagccacccccgccgcgagaattaacacctcccgcatcggggtgacggggtgctcgcggaacggcaagggcgcattagtcgctggcgcattcgattcgcggattgcactcaccgtcccgcaggagtccggcacgggggggtcagggtgctggcggctggcggcggcgtctgaaggcgcgccgcagaatgtccagacggcgggggagattgtgcaggagaatgtctggttctcgactgcgttcaatgcgtacgcgaatgatgaggaccgtctcccgttcgaccaccatatgctggctgggttgattgccccgcgcggtctactatccattgacaatgcggggtatcagtggctcggcccgtgctcgtcgctggggtgtatgggaacggcgaggctggtctggcaggcgatgggggtgccggatcgtatggggtactcgatgttgacgaaccatccgcactgctcgtttccggatcagcagcgggaggatttgtttgcgtttattaatcggtttctgctgggaatggaggtcaataccacggttcagaagaattatgcggggatcttcaccacggggctggaaggagacgcg

SEQ ID NO: 4161 - DNA, 915 bp, A.fumigatus
aggcaagctacggtgttcggccgccgatcagcgcatgaaacaacagcctcaccatctcgactgcatcaccatcgaagaatctatttggttggtgaacttttccctttgtctggttggctatttcagcatctattcgcatcgtggtgtttactacctgaagctagattcgttatttgcagccaggtccaatcaacccttctcataagcgccgccccgcaaaacaagaaaacaatgaccgactccatcccagcgactttcaagcctgccctcattatccacggcggcgcaggcaatattcagcgctcgaggctgcctccggacctctacgctcagtaccatgcctccctcctctcctacctccgctcgacgaaagatctcctcaacagcggcgccagcgccctagacgcagccgtccacgccgtctcattgctggaagacgacgagctcttcaactgcggacgcggcagcgtgttcacctcagcagggacaatcgaaatggaggcctccgtgatggtcacatccgtcaacaaacccaccgacgagacgccatctcccatcaaacgaggcgcagccgtgatggagctaagaaacgtccggcacccgatccagctcgccagggaatgtctcctccgaacaggccacgacgccaacggcaacccgaacggcgacggcgggaacatgcactcgcagctcggggcgccgtacgtggaggaactcgctcgtgcgtgggggctggagttcaaaccggacgagtggttctggaccaaaaggcggtgggaggaacatcagcgcgggctaaagggggagacggagcccgtttccttgagccaggggacggtcgggtgtgtgtgtctcgatcggtggggggaactggcgtcttcaccacggggctggaaggagccgcgccataaggag

SEQ ID NO: 4162 - DNA, 225 bp, A.fumigatus
cctgttctaaccaacttcttctctgcagttattgctggtttcttcactggtggcgctcttgctgttcgtggtggtgtcaaggccgccaggaactctgccatcatgtgcgctgtgttcctggccgtcattgagggtgttggtattgggttccagaggatgatggcggacaacacaaaactagaggtatggagtcttaccattgctttatgttacgattgtggctga

SEQ ID NO: 4163 - DNA, 318 bp, A.fumigatus
tctgacttctcagcacacattgattgtactatcttctcttttgcggctggcgtggccggaatccctcaggtttggagatggcggagggagtcctactgtgcagagaggggtaaaggcaagctacggtgttcggccgccgatcagcgcatgaaacaacagcctcaccatctcgactgcatcaccatcgaagaatctatttggttggtgaacttttccctttgtctggttggctatttcagcatctattcgcatcgtggtgtttactacctgaagctagattcgttatttgcagccaggtccaatcaacccttctcataa

SEQ ID NO: 4164 - DNA, 264 bp, A.fumigatus
gctatcggtggtgcggtttggcacggtgtgaagggtttcagaaacagcccctacggcgagcgacggataggtgccatcacagccatcaaggctcgagcgcccgtccttggtggtaactttggtgtctggggtggtctgttctcgacgttcgattgcgcaattaagggtatccggaagaaggaggatccttacaatgctagtacgttaacctcctcattctacttgacagttgtggcgatccggcacacgaatgacctgttctaa

SEQ ID NO: 4165 - DNA, 204 bp, A.fumigatus
tggtttaacatcgcagctaccattctttacgtgggaaccgaattccccatccatgtcctatattattacgtgtctctcttctctggtgttggggctggtcatttcatcttcaacgaggcatggcatagaggttttttgctttcatattgtgcttctagtccaacttttggattagctctgagcactggcatttgccagcgatga

SEQ ID NO: 4166 - DNA, 747 bp, A.fumigatus
attcgttatttgcagccaggtccaatcaacccttctcataagcgccgccccgcaaaacaagaaaacaatgaccgactccatcccagcgactttcaagcctgccctcattatccacggcggcgcaggcaatattcagcgctcgaggctgcctccggacctctacgctcagtaccatgcctccctcctctcctacctccgctcgacgaaagatctcctcaacagcggcgccagcgccctagacgcagccgtccacgccgtctcattgctggaagacgacgagctcttcaactgcggacgcggcagcgtgttcacctcagcagggacaatcgaaatggaggcctccgtgatggtcacatccgtcaacaaacccaccgacgagacgccatctcccatcaaacgaggcgcagccgtgatggagctaagaaacgtccggcacccgatccagctcgccagggaatgtctcctccgaacaggccacgacgccaacggcaacccgaacggcgacggcgggaacatgcactcgcagctcggggcgccgtacgtggaggaactcgctcgtgcgtgggggctggagttcaaaccggacgagtggttctggaccaaaaggcggtgggaggaacatcagcgcgggctaaagggggagacggagcccgtttccttgagccaggggacggtcgggtgtgtgtgtctcgatcggtggggggaactggcgtcttcaccacggggctggaaggagccgcgccataa

SEQ ID NO: 4167 - DNA, 381 bp, A.fumigatus
aatcatacatctttgccactggaaagggcgaagcaatgcttttcgcttcatgcgcccagccaatacgagagagttgcccgaacaggagaaatgagtgtcaatcctacctccttccggcaagtcctgtattcgtctatggttgatagatgtggctcagccgtgatgcttctagctcatccgcatacagtgggtgatcacctgacgcctggtcccacctaccacctaatttcccttatagactttcaaaataaccaaacttcaactgctcataactctactaatataactctaattaaagtagctttagaagtaattaaattattagaactaggtgaattaattaattatactttctttataaataagtatagtgttagctag

SEQ ID NO: 4168 - DNA, 249 bp, A.fumigatus
ttttgctacccaggtataagaatagtggccctgttaccctctccatttcatttttcttgtcgaaacggatctcttacccattacagtcccattacggggtacagcatgaccgatacaggtaattgtggaaaaatatttgttcaagaaacggaagcaaccaagcggacctccccgctccttttttttttttttaaaaaaaaattattcattcatttccttttccacttcccccttaaaacaaacctctga

SEQ ID NO: 4169 - DNA, 297 bp, A.fumigatus
gcaaccggtatcaactattccagctgggccctcgtcaacttcgccttcaaccacgtcatcaagcgccgcttctttgcttggtggacaaaatacaattacgtccttgcggctgctctcgacaccggccttgcgcttagcggcatcgtcatattcttctgcatctcgtatcctggtgccgtgtttcccgactggtgggggaacacagtatacctcaacacggcggatggacagggagtcgcctggaagccgatgccggatgttggttactttggtccaccgaatggaacttggacctga

SEQ ID NO: 4170 - DNA, 1869 bp, A.fumigatus
  unsure (1093): Identity of nucleotide sequences at the above locations are unknown.
aggtctgttgtcttttgcgccatgaatactagattctcttactcattccagagctgtgtagtccgagcagttgttcctgaaactgacgacccacacatgcccgtcaatacgcttcggatgtggatgctcggcgtggtcttcaccatcctgggttctgggatcaatcaattcttctccctccgttacccatctgtacacattgtctcgcttgttgcggagcttcttgcctatccatgtggtgtcttcctcgccagaattctaccggtaatgacggttcgttgcggaccatttggctctttctgcctgaacccagatcgccatttcaatatcaaggaacatgccatcatcgtgatcatgagtaatgtctctttcgggtacggcagtgccgactcgaccaacatcattcaagcctcaagctctaacttctacaactttggtcttaaagcgggcttctcggtgcttgttgtgatctgtgcgcaattgttaggctttgggattgctggtttagcggcaccatggctcgtggagcccgcgagcattatatggccaggggttctatccaactgtgcaatgttggaatcccttcattctcgcgtcaaccccattgcgaacggatggaagatctctcgcttgcgcttcttcctgtatgtcactgctaccggtttcctgtggtacttctttcccgggctcatttttactgccctttcctattttacctggatctgttggattgcacccaaaaacgttattgtcaatcagcttttcggcatgcagacgggactgggcctgagtcccatcactttcgattggagccaagtggcgtacaatacgaatcccctcctatctccatcttgggcagccgtcaacgttttcgcgggcttcgcaattttcttctggggtgtcgttcctgccctctactacacgaacacatggtatactgcttacctaccaatgatgacggcggacgtctacgatcgaacaggggccgtctacgacacagctcgagtggttagctcccaacataccctggatatcgatgcatacaagcagtattcgcctccttatctaggcgccacattcgcgttcgtctacngactctctttcgcgtcgatcacgtccgtcctcactcacattgcagtctggcataagagcgacatctgggctgccttgaaaggccaaaacaatctatacatccacgctcggctcatgaaatcatataggaaaactccctggtactggtatgctgccgtaattgtgatagtgactgctatcgccattgtactggtcgtggtctacgaaaccaagcttcccgtctacggtgttttcctggccctcattatcccagccctctacatggtgccctgcggtatcgtccagggaatcaccaacgtcgacgccaaccagctcaatgtcctcagcgagttcatcggcggctacatgttcgaaggaaagcccctgaccaatatgctctttaagattctcagcacggacgtggtcgttcagggcgtctacttcgctatggacatgaaactgggccactacctgaagatccctccacggctgctctttggcgcgcaggggaccgccaccatcctctgggccctgacccaggccggcgtcaccctctggatgctcggcaacattgatggcatatgcaccgaggaccaaccatacggtttttcctgccccaacggtcgaaccgtgtactcctcctccgtcatttggagtctagtcggcccgcggagcctctactccagggggagaatgtactcgcctctctcgcacttcatctggatcggtgccctcgctccggtagtcacatacttcctgtacaaatacacaaaaacgcagcatctttcaaggccatga

SEQ ID NO: 4171 - DNA, 204 bp, A.fumigatus
agcaccacactcggcatggcttctaaggagcaaactcaagatcataatgtcaagacaattcacgccggagaccatccggaggtagaaatcggacgcctggatgaacttgaagtcgatctcgactctgccttggaggaacacgagtatgactacgagtcggaacactccccgttttctgaaggtctgttgtcttttgcgccatga

SEQ ID NO: 4172 - DNA, 201 bp, A.fumigatus
atgcaacctgttactacctccattggtctcttctccgtattccctttcataggcggcgacatcgttcggcaccctttatacgaacagtgtacatttaatctatattccccccagttgattggacaaaacctgcagaactcaccctttaagcaagctaatgcaagtctcggccctggctacggagtagaccaacttgcttga

SEQ ID NO: 4173 - DNA, 690 bp, A.fumigatus
  unsure (17): Identity of nucleotide sequences at the above locations are unknown.
gaagttcgtacgaaganatttggacagatttcgttgaatcttacagaggacctttcgcgtttcgaagattataccgatgatggccgaggcgatatccccaaggatggctacgtctcctcgctcgatcgccgaagggctcgtatggccaacttgatgtacgcctttttcctcttagctggggctggaggagtggcttacttgggacgtaactgggagaccgaagaagaagcgaaggcccaccccgacattccatccggctggagcttctcgtcgtggtataaccgcatgaaggcccgtttgagcgatatcaccagctactacaaggaccccgctttcccgaagctgctcccagatgaggatcccaatctccgccaaccttatacgcttgttctcagtctggaggatctgcttgtgcatagtgagtggagccgtgaacacggatggcgcattgccaagcggccaggtgtcgactacttccttcgttacctgaaccaatactacgagcttgttctcttcactagtgtccccagtatgatggcggatcaggttctccggaagctcgacccctaccgtatcatccgttggccactgttcagggaagctaccaggtacaaggatggtgaatacatcaaggtaggccaggatagctcagacccagcctttagacagaactcactaaaatatctgtag

SEQ ID NO: 4174 - DNA, 585 bp, A.fumigatus
gatctgtcatacctgaaccgcgatctgtccaaggtgatcctgatcgataccaaggaggagcatgcgcgtctgcagcccgaaaatgccatcattctggacaagtggcttggtgaccccaaggacaagaacctcgttgcactgattccgttccttgaatacattgccggtatgggtgtcgaagatgtgcgccctgtgttgaaatcattcgagggtacttccattcctgttgaattcgccaagcgcgagaggatcatgcgtgagaagttcgaaaaggaattggaggaggagcgaaagagacggcccaagcgtggagtcggcagcctggcatctgctctaggcctgaagtctacccgcacgctggacggcgaacagagcccctctgagggcctggctcaaggcaagatgctctgggaccagattcgtgaacggggccagaagaactatgagatgattgaaaaggagatccgtgagaatggagagaagtggctcgcggaaatggccgctgaagaggagaaggctcgtcaggaacagatgaagatgatgaagggttccttcaccagcatgtttggtgctggtaagcagtaa

SEQ ID NO: 4175 - DNA, 255 bp, A.fumigatus
aatgatctcattgttcgaggtatttgtctcggcggagggcttcaatctcttgaccgcggattcctcagggccttcatcgcgctttcgtttggccgcgtcctttttggccttgtcctccgcgcggcgacctcttttctgcttttcgcgtggcatagtggacacaagggatcgacccgtttttcgaacaatatgctgtatagttcgttttggtttttttggtttgactttctctccgctcaggaaattttacgataa

SEQ ID NO: 4176 - DNA, 1167 bp, A.fumigatus
aatttcctgagcggagagaaagtcaaaccaaaaaaaccaaaacgaactatacagcatattgttcgaaaaacgggtcgatcccttgtgtccactatgccacgcgaaaagcagaaaagaggtcgccgcgcggaggacaaggccaaaaaggacgcggccaaacgaaagcgcgatgaaggccctgaggaatccgcggtcaagagattgaagccctccgccgagacaaatacctcgaacaatgagatcatttcaggagcggattacatccccctggggcaagacgatggcggaaatgatgttccaatgaacgatgcgcccgcgaatgatatgcctttctacggtctccttgacagcgaagagcaggaatacttttcgaaagccaacgaggtattggagctgaaccagttccacgatgcggaagagagaaggcttttcgtcgacagtgtctacagggaagcggacggaaaagaattgaaggttgcttgcagccagtcttgctcacggcttatggagaaattgatttcgttgtccgacatgcgccaaattcggagactcttcagcaagttcattggccatttcttgcatctggtgcagcatcggtttgcgagtcattgctgcgagacgctgttcatcaacgcggcgcctggagtaacagagaagatctccaagtcaaaaggccgtaaggcggaagtggacgaggaggacgagcctgaaccggaattgtcgctggcggaaatgttcatgaaggtcgttgaggaattggaggggaactggggatatttgctgacggaacggtttgcgtcacatacgatccgagtcttgttattcgttctcgctggggagcccgtcgacctgtcatccaccgattcggttgtcgccagccggaagaaggaaaggttgggaatcgtgaacacggaggcacctgaggaaaaggccgctgcggagaagcgtaaagtaccagaagttttcgaggctacgctgaaaaaggttatgaatgacatggtttccgggctggataacacctacttgagagcgctggcaacccatcctgtagggaatcccgtcttacaggtgctggtgttccttgagctgtcgcactttggcaaggcgagcgctaaggatcctaactcaatcatcatcttcaacacgcgcggcgatctatccatgggg

SEQ ID NO: 4177 - DNA, 363 bp, A.fumigatus
acggcgccctctacctctccgaaatggacgcctcaggcggccgcagcgccctcaaccccgctggtgcaacctacggcacaggctactgcgacgcgcagtgcttcaaccccggtccctggatcaacggcgaggccaacaccctcggcgcaggtgcctgctgccaggagatggacctctgggaggccaactcgcgctccacaattttctccccgcacccgtgcaccacagccggcctgtacgcgtgcaccggcgccgaatgctactccatctgcgacgggtatggctgcacctacaacccctacgagctcggcgcaacggattactatggctacggtctcaccgttgacaccgccaagccgataa

SEQ ID NO: 4178 - DNA, 1002 bp, A.fumigatus
  unsure (15): Identity of nucleotide sequences at the above locations are unknown.
ccgtctctctgcccngacaaggtgacctgcagccagaactgcgtagtggaaggcatcaccgactacagtagcttcggcgtgcagaactcaggcgacgccataaccctccgccaataccaagtacaaaacggccagatcaagacactgaggccgcgcgtgtacctcctcgccgaggatggcatcaactacagcaagctgcagctcctcaaccaagagttcaccttcgacgttgacgcctccaagctcccctgcggcatgaacggcgccctctacctctccgaaatggacgcctcaggcggccgcagcgccctcaaccccgctggtgcaacctacggcacaggctactgcgacgcgcagtgcttcaaccccggtccctggatcaacggcgaggccaacaccctcggcgcaggtgcctgctgccaggagatggacctctgggaggccaactcgcgctccacaattttctccccgcacccgtgcaccacagccggcctgtacgcgtgcaccggcgccgaatgctactccatctgcgacgggtatggctgcacctacaacccctacgagctcggcgcaacggattactatggctacggtctcaccgttgacaccgccaagccgataaccgtcgtcacgcagttcgtgacggccgataacaccgcgacaggaactctggccgagatccgcaggctgtacgtgcaggagggtatggtgatcggcaattcggccgtcgccatgacggaggctttctgctcgtcgtcgaggacgttcgaggcgctgggtgggttgcagcgtatgggcgaggctctggggaggggcatggtgcctgtgttcagtatctgggatgatccgagcctgtggatgcattggcttgatagtgacggtgccgggccgtgcggtagcactgagggagatcctgctttcatccaggctaactatcccaatacggcggtgactttttcgaaggtcaggtggggggatattgacagtacctactctgtttag

SEQ ID NO: 4179 - DNA, 201 bp, A.fumigatus
acacaggcaccatgcccctccccagagcctcgcccatacgctgcaacccacccagcgcctcgaacgtcctcgacgacgagcagaaagcctccgtcatggcgacggccgaattgccgatcaccataccctcctgcacgtacagcctgcggatctcggccagagttcctgtcgcggtgttatcggccgtcacgaactgcgtga

SEQ ID NO: 4180 - DNA, 384 bp, A.fumigatus
ttcgacaagtacatcgcaaggtcacgctggaaacgcaaccgcatccgggattgtgacgccgcgtccaagcagttctggtcgtgtatgtttctcttccgcgcattctacttcgctgaatgcacattacccgagacgttcccgtgcttcttccacaagccctacagctctacctccatggcaggcaccgagttcggcgaaggatacgcgggcgtcatcacgtctttaggagtccgctgtcaaatccttacccacaacgtcccggatgccaacattcttagccttgttgaagctaagattacctcggttgatttggctcgcatgctggtcatcatggaggccacgcgagtggtcaagcattttgagcgggttggagagtggtgttag

SEQ ID NO: 4181 - DNA, 444 bp, A.fumigatus
  unsure (254): Identity of nucleotide sequences at the above locations are unknown.
ctaatccgcaggagggttacatccgcactgtcgaactatatatctatctatctatctatatatatatatatactactgtcaccccacccagttcttggtgtcatcctgtacatgacacatttctcatctttgtccccaccagaccgagacagacaccgagacagacatgccggacatccaacccatcacagtctacggcaagggcggccccaatcccccgcgcgtggccatcatcctcgccgaactggatcttncgcacaagatcatcgaggtgcctctctccaagtcaaggagcccgactatgtcgccatcaatcccaacgggcgcatccccgccatctacgatcccaacaccgacctcacgctggggggatccggcgccatcgtcgaatacctcgtgagcactacgaatccgaccaccggatcactttcccggcgggcttca

SEQ ID NO: 4182 - DNA, 285 bp, A.fumigatus
  unsure (139): Identity of nucleotide sequences at the above locations are unknown.
cacatttctcatctttgtccccaccagaccgagacagacaccgagacagacatgccggacatccaacccatcacagtctacggcaagggcggccccaatcccccgcgcgtggccatcatcctcgccgaactggatcttncgcacaagatcatcgaggtgcctctctccaagtcaaggagcccgactatgtcgccatcaatcccaacgggcgcatccccgccatctacgatcccaacaccgacctcacgctggggggatccggcgccatcgtcgaatacctcgtga

SEQ ID NO: 4183 - DNA, 822 bp, A.fumigatus
ctagtacagatcgttctccattcatcagacatgccctatgcggttctgggggcgacaggaaactgcggcactgccttgatccagaacctcctccagtccagcaccagcaaggtccacgcgtactgccgcgacaggcgcaagctgctgtacttgctgccccatctcgccgacaacaagcaagtcgacatctttgacggcagcatccacgacctgccactcattacggagtgcgtccgcaactgccatgccgtcttcctggtgatctcgaccaacgacaacgtgccccagtgtcgcatggccttggatacagccactgcagtcatccaggccctgcggatcctccacggcgaaggggcctccatgcccaaactggtccttctctcctcagcgaccctggacgaccagctctcccagaataccgctccctgggtcagatggatcctcctcaaatctgcctcgcaagtctaccaggatctgagccaagccgaggcgtttctgcgccagcagcaagactggatctcaaccatcttcatcaagcccggcgggctctcggtggacgtgcagcggggccacaggctgagtttgaccgaagagaagagtccgctgtcctatctggacctggcagccgccatgatcgaagcggcggatgacccggatggacgctatgacctgcgaaacgtgggcgtcgcatacacagatgggccagccaggtttccccggggagcgccgatgtgcatcttcatgggactggtgcgacacttcttgccttttcttcatccctacctcccggccaccggaccgaaccagggatttctgtgctga

SEQ ID NO: 4184 - DNA, 924 bp, A.fumigatus
ccggctgttagtggtcacattactaaccatctagatctggtctatctctcgagtcttctggaagtggaaatggccagttaccgtcgtatcgaaaactatatccaggaacttccacaagaggtttcttcccctaaccttgatgcctgtgcagtagaacattggccaacacggggattgatatccattaagaacttcggagccagctatgcattggatgagaaggaggttctcaagggcgtcaactacagagcgaatgccggccaacgaacagctattgtcggccgcacagggagcggcaagacttccctggcactgagtctgctacggctaacgactaggacgcgtggatccatatccattgatggcgttgacattgaagcggttcccgtggaaaagctacgacagagcataagttttatccctcaagatcccacactgcttgatggaacaatacgtttcaatctagacttcaacggagaatatgcggagggatacctgcagtccattttggatgacgtggcaggtacaaggaaatggaagctggatgacacagtcgaactgaatggaagaaatttctcacaaggcgagagacagctcattaccttcgcacgagttatggtgagcaaacacaaaattctcatcattgatgagggtactgctagcttggacaaatcaagcgaagaccgcatcatggctgtccttcgagaccgcttcagtgaatgtacggtcatagccatatcacacaggttacacagcattatcgattttgaccaagttctcgtaataggcgacggccaggtgcttgaggccggaaaccctcgtcaacttctcggaggggaaaatgttttcaaagcattgtatttgcagcagtgtggcacggatgctgtggttagtgggaatctcagtggcattcgccaatcataa

SEQ ID NO: 4185 - DNA, 537 bp, A.fumigatus
  unsure (334): Identity of nucleotide sequences at the above locations are unknown.
gggccggggacgcgtatcttccatcccgtggtgaagacgcggaagattgagtctctgcaccactggaacagctggtataccaaggatgtggtaaagatgaccacagttgctgctgctgcaggtcgtaaatcagtccttcggcggtgggttttcgaccaggaggaatatgtcaacaactccactggcaagtccgttcgcacgttctgggtcatgaccaacggctattctctcgtcaagtacacttacgatgaaaatacccccgatgatgcgatcaactttgatcacactgagaagacttgggaggaagacccccgtggttatgagggtcgcttangtcccctccgtctgaaggatcaagcaggtgtcaccaaagaccgctggttgttgagagaagcttatgtggttggtgacaacgtacaccaatggtatgtgcgtgaagaggatgagggccacagtgtcattgagattgtctggctcggacctaagggaggtggtggtgctggtgtacatgattatgctgtgagaaagcagcattaa

SEQ ID NO: 4186 - DNA, 321 bp, A.fumigatus
ttggtctggcgttgtgttgttgccgcagccgagaatggcgcactcaagatcggaatcaagtgggttttccgcaaagagcatattccgttcaaggtccttgactggttctggctttccatctgcctgttctggggaactttcacccttgatctgacatgttatcccggtcgagtctttcttccacttctcctacacactcccacgagagactttcttctttatatgtgtcttgtaaaaatagaatttcaggctgagctggtgtcgctgcttctggagattagcgttgaacatttgtcgttatgcaggaatatcatgacttga

SEQ ID NO: 4187 - DNA, 198 bp, A.fumigatus
tacatagacaccgtcgacgctgatacgaaacctggagacctgttgatcaagtactcccggcgcccggagatggcctccgttttcaactacgcctcaatggctcacaacaaccactttttctttaactgcttggtgagtacttcacagagaagaggaccgctatctgaccgaccacgtctaatttgtttgttgcaatag

SEQ ID NO: 4188 - DNA, 300 bp, A.fumigatus
tcacccacccccactcagattcccgacaagttcgccaaggacattatcgacacctgctcctctgtcgaatcgctgaagctcgacttccttgcaaccgccaacgccatgttcgggcccggttttgtatggctggctaagaaccttgagcgggaaggattgatgcacattttctgcacctacaacgcaggctcgccctacccagctgctcactcccggcgccaaccggtagatatggccacccacagtcccgatgcccctcttggcaacatgtacgccggctcaatggtgcccactccttga

SEQ ID NO: 4189 - DNA, 225 bp, A.fumigatus
aaacccgtcgccgccctcccacgcttccagacacgacagttgcaccgagtcccccagttgacgcacgatgcgtacttcaaggccaatggtattccggagctattgtcgccagaggcatttgactttgcttggacgcagtatcaaactctcctcattgataaactgaatctcttgacacagggtgagaccttccgcaagacgtttatcttcatcgctctgggatga

SEQ ID NO: 4190 - DNA, 561 bp, A.fumigatus
  unsure (209): Identity of nucleotide sequences at the above locations are unknown.
tattatcgagaaattatcccggactctgtatcaacgccgcgatacctgagtcgaaggggatgtccaacttttaaccagacacacacgaccgccacaatgccgccattcatctcctccctcgctctccgcaccctccgtaccttagtccagcgtcattctctcatagccattccggcagtctcgaggccaattctctcccggtttcaacntgtcttccgcacgcccaccgccatcaccgcagcaagagccgcaggcgcgggccctatcacccggcatttctccacttcccctttccgccaggcaacttacaatcaagtccgtcgtggatgccgtgtatcgcagcgagcacgccgctcgcgatcacctgcgcttgttggtagagcccagatgaagggtgtctgcctgaagacgggtattacgaagcccaagaagcccaactccggtgagaggaagactgcaagagtacggttgagcagtgggaaggtagtgacggcgtatattcctggtgaaggtgggaccctcccgagtgtcaattgtcaacgtgataggcgattgtgctaa

SEQ ID NO: 4191 - DNA, 666 bp, A.fumigatus
  unsure (72),(77),(146): Identity of nucleotide sequences at the above locations are unknown.
tcaagcttgcaattcctcgaacagccgtcactaacgcactcacagtctctccgcatagcacccccagcaaantatgntacccaggcctccaacacaaccaccagaaaccccaccgctcgtccatcaaaaggcgccccatccgctcntggtctccccgacaccctccgcgacaaaatcaccctcccagcaccggtgggacccccctttagcaaccaaaccgccgtcccctcatcgacacacccccttgaagcccgcctgctcgcctggcgtcagactcaggatgccatgaagatggagacgctccgccgcgcatacgggatcgcggagcctgtgcggcgcggcatggagctcaagatcgtgcgggacggtactttccggcctgctgtgttgggcggaaacaaaggtggtaatgtgcacgaggacattctggttcttgggggacgggatacggagattgactgggaggatattttccaaggttggttgaatgtctgcatacctgctgctggaatgacgaggctgatacttttgatacaggagacgagttccgggaaccaccttccttccatgacgagatggagaaaagactccgggtggagttctgattggggtgtcagcttgttctgccttctgcttaattttcgcatgagtcgttacgttttctga

SEQ ID NO: 4192 - DNA, 231 bp, A.fumigatus
  unsure (14),(19),(88): Identity of nucleotide sequences at the above locations are unknown.
cacccccagcaaantatgntacccaggcctccaacacaaccaccagaaaccccaccgctcgtccatcaaaaggcgccccatccgctcntggtctccccgacaccctccgcgacaaaatcaccctcccagcaccggtgggacccccctttagcaaccaaaccgccgtcccctcatcgacacacccccttgaagcccgcctgctcgcctggcgtcagactcaggatgccatga

SEQ ID NO: 4193 - DNA, 204 bp, A.fumigatus
  unsure (199),(204): Identity of nucleotide sequences at the above locations are unknown.
acaaagaatctccattattataaatctctgaatttaagcttgtcagcctttaatccaccattccaccatcaccgacgccgaaatggtaggtcatgttctttcaatcgccatgatcagtactacataatcaagcttgcaattcctcgaacagccgtcactaacgcactcacagtctctccgcatagcacccccagcaaantatgn

SEQ ID NO: 4194 - DNA, 258 bp, A.fumigatus
gattcaactaatagatgtttttcagatataattcaaaatttgctctctagtagcctcgaacaatctggcgataagttttacatcagacacgccccgatgagcagtcaagaaggtaatccggaaacccattgtccgaatgtcaaagcttgcgctaatatttatcagccaatgctcaagttgttctcttggctgctgggtgccttcaacggctggatagctgtgcagtcaaggacacagggcgttctagtatttttctga

SEQ ID NO: 4195 - DNA, 192 bp, A.fumigatus
ctggcccccgaaataaaacaatatgttgtcgaatacctcagcaccagtggagcattccaacactgtcaggaattcctgatgcaactggaaaattcgatcgtgactgaaattgaccggattgagaaggtcacaaacgaggcaaatccaatgctccgactattattggagaagctaagtgtgaaggagaattaa

SEQ ID NO: 4196 - DNA, 291 bp, A.fumigatus
tcagtcgtcattagaatgttcatctgcagtgtacgtttgcaaacatgcttaatagaaactgaatccatgacagctaacaatatgcgaaactccaagaagttgcacatggctgccattgctttctcctgctggggccgattcaatcaagggcgaagactcatgcccgcctatggtgccactgaaatgccagacttaaagaacgcattccatgacagttcaaacaatctcgtcgacattaccacttgtttttacctactatccttctgctccccgggcaaccccccagattga

SEQ ID NO: 4197 - DNA, 222 bp, A.fumigatus
  unsure (157),(170): Identity of nucleotide sequences at the above locations are unknown.
aggttgtcaaaaagacggataaggaaatatggtaccgaggttaccggacggatccgtatgtttattatgcctgcaaaggtccaaagaaagaatctctcggaagggacttttgaagtggaattccaccaagatctggaaaggtatgtacaattcccanaacccaactccanggttgctgaaaatgtttgcaaggccggccaatctggcccacaagccacccta

SEQ ID NO: 4198 - DNA, 1206 bp, A.fumigatus
agacacgcccttgctgtccaggaaaagctcaagaatcactatattcccgaaatcacctcaatccagtatgagggtaactttgtcgagccgccacgcccagttccttggtacccggaccagctcgcatggtggatgaccacccctaagaacgttgtccggcgattcaagcctttcgcctcatttcagaagttccttgtcgccgagacggacgttggcaatatcactcgacaggaggttgtgagcatgattcctccactgctcattgacgtcagacctggaatgactgttctggacatgtgcgccgcaccgggaagtaagtcagcgcagttaatggaactgcttcatgcgggagaggaagatgcgatgcgccaggtcgcgcagcaagtgaaggaagggaaggcggggccggaacctatgggccccgagggtctcgacgacgatggcagaaccaccggccttctcatcgccaacgattccgatttcaaacgtgcacacatgcttgtccatcagatgaaacgactgagctccccgaatctgatcgtcacgaatcacgacgccactatgtatccctccatcagactgcctcctctcccagaacaagacggcaagccccagaagaacagatacctgaaattcgaccgcatccttgctgatgtcccttgcaccggtgatggtactgccaggaagaacattagcgtgtggagagaatggggccctgccaacgccctgggtctgcacgctacacaggttcgaatccttgttcgtgcgttgcagatgctgaaggttggtggacgggtagtctactccacttgcagcatgaaccctgttgagaacgaggctgtcgttgctagtgctattagtcgctgcggaggctcggccaacgttgaaatcctcgattgcagcaatgaattgcccggactgaagagagctgctggcgtgcgcacatggaaggtcatggatcgtgagggccgtatgtacaacagctggaaagaggtcgaagagcagagggagcgtgaaggcatcaacggcctgggccggattggcgaaggcatgttcccgcctactggagagaatgcagacttgcctctggagagatgcatccgcgtctaccctcatctccaagataccggtggtttattcatcactgtcctcgagaagaaatctgaatcttcacgccggggtacgaagcacacgcgtagagggaat

SEQ ID NO: 4199 - DNA, 321 bp, A.fumigatus
catactctgtggcagggtggccggggcggcggtgcgcgcgggcagcgccagaattacgcggacattcccaaaacgaatgagaagctcgagcgcttctatactgaacaaggcttcattccagaggaagagagagaagcattctgggaagctctgcgcagggaccttcccaacagtttccgattcactggttcaaaagggtacgtcatggcaggtcgacatctcccagctgcattgaactctgacattttgaagacacgcccttgctgtccaggaaaagctcaagaatcactatattcccgaaatcacctcaatccagtatga

SEQ ID NO: 4200 - DNA, 1116 bp, A.fumigatus
cctggctcatcaatgtcggtctccagtgagagccagagcacttctcctcacacctacgaagctgtgtctcccgttgatatcgtgcgtggtcacaatcatttcccaatgacagcctcttcgcaaccgggtggagctcggacggagcgaagctcctctgaatcctctgtttcctcgtcactcaggagccctcgcactgctcgattcgcggaagcaacatcggtgcactcccctaccgaacccaggggtgcttctacgtctccgttcgcggacccgccgggtcattcacagagtcagcccgatgtgtctgacgtgggctttggctatgtcgcagctagcgatcctgctcagcatgcatcgcatcagcttcccccagcatcacctctcaagagcgccctcaaggtccctggcacgcctgggcggactttgaaccccctgagtcctacttttcgggaagaattttttgtggagaagcaagaaaaggctactgagaaggagaatgcgagggacctggtaagcggaccccgagaatcagcaaactactcccgaaccttaatgctcacacactgctcgcagcgaattaaacttcgcgtgcgtttggccaagatattccttcgttttgtcaatttcagttgcagtctgatcgtgctcactattctggcaacgactttgacgatattccatgcgacaatacatcttcctcctcggaacgatttacccccatgggcgaaagggacgaacccatggccgcagtatctctttctgtcattggcacgcatctccctgttttcgagcctggttgttttctgggcgtatcggaagggtggtcacaggcgcgctgagaaggtcgcagtctattacacagtgttctcagtctgcttcttcacattcagtgtaatcatgtggatcgtcgcggcagccatctatcagaattccaaggccaacggcaacggtcaagacgtatggggctggtcgagcaagcagaacctccgagagcaattattccataacgatatcgattacgcactgctgtgccgtctacaggtaagtcgagttcttctcccaagtagtcttcgaccaggttttcaccacgggcctcgaaggatccgcactaagcga

SEQ ID NO: 4201 - DNA, 378 bp, A.fumigatus
tcatggaaacagtcgaatgagatgtttgacggatttacttactttgccatcaatgaccaagggacagatcgccagatggtcagggctagttattttactgtcgtacggcagattgctcgaatgccaggaagttttgcagtcctcttgtctgatactctggagtctgtcgccccgaatttcgtccaacctgtgtttcagctcttcaacgtagctgtcgcccaatgcgctgggaaattgtttccacaacgcctcactagtttcaagctgatgaagaaccctaccaccgcctctactccatctggacgcatcgtcgttgcctttgttcgatcagcccgtcatttttctcctcatttagatccttcagctgtatttacctga

SEQ ID NO: 4202 - DNA, 1377 bp, A.fumigatus
agatcaagcttgctgccattggaagcaaagctgaagttgaagcagcttcagaaaagtcgcgcacgctcaaactcgttggaatcgaacaatatacagtccagaccgacatccgcagttagcttctcgtcgcggtcacaagagcaggcatcgagacttaggagccctatccacacaacacgcagacacgagccagatgatgttcatgtccctttgtcgcctgtcagacgagcggctcctccaattgaacctgcgtccccacggagataccttctcggcttcgacaagggtctgaaaagtagcgatgttagtctcaaacgtccgccaaactcacgcttggggacacggccatcgagtatgcacggggctcttgaagctgcaatgtctcactccggcgatatctttgcatctcgcgcgcagatgctggctgcagaggagagtgggaaacggggcaagacatttagtgagcggattgctgaaagccgaacagctgaaaagtctcgcagggaacgagaactccgacttcagattaaccgaagctctgcgttccagttcgacaagacggagatggagacatttaggacagcagcggctgaggcgagaacaaacgctcctcccaggtcaccgacaagaagccgcctaatcgagactttcagcagagacgatgttgtgcgatcgtttcagaatctcaagccttccatcaaacgaagccaaactgcaccaagtgtgcgcaaagatgcaggctccgagggaccacggccattttcccataggcgacccaatcaatctgaaaccggaccggcatcctcccagtctcgtggagatcctgtctccgacattgacaacgaaattcgagacgaagtaacaacgaagacaccagattcgtccaagtttgagccgtactcgtcgcttcacctgtcgaatcgaatactaccgcactcctttttaactagaaccctctcagacaagaagattcttcgcattccagaccttctgaggacagtgagagggccagactttgagcttcccgaagagattgacggagactacgtcgtgttcggcatagttgcctcaaagtcggagccaaagcaaatcaaggacgcaaaaaatgtatctgcaaaagaagttgatccctttgatgatgggctgaacaacagcaacaggtatatggccatcacactcacagatctcaagtggacaattgacttgttcctgttcgacactgcctttcctcgatattacaggttatcagaaggcatcctcattgccattctgaatcctaccatcatgccacctcccaaaaataagatagacaccaataggttcagcctgtccatttcctcatcagattctagcagccgggagtggaaactaccggtg

SEQ ID NO: 4203 - DNA, 609 bp, A.fumigatus
ttggcatttgcacccatctctcgtatttccgataatggggaacaccatctgtatccctggcggtatgtacgatttcatctctgcctgaccatgggcgtggcagccctactatatgccaaaaagccaccccagtatactcttagttcaatggacctcgtcaaagacgtctctctgcttatggcaacatatctcgttggactgttcgcgtcgctcctcctctaccgaacattgttccaccccctccgccagatacgtggcccctgggcagccaagatatcttcattctggttatccttccgtctgaggcgtgggccatcattccggatccttcatgaactgcacgaggaatacggccccgtcgtgagggttggaccctctgaagtgtctatcatccaccccgaagccgtccggatgatctacggacccaactcccgctgttcaaagaacaccttctacgacaacggccatccgatgatgtcgctacattcctaccgggaccgaatagcccacgaccagcgccgccgggtctggagcgcggggttcggggatcgggctctgcgtggttacgagcagcgcatgcgggtctatcgtcagaagctcttcgtcttc

SEQ ID NO: 4204 - DNA, 324 bp, A.fumigatus
tatgttggtttcatttctctttccctggccttgaatgtgctaaccgctgcccgcgcttgcagtgtcggatggattgaccctgagcacactgcccccccgatccatttcttcgagggtgatcagggtgattctgctattggtgtctacagcgtgcagtatacggcaacggacagagttgcctggagtggtattccaggcacagagaaatgtcccttcgaggggctgtgcaacccccagtatatcttctaccacaacggctatcaaatcgttctcaatacatggcgtgagttccgtgaacggttccttgattcaatggctctctaa

SEQ ID NO: 4205 - DNA, 240 bp, A.fumigatus
gttgtacctgaatgcatccaagttgtccatgtagtagctgatggaaactcgactcaaaactacagagagcgcgacttactacaccgggtttttacggagaagagagtcgggatctatgtcggagtagacccaacagctccatccctacatgttggccatatgcttccgttcatggtgctggcctggggttatgtctggggtctacctgtcacctatctggtcggtcctgcctcgccctaa

SEQ ID NO: 4206 - DNA, 330 bp, A.fumigatus
cgtctgaatcgcgtggacatcattgctgataaacaacagcttggcggggtaacttctcgaatcggtgatcccactgggaggttgaaaggacgagaggcgatggattcttcggtccggaaagcaaatatggcgagtatgcacatgcagttgaaaaagttgggcgcctctgtggagcaatacggcaggaaacacggatatcacaaagagaagatctggcggcgagccttggtgaacaacaacacatggtggaattcgacatcgttactggaagtgctacgggacctcggcgcccatacgcggcttggtcccatgcttggtagagagacgtga

SEQ ID NO: 4207 - DNA, 522 bp, A.fumigatus
acaacaacacatggtggaattcgacatcgttactggaagtgctacgggacctcggcgcccatacgcggcttggtcccatgcttggtagagagacgtgagtctattactctctttcattcagtcggccatacgattactgacctcgatgattatagtgtgaaaaacaggatgaccaaaggagacggaatgtcttttgcggagtttacttatccactactgcaggcatgggactggtgggtgctgttccgaaaaggtgttcaggtgcaggtgggaggttccgatcaatatgggaatatcctcttcggcatggacgccgtgaagtctatcagcaagaatactgcgatagaacaggaccgaaatcccctggaagatgatttagataaacccattgggttcactacgccactattgacagccgcgaatggcgaaaagttcggaaagtccgctggtaatgccgtctggttggacaaggacatgacatctacgttcgagctttaccaggtgagccaatctagctcctag

SEQ ID NO: 4208 - DNA, 954 bp, A.fumigatus
atccagtcgagagtgcccccaatcaaagccgagaacggtcagaagaaaccacctgctgtgtcattcatcgcgcttcagcttgaacaagacgcaatcagaccgaaacggggtatgtacgaaggtacggatgctgaaattcacagagtcgaaggaggaaaggatgacgcgacagtggcaaaacgaggggaagattttgaggaggttgacgagacgttcagctatctgcgacggccagagcctggacagggcgacaaggagcagcgcttcatccggtggtcgcagtccacggagattggagacttcatccgggatgccgcacgggccaaggagttcatcgtaacgattgaaggtgcaccagcggggctggaacagattcacgttgccgtgccgtcattcgatgagaggacgtatttcctgcggatgaggttgcggaagatctctggcagaatccagggtcttgcggagatcaagcatgagtgtgacgcactggcgcatcggggtgctcaacgggtggcccttggcgggtttggcattctcgccttttggtggtacattgtctacaaactgacctttgagacggacctggggtgggatacgatggagccggtgacctatctggtcagcctgtccactttgatgggtggctacctttggttcctgtatcacaaccgcgagatttcctatcgttcagcgcttgattttacaatcaatgcgcggcaaaagaaactctaccaaatgaaagggattgaccttcaggtttgggaatcactcattgatgaagccaatgcgatacgcagggaaatcaagaacatcgcggccgagtacgacgttgattgggatgaacgaaaggacgagcaggacgaccgcgttaccgaggctttgaagaaagagagaagactcaagaatggatctcagaaagaagagcggccaaacgatgacagagacgatgattga

SEQ ID NO: 4209 - DNA, 456 bp, A.fumigatus
  unsure (84): Identity of nucleotide sequences at the above locations are unknown.
ttactgaagcaggccgttgcagccgattcggcaatcggcacttcattgtggatgactgtggaatcatgcccagcagacaacggncaggtcctgctttccgaaattttggatgagttcgaatggcaattcggattcaagatccttcgcagtggcccctccgaaaccaagaaagaaggggaaaagaaagagcccgcgcaaaatgccaacaagggttccatgcagaacgccaaccccagcaaacagggcattgagaaagactatgatctaattacaaaggcacgggaagtcttgaagagcaaggagaccaacaggattggcatcaaagacgtggctgaagcttggaacctggcggacactgaactctggcgcttcgtcagagcttaccggtacgtgcttccatgccccttacacccaatgcctaggagacagttcattgacaaagttcactacgaatag

SEQ ID NO: 4210 - DNA, 240 bp, A.fumigatus
agagcaaggagaccaacaggattggcatcaaagacgtggctgaagcttggaacctggcggacactgaactctggcgcttcgtcagagcttaccggtacgtgcttccatgccccttacacccaatgcctaggagacagttcattgacaaagttcactacgaatagggcccgaagcgtcgttgagcgaaagaaatgggaggcagaagagaaggattttgttggtgctaaggtcagagaatag

SEQ ID NO: 4211 - DNA, 279 bp, A.fumigatus
gccccggttgacattccaatggcgcccggaagcctgaccgcgccggttgttgaggagcaaccttccaaggctgtttccttagcccagttgaccgaggactgggatgacacaattcgtttctaccttaatggcacaaaagtcatactcgataatgtcgatccagaactcactctgttagaatacttgagaggcatagggttgacgggaacgaagctgggttgtgcagagggaggctgcggtgcctgcacagttgtaagtcaggacgacatcgacatctga

SEQ ID NO: 4212 - DNA, 246 bp, A.fumigatus
gcctatctttgtgacagaaattcttacttcttacaggtcgtgtcccacatcaatccgacaaccaagaaggtctatcatgcatctgtcaatgcttgcctggcgccggtgataagtgtggacggcaagcatgttataacggttgagggtatcgggaatgtgaagaagccccacgcggttcagcagcggctcgcgatcggaaatggcagtcaatgtggcttttgcacacctggaatcgtcatggtatga

SEQ ID NO: 4213 - DNA, 234 bp, A.fumigatus
ccatactttgcagcttcctatgcgacgcggaacaccgtatcggcaatgaaggcggccaattcggtggtgctacacaaatcaagaaccacccattcttaccgtggagtggtatgggagcaacttcgtaatatccgcgctcccttagagccgaagctcagctcgaacatcgatgtttcgtattaccccatagacgagattccggaggaagataccaacgctattcaccgtgcttaa

SEQ ID NO: 4214 - DNA, 531 bp, A.fumigatus
tgcctttcgttgccttcgaacagttctgccgagctcgacaagatgatccgtgaccctagtatttccaaggaaaagaagcgccaggaggccgagattgctgcaagaaaggagtcaaccttcctacgattcctccgaaccaaggagacacctgccaacttccagaccatcaagattatcggaaagggtgcctttggtgaagtcaaactcgtgcaacggaagaccgacggcaaaatctatgccctcaaatctttgatcaagacggaaatgttcaagaaggatcagctggctcacgttcgtgctgagcgtgacattctggcggactccaaggacaacccgtggctcgtgaagctgcatgcctcttttcaagacagcgcctatctctatctgctcatggagttcttacctggaggtgatctgatgaccatgctcattaagtacgaaatcttctccgaggatattacgcgattttatatggcagaaatcgtaatggccatcgaagccgtccacaagcttggtttcctccatcggtga

SEQ ID NO: 4215 - DNA, 546 bp, A.fumigatus
tcttatacagatactaactcggccgcgttcagtgacatcaaacctgacaacattctgcttgaccgaggtggtcacgtcaagcttacggatttcggtctctcaactggaggcaagaaaactcacgacaattcatattaccagaatcttttgaagaactcgacttcgaaggataagaatcgcaactccggatacttcaacgatgcaataaacctgacggtctcgaatcgggggcagatcaacacctggagaaaatcccgccgggccatggcttattcgacagtcggcacacctgattacattgcacccgaaattttcaatggtcagggatatacctatctttgtgattggtggtctgttggtgctatcatgttcgaatgccttgtgggttggcccccgttctgtgccgaggataccacggatacctaccgtaagatcgtcaactggagagaatgcttgtatttccccgaggaacttacgctgtcccgcgattcggaatcgttgatacggaggtatgttccagtacccgtttgcagctttgtgacttga

SEQ ID NO: 4216 - DNA, 630 bp, A.fumigatus
tcgtttgcgcttatagtcgtacacttcccgtctaccagtattcgcagtctttggtatcacgattctccattgaatgcattgttcaattgcaatatcttctctatgcctgtgttcaccgaatacgccgcctcgtcgcgtgaactgcgcgttctgccttcatttgcccctccactcccccgtctttccccgcgatttacgcgtcctgaagggatcgaaaagtatgaagtcgtcattgtcggcgctggtccagcagggctgatgctacacctgcttctggcacgatatggcctcaatgatgactctctgctttgtatagacgcgaaaccgggcacgctcaaatcgggccaagcggacggcctgcagccgcgcacgctcgaagtcctcaaatcgcttgggctggcggacgagatcctcactgatggctgtcacatggaagaggttgcgttctggaatccgtcacctgacaaggagaaggtgattgagaggacgtcgatcgttcctgatgtggctgtgcctgcccgctttcaacatgaagtcacaatccaccaaggtcgcattgagcggatcctcgaaacagatctgctccggtattcgaaaagaggcgtgcagcggaacaccaagcttgtggac

SEQ ID NO: 4217 - DNA, 219 bp, A.fumigatus
tcgccctccgatcggctcattgtctctctggtcgacactgtcatcgcggacagtggatcctcagtggggcattctttggatactaccgtaaactttactagcattactccccggtcgtatgcctctgaagtatgttttacaagaatgaccactttcaagaccaaccccgcacaggaaaaactgaatccactacggagtaacatatccagaaccatctaa

SEQ ID NO: 4218 - DNA, 537 bp, A.fumigatus
gttgcactaaagcgattattgcgtagttatgaagtgccgccaacttctactccatccagaatacctcctacacagacatcagataatgaccgcttgaggatcgctcattcactgtgtcttctagtgttcctccacattcgagctcaacaaagcattttaaatgagtcattcttccagaccctggagaaaatgaaactcaactctctcatctctttcctctgcattgcggcgagcgcgctttgtacatcctcagaccctaataagtacgagaaatacaaatcagtatctcctgtcgcgccgattggattgacggatgttacatatcatgatttgacctcaaaaccccgcgacttccatgtcgcggttcttctaacagctactgacgctcgctatggttgcgcgctatgtcgcgagttccaatccgagtgggacctcattgcacgaagttggaataagggctccaagtcagacgatttaaagctgctcctcgctactctggatttcagtaatggcaaggagaccttccagaaggtataa

SEQ ID NO: 4219 - DNA, 429 bp, A.fumigatus
aagatgtttagtccattatctgccgaccaactctacacatggatcagccgacatcttccggaaggtgcaaaaccacctctcatccgcccaatcaattacatgcgaattatctctgcaatcactctccttatgggtgtgataactttgtttacggttttgtctccgtatgccttgccgatcataagaaaccgaaatctgtgggccggctttagcctgattgctatcttgctgttcaccagtggccacatgttcaatcatatccgcaaagtaccctacgtcgtaggtgacggcaagggaggcattagctattttgctggtggattctctaaccagttcggcatggaaacgcagattgtcgctgccatttgtaagtcgttcacgttccggagtcttcaccacaggggccgaggaacgcgcaaggttcggcgc

SEQ ID NO: 4220 - DNA, 189 bp, A.fumigatus
  unsure (8): Identity of nucleotide sequences at the above locations are unknown.
tgttatgnccataccagcaaagaaggcacggatcacgcgaagaacaaggcgtgtatctaccggccaaaagatgggacggatgtttttgatgtctctttagtcctctgcagcgacccttgcaagttatttatcaaaaaaattaccggggttcttttcttttctaataccatggttctatctgagaggtag

SEQ ID NO: 4221 - DNA, 204 bp, A.fumigatus
tcatggacacaaataccttaccgtcaggaacgggtattgcgtcatacggaccagttagtaagacggacagtttgggatccgaacagcgagaaccactccgtacctactaactccgtcggtactctctatccaccaagtactaagtttaaacatccgcccgctccgatcttgtgtgtcttctggttcgggatttccctcaattga

SEQ ID NO: 4222 - DNA, 186 bp, A.fumigatus
gatgtccggtttaatttcatgcagcagacatggtttcaagttactctgcgttatctgtcgcttaccttactctccaagggtttttttcattccaactttagttccagagcgtacatccatggccattcttcccttgacgaatcagcagccttctatacaaaggcaaagctaacaatgtctagataa

SEQ ID NO: 4223 - DNA, 219 bp, A.fumigatus
catgagtccgttgtactacaggttctgcgctactcggctctcgttgccggtctcatttatggcgtctaccaccagaactctatcacagctcaagccaagcaagcagaggccgatcgtgaatatgctcgacaggaacgcttgatccagcaggccaaggcagagtggaagaagaagacggcgcccaaggacaccaaggcagagagtgggggtaggttctga

SEQ ID NO: 4224 - DNA, 228 bp, A.fumigatus
ttttctgttgttcttctaacctatagaccttcctccgagacttgtacataccctggggtggctgtgtatctgtacactatagttggaccagaagagcaagaaatgtgtggtctctccggctttgccgctcatctcctatctccgggcactatcaactacttcgtgcaggttgtatgcgacgtcgcatcccgtcttcaccgaccggggctggcaggtcacgcgctgcga

SEQ ID NO: 4225 - DNA, 414 bp, A.fumigatus
tttgacgtggcgagcagattcaacattgtcaagtccggcaacatgacagagacagtcttcaacaaggaacgtcacatcaaatactacctccgctgtctcaagactttcctcccccaccagtacacctccaatgactccaatcgcatgctcctcgctttctttacgatctccgggctcgacattctaggcgcgctcgatagcaaaatcaccgccgaagaacgaaaaggcttcatagactggctctatcactgccaggttccatcgggggggtttcgcgggttcacggggacagattttggtatcgacaagcgcaccccggagaacgaagcttgggacccggcgaatgtgccggccacattctgggccgctggtagtgctacttcttacagccgcccggctggaaggaaacgcgct

SEQ ID NO: 4226 - DNA, 489 bp, A.fumigatus
agccaggatctggggattggcacggtgttgaaaggcatcctggacctatctgagcctgacacaacgactatggtcaacaaccccagtgaccctgtgggcctggattgggggaagctccattggtcaatcaagcctcctaattctggtcaagaatatgctaagggctgccagatcctgtacacacagcgtgtgatcctcactggtcatttgcgtcaaatcaccgtctcatccattaacatggaggacacagtccacattacgggtctgaaactttccttcgacgatgggaccaacacacaactcggttacagatctcaggacaattcttcaaccgacgtcgtagcctttgggggattcgttgtcgcagtagggacgacaggaatccatgggttgcagataattgacaatagatcggactccactaaatggtttggttccaaccggagatgtcttcaccgcggggctggaaggagccgctccaaaggtgaa

SEQ ID NO: 4227 - DNA, 201 bp, A.fumigatus
  unsure (10),(148),(149): Identity of nucleotide sequences at the above locations are unknown.
gtatacctantacggagattcatgcaaacaagactgccaatcagcttcaaaaagtatctcgttgcaatcaaccttgtcaaccaatcaccccttgagtcaacactttccagtctccccatgttcatggtcctagtgtctttcattgaannaaatccacctgctggaagggcggtcccgcggaatcaaatacctcggacatga

SEQ ID NO: 4228 - DNA, 969 bp, A.fumigatus
tccagtgaggcagctgtgatgacatcttccatgagcccactgccctccgcaatccccaggaccattcctcgacccaatgacctccaatctagtcagagacaaacgacatcaagcagagtctcgccaaagccagaacctgagcttcccagacccaaattccgtcttcacctgaatgatctgcgtcatccggctacgctatcgttcatatccctggtccccgatgttgcatcaaccctcgacaccgcgcttaaagcaattgtacgacacctctatacaccaccctcactttcgccaaacgagtcgagcaacgccccagcgaggaaatgtcccagaccgtccttcacaccatgtatccctcccacccgctccgtgacagtcctcgtccgcgatataagtggggtagcgtacaccaccggcatcgagctcgatgatgaccataaggaaatccacttgtccctgtcatacgtcaagaccagtgcggagaacaatccagaccctgcagccgaaatcaccggtgtgttgacccatgagctggtccattgctaccaacatacaacgccgaatggggatgaaagtgcctctgtgcctcgtcctccgggtggcttgatcgaaggtattgccgattttgttcgtctgaaagcgggccttgagcctccacattggaagcgaccaacatccgctaaggaacgaccatcaaagtgggatcagggctatcaacacacggcgtactttctggcgtggttggaggatgtgcgggtcgggaaaggtgctgttggcatgctgaacgacagactgctgagagtcggatacgtaggcgaggattcggagtctgaaaatcaagacacacaaagcttctggaggggcctgttcgggaagggcatctcggagctctgggaagaatatggcgaatatttagatcgctctaggaatagtggtaattgggaggacgagatcatcaatcccgagtaa

SEQ ID NO: 4229 - DNA, 309 bp, A.fumigatus
tgtaagtccattgatattatgtttctaagccgccgtaagtcgaaccaccaagtaacagctggtagaggcgattcctgccatcccatgcttccatatcttgcccagggcgctaattcatccatggaggatggagcggccctagggacgatcttaaagtccgtcacaaggaaggagcaactcccgaatgctttgcatacgtttgagaagcttcgcaaattaaggagtgaggctatagctagggaaacattcaagcaggtatgcactatcgtcttctaccacggaggctggccggacccgcgcttaggttag

SEQ ID NO: 4230 - DNA, 738 bp, A.fumigatus
gttggtgccggccttcaagtgacccctaatggctcgcgcctgctcagaatctgggacctgcctcaaaccttgtgggatcaggccgctgagccaacccagttgaccgttcatcgatattctggggcagtgctggcccgtgaggtggactttgataagaatatccggagaaaatatggggtgcctttcgttgatctacatcgaggcgacctgcagcaaggcttgtaccaacgggctcagcagttgggagtaaaattccatctgaacgcacgcgtacaatcggttgatcccgcagtgccatcactaactactctttcggggcaccaataccacgctgacctcatagttggagctgatggcttgtggtcgcgaactcgagaatgcttcctagggactgctgatccgcccaaaccaacaggagacttggcatatcgaattgttctgtctttggatcaaatcaaacagtcacctctacgagactgggttagccacccggaagtccatttttggattggtcccagatcccacgctgttggctactccttaaaggcaggcaaaatgtataaccttgtattgcttgtaccagatgatctccctcctggcgtcacgaagcaacctggaaatgtcgaagaaatgaaactgctgttcgaaggctgggatcccgtgtatgcagagtttgacctgccactttgccttccaacattcatgactgactcaattcaaggctcactcaacttctag

SEQ ID NO: 4231 - DNA, 453 bp, A.fumigatus
  unsure (280): Identity of nucleotide sequences at the above locations are unknown.
cgccggtgtgggatgtcgaagaagctacacgcaactggtgagaaggccccaccggcggctgggggtgttagcgtcgcgttcaagcaggtcttcttctcctatccggcacggccagagtcgccagtcctgcacggcctggacctgagcattcaacgcgggcagttcgccgcgcttgtggggccaagcggcgctggcaagtccacgattgtctcgctcgtggagcgcctgtacgctcccacggcggagaccgttgcgatagacgggcatgacattgcatacngggatacctcgttccgctctgctattgcctatggtccgcagcaaagcgtcctgttcaatggcaccattccgattcaacctgacccctcggggcgagacccgggcaaacaggtcttccaagaaagaacctcagggaagcgttgcaaagccagccaacatcccagacacgaataa

SEQ ID NO: 4232 - DNA, 936 bp, A.fumigatus
gagcaaggaacacaccgggacattatggatgctcgtggcgagaatgccgagctcgttagtatgcagaatctcaacatcaacggtagcgaggagggtaatagtaccgccgcggcgagctccaaatgttccacggaagagatctccgagaaggccggggcccttgagacatcgaccgtcgctgatgtcccccatgctgatactcgggaaccagcagatgaagtggtggaaggggagcgaacgttctccgcgactgcacagtcgatgggtgccctgttgcgaccgtactccttcgtgctggtcatcgccactgttggagcaatcgttattggcggcacatactgtggatcggctctgatcttcgggaacgttgtcagcaagctcagttactgcgaagaacctggctccatccgtcatgcgggtgaattgtttgggctgctgtttttcatcctcgccatcgttgagttcactgccaatttttccagctggtcactctttggctgggttgccgagcaggttgtgtacaaggtgcgcgtcctcagtctgcggtccattctcgaacaggatctggcatggcatgaatctcaaggccggaacccatctctgctccttgggctgattaccaaggacagcaccgccctcggaggcctgacggggtctgtgatctgcacgctcctgtccatcttggtcagccttgtggcgactatcaccatgacgcacattattgcctggaagattgcgatagtatgtctctccgttgtccccctgctcctgggtgctggttacatgcgtgtcaccacgttagcccgctttgaagaggaacatctggaagcgttcgcaaactccaacgccatcaccgtcgaagccgtcaaatccatcaaaaacggtgatggcgcttttactggaacacgaaaaatcttggaccatacccgtcgttaa

SEQ ID NO: 4233 - DNA, 480 bp, A.fumigatus
cccgctttgaagaggaacatctggaagcgttcgcaaactccaacgccatcaccgtcgaagccgtcaaatccatcaaaaacggtgatggcgcttttactggaacacgaaaaatcttggaccatacccgtcgttaatttcaagaaaccgatgcgccaaatcacaaagcacagtgcctgggccaatctgtggctggcggttgggtacggtctgagtaacttcctctatgcgttggcctactggtggggatcaacgcgcattatggcaggcgaatacactccaacccagttcttcatcgtgcagctcgctctccttgttagctcccagctgtgggggcaggcgttcgccctcgcgcccgacgtgtcgcgcgcattcagtgccacccgacgtctactgaacatgctcgacatgggatcgacgaagaagctctcggcgcctctgacgccggtgtgggatgtcgaagaagctacacgcaactggtga

SEQ ID NO: 4234 - DNA, 870 bp, A.fumigatus
acaaagaaaattaaatgcgacgagacacctccatactgcaatcagtgcaccagacgggggtacgattgccccggatactcgcgtccgctcaaatggtcatcgaagtatgaggtggcaaacacagagctaggatccaaaagcaatgcaagacggaaacggctcgattgttcggacagtgatgataaagtacttcgactcgaggtgatgttatcgcacaacaaaagacagactgaaatgcagcgcgatgtctttgccgctgaagaacatacatcatatgcggcaggcaaggagcaaagctcaggagatacagtgcaatctcatttacaagaggatgatctagagccgaacttagctctaccaatattttccaatgttgagttcaatgacctccatttggacgtcacgtcgtcgttggagcatgaactagacgcgtcaacttcagttacgatgctgtggaacgattcattcacaccgactttaataacattcgaggatcgaaatacgagtctcttgaggcattatttctctgtgatatgtcacattaattgcgcttttgattccgaaaagaacccctttcgagtctgtgtctccgacatgatgaagggctgccccttgatttaccattgcgttctgtcaatgtctgctgcgcatttagccacgcaggtcttagaagtgagttcagaggctttggagcataggacgaaagctctatcctgtctgcaagcacagattgccaagatgggtaagggcaaaggccctagcgatgattacgcctcttctctcaacttgggagcgttgtttgggagcatcttactgggcatgacagatgttagactcgcaagggcatcgtacctattgaaccggagctaa

SEQ ID NO: 4235 - DNA, 234 bp, A.fumigatus
accgaaggccccctgggcttttacaagggccttagccaaaatcttctaaaattaacaccccccgtttcgatcaactaccttgtttttgagaacccaaacacaaagcttggaattgagataaccaccttaattccccggtccaaaaaaagcttttttcttttttgcttatcccttttaattttttcccttttggaaatttgtgtcagaatacccattaaaccccaattgccctaa

SEQ ID NO: 4236 - DNA, 450 bp, A.fumigatus
ctaacccgccttagccgaatgcaatgtgacaccgttgagggtggtttgaaaggcaatcaactcatcgcagctactgctcggaaagtgtggaacaaagcaggtttcctgggtttttttcgtggtttgcctctaggcctcgttggcatgtttccttatgccgccatcgatctgtcaacctttgaatatttgaaacgcgctctccttgcgcggcaagcccggattaaccactgccatgaggaagatgttcctctcaacaacttcacaacaggagcgatcggtgctctgagcggcgggttcagcgcttccgttgtttacccactaaatgtccttcgtaccagactacaggcccaaggcactgtactccaccccacaacatacaccggtatcactgatgttgcgccaaaaacacttctaaaccgaaggccccctgggcttttacaagggccttag

SEQ ID NO: 4237 - DNA, 1002 bp, A.fumigatus
acgagacatcgcccagatacgcatattcccacaattttgttcgatattgatgaagtgttcaccattcccccatccaaagtttactccacgtcgatggagcagaccgcaggggaggatcaaggcgttgttctatgcggattggttcgttatgggtctatctcggtgggagacgaactcttagttggaccgctccgggccaccccacaggccgagcccgagaactttttgtcagccccaagaagccaatcaagccgaagtagaccgccatccgaggagttttctacgtctttttcacagggatttctgtccggaaaagcaactttccccgctcaagcaatctggcaacgtgtgcgagtcgtcagtgttaggaacctgcggttaccggtgcgaactcttattcaagatcaggtcggcacaatcggtattgagctcctttcaactcaaaacgagcacactccgcgtttgggaaaggtacgaaagggagccgtcctagccgactttggacccagcggctcgcccgcaaaaccctcgcttttccacactggatttgttgctagcttccccgcgagcgagttcacgtccatgtctccgcctctactgttaggtggcaacgctattgcctatgtttccaatattcgggctactgtgaaggcgacttgtgttactcttgcagaggatgagattatatcttctccgccatcgcctacggagccggacttcttcagctttgacagtgatgctgttgatcgtgtgaaggaacatgtgtcagaagtgactaatgtggtcaactcggctaagaatgcaagtcacggagacgtgaaaatctcattctcctttgttacgtcggtcgaatgggttgaatccggttctcgtgtgcttgtcatacctgggtcttctacagtgttgtcctctacacaaggctccgcaccaccttttggtcttgggggctttgtcggtagagtctgcaatgtcatgtcttcggaactacaggagagtagatga

SEQ ID NO: 4238 - DNA, 408 bp, A.fumigatus
gagccgttgaaactgcctctcatgtcgtcgggatctgcgtttcaacctccgatagagattccaactcgaaagagctccgccggtatggccgaccgtctgcatacaagctcatctgtgatggatggaagccagttgcaaggtgaggggcctcagaccaacatggactcttccagaagacatacgcggaaccgatccagcttcgatggcaccaaatatcgtgatgggaaatggtcgcaggagtacgagaagatcctgatgggcccgtatgactacatgcagcaacatcccggcaaggatatccggcggcagctcatcaccgctttcaatgtctggcttcaagtccgtccggagagcctctcaatcatcaccaaagtcgtggggatgcttcacaccgcttcgttgctgtaa

SEQ ID NO: 4239 - DNA, 798 bp, A.fumigatus
tttacgtttcctgccagggtcgatgatgtggaagacaactccatcctccgccgcggcattcccgtcgctcacaacattttcggtactgcgcaaaccatcaactctgccaattacgtatactttctggctcttcaagaagttcaaaaattgaataacccgactgctattgatatcttcgttcaggaattattgagcctgcatcggggtcaggggatggatctgttctggcgagacaccctcacctgtcctacagaagaggactatctggacatggtggggaacaaaacgggcggtctcttccggctcgcaatcaagctgatgcaagccgagagcaccaccggcatagactgcgtgagcctcgtcaacgtcatgggcctgatctttcagatctgcgatgactatctcaacctttccaacaagacttacacccagaacaagggtctatgtgaagatctgacggagggcaaattttcgttccctattatccacagtatccggtccaacccacggaaccatcagcttatcagtattctcaaacagcgaaccaaggacgaggaggtcaagctgtatgcgattagttacatggaaagtaccggcagttttgcctacacgaggaaagtggttcgggaattccgtgacaaggcgttatctctcatcgacgagattgacgcacagtgtgatgggaaacaggccgaggggcagaaggatggggcgatggtgcgggcgattctcgacaagatcaccgagtcgactttgcgggatgataatggcgctgatgatgctggtggcggcaaatga

SEQ ID NO: 4240 - DNA, 348 bp, A.fumigatus
gggggggaagatataaagcgcctgtccagcggactgcgactcccatcatcaaccaagtctctcaattcatctactctggtagcattgactttttttcccctctcagttctgcgaactatactgcttatccttttccaaatcagcatgtatcaaaagagccttctcttctccctgctcgccagcagcgccctggccgcccagttccccatccccgactccaaaggcagcgtgacctttgacgagccctacgaaatcgccgccggcgagacctacgacggtggctacaagacctacggccgtggtgtctcctgcaccgtcttcaccacggggctggaaggagccgcgcca

SEQ ID NO: 4241 - DNA, 417 bp, A.fumigatus
actggccctgtccggcagtcattgacctcggtagactactatacctggacgagagatgctgctctcgtcacgaaagtcctggtcgacctcttccgcaacggcaacctgggtctgcagaaagtcattaccgaatacgtcaactctcaggcgtacttgcagaccgtgtctaatccgtcgggtggtcttgcgagcggaggtctcgcggagcctaagtacaacgtcgacatgacggcctttaccggagcctggggtcgtcctcagcgtgatggtccggctctgcgggccaccgccctcatcgactttggcaactggctgattgtatgttctccatacgagccccaggaagcgttgctgacgtctacaggacaacggctagtcttcaccacggggctggaaggatgcgcgaccagcgaattc

SEQ ID NO: 4242 - DNA, 498 bp, A.fumigatus
gaatgctacgaagatagtccagcagagcataccaaaaattcactcaccgggaatacattcgagacacacgacgacgacggcgacaagacatgggcagtcaacatctataagaagagggatcacacccccaagttgccccttgcgtcaggattcagaacgatcaatctcattccgtccccttcttcctcctttcgtctcctcctgtgtttgcaaaccgtctgtaaccgagctatgcctcgcctttcctacgcgctctgtgcgctgtctctcgggcatgctgctattgcagctcctcagttatccgctcgtgctaccggcagcttggactcctggttgggtactgagaccaccgttgcgctcaatggtattctggccaacatcggtgccgacggtgcttatgcgaagagcgctaagcctggcataatcattgccagtccgagcaccagcgaaccagactgtgagaaccttcctgaactggccctgtccggcagtcattga

SEQ ID NO: 4243 - DNA, 315 bp, A.fumigatus
cgacaccccaacaccctggaagatggcacaacatcaggtgctcttacgaggtattttatatcttcgaccttgccccctgcttcggacatttcggttcactttcacagctcaccatacactatatcctcattgttcaaccaacacttcatgatggccactgacattgctacaagggagcttcgcaagcctgttgatgttgctgagtatctatttcggcgtctccatgaggttggaattcgctcagtgcatggtgtacctggtgagcgatcgtcttcaccacggggcggaaggatccgcggtagtggcaactcaatg

SEQ ID NO: 4244 - DNA, 240 bp, A.fumigatus
tttagcggtatcttcggctacatcaattaccttgtcgagagagatcgtaaatacatcattgatacgttgctcaatggtatgggtttccctccatttgctctaatagcaatcttacagtatgaaatgcaggactctccagacttgaataccgcggttacgactcggcaggctttgcggtggacggtgacaaaaagaatgaagtttgcgccttcaaggaagttggtaaggtcgcgaaactga

SEQ ID NO: 4245 - DNA, 243 bp, A.fumigatus
aatgcaggactctccagacttgaataccgcggttacgactcggcaggctttgcggtggacggtgacaaaaagaatgaagtttgcgccttcaaggaagttggtaaggtcgcgaaactgaaggagcttattgaggaatccaagcccgatatgacgaagactttcgagtcccatgctggtattgctcacacgcgctgggctactcatggaacaccctctcgccagaattgccaccctcaccggtaa

SEQ ID NO: 4246 - DNA, 774 bp, A.fumigatus
gtgcatcagtggtctcagcaagtcatttggcattcgacgggcaactataattctgataccttcactgaactaacgcacattttgtccgacaggtctgatccaaactgggaattcgcagttgttcacaacggcatcattacgaactacaaggaacttaaagctctgctagagagcaaggggttccggtttgagactgaaactgacacggagtgtattgcgaagcttgcgaaatacttgtacgaccagcagcccgatattgagttcacagttctcgccaaggctgttgtgaaagagctcgcgggtgcttttggtcttctcatcaagtctgtccattaccctcatgaggtaattgcggctcgcaagggttctccgctcgtcatcggcgtgaggacgtcaaagaagatgaaggtggacttcgtcgacgtggagtattcggaagatggacctcttcccgctgagcaggcttctcagaacgtagctatcaagaagtccgctaccgggcttctggctccacctgataaatcccttctgcaccggtcgcagtcgcgtgcgtttctttcagatgatggcatcccccagccagcagagtttttcctttcttctgatccctctgcgatcgttgagcacacgaagaaagttctttatctcgaagacgacgatatcgcccatgtccatgaaggccaactgaatatccaccgtctcacaaaggatgatggtacctcgaacgtgcgcgctatccaaacaattgagctggagcttcaggaaatcatgtaa

SEQ ID NO: 4247 - DNA, 285 bp, A.fumigatus
  unsure (271): Identity of nucleotide sequences at the above locations are unknown.
ggcaaatttgatcatttcatgcagaaggaaatcttcgaacaacccgagtcagtcgtcaataccatgagaggtcgattggatgttgcaaacaagcaagtcacacttgggggactccggcagtatatttccaccattcgtcgctgcaggcggatcattttcattgcttgtggaaacagctatcattcatgtatgggcgtacgtggtgtctttgaagagctcactgaaatccccatatcagttgaacttgcctcggacttcttgggacgggcanggcgctggttttcg

SEQ ID NO: 4248 - DNA, 297 bp, A.fumigatus
accttcactattgtgtcagcttttcatctgtacgcaacccaagacacccttgaaaagcgtgcgatgcagaacccaatgactttcgatgaaggtaccaagtgtctcaagtccttcagagacggaatggtgaggtactatcaagagctgggtgatctcctcaccctggacagcttcaaggtcgtctttgatccgggtacgtatacaaccaccactttcaagaatatgaatggattcacagggtggcctcttaccagagtagaggcccaaacgaattccaggtttttacccgccaaataa

SEQ ID NO: 4249 - DNA, 1434 bp, A.fumigatus
tgtggcgcggctccttccagccccgtggtgaagaccggcgagatgagcaagcctacttccaaccttcctcccttcgcttcctcgtcgacggaacaatcagctgctgttaccgaattagcgccacttattcaagagctcaaagctatctgcgataattgcgacaagcagacgtttgcctcgcagcaatttcttaccgcgactgaatctttgctacgcctgcgtcataccttccttgataatgatcgtccaagagaagcccaggaggcctttcgacatcttaatggcttcgagacgttactgcagctcgtgaagaagctctcgcatttgtacgagccgacagagttatccgccgaagagagaagatctctcttgaccctctataaagatgctctagccgtcctggctgagagcttgaaggggaatttcgggaatagacgttattttgcgagacggatatctggcggaggtacagcagctctgcaggaagcactggacataatagtcccgaaattgagcagcgctcagggtgacacggaacaattttatggtggcatcctggccgcggctctctgtcaggaagcggttgctgatatctttaccacactcaacgcgaagtttcagccagtccaggaattgcttcagcaggatgttaaggcggaagttgatcgacgcatggggagctcggagaccgtcgaggtgccggaacttttggggccgtttctgaaagggtggttgaagcaatcggggtcttctccttccgactacagagttcagaggctagttttgcccgcctgtctgtgtcagttggctcaccagtctcaaagaaatctgacagcgctacacgccactgggatattaagctcaatactgcctattctgctcggaagtgaccgcctagaatcagagagaataatttaccaggacatggctcaacttctttgtgctcaaggattaactagtctggaggatgcggctaccttgtatcgacaagcccatggttgtgcaagaatactacgatttcttgtcgatgttctgaagtgttccaaagaaccgccattgatacagttcgacctgtcactccatgggtattcctccttggagttttcgaccctgggtcgaccatttcctcccgttacttcctcaggttatactattgcagtgtgggcccgatttgatagattcgatccaagtacacacactacaatatttggcgcctttgacgcgagtcaatcatgttttttactggtgtatctcgaaagggacactcgcaactttattttacaaacttcaatcagaggaactcgtcctagtgttcgattcaagtcgatggctttcgaaccgaaccgttggtatcacatatgtgtggtgcataaaaagcctaggccaccatcgcattcccgggcttctttgttcattgacggcgaatttgtcgag

SEQ ID NO: 4250 - DNA, 360 bp, A.fumigatus
aattctcatctgggtgagtcgctgttgctaatatctcctttaggtgccatcaaggtgatcaagggccagggtatgccctcttaccgccaccacgactttggtaacctgtacattcaattcgatgtcaagttccctgagaaggatcagctccagaacctcggtctcctggagagggtgctgccacctcgtatggagcagcctcagcctccggctgattcgatggttgaagatttcgaactggaggacatcgacgccagcgaaggctctcaaagacgcgctcacggcgccgccaccgccatggacgaggacgacgatgatgttcctcctggtgcagagcgtgtgcagtgtgcttcgcagtaa

SEQ ID NO: 4251 - DNA, 597 bp, A.fumigatus
gaagaatttctaggaagtgtatcaatgtgcgggccctttgggatatttccaggggtcttacttaagatcccttgcgagccagatagtagaaaattaactgtaggcaagctttcagatgacattataccagctattaagaatatctctaagaagcacggggtggtaacctctaggtctatattcctccactggttctacatcatcatagatgcgctcaaatcattgttggcgggccattgtcaaggacaaattcccaggatggaaagcatcagatgtgaagttcaaaagttgaaaactcgcagccagtcctgtttcactcgccaaggagcgcgtgatggaggttacccaactaaatataatatgtatttgtatttaatcgaccgcgctagccaacctatcttgcatgctttatgtcatgtatttctgattgaagaccagcattacagcaaccaccctgactttagttcgctctctccactatcttactctgccaactccatgagccgtaatggtcgcgtgtacggcgctgccgcctcgacctgtatcaggtcagggataagaagtgctgtgagaatagacagcctgttcgttagttaa

SEQ ID NO: 4252 - DNA, 186 bp, A.fumigatus
agacccaatgttgatttggaattgtttccctccaaagtgatcaagaacaagcgagtatataaactcaactataagctcagagtcacctttggcgcgcgtgagggtgtgctcaagttcgaagccgttagccagggccagactgttggtcagacaagcatcaattttagtgcagccaagtactattga

SEQ ID NO: 4253 - DNA, 273 bp, A.fumigatus
aaccagtggaggaatatagacctagaggttaccaccccgtgcttcttagagatattcttaatagctggtataatgtcatctgaaagcttgcctacagttaattttctactatctggctcgcaagggatcttaagtaagacccctggaaatatcccaaagggcccgcacattgatacacttcctagaaattcttcttatgttgctgtgaagattctaaaggctaaagcttctatttcagagggccctatagaactaagtatgttgatgtcttaa

SEQ ID NO: 4254 - DNA, 276 bp, A.fumigatus
ctctcccgcagcgcgtgtccttctagccccgtcggtttaagacagtgtgccccagaactcgaactggagttcggcttctccgccctcatggatatcaacaacagaggtttgacctctgctaattctaacgctcggcatctcatgaatggtttttgttatgttcttgtgtgccttgcattttccactggcaccgtcgcttactgcggtaatggtgaatatacccggtctttccgcgatgcgtcggaaattagttgtacgggaggtggccttccttga

SEQ ID NO: 4255 - DNA, 1281 bp, A.fumigatus
  unsure (158): Identity of nucleotide sequences at the above locations are unknown.
ggttgggccaattggataagaaaccgaactgtgtcagccttgcaaggtgcaaaggttgatattccgctaagactaagcggtgaccgaccatggccgttcactacaagaaatctagacgatgactcccctgctatgaagaagacgttctggcaggaaancagtgtctgtcaagtgacgcagaaaggacactataatctcattggcgtgacggacagctcttgccctgggtctgttgaccaagcagctagggatttcgaagtttcttggatacctcggccccatattgctgctgtagacggctcccctgtggtaattggaagccccatcgagaagcgcgacgtttgtcaaggtgaagacgatagtgtggaacttcgcctgaccggcaatccgccatataccattcaatgcgaacaacaacgcaaaatgggccgtggcacgtcctctattcgaacaagaagtcttaagacggcccttcatgtaacatctatggaaatggacacgtctgaagccgggttatacacgtacaaattcaaggaagtcggcgacagcctttacgactatgacccaagaagtgagcctgtgcttgtgacgcaaagagtgaacccattgccatctgcgcggtttaactctcctggccacatttacgggttctgcaaagaggatgtcagtggcgaagaatccatccctgttactttggagggcgttgcgccgttcttcctggaaatcattatcaaacaccattcgaacgccaaaccagaggttgtgtcaatacccaacatcagctccaatcgatacaatctacctattccgcgtcgttatttgaatctgggccaacacgtcgtgagcattcacaaggttcgagatgcgcgaggttgtcagcgaactttcgagaacgatgcctcaacagtcagagttgccgtatccgatgtgccgacaatcattccgctcgaatccaagattgactattgcgttggggagcgcctgtctttctccctgtccggccatgccccgttcgacgtgttttacacgtttgatggggtttcaaggaaggccacctcccgtacaactaatttccgacgcatcgcggaaagaccgggtatattcaccattaccgcagtaagcgacggtgccagtggaaaatgcaaggcacacaagaacataacaaaaaccattcatgagatgccgagcgttagaattagcagaggtcaaacctctgttgttgatatccatgagggcggagaagccgaactccagttcgagttctggggcacactgtcttaa

SEQ ID NO: 4256 - DNA, 1416 bp, A.fumigatus
gggggtaattgtgcggattcgggcctcctcgtgagagaagacgcttctttcctcatggccgcttccctgaagacgagaggccgccgccgcgtgatagactcgtttgctcgaggcgatatatgggcaagcagaccgccagttgagggcgtcatcgacaatctagacgatttcttccctgatatcgaccttgacgcaccttaccttgatggacaaggggtatctcctccgtcatcccccgcaaacagggccccgcctgagaatgatttgcacaagaaggaaaaccagcccagctcatcttacaccggagagatgaatgccaacgcaggagatacgctgggctctaacgagccaactctcaaaccacaaggtggagatgttgtagctcgtcgtaacatcaaccggtcaggagggggacttactcgaggaaagtcaatccgagaggtcgccaagggcgccaaccaagctagccgaagtcgcagcatccatactggaaaccagaagtccggtgagattcttcggcgtaagagcaccaaaatgttcggagcaaagattatgcaaatcaagccaaagcctggcagtcgtctcagccaactcgacccgattcctcagaacaacacaccatcgggggtacctcagcgacagcctactttccgcattatccgcggccagctgattggcaaggggacatacggaagagtctacctgggcatcaatgctgacaatggtgaagtcttggccgtaaaacaagttgagatcaacccaagacttgctgggcaagatacagaccgggttaaggagatggtcgccgctatggatcaagaaatcgacacgatgcagcaccttgaacacccgaacatagtgcaatatcttggatgtgagcgcggcgaattctccatttcaatctatcttgaatatatttcaggtggttccattggtagctgcctccggaagcatggtaaattcgaggagagtgttgtcaaatccctgactcgtcaaaccttgagcgggctagcataccttcatgaccagggaatattgcatcgtgacttgaaggcggacaacatccttctcgatctcgacggcacctgcaagatttctgacttcggtatatcgaagaagacggatgacatctacgggaacgactcgtcgaactcaatgcaagggtccgttttctggatggcacctgaggtcatacagtcacagggtcaaggctacagcgccaaggtcgatatctggtctctgggctgtgtggtactcgagatgtttgctgggcgccggccatggagcaaagaagaggcgatcggtgccatttttaagcttggaagcttgagtcaagcacctccgattccagacgacgtttccatgaccatcagtcctgcagcgctggcgtttatgtatgactgtttcactgtgtaa

SEQ ID NO: 4257 - DNA, 1101 bp, A.fumigatus
tttactatttcaagcatatcctcctcgttgagaagggattgcttcctctggccactcaccatcgttttatcagctttacgctttatgttatgggtaagttttgatcacttactctacaagaccggacctgccactgacactgtccactttttaggattcgtcttctttgtctcatcgctgcaaaaaggtcactaccgttttcaattcacccagtttgcgtggacacacatggcactgtacctgatcgtcgtccaagcgcactttgtcatgaacaatgtcttcgagggcatgatctggttcttcctcccagcctccctcgtcattacaaacgacatcttcgcctacgtgtgtggtatcacttttggtcgcactcagctgatccagttgtcacccaagaagactgtggaggggtttctcggtgcatggatttgcaccattattttcggttattttatgaccaacatcctgatgcgctacaagtactttatctgcccggtcaacgacttgggatctaacgtcctgaccggactgcaatgcaaccccaaccctgtctttgtgcctcagccctattctctcccagaatggactggcctgtccaagaccttctatgttgagcctatgcagttccacatcctggtgtttgccacctttgcctctctcattgcgccttttggtggtttcttcgcatcgggcctcaagcgcaccttcaagatcaaggacttcggtgaatccattcctggccacggtggtatcaccgaccgcatggactgccagttcatcatgggcttcttctcctacatgtactaccacagcttcattgcagtatacaaggccagtgtgggggatatcatcgaggctgccatcaacggcctcacagtggaggagcagttcgaagtggttcgcggtttgggcaaatacctctacaaccagggaaccgtttccgagacggtatgctcaattgatttttttttttttttttttttttggcacgaaaggaccacctgctcacagatcatacagatactggattgccttaacggcgagttgaaacgccgtgaaatgatcgctatgacatctccttttcctgcccggggcccttga

SEQ ID NO: 4258 - DNA, 465 bp, A.fumigatus
tccgggaggaggggggcccaccagggcagtcggaatcagttgaatcatttggcaatagggaggctgatatactcggccagaaacaggaacagcctcaatgtcccgaatatgagagagaagaagcagacattcatcactcggacaatatggacgtttgtgatgattttcctcttcttcattgccatgttttcgggccacatttacatcatcggcatcgtcacggcagtccagatcatttcgtttaaggaagtcattgccattgcgaatgtacccagcagggagaagaacatccgctttaccaagtcgctcaactggtatttcctggcaaccaccatgtactttttgtatggagaaagcgtgatttactatttcaagcatatcctcctcgttgagaagggattgcttcctctggccactcaccatcgttttatcagctttacgctttatgttatgggtaagttttga

SEQ ID NO: 4259 - DNA, 1449 bp, A.fumigatus
ggcgaatccttactctacgcaatcatgtcttcctcaatgcgctcatcccgtcagaggatatcgagcttgtcccgtcctattcgcactagtcgtacccgagtgcaatcatatcttgaagatagtagttcagatgatcgactggatgaagacacagactctgatcaggaacgatctagacgaatgtcgctttcgctgcgtccacgcagttcaaacagagcccccgtttcttatcgcgaggaatctacagatgatgactttgagcgatcttctaacgaggaccattcagcggtcgcacccgttgaagctcccactcgatacacctatccgtttccccaatctgctggtaatggcacatcttcccggcccaaacgcaatcgtacggtcaaaaccaggtcccagactagcaagtccaaaaggccccctgccaagaaccgcctggaattgggtaggcctctcaacaagcgtccaaaagttcaggcagatgacatgctcccaatcggctctggagtcatcccaccctggcacacccttccgtaccacatattgtttgacatcttctttcgggcatcgtttccattgatggatgagaagacaacaaccagaaacagttcgacgcaatggcttgtgagtgttgccttgttgtgtcgcgcttttcatgagccagcattgtcagccctctaccattctccgcctctgatacctatcaaatgccatgctctgctcaacctgctatgtcagccacaggagacactttcaaccaattatagaaataagatacaagagttgcacatcgacgtggagaccctgttgctccacaaaagcggaccaacgctcggttattttgatcttcctaagcttatcgaaaagacacctcaagtaaagaaagtgcggctgtatcacaaagatgacttcattgtgggtctcgcaccatggcagatacaacgatctaaatgggtctatccggagagtctattcgaatcgatcaatacgagcttgatacacctgcgcagctgggattggaacagccggtttatggaagcgaagcaactcattcccttcctcctcggcaaacatcatgaccaggcgttccggggcttgcgcgagttacgactgttgcatgtcgcttcagaagatattgatcacgatggaagtgcagagccatccaacgagcgggaagtgattctcgctaccgcgattaaggagctcccatatctgcgtcgtctggaattttccgagtgctcgattgtcaacgagcatcttctcctcaatatgccctcggcacttacgtccctcactatcaacaactgcgatgaagtgaccacctcgaacctcagtgcatttctcgctgctcatgggcagcatctccgggaactcaaccttaatcacaacaggcatttaagtatgtcattcgttgtaggttttcaccacggcctggggcatccgagttcg

SEQ ID NO: 4260 - DNA, 798 bp, A.fumigatus
aattggacgattagttacgttaaccgctctgagacctcacgcttacagggcagccagagcgaggcagacggcaacgacagcgccgcagatggagcccgagagaccgctggcagcgttgctcaggatgttggaagtcgaaggagcagaggagctgccggtagaggaagaggactggccggaggcaccggaggcaccagagcccgaagagcccgaagagccggaagagccagcagcggagccagaagaggagccggagatggcgctgctagagggacgggccgacgaggtggagttccagaagccggtgccgttgtaggagccgccgggtcctttgccgacggtgaaggtgggcttagcagagttagcggcagcggtagtgaaaccagaagccttgccgccgatcacggacgaggccgaggggccagcggtggaggacgcggcggcggaggaagaagaagaagcagagcaggagaggtcaaagagaggggtggtgctcagagtgctgccgacgataccgaagctggggttgggggtcaccgggtcggcatcctggaggatgtaccaccaggtgttggtcttgccgaacagggggcatcccacctcgtcccagtaggtcttggcgttggccaggttggcgacggcgagattctcggtcttgccgctgacgggccagccagtctcggtaatccagacctccttgcccttggcaacagcctgggtcttggccacagattcatcgaagagagccttggcatcggagatggagtcttcaccacggggcggaaggcgcgcagttaa

SEQ ID NO: 4261 - DNA, 762 bp, A.fumigatus
ctgggtttaactgcgcgccttccgccccgtggtgaagactccatctccgatgccaaggctctcttcgatgaatctgtggccaagacccaggctgttgccaagggcaaggaggtctggattaccgagactggctggcccgtcagcggcaagaccgagaatctcgccgtcgccaacctggccaacgccaagacctactgggacgaggtgggatgccccctgttcggcaagaccaacacctggtggtacatcctccaggatgccgacccggtgacccccaaccccagcttcggtatcgtcggcagcactctgagcaccacccctctctttgacctctcctgctctgcttcttcttcttcctccgccgccgcgtcctccaccgctggcccctcggcctcgtccgtgatcggcggcaaggcttctggtttcactaccgctgccgctaactctgctaagcccaccttcaccgtcggcaaaggacccggcggctcctacaacggcaccggcttctggaactccacctcgtcggcccgtccctctagcagcgccatctccggctcctcttctggctccgctgctggctcttccggctcttcgggctcttcgggctctggtgcctccggtgcctccggccagtcctcttcctctaccggcagctcctctgctccttcgacttccaacatcctgagcaacgctgccagcggtctctcgggctccatctgcggcgctgtcgttgccgtctgcctcgctctggctgccctgtaa

SEQ ID NO: 4262 - DNA, 252 bp, A.fumigatus
tatcgagatgctctcctgtcccccacgctgacagcattgccctttgtgtccccgcgaacccactccctcaggatactgatttgggcgaaagcctcacgtcggggaggcatcccggcactgaccctgacgaccaatacccctgagccccaactcactgaccccttgccgacagaaaccatggctcactatcctcagcatatctcggctcgggccggaggtggttataagtattatagcatcaaccatttctga

SEQ ID NO: 4263 - DNA, 339 bp, A.fumigatus
gacaaagtgacgtgcctgggttttgagtctctgctaacggaaattcccaacccccttgaaataggctatgacttttggcatacagctcccctaccacggttcaacgttccctcggtcagagtcagcgatggtcccaacggcgttcgaggaaccaagttcttcgacggcgtccgcgccgcctgtcttccttgtggcaccggcctcgccgccacgtgggatcagtctttgctttacgatgctggggtgctcatcggccaagagtgcctagccaaaggtgctcactgctggctagtaccacagtgtgtatccaacggtcgccccttgggggcaaagggttga

SEQ ID NO: 4264 - DNA, 231 bp, A.fumigatus
gtccgatttatacggtattgccatctagaagaacaggcagtggggatgagggcacatgcgggggagaaggccgttgcgccctcggtgaacagcaacaacgatgagagcaacatgcgcacaccagaacagcagccagaagagaaaaacctagaagagccaaccttcgacacaggtgccctggcatggctgcaggtccttggatcattcttcctattcttcaactcctggtag

SEQ ID NO: 4265 - DNA, 1146 bp, A.fumigatus
tcgctacgtcgtcttaggggtgtgatcaatacatggggcgctttccagactttctatgaacaaaatcttctctcgaatgtttcgtcatcatccattgcctggattggatctctgcaatcgtttcttctgatgctctttggagtagtgaccggcccgttgttcgatgcaggatactttcgagctctcgtcatatttggcaccttcgtgctcccatttggcttgatgatggccaatatttcttcacagtattggcacttgatcctcggtcaaagaatctgtatcggcctggctgctggatgcctgttcgttccctcggttgctattctgcctcagtacttcaagcagaagcgaggtttagccaacggactggcggcgtcaggcagcagtattgggggcgtggtctatccgataatgttcaataagctacaggaccaaattgggtttgcgtgggcgactcgcgcactgggcttcgtagctttcggaacctgctgtgtctccctatctctcatgcgcatgcgatttctgcctaccgagaaacgcaagttggtccagctgtctgcctttaaagacccagcattcgtgatgtttgccgttgccatgtttctgggcttcctgggcttctataacttcctattttacgtgcagtcctatgccatcgacaccggaatcgtcgatgcaaatctggggttctatctgctctccatgctcaatgcgggctctaccgtggggcgaatctttcccaacttcgttgctgatcacaccggcccacttaacatgctgacgccagctgtcacagttacggcagttctggcctttgcctggattggtgtgcacaatgtgcccggcatcattgttctctccgtcctgtacggtctcttctccggtgggtttgtctcactcccgccggtagtcatggtcacgttgacgaaagatatccgcgacctgggtactcgtctgggcatgatttttgccacgacctcaatcggcttgctgatcggaacaccaattggtggagctatcttgagtaatacccataattatctcggggttcagctctttaccgcttgctgcatcatcactgctgccgccatttttgcagccctgcgattctcacgcactgggccccggttacttgtcagagcatga

SEQ ID NO: 4266 - DNA, 228 bp, A.fumigatus
cttagcggcggagcttggcccccctgtggtagaagaccagccagttcttttgcttgggtgactccaatatttgaactttactgtgttgctagccccaatgccaatcgcaatgcacttgcacagagtgcaagtaaggttgtccagtgggtacaacgggaggaagaacggttgttcataattggtggagctgtaggtcattcccaagagggacctttggccggatactga

SEQ ID NO: 4267 - DNA, 249 bp, A.fumigatus
gtgctgttcctagaccagcgcggtacaggcatgagctcgacgataacggctcgaactctcgcccttcaaggcaatgcagtaaaacaggctgagtacctgaagcaattccgtgcggataatattgtccgtgactgcgaagctatccgtcggtgccttactacggactaccccgaggaccaacgcaaatggagcatcatcggccaaagtttcggtgggttctgtgctgtaacgtatctttctatgttgtaa

SEQ ID NO: 4268 - DNA, 312 bp, A.fumigatus
atctataaggacatgtttgagtcatacaccgaattgcagcaagtcaaagacgttgcaaacatccttgctacgacggccgagtggccccagctttatgatgaggctcgactggcggacaacgaagtccccgtctatgcagccacctacgtagaggacatgtatgtccactttgacctggcgtcgaagaccgcggcaaagatcaagggtatcaagcaattcatcacaaatgttatgtatcacaacgccatccgaagcaaagcagacgaggtcatgcagcagctctttgccctacgagacgacacgatcgactag

SEQ ID NO: 4269 - DNA, 375 bp, A.fumigatus
tccttcgacccccggctggtgaagacggtttatcaacatcggtcgggtctttgtcgattgctgcgatctattcctatgtcaggacaacggaatgttccaatgtttgatacaccatcggatttaccttgttggagattgccacatttaccctcgtcccttcgtcataaaggtctgcctgctgctgtctgcctccgagaaatttatcaaccggcactatattacgcacctgcgttagcttgctcgggatctcttgtggtcacgaattatcatactccttttgacattgtcaatgtatacaccgtactgtgtgaaatcctccaaaaagttccagctctggcgaagtgcgtcaaattccataatgctgcgcattactaa

SEQ ID NO: 4270 - DNA, 309 bp, A.fumigatus
gttaccagtctatcaccatgtcttattctgcaatctaagtctatatttagcgccaaagttgctttcacgatgtatggggttactggtgaagtgaccgaggaagtcaaacatgctgtctcgtcaatccagaagaactcccgaatcacaatctggatccacatctctggggggggaaccaaactaggtgaaaccaagcggatcgactcgggacctgacgatgaagattcaccgctctttaaaattaagaaggaagctgataatttctatcaagagttgaaagatgggaagcttaaatacagacgtttgtaa

SEQ ID NO: 4271 - DNA, 1020 bp, A.fumigatus
  unsure (997),(1009),(1014): Identity of nucleotide sequences at the above locations are unknown.
agacatgccaagtcattgattgagtccttctctcgcgagttgacgtcgaatttgttcgggaatccccattccttgtccacctcctcacagctgtccacgcagcgtgtggatgatgttcgtcttcgagcccttcgcttcttcaaagcagacccggaagaatttgatcttgtatttgtggcgaatgccacagcggcgatcaagctggttgcggatggaatgagggattcaacacggcagggattctggtatgggtaccacgtggacgctcatacgagtcttgttggtgtacgagagctcgcggagaaggggggtcggtgcttcacctctgatgacgaggtcgaagattggatctcaaggttgtgtgatgtccgatctgagtcgctcaaattgtttgcgtatcccgcgcagtcgaatatgaacggtcgccgtctgccattttcatggtgcaagaagatcagagatcagggcgagactactggcgggaacgtttatacgctcctcgacgcggcgtctttggtttcgacctcgcctcttgatttgagcgatgcatccgctgcaccggactttacggtcctaagtttctataagatcttcggttttccagaccttggcgcgttgattgtccgcaagagtgctggacagatctttgagcaccgcaggtatttcggcggaggcactgtggatatggttctgacacgcgggctgcaatggcatgcaaaaaagcaatcttcgatacatgaccggcttgaggacggcactctcccgttccacaatatcattgcccttgactcggcgtttgcaactcatgagcgtctgttcggctcgatgcaaaatatctcgtctcatacccgctttctggcaaagcgcctgtatgaccgactaaacgccttgagacatttcaacgggcagagagtctgcgagctttataagtctccacggtcagactacgtcttcaccacggggctggaaggtccgaaggtgactctatttcaaaaanggttttcaaccngaaancctccc

SEQ ID NO: 4272 - DNA, 741 bp, A.fumigatus
aagctcaagctcatgctgggccagctcctcctaaacatctcccgtttggggccccatggggaccagatccgggaccaggaggtttatttgattggcatctacggctccaggctgcatatccttcgtgctttcttcctcggccagaaaacgtcccatctgtggagcggaagacacaaccgttcgtcctcagacgccgatgtgatagaccccaatccgagcactgtctacgatcgattctacactggaaagaacctggaacgacttcgccaacaggtggagtggctgagcgcgaagaatctggacaataacccaaatccacgtcattttcgagtcttaggcagccgcgaatttgacctctggtgcaagcaagattttcgagctgccgtcaagatgatcgtggctctgttcatctacatgatgagcgggcaggctcgttgcggtgttctgcagaaggtgttccaaaattaccctattgatgaagaatctgacgatgagttggaggaggtacatgacacccgcaaacgggtggcgattgaggaagagaagctagcaaagaaggagaaggagttggaagagaccgaaaggaagaagcgtgaggaggaacagaaaatgtccaaatcaaagggaaagaggcgaagttacatccatggtcgctttcaaggattcaaaggttggcgtaagccgtgcgaagactttgcgtggcagaaggagacagatagttcactggacgacgacttgtag

SEQ ID NO: 4273 - DNA, 597 bp, A.fumigatus
gagcctctggggccggtaaatcaacttgtgagataccacgaacctgctttcccactcatgtttagcgagttgctgacactactggaagtattgactgttctcacgcaaagacaagcatcagggacactgtctggaacaataagcgtggatggacgtcccgttgacgaatctttcaaacgcaatatcggatattgcccgcagatggatgttcatgacgagactagcactattcgagaagctcttgagttttcggccctgcttcgtcagcctgtaagcgtccggaaagaagataagctctcatatgtggacaccgtcttgcatacccttgaactagttgatttccagaacgccatcatcggatctttggatatcgagaagaaaaggcgggttactatcggagtggagctctgtgcgaaacctgagctcctgctcttcttagatgaacccaccagtggcctaggaagtcaaggcgcatcgagcattgtgtctcttctgcggcgcctggccgaccaaggattagctatcctttgcactatccatcaagcaaaccaagagcaattcgaacaagtaagcctcaacgagccatggcgcttgtga

SEQ ID NO: 4274 - DNA, 645 bp, A.fumigatus
  unsure (588): Identity of nucleotide sequences at the above locations are unknown.
tttgacaaagtcctggccctcagcccgggcggacgaacttactatttcggcgaaatcggaagatctggatgttgcatttttgattatttcaagaagtacggcgaccagcccaagaaaatcaccaacgcagcagactacttgattgaagtcgttgtcgggggcatgagggataccgaccacgaggtggactgggcagacatatggaatagatccgctgaagctgacgctctccaaaaggagatctccaacatccacagggcgaggtcgcaaaatactgaatcatgtgacagcacgaagcagactcattctatgccgcccctgtattgccagatcggccttttgacgcagcgcacgcttcggcagtactggcgaagccctgaatacccctattcgcggctttacgcatcgttcttccatgcattgattaacggattgacatatttgcaaaccggaaacagttctacagacctgcaatcgaaagcattctcatgttttctagttctgatgctggtgccggagttcatcaacgcaatttcgatgcgattcattttgaaacgtgatatcttggaatactcgggaaaggaccantggtgtgtattcctgggttgcgttttgcacggcgcacataatctccaaaataacgta

SEQ ID NO: 4275 - DNA, 606 bp, A.fumigatus
gcacaatctcatcgcgaattggaggaacttgtcaaaatgctttctgcagacaatcaacatactaaagcagcggcgttggccgtcttccaggacgaggctaaactggcatatcaggcgttgcgcagtcacacacccacccaggcgcataagctgcttgccatggctatcgcaggtgcggccaaaggcgataccgactcagattgggaagagacatgcgcggagatcgccaaggaactcactgacccctacgcacgagccatattggcgctcgtgagtaaaggagattggaagtctgttatccacgagtctacccttcccttgagataccggatcgaggtagctctacgttggcttcctgacgccgaactgtcaggctacttgaaggaaacaattgctgaagtcatccggcaaggcgacattgaaggtatagttctcacggggcttggccactctgccttggaccttttccaatcttacatcaataaattcaatgatgttcagacgccggttctagccatgagccacacagtcccacgcttcatcaggactggttggggccagggctcgattatgaagaatggcgtgagacctatcgctggcagatga

SEQ ID NO: 4276 - DNA, 618 bp, A.fumigatus
  unsure (195),(234): Identity of nucleotide sequences at the above locations are unknown.
tgttcagacgccggttctagccatgagccacacagtcccacgcttcatcaggactggttggggccagggctcgattatgaagaatggcgtgagacctatcgctggcagatgaactcatggaaactccaattagagagagcgcgattcgatgtcggctcgcgcaagttcgccgtcacctgggatggcgcaaaattngtcgagccgccccggcaacaagtcagcttgacttgtaantactgcactcgacatctcacccaacatgatgcatcctcccaattttctccatcggcttcaggggaaggcgtgcatcaaaccgctggcaatcccttgggtacagctgttatgtcaggaatggtttgcgccaggtgtggacggccgatgccccgctgtggagtttgcacgctctggatgggctccccagatccaatgtccagggcgtgtatcgccgccgatgctggtcaggagcagcgcaagcccacagaggccgacatcatgcgccgattcatcgtcttctgtattaattgcaatcatggtttccatgcacatcacgccagagaatggtttgcaaagcataaagtttgccccgtcgcagaatgcagctgcatttgtgatcgatga

SEQ ID NO: 4277 - DNA, 321 bp, A.fumigatus
ttggcggcgggtaggttctccgtcgtccagccctacacttataggatacacaagtgtctaaccactagtagtccaaccggcgacgcaacccttaccgaaccgaaaaacggcttcaacagcacacagctcgctagcctattcacaaagcgcagtgtacgggccacttctactgcggtctcccccagcactttagcaacttccatgttaatggcaatgtcaacgcgaccccgcgcagcagcaccctcattatcaggcagcaccatagctagagtaatcattagctctattactagtgcagccactattagtacactagccttt

SEQ ID NO: 4278 - DNA, 282 bp, A.fumigatus
  unsure (14): Identity of nucleotide sequences at the above locations are unknown.
actttgaaccctgntggaaacccggtcttgtatggcacccccggggctgatacgtacatgactccgggactgatcaccctagatatgaacacccttgagtggaccaacgcatccactaccgatatggacacttttggtaccattggcgatggctacatgagtcttatcgaatccgtgggtgaccagggccttatcgtggcattcggaggatatacgtatccagtcggggagaagatttcctttttggctgcgagacagaatgaaactactcatcgggtatag

SEQ ID NO: 4279 - DNA, 390 bp, A.fumigatus
gttgtccggatcctattatcaattacatgctcaagaactagctatgttttcggaggtatgggacaaacgaccgcggaatccgacggggacgtatacgtcctctccctaccctctttccaatggatccgagtctaccgagacaacactatccggtacaagcacaaatgccagctggtgcaaaagcataccatgctggttattggcggaattattcccatcgacgggatggagtactatccccagtcacgaaactgcgacactgcgaccttcgccaacggcataggcatattcgacctgcaaactctgtcctggagaacaaactataatgcaactgacgttgttggatatgcggttccatcccagatttcagacgtgattggcggcgggtag

SEQ ID NO: 4280 - DNA, 225 bp, A.fumigatus
  unsure (38),(64): Identity of nucleotide sequences at the above locations are unknown.
gcctttgataagatcccatctttcgacctttgtgcctncactgccactctccgtaacgatgtangtgcggccgggtttctggcaccctctctgccgtgcttctgcggtctcgatgacaactcctgcgataaaatcaccatttctagactgtttctgactgagaaaggcattgaacgagaagaaatctttgcgccgaggaagaaccaagggattcgacgcgtgaag

SEQ ID NO: 4281 - DNA, 297 bp, A.fumigatus
cgaaaatgccaccttagtaaggaccgtgtctacggactgccggccgagcttcgattccgggtcgtcattaccggacttggtgccaaggataatggtgtctcctttaatgctgctattctcccgttgggggtcctcaatgtattccaaatcctcggtctccagattatctatgtgggcgccttccgccgccgggagaagggttctagttgccagaaaagatgtaaagccctcgggcaaagaccatgccaccacagtgccggaagggaaaacgaatacatcgccaacttcatcggatga

SEQ ID NO: 4282 - DNA, 456 bp, A.fumigatus
gactctgttggccaattatttcgagtcaaccagaacaatacccacacttctatcacaaggctctcgcttaccctcacaaaagattcatcctttcgcaagaccggccaactgctgagtgtgcgagcccaattgaatctctattcggaactgacagactcattgccagatttattctgggatagccggcatgagctaggtctagagggctactacgaacaggtaggaagggcactggacgtgggtattcgcatcaaactcttaaacgagaaaatggactacgcacaggaaatagcaagcgtgcttcgagagagactgagcgagacacacggcctccggctcgaatggattatcatcctcctcattgccgttgaggtaggatttgaggttttaaggctttggaaagaacgcgctcatgagcttgaagccaaagctgaattaagctctgaaccttcgtga

SEQ ID NO: 4283 - DNA, 360 bp, A.fumigatus
aacaattctcggctctgcagtgagagtggaggcaaccgtcacgtcgtcttcactcctagtagttgtaccgccctccagagcttcgatgtcaacatgttgcagagtatacctggaccgcagcatattctgaaagctctgactggctctttgggactctcgactatatatgagccggatcatgaagcttcgcaaaactcattccaatgctctaaaccggagttgagctgtcacgcccagtaccatggccaggacacttgctgcttcaactatcccggagggcagatgctccagacgcaattttgggatgcggatcctgcggtcgggccagtcgactcctggactattcatggactctggtga

SEQ ID NO: 4284 - DNA, 630 bp, A.fumigatus
aaggcagtaacagcctatgctgtagcagaacaattcgatatccgcaaagtcagagatatcctccaagagaaaggtttcgagccggatccgtttcaaacaggcctgtttcctcaagtcgttcatatccaagttcccatagattcaattcgacgcgtcagtaatctcaccacgaccgatctgtcatccgatgaagttggcgatgtattcgttttcccttccggcactgtggtggcatggtctttgcccgagggctttacatcttttctggcaactagaacccttctcccggcggcggaaggcgcccacatagataatctggagaccgaggatttggaatacattgaggacccccaacgggagaatagcagcattaaaggagacaccattatccttggcaccaagtccggtaatgacgacccggaatcgaagctcggccggcagtccgtagacacggtccttactaaggtggcattttcgtcagggttggctcgaagtacgaaactggcagtgcttgagactctgttggccaattatttcgagtcaaccagaacaatacccacacttctatcacaaggctctcgcttaccctcacaaaagattcatcctttcgcaagaccggccaactgctga

SEQ ID NO: 4285 - DNA, 501 bp, A.fumigatus
gctgtcacgcccagtaccatggccaggacacttgctgcttcaactatcccggagggcagatgctccagacgcaattttgggatgcggatcctgcggtcgggccagtcgactcctggactattcatggactctggtgagctctacgtggtgctaccaaagctcctattgtcgcagacatgcatcgtactgaataagacactgatcaccgggcacccccctaggccggacttctgtgatggtggctttgatcaatactgtgattcaaagaggagatacagcaacatctccctgatcttggttgactcaggccgagctgacctactagagtatatgagtgatttttggaaagatttccgaggggacgatgaagatctctgggagcacgaatggaacaaacatggcacatgtattagcactctggagaccacctgctatgcggattattatccacagcaagaagtcgtagactacttcaacaaaacggtcgagatcttccagaaa

SEQ ID NO: 4286 - DNA, 279 bp, A.fumigatus
actgaccattgcacaggcatcatgcagatcgcagctctcgccgccactttcgccctggccctcgtccccagcgtgtctgcctggcgtgtgttcttttaccagctgaaggagggcgagggtccctctatcaccaatgctgggcctggaaatcccgggttcaggtgccatcccaacgtcgaccctctcaaccagaatatttcctcgatgaggtactactcggacaatccggagggtactatccgctgctgtcttacagtattccacagtcccggctgctaa

SEQ ID NO: 4287 - DNA, 222 bp, A.fumigatus
ttagcatctggattctgctatcgactagttggcatcacattcgatatggacacaacattgaaatggcactgggacacagtgcagttcgtgctgaattgcggcgaaagaacctgcagacgaattctatataaggcctctcctatcccgctcaaagttgacatccacaagccagctcaaccccgtcaagaatactccgacagaaacaagctaatcactcgataa

SEQ ID NO: 4288 - DNA, 429 bp, A.fumigatus
ggtactactcggacaatccggagggtactatccgctgctgtcttacagtattccacagtcccggctgctaaggctactttggatattcgtcctgtcggaactagttccccctactttgccgaaattggccatgaactctatgttatttctttcttaactgagttgttccttactcttcactccgcgtccgttctgctgatcatctgtcctctttacgattatgggtctaccattccctctcaatatatcttccctttcctttcctctttttcttctccccctatgttctttcctcctcttctctctcttcccctctctcccttctccattttctttcttctctcctcccctaatcatagttctttttctctcatccctataattcttctttcattccttatccttcatttttttttcctccttccccta

SEQ ID NO: 4289 - DNA, 255 bp, A.fumigatus
accgctttgtcgaactttgagctaactcatgcctcagccacatttaatgagaagttgctgctgggacaaggcttatccattacgcctttagatgagggcgcaggcaatggctctattggaccaaagagtctgtatgaggtggtacggcagattgataaccagaaggacttccaggattatattctcagctacgaatataatcctggtgctgtgacttcggaggaggttcagtaccagcgtcatccggtacgttaa

SEQ ID NO: 4290 - DNA, 600 bp, A.fumigatus
  unsure (42),(149): Identity of nucleotide sequences at the above locations are unknown.
ggaagttgtctcgctctttttaaagacggtgccagcggcccngacaatcgccaaggcacctacggttctagctacaatgatctcaatggattccacggacgcatggcggatcatggacttcaattggcagtatctctacagcagatggntgatgacctccacgagcttgccacgaatatcgagaagggacgcaaacagtggaaacaaaccggcctgagcgcggagaaaagagttactgaggccgaggcggcagcggagaaagcaaaggcgaagtacgaatctcttgcggagcagtatgaccgcgtgaaaaccggggacaaacagggcgggaagtttggcttgaagggacataaatctgctgcccaacatgaagaagagctgttgcgcaaagtgcaaaatgcggacggagattatgctgccaaggtcacggccgcacaagcggctcgacgagaactgatttccacccatcgtccgcaggctgtgcagaacatccagaaattgattgcagagtgcgactctggtcttacgttgcagctacaaaagttcggtatgatgtcactacgtcccgacattgaaccgctttgtcgaactttgagctaa

SEQ ID NO: 4291 - DNA, 675 bp, A.fumigatus
cttcggaggaggttcagtaccagcgtcatccggtacgttaatttgtatcgatcattattatccgcatgctcatttcgtgttagacactgggaggtacgccccacaccggttgctccggcctcgcagccttccacacagaacaagcgccagtcaatcatgtttccttcatcattttcccaacaacatcttcctgtcagtcagccctccactcagccatctggaccggctgcgactccgtctccgccaccagcgcccgctcaaagcacccagccatcgtctttccagccacatccagactcgttctcttcgccacccccattccaaccaccttatccaacttcttctgggttgccagctcctgatcagcacaatgtgaacacgctgcccatggcggcaccggctaatcccctgcctccacctggaaacaacttccaacagaatctccctcctctgaggccggtcttcggggtgtcattagaagatctatacgccagagatgggactgccgtacccatgattgtttaccaatgtctccaggcaatagaattgttcggattagatgtggaaggcatttaccgtctctctgggagcgcaaatcacatcaaccatatgaagtcgcttttcgacaacggtatgtgtaaccacagtttaacccgtttctctagcaatcgctga

SEQ ID NO: 4292 - DNA, 210 bp, A.fumigatus
cctctatggatggcagactcttcacaagtggactttacgaatcccgagaacttctatcacgatgttaatagtgtcgccgggctgctgaaacagttctttagagaactgcctgatcccttgtttacttcccgatactattctgatttcattaatgcagctcgtaagtacattgattcgaacccggggtgccatatgacaagagctgagtag

SEQ ID NO: 4293 - DNA, 207 bp, A.fumigatus
ctgacacgtatttccgtagggatcgatgatgacatccagcggagggattcactgcatgcacttgtcaacaaccttccagatgcgcactacgccacgctgagggctctgatacttgtaagtaactcgggtatcgccccatctttctatctgccaaggtctaatttgctcgattctagcacctcaacaaagtccaagaacattacatga

SEQ ID NO: 4294 - DNA, 459 bp, A.fumigatus
ccccctcgctcgctgcgtctcagcccacttccggtcgaaatccaccagcccctccttatccttccggcggagtcgtgccaggtaatcatcccgggagctgatctcgtcgtcgtcatcgctgtcgcccgcaaggtaaagcccgctcttgagatcctcgtacatgcgcgccttttcctcgagccgccgcttggagcggtggagggtggcggagtcgacggcgccgatgtctgcggtgcgcttgtggatctggcggacggaggtttcggcatcgtcgtcgtcagcatcgcgaaggtccgcggccgcgcgtttctgggcgcctttgttgtggacagcgaagatgtcggatttagaggatttggagggtcgagggcggccgcgagtggaggactcggtgcctttggtgatgagggaggagagctgggtggtgaaggcgagggtagaggcagagggggcggttga

SEQ ID NO: 4295 - DNA, 288 bp, A.fumigatus
ccatgtcgaacatctatctcggtgtcatcggtgagtatccatcccacctttgctgcaccgtgctgcattggagttctgactcatgcttacaatccatgcattgcaagcgtcagtggtgttggaaccgcattcctgaaccaacttgcccgtcttccaaatgcccccaagctgatcctcctcgcccgctcaacacaaaccctcctggccccgacaccggcctactcgcctgccatccccgccggtgactggaacgcggccgccgagaccccctcgctcaccaagtctggt

SEQ ID NO: 4296 - DNA, 663 bp, A.fumigatus
aacatccatcatctcacagtcaccattcgagcacacaaaatgtcaaatacaaatccatccctttacggcctcccccgacatagccaaaaagcctccgctcaatcaaccgccccctctgcctctaccctcgccttcaccacccagctctcctccctcatcaccaaaggcaccgagtcctccactcgcggccgccctcgaccctccaaatcctctaaatccgacatcttcgctgtccacaacaaaggcgcccagaaacgcgcggccgcggaccttcgcgatgctgacgacgacgatgccgaaacctccgtccgccagatccacaagcgcaccgcagacatcggcgccgtcgactccgccaccctccaccgctccaagcggcggctcgaggaaaaggcgcgcatgtacgaggatctcaagagcgggctttaccttgcgggcgacagcgatgacgacgacgagatcagctcccgggatgattacctggcacgactccgccggaaggataaggaggggctggtggatttcgaccggaagtgggctgagacgcagcgagcgagggggtcagatgattcggcttctgattctgacgggggagatgtcgaggccgacgataatgcgtcgatcgtctcgtatgaagacgagctggggcggacccggcgcggg

SEQ ID NO: 4297 - DNA, 816 bp, A.fumigatus
cagaagcagctctttaatcgtggggtcgcggggcagcgattatcggagtggtgcctgaggcatacacggttatctaatcagcatcggcagagttgccttctccgtagagtccaaacatttactgctctgccatctcagaagatacggagtgaaacatccatcatctcacagtcaccattcgagcacacaaaatgtcaaatacaaatccatccctttacggcctcccccgacatagccaaaaagcctccgctcaatcaaccgccccctctgcctctaccctcgccttcaccacccagctctcctccctcatcaccaaaggcaccgagtcctccactcgcggccgccctcgaccctccaaatcctctaaatccgacatcttcgctgtccacaacaaaggcgcccagaaacgcgcggccgcggaccttcgcgatgctgacgacgacgatgccgaaacctccgtccgccagatccacaagcgcaccgcagacatcggcgccgtcgactccgccaccctccaccgctccaagcggcggctcgaggaaaaggcgcgcatgtacgaggatctcaagagcgggctttaccttgcgggcgacagcgatgacgacgacgagatcagctcccgggatgattacctggcacgactccgccggaaggataaggaggggctggtggatttcgaccggaagtgggctgagacgcagcgagcgagggggtcagatgattcggcttctgattctgacgggggagatgtcgaggccgacgataatgcgtcgatcgtctcgtatgaagacgagctggggcggacccggcgcggga

SEQ ID NO: 4298 - DNA, 300 bp, A.fumigatus
ctggcttcttttgggaagctgcaactaatatgtctcctggttacagccggagtgcgcgagaatgtcgagcagctgctcaactactctcagaatgagaagaagagaaacttcctcgagaccgtcgagcttcagatcggtctgaagaactacgacccccagcgtgacaagcgtttctctggcaccatcaagcttcccaccgttccccgccccaacatgaccatctggtacgtcaactttgccgaccgaccgatccttcggtggaatgtcttgatgcgcatcatcgggagaaggatgaggtaa

SEQ ID NO: 4299 - DNA, 246 bp, A.fumigatus
  unsure (4): Identity of nucleotide sequences at the above locations are unknown.
acancacgatctcgaccgtgccaaacaacaacgcatcaatgcatgttcgctgatgaactgaaaaaactcacacagaaccaaaagctcctccagaagcttctccgcaatttcaatgctttccttggttccgacaccctccttcaacagtatcccccgtctcctgggttcgggtcttgtccaagggtacttatcttccgtccccgacaaaaccccaacgcccgggattatcctctaaccaaaaactaa

SEQ ID NO: 4300 - DNA, 285 bp, A.fumigatus
aagcgctgttccttccagccccggtggttgaagaccagacactatggtctgtcgccgcaatccgaggtttccaatctcgcctaccgcatctcgcaggatctctatcgaacatttgcccccattaagcagaccacctctaccatggccttttgctctctcgaactcgctggccgcctgctggatcagcgtctggagcccgttgagcaggggtcagattacgagcaatggaggacgagccgcgaagaagtaatgggtgggtctcctgccgttttctcaagtctatag

SEQ ID NO: 4301 - DNA, 597 bp, A.fumigatus
gtagtcaactccagcggagctaccgacggatccctccattccccgcagagaggcgaccttccaacttattttctccaaaccatccccaaaaaatacctttcattctttagaatggctcagccaaagaaccacattatttatgcaccttcagaggagactccccgcggcgtaaagtctgtcttcctcgccggcaccaccagcaaagtggaccccggtgactggcgcgagactctatccacctccctctccgacctgccagtcacgatctacagtccttaccggcctgattgggacagctcgtggcgggaggacattgatttcgctccttaccgagagcaggtggagtgggagctcgacaagctggacaaatccgacaccgtcgttatatatttccatccggccacccaggcaccgatcagtttactggagcttggactctgtgcgcgagtccccgggaaggctcttgttgtctgtcctgagggatactggaagagggggaatgtgcagattgtgtgcgaaaaatacggagttgaaatggtggacaatgttgatgcgttgagggacgccattgtcgagagattgtctgttcgttcgtaa

SEQ ID NO: 4302 - DNA, 1623 bp, A.fumigatus
cctatcgttgccattctccataccctctatggaatctaccacctatgtcgctcgccagtcaccagacccgctggatcacaggccagttacatggtttttgcggcaacgcttgaccttggcttggttccatactatgtcttctccgcatacatcgcgtacaagcagatcaccaacaatgcctaccactggagcactctgctgagcgcggaaactggtatcacggacaagatcgctcattccaccttcatccttagtattgtcaacggaagctttcatttaacctctctctgcatttccgtctggctggctttaatattccggcagatctcccaactgcctccggatctgaatcctctcgaagacaatctgaccgctcgtcctcataaacgaaacaagtcggaaatcagcgaaaagcatcgcagcctgtctactgttgcatcggccacgtctgcggaagaaccccttattggccctgctcggcaagtgccattcatgcacactcgcaaccagtcctcagaagatggctcgagtcggttttccgttattaacgagaagaggcgatcacaacaatctacataccgtgacacggttgtcccacccgtaccacctgtccctcaacactccttcctggcacagcatgaccagcaagcgtcggtgcaatcgctcttggcagattctcatagcgaccacgctcagcaagtctctcgtgacgttcctgacagagctcaatgcgtaagtccagactcgggcaactggattgcctacccttctcggtcaccctcaccggcagaggctggtttgaatgagaacctagcccgtcgagaaccctcgtctgcctacagtcaaacggagagccttatctctgcaggtagcagtttcaaggactggcttacttccgcccagcgctacgaactgcaccttaacgaggcaatctcggaggacgttcgcggcgagtacgaatcactagctttccacgaacactatgcgaatgacgaggacattcatgataatcctcaggcaacacgattctatgacaacgccgagcaagacattggcgaccacaacattaatatattcctggaccacaacgaccgcgagcgacaattctccgcctccctccaggtcaaccctttagccctcaaccctcccaccccacagccggtccaggacgagaccgacaatgcacctcaccccccggcccgtgcccctctcactgatatcccgaacctcgctcctaaccctcccgcttcccctacctccccagacagccccgagaagaaaggccgcttctacggagagctcaacaataagccttggctcagcgttgcgcgcagcgtaagcggtcagaacgatcccgactcgcgcgatctggaccggaagcggagcaggctcgtcaaacgcaacagccagaaactgaacacatacagttcgcttaagcagcacgacgctgatgattcagacgtcgaaaacgagatccctcctgtacctacggatcctgctgttgcagacggtgatcgcaagggtcgtgttgtcagtaactccggggctgacatcggtcggcatgattttggatcaggctcctcctgtcttcaccacggggctggaaggatccgcggtggcgca

SEQ ID NO: 4303 - DNA, 936 bp, A.fumigatus
ctgatgaccttccaggccggcggtgaagacatccgtaccgggaggagacccgatgcctatgacaatcggcagcatgcgcggccccgttccggctatggcaatggaccggcgccggattaccgcagtatgccaccgagcagaccagagtaccaatccccaccagtgccagacatgcacccaagacatgcatacgaatcaacgtctcgccccaccagccatcacagcaaccgtcaatttccagcaccggagcagtacggatatgagggagatgtgctgcgtcacagtcatggacacgaagctgctcaatactcccctcattcgtcgacgaggtcgtacaatccccctcccgtagattacacgcatggcgctcctccgggcccggaaccggaacatcactaccggctgcatagcaactcgggagcgagcatcaacagccggcatcgcaattcccttgcgcacgaaaccttccacccggaatatgcagcaatgcagccccgtgtggacgacgacgaagaagaggagggacctccacctccaccaccggcccatcggtcaggcctggtccagccgagtcaacagttagtaccgtcaccaacttcctcgtacaaggcttactctccagagtttgcaccgtccccccgcaataccaccgatatgaccgcgctccagccgctgcgcccctcgcacgggaaccgcctacaggaccaccctcatatgaagaatccatcggtgccgcgcagcctggtcgccggctttgacccggccattgccgagggggaggccgcccggaccgcgcgggaacgcccagcgaaccgccggcgtagcttcttcgaggaggacgccatgattcgcgcggccgagtcgaatcctgcctcccccaccctaaccctgccgacaccgatccgtcttccaccacgggggctagaagatccagcg

SEQ ID NO: 4304 - DNA, 900 bp, A.fumigatus
tcttccgcgcccgcgtatgcctccctccccgccccgggacgaaagtacctcgtccacggtgagaagtaccaagtccacctcgcctgtgtcggtcccctgaacggcaccgccgacggcaacggaaagaaaccgcccactgtgctcctcgaaggcggcgaaggcccagtcgagcactccctgcaacccttcatcgatgacgtctacaaacaaggcctgatcgaccgctactgctactgggaccgaccaggatacgcttggtccgacaatgccccctccccacactccgccggcatggcagctgatgctctctccgaagccctcgcgctcgccggcgaggaaggaccctggatcctggtttcctccggcatcggctccatctacagccgcatcttctccagccgccacctcctcgaaacacagggcatcatgctcatcgatgccatgcacgaggactacctcggccaagtgggcaacgccggccgcggcttcctgctctggctccgcggggtcctctccccgctaggcctggaccgactcttcggcgccttgttcaagggccgcacacgcgaggaccgcgtctacggccgcagcgcgtaccagacggacaaattcctcaaggccaagttgcaggaaaaccttgtcgccgagtccatgactgcctccgagatccagacggcgcgccatgtccagatgcccgatacgccacttgtcgtcgtaagttccgggattgaggtccgcaggagcgacaaatgggccaagacacaggaggatctgacgaagatcacgaagaatttgaaggagtgggatatcgtcaagggtgcgccccacgaggtgtggaagaccactgaaggtcgacaggtgctgggaaagagactcaaggaaatggtaaaaggcgagtga

SEQ ID NO: 4305 - DNA, 711 bp, A.fumigatus
  unsure (22),(33): Identity of nucleotide sequences at the above locations are unknown.
gggggtctatatactgcgggtncagctgataanacacgaaccgcccggttccgtgtttctatatcatgcttttactatcaggtatccccttacaatctgtggagtgtcagggctctcagagccttttcctcgttctgtctcgcggtcagtttcgtctggtggaccttcctgctcgtctccatcttcgtcagccctccgatgatgcacagccgtggctctggctttttcagcttcgcatataccacactcaccgtcggctacctcgttatcgcgctgctattctttactatcccatctttggccatgaccatatccggcatagtgttggccgtcttcctcttcgtggatatgtgcattatcctctgtgtacctcagctgcgcgtcgaatatggctgggttggtatcgcctcggtcgtctgggccaccctgatttccattttcaacgtccttcatttccggaccgttgcttggggcaagagggagggaagaggaacgccttaccggacgagaggaaacccggcggtccctccgggaatggatcgctgtgcttatcgacccgatcttcatggttgtgtttgcgatagtttccatcctcttcactgctactctgatcttccgcgcccgcgtatgcctccctccccgccccgggacgaaagtacctcgtccacggtgagaagtaccaagtccacctcgcctgtgtcggtcccctga

SEQ ID NO: 4306 - DNA, 297 bp, A.fumigatus
tcagaataccacactatgacagggcgatcgagtatctctcaaccaccagccacggactcaacacctctgctctcttctcatgcagcatcacagcggttttcagtcttcacaaatggacagaaacgcctcatcattcttgcagctgctctagcctcgagcttctcacctttctcggccaacatctactacccctctctcaattccatcgcggcagatctacatgtcacgagttctcagatcaacctgacaattactacctacatggtatctctccttgttgatctggttccgttctga

SEQ ID NO: 4307 - DNA, 1179 bp, A.fumigatus
gtgaagactggtcaagtgatgcatcaacttcccgtcggtcattatgccatggtggcggtcatgagttattccggttacgatattgaagatgccctagttttgaacaagggttccgtcgatcgtggcttcggtcgttgccaagtgttccggaagtacgtgaccaatctgaagagttattcgaacggtacaaaggacagactcaatcccccaacgtacgagaatggtgcacccatcagaaagcatgcattacttgaagcggatggtctggctgctgtcggtgagcaggtgaatgctggcgaggtctatatcaacaaaagcacacccgagcaatccaacctgtcgggaatcggctccgatgctggccgaccagttcagtatacaccgacgcccatgacttacaagcttcatgaccccgcatacattgacaaggtcatgtattccgtacaggagaacgagaaccaactggtcaaggttcttgttcgccagacccgtcgaccggaagtaggtgataaattctcctctcgtcacggtcagaagggtgtcgttggtatcatcgccgaccaggtagatatgccgtttacagattccggtatcaatcccgacattatcatgaacccgcacggtttcccctcccgtatgacagtcggaaaaatgctggaactcgttgctggaaaagccggtgtgcttgccggtcaccacggttacggaacctgcttcggcggcacccccgtggaggaggcctcgcgggttctgatcgaccacggcttcagttatggaggaaaagactatctcacgtccggcatcaccggcgaagctcttccattctacgtcttcaccggtcccatctactaccagaagctcaagcacatggtgcaagacaagatgcactcgcgtgcgcgaggacctcgcgcaattttgacccgtcagcccacagaaggtcgttctcgagccggtggtctccgtcttggagagatggaacgtgattgtcttatcgcctacggaaccagccaactgcttctcgagcgtctcatgatctcctccgatcgccatgagattgacgtctgcgagcaatggcggcttcatgggctatctgaactggtgtcagcggtgcaagtcgtcccggagcgttctgaagatgaagatcccccacgccggcaagcttctcattcagggaatgga

SEQ ID NO: 4308 - DNA, 414 bp, A.fumigatus
tcttcacggctccctcgcatgccgcccttcgttccccgtaaacgtgtctcttccgaggatccgcccacggccaagcgtcagaatgccacccccatcgtggagattgcagactttgatgaagactctgactccgagtcatccttgagtgatgcgcctagctttgacgacgaaccacttgcgaaaagggaccttcagaaacagaagaaacaagcttccgatggctccgaatccgagtctgagtccgacgacgatgacgaggtggattgggaggacgcgatagactccaaactcacctgtacgtcgatctcgacgccggctcccgctgtgcaagatctcgaattgacattggacaagaatgaggtacatttggctgatatcgcagatgggaagaaaggtccctccaagaccgagctt

SEQ ID NO: 4309 - DNA, 249 bp, A.fumigatus
aaacggacacaaggtggtcgctctagcgaatctgtacccgtctacatccagacaggcgggccagtaccgctgcaaaggacagtcatgaagatctcaagaaggaagaaggaacagaagacgaagaagaagaagaagaagaagaagaagaagaagaagaagaagaagaagaagaagaagaagaagaagaagaagagaaagaagaagctcagggtcaagaagaagagcccatatcaccaaaccgcccaatga

SEQ ID NO: 4310 - DNA, 312 bp, A.fumigatus
ccccaattacgggaagactggtctcacgaaatccaattcgccctccgtgcaatcctgttcaaactttctatatgggatcataatgcctcctacggtgctgccctccagggactgcgatacgtcgatagtcgcagcaaagggcccgtccattctacccccacaaaatggcaaaagagcctatatggcttactcacagttggtggtcgctacgcctgggagaaatgggagtcatggttgatcagtcaagaaggcggttatgaagaggtattatctggaacattttttgttggaacttatatggacttgtgctaa

SEQ ID NO: 4311 - DNA, 726 bp, A.fumigatus
ctgaagcagccatcgcgggatgttcgaatgctggctcggctcacaggtttagtctccaccacacactcaatcgcagctttcgtttcattcctcgtcttcctagtgaacggccgataccggacactagtcgaccgaatccttcgcatacgccttacccctccatcagctcagtctgctcgcgaggtgtcttttgaatacctcaatcgacaactcgtatggcacgccttcaccgaatttcttctcttcctgttgcctcttgttggaatcagtaggtggcggcggtggttgtccagagcatggcggaaagcaatatctgccatcagatcaagggatgacgatgaagtggaagtagagaagcggggagaattggcgttccttccagagcgaacatgtgctatatgctacaaagaccaaaatcctgcctctacttcggaaaacgatatcattacagcgtcggccgggggtatcgtcgggtctgcacagacagacatcacaaacccttacgaaacggtcccgtgtggctgcatatactgcttcgtttgccttgtgcagaaggtggaaggagaggaaggcgaaggctggatttgtttacgttgcggcgagatcgtaaaaaagtgcaagccatggaatggcgacgtccttgaagaagttcgaccgtccacaacctccggaaaaattgtggggttcgctatgcttcaccacggggctggaaggagcgctgctaat

SEQ ID NO: 4312 - DNA, 441 bp, A.fumigatus
  unsure (26): Identity of nucleotide sequences at the above locations are unknown.
tctacgggacttgactggtcactgtnatctatctatttctccctagaatacacacacaatgatagtacgatgagctcaacaaactttgccgccgctcaggaacgagtcttagaacgccgccgcttgcgcgaggctgaagctcgcaaacggctggcggaacagcagcgtgcatcaccactgaaccatccggcgctcaaccgacttccgtaccccttgaacagaatcccgcagtccggtgtcacgttatggaactccatcaaggggcgagaaggaagcagacctgctttccgtgttggtcaagtggatgccgagctcctcgatgaagagttgctggggctgcttaaggggcaggttggaaatgctttgaagtacttcggggtatggcctaatgtcgctgcaattccagtcgcctatctcagtatcactaattgtctgtcttga

SEQ ID NO: 4313 - DNA, 888 bp, A.fumigatus
gcagcaagtcctttatctcttgctgacgccagtccccttccaactgcagcaaacgccatgacgggtctcgcgcaatgccctgcacaggtggtcgaggaaatcgacgcatacctggatctgacggatgtgggcaatcttcgacagactaatcgacgtcttaggtctcaagtcacccagggacggtttcgattgaacttccgctctaagcgtgtcaaaatcacgggagcacacctgcaacagctaggccttttgacacagcgtggttggctcggctgcgaaactcgccacctaacgctggtcggcgtggttaacgacactatggctcttgacgccggcctcaaagcagacgcaaccaatcccaggaagcgagacttggcgattcttcaacagcggcgacaggattatgagcaactgctggagtcagggaagattgtgcagcttctcagccaggcttttaagtacctggcgacgaatagcgccgagaggaaactccaatccctctcgctcgaggttaccgtgtaccgtcaagatgcggaacgcgaggtaactcccctggctggcagtagttggaggcttgtctggcagactacggcagagaccttccggattgtattggcggctctacagaaaagcctcctggcggttgattatttgaatgtcttcaatggttcctacatgcagcgatgcagcctggagagtcgggagctgtcccagattgattatcataacgagaggctctccaaagtccttggagctctgaaagctttgtctatcagtgtttccgaccggattctctggctcacaccccaagacgcccagcgctccagcgatggttcggctgatgtgatcgattggtcggacgatgagcacgatagacgcatcgactaa

SEQ ID NO: 4314 - DNA, 798 bp, A.fumigatus
gatccgggtcttttgcgcttgccacattcggcgaataccgtaacatatctacacaatatcatgcttgacatactctccctgaggacggaagctgaacatggcctggcggattcaatattgacagcaacgcatcaatatgcccttctacagcgtgcatctatactcgataaccgcttagcacagtgggaggaccgagttgcgccagagaacaaacctatcacaatagcccatatgcgaccgggcagtgacccctatattgaagtcggacattggcccggcccattgcatatgtacacagaccttcgcgcggcagccctccttaacatcagtcgcgttgcgcgatgctacctccttgacatcattctcaggctcaaggatatgcaggctgacaccggcaacgatgataaagagagagcaactgctgtccagctcattcaggactttacctcctcaatcccgtatcacctagttgaggacttgcattcattctccatgagtgtccagcgcggcaatcccattgagccgcctggaagagcagttggaggattactgctgatgtatcccctgtacattgcttcgcagctatctattgtgtcggtacagtttcaggactacttcaaacggtgtctagtctggattggacaaaacacgggagttggatatgcttctctgttggctaaggtgagatatactgtcacaggtcacagtctctgttatgctaatggacagtcaaaggcccatttcaatattcaagatctaactgcaggatgcatcattgtgtatggcggattgctataa

SEQ ID NO: 4315 - DNA, 420 bp, A.fumigatus
tgttgcgttgtattgctggtgacaaaactaatggaagcaggagctttgaacatgtcgcgcgctcttggagatctgcagtacaagaacccactgaacaatgatactatgggccccagcactgcaggccaggaaatagccgccatgacgccgtcgatcgaacagggcagctttgtgtcttctgagccgtctatcatccgggtagatctgcggcaggaccgtcggtatatcctggctttgacgacagatggtgtgaccaacgtgctgaaggatagtgtcatcatcaatgaaatcaaaacacggcatgagggaggactgggggtgcagcaggtggccgacgagcttgtccggggcgttacacagggtgagcggagggataatgctacatgtattgcggtgtttctggatggatgtttgtcttga

SEQ ID NO: 4316 - DNA, 576 bp, A.fumigatus
ctgttgcggtggtgtggggaaagcttttcgagtgacatgctcgcaggtacagcgcgggaatgccttgatgacctctttctcttggaacgaaggagtcctttcttttccgaggcgtgcatcaacgcggcgcggcggacagatcggttgaccgaccatgcgacgagcccacgccatgccagcactgccagcccaataaagcctagagctgcacctacagcaataaacaccgttccttcgggcgtgttcgatttttgcatgtacggcgcatccgctgtcggtggcacggtcaccacagggaaaccgtctgtagaggatgcagacgttgcagtcgagcctgctgagtcggtggtagagactgtcgacgtcgtcgctgcatcagtagttgtagaggcttccgtagttgaggtttcactactcgtcgaagcttttgtggttgtggcgtcggtcgtcgatgtcgaatcggttgtctttcccgtgtctgtagtcgctgggtctgtggtcttcgttccatcggtcgtttgcgcagtagttgcagcatcgttggtggagggatcccgctgggcagaggccagttga

SEQ ID NO: 4317 - DNA, 396 bp, A.fumigatus
tgcagcgacgacgtcgacagtctctaccaccgactcagcaggctcgactgcaacgtctgcatcctctacagacggtttccctgtggtgaccgtgccaccgacagcggatgcgccgtacatgcaaaaatcgaacacgcccgaaggaacggtgtttattgctgtaggtgcagctctaggctttattgggctggcagtgctggcatggcgtgggctcgtcgcatggtcggtcaaccgatctgtccgccgcgccgcgttgatgcacgcctcggaaaagaaaggactccttcgttccaagagaaagaggtcatcaaggcattcccgcgctgtacctgcgagcatgtcactcgaaaagctttccccacaccaccgcaacagctacaacccaagagcacctaa

SEQ ID NO: 4318 - DNA, 1095 bp, A.fumigatus
gcccctccgacgatgagattccgcaatgtggggcgtgcgaagccccatcagcgctccatgacattgcttctatttctcctgatcgttgtgttggctcaactggcctctgcccagcgggatccctccaccaacgatgctgcaactactgcgcaaacgaccgatggaacgaagaccacagacccagcgactacagacacgggaaagacaaccgattcgacatcgacgaccgacgccacaaccacaaaagcttcgacgagtagtgaaacctcaactacggaagcctctacaactactgatgcagcgacgacgtcgacagtctctaccaccgactcagcaggctcgactgcaacgtctgcatcctctacagacggtttccctgtggtgaccgtgccaccgacagcggatgcgccgtacatgcaaaaatcgaacacgcccgaaggaacggtgtttattgctgtaggtgcagctctaggctttattgggctggcagtgctggcatggcgtgggctcgtcgcatggtcggtcaaccgatctgtccgccgcgccgcgttgatgcacgcctcggaaaagaaaggactccttcgttccaagagaaagaggtcatcaaggcattcccgcgctgtacctgcgagcatgtcactcgaaaagctttccccacaccaccgcaacagctacaacccaagagcacctaatatccccagtactggtagcggtctctttttctctcctaccgcaggcgccggaatgcatacaagcggaaacagaggatccagctaccttccggcgggctattatgctgcaggaaacgctgcgcccacggggagtcagaatatcccatactcaacgccagaaatgcgaccccactcgcagggctatattcgcaccaaatctaatccgagcccccctaggtcgccgggtctgtcgcctagcggcttccatgacactcactacgatccttccaccaggcattcgtatgttgcaggctccaccagctcgttgaatcttgcctctccgacacatggaagaacccccagtgcgttcctagaggatcttttcgaaagtcatgcccctcaatcggacaacggtcatagatga

SEQ ID NO: 4319 - DNA, 738 bp, A.fumigatus
tcatcatcccacttccacaagtttgcctttataccggagtcctttgatgactgtgatctctccacccttagtacgatgattgctgtggtacctgtctcgcgggaacatctctctcagcctcctctgaatcttcagcgacgcgccatggcacaaacttattacctggactcacctgatatcgccacgttcaaaaatcccctacaacattactctcagcgagattgtcccagtccgattacttcgtctgccccatcctcggttcctccctcacctcattttgcgccggtaactgaagagcagctacttcctactccagcaacccttagcagtctgtctctctccgtgagcaacgatagcgacgacgagatcatcctaccttcatatgattcgagccacttcaacgacttgaacgaaatcgtgtcagctgttgcctcggaccaggcctcggagtcatttctcacgggacccccttgtttgcatgtacatacgccggccgctgatgatacttcggttgaagaggagccgactaggcatgtcgattatctctcccatgagtggaaagaggaagatatttgggcttcttggaaatatgtcgtttgccgcagagacatttacagcaatggcgcgagattagagaatgcctcttggcggacttgggcaaaactgaagaataacttgggaacggtgtcgcccgagaccctcaattggtcagtactgcatactctcgcgttccattaa

SEQ ID NO: 4320 - DNA, 225 bp, A.fumigatus
ctcagccaatctgataataaagttatgtctatgtattctaacatgttccatcaggttgaaagattgcgatgtaacatggctttatggtccgttgaagtcgtgcaccaagtttacaaaagcgtcgccgagtatctccccaccgccgagctgcctcgaaaccccctcgttgtatgcggacagggaagccgatcttctcatggggcggcaagatccgaaaatatcccc

SEQ ID NO: 4321 - DNA, 1119 bp, A.fumigatus
  unsure (998),(1006),(1023): Identity of nucleotide sequences at the above locations are unknown.
tcgaagtgttgcctccagcatctattcaactccaatcttgcacccagtcccttcgctcctttcaaagatcgggctcctcttgtctcgaagagctgcatcatgacggactcatcaacgccagatatgaccttaacggtccaccaccatggcaaaccacacaccttcaccctggccccggacgcaacactgcaagacctctcctccaccatcgccgacaccctcaacatcccaatcgagaaccagaaaatcctcatcgccccgaaaccaggcatgcagaagcaccccttcgcgccgaccccgctctcaaccctcctccccctcacctctcccaaattcaaactcaccctcctcggcaccccagcccaggaaatcgaatccctgaacgcccaaacagccgaaacccgccgccgccttgaagcccgcgccgccgctgccgcaaaacaccgcacccggcgccccgctcccagcatcgcagggggcatccacaccctctcaagcgccggcagcaacacctacaccttccaccggctcctcccgctctcatacctgcccaatccgtcgcggtcgctggagtttctggcccgcctgcgtgacgacccgggcatccgcgccgccatggcaaagcaccgcttctcggtcccgctgctgacggagatggatccggccgagcataccacgagcgaatcccgcacgctcggtctgaatcggaataaaggcgaggtgatcgagctgcggctgcgcacggatgcgtacgacggataccgcgattaccggacgattcgcaagacgctgtgccatgagctggcgcactgtgtgtttagcgagcatgatcgggatttctgggatttgacggcgcagatcgagaaagaagtggagcgggcggattggaagcatgggggaaagaggttaacggatgaagagttttataatcccggggaatgggagcgggagaaagatgccgctgtggtggatgaaaaggggtggacggggggcgaatntgtgctangggggttgaaggatganaacactggtgtcgaaagtcgacgggagattatacctcgcgcggcggaagaaaagatgcgcaaaaaagaggataatataatgggccccgggaggtga

SEQ ID NO: 4322 - DNA, 441 bp, A.fumigatus
caaacgcaatcgccgtggaacgtaatcgaagtgttgcctccagcatctattcaactccaatcttgcacccagtcccttcgctcctttcaaagatcgggctcctcttgtctcgaagagctgcatcatgacggactcatcaacgccagatatgaccttaacggtccaccaccatggcaaaccacacaccttcaccctggccccggacgcaacactgcaagacctctcctccaccatcgccgacaccctcaacatcccaatcgagaaccagaaaatcctcatcgccccgaaaccaggcatgcagaagcaccccttcgcgccgaccccgctctcaaccctcctccccctcacctctcccaaattcaaactcaccctcctcggcaccccagcccaggaaatcgaatccctgaacgcccaaacagccgaaacccgccgccgccttga

SEQ ID NO: 4323 - DNA, 420 bp, A.fumigatus
  unsure (222): Identity of nucleotide sequences at the above locations are unknown.
agccggaagacaagaatgtcagcccagctgaaacggcagcgtcggtccaagattgcctgtgagccatgccggaccaggaagaggaagtgcaacggccagcatccttgcgagatgtgcacagactctgagtacacatgccactatgacttgggctctcgcaagaaacgaaacaagggcctcgtcctggaaagtctgatgacagtccgaccggcgcagatgcancatgcggggtcacattgggagcgcccaacggccccgactccacgacgtccatcgccgccagtggagcgatttaccaacactgtgcagcagtcgattgggaccaattccggcgcattcttggttcagaacctggggactcaagatcgaccctggtctacgccctccaatcctccagtcttcccgttggaatatccgggc

SEQ ID NO: 4324 - DNA, 789 bp, A.fumigatus
gctcagacatccagacttgagcgcgacgttgctgacccaaacagaatccataagatgatcctggatgacctgggcgtccgacagattgcagctgtcgtcggtgggtccatgggcggcatgttgacccttgagtacgcctatttcggcaaagactatgtccgggctattgttccaattgccacttctgcccgccactcggcgtggtgcatcagctggggtgaagctcagcggcaaagcatctacagtgatcccaagtatgaggacggttattattcattcgatgaccctccagccaccggcttgggagcggcacgcatgtccgcccttctgacctaccgaagccgcaattctttcgagtctcgctttggtagaaacgttcccgacccgtcgaagagacagaatatcaatggcaccgagcgtttgccgactccgccgaatgaacactgggccattcataatgatggtcacaaggccggcatgtcttctcgggcctccagcgagcgcaactcgcctgggccgcagcagtcctctgaagtccagtatatggatcctcagttctccggcacaaagacgtttagctctcccgtcagtaacagtgacaggaagcggccccctacctacttttcagcacaatcctatcttcgataccagggagagaagtttgtgaaacgatttgacgctaactgctacattgctatcacacgcaagctcgacactcatgacgtgtcccgataccggggtcttcaccacggggtggaaaggcgctgccatgcaaacaagatcagcagc

SEQ ID NO: 4325 - DNA, 450 bp, A.fumigatus
ctacttggtgaacagctactaaatcccgtagagagagttgcctccttgcctgaaaatccatatgcaaaactcatcacggatcagtctatcgctattatcccgtcatttaccctggaatcgggggtgaccctctacaatgttcctgtcgcctacacaacgcggggtgaaatgtcccccaaccgtgacaacgtgctggtgatctgccatgctctgagcggaagtgccgatgtggcggactggtgggggcctctgctgggaggacccggtcaagcctttgatacgtcacgattttttgtcatctgcttgaacagtctgggtagtccttatggaagtgcaagtgccgtgacttacaaggatggcaatcccgaaaaaggcctgtacgggcctgaatttcctcttaccactgtccgggatgacgtgaggttagtgagctcagacatccagacttga

SEQ ID NO: 4326 - DNA, 234 bp, A.fumigatus
aaatttccgcacgtacttttccatggacctcctgggacagggaaaacatccacaattcttgctctggcgcgtcagctatatggcgatgctggcatgagccagatggtccttgaattgaatgctagtgatgacaggagtgtacataacgtccagacacggatcaaagcatttgcaagtatgttgactagccctctcctagatcaaagtattcctaaccttgtttctttttcctaa

SEQ ID NO: 4327 - DNA, 522 bp, A.fumigatus
ggcacaaggcccattttcaaagttcctttacgggagagtccttataacatgtttaaacttgttatacttgatgaagctgatacaatggaccacactgcacaaatggcccttcgtcggatcattgaagattatgcagccttcactcgtttctgcattatcaccaataatattcatagactattaccagccttgatctcacggtgcgcacggctccggtttccacctctgcgaccttctgcgatacgaactttgttattgcaggtcgccacaacagaaaatattcaagtcagaccagaggcgttagaatatctatctactaccagccacggtgacatgaggcaggctttggccgttttacaagaatgccatctaaatagtacgttttggtcggatgatgaatctaccacgactatatctcggataaaatttctaatgatggcttcagaaacctctcaacaggcatcgacatcaaatctccctgcccagggagtgattactgtggagaccattcgagagtatact

SEQ ID NO: 4328 - DNA, 1074 bp, A.fumigatus
atgagtatgtcaacccagttggctcattgcactgcaactaaaagcttacatcgatacagtatctctgagctttccaccaagaagattgcccaacacaacatccccctcgtccaaaacaccgccgccaatccttatgccctgtacaaagccttgcgtcagacacctgactccaccgacaacgataaactctttgactaccagaataatgtcatgatgggtaattctcatgcagcggaccttctagtccagaagtatgatggaatcatccgctccgcatccaaaagtactctcccaagcagcctgtccctccctccaatgctaggaccaactgcctctccgtctacagcgcagcggcacacgcacaaggccaaaccggggcccaaggccctgaaagccatcttccgggtcttggagagacggcccaaggacatcgggctggtcctgactgtcgttcagctctacgtcaatgcaggcaatactacttctgccatcaacacgctggagaaactgctccagaacctcgacgagtccattgctgaacaagacaaggatatccgcttcagccccggcctgcttactgtgctggtgtccttgtacaagcttgaaggccgcaagggccagattcgatccgagttagcgaaggcagcgagccactggcgaaaccgcgccgaagcccccgtgccactcctccgtgccgcagcagcctcgttattacattcctccgaccgtgcagacctatccctgtccggagaactgttcaaggatctgtaccggaatggcaccggcgaccaattcgcagtggccggctatgtcgcctcgcaggctaccctcgactacgccaaggtcgagtcgcagctcgaaagcctcccacctgtcgatgagctgatcgcagacgttgatgttgccgccctggagcaagcaggcatctctccttcctcggcgacagcggcagccgctgctgccgcgatcgccggcgcgaggaagaggactgcagcggagagccaaatccgcgcgacgaaacggatcaggaagtcgcgtcttcacccacggggctggaaggacacgcgtccgggg

SEQ ID NO: 4329 - DNA, 204 bp, A.fumigatus
tactaccagaccaccacgccctactcagccagccaagacccatacgaacaggcaatatcgaccattcagaactcgacctccctccataatggatactggtcttcaaaatttacaaggttagcacgtttccagggtacagaagccggttctgatttgtttcggaagattaactacatgaggctggcactgtattactggccttga

SEQ ID NO: 4330 - DNA, 561 bp, A.fumigatus
gcactatatgacactacatttcattttatccatgccgagttctattctcgatttactggtctgaaggccatattctatgacatgacgagcttgcacttttttaatgtggttctgagccttctagctctatttcccgtcgttctggcacaaacatgctggaggaacacgacttgttcagggccaaaagacagtgcgttcgaagggccatgggaacggggcatttatgcgccttcttcaaggaccgttcgtcctaagaaggttctgtccatcaccgacttgagcctgagctcagcttatgcacaagcgatgccggccactctccatggcaatgggtcacttgtcatattcgactttggcatcgaagtcggcggtatcgtcactctgaattatacctcctcaggtagtggagcgttaggaatagcgtttacagaggccaagaactggataggcgagtggtcaaaatcgtccaacggcgcaatcaaaggtcctgatggggcactatacgcaaactttaactcaggctggaagggcctcgatacaatgccggacgaaaccttgcct

SEQ ID NO: 4331 - DNA, 306 bp, A.fumigatus
  unsure (256),(297): Identity of nucleotide sequences at the above locations are unknown.
tctcatgcaatgcggccttcgataatctccctcgtcgctctctcactttttctcgggctggcgtacgctggcggcgttgaaaaggacaaacgagacaatgtctgtaccgtcaaagcaaatggaaagcagaaggatgatgtgccaaaccttcttagggctttcaatgaatgcggaaatggaggcacaatcatctttcctgaagatcagtcatattggattggggcgagacttaatcctgttctgaatgatgtctcantgcaatggaaaagaaagtggacagtaggtcctcctgctctntgcctctaa

SEQ ID NO: 4332 - DNA, 867 bp, A.fumigatus
  unsure (700): Identity of nucleotide sequences at the above locations are unknown.
ccaatattaaccatgccgccggcatctacgcggacatgtcggtggatggtccggcaatcggcacgctggtcgccgtcattgatcgcgcgaagaatctgccgaatcgaaagactatggggaaacagaacccgtactgtgctgcacggttggggaaggaagcgaagaaaacagagactgacctgcgcggagggcagacgccgaaatggtatcgccccattgtcccttgagcggtcgaatcatgctgaccgcaatgccagggatcaggaacttcggttcacggtgcacgagtcacccgactacttcagactcaaggtctcggtcttcaacgatgacaaaaagaccgacctgatcggcgaaacctggatcgatctgaaggacttgatcatccccggaggcagccagagcgaccaatggcatccgttgcagtaccgaggaaagtatgccggtgaggttcgcatcgagatgacttactacgataccaggccagaagacgaggcggtgattgaacggcgaacgcaagccgccgagaaggcccatgccaagagcaatagttcgagaccggccccggccgctcctgtcacctcgtcgtcgtcgtcgtcgtcgtcgtcgtcgtcatcgtctctgtcgggccctcgccagctcgagaaggtcaagagacgtccgtttccgaacgaccctaccgccgcgactcctgcgcgtncgggaccccccgaaaagacctccccgcgccttgtgcgtttcatccggctccagggaagaccggtgcaccatgagcatgctcatttcatgcctgccatgaatagccccgatcacattcgctattcgcaacgacaagcacccaaggcgcccgacgatgcattttccttc

SEQ ID NO: 4333 - DNA, 336 bp, A.fumigatus
tctcgctcgataatatttccacaagctacacgggccagtgctgcggtggacgcattgagaacgaaaatgcctggtttcgcggattcattttggacaccggactatgctaccggtcttggggtgctgtatgggaaactccaacagggtgtcactgaaaacaggcagattctcactattgcgagcttgcgagcggatgcggaggagcagtatggtctcaagctaggggagatcgcgcccagcgttgaccgcatgacagcagggtttgcgaaagacgatggggccagcgtgagaaaggtaggttattcttcaccctttcgagggaggctcatttgctga

SEQ ID NO: 4334 - DNA, 216 bp, A.fumigatus
ctctcacttctgctaaacgtccgctctggtcgatctttaggcgccctcatatacattctcctcaagcccatgcctgcggccgatttgttctaccctgggatttgcaagtgcgataaaaagaagcgtttcggaagagtctggtcactcattatccctttcgcattcctctctgctgtcgaagctgcctcaggagtatctcagcgtgtggttgtgtga

SEQ ID NO: 4335 - DNA, 645 bp, A.fumigatus
gttattcttcaccctttcgagggaggctcatttgctgatcgtatgcgttctcaggcgtatgaaggtgttcgctcggaaatgatagaggcctccaaaaaccatcaaaagattgcatcgaatatccgtgaactcgttgtttcccccttcagacgatggtgtgaccagcacgaggctcgaattcagaactcccatgacgatcttcaggcccggattaaggagcatacaaagcaggtggaacttaccaagaagctacggagccactactttaacaagtgtcgggtggtagaggatctggaagaagaaaacaagttggctttccaggaccctgagaccagtcccaaggtcaaggcgacacccaagattgttctgccggaagaacaagcagaggaggaggagccgattgagctgggagatcgagtctacgcccccgaggacctcaagaagctcctgacacacatgcttgataatatcaagattggggaggtcaaagtgcctatcattggaacttatcagaatacatccaacggtgctgatatcgtggagtatattcaaaagtacatgaacggaaccagcatcagctatgcggagagaatcggtcaggaccttgttgttcttttaccacagggggcggaaggaaccgcataa

SEQ ID NO: 4336 - DNA, 465 bp, A.fumigatus
agacgtgaagcattcatgtggatgatggccatctccggtctttcgtccatcttcacctggggctctgtttgtttcgcccacatccgcttccgcaaagcctggaaggtgcagggccacagcttgaacgagctcgctttccaatctcaggctggtcttgtcggctcatggattgggtttatcttcaattgtcttgtgctggttgcccagttctgggtcggctttgcacctatcggttacagcgaaatgacttcaggcgagctggttgagagctggttttccgtctacctggccgcaccagttgttcttgttttctacttcggttacaagttctattacaagacttccttcctgcgtgctaaagacatggacttgcacactggtcgtcgggagttggatatccagcatctgattgaggaggaacgtgctgaacaggccgcttggccccgtatggaagaaggtttataa

SEQ ID NO: 4337 - DNA, 1425 bp, A.fumigatus
tgggagcaagtttatacccagagcatgagctccatacattcgtggagggcggttgtttcacgagcgaagtcatccccaaataaactgacggccatcagcctaaatacgatgtacttttttgactccaattccgccgtcgacgggtgtaaagccaaatctcagccgggttacgagcatatggaatggctacgggttcagcttcaattgctacgcgaacgcgggatgaaagccattcttatcggacatgtacctccagcccggacagttagcaaacggaattgggacgagtcgtgctggcagaaatatgccctgtgggtgcatcaatatcgggacgtgattgtcggcagtgtctacggtcatatgaacatcgaccatttcatcctccaagaccaccacaatgccaacattgtcgatgttgacctgcatgagacgtctttggaagctccaaatgatacaaccggcgacatctccattcggtctcggtcagcgtacctcagcgatctcaggcacgactgggccaagttgccgtcaccgccgcgagatttccctatggacaacagtacccttgacgactggttcggagagggagcgacatttgaaaacgacgatgatatccaattcaagaaatccaagaaaaaaaggcgacagtttctgaaagagatcggcggaccttgggctgagcgatacagcgtatcgctggtatcacccagtgtagttccaaattacttcccttctttgcgcattgtgaagtataacataaccggactcgaagatataaatgcttgggccggaacttctgttggtgctgatatcctactttcgttgacggaaaaatccaaggaacgtcgatcacattctgagtcaattgaggacccagatgtggatgagttggagaaacgaaaggacaagaaaaagaagaagaagaagaagaagaagaagaagccgtccttcaaagttccagaacctccttcgcccacggccccgccagggcctgcatattcgaaccagccattgacatggcttggttatactcaatactttgcgaatcttacgaagatcaatattgagtattatgaacgatatggtttctcgactgacggattagtcaatgagacgagcgacaaagacatctttacttttgaagttgaatatgacactacgaaggatgacatgtacaagctggcagacctcactgtgcgcagttacttcaaattggccagtcgaattgcaaagaaagcctccacaaaggatcagatgtcggaaacgggagctaccgatgacctgcatgctgctattgataacgatggtgacgactccagaaatatgaaggacacaaagggaaagatgatgagaaaccgagtatggaaaacatttctaaaacgcgcatttgtgggatactacaagggtgatgaaattgatgattga

SEQ ID NO: 4338 - DNA, 906 bp, A.fumigatus
gcagccggcatagccgcagtaggagttgagcttctcacccacccactcgacacgctcattactcgattacaatcccccgcctacgcctcaacatatcaacgtgcaaatggccgcatcaacccagttctctaccgagggttatatcaaggcttcggcccaacgatcatcaccagtatccccgcctcagtcgccttcttcaccatctacgaagccacgaaatcaacgctgcaacccaacgaggccattccatcatcaaaaacccgcgagctagccacgtacgcgattagcagcgcagtagcagatctggtagcatgcgccatcactaatcccgccgaggtgttgaagcagaacgcgcaggtcgtgcatgctcaatccgagcatagccgctcgccgctgctatcgaccgtcaggcacttctccaggcatccgacgaagctctgggccggatacaccatgctcgctgctggccatctccccgggacgagtctgacgttctcgatatatgagtatctcaagtcctcgtggtttgcggtaccgcagggctccagtgatgttcgtgtgcatttcaagggaagtttctacggcggtgcgctggcgagcgcggtggtatcgctgctcttcgtaccagttgatgtagtgaagacgcgcatgaggcttgcggcgggtactcccacctttgctcgactgcccttgaaggctgacattcggcctatacctccgtccgtgaaggcagagggggtaccatctgcgaatgctgtggctgtagcaaagggtattttgttgaaggagggtgtacgaggtcttttcagaggcggggctttgacttgcctcgcggctgggctgggaggtggtttgtttcttgggtgttatgatgctctgaaggtatactttggaggtcagggatga

SEQ ID NO: 4339 - DNA, 237 bp, A.fumigatus
catgatactcaggcctcaaaagcaatgccatatcagaaggacgatccactctacccccaattacgaaaggaggcagttgcacattttgacaacatgctctcctttgcgaatcatttgggcatgttctcagaagaagtggccatatcaggggagcagattggcaataccccacaagccttcagccatctggcgtgtgttagtgctgcgatgaatcttggggaacaaggcgagagatga

SEQ ID NO: 4340 - DNA, 216 bp, A.fumigatus
actgtagcgcagaccctcgacggcaattctctaatagaatctgcgatgcataatccggtagacaaggatgtgcgatacagccgcaccttgtacgttttaaggcatggcattcaaaaaccaatattctatactatgtttatgaagattagagatatctattatacaagttcccaacgaagagtggaaaaggccgcaggcatgtcgaatgccccctga

SEQ ID NO: 4341 - DNA, 582 bp, A.fumigatus
agacatgcaccacatctgatcttcggcgctatatcgccagagacactgcagtggaactacagcttgacaggatcactgggagttgtcgacttgcccgtgatggcgagcctctcccccaccggtggtattaatggccgatacagacgctatgagatgatgagaattcaaggatcagtccggactctgaagagcccacgagggcgcaagttcgacatcgacgccggagaaattgtttggtcgctggaggagaacaatttgcagagatcgggcctgccgcgggagttcacctttgccatgctgatccagaaaccgcgcgcagacagccgcattgttttctccttggacatcgagcccaccctacagtcgtggtacggcagctaccctgactggtggttatctttgcctaagtatcagcctcagagtcgacggccggtggactttagatcagaggtcggtcagcgctttgagcccgccgaatcaaagaaagggttcaatttcgcgactcttgaaagctctttcgatgactatgtgagcatgccgggaaagagaatcgcatttgtcggaagtcccaaaccccaatga

SEQ ID NO: 4342 - DNA, 417 bp, A.fumigatus
ctggctgagaccgagactaacggaaacttgtacaggatcccggccaactgcgcgtttacatcacagcatgccactcccgacaaggcccagacaaacggagcaccatcggaccgtggacttggactctgcaactcgggcctcctcgtcatcaatccgtcgaaaggagtctatgataggatcattgaccagctcaactcccccgcaacgatgaactacaccttccccgaccaagaccttctctccgatgtcttccgcggccgctgggtcggcataccctacatttataatgcgctcaagacattacggcgcaagggggtccacgacacaatctggcgggatgataaggtcaagaatgttcactatattctcagccccaagccgtgggacgagattgacagcgctgcggaaggccattga

SEQ ID NO: 4343 - DNA, 867 bp, A.fumigatus
atcattatcgccactccgggtctgcacgttcagcgacccttacattcttgcctctgcagagtgcagacattgctacaccatgcgcctcagcaatggtgcccaccgcagcattgccgcaaccaaaggtacgcgcaagccgaatcatgcgatccgcccattgacaagctaaccgactctttccgcgcagtatgggccaccctggtcacaaacacaaactacctcccgggcctttttaccctcgagtactcactgcgaaaagttgggtcgaagtacgcggtcgtcgttttatacacggactctttccccgccgaaggacatgctgccgtcaacgcccgtggactaccgaagcagcgcgtcccgcatctcctcccgaccctcccgaaagaatataccaatgaccctcgatttcatgatacgtggacaaagcttacggctttctcgctggtggagtatgaacgcgtggtgctactggatagcgacatgctggtcatgcagaacatggacgagctgatggatatggagctggatgcgccggagttggaggggagtgggagccgggtgtttgcggctagtcatgcgtgtgtctgcaatccgctaaagaagccgcattatccgaagaactggtatgatctatctgtctcaagaggttccagtgactggctgagaccgagactaacggaaacttgtacaggatcccggccaactgcgcgtttacatcacagcatgccactcccgacaaggcccagacaaacggagcaccatcggaccgtggacttggactctgcaactcgggcctcctcgtcatcaatccgtcgaaaggagtctatgataggatcattgaccagctcaactcccccgcaacgatga

SEQ ID NO: 4344 - DNA, 408 bp, A.fumigatus
ccggtattctttatgaaaggctctttcggcgcacgtaatgttccaaaggttctgaagaacgtggaaatcttgggcatcattcagagccggaagtggaatgtgggctcactcaatgagttccgaaagttcttcggattgaagccctacgagacttttgaagagatcaactcggacccagacgtcgcggagtcccttcggagtctgtacgaccaccctgattttgtggaactctatcccggaatcgtggctgaggaagcaaagcagcccatggtccctggtgttggcattgcgcccacctatactatttcacgggccgttctgtctgacgcagtggctcttgttcgtggtgatcgtttctacacagtaagtcatacagcttcctttggattttccctgccgccgccctga

SEQ ID NO: 4345 - DNA, 549 bp, A.fumigatus
cagctgttccagatcgattataacccgagaaacctcaccaactggggttattccgaggtcagatatgacctcagcatcaaccagggctgtattttctacaagctcgccaccagagcgttccccaactggttcaagcctgactctatctacgctcactaccccatgacaatccccagtgagaaccgaaagatcatgaaggatctgggcagggagattcactactcctgggaccgcccccagtacactcctcctcgcgtcgacctggtgtcgtactccaatgccaagttggtcgcggagcagcagaaccagttccgtgctgcctggggtgacaccgtcgagtttgtgttcggaaaggccagcaaggagttcaagctatatcaggatagtgcctttatccagaagcacgctgatgttatgagcaagctgctgaacaaagaggagtggcaccggagtgtcaaagaattttatgaggatatcaccgcgaaacttctcgaagacaagacaaggagatttggtggcatcaatcaagtggatattaccaacgagtga

SEQ ID NO: 4346 - DNA, 225 bp, A.fumigatus
tctaagcgtgtcgctattgttggaggtggatgcgctggggtcaccgcgttttgggcttcacagaagccccctcatgatgtccatcttttcgagacctctgcaatgcttgatgggcgtatcaaggcagtaccgtttgaacatgcaggaaataaagtcaccgtgaacacagtgccaccagtattcaacgcaactgcttctcgtcagtgcattctgggatcgggatag

SEQ ID NO: 4347 - DNA, 609 bp, A.fumigatus
aataggaggcagtcatatccgtcgccactcaactacaaccactttcccaagtccatatgtacgtctccgaatgaggttgtatgccacggcattccggatcagcgagttcttctggatggcgacatcctcaacctcgacgtttctctgtaccacggtggataccatgccgacttgaacgagacctactatgttggcgacaaggccaaagcggatcccgactcggttaggctcgtggaaacgacgcgcgaggccctggacatggctattgagatcgtcaaaccaggggtccccattcgcgagttcggcaagatcatcgagaaacacgccgcgtcgaggggccttgtcgtcattaagacttggggcggccacgggatcaactcggagttccaccctcctccctggatcccccactacgcaaagaacaaggctgtggggacatgcaaacccgggatgacattcaccattgaaccgatcctggctttgggtggcaaccgagaaaagtattggccggacgaatggacaaatgttacagtggacggcaagcggacggcacagttcggtgtgtatggaccttcaagttgcacgcgctgtatactgacgtggccatga

SEQ ID NO: 4348 - DNA, 378 bp, A.fumigatus
tttcaaaaccggtttccgtcccaaccaagttcccttggttcgggccaaacccggtttatatcctttttccccggaaacggttcggttcccccaaacctcctcaagagcggcccggattgggcccaaagatggcaattcccaggcgttaaaatgggcttaacaagttcaaaattgggaccttttgggattaaaaagggtcagcaggccatgcgcaaggtgtgcaggttggctcgcgaagtcctcgacatcactgctgcggcggtaaggcccggcgtgaccaccgattatctcgatgaaatctgccacaacgcttgcatcgagcgagatgtaagtaccagtcactcttgcatgcacatgtcaagttgcttgctgaaatag

SEQ ID NO: 4349 - DNA, 798 bp, A.fumigatus
gactcgacacataccaacgaagtcgaaaagcatctgatggccggcggcgccatctcgtacctggactgcttcaaacgggtcgaccttcggcggacagagattacgtgctgcgtctggatctctcagcaattgtgtggaaccagcctcatgggctgggcggcatactattacaagcaggctggattcgacaccagccacgctttcgatctcacagtcgggacctttggcctggcaattgccgggggggtaatctcctggttcctgatgccccgtgtgggtcggcgccgactctatctttctggccttcttgtcctattcctcactctacttactgccgggtgtatcagcgtagcttcaagcacacaatggcgcttgtgggctcttggctcttttcttattttcatgaccttcgtatacaacatcaccgtcgggccaatttgctacgtgctggtcgccgagattccttccacccggctccgtgtaaagaccgtcgttctggcccgcgtggcctacaacttttccggcgtgctaatcaactggatgacgccaaatatgctgagtcccgacgagtgggactggaagggcaagtcctgtttctttttcgccgggacgacccttttgtgcctactctggtgctactggaggctaccggaaacctacggcttgagctacctcgagatcgacattctgttcgagaaaaaagcgaaaaagagcaaattccgcgagcttcaggctaatctccaagaccggggctatttcggtctcagggaagacgagtgtccttttcgggggtactga

SEQ ID NO: 4350 - DNA, 270 bp, A.fumigatus
atagatagcctactctttgattgcaaatacaatgatctcttagtgaaggctcaggtcactacggagtattgcgtgagctcacttttgagttctgatgtgtcgcatacacagtcgtctatcgtgtcagctctccatctgtggcacgactattggaataaacccatcacaaagacccttatcccaagcagacttcggtccaacacttcgaacagagctagactcattagttgggtacctagtattgggagaaatgtcatgaatcggcattga

SEQ ID NO: 4351 - DNA, 390 bp, A.fumigatus
tgcggatccttccagccccgtggtgaagacgatggagagacagattccacgcatgatacgtctgtttacgaggacaccatcgacaaatgggcagatatggcaggcgccgtgtacagcggcgtaacttccattactgtcgcctgcaggtgggcaatcaagctgcaaccgagatacgtggattgcgtgcgggagcgcaagcccctagccctggtcattctggcatactactgcgcaatcctccatcgccttcgacacaattggtgtctcgacgagtggggtcctcgggtttcaaaggcgctctggcttgttctagatgagcgttggcgcccgttgatatattggcctatgagagatatctttggccaggcattcgagccgaatttaacctga

SEQ ID NO: 4352 - DNA, 474 bp, A.fumigatus
atgcgagctaaaacaataatgatccgttgcacgacaggggcggggatcttggtcacggacaaccaaagtatcggcgaaaatgttatcgttggcggtctctttgtccagatcatctttttcggtttctttgtgataagcgctttcgtcttccagcgtcggatcactgcccatgcaactcccgagtccgtcgccgagtacattccttggaagaaacatatgggcgcgctatatgcatcaagtattctgatcttggttcgatccgtatttcgagttgctgaataccttcaaggctgggatggttcattgctgcagagcgaagtgttcatatatgtactggacggacttctgatgtggttcgtcatggctatctttctggttgttcacccgagcgagatcaattgcctgttgggtcgcgggaaaatgatgacagccaaagggggtctccaggtctgtgaggctgctcctcctgtttag

SEQ ID NO: 4353 - DNA, 186 bp, A.fumigatus
gctgctcaaggacctgaactgaataaactttacatcttgaatatttctgccgcccctgactttgatatctcttttcgtttctcactctcggctttagttcaacttttactggactctaaaattgcaactcctgcttcttttttggcttggcttcgccttcagtgcacctctcccattcatgactga

SEQ ID NO: 4354 - DNA, 201 bp, A.fumigatus
aaggtgtctttatcgaacctcacacgatgtgatgttcaactgacgctcggggacattggcgataggaatcagtcagattacgagagagggcctatggtcactagcagcatgaagccttgtgctttggctgccattaagatctttctacctgtcttttgtcaatccctccaactcgacccgttattattatcgttaatgtga

SEQ ID NO: 4355 - DNA, 402 bp, A.fumigatus
cctgacactcgatcccaggcttctgatcttgctactacttcacggatccttgtcaccatcgtcacaatctgcaaagactcgggcaactggaatctcctcaatgaccaggtgctcctactttccaagaaacatggtcaactcaaacaggcgacaacgaggatggttcagacagtgatgaagtttttggatgagacacctagcatggatgtgaagttgtctgtgatcgatacgttgcggaccgtgaccgaaggcaaggtaaatgctcctgcccgtcgctccagcactctgtcgctgatgtcctttgcagattttcgtcgaagtagagagggctcgtgtaacacgcattttgtcgaacatcaagaaagtcttcccacggggctggaaggagccgcgccatgtcaa

SEQ ID NO: 4356 - DNA, 339 bp, A.fumigatus
  unsure (280): Identity of nucleotide sequences at the above locations are unknown.
accttgacgatggcgggttcagatgatcaccctgacggactgcccgttgccgtatcttatctggcaggctacatctttctctcctacgttgtcagcacgatggggtgtgcgactaccctcgaacttcttcaccgacggacttcgaagtccggcttatataactggtataatgactactgttcgatgtacagtttcacctggttgacgaacaattacaggtacattctgctcacctcctcaggaaccatgggcggcatcggcatctggtgcatgcatttcnatttgcaattgaagactatgccctggttctctcatctgactagagaccaacattgccca

SEQ ID NO: 4357 - DNA, 186 bp, A.fumigatus
ctgggaccgcctgccggcaacatgcttggaaatctttcgccggaggcccctggccccacactgaagttttttgacactggcttctcgattctagttcctggctttgcacgagctattcgacttctggttctaaaaggtcatagacttgtttgtatactccagtcttcgcagaagtccagaccatga

SEQ ID NO: 4358 - DNA, 417 bp, A.fumigatus
accacgcctgcacaggaccagcgcacaaaaatggcagccagcgaaaagcgccccgagatcatcgcactcgcgcgcgaactgaaagacgttcccatgtgcgaggaatacgagcgcatggtttccggcatgatgtacaatcctaacacacccaaactactcgaggcacggcaccggtgtcgcgggctaacagccgactacaacggcctggatacgaaaacggtgccctacgaacaaatcgccgagaaaaggctcgagctgctccggcgcgtggtcggccgagtgggcgacggcacgtttatcgagccgccgttcatggcagactacggatgtaacatcattatcggcaagaattgtttcattaattggaagtatgtcgatccatgttcacgtcctgcaattttcgtagtgcttgcataa

SEQ ID NO: 4359 - DNA, 372 bp, A.fumigatus
gctgaactgactgggggaatcagtctcactgtgctggacacaagcctcgtcgtcatcggtgaccgggttcagataggaacgaacgtcagcatcatcactgccggccacgacacgagtatcctgtcgcggcggaagaatgtggaattcggccacccgatcttcatcgaggatgactgctggattggtgcgaatgtcgtcattctgcctggcgtgaggatcgggcagggttcgacgattggcgcgggctccatcgtcaccaaggatattccgcccttctctgtggcactggggagtccgtgccgggtcaaacggacgattccatcggcggaggaagaagagcaggatgagacaaatccgttcaggaatctgtag

SEQ ID NO: 4360 - DNA, 438 bp, A.fumigatus
agacaaagagcgtacgctgactctcacagattcctcgctcgtctcacacccacttctccaatggagcgatccaactacttcgtcgaggtcaagcgaccagatgagactctcttcgagattctctatcgcccaacgaccctctcggaagacaaccccgacccggcaccagaagacatcgtcatccgccgcgagcgccagactttccgccgcctaccgaaaacaggcaccatcgtcttcggcgtcaagaccttcctaacgacgctcgacgagctgcccatgcaggaactccagaatctcgcgaaggagaccaagagttggcccgactacgtgggcgagtacaagggccgcgaaatctgggggcccaaggtcctcgaattctgcgagaaccgtacgcgatcattttcacagcagcttgagtcggagaaactggacgtataa

SEQ ID NO: 4361 - DNA, 231 bp, A.fumigatus
gagtcagcgtacgctctttgtctttatgaagctattcaagactacctacttgctaacagaactagcaacctgctggtgccacggatgcacgggattgtgaagctgggagattgtccaaccgatgcgttccttgactgtccagccaacagggatgagactggcactggcggctctattggcggtgtcagtcgggggcaaactgttagcgcttcacttcaacgtacaagttat

SEQ ID NO: 4362 - DNA, 603 bp, A.fumigatus
attaaaaaggagtttctgggccgggatgttccgaaccaggaagattggtgcaattttaaaaaggggttccgggcgagcttgttccagggatacggcccaccaccgtgggggccttcaaccccttcactttggtggacggaaaacccccgatttatctccacgtcggacgacaagtacatgcgcgcctgggagtacgcattcccagtgcccatcaagttcatcgccgagcctaacatgttcgccatgacgcgcgccgcgccccatccaaacggtaagtacgtcgccttccagtccggcgacaaccagatcgtcgtgtacggcgccacggacaaattccggcagaaccgcaagaagagtttcaggggccacaataacgctgggtacgctattgatgtgaagatctcgcccgacggccagttcatcgcgtccggtgacagcggcggctatgtctgtttctgggactggaagacgggcaagatgtaccataagatcatggccggggggaaagagggcggtgccaccacctgtctggactggcatccccaggagacgagtaaagtggttacgggtggattggagggtgtcatcaaatactgggattaa

SEQ ID NO: 4363 - DNA, 183 bp, A.fumigatus
agccaccgcacccaagatgcccccttcatcgattcaccctcttcccccggcagcatcgtcatcatcctccatcccgcgacgccatggtcccacactccctccctccacgctgacgcttactcgctgggcatacctgaaccagatagagcgagaggcgaaggaacgcggcggtacaggcgctaa

SEQ ID NO: 4364 - DNA, 216 bp, A.fumigatus
ctgtcgattttgttacttttatttttgtggggattttggattaattccttcgtaaattgtcgtgtccttttttatagcagaattttcgccctgaacatgcctcaaataggtgcagtgtctatcataaagtgcgtgtcctttaactggcatgcctgtggctatagccactgtgagcgctcctactccgcctttgtcaataactgcatgcaactctag

SEQ ID NO: 4365 - DNA, 1797 bp, A.fumigatus
  unsure (1452): Identity of nucleotide sequences at the above locations are unknown.
agaccccctcggctggtaagggcttggctgtacaaacctcacagtgccacctttctgattttctctatagaccctcccatggaggataactccaacattcgtatcaccaggagcgctcgggctagccgagacgctcgtgctcataatatgaacattccgagcaccccatcatctactaacaataccactcccaacaatctcaataatggccgtccgtcacgcattataacgctgagcacccgcactgctagagccaatagtgcccgtcaggctcaggccaacagtgtccgcgaagctcaagcaaacaatgcgcccgtggccgatactgctaccagcacggccaaccctctccgtgagactcgcacctctcgagcacgcgctgctgctgcggccgcagctggttccactgtgccctctacgcccgcgggcccccctgctccagctccagctgcggcagacagcgtagcatcgacgaatattccagagaccccccggcacaagcgcgtcaaacgaactcctactgttgaagagacgccgaggacgacgaggcagtctgcaagacttaggggcaatatccaacccgttagttccaccgagaagactttctcgaactctcaggctgagtccaaacaacctgatggcagcccatccgccggcatggctcctggtggccggacacggacacggagcagacagatggccagcagtctgaaccagaaaaccggcgactcaacaagagtcacatcctctccctcgaaaaagaatgcgggacgaaatgaagagaacatcagccctctggatacagttgcttcgcagctatccacaagagaccaaatgtctgatctggttgatgaaaaactatcgaaggacaacggtcctgataacgtcgagaataaaatgaacggacccttggacatggaaagcgaggaaaagcacgaacccgagactgtcccaccaaattcactaaaacggaagtctccagagcctgatgacggccgcgctggggagcccaccccctcttctgattccccacgcaagaagccgaaagtggagaacccggagctggaccgcgcgttggaccagcagttacaggaaggcaccgtgatcaacgttgatgacaaagcagcactgcagtctcagtctcctggtggcgtagacgctatttctgccgagggcgaggtcgaagcctccgaaaacggtgctctcaaagccagggctacttctgttgctgccgacgccgatgttcccaatgttcaggttgctgaaatctccgcgttatccgctgccaatgcaagcgataagagtcttgaagttgctgatgctgcggacaatgataccactgctgctagaggatcggcggcgggtgatgagtctcgtcaaatcacagaagaagttgaagaacaagtttctgaaaatggcgtcgaattacggtcagcagtggacgaagccgangtcgtggccgtgggcgtggaggccgtggcatgggagccctcacgcgcggcgggggcgtgcagaaaggggaagggaaaatccaaaggcccagccaagggaaaggggaagggtaaacttgtaaaccgaggccgcaagcggatggggaatatgaacaagaattccggcccagacccgaacctttggggtccccttcttcgaattcaggccaccagaagaagccggacccgccaaggggaactggacaaggggttcaaaaagggaaccgccgcgcacacaactggttttgcttgggttaacccgacttttttaagggcaacttggcgcgggattaaaaacgccctataa

SEQ ID NO: 4366 - DNA, 510 bp, A.fumigatus
acaaaccaatcgcaaggtctcagcgccgagacggatttgctaatgctctattcctgtttagcatctaaaaccaccttccattttgccgccggtctctgctctggcctgacctcctctatccttctacaacccgcagacctcctcaagacccgcgtacaacagtctcagaaaaccgcttctctcctacctactatcaaaacgattctttcctctcctcaccccatccgcggtctatggcgtggcacacttccttcagcccttcgaacgggctttggctcagctctatatttcaccagtctgaatgcattacgtcaaggcttagcgcagacagaggctgccatggccatcgccgcatccagcagtgatggaaaatcccgtacctcgtcctctgcgctacccaaattatccaactggggaaatctagccaccggtgccgttgcacggacagctgcgggtttcgtgatgatgccagtcaccgggtcttcacccggggctgaagggcggccataa

SEQ ID NO: 4367 - DNA, 237 bp, A.fumigatus
cctcgaggcacagtcgacatgaaatttctatcccagtccaggtggttcctacgctgctgtctagtaggagagattgtcccctttgccactgcagaaataggatcatgctccgaaaccgaagaatgccagaccggctgctgctccaaggctggctactgtggttttggtcctgatttctgcggcgatgatgtctgcatctcgaactgcgatgcagtagctgaatgtggtggtatgtga

SEQ ID NO: 4368 - DNA, 240 bp, A.fumigatus
catctttactactcattcgccggaattgatccttccgacttcacaataactactacgcacgataacgacgcagactattgggagaagtttaccgctctgaagcagaaaaagtccactctgaaaacatacatctccgtgggaggatgggaccttggaggcaaggttttctccgatatggtacggtttccgggatcacggagagccttcattgactctgccattgccatgatgaacaaatag

SEQ ID NO: 4369 - DNA, 210 bp, A.fumigatus
cttcaggcagtacttataagtttaatttatatcagcacttggttagcatatccccggctagttgcatggtatttcatccactttcttcctattgagtccgtcctcccttggtttctggctcatttccctcccatttccctcccatttacctcccatttatctcccatttacctcccatttacctcccgggaaccaactcagaacggatag

SEQ ID NO: 4370 - DNA, 267 bp, A.fumigatus
aacgcccgttcttcttattttcctcatcacttaattcttttcaacctttctctcgtcttcacgatttcgtccaaaatgcctgctgttgatgtttcttccgttcctgtcgtctctggcaaagagactgcccaggctgtcgccgttctcgaggacttgattaagaacctcaacatctcgacaagcgctgacgaggttcacgctgccactggcaacctcgccacctacttcagcggtcctatccctgaacagactctgcctctcaagtaa

SEQ ID NO: 4371 - DNA, 231 bp, A.fumigatus
  unsure (187): Identity of nucleotide sequences at the above locations are unknown.
ttgtcaacaaggatattgagcgcttcattctcgagctcatcaagtgtatcgcccaacctgagaacgttcccgagactgttcacttgctcggtgccaccactttcgtttccgatgtcactgggccctaccctcgccatcatggtccctctgcttgaccgtggtctcgttgagcgcgagactgccatcnagcgtaaatccgccgtcattgtcgacaacatgtgtaaactccgt

SEQ ID NO: 4372 - DNA, 654 bp, A.fumigatus
  unsure (489): Identity of nucleotide sequences at the above locations are unknown.
aaatctctatatgtactaatgttcgattcactcagagctgtcgaggtattccagaagcagcttaacaacaagaaagatgccacggctcgtgagcgtgcttgcgaggccatccgcgctatcgcctcccaccagaccatcgctcctggtgttgagccccacctcgtctctcttctcggccccgtcctcgctgcttccggtgacaagatgactgccgttcagaaggctgcccagtctgccgccctcgccatcgtgcaggctatcaacgccaacgctgtcaaggctgttgtgcctgtcattctgaactctctgcagaacgcccagaagtggcaggagaagatgtgtgctctcgactgcctcaactgcctggtcgagtccgctcctgctcagctttccttccgtgtgcctgacctgatccccgctgtttccgaggccatgtgggacacgaaggccgatatcaagaaagctgcctattccaccatggaaaaagtntgcggtctgattgtcaacaaggatattgagcgcttcattctcgagctcatcaagtgtatcgcccaacctgagaacgttcccgagactgttcacttgctcggtgccaccactttcgtttccgatgtcactgggccctaccctcgccatcatggtccctctgcttga

SEQ ID NO: 4373 - DNA, 219 bp, A.fumigatus
tctttgaaagccagacctctaaggagtgtacacacctgtgcgatattcttggagagcaaatacagcataaatttctcgttgttgtcaaaaatacagcggccttctttcacaacttcaaggatagaggcaagattatcatctgtcaaaataatatcagaggcatctttggcgacatcgaacctgcctggcctatcgcgatcccaacatccacatgcttaa

SEQ ID NO: 4374 - DNA, 219 bp, A.fumigatus
gcatgtggatgttgggatcgcgataggccaggcaggttcgatgtcgccaaagatgcctctgatattattttgacagatgataatcttgcctctatccttgaagttgtgaaagaaggccgctgtatttttgacaacaacgagaaatttatgctgtatttgctctccaagaatatcgcacaggtgtgtacactccttagaggtctggctttcaaagattaa

SEQ ID NO: 4375 - DNA, 696 bp, A.fumigatus
cagcacactcgcatactcactattatgatggccgtgggaacaaaatgtatggtcaagcggaatgtgatcgtgcccaagcttgactaccttgaggccttgggtgccgttaccaacaactgttccaacaagacaggcactctcacacagggcaagatggttgttaaaaaagtgtggataccctccaagggcatatactcaatgggtgtgtctaatgagcccttcaatccaactgtcagtgatgtcacctttaccccagtgccacccatgcactttgaccaggagaaagagggtgctcctattgacagccttgagaactctgtggctggcaatcctcgcttggaagaatttctcaacgttgccgctatggccaatttatctcacgtctaccgatctgaacagggtgagtggcacgtgcatggtgaggccacagagattgccatccaagtttttgcctcgcagttcaacttgaacagagaccagtggacaaaggacgagggcgctatatggcaccaaaaagcggagttccagtttcactcgtccgtcaagaaaatgtcggtggtctttacgcggctcgagggacaaacggaatgcagcatggtcttcacaaagggtgcggtggagcgtattgtcgatgcttgcacaagcgtcctctgggaggtctccccagaccctgttgccctgatggatgatcattga

SEQ ID NO: 4376 - DNA, 381 bp, A.fumigatus
caggacaaggcactggaaggggcaaacctgcaatgcaatgaggtcgagcgcgacctctgtttcctcggtctaattggattgtacgatctgctgtgtccagagacagcaggtgccatctgcgcctgttaccaggccggcatcgctgtgcacatggtgatgggagatcacccaggaacagcaaaggccatcgcgcagcaagttggcatggtcctggctaatctttcaactgctgccgcggatgtggctgatgtgatggttatgaccgctggtgagtttgacaaactcatggacgacaatgtcaatgcccttcctaccctcctgcttatcattgcacgctgcgcaccccaaaccaaagtctggataattaacacgctctactga

SEQ ID NO: 4377 - DNA, 603 bp, A.fumigatus
tgcagaggtatgctacttctagtctgctaccgtggcttgtcatttgctcgcacatctgaccctgttttctgccgcaaaaagtctccctggcaaactttacgacaagatgagcagatgagagcggatatatcccaggatgttgatcgatgcttacaagagaactacttcttccgtgaacccgccaccaaggcgaaaatgattgatattctgtttatctatgcaaagttaaacccagatcttggttaccgacaaggaatgcatgagctattggcgcctattctgtgggttatacacggggatgcggttgatgggaaggtgctcgaagagtcttcagttaaagaagagggagatgatttgatgctgcacttgctcaactttgactacgttgagcacgactctttcgcgctgttttgctctgttatgcaaactactcgagtgtattatgagcataacaaagaacgctctgccaacggccagatggatgagatacctattgtcaaccagtgtcagcacattcatcagaatctcctgacgacaacagacctcgagttagccgatcatctacaagcgctggaaattctgcctcaaatattcctcacgtaa

SEQ ID NO: 4378 - DNA, 279 bp, A.fumigatus
ccgcacacaacaacgacgtccaaaatggcctgggctccgagagatacgctccgcccttttctcctcgttgctcgtctattcgcatggattagtgctgtcattgtcatggggatcacagcttgggccgtgaccaagagagacggctaccgagtgatctatccgctggtgattgtaggtctatcgcgctatatgacgggaactatgttactgaccttggcaggccgttctaacaaccgcgttttttattcctgcgatgatagtatcagctatgaaacgtaa

SEQ ID NO: 4379 - DNA, 1818 bp, A.fumigatus
attctcttcggttcactagcctcagcgttccagggcatatctctgggtactatgccctatcatgagttctatcacaaactgactaagaatgtgctttactttgtgtatctcggtattgccgagtttgtcacagtctatgtcagcaccgtgggtttcatttatactggcgaacatctcacacagaagatccgtgaaaactatcttgaggctatcctgaggcagaatatggcttacttcgacaagttgggcgccggtgaagttaccacgcgtatcactgctgataccaacctgatccaggacgccatctctgagaaagttggtctcactttgaccgcattcgccacatttgtaaccgcatttattgtcgcctacgtcaagtattggaagttggctctgatctgtacctcaactatcgtcgcgctggtcatggttatgggaggtgggtcgaggtttattgtgaagtacagcaagaaatctattgaaagttatggtgctggtggaactgtcgcggaagaagtcatcagctccattcggaatgctaccgctttcggcactcaggataagctcgccaagcaatacgaaacccatctggctgaggctgaaaaatggggcgtcaaacaacaggtcatccttggtatgatgattggtggtatgttcggtatcatgttctcgaactatggtctcggtttctggatgggatctcgcttcgttgtcggtaaagaagtcaacgtgggccaagttctgacagttttgatgtctatcctgatcggttcgttcagtttgggcaacgtcgcccccaatggtcaggcctttacgaatggtgttgctgcggccgcgaagatttacagcacgattgaccgcagatcgccactggacccctattctgacgaagggaaggtactcgaccattttgaaggaaatatcgaatttcgcaatgtcaaacacatctacccttcaagacccgaagttacagtcatggaagatgtctctttatcgatgcccgccggaaagactaccgcattggtgggcccatctggctctggaaagagtactgttgtcggcttggtggagcgcttttaccttccagtaggaggccaggtattgctggacggccatgatatccaaaccctcaacctccgttggctgcgacagcagatctctcttgtcacccaggaacctgttcttttcagcaccacgatctttagaaacatcgaacatggcttgataggcaccaaattcgagcatgagtcgaaggacaagattagagagctcgttgagaatgcggccagaatggccaatgctcatgattttattatggctctgcctgaaggttacgatacgaatgtgggtcagcgtggcttcttactttcaggaggtcagaagcaacgtattgccattgctcgtgccattgtcagtgaccccaagattctgttgcttgatgaagctacatcagctttggataccaagtccgagggcgtcgttcaagccgctcttgataaagctgccgagggtagaactaccattgtcattgctcaccgtttgtcaacaatcaaaacagcccacaacattgttgccatggtcggcggaaagattgccgaacagggaacacatgacgaattggtcgatcgcaaaggcacgtactataaacttgtggaggcgcaacgtatcaacgaggagaaggaagcagaagctctggaagccgacgccgacatggacgccgatgattttggtcaagaaggggttactcgcatcaagactgcagttagcagctcgaattctctcgatgctgtagatgagaatgcgcgcttagagctgaag

SEQ ID NO: 4380 - DNA, 591 bp, A.fumigatus
cagttgggaacagcaattgatttcctttacgaagcgtccaaggccaacgaggacggtacagaccatgtatttctgcatcaagcgattctgaacgcgaaaggagcaacccagcttgactgcgtcaaaaccgccgagcttaatggaggtatcacgcgtcgagtcattctgaccaaagaccctgagaacatcaaagctatccttactggacaatttgccgattatgggaaaggtgaggaattccatgaacaatggaaagactttctaggtgacagtatcttcgccacggatggtgagctctggtcccgttcacgccatctcatccgacctatgtttgtccgggatcgcatcgttgacactgaaatctttgagaaacacgtccaaaacttgattcctctgttggaagggagcaactcgcccagtgggagcaaggccgtcgatgtcggttctctgtttttccgcttcaccctggacgcagccacagattatctcctcggccaaggcaccaacagtctgcacaatccggagactagatttgcagaggcctttggatatgtgaagcatcgccaatccgagatctttcgtttagggtaa

SEQ ID NO: 4381 - DNA, 903 bp, A.fumigatus
cttaacacaagtgatggaattagcatgttcagcttcatcgtggcgaagaggaaattccgccgggaactcaaagtgatggatgacttcttccaaccatacatcaaacgagccctctctctgacaccttcggaactcgaccagaagatctccaagagagaaaccttcctggacgccctagcccgcttcactcgcgacccgcgcgtcctccgtgaccagatcgtcgccgttctcctagcgggccgcgacaccacagccgctgtcctgaccttctgtatctttgaactagcccgcaaccctgatgtcgtcgccaaactgcgcgaggagatcagtgcccgactgggtctcggcccctcggcccagaaatccagctacaacgacctcaaggagatgaagtacctgaacgccgtcctcaacgagaccatgcgcctctacccacccgttcccttcaatgtccgctattccctccgtgacacgactttgccgcgcggcggcgggcccgacggcctctcgccagtcggtgtccgcgccaacacacgcgtcatctactcgacgatgatcatgcagcgaagcgcagaaaactacgaccccccgggctcgcctaactacttcgatccagagaaatggttacctgaccggtggctgtctgggtggcagcccaaaccctggcagtatatccccttcaatgggggcccgaggatctgcctcggtcagcagtttgctaccatcgagatgggttacaccgttgtgcgtatcctgcaggcctttgagaggatccatgccatgccggccaatgggaaggagcgggttgaggacccagtgctgaagtttgaggttacgctttaccctgggttcggaattgaattgtgttttcgtgcgagaaggcgaagatactttaccttttga

SEQ ID NO: 4382 - DNA, 1128 bp, A.fumigatus
  unsure (102): Identity of nucleotide sequences at the above locations are unknown.
cttctttcatgcatccgggtgtgttgttccgtttgcgcaatcatcatgcccgagagccaacccttggaagaacgattgctgaagcaaaaaagagagagcgcncaagcaaagcagaaagtagcgtacgctctggcgatgtacaagcggacatttctccaatcacctcgtctcactcaagcaatccgtaccctgtgtacacgtcatccattgctgtcgcctaccgtccgcttactcaaacactggttccattgtcatctcttcaaaggtcatgtatgcgacgagttgatggagttgttcgcagttcgggtattcacgcagtcgtatccatgggatacgccgtcaagtgtcatggctggcttcctgagaaccctccatctgctctcacggtgggattggcagcaagagccgttgatggttgacttgggcggccagttagatcaaaatgcagttgaagtgatccgcacgcgttttgacgcttggcgaaagatcgatccggcgatgaataatgtcgctctgtttgtggcttctgatattgatactgacggaatatcctggacacagtatgagatgccttcgaaggttgtggcagctcgcatgtcctctttggcaaaggcggctgtgagattgatgcgggaaaaaggatatgccctcgacgtttcggacctttttcatacatctttagcaccttacgattttgttttgagtttacggtcgaaagcactcacggaagttctagcaccaccaccaccatcgtcatcatcatcatcatccaaattcaagaatctgcaacaacagatcattccagagcgagccgataggctcacagtggccagaacatttgttcgcgaattgcaggcgtgctttagtccaaacattctgttctttcatggcgatgagcagtgcgacgtgattgcaggcctctggaacccatctacggtcaagcccaaggtttggagcctgaagatgacatactccacaaaacctgttgccctggtgaaaccggaggtgaagggcagtgaagatgtttccatcaaccaaacggctatcttgaacgaaattgcgaggttaggggcacatttgattgaagggatagatgtgtacaacgaagacgcggaaaatagtgcttaa

SEQ ID NO: 4383 - DNA, 216 bp, A.fumigatus
gaagatcattgggcggtgatctgtattggaccgagtcatgatctcatccgtcgcctgactgggaatagtacgtactacggtcgcacggccattggctggtacctgggtcttacaactctttacagtcttcctctcagaccgtttcgcctgctggactttggggagttatggcccgtgacttacattacagctttcactatagaatcctgtccttga

SEQ ID NO: 4384 - DNA, 255 bp, A.fumigatus
cgacaccagaccagtcaaagccttgacatcaagagggcagaagacctctcctcagtagagctcctgaacccattggggtcgctctatcctcacgtcgtcgccctccaactccaatccgacgataccccatggatccgagccaaaaactcgcctggctatcgcgaccccaattcctggatagacgtatactccaccgaggattattccaagccgtcggcgcgcagaaactgtggtgagtttatccatcacatttga

SEQ ID NO: 4385 - DNA, 819 bp, A.fumigatus
  unsure (580): Identity of nucleotide sequences at the above locations are unknown.
ttccacggtctggatccttccgtcccgtggagagcactcctgctcgaccaagtcctcaacgacttcaacgggctgcagcagtacgccctggtggacatcaagtatgcggcgcgagtggccgacaccggactctcggacgacgaggccgccacgatccccgtcaacgtcgccacgggcttcgtggtgttcttcgccgagagcggcttcggcctgcctctgcccgacagcggcgtcgactttgactatgcatcgcagaagctagtggtgatcggcgcggcgaccaactgcggccgctatgcgatccaatttgccaagtggctgggctttggggttatcgtcgccgtggccgggctacggacggcggaggagctaagggagcttggagctacgcatgtggtggatcggcatgcggacgatgtgctcaggcaagtgcgggatatcgtgggcgatgagctcgtctacgcgctcgatgcgttcaatttcgggcccaagcaggagctgggggttgcggtgctttcggactcgcggcgggggacgctggccacgctggcgccggcggttggggagctcgatcgcgccnagattggagagaagcgggcgggatatgagaggcggtttatccggggttcctgtgccaatcattcggatgactttacgaagttgttctgggagaggattacggggtggttgaaggcgggggtcatccggccgagtaggtttcgggttattgatgggttggatgcggatgagatcaatgctgcgttggacgagtatcgtgatatgacagggatgaaggtgcaagtccatcctaatgtgtga

SEQ ID NO: 4386 - DNA, 549 bp, A.fumigatus
tcacaaacagtcgtgacagaagccgtggcagttgcgctgcacgattcagaagttgatgtctcttcctcctcagagccgccaccacctccttcctggagacagctccctagacgcgcaacagaaaagttatgtcagcgtcatgcacgatgggcgaactatgatatcggtgcttggttattgaacactgttgactcaccagatccgcatcctgggccgcaaccgagaagaccacaccctcccccgcagaatcctaagccacagcctccatcacacccaaagaaaccacattcacccccacaaccaaagagggaacaatcgatctttccacaaccagtggtctcgcctccagaactacatcccccattcgagggtgccttcccgtcggagtatgtgagtatggggatacttgttccaggcggttggattgatgtcgctgtcggctgtggcgccacggtaataacatgtgaattgccacagaaggtcacggggatgggtgtatatgacgtggtactcgtagctttagcaacagcgacgcctgatatgggttag

SEQ ID NO: 4387 - DNA, 213 bp, A.fumigatus
  unsure (26): Identity of nucleotide sequences at the above locations are unknown.
ccccctccccgcattaatttggttcngggcggctaccttccatccccggcgtgtacacacgctgtccaaagtggaattgtttccgattgtacagagttctataaagcaatcgccggcgatggatgctatgccattgcaaccgcgcacgatatcacacttgcgcaattcatcgtaagttatgcgagactaaggaacaccattaatccttactga

SEQ ID NO: 4388 - DNA, 648 bp, A.fumigatus
cataacttttctgttgcgcgtctagggagctgtctccaggaaggaggtggtggcggctctgaggaggaagagacatcaacttctgaatcgtgcagcgcaactgccacggcttctgtcacgactgtttgtgactatgcctgtccagacggagcatcgacatcctgtgccactctctgcacctcgttgactattagctgtgagcctaccgggttggttaatttcgcaccgggcactgtggacgcagacgcgctgccactcacattacttgaggcctccgatgaggccatgacatccgctgccgaatctgtagcatcctggttgaaccccaaatacactagcctagatcctgtcatgataagtggcaccaccatcactgcatccgctacagcgcccgcggtgacgacgtctgcttcaatcacctccgccactgctatctcggcctcctcttgtgatatcaaaagcaccagctcctcctcctactgctcatgtgatggaggatatggcgtgacactgtcaaccaaagctaacaagtccaaaaccaccttcctggtctgtgatgtcactccagccctgacaatttccactatcaagccgacgacgaccagcaccaaaccgtcttcaccacgggggtcgaaggatccgcgctaa

SEQ ID NO: 4389 - DNA, 519 bp, A.fumigatus
ctccatatgataggtgaatcgggtcttggaaagtcgactctcgtcaacactttgttcaacacctccctctaccctcccaaggagcgtaccggcccgagtcatgacatcatccccaagacagtatctatccaatccatcagtgcagatatcgaggaaaatggcgcgcgtcttcgcttgactgtggtcgacactccgggcttcggtgattttgtcaacaacgatgactcgtggcgccctatcgtcgaaaacatcgagcagagatacgatgcctacttggaggcggagaacaaggttaaccgcacaaacattgttgataaccgtatccacgcctgtgtctatttcatccagcccaccggccactcgctgaagcccctcgacattgaggtcatgcgtagactgcacaccaaggtcaacctcattcctgtcattgccaaagccgatacattgaccgacgaggagatttccctcttcaagcagagagttagtagcccacgcttttcatcgatcctgggtcagtaa

SEQ ID NO: 4390 - DNA, 228 bp, A.fumigatus
  unsure (176): Identity of nucleotide sequences at the above locations are unknown.
attctcgcagatatccagcaccattcgattcagatattcgagggaccccgctatgagcttgacgacgaggagaccattgccgagaaccaagagattatgtccaaagttcctttcgctgttgttggtgccaacaccgaggtcaccacagctgatggccgtaaggtgcgcggtcgtanctatccttggggcgtcattgaggtcgacaacgaagaacactgcgactttgtt

SEQ ID NO: 4391 - DNA, 663 bp, A.fumigatus
agcgcggttccttccagccccgttgtgaagattcgagattcttttgcatcgagctacgttgttgtgccgacctctccgccaactccccgtcaattatcacttgtcatcctcctgagttctacttgctacaacaaaacgatgtcggtggcctcggagaatcccactgtggaggagcatctaccattggaatctttgagcccgaccatcagttcgctgcaacagaagccgggatcgacgaccctttcactatcctctctcctgccagggacctatccgtctcgaagtgaaagccgaatcccatatgactttgctgactcttcttcggatgatgtagcttcaccatcctctcctgccaatggcactcccgcatctgtcaaggaatcacctgcacctagcagcccaggatctccttacgttgagcgtagcaaccccatgggtgctggcaacgctcagacagttagctctaaggatccaaaagctgtggctcaagctgccacggacatgaagaacgtcgttcgccgcaaactgactggctacgttggtttcgccaatttgcccaaccaatggcaccgcaagagtgtgcgcaaaggattcaacttcaacgtaatggttgttggtaagtttcgtccgaatggtgttcggaagcgaagccaattccgataa

SEQ ID NO: 4392 - DNA, 555 bp, A.fumigatus
tatgtgactgcgtgcttccaagtcaatctggggcaggcatatctcctgagaggcttctatttcaaatactgctggttgctgaccttatggctaagtatgttctgctggtcggcatccttttatccgcagcctatcagtaattttcgacgacgttcaactgtcgggctggccattgactttcccacaatcaacgtcctgggcttcgtctgctatacagcatatacatctgcctttctttactctcctgtgattcggcggcaatacgctgcccgtcacccttcggatgaggagtcgacagtgcgcttcaacgactttgcctttgccttgcatgctgtcatcctcagcacgttagtttacacacaattttggcctaagatctggggtttcaaagtctcccgcttccagaccgttagtaagccggttcttggcctcttctggggctccaatgcagcaataggtatagtagtttgcattgtgttggttaagagccctgacggaggatacgatccatccacctgggcatggatcgacgtggtaagtggtttggacgattga

SEQ ID NO: 4393 - DNA, 603 bp, A.fumigatus
cgacctaagtcatcgcggatcggcaggcccgtggtgaagatgtgtggagcttttggcatgtgcgtcagccagcttatcgtcgccatcgttggcactgccacctcgtccgacgtgggcaacaaagtcctgatcgccttcgtctgcatctacatcttcttctgcgcctgctcctggggaccggtggcttgggttgtgactggggagctgttcccgctcaaggcccgtgccaagtgtctctccatcaccaccgccaccaactggctgctcaactgggccatcgcctacgcgactccttacatggtcaacagcggcccgggcaatgccaacctgcagtccaaggtgttcttcatctggggtggcttctgcttcatcgcgtttgtctttgtgtacacctgcatctacgagaccaagggtctctctctcgagcaagtcgacgagctgtacggcaaggtctccaaggcctggaagtcgagtggtttcgtccccacggtccacttcaccgatgtccgggatgtggccgaaggacaccagaaggccagtctttctcagcttgaggttgatgctcaagagaagcacaagctggaacatctggagaaggcgtaa

SEQ ID NO: 4394 - DNA, 498 bp, A.fumigatus
ctggggagctgttcccgctcaaggcccgtgccaagtgtctctccatcaccaccgccaccaactggctgctcaactgggccatcgcctacgcgactccttacatggtcaacagcggcccgggcaatgccaacctgcagtccaaggtgttcttcatctggggtggcttctgcttcatcgcgtttgtctttgtgtacacctgcatctacgagaccaagggtctctctctcgagcaagtcgacgagctgtacggcaaggtctccaaggcctggaagtcgagtggtttcgtccccacggtccacttcaccgatgtccgggatgtggccgaaggacaccagaaggccagtctttctcagcttgaggttgatgctcaagagaagcacaagctggaacatctggagaaggcgtaaatctgtttctttccctctagtccttttgggagcatgcatatttggttcattggcacttcttacggcgcatatggagatacctggattgtga

SEQ ID NO: 4395 - DNA, 480 bp, A.fumigatus
ttgtgtcgctggtatgttgcagcccggccctggcggacccgatcgcatttactgatatcttggtcgcataagatcctggtcgtcgtggccaccgttttcctcacgcaatgcgtgcaacatggctttggcaagaatctcctccttctcgtcaaggaaaaaccgcacgatgtccaactcgtcctgaagtacatcgccatccaagtgccgattgtgaccatcagcaccaccatcgcccgctgctccttcgttctctacctcctggccattctcggaaacaataaaaagtaccagatcgcgttatggacggtgatggtgctgcagttcgccggcaatgtcgtctcggctgtgctgccgctgagcatttgtcgcaatgtgcgcattctctgggaccccacgacgaaaaccacctgtggggatgtccacgccgtcatcaagtttgcctactactccaacagtaggtctccattgctgtctccatga

SEQ ID NO: 4396 - DNA, 186 bp, A.fumigatus
cgggtgatagccgcaaactcggcctgtgacctgtttctggccgttttccccaccctcatcttctggaatctcaacctgaagatgcgcatcaagatcagtttgatcatcctcctcagtctgggcattctgtatgttgcatccccccctcctttgatcatcatgatactgacccgtccagtgccatga

SEQ ID NO: 4397 - DNA, 801 bp, A.fumigatus
ccaatgtcatcccaacctctcccccgagtcctcttcttcgacgtctttggcaccgtcgtccaatggcgcacctccgtctccgaagctctccgtgacgcagcacagagcgcactccgagacccagagaagaatctccccgacgccgtgcgcgccaaagcctcgtcaatgactcaatcggactggcttgacataacccaagaatggcgcgagtcgtactaccacttcacccggaactccgatctatcaaagcccttcgtctccgtcgatgagcaccactactcgtacctcctcaagctccttcaggcccacggtctcgagaccctgttcaccgatgctcagagatgggatctcgcgctgagctggcaccggctcgccccgtggccggatagcgttcgcggcctggagctcctgaaccgcaagttccgcacctgcaccctgtccaacgggaacgtggcgctgctgcaggatctctgtcggcacggctcgctgcccttcacagaggtgctaagcgcagagcactttggggcgtacaagccgtcgccaaaggtctacggcggggctgcggagaggttcggactggagccgggagagtgtgcgcttgtggcggcgcatctgggggatctgaaagctgccaaagcctgtgggttccagacggtttatgtggagcgtccgaaggaggagacgttggacatggagcaggcacgggaggagggatatgtggatatctggattgatgcaggctgcgacggatttgttgaacttgccaggcggtttagccttgatatcgaggccaaggcgtag

SEQ ID NO: 4398 - DNA, 279 bp, A.fumigatus
accgcctggcaagttcaacaaatccgtcgcagcctgcatcaatccagatatccacatatccctcctcccgtgcctgctccatgtccaacgtctcctccttcggacgctccacataaaccgtctggaacccacaggctttggcagctttcagatcccccagatgcgccgccacaagcgcacactctcccggctccagtccgaacctctccgcagccccgccgtagacctttggcgacggcttgtacgccccaaagtgctctgcgcttagcacctctgtga

SEQ ID NO: 4399 - DNA, 495 bp, A.fumigatus
ccagcggcactttcgcagccctcaacggccttttcgctaaactgtatgtccccaagttcttctaatggcaactcgcattttgaagcagatcattcgctgataggagtcagaacaaccgatgagcaaaccacagcgttcaccaggagtatctcgcatctcttcggcgcaggggatcaaaatacgtttcttgaattgttggttcgaggtgtacgtctcccctacctttcctgcgttttgaaggatttgtttgactttgtaaaggtttgtctgggactcaatgtcctgtgtaacattatcatgtgggccctctttacgagagcgttgaccgcgtctccctccacgaccaaagtgtccatcactaacacgtcggcaaactttctcatcacggcgttgctgggtatgattgtctttcgggagaaggtgagtgggctgtggtggttgggggctgcgatgatgggtggtgggtgtattttggtcgggatgagggattcatga

SEQ ID NO: 4400 - DNA, 336 bp, A.fumigatus
aagaagtgcacagtctacgcgccaaggtgggtactatttccaggccttgattgccctgttttcctcggtctggcgcttacaactggttcaggtatcgttgttgctgcctataatctgggatgtttcgccggttcgattcccacaatctgggtgggtaattggctgggtcgccgcaagacaatcttcctcggttctgcgatcatggtggtcggagcgatcttgcagtgtacatcctaccatctcccgcagttgatcattggtcgtttggttaccgggtttggtgagtttatccgcttaaacagggatatccccgactcaagcagatccatgtgctga

SEQ ID NO: 4401 - DNA, 507 bp, A.fumigatus
gcagtttggtcgtcggtccctgatgttgtttggggccgctgggatgtcgatctccatggtgatcctggccgtcactgccagtctcggcaccgatgcatccaaagtcgcctgtgccgtcttcctctttgtgttcaacaccttcttcgccattggttggttgggtatgacctggctgtaccctgccgaaattgtgcctctgaagatccgtgccccggccaatgccttggctacgtcctcgaactggattttcaacttcatggtcgtcatgattactcccgtggcattcgagaacatcaaatggcggacctacattatttttgccgtcatgtaagctacccttactctctggttccggtacagacgctaacccctgacagcaacgcggccatcttccccgtggtctacttcttctaccccgagactaccagacggtctctggaggaaatggaccgaattttccgaaagaacaggagcatcttctctgtggttcaggttgctacggattga

SEQ ID NO: 4402 - DNA, 432 bp, A.fumigatus
gtttgggatggatctatcttctctggcattggcgctttccgcgagcgatatctgactgttttctcgactagttacgatcaaggtgtcactggtggtcttttaaccttggagtcattcatcaaatacttcccaacgatcgcccttaacggaccttattttgaaagcctgagcccgtctgaaagaagtgcacagtctacgcgccaaggtgggtactatttccaggccttgattgccctgttttcctcggtctggcgcttacaactggttcaggtatcgttgttgctgcctataatctgggatgtttcgccggttcgattcccacaatctgggtgggtaattggctgggtcgccgcaagacaatcttcctcggttctgcgatcatggtggtcggagcgatcttgcagtgtacatcctaccatctcccgcagttga

SEQ ID NO: 4403 - DNA, 996 bp, A.fumigatus
acagggatatccccgactcaagcagatccatgtgctgattcagatgacacaggtaatggtatgaacacctcgacagtgcctacatggcaatcggaatgctgcagatccaaccgccgtggtcagatggtcatgatcgaaggtgccatgatcacttgcggcattaccaccagttactggatcgattttggtcttctgtttgcggaccccaacgaagtggcctggcgtttccccttggccttccagatcttctttgcagcgattatcctggctttcgtcatgtggcttcccgaatcaccccgctggcttgttctcaagggccgcgaggatgaggcgaggcagactctgaccgctttgctgggtcacgacgccgatgagacttttgtcgacaccgagtttaccgccatcaaggctaccgtcctggagatgagcaagggttcgttccgcgacatgttcaccatgactgaagatcgccacttccaccgcaccgtgctcgcctacgtcaaccagatgttccagcagatttccggaatcaacctgatcacatattacattcccgttgtgctggagcagcagctgggtatggacatgatcaagtcccggctggtggctgcttgcaacggaacggaatacttcattgcttcctggattgccgtgttcaccattgagcagtttggtcgtcggtccctgatgttgtttggggccgctgggatgtcgatctccatggtgatcctggccgtcactgccagtctcggcaccgatgcatccaaagtcgcctgtgccgtcttcctctttgtgttcaacaccttcttcgccattggttggttgggtatgacctggctgtaccctgccgaaattgtgcctctgaagatccgtgccccggccaatgccttggctacgtcctcgaactggattttcaacttcatggtcgtcatgattactcccgtggcattcgagaacatcaaatggcggacctacattatttttgccgtcatgtaa

SEQ ID NO: 4404 - DNA, 366 bp, A.fumigatus
gaatcattcatcagcacccgcatcgtcatgagaggcagcaatattctggaacaaataacattaatctttgtgattatgataaattcaaccttccaaataggcatcatttttgtagtgctgaatatccttcttgatctccttgtagctaggtataaatactttgataacggtaccagtggcggtggatggtctcctatacgaagcggcactgaacccgacgacccttttgcttcattctccagcaccaacatcattaccgtcaagacgattcatagtccttaccactgtctggttaaggaaaacatcatcatcgacataactaacaataattatagcaaagaaagtggacttttaagcctcttctaa

SEQ ID NO: 4405 - DNA, 345 bp, A.fumigatus
ctatcttcctttctctcgctctcctctctcctactctctccccccctacttcgaacttctctccctcctacacaacaaccttctcccaacttacgtactcaaactcaactttccatccacttcccctctatctcgtttcacccctccatcagtcttatatctctttctcttctctttaatttttctttttttttcttctctgtagttttccgtcttaatcctatttctgtcaccatggaaggtacgtggtttcttgacacctcaacagctttgcttgggttccctgccaccaaacaaccccccgttccaacccccctcctgctcgcttgctctacacccatatag

SEQ ID NO: 4406 - DNA, 573 bp, A.fumigatus
  unsure (531): Identity of nucleotide sequences at the above locations are unknown.
cctccctgtttcagggtgatatgggggatccttgagttctctctgggcatccagttgtccgacgaggacattaaacagatcagacatatcctggacgttgcagaccggatcttcgtcaacaccaaggactatttcagctgggaagtggagcgcgatcgtgacccgagggggcaaaacacggtcaagacagtcatggacagcgagggtaaatccgagcagcaagccaaggagaaactccgagtcgcgatcctggaggacgagcgaaagtacaaactcttaatgaaacagttcgcactttcaactctagatgccccggcacatgtgcaaagattcctagtcatgcttgaggtgcttctcggcggccatcatatctggtctgctgcctgtggaagatacaaacgtcgcgctccatctgtggggaatcccttccttaggagagaaagcatcataccaaacagagtcgaggacgcgaatgagagcgccgcgagtcccgtagccctgggcaattcggctctcctggatccatcgcantacatccgtcttcaccagccgccctggaaaataaagaatcct

SEQ ID NO: 4407 - DNA, 420 bp, A.fumigatus
cggtatcctatcctggtgttactggccgaggtggaggctaaccttgcggaggaagatgtcagagacagagacgagctcgggcataccaccgattatcataaaatggctgcgtcggctttacgggcctccctaggagtcggtaccgtgagctccatgcacggcttgaaaggaaatgcattcatgtcgaggcacctaactgcattcatgaccaagtacggggcggccggcaaagcgctcatggcaagatgcttggacaactgggtccagccgcaggagtcacgagtggaaacagagcctgtcaattttgaggattctgtggcccgccgagtcgtgactgtcgggacaaggtatgtcttcttggccatggcagaaagtgcatccctaacctccctgtttcagggtgatatgggggatccttga

SEQ ID NO: 4408 - DNA, 240 bp, A.fumigatus
  unsure (43): Identity of nucleotide sequences at the above locations are unknown.
aggattctttattttccagggcggctggtgaagacggatgtantgcgatggatccaggagagccgaattgcccagggctacgggactcgcggcgctctcattcgcgtcctcgactctgtttggtatgatgctttctctcctaaggaagggattccccacagatggagcgcgacgtttgtatcttccacaggcagcagaccagatatgatggccgccgagaagcacctcaagcatgactag

SEQ ID NO: 4409 - DNA, 1812 bp, A.fumigatus
  unsure (185),(250),(255): Identity of nucleotide sequences at the above locations are unknown.
ccgaacttgtacaacccagattcaagtttattcttcaggaaacggtatcagtttcggcccttttcaccggaaacctattccatgcctaagaacttcccggattgcctgttcggccccatccccatggggaatcttaagctgcttgtcagcggaaattatatagtgtgggcgtccggtgtcagtgngaaggtgtatgtatcggccttaaaccctttctcacagtcatgtgcatatcagtgcttgggtaaanctggnacaagtgtacagacacgagaggctcggcgatactccacatcatccagttccactgatccggatgcatctcgcaacgactccccacatggttcagccgtttcagattaccctgtggtggcgcttagaggacgatggctagcaatagtgccaccatcctcaacttatagagcctctatttgtggaagggtgcccgcctcacttattcaaggcaaagcttttgggctcgagacgcgtagtcctccagccaaaccgccagtcacctccgcaacggacgttggcgaaggtgagagcctctttgacaaagtagcaaggggtgtcacacaagagctggtacgtggcgcccgctggatgggtgaccaagggcttcaagcttggaacagttactggaataaagaccagtctcagaacacgtcctcgcgccgatctccaaattttatggatttgccgcaacaaggatacagtctcttccctccaacacacgcccaggaaactcaaactacttcctctacagaacccgattttgtctcaatcctggatttgagacgattggatgatggcggcgaggcaaagaatgctattctcaatcccatcgttaccttccaggcccctaatggatgtagcttcttgtcattctcccctaatggtttgatgttgctcacggcgagcaagaagggggatgtacagtacgtttgggacttgatgcaagccaggcattgccgggcaggggtcttcttttccgaggactccacaccgccatcagccaatgtgcgacaagttgcgcggtttgcacgtcttactacgtcttctattgtcgacgtgatctggtccccgccatccggggatcgcctggcagtgataacccgcaagggcacagtgcacgtttttgaccttcctcgcagtgctttccagtggcctccgttccggcgagctcgtccccaaccccacaagtcacaagccaacaattcccccacggacgaagcgactgacagaggggctgtgacgaatccgctatccgccgctttcaaactcgttggtgggaaaacacagcctatcctggctgcagttagaggtcgcactccttccgctagctctgcatttcctgcagtcagtgcgttcgcaatgccctccgcagctggagtgcgaagcggaagggcggttgctgctggcctgagcaaatccatgggtgcagcaactggtacagtcaatactctccggcacgctggtgaaaatagactgcatctttccggtctcgcccgtgacccagccgcgttccgcgttgtctggatttcgaacaaagggcagtctttcctgggtgtggtaaacaatggattctttccgctgtaccgggtcaaaagatccatgtcttctcacaggaatcgccaactgcagtcggttattggaaacaaggaaattgagtacaagttgcctgcaaaccttcaaattccatgcggtccactgctgattgggaaattcgcccatgaacacactgtttctgccatcttaactctgccgtcctttaaactcgccggcccaccaatacctccaagatcagatgcc

SEQ ID NO: 4410 - DNA, 285 bp, A.fumigatus
gacacgttttttattttagcacagggaatgcggtgcacaaaccaacagattctaggcaatctggccattttggagttcgaggagagtaattttattattagcgctaatgctctttttaccctgactttgcttttgcaagaggggtacggctccatgactggtctgtgtgtgacaacgattttgcatcacttccagtacgtactactcctggcaggctgcatcaagcaccgccttcattttctgctgcctgtcattgctggaccttggttttggcgattacaatga

SEQ ID NO: 4411 - DNA, 1002 bp, A.fumigatus
ggggaggaaatccgtagattattggccacggaggacgaactgcgatcaaaattatatctcactatgtggttttcaaaggaaggattcttgtggattcccgtgtcaacaaaagaaggcctccgtaccgatgcagtgattcaaaggtccgtccatataaggcagagctacgatgtcattgtcatcggggccggatttgcggggctcattgcagcacgcgacctcagccaaaagcatcacctcaaggtcctcattgtggaagccagagatcgaattggtggtcgcacttggacagcgcaagttcttggggaagaaatggagatgggaggaacctgggtacactgggcacagccccatttgtatgcggaactccatcggtatgggctgcaccgcaaccttaaaacctcctctggcacctattcccctgaaaagcagttcttcaagcaagctgggaggccggtggaagagatatccttgaacaaagcagcagaagcacttgaacgcgttgcacagatgttcttcacagttgacagcactgacagccgtgggcttatgccgtatccgcatgaccctttacgtgaaccggccaaatggaagcaatatgatcattggacggtaaaagaccgacttgatcgtttagagggcctacctatgtgggaaaagcagctttttgagtcaattatcagtacttttggaagtgcgcctggaaaggacattgggtttacggaggctctgcgctggtttgctctaggtggacacagcatgaaaggtgttttcgatttagctggcacatacaagcttgggaatgggggcatgacctctcttgctagagcgattctggacgagttcctcggtgatattttgctgaatacggcaatcaaggagatccatcagagctccccaggaatcaaggtagtgacggcagaaggccagcaactgaaggcgaagacggttatttcgacaattccactgtatggcaatctgtccctttgcatagaaacatga

SEQ ID NO: 4412 - DNA, 615 bp, A.fumigatus
  unsure (553): Identity of nucleotide sequences at the above locations are unknown.
tttcactcacgatactctgtcagaaattgtctcggagacgtcaatttcgatccgccactctctccagtccgtgaagcagctatcgcccgaggccacatcaacaaaggcgcgaaaatccatttcaagttaaagtccactgaagcaggatggttcgttacgaccgacccttcaggggattcatcctatgtctttggcttctccgatcacaatggcacaaacagcgcttgccaatccggcacgtggtgcatcgggttcggctataatggccatctgacagacaagaacgatcaccggcacattatcaagaaattccagaatgatctccgtttcagtgcagatatcgaggcctacgctactcacgattggatgaatgacccatatgccaagggtgcatgggcttgttggggaccgagctgtgcctcgatgtacttagaggagcttcaaagagctcacggccgagtgatttttgcaagtgctgattgggcaaatggatggcgggggtgtataaatggagcgattgaacgtggtcaatgtgctgtgcaggaggtggtcnaaatgctcaaggaaaaaatatggcacagcccagccacatttatgatggttgaaaacgccaag

SEQ ID NO: 4413 - DNA, 657 bp, A.fumigatus
  unsure (603): Identity of nucleotide sequences at the above locations are unknown.
gctgccctggtctcggtcagttttctgataccatttgccatctatggtgtcaccctttacaacggacaaatggtcaaatgcaatgacggaagtatagttggaagtctagatcagtgcatcaatgaatacttaagctcaccctacaactgggacgtcttagcaccgcgtgtcgcatcaaaccctttttacgactttgacaattttggggatgctctattcatccttttccagattgtctcccaggagggctggattgatgtgcagaacagcgctatgagtattacagggaaggacatgcagccacagtcgtttgcggcgccagccaacggcctcttcttcattatgttcaatttgctcggtgcagtcttcgtcctgacactgttcgtgtctgtgtttatgcgaaattacacggaacagacgggtgtcgcctttttgactgctgaacagcgatcgtggcttgagttgaggaaactcttgaggcaaatctctccgtcgaaacgctcgctcgaccgcaagagtagtaaatggaagttattgtgctatcggaatgcgggtaaaaaacatggtccattggcaagatgcgtgacaagtattcttggcctncattctctcttggttgtgccggagttttatccggacccttattttgggaattga

SEQ ID NO: 4414 - DNA, 564 bp, A.fumigatus
  unsure (51): Identity of nucleotide sequences at the above locations are unknown.
caatcctgttcggggatttgtttcaacgcattgttgggccaggaacgtggnaatcaacgagtcgaaggagtggatccttataagccggtgtggtatacattttcagcttttgtctacgcggcgattgttgccatggtcctgattgcgtgcatcaccactccgatctatcagcgcaattatcaagtccagtggcatggcgaggttatgccgtggtatgtttacactgatacgggcttcgcaatcctgttcacaatagaagcactcattaaggtcattgcggacggtttcttctggacaccaaatgcatactttcgaggatcatggggattcattgatggaattgtcttaatcactctttggatcaatgtgggcagctcactgttcaaggactggggtgtctctagagctattggggccttcaaagccttgagggccctgcgtttattgaacgtcagtgacagtgccaaggacaccttccactcagttatcatcgtgggtggatggaaagtcatcgctgtaagtcttggcctccgcttcgtgatctggagcaaagacgcgcactaa

SEQ ID NO: 4415 - DNA, 1242 bp, A.fumigatus
gtcatgtccataaaactgcgctcgagttctgcagcttccattgttcttttagtctcatccatcccacctatgcccctcagtatcgcaatgactccgaagaaccaggcagcctggatccccgccaaaaaggcacggccgttcaaggtcggcgacgcgccctacacgcccgcgggccctggccaggtggtggtcaggaacactgccgtggccatcaacccattcgactgggtgctgcaattcatcgggccagcgatcgccagctacatcaagtaccccttcatcttcggcaccgatgtggccggcgaagtggtcgaggtcggccccgacgtggagcggttcagggtaggggaccgcgtgtttggaagcgccactgccatagccaaggaggtcaaccgcccggccgagggaggctttcagctctacacggtcatgcgacagcacatgctggcgccgactccagcgcacatcaccgacgaacaggcctgtgtcctgggactgggtctcttgacggcggcgtggggtctcttccatccgaactatctgggcctcgacatgccccaggtcccagcgcccacgggcgcagtgggcaagtcgggcctgccgcgcgctgttattattactggcggcgcgtcgagtgtgggcagcaacgccgtgcagttggccgtgtccgccggctaccaagtcctgtctacctcgtctccaaaaaacttcgagtatgtcaagggtctcggcgcaacccaggtcttcgactataggagcagaacgttgtctaaggacctcctggccgctctacggggccacgaactggtcggcgccctcacgattgggcgcggggccgtcgaggcatgcaccgccgtgatgaagcatcatgatgtccgcctcacgcggaagcgcatcgccgtggccggcgccataatccctgccgagaagctcacgacctttgtcggcaaaggcacgtacttgatggggatggtggggggcatgatcaagtcgaatgcgaggcgccgtcggaccggggtcgaagccaaattcatcctcctcgatggcctagttgacccggagagtatcgtggctcgcatctaccgggagtttctgccactagcgcttgagcggcaccagtttgtgccagcgcctcccacgcatgtcgtgggcaagggactgaacaagattcaagatgctctggagctccagaggatgtcttcaccacggggctggaaggatccgcggtggcgcgatgtaaga

SEQ ID NO: 4416 - DNA, 951 bp, A.fumigatus
agactcaagagacgtgcaagacaactagctggtattgatgtaaggaaagccgcgcagacaatgcaggaattcgtccccgaaacgcatgagacattcctcaaggctctggaggacgacggttacaagcagtatcagtatctgcttgttgtcgtggaaagcccgacgcgggatgttgcggaggcaggggctccccgaaacgtcgcaaactggatgattgagcgatatgtgcagctgctctgcaggtacaacccctcgcacgttgcggagttcgtagatgacttgcgagcgggcgatgtacatctggaggagttgctgcctgccatggaagagagcggggtggtcgatgcggccgtcattctgcttgtgagacaaggccaggtgcgagctgcaatggaccggctcatcgctcacttgggagcactgcaatcgggtctggtgggaatattgcagagtgcgcgcgagtctcccgactcagccagtacggccgaagcgattaccgatctccttgaatccttggacaagtacgcgcatgttggcatctggttgtgccaaagtcaaagccagacaaccaagacgtcgcgaccggagaggaacggcactggcagcaaggtcgcgttggaccagcctctctcgttcaacgagaccttgtggctggatctcattgaagcagtagttcgcaccgcgagcagtgtatttgctctggtgcggggacagcaagtttatgacggcaaactcacccagatggcccctgagacctcttcaccgggtgacaataccgcccaactcatgtcgtccgtccgcactctggttcaacaagtattcactgctcttctgtccagcacggtcaagctaggcggagcaacacctagtgccgagcggaccgatgtaacctttctccgcatcctacgtgcatttctcactcgagctgccagctggtcaccatcacgtctt

SEQ ID NO: 4417 - DNA, 252 bp, A.fumigatus
gctctaaagttcttctatagcaaccaaaccaatctggctctgaaggggattattggtattgaggccatggcaaccattagcaagcttacccaccacgctgatgcagcaaccaatcgctctgctatcgcccacgattatatcgataggtggcaagtactgggtattgctcatgaggcggatcctccgcacaccacattgtcttatggctcaaatgattctcacggtcagttccatttctcttcttccttttag

SEQ ID NO: 4418 - DNA, 633 bp, A.fumigatus
gtatataccgttgctggtatttgtctaacccttgctatgttccagcttgagttcttccattacgactattcaaccgcaaacaagctctcttcggcattagacgagaggattgcgcgggactccgtagcagcggctggccaagactacttgactattacctctctcagtgctcgtcaagcctttgctgcaactcagttgtgcggcaccctgcaaaatccatatctctttatgaaggaaatatcctccaacggtaacatgaacactgtggacgtcattttccctgctcacccggtattcctgtacaccaatccagagctgctcgagcttttaatgaagccccattttgaaatccaagaatccgggcaataccctaacgcttatgccatgcatgacattggaacccattaccccaacgccactggccaccctgaaggcaacgatgaaccaatgccgcttgaggaatgtggaaatatgataataatggctttggcgtacgcactcaagtcatctaacacggattatctgaacgaacactatccattattagaacaatggacatcatatctcgtcgacgaagctatctacccggcaaatcagatatcgacggacgactttgctggccccttggcgtaa

SEQ ID NO: 4419 - DNA, 243 bp, A.fumigatus
tcgataacaggtctcctgtacaacctttacgccgaccgagagttgggcttgaacttggtgcctcaatctgtttacgatatgcagagccacttctaccctacggtgcagaagaagtatggggtgccgctggacacccgacaccagtacactaaaggtgaattccttgcctttcgtatacccacctgccttcattgcgtttttgcatttaaggaaatattcagtaatctaacaagagtcttttag

SEQ ID NO: 4420 - DNA, 252 bp, A.fumigatus
tggatggctacgaagccaaaggcagtcgaggttaactatcccccacaaatgttcctgggatggactactaatcgaatcacaggctacatcaaccagatcgtctcgtcaacggccagcaaccccaatctcgcacaagtgggctttaaagctggactggagagcgtcattctcatcaatccgtctcaggccagcgtgtccccggggtcttcaccacggggctgggaggatccgagcaggcgtacgtgccatcgc

SEQ ID NO: 4421 - DNA, 243 bp, A.fumigatus
tcaaccatgaccaggtctcacatgtcgctagacgagagagctgacgtcgtcgaggatattattcattacgacttcaacaatcgctcaatcctctacgaagctctccgtagcgccggcgcgcttgccctgaccggacgagcacatcgctccgacggcaacaaggacctggcgcaagtcggggatgcggtcctgcagctgatccttgtgatggatggctacgaagccaaaggcagtcgaggttaa

SEQ ID NO: 4422 - DNA, 1233 bp, A.fumigatus
  unsure (45): Identity of nucleotide sequences at the above locations are unknown.
cgagttgaagaaacggagcaaccagttattccattaccaagcccngtcaactcccacaaggagtttcttctgagctcggacaagccggacatacttgctttaaagccgccgtcaatcttgccggcatgtcgattcctcctgtcgcgacccctctctctgtacatgcgatcattggcgtaccggaacgagacctggaggataccccaagtcgtagcagaagtgcagaaagctggatttcctctgacaactttcaattggtccacatacgtgcagatgatggcttcttccgataagccttctgaccaggttgaggcgttcacggtctttgagcgcaagttcatgcctaactttcctggatggaataatcttcgtcggggttatggagtgagaccacctggcgtaccttcgaccattgatgttatggagaacccgagacgtgcgaaacctcctaacatgctcggcaaagaatcccgacgctactggagcaaaattcagcctgacttcatgcaacctacgtatgtctccatggtctatctggcgtccgcattacaagcattccgggagaggagtatctatgacggaggattagaggtcgggactctcttcaaagttgcacctaaaactattgcagccattgcggacatgccgtaccttcgtgagaagttccaaggtgtgttacttcggcgtcgtcaggagcaaggtgacaagaagggagactctggagatcgtgatcatttcgtgtggaccggtggcatccttggtgttggtggcaaaccgagatctccaacagctgttgagcggccagcgatggaagcagaccaagaggaaaacgcatcggccagcgcccggcctcagccagatgtgactgatgacgaagcaccagatgccccaaacgctcctgctgtcgaggcgggattatcccctgaagaggtgtccgcgccgaacgccaagagcatagatccgcaggaccagttcgatatcgaggcagaagcgctccttggatccagacgcgctctgctagaggcgagcgaagcattgctggacaatgaacaccgcgcttcagcggatgaagtcgacgaaacagacatatcttccttgatagacgatttggcaaacccagacgaagatgcgccaaaatcagcagacggacggcaacaacaagaaccgcctaccgagcatcaaggccagccagagcaggagcaccacaacaacggtatggcgcatgatgcatag

SEQ ID NO: 4423 - DNA, 756 bp, A.fumigatus
attgactcgatcacaggcccttatgcctctgctgtcctccgattccagctccgatttcccgactcctatcccgagcttccacccatcgtcaccttttcgaccgatgttttccatcctttaattgtaccccttactacatataccttcagcactggcgcctcgaccgaagaccctgttagcgcgacggatgaggagcgactcccccctggtggattcagtctacgacatggcttccctcattggtttgggcgggcacggaagacaggacgacagtcaacaggctcatccaggccagtgagtgtgaatggacggaatgctggtgaaggggagacggcatcgacagatggtccttcgtctccttcctcagatcagcccactggtgcagagggaggccagaatctcaccaaggacaaaggaactgcttcggacgcaaggaaaacagtaccggtagcagtgctgctaaactatatccgatcgacctttgacgatgagaacgtccttgactccttgcctctcgaagctgcgggaaacccaagtgcgtggcacgcatggaaggcacacagaagagaaaatagtgaatcggccacgagcaattccaaacgaggaagtccgcaggctcggcttcctggtgattggcattgggacggtatttgggcgaagcgtgttcaatatgaaattgaggcgagtcattcggatcaaatgttgtttggaaatgctgctcgcggtgccaccgatgagatggtatgtatgcgttga

SEQ ID NO: 4424 - DNA, 378 bp, A.fumigatus
attcccaaacgcagggaacaccctctacttgtcagcataccagtaccgatcgcatctcagacgttttggataacactaatcatgtccaacgactggttctatcgataccaaactacaattctcgctgtcgtcctagttttcgtccctatcattgtggtctgcagcatcttcatgactgctcttgcatgctccgaatactggtccacacggcgtggttgcagtttctcctattttacttgcatctgtggtctcaggtcgagaagtcagcgccagaggcctctttctgacactgatgacgccaactcgtccgagaggactgtatcatcgcggccctctgctgaaaataagaatccagtcctaagaactgagcgagcctag

SEQ ID NO: 4425 - DNA, 234 bp, A.fumigatus
ttgggattttattcaggtgcatttgacggcgttattgcggcttgctcacgatttccacctatgctttacatcgggcttacggctttcttttccggcgttacatgcgcgggcaaccctatcttgaatagtcgtcccagctgtccttctgcaaggattccctttagaagggaagactggggactttcctatctggcatgggatgtagtctttaaacagagcagttttccgatctga

SEQ ID NO: 4426 - DNA, 420 bp, A.fumigatus
tacggaaaaccgcgaggaaaatcacgggcaagaaaggcagctatgaagttgacgcccctcgcggttgagcaacttcgtaagctcctgtcacagccggaccccaaatttattcgagtgggtgtgaagaatcggggatgttctgggctcgcctaccatctcgaatatgttgaaaaacctggagctttcgacgaagttgttgaacaagacggagtgaaagttctgattgatagtaaggctctgttcagcataattggtagcgaaatggattggcaagaggacaaactgagccgaaagtttgttttccgaaaccccaatattagtgagtccctgtcattttacacatctttaccacgatacagttcgtctaacgttgaaatcacagaggagcaatgcggatgcggcgaatccttcatggtctag

SEQ ID NO: 4427 - DNA, 1062 bp, A.fumigatus
ctcgtgcagatgcggccatccagcagggacgaattttcaaccgctatcatctgcgcgctgacactcgaagcagaggctgttgaagaactcttcgatgagatttacgacagattgagcggatactacaggaaacagccgggagacgataatgcatacatcaacgggaggattgggaatcataatgtggtcgtgtgctgtatgccaggcatgggaaaaggaaatgctgccagcgtggcatcgagtttaaaaatcagctatcaaaggatcaacctggcactggtggttggcatctgtggaggtgcaccatatccatcgtctggtggagagatatttctaggggatgtcataataagtgattccgtgatccaatacgacttcggtgggcaatatcctggtggatttgaagagaaaactagtgtgaaggactcgcttggaaggccgaataaggaaatccgagctctactggcaggtctccaagcaaaaaacactcgcagggacttgcaagctaggatgctacggcatctacaagctatccagagatcaaacccggagtggcattggccgaggtctgctgatgatattttgtttgaagcatcatatcaacacaagtattccagtcctacttcttctgtatattgttgccttgatggcaagtctcgggatgtctgcaagtccgcgctggacatgacctgtatccatttaggctgtgataaaaaccgaatttcccgacatcgatgtgatgcagaaaagtgcatcccgagcatacacattgggacagtcgcatccgctgatactgtgatgaagtccggtgagcatcgtgaccgtctggtcaaggctgacaatgtaattggtttcgagatggagagtgcaggagtatgggacaatgcttcatgcatcgtcatcaaaggggtgtgtgactatgcagatagccacaagaatgaagcatggcaagcctatgcagcagcaactggggcggcaactgctaaagctttcttggagtactggatacccactgttcgagaaggtaagtacacaaatctgggagaagtatttctatactga

SEQ ID NO: 4428 - DNA, 189 bp, A.fumigatus
gggatgtatcccttccgtattaatttccccgttgtccccggttccgatggtgccggcgaggttgttgaggtcgggtcgaaagtgacccagttcaagaagggcgataaggtggtgaccttgtttaatcagttacaccagtacggtcctcttgatacccggagtcttcacggccgggtgcaggtaagcgtg

SEQ ID NO: 4429 - DNA, 300 bp, A.fumigatus
ctaaaagcctccttcgatcacaatattccttcaattgactctcctgagaactcgacgccttacgtacggaaaatggctccctcaactatgaagcagtgggttgttgcggataaggagaatggtttcgatagtcttaattttaaggaaggtcctgtgcctaagtgtggtgaaaatgaggtgcttgtcaagctacgcgctgcgtcgctcaactatcgtgacttgatcatccccaaggttcgtcgcttcatctacgctcgagacagcatgagcaaatcagccttttgtcacgcacatttctga

SEQ ID NO: 4430 - DNA, 975 bp, A.fumigatus
gtggtcaacgatgatggccctccatcaaacaaatcttcgccttacgtccattccctcgtccacactcttcagtccgccggccatgttgtatcagtggtcctccctcatcaacagcggtcatggatcggcaaagcgcacttgatcggtgcctctgtgagaccgacctacttccgccccggcatcctgcacgaagacaacggcaccatccatgacttcccccgcaccgacgacgacgatgacggagacgagtggcttctcatagactcgacgcccgcaagctgtgtccagatcggtctttttcactattttcaagaacgaggtcccgtcgacgtggtcgtgtcgggtcccaactacggtcgcaatacgactgctttattcgctttgtcgagcgggacaatcggaggagctctggaggctgcgcactgtgggaaacgcgccattgccctttcctatgcctttagctcgcgcaaccatgatcctgttgtgatcgctgaggcttcgcagcactcggtgaggttgattgaatacctgtgcgagaactgggcggagggagtggatctgtataacatcaatgtccctctggagccgggaatgagcaagtgcaaggtgctatacaccagtatgcttgacaataggtggactggcagctgcttccaggctgttgatgcagccctcccggatgaaactccccaggtacaggagcagaggctgcgcgaccagggtgaacgactaggggagaagcccactgccgctccaggggcagggccacgcaggaggatacggttccagcacaagcactttcagtggaatcctgatttcacagatgtttggaagagtgtagaggcgagtggaccgggcaacgatggtcgcgctgtgcgtgagggaatgacaaggtatgtatgtattctcgatcctgtctcatattcttctctgtactggtctgtggctgactctttgaggtcagtgttacccctc

SEQ ID NO: 4431 - DNA, 957 bp, A.fumigatus
gggttgatcccggggattggagtaatgctgggggagccatccctgggattaggaacaaatccgttgtaccgcacggtgggccctgaggatatgctcagtattcttgcactctcgatgccgtcttttacagctctgttaggtgattctgatcgcatcatctccgctgtgtcaggcatatcctctcatgtgattgggcctcttctgcgttcgcggctattccctaacaatatcaacggcagcgtgatgtctctactgcaacacattgcgaaggttccagctgctgcaaaaatctggaagaaggacatcgccgatgcctttaacgatccacgattttttggcttccaggttgaactcgtgagaagcggttggatgaagctactcaggcaatgggtaattgccgacaaggaccgtctaacagagttgatgtctcgtcttccaccaccgagcacagcgggactaatgttcggtgttggagcgtctgctgctcgcttggaagctgaccggaaggctcagttgaatctgcggaggatatcactgctaatattatctgcaaatgacgattacttcattggagaactaccagagctgctccagaagctggaagatctccttgcagcgacgagctcctcatctccgtcgtccaccacaagagcagagatattcatggtacttcgagcgcttgcgctcaagagttcaactaccacacttgcgccattttggccattgatcactacagagcttcaagaagctatttctagcataccgcttggcgcgcaacaagaagtttacaatgcatactcgctgctgcaggcgtgtaagcttctggatacactgcttgttctagcgccagacgattttcagcttcttgagtggctctatgttcacgacaccattgatgccgtttacccccctgagcaccgtgaatccatggcacttgcagatgagaattcgcagacc

SEQ ID NO: 4432 - DNA, 237 bp, A.fumigatus
tcccagggatggctcccccagcattactccaatccccgggatcaacccctaagtttgcctgttaaaattgcgggtagcacggcaaacaattcctcctggctgaaatttaaaaccggcacggcctggggaaaaacctggggtaaaacatatcccctaggttccttcctcttccggtcgatggttccccaaagggtgttttcccccaccttggctccctataaattatcgccaaattcc

SEQ ID NO: 4433 - DNA, 225 bp, A.fumigatus
ctcacattgtcaaccgcttctagtacctttctgaaacgaaagggcggtcttttcaagaaggcacatgaactcgcggtattatgttcggtagatgtcgccgtcatcatctttggtcacaacaagaagctctacgaattctcatcatgtgatatgcgagagacattgggtcgctatcaatatgtgcgttccctccattatccgcatcaattcagtacgttgacatga

SEQ ID NO: 4434 - DNA, 1122 bp, A.fumigatus
agcggccccttgcaaccccgcggtgaagacacgatatccactcttctcctgacagctccttcattatccgcagccttttaccttcctggtgtagcaccaacctcatacgatgaaggccaagctgtgccgctctacgtcaaccatcttactccgggactagcgcaacaagacgaacagctgcattccgtcttctcttacgactactatcataccgcattccacttttgtcgtccggcagatgggccgaaagatattcgcgagtcattaggtagcattcttttcggtgatcgaatccagacatcgccgtttgagttgttcatgggcaagaatgaatcatgcaaggctgtttgtggagaagtcaagttcgattcgcgaagcgccaaatttgtcaacagaaggatagctcagggctataatatcaactggttggtggatgggcttcccggcgctcaattgaatctggacgcagtgacccagtccaagttctacagtcctggttttgcgctcggcactctgaatgatgatggacaggcaattctgaacaaccactacgatatcgtcattgactaccaccgtgtagggttcggcagcaaagacaagtaccgggttgtcggtgtgctcgttcaaccggcctcccggcgtgattccaaagtccttgaagatggaacagtggattgcggctccgacaacgcggccgtaattctgagcgaagatggcgagactccagtcacttggacgtacggcgtgtactggcgtgagtcgcccactccttgggctactcgctgggacaagtacttgcacgtttacgatccaaagattcattggttttcactcatcaactctgccgtattcgtggttttcttggttggcatggtgagtatgatcctcctgagggctctcaggaaagacattgctcgctacaaccgcctggacacgatcaatctcgaagatttggatggcacttcagctgctattgaggacggaattcaggaggattcaggttggaagctggttcacggcgatgtattccgatgccccagggatcctttaatcctcagtgtgcttgttggcaacggggctcaaatcttcatgatgaccggtgtgacagttggtaagttcttc

SEQ ID NO: 4435 - DNA, 480 bp, A.fumigatus
ctgcccgtctcttccaactccgtttcggtttctccggacgatagtcggtcatcgccgtacccttcatccccctgggagaactcggtctgtgtcctcttccgcttcttccctgtcagggctgcctgttcggctgccaaatgtgtgcttgttgatcccgaggcacgtgccttggccgcatcgccgatggcggcctcgacgcagacaccgcatgccaactccaccagcagcctttcatcatccgcaagacggagcacgccccgagcggcatcggcatctgagaggacggcagtgtgcacagcaatgccgggtggaggggagatggcgtatttgaacgtacgttccgagacgcggatggcgcccagcgaggtagcttgggatgtgatcttggggagagagacgagggatttctgggcgacagcgagggcaagggagtctgtgccttgggtttcgacggcgagtatgtggatggggtttggttga

SEQ ID NO: 4436 - DNA, 693 bp, A.fumigatus
  unsure (484): Identity of nucleotide sequences at the above locations are unknown.
aaagcaggaatttggggttggaataatttcttccaagggttaaaggtggggattataatcccccagtttaaaacccgaagctttcttttttccccaaggttttctggggtttctggaacccttcttaaaaaattcggcctcggttttatattactaccatccccactttacgaattgacctgtatcccatacttgccaaatggggctcctcggtcttttccctggtttcttgagcaagaattgcgtcccgcctcttacaccatgggcagcatctcacctgagaaagcgaagctgagctcaagcttgccatgggttgagactccccttgtggaatcgcttggtctgtctcgcgcgcaaggctgtagaatcttcttgaaactcgagaacattcagccagcgggatccttcaaatcccgtgcaatggcaaacagatccctctcgcacctcgtcaagccggaaaacggtgggccggccggtgcattcntatgcttcctcggggggcaatgccggtctcgctgcggtgtgcgctgcccggagcttgggttatccttgcaccgtggttgtgcccctctcgacaaagcccctgatggtgaacaaactgcgggcggcgggcgcttcggacgtcatccagtacggcgagacattctcggaagcgggagagtatatgcgggaagtgataatgaaggcagatga

SEQ ID NO: 4437 - DNA, 1269 bp, A.fumigatus
  unsure (108): Identity of nucleotide sequences at the above locations are unknown.
aactcgagaacattcagccagcgggatccttcaaatcccgtgcaatggcaaacagatccctctcgcacctcgtcaagccggaaaacggtgggccggccggtgcattcntatgcttcctcggggggcaatgccggtctcgctgcggtgtgcgctgcccggagcttgggttatccttgcaccgtggttgtgcccctctcgacaaagcccctgatggtgaacaaactgcgggcggcgggcgcttcggacgtcatccagtacggcgagacattctcggaagcgggagagtatatgcgggaagtgataatgaaggcagatgacggggacgccggaacagacgtggtcaagattgccctccatcccttcgacaatgagcccatctgggagggaaacagtacgatcatcgatgagctcgcggctcaactgccgcccgtaaccacccgagaagaagctatcgcctacagtggtcgtgctttgccactggacgcggtgatctgcagtgttggtggcggcgggctgctaaatggtcttatcatgggcctagagcgacggagacatctacagaaccagagctcacactacagcaacgacatcatatcctctcaaccaaaccccatccacatactcgccgtcgaaacccaaggcacagactcccttgccctcgctgtcgcccagaaatccctcgtctctctccccaagatcacatcccaagctacctcgctgggcgccatccgcgtctcggaacgtacgttcaaatacgccatctcccctccacccggcattgctgtgcacactgccgtcctctcagatgccgatgccgctcggggcgtgctccgtcttgcggatgatgaaaggctgctggtggagttggcatgcggtgtctgcgtcgaggccgccatcggcgatgcggccaaggcacgtgcctcgggatcaacaagcacacatttggcagccgaacaggcagccctgacagggaagaagcggaagaggacacagaccgagttctcccagggggatgaagggtacggcgatgaccgactatcgtccggagaaaccgaaacggagttggaagagacgggcagtcagcctcaaggacatcctaccgaaaatacgctgtcgccgttgcacgaattccaatccaagctgaagcaattggtccctaacctgcaaccggatagtcgagtggtgatcatcgtctgtgggggcagcaatgtcaccatcgacatggcggcagagtggaggaagatgttgcaggagggttgggacgcttaa

SEQ ID NO: 4438 - DNA, 1065 bp, A.fumigatus
agaactcccatcaaatactttgacaacaaggttgtgtgctcgttgatcgaagacaagcgtccacctggtgtatttgctgctttaaacgatgcctgcgcaacagcgcacgctgattctagcgctgcagataacaccttcgtcggacgactcaacttcctgtctcaaaatcccaactttgagaaccgccagggtcaattcattatcaagcattacgctggtgatgtcagctacgccgtggctggaatgacagacaagaacaaggaccagttgctgaaagatcttctgaatcttgtcggaacaagtgggaatcaattcgtccatacgctcttccccgagcaagtcaaccaggatgacaagagacgtcctcccaccgccagtgacaagatcaaggcctcagccaacgacctggtggcaaccttgatgaaggcccagccctcgtatattcggacaatcaagccgaacgataacaaggcgcctagagagtacaacgtcggaaacgtcctgcatcagataaaataccttggattgcaggagaacgttaggatcagacgtgctggttttgcctaccgtcaaacattcgacaagttcgtggagcgtttctatcttttgtcgcctaaaacgtcctatgcaggtgattacacttggacaggggacgccgaatccggcgctcgtcagatactgaaggataccagcatacccgccgaagagtatcagatgggaattacaaaggtgtttgtcaagaccccagagacgttgtttgctttggaagccatgcgtgaccgttactggcacaatatggccatccgaattcagcgtgcctggcgaaactatcttcgctatcggactgaatgtgctattcgcattcagcgcttctggcgtcgcaccactggcggtcttgagttcattaagctgcgcgatcagggacatcagctgctcaacgggcgtaaggagcgtcgccggatgagtctgcttggttctcgcagatttcttggtgattatatcggggtgggtaataaaggtggacccggcgagatggtccgtaacggtgcaggcatcagcggttag

SEQ ID NO: 4439 - DNA, 231 bp, A.fumigatus
  unsure (79): Identity of nucleotide sequences at the above locations are unknown.
cagaccaaccgccacgtatacatcatagcgcaaaacctggtcaacaatcagctggtcatctcgtccgaaaggacgattncaatcggcgccttcaaggctggcggtgcctcgaacttgaaagatgaatgggtttcaatgggggtgggaagtcacaagaacctgacccttttggtaactgctggttcagaacgggtttttaaaccacttgacaaagcgttgggcggacaatga

SEQ ID NO: 4440 - DNA, 240 bp, A.fumigatus
cactacctaaccgaccccttcaacgttagtctacggggtccagcttgtaagatcctcgagcccaatccttgctgcttccacttcctctacttctgcttctgcttcggctccccttcttattctgagggtacctttaccttgagttctactggtcctcattttacttgtgagcctgatgagggtgataactgtgaccgaaacagtcagttacactgggacggcagatccaccgtctcttaa

SEQ ID NO: 4441 - DNA, 189 bp, A.fumigatus
tggtccatgcccataagaaggcttaagatactgcgcgatatgatgaagagtaaagctcaacttcgtcccaagtatctgttcgttgagcaacagccgctcgacagcgggattcgttgcgttggcgatgatctgagctacctagtgacctggctttgcagcgagcgagatactgacacactgcatgactag

SEQ ID NO: 4442 - DNA, 621 bp, A.fumigatus
tggatgtttggctggatcatccatccattttcgtgtgtgacaggacccgatatgctccaaccatcatctgaaagctcacttgctggcaagacctgcctggtcactggcggagctggcgggctgggcaaggccattgcgtctactttcctcgcggctggtgcaaacgtggtggtttgcgatgtcaacgaagaccgactacagcagacttcctcagaactgggggaaaccgatcgattgaaaactgtcagggcggacataacctcggcgagcgccgtgcaaactctctttgacgagattatcgcggactttgggaagctcgacatcttggtcaacaatgcgggaatcatggataggtttgatcccgtgggtgatctcgacgaggcgctgtgggataaggtcattggtgtgaatctcacggccccttttctactcagcaaactagctgtgcggaatatgctggcgcagcctacccctgatggatgtatcatcaacatcgtctctgtggccggcaaggccggctgggccacgggtatgttctccaacgaccgtggtaatcctcttgctaacacccaattaggcgccgcatacacagccgagcaaccccggtcttggtcggattga

SEQ ID NO: 4443 - DNA, 636 bp, A.fumigatus
tgggttcaatccgaccaagaccggggttgctcggctgtgtatgcggcgcctaattgggtgttagcaagaggattaccacggtcgttggagaacatacccgtggcccagccggccttgccggccacagagacgatgttgatgatacatccatcaggggtaggctgcgccagcatattccgcacagctagtttgctgagtagaaaaggggccgtgagattcacaccaatgaccttatcccacagcgcctcgtcgagatcacccacgggatcaaacctatccatgattcccgcattgttgaccaagatgtcgagcttcccaaagtccgcgataatctcgtcaaagagagtttgcacggcgctcgccgaggttatgtccgccctgacagttttcaatcgatcggtttcccccagttctgaggaagtctgctgtagtcggtcttcgttgacatcgcaaaccaccacgtttgcaccagccgcgaggaaagtagacgcaatggccttgcccagcccgccagctccgccagtgaccaggcaggtcttgccagcaagtgagctttcagatgatggttggagcatatcgggtcctgtcacacacgaaaatggatggatgatccagccaaacatccatcatgcctga

SEQ ID NO: 4444 - DNA, 468 bp, A.fumigatus
gtctcaatgcctgctctaatctctctgtgcgccagaaacctcgaagattccgatgtctctccgttgacagcctctgattttgaaggctgcggggcccgtgtccagacggactatgtcattcatttttcagagctttgcacaatgatatcttatatcgtgcgtgagcgattcggactgcgagtcagttcggagcgtcgcaaagccgcattgcaggaagcagatgaagctcttgcgaactggtctttgaggcttccagaacatctgcggctgcgtgcctcggatatggatccttggtccgccatgcttcacttgacctacaacaatttcctcatccttctccaccggcctcatcctcgggcatcggcatattcggacgaatacggtccgcatgacgcaaaaatctgcaccgctgccgccggtgtcttcacatctatcttcgaaaaactccgcttaaacgatcgcctctag

SEQ ID NO: 4445 - DNA, 1074 bp, A.fumigatus
aacacagactgccgcatcgagcacaagaagaagcgccttgcggtgcgctccattctaaatcccgttcccattcgttgtcggccgccgtccacctccgagcatgtccctgaagcgtctcctccatctaccatcagcgaaccaaccgctttcacaactgcttttcgcggagttcagccagaagcagcagctcctccagcgagcgtcgctccaaatgtccagtccaaggcacagcatctccacagcaatagttatagtcaaacgtctccacaagcacaggaatgccatcttccgcccgcttcggaccgtttcgccgaacaagatgcgcatgccgactttgagaagcgactggtgaagctcattgacgatgaagaagggtcaggtcctagggaaattcagcggggcgtgcgagcaatctatgttggacacgagctgtcgaacatgtccttcttgatacgtcaacagcgcgataaagatgacgatgtatatcactttgcgggaagtgagataccacggcgacagttgaaaaccggacatgaccagcttctcgtagacgccctgactctaccggagccggccctcgtcgacgagcttgtccaggcatacttcacccacgtgaacccgggatatcccattgttgaagaggatcagttcatgagtcagtatcgcaatagagacccctctgatcctccccctatcctgcttttgcaagccattctattagttggatgccatgtcacgcatccaaaagaggagcgggatgctttgaaggccattttcttccgtcgcgcgaagtggctctttgacaaccgcatcgagcgaaaccgtgataccttggtgcaagctgcgctgctcttgacctggcattcagacagccccgacgatgatgtttctgccaatgctcactactgggtcggcgttgctgctcgaatcgcgactggcctcggcatgcatcgaaatccagtctcgagcaggttcgctccccgggatcgccggatgtggagaaggctatggtacatcctggttcagctcgatgttatggtctccctctcgtatggtcgacctcaagccatgtaa

SEQ ID NO: 4446 - DNA, 513 bp, A.fumigatus
actaccattgcaaatacgtcagcgaatttgtggacgtcccgctggagtgtctgctccgctgccgcgcgaacattattgtcaacgaacacaagggagggcagatcaagactggaagagccgtcgaggcagcggcaaaaacagaggcgggtgggggaaaaaggagaacgggaaaggccaccggaaaggcgaccagaaaggcgaagggaaaggctgaggcggaggctgaggcagaaccgccagtcggcggaggttctgctgacgaagcccatgaagtcgaggacgccgagaaggccggaaatgactctcaagaaattgtcgctgtccaggatcaagacacttcaggtcagcgtggccccttatatgcttcggcggcacgcgggcagtcaagctatgcgcagaacgatcagtcaaactacggccacaacggacagtcaagctctgcgcacaacggacggcactcgcggggttattccatgcaaggtcaggacagtaccgggtacaaccgagttatga

SEQ ID NO: 4447 - DNA, 1110 bp, A.fumigatus
  unsure (1046),(1064): Identity of nucleotide sequences at the above locations are unknown.
gaaaagatgatccattatcatcgcacaacgccattgccacctcccaaggaggtaaagaaggggggcaacaaagggcgcaagagtaaagaggagaaggacaaggaggaggaggacgatgacgaagaggatgaggaagagaagaagaaaaacagagatcccgccaaaaccggggcgctactctccttcccggacagggctgcggccattgtccgcatcttccacaccaacaagtcgacgtgtaagcggatgttagactaccattgcaaatacgtcagcgaatttgtggacgtcccgctggagtgtctgctccgctgccgcgcgaacattattgtcaacgaacacaagggagggcagatcaagactggaagagccgtcgaggcagcggcaaaaacagaggcgggtgggggaaaaaggagaacgggaaaggccaccggaaaggcgaccagaaaggcgaagggaaaggctgaggcggaggctgaggcagaaccgccagtcggcggaggttctgctgacgaagcccatgaagtcgaggacgccgagaaggccggaaatgactctcaagaaattgtcgctgtccaggatcaagacacttcaggtcagcgtggccccttatatgcttcggcggcacgcgggcagtcaagctatgcgcagaacgatcagtcaaactacggccacaacggacagtcaagctctgcgcacaacggacggcactcgcggggttattccatgcaaggtcaggacagtaccgggtacaaccgagttatgagcaatgccgaacacaaccaaggcatgacctatacaggacagtaccaaggtgtgaccaatgccgggcacaaccaagtcataagcaatcacggacacgtcccaggcatgacctatacaggacagtaccaaggtgtgaccattgccggacacaaccaaggcatgaacaatgacagacacgtccaaggcatcacatacacaggacagtaccaaggtgtgaccaataccggacacatccaaagcatgacctataacggatacaacaatattggcaccggcgtgtntaatgccagcccaatccnacgctgtctacgtagcgacccggaggtcatattggttacagcgacc

SEQ ID NO: 4448 - DNA, 1449 bp, A.fumigatus
cgtattcgatctgccagattcctcccatacactgtgaattttcatgacaacgactctgaagatccagccggtgatctaacgagccctcccgtatcgaaccctccatcccaggctgtgacgccagcacccaatgctgctatcagcttgtttgaacgacagaatgatgctcgaaaggcaggcctgacgcctggggctacaactgatcatgagcgaatcttcacatcggacatcacaaaggctgagcaggaaccctcaagttatccatttccagctgtgccggatgatgcaaatcttctcaccgaaagtgaagctcattctcccgcatggggtgccaccacagctctgaaccagcccaaggctcggccgcctatttcaccctccccttcgattcttaaacaccaggagcccactgtctctgttttggaaccgattcgcgaaaagacaccactgaagatcgaacccttccggtcgcatcccccggacaaagctgaggatcgcagccgcaaaacttcgttctcgaaggccgagtggaccgtcgaaacagcagagcagggtaacggcgggttacgtaatgcggtgcgatctgcaacagatgcaggtcaattggaagacaaagtgtgggttggcacgctgggtatgcccacggatgcattgtcgccgcacaccaaagctgccatcgccgagaagttagaagatgagtacggatcgttgacggtctatgtcagcgacggtgactttgacggtcactacactcatttctgcaagacaatcctctggcctgtgtttcattaccagatccccgacaacccgaaaagcaaagcatatgaggaccattcctggatttattatgtcaagaacacaccaggcgttcgcggagcgcatcgcgaagatttggaacgtggtgattccatctgggtccaggactaccacctgctccttgtccccgcgatgcttcgaaaattgctcccggatgcacaaatcggcttcttcctgcatatagcttttccttcctccgaagtcttcagatgcttggcgcctcgaaaagaacttctcgagggcatgctgggcgctaaccttattgggttccagactgatgagtactgccgacatttccttcagacctgtagtcgcatcctttgcgtcgaggcaaccaacgagggacttgagctggaagatcgctttgttaacgtcggtacatttcccatcggtatcgatccaacctcctgggacaagcgacgacaggcggccgatgtggagcaatgggtgaagacaatttcggagagatatgaaggaaaatatcttatcgtttcccgcgacaagattgactcggttcgcggaatcaggcaaaagcttctgagctacgagctcttcctaaacacgtaccctgaatggagaaacaaggcaagtacattcttggctgctatatgcgcaatcacgcgattgcgctga

SEQ ID NO: 4449 - DNA, 237 bp, A.fumigatus
ttaacctcgtctagccgtgttgagaacttgaaagacatggttctctatcgctttggttccactggagtggtgcagtgtctctcgcgagcagcggaactcttgggactcgtgcctgttttcccagtcaagaacgtgcacacattttcgtctggatccggaaatgcggtgttcagagattgcgttctggttaaaaagtgggttttattgcaatcagacatcaacgaagtatatgactaa

SEQ ID NO: 4450 - DNA, 255 bp, A.fumigatus
  unsure (44): Identity of nucleotide sequences at the above locations are unknown.
aacattactgacgataacagtctcttattgggaagggacagtancaatcacctcacctctttcatccttcataccgattatcggttctggtgccttaagaatttccttcttaactggcgctccctgctgaagccttccctcctcggtcacgcttgctggttgggtatctctgcgaaccccgcgccttcttttttcccccttcaaccgggaaccgaaatatctgtccgaagatattgtttttcccgttggcctccc

SEQ ID NO: 4451 - DNA, 387 bp, A.fumigatus
gattctctctcttaccagtgcgtttgctccaacggcatctctccaaacacctccgaatactctcaaaccattccctactacctatgcaccgaggccaacaacgagtgtgtgagccgatgctccgaagccgactcggcctgtcagtctgcttgccgctctgagcacccttgtggagctcaaaatcccacgcggtacaatgtcactacaacaagtgcgacatcgaaccctaccaacaatcctgctacgaccacgactctggccgcattcacaggagaggccacgaacaagaacgcagcagtcaggatctcgcctgttgacatcggccatgtgtatggtctgtgtgttgtggtgggttgcttcattgctggtttcgcagtgctgctgtaa

SEQ ID NO: 4452 - DNA, 654 bp, A.fumigatus
  unsure (141),(236),(377),(378),(380),(381),(382),(383),(384),(385),(386),(387),(388),(389),(390),(391),(392),(393),(394),(395),(396),(409),(410),(411),(412),(413),(414),(415),(416),(422),(424),(427),(: Identity of nucleotide sequences at the above locations are unknown.
cggactcggcagtccggaggtaatgacaccgatctgcgggtgcgactcgtcgcccaggtcgacgacgatggcgccctcgcgcgcgggactgcccttctcgactgtgaagccgacacggcgctgcgagagggtcttcgcggnggacgccagctgcgggagaatggtggcggcgccgttgaagttggccgttgcggggtcgcggcggtccttgccgacgacccagcccaaggccgcancgggaggtgtctgtgcggtggagatgtcgttgccgtaaaggcacatgcctgcctcgaggcggagggagtcgcgggccgcgaggccggcgagccggacttgctccgggttggacagaaagagctcagtgacctttcgtgggnngnnnnnnnnnnnnnnnnnggggggggggggnnnnnnnngccggncnggnnggggnnccccgggcgggnnnngggggggggcccggggggnngggggggccccnggnnggggggngggggnngggcgggggnnnncccccccnnnccggggcccgngcgccgcgccccgccggggggcgcccccccccgggcncccgnncccgggccnccnngncccgcccccgccccggggggcccccggggggcgcccnggcggccccgcgcgncgnngcccccc

SEQ ID NO: 4453 - DNA, 501 bp, A.fumigatus
ccagttgtagggtacactcaaggaggatctaacgcagacgtcgttctcgccgatgcatacgtgaaaggcatttccgatggcatcgagtgggaagccggttatgcaaccgttcagaaagatgctgaggaagaaccgtactactggtcaaacgaaggccgaggtgggctgaacagctggaaatcgctgaagtacatacccgtcgaggactttgactacgtcggctttggcactatgacccgcagcatttcccgcactcttgagtataccaataatgatttcaccatctcgcaaatggcgcgtggcatgaaaaagacagccgatgcagaaaaatatgagagtacttcgggttactggagaaacctgttccgtgaggatcagacttcgttcgtcaatggtagcgacactgggttcaaggggttcttccagccccgatatctgaatggcacttgggggtcccaggtaggtctccctcggctggcccttgcggagtttgccgattga

SEQ ID NO: 4454 - DNA, 744 bp, A.fumigatus
ctagactccagcttcgtccctcacgacatggccgctctcgttacccttcttggaggaccagaccgatacgtccaacgactcgactatctccatgataaaggaatcacctacatcggcaacgagccatctttcctaaccgtcttccaataccactacgccggccgccccgccaaatcagcctctcgcgcgcatttctacattcccaatttatacttcaaccccacgccagccggcctcccaggcaacgacgactcgggcgctatgggttccttcgtcgccatgtcaatgatgggcctgttccctatcccgggacaaagcgtctacctgatcagcgcgccgtttttcgaggtcgttcgcatccagtccccattgaccggccgcacagcaaccgtccgtgcagtgaacttcgacccgacgtaccagaacatctacatccagtctgccacgctgaatggcaagccatacgctaagaactgggtcgaccatgactttttcaccaagggaaaggagctggtacttgttctaggtagaaacgagagtcgctggggaacagccgaggaggatcggccgccttccttgtcgactcgaggaggggcctcttcttcgggcctcaggcagagaatggttgatttcgaccccgctgctctccagttcggcgagtatggccacgcgaggcgacgacgtcactcttttccgtttgcttaccggcaccatgctgttgccaaggaattcacccacacgtag

SEQ ID NO: 4455 - DNA, 660 bp, A.fumigatus
  unsure (7),(8),(11),(26),(63),(65),(66),(69),(78),(79),(84),(121),(132),(133),(134),(142),(143),(144),(145),(155),(156),(162),(169),(170),(173),(185),(186),(205),(206),(207),(208),(220),(221),(226),(2: Identity of nucleotide sequences at the above locations are unknown.
gggggcnncgncgcgcggggccgccngggcgccccccgggggccccccggggcgggggcgggncnnggnggcccgggnncgggngcccgggggggggcgccccccggcggggcgcggcgcncgggccccggnnngggggggnnnncccccgcccnncccccnccccccnnccnggggcccccccnnccccccgggcccccccccnnnncccgcccggggnnccccnnccngnccggcnnnnnnnnccccccccccccnnnnnnnnnnnnnnnnncnncccacgaaaggtcactgagctctttctgtccaacccggagcaagtccggctcgccggcctcgcggcccgcgactccctccgcctcgaggcaggcatgtgcctttacggcaacgacatctccaccgcacagacacctcccgntgcggccttgggctgggtcgtcggcaaggaccgccgcgaccccgcaacggccaacttcaacggcgccgccaccattctcccgcagctggcgtccnccgcgaagaccctctcgcagcgccgtgtcggcttcacagtcgagaagggcagtcccgcgcgcgagggcgccatcgtcgtcgacctgggcgacgagtcgcacccgcagatcggtgtcattacctccggactgccgagtccgtcactag

SEQ ID NO: 4456 - DNA, 447 bp, A.fumigatus
  unsure (123),(218): Identity of nucleotide sequences at the above locations are unknown.
gctctttctgtccaacccggagcaagtccggctcgccggcctcgcggcccgcgactccctccgcctcgaggcaggcatgtgcctttacggcaacgacatctccaccgcacagacacctcccgntgcggccttgggctgggtcgtcggcaaggaccgccgcgaccccgcaacggccaacttcaacggcgccgccaccattctcccgcagctggcgtccnccgcgaagaccctctcgcagcgccgtgtcggcttcacagtcgagaagggcagtcccgcgcgcgagggcgccatcgtcgtcgacctgggcgacgagtcgcacccgcagatcggtgtcattacctccggactgccgagtccgtcactaggcggtacgaatatcgctatgggctatatcaagaacggcatgcacaagaaggggaccgaggttggggtgttggtccggaataa

SEQ ID NO: 4457 - DNA, 810 bp, A.fumigatus
  unsure (8),(9),(12),(27),(64),(66),(67),(70),(79),(80),(85),(122),(133),(134),(135),(143),(144),(145),(146),(156),(157),(163),(170),(171),(174),(186),(187),(206),(207),(208),(209),(221),(222),(227),(2: Identity of nucleotide sequences at the above locations are unknown.
ggggggcnncgncgcgcggggccgccngggcgccccccgggggccccccggggcgggggcgggncnnggnggcccgggnncgggngcccgggggggggcgccccccggcggggcgcggcgcncgggccccggnnngggggggnnnncccccgcccnncccccnccccccnnccnggggcccccccnnccccccgggcccccccccnnnncccgcccggggnnccccnnccngnccggcnnnnnnnnccccccccccccnnnnnnnnnnnnnnnnncnncccacgaaaggtcactgagctctttctgtccaacccggagcaagtccggctcgccggcctcgcggcccgcgactccctccgcctcgaggcaggcatgtgcctttacggcaacgacatctccaccgcacagacacctcccgntgcggccttgggctgggtcgtcggcaaggaccgccgcgaccccgcaacggccaacttcaacggcgccgccaccattctcccgcagctggcgtccnccgcgaagaccctctcgcagcgccgtgtcggcttcacagtcgagaagggcagtcccgcgcgcgagggcgccatcgtcgtcgacctgggcgacgagtcgcacccgcagatcggtgtcattacctccggactgccgagtccgtcactaggcggtacgaatatcgctatgggctatatcaagaacggcatgcacaagaaggggaccgaggttggggtgttggtccggaataaggtccgcaaggcaacagttacgggtatgccttgggtggagagcaagttctaccggcccaaggcttga

SEQ ID NO: 4458 - DNA, 321 bp, A.fumigatus
gggtcaacggcactgacatggaacttttcacgcgaatcaggcaagctcgtcaaggacctctcccacattgccgtcacctttggccgccccgagaagaatgtcatctccatcgagatgcaccacggcgcccgcaagggtgtcgctaccctccgtaccgttcgcacccttatcaacaacctgatcatcggtgtcacccggggcttcaagtacaagatgcgctacgtctacgctcactttcccatcaacgtcaacattgagaagaactccgagactggccagtatgaggttgagattaggtacgctgcgcataaccccaattga

SEQ ID NO: 4459 - DNA, 213 bp, A.fumigatus
acacctatagaccttgaacgcatactgaaactaacgtgggagctgttgatttcacatggggtggagagttgcaatggcaacaatgctccgacagatttcaagtctcttttatcttccatccctggaacctccaacagcaacaacaactacttctcccctattcgtcttctacagaatcttagtcttggggcttcttttattttatcggaatga

SEQ ID NO: 4460 - DNA, 216 bp, A.fumigatus
agagttgtgctgacgggctttgcgattgttagaaacttcttgggtgagaagatcgttcgtcgtgtcaccgcccagcccggtgtcgaggtcgctatctccagcaacgtcaaggatgagctccagctcaccggtaactccctggaggccgtctcccagagcgcagccgacatccagcagatctgcagagtccgtaacaaggatatccggaaggtatga

SEQ ID NO: 4461 - DNA, 342 bp, A.fumigatus
gatcgtctatatgcacgcatacaaagtccccattttaggagggtaagtggaatgagaaacatttcaaccacagtcaccccagacttcctccgcctctacaacgccaatgcactcctcgcggttcgcgtcgtgcatgacggcaactacctccacgcgggaaccacatgcagaattagctttcgcaacgcggcggcggacttcctcgagggtgctggcgctcgagacacggagccagtcactccgggttacggagaaggggagacccagggcagccagggcggacgcgctcatgtcaatattactactctgggagagggagcggatatggcttggtgggattag

SEQ ID NO: 4462 - DNA, 1620 bp, A.fumigatus
atacatgtatcaagcctcatgcccgccattgcctcacccgcaactgatgcgaagctgttaccgacggcgaaagcaaccaattggtttgtcatccgtgccatcgagtctggaggcttcaatgccgagaatgaccctcgagctttcgaggcgctgctcaaagttactccgcatgttgttccaccgtggagtaacaatacctctcctatggaagaagacgtggaatcgttgacattggggcagttgtacgacgacacgtctgcattagcgggccttatggagtacaatataaggttctttgcgtcgcagcgtttgtgtacagacgcgttagacgccttctcgtggcttcaggaagtggtggatgcgagcaagttgcagcgcatccgcgaattttctgagcgagtgggccagtcggatactgctggcctaccttcatttgacgctaacagcctggaatccttcaaaccgtttgaatcgtcgatgccgcagatgtcgatcgttacagtagctgaattgctggacttggtcacgacatcgcgggcgtttgcattcggagaatggttgttcttttcgaatgacattgacggccctcccattcctccaagtgcatacgggaaccaagccctcgcgccgtcgatcatccgattcgcaagcgccactaagaacgaagcactgtgtaattcggtcgtgcggtctctctctcaacccctctccctgaacaccatgcgggcgctgttgaactttcggatcgctatggggcagtgggattccgcaactatgatgctggagtacgtccgcgactaccgactaaagtcatggggatacagcaacgtcacggcgctggccgcagcactcgtgcggatggaccacgctctcaagcagcaaccctccacggagcggcaaagcgacctagaccgcgcaaaggaccttcttctccgtctcctcaatggcgaattcaatgaatcctgccactccaaaaccagcttccaggacaggttcatccacagcatccgccgcgtcttcctgaccatcccaggctccctccgcgaggtcgcccaaaaaacccacctcaagtacaaagccacagcgcgcagtaatctcccttacatccccgccacggccttccacgcgctcctctccgccgtcgtagacacgcacggcagtgcggccggcaaacgcctctgggaacagtggtgtctcgacgtccgctccccaaccttctcccgccttcaggaaggcggcatcacccgcctgtacctgcagcgcgagcgtgacccgcgcaagggagacccacacttcgacccgcggtacttcgcgcagacgcagaagaaggctgttcttccgaaccccaacaccgtccgcatcatcgcgcagcaggccgtgaaggagtacaccgagtttgacgaggctcgccgacgtcaacaagctgaccagcataaacagcaagactcgaaccccgcccgtgaagtcgtggaattctgtatccggcagttccaggctttccgggtgccgtggagggagatcaacagggaactcaggggcctcgtgtaccgcatgcacagggagaagaagaaggagcgaaagaagatgggaagagatggcgcttccactcctaacaagtaa

SEQ ID NO: 4463 - DNA, 1281 bp, A.fumigatus
tgcgactggctgacattttctatagaggcaggaaattacgcaattgatatattcaagcgagctggggagacggctggtggcgttgcctcgggtttctttcaagagttacagaacgttgcggagcagactcatcgcggctggcagaaaaccactgaagatatcgaagtcccggagtggctgcagaagatcctccgccttgatgaaggttcacatgacggaagcggcggctcgtctggaggggggtcccctaaagaaagtcgagctggtgctggtgtagttggggtggctgctggctcggcttttggttacagccagtctgacgaagatgaagtccgtcacgcgagacaaatcgccgaggatgaccagatgatgcttcttacgcggaagatgatcgagatcagaaatattcttcagactgtcgggcagtccggtaccctcacactgccatcgattgttgtcatcggatcacaatcttctggcaaaagttctgttctcgaggccattgttggacacgagttcctgcccaaagggaccaacatggtcacgcggcggccaattgagctcacactagtcaacactccaaacgcgcaatccgaatatggagagtttcctgctttgggcctagggaaaattacggatttctcacagattcagcggactctgaccgacctcaatcttgcagttcccgaacgggactgtgtttcggatgacccaatcaagcttactatctactcccccaacgttccggatctttccctgattgatcttccaggatatatccaggttgctggaaaagatcagccgccagagctcaaacagaaaattgctgacctctgcgacaagtacattcagccacctaatgtgattcttgcgatttctgcggcggatgttgatctagccaattctaccgccctcagagcaagtcgcagggtggaccctcgaggtgagagaacgatcggagtcatcactaagatggatctggtcgatccggagcgaagattcagcatactttcagatcagaaataccctttgcgtttgggctacgtccgtgtggtatctcgagttcctcagaacactgctctgttttccagggtatcggcaatatcactaatgcgattctcaagaatgagaatgcctacttttcggctcatccgtccgaattcggtcctccatccggtgtatcaatgggcgtttccacgctgccaaggaaactccttcctgttcttgacccaacattgcaggcaacctaacccggttttaagggaactcttcccccaataa

SEQ ID NO: 4464 - DNA, 1131 bp, A.fumigatus
  unsure (1125): Identity of nucleotide sequences at the above locations are unknown.
cgacggcccgtgacgaatttcgtcacgctttcttaccgtctccctagaacaggccggtcggccatccgatcatggcgaaggcaatatgctaatggtaatggcagagcaccagaatcatctgctccttcgtcaaattggcttcgtactgcacttggtctaggtggaacagctgccgctaccttcttagtctatacctttgcgaccacccgaagcgatcaacttgagagtgctattgaggcgaagaccgtcacgccaaaaattgctcaggatttggattcccagtatgtgcaagaaaaaaagagtctgaagagccctggagtttacctatggggaaacaacacttatcgtgttgtggatcctacctccaaagaatcggtggtgaagactcctcgacaattaccctactttgagggtcaagtgctccgagatctcaaaatttcagagaagtctggtgctgccattactgagaatggtgatctggttcaatggggtaaagggtactcggaaactgacttcaaaccaacaaagaccttgactggcaaggatttgaggtcgttgtgcatgtcgagtgatcgcatacttgcattggcctcaaacggaaatgtatactcactcccaattgccaaggatgaccaagaaagcggtcggaaacccaaggaaggctcttggttcccattcagctctggaagagctggcgtgagctatcgattgcttgaacccgcattgaggctaggcgaaaaagtcaccgccatcagtggtggactacagcatgcgcttctcttaacgaactctggtagagtcttttccgttgcttcttccactgagggctatccttcctttggacaacttggtgtgcctggattgacttggtcgactcgacctcaagggcccgtggatacctgccatgaggtgaagaccctcagcaactctaaggttactgaagttgctaccggagattaccattccttggcgcttaccaaggatggaaacgtttacgcctttggcgacaattcctttgggcagctggggtccgaattcgaccctgctcagccattcaacgatacccctactctagtgccactgaagcttttctacccacgcaaatcttgcttacggcagggcagngagtaa

SEQ ID NO: 4465 - DNA, 705 bp, A.fumigatus
  unsure (120): Identity of nucleotide sequences at the above locations are unknown.
agtatgcttctttccttccatgcagtccacactggcagatggtcgaatcaggatcgcatggccggcgcacaggatcttgaccggccctttttagcgttctcccaggacatgcctccggantggcagccggaacggcggattctgcagtaccccttgccccatgtgtatggccaggaaatggacatctatcgtgatcggcatgtcactcagacctggaatgttgtgcggcaggtgcgcatccaactcaacgaatatctcgtggactgttatgagacgttgaacgcggtccacggagttaaccagctcgctgcatctgaagctgccttgagcgatattgcagcgctgtcgctcgaggtttatgcctccgttccacaatatgcaagctatgcctgccgatcaaaacgcagccaaggccaggcagataacaccgatctctccgttgtctcgcagaagggctgcaacaaagtgcatacgccgtctgagctcctcgactgttacactcttctgtttccgatgtatgttgccgctcgatccaaggctgccacagccgatcagagacggtgggtctcgtacatgttccgttatatcagcgatcactttggcattcgtaatgccttgctactggcacagttactcgatcagaacagcgatattagtccttggtgcatttatgctatgctagggggatacggattcgccgcttga

SEQ ID NO: 4466 - DNA, 798 bp, A.fumigatus
aatacgatgttctgcaatacgtcgatccactcattggaagtgccaacggaggtaagctcccgagctagaatgttgactggtgtagacgatcgttttctgacagactcaataggtaatgtctttgctggtgcatcgcttccttatggtatggccaaggcggtagccgacacgaattccccgagcaaccagggaggctttacactcgatggcagcaatataactggtttttctagcttgcacgattctggcactggaggaaacccatccctcggaaacttcccattgttcccttatcccaaatgcaaaggtgacgatgtcaatggttgcgcttatccgaagaaagagcgccacatcggatatcatgcggactcggtcaaagcttctcctggatactttgcactgaccatgaactctggcattaaagtcgatatgaccgtttcccatcatacatctctgttccgtttccagttccccaccgacggtgcatcgagtccgcttatcctgcttgatcttacagacctatcggattcaagacaggacaatggaacgatttccgtcgatgcttctaccggacgcatgacgggccatgcgcgctttctgcccagcttcgggagtggatcatacgtgccgtacttctgtgttgactttcagagcaactctgcagttcgcgataacggaatatttgtcaattcacgcgcgagcacagacgtgaaggaattgaggatatctcggaatatcaaaggataccctcttccagtgagtcaactggcgggctcattcaataggaacctattctaa

SEQ ID NO: 4467 - DNA, 351 bp, A.fumigatus
ttgcccagcatgctgtcctgtgctcgaagccgcgtcgcggccttctccacggcgtggactccccgcttcgtcgcccgggccagctattcgacaaccatgcctcgcctgacagagaaccgcatgcaagccaatgacccgacctcgcgaacccccgagcccaatgtctctgccaccaatgctacccctaccgactcacagggtgtatgggatgctcctctgcgcgaggagcccgaggccggcgagcgtaaccgccagcttcaggcccccaaccgtgccactacatgggccgctagccagcagcctcgggaaaaggctatgaccggtcctcgtttcgagcagaccatcatggag

SEQ ID NO: 4468 - DNA, 249 bp, A.fumigatus
gctcaacaagtcatcagacatctttccgccggaatccggtgggagttcaccgacattgaagagactgtcaagtactaccggtctcattcgtgcatctatactatgctcaagtgcacatgtttgatcctggaggattgtacacaatatcagactgagggtccattgcctgctttgttcaccggctgcgccaactgttgtcttgtggcgctccttgataatagcagttgtcgaatttctaggatactatag

SEQ ID NO: 4469 - DNA, 534 bp, A.fumigatus
ggtaacctcgttttatgcatcttccgccgtctgcgtgcagttcactccactctctccccagctctgatgagccaaatgctggagctgattacgaaagctctcgcctgcgctcgccaactagtagacgcaaactgcccatggagccacgtggcgaatgtccccttccaggctatctgcacgctcctggcggtggacagtccggagtcgttgtctctgttagacgacgcggtgcagactctcaaatacgtgacggatgtctatgacactgaggtattgagggaagcataccgcaccgcgggctctctcattctattgcagcagagacgaaaggagcacgatgcaggccgtttgaccagtatctgggggcggcacttcggccctgataacgataccatgtcgcagcgacggccgagcatacaggattccgagtctttcagggacttggtcgcggatttgtccagttcggagaatttcgattttgcgcagttctttatcgcggataacccctggaatgcgctgggaatggatagctag

SEQ ID NO: 4470 - DNA, 243 bp, A.fumigatus
tctcattgggtgataccacaaagtaggcatacagacatacatacacacatacatacagataacggtagggaaatggaagcaaagaccgccaaatgcgacgacactcaatttgataaagcagatgacattcctctctcgtcgaactacaccgagatcccgacactgcccaactcgcccgatccccgttcatcaaaaagcggcatggacggaatccgagcaccctcccctacggaacagaactga

SEQ ID NO: 4471 - DNA, 690 bp, A.fumigatus
  unsure (147): Identity of nucleotide sequences at the above locations are unknown.
ggtggggattctaccacgcttggaacaccacctacaaacaatccttcagagttgcaacgcaaaaccaggacgatcttgcccccgcgcatccagtcgtggtacgtattggtcgcagggcatgggctcttggcggccatgtggctggcngacaccgtcaagggcatcgacgagggccacctcgggctggacagccggcgcgaagcccgcaccgcaatggacttcgtcgccaccctcggcggggacaacgcgctgcccgtcggggccatcgctcagcgctcctgcaaggggcgggactccctggccaaccgcatccagttctaccacgacgccgtgaacgaggccgcgtttctgacggagccgtggacgctcgtcctgattcgctgtttcgccaaggcggcgtatattctgctagacgacatcacgccgcagtcgcacggcgcgcggccggacgacccgtccgagtacgcccggcggaactgcgagttctgtatctcggcgctgtggtgtctggggacgaaatcggacatggcgtttgtggctgcgcgctcgttgtcgaagctgctggatacgcgactagggaaaggtgtcgatcagttctgttccgtaggggagggtgctcggattccgtccatgccgctttttgatgaacggggatcgggcgagttgggcagtgtcgggatctcggtgtag

SEQ ID NO: 4472 - DNA, 336 bp, A.fumigatus
  unsure (149): Identity of nucleotide sequences at the above locations are unknown.
acggtggggattctaccacgcttggaacaccacctacaaacaatccttcagagttgcaacgcaaaaccaggacgatcttgcccccgcgcatccagtcgtggtacgtattggtcgcagggcatgggctcttggcggccatgtggctggcngacaccgtcaagggcatcgacgagggccacctcgggctggacagccggcgcgaagcccgcaccgcaatggacttcgtcgccaccctcggcggggacaacgcgctgcccgtcggggccatcgctcagcgctcctgcaaggggcgggactccctggccaaccgcatccagttctaccacgacgccgtga

SEQ ID NO: 4473 - DNA, 645 bp, A.fumigatus
  unsure (148): Identity of nucleotide sequences at the above locations are unknown.
cggtggggattctaccacgcttggaacaccacctacaaacaatccttcagagttgcaacgcaaaaccaggacgatcttgcccccgcgcatccagtcgtggtacgtattggtcgcagggcatgggctcttggcggccatgtggctggcngacaccgtcaagggcatcgacgagggccacctcgggctggacagccggcgcgaagcccgcaccgcaatggacttcgtcgccaccctcggcggggacaacgcgctgcccgtcggggccatcgctcagcgctcctgcaaggggcgggactccctggccaaccgcatccagttctaccacgacgccgtgaacgaggccgcgtttctgacggagccgtggacgctcgtcctgattcgctgtttcgccaaggcggcgtatattctgctagacgacatcacgccgcagtcgcacggcgcgcggccggacgacccgtccgagtacgcccggcggaactgcgagttctgtatctcggcgctgtggtgtctggggacgaaatcggacatggcgtttgtggctgcgcgctcgttgtcgaagctgctggatacgcgactagggaaaggtgtcgatcagttctgttccgtaggggagggtgctcggattccgtccatgccgctttttga

SEQ ID NO: 4474 - DNA, 186 bp, A.fumigatus
  unsure (158): Identity of nucleotide sequences at the above locations are unknown.
cttggcttttctcgttcctatggatacaaagcgcaatcgaatgtagcccaaagctttagtcaaaagggtaccaggaatttcattaagcttggcataatccaacgccttcgcggttggcgatggggttggtggatacctcccatgggccttgggccatnccttttactaaccgaagaggaaatggcg

SEQ ID NO: 4475 - DNA, 501 bp, A.fumigatus
gatatcactagtctttttatggcagaccaactggcccttacttactccatacgtacttttacaggattaggccacacaaaagaactttacagccgtttccgccaaccgcccttacgccctcccgcttgggtcttcgggcccgtgtggaccgtcctctatggaatgatgggctacgcggcccatcacgcaacagcctccacgaccctcctcacgccagcgaccgcagtagcctctttccaaacattgtacacgacgcagctggtcctcaactacctctggatgccgttattctttggtgcgcggaaacctgggtgggcccttgcggatattgtagctctgggtggtacggtcggcaaactgatggcaatgtggtgggatttcgatcgcactgcgttttggatgatgctcccgtatgcaggttggctctgctttgcggcatatctgaatgttagcgttgggtggttgaacaactgggattttgacagtcgtgatggacgatag

SEQ ID NO: 4476 - DNA, 186 bp, A.fumigatus
ttggagctactattaacaaagcttagtcttcctgcccattccattaatcattataatcacgtgttcattcaactctacaacatgagtgacccttctttgggcagccgcttcattgacaacacacctttatcgtatgatacatacagcatcgtgatagaatcggcatccctttctcttcgaaggtga

SEQ ID NO: 4477 - DNA, 1518 bp, A.fumigatus
cgcggatccttcgacccccgtggtgaagacacgcgtacgggagccgcctttgtcccaattgaccccgacgctcctatagagagaatgcagaaaattctcaaattgactaatgcctgctgtattctcacctccgccagtctggctgagcagactcgcgccaaggctcctgccagggtggctgtgttcgcgattccgttggacagatcagcaaggatgtctactgattctgatttgatgccgggacaatcgatagtttcacacgaggcagtgtatgtgctttttacttccggttctacaggcattcccaagggcgtcgttgttacccacagctcgatgaagtccagcttaaaagctcatggccgtcgtctgggtctgtccgagagctctcgcgtcctacaattctccaatcataccttcgatgtttcactgctcgagatcctcacaaccctcgcgtatggtggatgcgtctgcattccatccgatggtgatcgggttaaccggctgtctgaatatatgcgtgatgctaaggtaaattttgcgattctgaccccctctgtggcccaaatcctttcccccgtcagtgtgccagaccttcgcacgctagccctcgccggagaggcatggggccaggaaatcgtgaatatctggagagactcagtgcgtttattcaacgcctacgggcccacggaggccactattctcagtgcgattggagaagtggatgctcaatgcttccgcccaaacaatatcggttcaggaagcggcgcgctttgctgggttaccagtccgactgacccgacccgcttgatggccatcggcgccgccggtgagcttctgctcgaaggcccaatactcgcgcaaggatatctcggcgaggaagagaagacgcgggcagccttcatcgatccacccatgtggcggcgtgagctctctagccatggggcacctccatgccgctcttccctgtaccgaaccggcgatttggctcggtacgaagaggatggctcgatcacctatctcggccgcatggacggccaggtgaagatccgcggccaacggacagaattaagcgagatcgaacatcacattcttgcatctgatgcggtaaggaacgcggtggttttgctgaggaagaacaagctagtatgcgtcctctctctccagtctacttccctcacgcctgctctttctcggcctggagacatccgccctgtgtctgacgatgatcgtgatgcggcccttcgtatatgcttgtcaatacgtgccggccttgctcggaaggtaccagagtatatggtgcccgacctttgggtgcccgtcatcgatcttcccctctcctcctccggcaagttggcccgaaagggcgttgacgattggctcgcatccgttgacactaaacacctgatcaatctgtctctgcagaagatacctttatcaacgacatcgccatcgcctaatatagcgtcatcatcagtggagcgggccattcgtcaggtcatagcgggcgccttgcagctt

SEQ ID NO: 4478 - DNA, 360 bp, A.fumigatus
aacgagatcagacgaattagtggagggaacatcacagatataaagcggtggtggcagcctaatacgttgcaactatgtatcacacaactcgaatctgacaactacagcgatatgcaggatactacagctacatctctacccttgtatctccattgtacccagtccggtttcctgaaagggactctgagcctcacctcgagcctgtactggccattgacctttggttctggtcttatgggcccctttggtttgccgctaccaaaccttcaagatgcatctgctaatccagtacaacctttacatggttggtttcccttcctcctaattttcactcagcattctgtgattttctctgcgtag

SEQ ID NO: 4479 - DNA, 660 bp, A.fumigatus
  unsure (36): Identity of nucleotide sequences at the above locations are unknown.
gagttcgttccgaccttcgatcctcgaacaaagacntattcgctcgaccccaagttaccatcggtaggcgaggcgctggcggatctggccggcagcaccgtgctcctggggtcgaggaatgctccttttgtgcaattcttcaactacaccaagccagataacgtgtcctctgcactcgccgagcccgtgtcgcagtatttcgaggccaccgttcgcgccgtcgggtatgcttccggcggcacggagcaatggcagaacgtgttctatctgatcctggtgtttgcctttttgaccagcgccatcattctcgccttcatgctgttcgaggtgcgtggacgacagatcaccgactttacagaaccgcagaatctgtttgcgttggcgatgaacagcccggccactgcgcagctgcaaggggcatgtggtgcaggaccgcagggtcgccagctgaacgagcggttctatgtggccatggaggaggaggatgagcattattacatccggaccaaggccgaggagaatgtgcggccggcctcgatgagagcccgtcgctctatggcctcgatggaagtcgacgagatgcccaaggctgtcagtccggccatggatgaataccggcggctttccagtaggagcagtcttttgtcgagattttattag

SEQ ID NO: 4480 - DNA, 474 bp, A.fumigatus
ctttgcaacctctggatgagaaaagggtcccataatctacgtgcgcaatgtaagtttagccttttgatctacacggctggtcatctcggccgtcgaggagcttgtgctaacgatcctgattaccagctgccatggtctacttgcaatgacgatctggtggatcttttctccaccatcggcaaggttgaacgtgccgaaattcagtatgagcccaacggtcgctctcgtggcacaggtgtagtccaattcgataacgcggagactgcggagactgcgatcggtatgttaccgttggaaaatatcattgaccgcacgcaggctaacccctccacagccaaattcactggttatcaatatggtggtcgtcctctcggtatcacgtttgtcaagtacctgaatgtcgaccagggccaaggcgaacccatggaaggcgcagaaaccactaccggtataacgcaggatcagatcatgtaa

SEQ ID NO: 4481 - DNA, 363 bp, A.fumigatus
  unsure (300): Identity of nucleotide sequences at the above locations are unknown.
gcattcttttccttccacgcccggcgtgcagataagggctccggcattgtggctttcgaatctccggaggatgcgcgcaacgctattcagcagttcaacggctacgactggcagggacggacattagaggtccgtgaggatcgctttgccggttccggacccggctttggcggccgtggaggctatggtggctacggccggggtggcttcggtggtcgtggtggttttgccggccgtggtggatttggcggcggcggcttcaggggtggatacggcggcggtggttttggaggcccccanaacttcgagcccgtcgcatcggttcctcccaacccatttactgactttgcaacctctggatga

SEQ ID NO: 4482 - DNA, 759 bp, A.fumigatus
atgctggacaaaatgggccgattgtcggttttcaaccgaaaacgaagagccgcggatggcactaccccctcggccggcagtaatgaatccctatcaccccctgcaacggcagcgcctttgaatgatgcagagaaaatcaaaccggtcagcgaaacagcggccatcgagcaagaaacggaacaagatcccgaagttgcagcacttccccttgaggtccgccaactggtcagcctcacagacgatcccactctgcccaccatcacctgtcgctatttcctgctctccctcctctttgttgtccctggggctttcttgtcgcagatgagccattaccgtacaacgcaagcgccgtattccgtcttcttcgtgcagattgcctgtcactatgtcgaccactttctggcgcggtggctccctgcctggacgatccgcatcccgctgacgaaatgggcattcagtctcaaccctgggccgtggagtatcaaggagcatgtgctcgtcaccttgacagcagcatctggcgcgacctacaatctgggctacgctcccatctcgatggctgaactgttctatggagaaagagtgcacccggccgtggcgatcttcttcatgtttgcgattgtctggattggatatgccttagcggcgattgcgcggcagatcttgttgtatgatcctgctttcatctggcctcaggccctgatgcaaaccaccctgttgttttcatccacgaggagccgccatcctccgcgagtgtct

SEQ ID NO: 4483 - DNA, 246 bp, A.fumigatus
  unsure (83): Identity of nucleotide sequences at the above locations are unknown.
caacggaggttgcttggtgcccctgaaggggctttccaagggagtttcaggggactcgcttcccgccatccaaaccaccaccntggtaaactggccatccccatcaacatcaaacacgttgcaattccgcatgtcattctgggtgccatccatcaactctccaacataagtctgttcggtggaaaccctgcgattgacctcgtcgacaacgatgttggtgatttcatgacgcatcgttcgagctga

SEQ ID NO: 4484 - DNA, 183 bp, A.fumigatus
gggcccttgcgtcttggttttagctcggaaggcgtgatcgagtggctatctaccgcaagcagcgctattagtcaccgcaccggcgatacttacatactaaccttgctcttgtgtgaatacgggaatgggccatctctagttatcaagatatctgcttgttggatttccaagtatggatgctga

SEQ ID NO: 4485 - DNA, 561 bp, A.fumigatus
tctataaacatgagtaaacataatccatcatggctctactccatcctgttcttcaccccctccagcacccccctcgcccacttctccctcctctcaaactccccattgaacaagcctggcaacaccctcttcgcattcgcatgctcctcatcaaacaccgggccctcccaccctttctgtctgcacatcacaaccgcctcctccaacaatccagcccccacccccttcccgcgataccgtctctcaaccgtccacgcccaaataacccccgtcattttcaccttcttctcacccgcaggaacagggaccccacgcaacacaaccaccccaataatcctttctgcgaacttcgtcaccagaatctcctgctcctccccttgcccccgttctttaggattagtgcgactaggcaacagccactcccctttcccaaccctctccgcctcctcaatataccccccggtcaaccccctcacgaccaacaatcccgccatcacgcaccccgcgctcgtcgtcccgatgagcgggaggtcagaggaatcggtgtacagcgctttatag

SEQ ID NO: 4486 - DNA, 579 bp, A.fumigatus
gggaatctgatcgtgatgtgtgcgggagccatccccggttactggatgacggtggccaccgtcgacaccatcgggcgcaagcccatccagctgcttggcttcattatcctgaccattgtctttatcgtaatcggtgtcgcatacgagcccatgaagaaatcccacaacggtctgctgggtctgtacgtcatcgcgcagttcttgttcaacttcggccccaacgccaccaagtttatcgtgcccggcgagtgctttcccacccgctaccggtccacctctcacggtatctctgctgcatccggcaaggtcggcgccatcatcgcgcagtgtgtgtttggacctctggtgcacaagggcgccaaagacccctcgcaatccccttggctcaaccacgtcatgcagatctttgcgctgttcatgctgtgcggttgcttcaccactctgctcattcccgagaccacgcgcaagaccctggagcagttgtccggagaggagtatgagagtgataccctggtgcagaactctcccatgatccaggcagagaagaaggtggataattcaagtgctgcggatgtttag

SEQ ID NO: 4487 - DNA, 318 bp, A.fumigatus
  unsure (241): Identity of nucleotide sequences at the above locations are unknown.
cgtggcaaaccacgtcatttcctcgaggccagctatgttctctggaagcggattgttggccccagtccctatcttatactccctaactacgtgtatcagataatggttgtggaagcctgcacattcttcaagctctgcaagagtttcttttcggcgcatatagatatggactacaccaagacccttttcaaccgaaccatctgggcgattcggggtgtatcggtgtccagcaacgacctcnccgaacggttggcggaagtcttggcccaaatgtggcgaatgggcagtaccccggcaacagaaagcatccgctactag

SEQ ID NO: 4488 - DNA, 330 bp, A.fumigatus
tacttccctttttctccagcttacctcaagaacccgacaaatcccgactcgaactcggaatcttcagcgtcgtcaaccgcagggcccgcagggcgcacctcgtcctccacacccggcctcccggctgacccaagtctcgcgtccgctaccatgatcccacagggcagtctgggagtcgcccccgccagcggagtgaccaatctccccagtggattcctcgagcccaactacgaggtctttgatcctttgaactggctcctggacggcctcgtcgatctcccgtactcctactccgcaatgtcagggatggagccacaaactatcgcctga

SEQ ID NO: 4489 - DNA, 510 bp, A.fumigatus
aggtacagaggtgatacaatgtcagccgagagcagaaaaacaacaacaaagataggcacagggacaacgacagcctcctaccaaacccaccgccccgcttcttccctcctcatcgcctccaaacgactccttgtgaagcccagccccgtgccccaaactataacccccaacgtccatcccgccagcatcaccatcaagccttcgttatcttcgatagctacacctacgcgacctacagaccgatcaaaagcgcatactgtcgagatggatttgtcgcagccgccgcagccgttccttgatcccggcgtatgggagcggatgaaggccgcagggagggacgcgtcgaggggtccaagtgccgagcgggaggaaggggaggaagagaggaggcggcggagggagcgcgaggcggagtttgggcagatggcggtgcgagggagaatggggggattagggaggcaggagatgatcggccctcgcaggcccagtttaaccagccgaagcagctag

SEQ ID NO: 4490 - DNA, 354 bp, A.fumigatus
  unsure (60),(61),(62),(63),(64),(65),(66),(67),(68),(69),(70),(71),(72),(73),(74),(75),(76),(77),(78),(79),(80),(81),(82),(83),(84),(85),(86),(87),(88),(89),(90),(91),(92): Identity of nucleotide sequences at the above locations are unknown.
tgcttcacgaccaccactattactctctctccctcccccgccgcgtgcctcgctcgcccnnnnnnnnnnnnnnnnnnnnnnnnnnnnnnnnntgaacactgcaaggattacatggccgactacatctccacaaggggcggctatctggagaacccatccgcaaccagcgactgcaccttctgcaccatctccagcacggataccttcctcagtgccgtcagcagccactacagtgacgcctggcgtaactttggcatcatgtgggcttacatcatctttaacatcttcgctgccgttttcatttactggcttgctcgcgtgcccaagggcaagagaaccaagggttcgacgtga

SEQ ID NO: 4491 - DNA, 207 bp, A.fumigatus
ttgttcgatgctctccttgtacggactgtcggttcttttcttttttctttcccctttcttttcttaacctttctcactgtccaaaaatctccttaccttttcacctttcacctatctttgtacatcaatttcagattccttgtgattattcctctcgtttattttgtcgctggttttaatacaagttgtctggcggtatcttcgtga

SEQ ID NO: 4492 - DNA, 186 bp, A.fumigatus
ggacatacgaccttccacgtctttgtgaagatcgtcctgagtgccctcatccccaaacgcgtcggcgcaaccatcgtctccgtgtgtgggccgggcgcctttgcagatgaggtccgcgccgcggcgcgaaataacatcgggaagggcgcggtggtcgattttgtcgaagaggcgttcacatggtag

SEQ ID NO: 4493 - DNA, 333 bp, A.fumigatus
caaacacaggacgtcgccgtccccggcggccagcgcatctacgttgacccccgcggtgccctccgcttcaccaccgctcactcgggctccatcccccctggctcctctaccggtccctttgtccacagcgccggcacgccattcggacacttcgcctacaagggccagggcgccaagggcttcatcgcttgccccaagagcaatggcaccgccacgcactggcaggtgtatgcctctgttgcgaacgttgccagcggtgcggaatgtctcggtttcaatgctttggcggtaccttcgaatgacactcgggctgccgcttgggagtatatctaa

SEQ ID NO: 4494 - DNA, 207 bp, A.fumigatus
cccgcagtacttcaaggagcctcaaccaagcaaaccaattgcaacaaagtaaccccttgcaacaataaggaaacatacctatcgctctcgcaatccctccccctctccgcacacaaacctgcaaccgtcagcaaccgtcagaatccccagacaatacctaccgaaacccaagcgcaggcttacaccccatctgcccatcattcgtag

SEQ ID NO: 4495 - DNA, 690 bp, A.fumigatus
ccttcgggccccgtggtgaagatcccggttcttttctcactcctcaccctggcctctgccgtcagcatccccatccgcaacaatggccacagcaacagctacagctaccacaccagcaacagcacgaaattctccgtcatgtccgcccgctccggctcgcccatccacttgctccccatgaatgcagcccacggcaacttctggctcggcgagtccccctccaccttctgccctgagcccgtcgagaaggtcagcggctgccccccaggcaccaccacccggttcgccagcgcgaacgccttggtacgtcctgccctatactcgcctggtttgaaatgtactgacaaacacaggacgtcgccgtccccggcggccagcgcatctacgttgacccccgcggtgccctccgcttcaccaccgctcactcgggctccatcccccctggctcctctaccggtccctttgtccacagcgccggcacgccattcggacacttcgcctacaagggccagggcgccaagggcttcatcgcttgccccaagagcaatggcaccgccacgcactggcaggtgtatgcctctgttgcgaacgttgccagcggtgcggaatgtctcggtttcaatgctttggcggtaccttcgaatgacactcgggctgccgcttgggagtatatctaaatcgaggccctga

SEQ ID NO: 4496 - DNA, 486 bp, A.fumigatus
cttggggggcatagattcgcttggttacctcaactgctcacattctgcatcttggcaggatcagcaataccacaatttgacctccatgcaaagtccgtcgggtcgtccgatgagataaatgcaaagcgcttgggttttttctcgctctgcatgtcgtcggctctctcgtgggcaccctccgctgcagactattatgtttattacccatccacgatcaggccatggaaggtttggtcagtgactaccattggagggtgcggagcgatgataatgagtattctcctgggagttggcctgggaaccggtgttgccagcaatatcaggtggcaggcactctatgacggaactccgggaagcttgttgatggcgggctatgacaggcttggggcgtttggcaagatttgcgggttcattaatgtgctaacggtggtttccaacaatggccccggaacatattcgctggcaatgaactttcaaatgctctga

SEQ ID NO: 4497 - DNA, 474 bp, A.fumigatus
gacatttggtcgagggttccgcgtcctatcttcaccatcgcaagtaccgtcacctatacagcatgtgcaatcggagggagggatttcctctatcagatcttcaagaatttccttcctctgatcggatactggatcatcatctggttcaccatcgctgtcgaggaagatgtgcttttcaaccggtgtcgaggatactattggagtatatggaatgactggcggaaactcccagtgggtgttgccgccggggtttccttcctaatcggatgggcaggggcgattgtgggtatggtaagtgaaggattcctccttttttcagaggcgcctgcaacagacccatgtttgctgacagctcgggcgccaaacaggaccaagtctattacactgggccagttgcgaatgcgacaacaggaggatgtgatcttgggatctggctcggtctggggttcaccgccatatcttttcctgctctga

SEQ ID NO: 4498 - DNA, 249 bp, A.fumigatus
gtcatgaccagatacttcatgggttactaccccaacaaggtctgctgttcgctgaacgtgttaaccaatctcgggtatggaatgatcaatgccatggtagggggtcagattctgtctaagctctccggaggaactgtatccgtcattgtcggtattatcattgtcgcccttggaagtgcaatcatggcgacgtttggcatgcgcgtattccatatatatgagaggtattatccttgcgcacagtgctga

SEQ ID NO: 4499 - DNA, 207 bp, A.fumigatus
aggattcctccttttttcagaggcgcctgcaacagacccatgtttgctgacagctcgggcgccaaacaggaccaagtctattacactgggccagttgcgaatgcgacaacaggaggatgtgatcttgggatctggctcggtctggggttcaccgccatatcttttcctgctctgagattgttggagcttcagatgcttggtcgctga

SEQ ID NO: 4500 - DNA, 195 bp, A.fumigatus
tctactccatgccatatacttgtaccctacaaactacattactacattctatatagtctaggtcctatgatctactctacaatcttttctatactctacagcctacgtccgacagcctacgtcgtgcaatctactctattatatatgtcctactctacgccctacttatataatctactacaatctacttcctaa

SEQ ID NO: 4501 - DNA, 231 bp, A.fumigatus
tatatgctagtctataagttcctcctatctattagttttaaatatatatatactaattattctatctttattaaacatagcattactatactactctatatagataatattcttatacttttaaattctaataatcttattaataacttccttaagcagctaggaaaattatttaaatatactaataatagtaaggtttctatttacctagggattaatatgctatattaa

SEQ ID NO: 4502 - DNA, 189 bp, A.fumigatus
cttatactagtaacctatctagatattacttttactatatctaagcttacttactttactaggaatcctagccctaattactttattatagtaaagtatgtattctgctatctagtagagatactcttacttttattattttatccttctatgcttagtaagcttaatagttttattaatactaattag

SEQ ID NO: 4503 - DNA, 825 bp, A.fumigatus
  unsure (789),(800),(802): Identity of nucleotide sequences at the above locations are unknown.
gcatcattgacccttgcgggaagcgagcgagctagtgccactaagaacagaggcgagcggctcctggaaggagccaatatcaacaagtcccttctcgctctaggcagctgtatcaacgccctctgcgaccctcgaaagcgcaatcatgttccttaccggaactcaaagctgactcgtcttctgaaattctccctgggcggcaactgtaggacggtgatgattgtgtgcgttagcccatctagccaacatttcgatgagacacaaaacacgctgcgctacgcaaaccgagcgaaaaatatacagactaaggtcacgcgcaacgtattcaacgtcaaccgccatgtgaaagacttcttagtgaagatcgatgagcaaatgaatctgatcaatgagctcaaagctcaacagaaagaatctgaaaaactggccttcgcaaagttcaagaagcagactgaaaagaaggacgcagctattcgggaaggtgtctcacgtattcgcaacgcatatgatcactcgttgctagaaaggcaagagaagatcaatactatgatcaaattgaagcaggtaaaccgccggatcggcatgttatcttcatggattgcggctttcgacgcggtgtgcgcgaactctggaaacgatgaacctttatccaatctgcaagcgattcggaaaacggcgcaaggtatcctcctcgaactggagggtagcaggcaacattaccatcagcgactggccaagaataactgggaccgagctatgaattctgctgtagagaaccccatccgtgtnttcatcagacngngcgaaggatcaagcgtagtgcgt

SEQ ID NO: 4504 - DNA, 684 bp, A.fumigatus
catgctcaaagagtctttgaccctccggaggacaatccagtccagaagttctcgagaagcgttgtgccaaacggcaaacgcgttaaggaccagacattcgccttcgaccgcatctttgaccaaaacgccacacagggtgaggtgtatgaagcgactacacgaaccctcctggacagcgtacttgacggttacaatgccacggttttcgcttacggtgccacaggatgtggaaagacgcacacaatcaccggcacagcacaacagcccggcatcatcttccttaccatgcaggagttattcgaacgaatcgaggagcggaaaggagagaaacacaccgaagtatcactctcatacctggaaatttacaatgaaacaattcgcgatcttctggtccctggcggcagcaaagggggcttgatgctccgtgaagattcgaataagtcggtttctgtctccgggctatcaagtcaccatccgcaaaacgtacaacaggtgatggacatgatcatgcggggcaacgaatgccgaacaatgtcgccaacggaagctaatgccacgtcctctcggtcgcatgcagttcttcagatcaatatcgcccagaaggatcgcaatgcggatgtcaacgaaccacatacaatggcgacattgagcatcattgacccttgcgggaagcgagcgagctag

SEQ ID NO: 4505 - DNA, 1392 bp, A.fumigatus
aggtacaaaaatcagcttctccatggatgtcaagatccggactgccgcactccgacctgcgcgagttataggcgaagggtatctgaagggccatatcgccgttacactgagctaagtgcccggaccctggcttgctacttagctagcctggacaatccggagagtggtctctgccgtaacacccagcgcctttcgtcggagctgtcgtctcacgatcatccgcgttcatcgagacggtcaagccgcggagcattgaccgaccttacggaagcacgaagtccgtcatcggtatcaagtcgaaggacacctggcgatctaccggcagatagagccctgctcaatcaagatacagcatctgcaaagccctctgacaacactagaatagggtccgattcgtatacggaatcgcgacaacagaatgtgtccgcgccagttgacggtgattccgcaacgcaacgaatgaaagacccgaaatcctttacgcagaacctgtttgataccctctcgctccggatggtcgagtggctccctctacggcggtcaccagacgtgctggattcagatgcagatcgtttgggtaatcaatacgtgcggtcgcccaaacgcgagggttgcgaacatacagatactactgtgggatctacatgcgcaaagcggcgtgcaaacttgaaaaataagtcagcgcgggttgctcctcatactccttcgtcgcaggatgcgagtagacgagtcccccgagttgagtcgaaacccgagcaccaagtgaaacgaatatccttggttgaaacagaccagcatcaacaaagtccgcgcacggtcaaagaggggaagtcgcggttagacttgaggccaagccgaaagctctcttacaattcgcatcttgagactgatgcatcggtcaacataccgtcgccgccggcattgaagcatcgcccgcaaaaacatcgcggcagaaatgaacatcttgatgggtcttttacacaggcacagcggaagaagaaagagaggcgtgtgtcatgggatagtgcgaaatttctgaatgacacccagaatcaggatgccgaaaagccgctggcagctagagactcccacttggcatcggagacgcaatcttcgaacgatgaccagttaaacttcaaaagcccttatgaaaaggtggaacgaccgctgactgttcaaacgttaagtcacttaaatagcgcaatcatcgacgggctcgcgcgaatgatggtccaatctgacgaagaagctcatagatggagggatgagctgcgttacattgaatctacagggaactttgagaatccggaatggcagtttgcaacatggcgccagcgtcgagtgtatatattccttgcccagagtgtattctacgcactgggttctaccaac

SEQ ID NO: 4506 - DNA, 186 bp, A.fumigatus
ataaatattatagtacccaaaatcgacgatcatcccattaagattttctatggagtactcaggtaccgtttgagcaaaagacccatcgtaccgaccttgtccttttgcctaaacttttttctttcccttttcttcttcactgttgccagcgtgcaaattctgattcagctcattgatcaaagatga

SEQ ID NO: 4507 - DNA, 216 bp, A.fumigatus
gtcaacgtcagcaaatgggttgcccgcttacattgcggctaccaacaggacaccgatagcctctctgtagtgcttgacgggacaatccagacgctatctactcaaaatgcaccagacaagggcccagtcagaggactactctttgtccctacccttaactctcaggatccatgcaccgtcttcaccacggggtggaaggaccaggtctcatgggat

SEQ ID NO: 4508 - DNA, 261 bp, A.fumigatus
aattactgctacaacagcctcaacccctcgtctcagccctgcctgcaatatatctataacttaaacatgttcccccgctgcttcgcctccagagcaacacttacttccagaccttccacacttacacccttcccatccacacttatccagaaccgcaccttcgcaatcacctcgcctaccatgacccgccttgcagacgcaatcaaagacgaccaccgcgagctcgaagaagcctacaacaagatcctctccgccaaaacc

SEQ ID NO: 4509 - DNA, 468 bp, A.fumigatus
ccagccgcgcaggtgcttactcatgtcccattcacgcacctcagtatactttacaaagtcagcgagtgttgggtatccaggctaacactgtgtctcttctatagtttcgagtcttttgttctgtctcctggagaagagaaagtcgaggttgagaccgatactcgtaagtttttcaatcaaacttcgcggtgcaaatcaacaacaaccgatctaatgcacctaggtattccatcttcctcgattttcactttcaacaaagaggaccacacgctcggcaacctccttcgatctcgtcttctgcagaattctcacgtgatcttcgctggttacaaggtatgcccgcccatggaagctgtgttttcctcaattttatttgaggttttaggagctttccttgagagctttgggatgcatggctctgacgaattgtctcaggtcccccatcctgtagttcccaaggtcttcacc

SEQ ID NO: 4510 - DNA, 264 bp, A.fumigatus
ccaaggacaaccgcctttgaaggacatcagagaacttacaagcctgataatccgaggttagtaaggggagtcctttgtacaaagctgccaaggggagttattagacggttgtgggcttccgtgagcgaactgaagatatggatggaagagtgtagcaatgaagaaggcctgtctagtctaggtctaactatcaaaatgctttatcagattcaatcattcattatctaccgcgtcttcaccgcggggctggaaggggcagcgcaa

SEQ ID NO: 4511 - DNA, 690 bp, A.fumigatus
  unsure (121): Identity of nucleotide sequences at the above locations are unknown.
ccggagatattttggtttgaaattaattcggagctgttcggaattgtctcaacacgccaccttggtttgaggcggccatatccaaacaagtttagcctttcaaaacaagaatacaagttgntggttgattgttcccttgttgagccaaggcaacaggaaggaagctttgcaatccatccggtggtacaggactggtgtttccatattgctgcttcagaggaacgaacagtccagctatatgaattagcactagtctctgttggttatacagtcccacgcaaggatgacagggagtatgcacagcttcagcagcgattacttccacatgcagactatgtgattcagagggagaaatacagttggcttgaggacaaagtcgctgtgtggagagcgctcagtaggttgggaaatctctacactaatcagggcaggctgcaggaggcagaggagatgtatcagcgagcactagcaggttatgagaaggcactgggcccagaccatgcaaaatcatgcaagcttgctgatgatctagcttctcgcgctagcctcagtgccacacaagagatgcctgattccatgccctccaaccccacggcaggacagccacgggctgtcagtgctctccaaccctctttaccagaaagcctacagaaacggcatgttttctcgaggattttctgcagaagatag

SEQ ID NO: 4512 - DNA, 195 bp, A.fumigatus
ttcgttgatgataagaaaataatgaccagaaggtgtcacggagctgcatctcaggcacagaaaaacgagtttaatggggcgcaggacgtgcccgggcaagtctactgcgaagttttcgcctgcttgctaaaggctgttcctctgatcgtggaggcctcagccgcaagcagtggctgtgcaggagacatagcatag

SEQ ID NO: 4513 - DNA, 291 bp, A.fumigatus
gggagcggcggcggcagcacgttcttattccaagtggctctcgcactcctgaaactcaacgagcagcagctcctgaccacctgctccaccccggcggaactctatacatacatcaaccaccaaatgaccaaccacgccatcagcatcgacgggctcatccaggccagcgaggccctccggaacgtcgtccgccgcgaagacgtcgtggctcgacgggcagaggccctgcgagaaatgagggaactcggcggatcaacccagtcagctgatgccgaagccaattccgcctga

SEQ ID NO: 4514 - DNA, 1500 bp, A.fumigatus
  unsure (1464),(1484): Identity of nucleotide sequences at the above locations are unknown.
agaccgacattgagataccccgttttgcatcctgtcttgccgcacattgcgtctattattcctcagtcactcgcctgcgatctccttgacgtctacttcactagctcttcctcgtctcacctatccccccagtcgccgtatgtggttgggtatattttccgaaagcaatccttccttcatcccacaaaaccgagagtctgcacgcctggtctcctggccagtatgctctgggttgcagctcagacaagcgacgcccctttcctcacatcgcctccatcagcccgcggcagagtctgccagaagctacttgaattgaccattggtttactcaggccgctaatccacggccctgcgcccggggaaacgtcgcctaactacgccgcaaacatggtcatcaacggtgtcgctctaggtggcttcggtgtttcgatggatcagttaggcgctcaaagcagcgcgacgggagctgtagacgacgtcgccacctacgtccatttggcgacggtcatctctgcaagcgaatacaaagcagccagcatgcgttggtggacagcggcgtggtctctcgcgcgggagttgaaactcggccgcgagttgccgccaaacacccctcacgcacgacccgatgctgagcgagacggggacccagacgccgatctctcaaagcgacatcctccaccgctcatcacgtccatggggcacggccctggcaacaccatcatcaacattaccgaagaggaacgagaagaacgccggcgtctatggtggttactttatgcgacagaccgtcatttggcgctttgttacaatcgtcctctgaccttgctagacaaggagtgcgaggggttttgcaaaccgatgaatgatgacctgtggcaggccggggacttcgccacttatcgccaggccggccccccagtcgagtgtacaggccacagcatgtttgggtacttcctcccgttgatgacgattctcggggagattgtcgacctgcagcaggccaggaatcatccccggtttggtcttgcctttcgaaacagtgcagagtgcgaggctcaggtcctcgagattgcgcgccaactagatgtgtatgcgcagagcctcaaggaattcgagacgcgatacactagcagtctcgctctaggcgcggcggagaccgaggccgctatggacgggtctcacccgaaccatgtgagtccttcaggccggtcgagcagcacagtcgaatcacgcgtaaacgagtccatcgtgcacaccaaaatggtggtcgcttatggaacacatatcatgcatgttctacatatcctcttggcgggtaaatgggatccgatcaatctgcttgatgacaacgatctctggatttcttccgaatcatttgttgcggcaatgggccacgcggttggcgccgccgaggcggctgcggaaattctagagtatgacccggacctcagctgcaccccgttnttcgtttcacagcccagcanggaaggtaccgtagtc

SEQ ID NO: 4515 - DNA, 186 bp, A.fumigatus
aatcaacttaggctaatcggtgttcctttgatacaggctaagatcaacgaccgtggtattgccgccttggcctacaacgtcctgctccgccctggcgtcaccctgggtcttggtgcttccttcgacactcagaacctgaaccaggccgcccacaaggtcggtgccagcttcaccttcgaagcttag

SEQ ID NO: 4516 - DNA, 747 bp, A.fumigatus
cttgaggccaaatacgtcgacctgcctactggtaaacgccccataacgcgcaaaccacctgatcccagcaccaggaaaaccggcgaagccaggtccatgttctcctttacatgcggccaggtctcgtcagcatacttcagattcctattcatgaccaggatagtcgctcattccgtgatgctaatactctgtccccacccaggtctcaccctcacccaggcttggaccaccgccaacgccctcgacaccaagctcgagcttgacaacaacattgccaagggtctaaaggccgagatcctcactcagtacctgccctccaagcagtccaagggtgccaagctcaacctctacttcaagcagcccaacctgcacgctcgtgccttcttcgacctcctcaacggcccttccgccaacttcgacgctgtccttggccacgagggattccttgttggtgctgagggtggctacgacgtccagaaggctgccatcaccaagtactctgctgccgtcggctacagcgttcctcagtacaccgctgccatcactgctggcaacaacctgaccgtcttctccgccagctactaccaccgcgtcaaccagcaggttgaggccggtgccaaggctacctgggactccaaggccggcaactctgttggtcttgaggttgccagcaagtacagactcgacccctcttccttcgccaaggcatgtagaagcgtcttcttttgtgaaatcaacttaggctaa

SEQ ID NO: 4517 - DNA, 273 bp, A.fumigatus
ccccgaagtgtcctggattctggagcgacccgcactgaatgtttggtagggtgccttcttcacgacatcttcccagaaaaattcttctatttgcctcacactatttctcataggatcggcgactcgagacacgtcatgacctatacgatcggggcaggcaacgcctttaacatggtgctctcgcaccgggatacctcggacccggccacgtgggataagcagacggccctgcaggatatgaaggccgaattccagggatgggaccctgtgtga

SEQ ID NO: 4518 - DNA, 246 bp, A.fumigatus
gtctccttctgcgtgtctatacgacgtccccccttgctcatgtgtccccacagcctcaccaagatcattgggatggtagagaagacaatcaaatggcccttgatgagcggctcgttgctcacgcgctgggacagggggcaagtagtcattctgggcgatgcggctcatgccatgctgccatatatgtcacagggtaggatggacgcccccccatttggattaaaatcccatttacctgtcccgtga

SEQ ID NO: 4519 - DNA, 594 bp, A.fumigatus
gaacagacgccaacctaccccagtaattgcctccagtttgcgaagacgctggagggcgccctgcccgatgtccccaagcccacgggcaacgtgggcttgaatatccttcttgtcggagcgggtctcggagggctggccacggccatcgctctcacacaagccggccataaagtcaccatctacgagcagacccccatgctgggggaagtgggtgcggggattcaaatcccatccaactcgacccgcatcctgtttaagctcgggctggagccctatctgaagccttatgtcaccgagccagaatctatctccttccgtcgatggcagaatggggcggtgattgggaagaccaggctacttccggacttcatcgataactttcaggcgccttattacgtgatccatagggcagactttcactcggcgttgtgtcggaaagccaatgacatgggtattgacatccggctgggggctagagtcgtcgattacgatccggttctgggtagcatcaccttgaaagacggcacaagccacaggggagacctggtcgttgcggcggacggtacgccctccctttgctacccttatctatga

SEQ ID NO: 4520 - DNA, 195 bp, A.fumigatus
tcatcccccacagcctccgcagatttcccggcgtcttcaattaaggaagatgatgggataacctattatttccttgcctctatcatcaaggacactcagcagttcctccgccaaatgccccggataaagctggttctcgtcgttgcatcctaccagtctacaacttcaaatatatggataagaccaggaccatga

SEQ ID NO: 4521 - DNA, 1134 bp, A.fumigatus
gtgcaatcaagtgcagacacgtactcgatggtcaccatgcttaagcatgtattgctagccactgcagcggctttcctagtcttgaacgtcgtcgctggagagttatgcaacagtacagcacctgttgtggtacatccgactcctcccggtgttagcaaatatgactcttttgcggttcatgtgcgctccaatgctgagaagacacaagagtacactgtgcaaccgttccttgtccaagtcggcgaggccaataccaccagcggagcgagtatcgtgcacaacacttccgtcgcatactttgatttctgtggctccgtccaggtatcgttgacttccaacaatggccccatacattccgttgtcgtccgtccgcactcctacaacatcgttcccaacgtgcacggagacgttgtcactttttcgcttgactctcccaagaacgtggtgatccaggtcaaccatgatatctgggacgtgctcacccttctcaccaaccccattgagactgagatgcctaacccctcggatccgggtgtcatctactttcaccctggtatcaataacagcacggcgatcacgacaaacaaatcactcctcataccgcctgggacaaccgtctatgtagcttcgggggccaccatcacgcttccaatagccttccacaatatctctgacgccagcatccgcggccgaggactgctgctcaaagcccctatcacaatcgagtatgcgtctcgcattgcagtccgcgacctagtcctcatcaatacaaacatcggtgtcgcagtctcgtccgatgtgaccgtaagcgggatccggtccttttccatcggtgcatggggcgacggattcgacagctactgcagccgcaacgtgctggtggacagcgtgttcatgcgcaactcggacgacaatatcgcactctaccagcaccggaacaactggtccggagactcgagcaaactcactatccagaatgccgtactctgggcggaatatgccaccccatcaatatcggaacacatggtaatacacccaacccccgagaacaaggaacggcgtctttatcaggaacatcgacgtgctcgaccatcgcgaagccgcagatgttggtaccaaggaatgctggcttat

SEQ ID NO: 4522 - DNA, 699 bp, A.fumigatus
agacaggcgcagctaaagggacttctgtcggcatggatgcaagacagttactctccctttgaaatggtgcaaagcgacctggaggctatcttcgcacctgctcaaggattgcaggtttcagaatacaacgaagagaaccagagcggtctagtggtccccgaacgtagagacatgaagaacgagctatgcacatctgtgttcccactcctcgtggggttgcattcccaaaatgccctacctgctctgctttttaactatgcacggacgacatgcgaaaagatcgctatcacgactctagagattctagtcaaggctgaggacaagtacaagagtggtgcatcatggaggcagaagatggcggactacgagaaatacaggaaacttgcgaccaagaaagctcataccaatgagaaaagcaagaaaaagggcaatcctaaacaacctcgggaggaaactgagaggaccgcaaaggatgtggaggaagataatagtccattcaagaggtttgacccgggcaggcctctagagcagttttcgtttgctgatacccagaaattcgactggaaagaccttctcgaggagatagaaataatgaaagggcgcaaggtcaagcctctgttactcgaagctctgaagagaggagtaggcgtccaccatgccggattgaatcgtcattaccgccagtggtatgagatgtga

SEQ ID NO: 4523 - DNA, 606 bp, A.fumigatus
cctccttcatacgagcattggatattagctaactatttgcacagcgtcgagaggctattccgcgcaggattcttgcgtgttgttgtagccactggaacgctggctttgggtatcaacatgccgtgttcgaccgtggtcttctgtggtgacagcgtcttcttgaccgcgctcaatttccgtcaggctgctggtcgagcagggcgccgagggttcgatcttcttggaaatgtcatcttccatggcattccccgtcacaaggtatatcaattgatgagttcacggcttccggatctgaacggccatttccctataacaaccagtcttgtgcttcgactgttcatccttcttcataattctaaggattcgccatacgcagcacgggcaatcaattctttgctgtctcagccacgcatcaacttcggaagtgccgagtcgaaggacagggtgctccatcacctccgcttttccattgaatacctgcgacgccagggactcattgggagacatggagagccaattcgcttggcttctagcattgcgcatctgtactacaccgaaaatcgtgcttgtcttcaccagccagcggcaaggacaacgctagtgtta

SEQ ID NO: 4524 - DNA, 198 bp, A.fumigatus
agattctctgctgctgattcctataataaagaacattcaaaaatcttcgatgttccatatgatattgctgaaactaagcctatgctggatcagctccatacttcttccttctcctctacccctgctgactatcgtgcaactcacgaggatagattccctcaaattctcgccacaagcatggtccacttgcactgttga

SEQ ID NO: 4525 - DNA, 855 bp, A.fumigatus
agattcctcggccatgtcttacatatatgtacttctcctacgtctttgctgcctgcagaagaatcatcttactcgcaaactcattgcgcgatggcgactcaaagcagcaccgagcttcctcaaatcaatatgaccactgccgagccaacctcggccaataagcgaacatatccctgggtcaaacttcctcatccctatctcaccagttatgcgatccatgttgtttctgaatctacaccccgggtgcttcaattgagactccatgacgatcaaaagggacaggctctcccagagcctctgcactcggcctcgttgacctacaccgacattgcctttgacgaggccgcccaggaaatcccagataacgacaatagcccatgggcgcgcagtcgcagagctcctggaacctccttccactggactggccaggagccaccgactctgggacagatctggaacgtcatccacgccctcttcctgacatatccccaacacgagattgtccgcttggatctgaacgggtctggcaaggatattattcgggatgaatgcctgcgcactgggctggctgttccctttccttcccctcgagttcccttcggcactgagaaccgggcctccgaaaccgacacactcatcctactacgctctgccttctggcaaagagccggctcaccggttggaccacgtccgatatgggccgtcgaccacgggattcacggcctgcttcgaccatcgggaagctcctatccccctctcgctcaaaactacgagttctccatgaagttccccagcgagagaatctacacccggcaccctaggccgcccgcaagaaaccagccccaggatcactaa

SEQ ID NO: 4526 - DNA, 468 bp, A.fumigatus
tgcagcccttccatcgtcacacgcacactgtccggactattcctagagatagcggttgcaatctccaccgctgtcgccaataactggtcatgctccaccacgcggttcaccagcccccaccgctcgagctgggacgcagaaaagctcaacccgctcagagcgatctcggctgctcgctgttttcccagcacgcggaccagccgagggagcgagcctgcgacggcggcgattcctcgttgcacttcggggagaccaaaggtggcgttctcgctggccaccacgatatcgcagttggctaccatctcgaagccgcccccgagacagtatccgttgacggcagcaatgattggtttgctgcctcgtcggcgagggaggccggctaacccgggggctgtcatttcgttggtgataccacgcgcgttgaggtcgttccattctatgggatgtattgtcagttgttttccttag

SEQ ID NO: 4527 - DNA, 510 bp, A.fumigatus
ggaaaacaactgacaatacatcccatagaatggaacgacctcaacgcgcgtggtatcaccaacgaaatgacagcccccgggttagccggcctccctcgccgacgaggcagcaaaccaatcattgctgccgtcaacggatactgtctcgggggcggcttcgagatggtagccaactgcgatatcgtggtggccagcgagaacgccacctttggtctccccgaagtgcaacgaggaatcgccgccgtcgcaggctcgctccctcggctggtccgcgtgctgggaaaacagcgagcagccgagatcgctctgagcgggttgagcttttctgcgtcccagctcgagcggtgggggctggtgaaccgcgtggtggagcatgaccagttattggcgacagcggtggagattgcaaccgctatctctaggaatagtccggacagtgtgcgtgtgacgatggaagggctgcattacggtcggaatggccatcttaacgacgccgctggaagatattag

SEQ ID NO: 4528 - DNA, 696 bp, A.fumigatus
atccagtctcagactgtatactgtatctccgacctacagacaacaacaatgtcaacagaagcacattcaacagtacaaggatgcctcgtctcgtttccaacacctcacattctcgtcctcacactcaaccgcccagagaaaaggaattgcatatccctcgccacgagcgccgagatacagcgcctatggacatggttcgacacacaacctgctctatatgtggccattattaccggcacgggcgagtccttttgtgcgggcgctgacctcaagggtacactcctcttatctctattcgatggaaacatctctattctaaggaaaacaactgacaatacatcccatagaatggaacgacctcaacgcgcgtggtatcaccaacgaaatgacagcccccgggttagccggcctccctcgccgacgaggcagcaaaccaatcattgctgccgtcaacggatactgtctcgggggcggcttcgagatggtagccaactgcgatatcgtggtggccagcgagaacgccacctttggtctccccgaagtgcaacgaggaatcgccgccgtcgcaggctcgctccctcggctggtccgcgtgctgggaaaacagcgagcagccgagatcgctctgagcgggttgagcttttctgcgtcccagctcgagcggtgggggctggtgaaccgcgtggtggagcatga

SEQ ID NO: 4529 - DNA, 405 bp, A.fumigatus
gtacatttaccctccagatccgatggactcgagctggtcgcgaagatcaaggcacgccagatcgcttccaatctccaacttctcgaatcgacgtgcaaaaccatcgttactcgcctgctgatccagggtgctctcggtcggttttacaatgggaactcgagtgattcgaactggacttcgtccgtcacggatgtgcagtccgccctcggcagtaacaattatatggacctgtatcaagtcattattttctctcgaaatggccaaggcgatcgacacggattgctcaatgtcactgccaaagatattgccgagatcgctcttccctacactcacccggacggcactgctgtcatgctcggagaggaaggtcgtcttacaccgacgggggtcgaaggaaacgcgtaa

SEQ ID NO: 4530 - DNA, 543 bp, A.fumigatus
tgtattgggttgcgtatagctacgtcgggcggaatccaccttctcccttgcccagccaagggtactaacaagtggtgctgtagcatcaacgggacagactgctgcgataacgcggcgacggtctccatcggcacaatctacggatacacgagcatatcggcatcgtcggcatcgtcgtcaacctcaacagccacggggaccgggacgatagctacaacgacggtcaccacaacagctgcagccggtaacggtacggaagtctgctcggattcgagctcgaaggcgaccgcggtcggggcggggattggagcaggtctgggtacctgcttagttgcgacactatttgcgctctggttccagcgacggatgtatcagaagaagctgcagcagactagcggatacgctggatacagtcctgccagcatggcatatgcccaatctgggtattcgaacccgtcgagtggtgttcggcggaatgtctccgagctgcagtcgaatcaagaagtcatccatgaggcagatggacaagagacacgaaaatga

SEQ ID NO: 4531 - DNA, 1230 bp, A.fumigatus
tttgagcgatacaggaggaccagtaggaacaaaatctctccggaagaagaacaggctattcctgaggcctaccattattcgacgatgggcgactttgtcatgagatctcaattggacgcttatgatcccaggcttccgggaactggaatgttcgacctgaagacccgagcggtcgtgtccatccgtatggacgtacgcaactttgagcatggcctcggttacgagattcgccatcgcttcggcggctacgagtcttatgagcgcgaattcttcgacatgattcgggctgcgttcttgaagtactctctacaagtacgaattggccgtatggatggcatcttcgtcgccttccataatgttgagcgtatctttggatttcagtacgtcagtttgtcggaaatggatcagactttgcacggtcagtccgacacttcactgggcgataccgagtttcaactcagcctagcattatggaacaagatccttgacaaagcaaccgcaaaatttccaaagaggtcattgcgattccattttgagacccgagatgcgcagacgccgttcatgtatatcttcgcggagccagtcaccgatgacgagatccacgccattcaaacgaagaatcaggaaaaaattgaggcctaccagcgacgcattctcaacctccccacaaaggaacgtataaaacctaaacctacagcagcgccatcagagctcaaagcaggaagccagccagccaccctcgcaaaggaccacactgctgaatcgagcgacaagaaaaagggctcatcgcagaaaatttccactacatccgatgtcgatcaagagacaccagcaacttcagaaggatcgcctgcctcaggatctccagacgcacccgcggaggatgctcaggaagcgccgcgggaattgcttgccatgaccctcatcgtcaagaacaaaatgaacggctactacgttgaacggccgaccaatttcacagcgtccgacaagtggacggtccagtgggagctgaccgaagtgaaacagccgcaagcgcaatccttatacactgcatgccagaaccgccgggctaaggccctcgaaattcgcggagagggcgagaccggcgtcgcggccaatgtatatatccgtaaactgcgggagattgccaagcagggtcgcgaatttcgccaaaaggaggacgaactcgacaagaagcaaggtatcgtcgttctggatggtgcggtctga

SEQ ID NO: 4532 - DNA, 435 bp, A.fumigatus
acgttggaaaagacatccagcgcagccgcggaacattttctcagggtccactcgtcctccgggtcatcaccgaactcggaatcctcaatttcaccctcgctcaggtcgtcatcgtcatcttcgccagcggccgtgtcgccgttagcttgcgctccggacttagagaggtccaaacgagcggctttcgatttggcgaattggggcctgaggtcctcctcacggtcttcaagttcagcatcatcgccttcacccgataggcgaatcgcatcatcctcatcgtataccatgctccggagcagcaccggaacaatctttggcatgtgtggcgccaagggctgttgcagcttcgcctgctctcctgcaaccagccagaactccgccgcatcgagcgcgagttcggggtcctccgcgttgttctgctgcatgatgatatag

SEQ ID NO: 4533 - DNA, 2103 bp, A.fumigatus
  unsure (1367): Identity of nucleotide sequences at the above locations are unknown.
ctgacaaaacttttttttgttttccggtttgatagaagcttgttcaagcgacatcctcccccggactatgtcaattatattacgtattttttttgcaccccgcaaatccccccggccgtgggcatggatgacgatacttacaatctggtccgtttcgccgctgcgatgaacctcaagacgaagatccgtgtcgcatacaatacaatttctcagcccagtttagcatacatccgatccgcgaccctggccgggttgcgagacagcaaccttcaggtgcggaactccgccggtagcattatcacggaactgttgcaacaggcggggctgttggcgtggccggaggtgctgcatgaactcctcagtctggtggagaacgcttcgggggacgtcccggtcctggctcaggaagccgccatgtcggccctcgcgaaagtttgcgaagacaaccgcaaggtcctcgatcgggattacgaggggcaacgccctctcgatgtgataatcccgaagttgatggacttcacatccagcgggagccccagggttcggtctatggcgttgagcaccatccacgtcttcctccccagcagaccgcaggcgttgatcgcctcgttggatctgttcctttcgcagttgttccagctcgccagcgacaccgacaccgatgtgcgacgtatggtgtgtcagactttcgcgcagttagtagactttgcccctgaaaagctcgtcccgcacatggaaggattggtcaactatatcatcatgcagcagaacaacgcggaggaccccgaactcgcgctcgatgcggcggagttctggctggttgcaggagagcaggcgaagctgcaacagcccttggcgccacacatgccaaagattgttccggtgctgctccggagcatggtatacgatgaggatgatgcgattcgcctatcgggtgaaggcgatgatgctgaacttgaagaccgtgaggaggacctcaggccccaattcgccaaatcgaaagccgctcgtttggacctctctaagtccggagcgcaagctaacggcgacacggccgctggcgaagatgacgatgacgacctgagcgagggtgaaattgaggattccgagttcggtgatgacccggaggacgagtggaccctgagaaaatgttccgcggctgcgctggatgtcttttccaacgtttatcaccagcctatcttcgagatcatcctgccctatctgaaagaaactctccgccatgagcaatggccccagcgtgaagccgctgtcctgacgctcggtccggttgcagatggctgtatggatgcagtcacgccccatcttcccgagcttgtccctactttgatttcgctattaacgaaccnccagccggtcgtacgacagattacctgctggtgtcttggacgatactcggaatgggcttcgcacttggctgacccattagaaagggctcgtttctttgagcctatgatggagggtatactgcgccggatgctggatggcaataagaaggtgcaagaggcggccgcatcggcctttgccagcctggaggagaagtcagacgctaacttgataccctactgtgagccgattttgaggcagtttgtgcagtgctttggaaagtacaaggatcggaatatgtacatcttgtatgattgcgtccagacgctcgctgaatgtgtgatgggagaactggcgaaaccgcacctggtggatatcctgatgcctgccctgattgatcggtacaacaaggtgacggatcagtcccgggaactcttccccttgctcgagtgcctggggtacattgctgcggcgtatggcgacacctttgctccgtttgcacctcctctgttccaacggtgcacaaaaatcatctacgagaacctgcaggaatacattgcgtctgtcaacaaccaggccattgatgagcccgacaaggatttcttggtgaccagtctagacctcctcagtgcgatcatacaagccatcgatccccagaagagcggcgaactggtagccacctcgcaaccccgcttctttgatttgctctgcttctgcatggaggacccgaattacgaggtccggcagtcgtcgtgtctt

SEQ ID NO: 4534 - DNA, 231 bp, A.fumigatus
cacatttttcttcttcgatcctcaataggtcgtatcaaggctttcaaacctactcaagatcgtcctttcgtactgggtcttcccactggcagcagccccgagattatatacagaacacttgtgcagcgccatcggacaggtgaaatatctttcaaaaatgtcgtgacgttcaacatggtatctccccctcgttggcattatcatgactctttgtatgccgccatttgctga

SEQ ID NO: 4535 - DNA, 192 bp, A.fumigatus
tcgactcaggatgagtatgtgggtttacctcgtgaccacccagaatcctatcacagcttcatgtacaagcactttttttcgcacgtcgacattccaccgcagaatatcaacatcttagatggcaacgccccagatctggctgctgaatgtgcttcctacttcttcacgccgggacgaagctatgcgtacggg

SEQ ID NO: 4536 - DNA, 786 bp, A.fumigatus
acgcggactcttccaccccgtggtgaagactaccgggaccggctctctttccttttccagcgcctggcagtagtcggcacctccgtcttcgccatcgccggcgactggggtgccaacaacaacatcattgatggccagccgcatgtcggctggcctggtagtgacccctgggtgacctgcgtgggcggcacggtagtcggcaacgtgcgctcctcaggcgccttcaccgagcatgcatggagcgatcgcgacaatcccgacagccagtttaccattgatggccatctgggcgtcacggggggagggatgagccgggtcttcgctacacctccctaccaactgagtagtgggatcagcgcggtgacggactgcaatggggagcggtggacgggaggccgcttcattccggacatcacaggcatggtggggttcaggggcttcattgtcaatggcaaacggaattatttcatcggtacgagctgcagcacgcctctgtacgccgggctttttgctgcgctggccagcgccttgggagggggaggagaaggaggggtgctctttggacctctcaataccgtcttgtatcagattgacaggggtgtctatcgggatatcacctttggccataatgattccggtgatatgcctgcctgtgcgtactttgctgcgggggaggggtatgatactgtgagtgggcttgggagtgtcgatgggcgtaggatgctcgaggaactgcggaggatctattggcctaagacaaaagggtttggctgttttcggaattag

SEQ ID NO: 4537 - DNA, 270 bp, A.fumigatus
  unsure (6),(30),(31),(37),(62),(69),(77),(88),(96),(97),(101),(114),(126),(129),(130),(131),(151): Identity of nucleotide sequences at the above locations are unknown.
aaaacngggcaaccaagacatgccaaacanntaatanaacccccaacgacaattcaaccatntatttcntccggtgngtgggggggtnaaaatacnngaanatctggtgccgtntggggacgtccnagnnnttgcggtatttttgcaaganatataaagccaaaaaagggagactatgtctatcccttctccctcatgcacacttcagccattctctctcgcataattttcaccaccagctcctatcttcaaaccatggcccgcggctga

SEQ ID NO: 4538 - DNA, 627 bp, A.fumigatus
gtggttctttggcccgttcgttgctacaatgacttctcggacagctttggcttacgaagttacacaggaatggctttggtgtggctctactctcgccagattcctcgggctcttcttcccttcagcgtgtactcagttttccacgttgccacctatacacgtgcccatttgattcctactttgcaacctcctagccagggtgcgactagcgtaacctccccgtccacccctggctctcccaggcctgctgcgaagcagtctcctttggcagataccattggaagatttgtcaaacaatattacgatgccagcatggatcttgttgccgggctcgagatggcactcctcttccgattggtggtttccctactcaccttctccaagggcagcatcgttctctttatcctctacctggctttcttccgcgccagatattcccagagttcttttgtccagcaggctgtccgccatttcaccgccagagtcgatgcctcggtctctcaccagagcactcctcccgctgttcgccagggttgggaacaattcaagaacgttgtgcgccagggatacgagatcacggatgtgggccgctacacctccggcgctgctgtcaagaagcctcagtag

SEQ ID NO: 4539 - DNA, 243 bp, A.fumigatus
tgttccagagtttggctactccgtccccgcttgccgacacaacaagatcgccccggagctgaacagcgttcacgggtccacgatggccgagaagcttctttaccagcgcgcctgtctgccgatcccacacgcaaatggttgtgtccttggagcaggatacgatataccgatcatcaaagcacacgtctagcacgccagctctatggccctccagacgacggattggtcggtaatcgttcttga

SEQ ID NO: 4540 - DNA, 987 bp, A.fumigatus
cttggcctttatagagacaaaatcatcactggttctcgtgatcgaactatccgagtgtgggatgctcattacccgtggccgtgccgtaagatcattggtcctcccccgggcgagatttcgagcattgggcaggtcaacaacccgactcagcagtcgtcgggcaagcctccttttctcaccatctgtcctcctcctaccctcgcggcagggattgtgactcccattgaccagagctccgactaccacagtgcttccatcctttgccttcagtttgacgaagagatcatggtcactgggtcgtctgactacacctgtattgtctgggacatcaagaacgattaccgaccaatccgtcgtctggagggccatagagctggcgtgctagacgtgtgctttgatgatcggtatatcgtatcctgctccaaggacacaaccatttgcgtgtgggatcggcagacaggcgcgctggtaaagaagcttctcggccatcgtggacccgtgaacgctgttcagctccggggcgatcttgttgtgtcggcaagcggggacggagtagccaaactctggaacatcacctcgggtctttgtgtcagggaattctccagtaaggaccgtggactagcctgtgtggagttcagtgatgacgcgcgcaccattctcaccggtggaaatgaccagtcgatctaccagttcgacgcaaacactgcggagatggtccgtgagctcaaaggacatgccggtcttgtgcggtcactccatctggacagcatgaaccagcggattgtcagcggcagctatgacatgagcgtcaaggtcttcgacgcccagaccggcgagctctctattgacttgcctggctggaccaccagctggatgttgagtgtgaagtcggactatcgacgcatcgttgccaccagccaggattcccgagctgtcattatggatttcggctatggcctggatggcatcgagttgttggaagagtga

SEQ ID NO: 4541 - DNA, 195 bp, A.fumigatus
  unsure (132): Identity of nucleotide sequences at the above locations are unknown.
gccaccactactctctttagactcttcaggcattcctcaataaagttagaacactgtcctattctagagcttagaaactatgatttcttcataactgctcctaggctaagtgctgatgaagaaggttgccangttaaggcattcccgaattatgatattaaggtaatattaatgtatagcaagccgctaagttaa

SEQ ID NO: 4542 - DNA, 516 bp, A.fumigatus
gaggtcaaaagaaagacccaactgtggccaccaacttcgtgtgcgcaacaatcggatccaacctcatctgatagttcaacctcaggcaccaccgcaccaagcgcctcgactgtctctatgagttgcatagccaataccaaacatcaacgccataaccaaactcgacaccagtcaagccccagaactgtctcacaacaagatcttcccctaatcactggcgtgctatctccatcaccctcatcaactccttctaccaagaaaagtgggatttttgccgattctcaaacgatcaaaggcagcaaagctgacaaacgagcatcccataatgtcattgagaagaggtaccgcaccaacatgaatgccaagtttaccactctagaaaacgtcatcactacttgtcggaacaagcaaaaggcctcaactattaggccgtgctcgatgaagaagtgtgaaatcctcactagtgcaatcaagtgtattcaagatctggaggagcggaatcgccgctctgagtga

SEQ ID NO: 4543 - DNA, 1332 bp, A.fumigatus
  unsure (1307),(1308),(1316),(1317),(1323),(1324),(1326),(1328),(1329): Identity of nucleotide sequences at the above locations are unknown.
gcccaagggaagccttctccttcccagctactcccttcatcgacgagtgctacccataggagctctggtaccagcacgtacgaatggaacggccacattgaatggcgtgatatcagcaaattggaaagtgcaagtctcgaggccgcgcttcttgccgcatgggcactcactatatccggctacactcgatcggacgatgtcatctttggagaattgcttcttgagcaggattcgtcagggctggattctacttccgataaagcggcgccagtggtcgttcctagaagattacaaatcgctgaagatatgagcattgcggaacttatgagaaagacccaagagcgcctagtagcggcttctcccttccaaagagctggacttcaacgcattagaaacgtcagcgcggatacttcgcgtgcgtgcagctttaataaccttttctgctttacaagatttgactgcaaggtgcagactcttgctctcgcatatcctctcgggatcttttgtatagtcgcgaactcggagctccagttgagcgcttgctacgacgaacagattttgtctgctccccaggttgagcggattttagtacaattcgcacgctacgttgaatacttgaaggcggatctccgctctcaagagacgatcggtgacatggctctccgcaagaatcagacttcttacttgtctagccctgagactgtctactggaggaagtaccttgctgatgtcgagtcctgtgtattcccttctttgaacccagacggtgaaagaagtggattcagctcggcaaaactggcgattgaaaatctggctgatttacgccgcctttgccagaagattgaagtaaccgaggacattgtgctacagctcgtttggggattggtcctgcgatgctataccggttcagaagaagtctgctatggttactaccaggcatcaccacaacccgaggggtcgaagtacctgaaagtactcccaagcaggtttcttcttaaggacgactcagaccttgagtcaattgcacagcagagaaagagtgagctggatgaagccatggagcaccccatctcccagatagaactgcagcttgaacttggccttgactggtattcgctcttgaacactgtctttaaattcgacagatttgcggagctccccaatgacaataacagtacattagacctgctcaacgacaccgagaaagggatctggactattgttgtcaaccctagattttcatttgtatcggcagatatcctctgtcttcaccacggggctggaaggatccgagcttgcgttcaagnnattcaggnnttcaanncncnnccc

SEQ ID NO: 4544 - DNA, 393 bp, A.fumigatus
tatatatatacccctcacaaccgcaagatgacatgcaacgtagacaagtacaacgaagtagaccccaatcggaacgatatggccgtcacacagctcgcacctcccctctccctcttccccgacggcctcaagacaacaggccaacacccccctctctacgaacacctccagcccttcgagcgcttccccaaggaaatcacaggccccacggtctggaccgcagacgagtaccgcgctcaccccgagaaatggacgcatcggtttaccccggaggagttggacgagctgagtcgcgcaggggatgagtttatcaatagcaagattcctctgaccgggatttcaaaagtaccctccctccctcccccagcacccttccactgtccgacgcgatga

SEQ ID NO: 4545 - DNA, 303 bp, A.fumigatus
aaaaacttccccctcccaaccctaagcgcctacctgctcgccctgcgggatgaactactcaacggccgaggcttcatcctcttcaagggcctccccgtccagacatggggaaaccacaaatccgccgtcgtgtacatgggtctcgggacgtacctgggctacttcgtcagccagaacagccgcggccacgtcctcggccacgtcaaggacctaggcgaggatccctcgcagatcgacaaggtgcgcatctatcgcactaacgcgaggtaccttccccgaccccggcatgccccgaagtcctag

SEQ ID NO: 4546 - DNA, 537 bp, A.fumigatus
tataatcataactatcaatcaaaacatctctctacaccaatcccagtcccaaccaagtgtcgaaacaacaacaggaaaacccctcctaatccggtaactggatccgagaactccaaccacatcacaagcactgctcccaactcctctacagaatacccaacctcaaggaaaagacgcagagaaaacagaatgcacctccacatcgccatcttcgacctcgacgtccccgttccaaccgtctacaccacacgaggcctctacagctcgcaattcacccgtctcctcgctgccgccgcagcacgtctctcccagtcgcaatccttggccccgggtaaagaaataacaatacgaacctcgtcctacgatgtcatcggggggatcttccccccagcgcatctcctccagcgctctccaccaggcgcgggaggaaaggaacgcatagacggcatcctccttaccggatcctccgcctcagtataccgcgcagactcgcatccgtggatgctcttaaccagcgaacgcgaaggaggagcgcaa

SEQ ID NO: 4547 - DNA, 273 bp, A.fumigatus
aaaaatgctaagctttcatttataactgactttgtctactcagagggacatgcgatcaagaaccatcttgcctcgacgtcaatcgccgtccgtgctctcactggccatcacaaatggatcttgagtggaacgcccgtgcctaagcaagtactcctgcttcttatatcgagataccagagtgctaataggacgactacagcttcatcactgagttctatccgcacttcgatttcctggagtatccagacacgaatgattacagtcagttcgtga

SEQ ID NO: 4548 - DNA, 243 bp, A.fumigatus
tcaccagatgagtttgaccatctgggaagcgtgccgcaggataacttacatgacactgaacttctgcagactttgaataatgtcgatgctacgcattctgctctgagcacagtatataaggacgtcaccaacagcgtccttctcacaatgcttgacgacttggcactccctgttcatatcatcagaatacattttatgaaacaaaacagcaccgacaggtcataccagtgcccgacaaggtga

SEQ ID NO: 4549 - DNA, 678 bp, A.fumigatus
caatggtgtctttcttcatggggcggcccatatgtggaattatgtatgtctcctagtcagttctccaagagcaaagagacggctgaccctgccagacccaaggcaactcgtcatggaaagcgcgcatcgatggtctcctcgatgcgcagaggaccttcctctcgccgaacaagtcatccgagaacgtactttatgaatacgcctgtgaaaccatcaacacgtgtcgaaaccgaccagtactccttcaaagcgtatctggcgcgctggatgggagatgttgcgcaattggctccctggacccgcgacacaattgcgactcgactgcgggcttcggccacggcagcagcagcgcaatgtgtcggcggcaagacggggacgtattgtggtggaatgcgatggacgacgggcgagtacgacggcacgacgggggtgggacagcaactgtcggcgctggaggtggttcaggcgaatttgtacaacacggtcgcggggccactgacgactagcactgggggaacgagcaagaggaacagtgcggtggagaggggatcctcggaaagaattgcggtgtccgacgattcgagtatcgtcaccatggctgatcgcgtagtcgcgtgggtcgcaacggggggattaggggtgctgctggggggatatctttatcttgtagtgacatga

SEQ ID NO: 4550 - DNA, 864 bp, A.fumigatus
tggcccgcagacaatatcaaagaggtagccagtcaactagcctgggacctcgtcagcttctacactggcaacaacaccggtgacgtcccggggaaccttcccgccccctactactggtgggaagcgggcgcttttttcggcaccctggtcaactactggcgatataccggcgacgatacctacaataatatcaccatgcaggctatcttgcaccaggccggaacaggtgactttatgccttccaaccagacccgcaccgagggcaacgatgaccaggccttctgggcctttaccgcactcatggcggccgaacataatttccccaacccacccgaggactcgccgtcgtggctggccatggcgcgagcggtcttcaatgagcagatcgcgcgctgggacgatcaggcctgtggtggtggactgaaatggcagatcttccccttcaacaacggctacacgtatcgcaactccatctccaacggagggctcttcaatatcgctgcccggctcgcgcggtatacaggggacgccacgtatgccgaatgggcgaacaaggtctgggactgggtcacagagactggactgatcggtccggaatattacgtcttcgacgggacgtatgagagcgacaactgctccgcgctcaatcgagtcgaatggacgtataacaatggtgtctttcttcatggggcggcccatatgtggaattatgtatgtctcctagtcagttctccaagagcaaagagacggctgaccctgccagacccaaggcaactcgtcatggaaagcgcgcatcgatggtctcctcgatgcgcagaggaccttcctctcgccgaacaagtcatccgagaacgtactttatga

SEQ ID NO: 4551 - DNA, 396 bp, A.fumigatus
ttatgcagcggtttttctctctccaatattggaaattactttgtgagtacatacacacctgtgttctgtgcattttataatttggatctgctgttaggctctggagatcagaaattcccccctgatgtctcacctgatgacctggagaaactggcgaacggtgatcctactacagctgaattatctgttaaatttcgggatgcattgtttcgaacattgccccaaaatccggggtgttcccaagttaacacctccccaaacacgtttttatccttggaaaaagggacccctgaacaatttggaaacaagttctccgcccgtgtccaaatttgggggaaattgccagattttatttcccctgaacattactacaaatggaaggaaaaaacctttccc

SEQ ID NO: 4552 - DNA, 234 bp, A.fumigatus
atggaagagcgcggttcgtccttttcattgaaaagggactgtgtactgaaccgaatcaagggagagcaccttattttggacttctatactccatatacctactgtaaagcagccgcattgatttcatggatgatcgatacgagtttagtaactttagtcccatgtagcgacaaggataaatccaccacagctagtgagattgcttcaaaggccgccgtggcggggagtttgtag

SEQ ID NO: 4553 - DNA, 192 bp, A.fumigatus
gatacctgcagggtgaacgttgcaggcaagcttgatatagtctgtttcgataagactgggactctcacagaggacggcctggatgtgctcggtgtgcgaactgtgactcaggatttgaggtctgcacctcttgatgtatcttatagatgtgtgctcactaagacaatacagattcaccgatctaaaacctga

SEQ ID NO: 4554 - DNA, 243 bp, A.fumigatus
gtaccaatagaactcggagttctcaggaattttgagttcgtgtcggaactgcgccgtgcgagtgtcgtcgtaagacagtttggagatggcggagcaacctttttcgtcaaaggcgcaccagaaagtctgaagaccatttgccttcctgacagttgtcagtcaaccaccatgaccaccgtattgagtgtttatatcgagcccaatgagctgacaatgttggacagtaccacacgatttcgatga

SEQ ID NO: 4555 - DNA, 426 bp, A.fumigatus
ggagagtctgttcctgtatcaaaaatcccgttaacagacgacgcgttaaagtaccttaacctcagtactccatctgtccatccgaatgttgccaagcacttcctttttagtggaacaaaggtcattcgtgcacggcggccacatagcgtcgatgatggtgaagccattgcgttagcagtggttgtgagaactggcttttcaacaacaaaaggcgccttagtccgttcaatgcttttccccaaaccctcaggattcaagttctacaaagattcatttcgttacatcacagtgatgggtgtgatagctgcttttgggtttatagcatcatttgtcaattttgtccgcttaggtgtaagtctggcacaaggaatgatacaagggttaagcttacattgcacagctttcttggcatttaatcattgttag

SEQ ID NO: 4556 - DNA, 405 bp, A.fumigatus
ggtctgcacctcttgatgtatcttatagatgtgtgctcactaagacaatacagattcaccgatctaaaacctgatttggcttctctggcctccacatcttcatcttgcatcggagcctctgtcggtcctcaacaacataagaatattgtccacgctatggcaacatgccactctctcagagtagtggatggggagctaatgggagatcctctcgatgtgaagatgttccaattcactggctggtcctatgaggagaacggaagcgaatctatagaaccccatggtcctaagtacgaaacaatcatgccaccaattgcgaggccacctaatcagatatccgatttgagtggtcaaatagggaccagtcaaactgtaagttttcctcctccggaaaaatccacatag

SEQ ID NO: 4557 - DNA, 267 bp, A.fumigatus
caatgttggacagtaccacacgatttcgatgatttattgagcttctacacgcacaagggctatcgtgtcattgcgtgtgctgggagatacgaaccaaaactcagctggatgagagctcagaaattgactcgagaactcgttgaacgcgacctcgaattcatcggattcattatatttgaaaacaaattgaagtccagcactactgggacaatagcagagctcagtaatgcaggcatccgaaatgtcatgtgcacgggcgataatata

SEQ ID NO: 4558 - DNA, 237 bp, A.fumigatus
gcttacattgcacagctttcttggcatttaatcattgttagggcacttgatctaatcacgatcgttgtgccgccagcattaccagctactctgacaattggcaccaatctagctctttcacgacttaagggtcacaagatattttgtatcagcccgcaaaggtttgagctgctctccatctgctgtcatatttattcactaagatacctgcagggtgaacgttgcaggcaagcttga

SEQ ID NO: 4559 - DNA, 240 bp, A.fumigatus
ctgacaactgtcaggaaggcaaatggtcttcagactttctggtgcgcctttgacgaaaaaggttgctccgccatctccaaactgtcttacgacgacactcgcacggcgcagttccgacacgaactcaaaattcctgagaactccgagttctattggtacctaaagagtgtgtcgtttgaattagtgatgtgctgcgcgccctatgtggatttttccggaggaggaaaacttacagtttga

SEQ ID NO: 4560 - DNA, 417 bp, A.fumigatus
atactatatgtcttcctcatccatggtgatgccacccttctccagggcgacgggaatggccttccaagggccgatacccatgagcaggggcttgacaccgacaacgctggcggcaacatacttgccgatgatcttctggccgaggcgctcagcggtggaacgcttcatcagcagcacggcggcagcaccgtcggagatctgagaggcgttaccggcgtggatggaaccatccttggcgaaagcgggacgaatcttgccgagggactcgggggtgatgccgtcacggatgccatcgtcggccttgacggtaatggtcttctcctcaccggtcttgggatcagtccacttgacctggagaggaacaatctcctcgttgaagagaccggccttctgagccttgacggccttctggtatga

SEQ ID NO: 4561 - DNA, 609 bp, A.fumigatus
agacaaagcggcaaaaaggcccgaatgctgataaacgttcgtcccggtagacctggcgccgttaccgagttctctgagctccttgagagccatcccgagtccgccaactgcaaggtcccgatgggtgtcttgtcagaacagatggctaaggaccgtaacatttctcgcgccgtccaagatgctttcgctgcctcttcataccagaaggccgtcaaggctcagaaggccggtctcttcaacgaggagattgttcctctccaggtcaagtggactgatcccaagaccggtgaggagaagaccattaccgtcaaggccgacgatggcatccgtgacggcatcacccccgagtccctcggcaagattcgtcccgctttcgccaaggatggttccatccacgccggtaacgcctctcagatctccgacggtgctgccgccgtgctgctgatgaagcgttccaccgctgagcgcctcggccagaagatcatcggcaagtatgttgccgccagcgttgtcggtgtcaagcccctgctcatgggtatcggcccttggaaggccattcccgtcgccctggagaagggtggcatcaccatggatgaggaagacatatag

SEQ ID NO: 4562 - DNA, 855 bp, A.fumigatus
  unsure (697): Identity of nucleotide sequences at the above locations are unknown.
gagcaactaaactcatcacaaaatcagaccgatgtagagtttttgaaattcttacaggacgcttaccgatttgttttgaaacacgcccaaatgatcaacatggctccgcttcaagtctattgctccggactcgcgttctcgccaacagacagtattgttagaaggatattcaacaacaaacaacctagctggttgcctgtcttgccgcaagtgcataagtcatggagcgcagagctccagacgcttgagggccattcctcttgggtttcgtcagtggccttctcaccggacggccagaggatcgtgtcaggttctgacgataatacgatcaagctctgggatgcccagaccggctcagagctgcaatccctccagggccattcggattcggtccactcagtggccttctcaccggacggccagaggatcgtgtcaggttctgaccataatacgatcaaactctgggatgcccagaccggctcagagctgcgatccctcgagggccattcggattgggtccactcagtggccttctcaccggacggccagaggatcgtgatatacggtagcaagatcagactctgggatgcccagaccggctcagagctgcaatccctccagagccattcggattatgttacatacgcctttttgggaaatttccgtgtagagcacaaacaaggctctcatatatcanttgagagttcttgggtatgcttccgaggtgaaagagtaatatggcttccccctgaacttcgtgaacctagttgtcgtgctatcaaccatgatatactggcccctgggtatttgaatggtctcgtccttattataagatttcgtgcacattccgactga

SEQ ID NO: 4563 - DNA, 318 bp, A.fumigatus
ccatctgtgcttatgattgtcctaactaatcgggaacatagtctgaaaatgagtttcgtcaacgtcggcacacagtctggcgactccacaaacaacacgcctgtgatcaatcacggttctgccccggttctcgcttccgtcttctccgagccgttccaagtcttctccgctaagaagttccccggcgtcatcgagagcacgcagctaagcaagtgttttgcccttcaaggcatcaagatacctattcgtaaagacggtgtcaagggtcctcgggggcgtggtggtgacggtgatgatgacgctgatgattatgaatag

SEQ ID NO: 4564 - DNA, 276 bp, A.fumigatus
acaatttatacgggggaaatgctcagtgggcctacaatatggaccaatccacaggcttcctactatccgccctattacgctggaggtcagatgcccccggctggcatgtcgcctgcgcaacagccagttccggcggggcccggtggcatgttcacacgcaatcttatcggaagtctcagcgccagcgcctttagactcactgatcccgataacaagattggagtatggttcattttgcaagacttgagtgtgcgaaccgagggaactttccggtga

SEQ ID NO: 4565 - DNA, 219 bp, A.fumigatus
  unsure (22): Identity of nucleotide sequences at the above locations are unknown.
tcgccggcaaggtccccttccntactacaatatgtggtccaatcagcacctgctttccttagggatttgaatccggggtgtttctatgtcttctgcggatatatataccctcagagtgagacaaccaagtacaaagttacacgcgatcaccagcgtgagctccaggcctacggcgagtataccagcaataaagcgaaacttcaatctatggattcttag

SEQ ID NO: 4566 - DNA, 291 bp, A.fumigatus
tcctgtctttccacttcgtacatctactgttccgtgctatcccgtgtcttacgcatctctctgacattgcgtttctctagtgaatatgaggtcgccttggtagaggaacacgagctcacagctgggcccctgtctcttctccaaaccgctactcgcacccacactcaggttttgatctcatgccggaacaaccgtaagctacttgctcgagtcaaggcgtttgaccgccactgcaatatggtgctcgagaacgtgaaagagatgtggacggagaagccgaagggcggatag

SEQ ID NO: 4567 - DNA, 1122 bp, A.fumigatus
  unsure (114),(798),(995),(996): Identity of nucleotide sequences at the above locations are unknown.
ggcattcccgcgggcaccgaggccgacaccaccgggttcttcctgctgctgaacgagctcaagcaggagatgcccgcgggcaagacggtctccgtcaccgcacccgcctcgttntggtacctccagtacttcccgatcgaagcgctgagtctcgtcgtcgactacgtggtctacatgacgtacgatctccacgggcagtgggactacatcaacaagtacgcaactccaggctgtccgtcctacgaccaggggttgggcaactgtctgcggtcccacgtcaatctcactgagaccatcaactcactgtccatgatcaccaaggcgggcgtgccgtccaacatgattgtcgtcggagtcagcagctacggccgctcgttcaagatgagcaccccggggtgctggaccgagcaatgcacctacacagggcccgactcaggggcatacccgggccgctgcaccaacacctctggctacatcgccgactacgagatccgtgagattatccgccagaatcccaccgtccaggagctctgggatgcaagctcgtactccaacattgtcgtcttcaatgacacggagtgggtcgcatacatggacgaggacaacaaggcaacgcgcaaagccctgtacccggggctcgccttcctgggaactgcagactgggctgtcgacttgcagtccgagactggcggtggaagtggctcaaaccctaattcatcatccggcgggaccatctatgtcaatcctgatatctggaactccgcggcgcctgtggtgactgctcctccccgcgcatcnctcatttggccccccatgcctctatctacgcccacaaccattacgtttcttccgtggaacaacaccatctcgtactccagcctaacacgcgcacaaacactctgtctgacggcacaacctcgacgttccccgcgtacgtctattaattcctggctgacggtgattaccattcctccttgtgagcacactctcgctcnnccaccgcactctctcgctctctctctctctctctctctctcactctctctctcgctcctctctctctctcccccccttcaaggtagaggggttacctgtccactaatggatgcttctctcccatga

SEQ ID NO: 4568 - DNA, 225 bp, A.fumigatus
  unsure (41),(74): Identity of nucleotide sequences at the above locations are unknown.
acaatacggcatcttatgtctgggggctctcccctccctancaacgccgtttccacctccaacagttgcgcccntccccaccatcttgaaaaaacttgtgtgctgtcccccccctttcacgttacccgttcccctgcttctctaaatcacctcgttacttctttaaagaagcactttctcctcttttcccacgcaaccctatttctcctcctctctcttagacgc

SEQ ID NO: 4569 - DNA, 195 bp, A.fumigatus
  unsure (49): Identity of nucleotide sequences at the above locations are unknown.
tatctggaactccgcggcgcctgtggtgactgctcctccccgcgcatcnctcatttggccccccatgcctctatctacgcccacaaccattacgtttcttccgtggaacaacaccatctcgtactccagcctaacacgcgcacaaacactctgtctgacggcacaacctcgacgttccccgcgtacgtctattaa

SEQ ID NO: 4570 - DNA, 987 bp, A.fumigatus
agatcacccagtagagcagaatggaggagctctgatttactatctgtacgtcctcaacctttgtcttttggtatggctagccctcgcgagataactgacctgtccagacaacgacccgatccgaaaaacaaaacggttctagcacccccgaaagacctccgcatggttgctgggaacccaatggaccggaaattcaaaggcacgcacgaagcagaggcccggagttacgcttgcttggactacaacggcccagcgaagcccgagacaaacggattcccaaactataactgcccaaatggacttcgatctcaggtgttctttccctcttgctggaatggcgtggactacgatagtccggatcacaagtcgcacatggcgtacccgattgactcgtataatagcggcgcttgtcccgagtcacaccccatcaagatcgtctccatcttcattgaagttatctggaagaccgaggccttcgcggacatgtggtacggagacagccagccatttgtgtggtccaacggtgacaagacggggtatggcctccacgcggactttgtcaacggatgggacgtgcccgtccttcaagaagcactcgatacctgcgacgacatggggggcgatatcaggaactgccaggtccttaagctttacgacgatgcgataacagaaggctgtctcttggaaccatccatcgacgagaaactcgatggctggctcgacgcccttcctggttgcaaccccgttcaacccggacccgacgacgccgtaccagtcaagaactgcgccgcacctggaattggagagccgcagcactactacaccgacgttaccaaggaactcgggtgggcgtggatcgggtgtgctcgtgattacatcaatttcgagcacatcctggccgagtcgagctccagtagcgacgacatgacagtgcagaagtgtacccaaacttggcagaaaggcggggtatacctatgccggggttga

SEQ ID NO: 4571 - DNA, 345 bp, A.fumigatus
gatgtacatctttgtcccggacaccttagctgcatcgcctggaatagttgtctcccttcatggggcttctggaacgctcaacaacaataccaatctacgccatacgcaagactcgccgatatatatggctttattgccgtctaccctgagtctccccaaggggcttgggatgcagcttcgagcgagtctcttgtacacgaaggcggaggcactagccagtcaattgcgaatatggccaaatatgtcctcaatacctacagcgctgatgcaagcaaggtatatgtatcgggtgtgtcatccggtggtactatggctgtaagtaatccacatttgcaatccatttag

SEQ ID NO: 4572 - DNA, 381 bp, A.fumigatus
ctaaataacggacccatgcagaatacgatggcaggaacatatccagacgtcttcaaaggggtgatcatatactctgctggttccgcgagcaacattcgaagcatgtacccaggctatactggaacctatccgaagatacaaatctatctgggatctgaagatacagttatcggatcagctgcgtttaacacgacacttgctgcgtgggcttcggtgctccggtatgataccactcccgatgagctactagccaatacccctaggaggcgatggacgacgtatgttctaggagacaaactagacggcatctgggcggaaggagttgggcatcccgttccaattcagggtgatgaggatattaaatggtggggtttcgcataa

SEQ ID NO: 4573 - DNA, 456 bp, A.fumigatus
agaagcatcagtatgatgtcgttgctcaccctattggcgaccactctcccctatctgatgtgctatgcatctccgctcataaaacgtgccacattgactgaggtcaccaatttcgggggaaacccagcgagtattaggatgtacatctttgtcccggacaccttagctgcatcgcctggaatagttgtctcccttcatggggcttctggaacgctcaacaacaataccaatctacgccatacgcaagactcgccgatatatatggctttattgccgtctaccctgagtctccccaaggggcttgggatgcagcttcgagcgagtctcttgtacacgaaggcggaggcactagccagtcaattgcgaatatggccaaatatgtcctcaatacctacagcgctgatgcaagcaaggtatatgtatcgggtgtgtcatccggtggtactatggctgtaa

SEQ ID NO: 4574 - DNA, 246 bp, A.fumigatus
  unsure (237): Identity of nucleotide sequences at the above locations are unknown.
gatatgatgatagttggatgtaaattggcccaagaagccgttcaaaagcttacccacaacctactccgtgtcagtaagcaggcgatgtacgttttcaagaataaggacctgtggctcctggtcaggttgactcgatttatgtacggctatgtcacctggcacctctccagcaagcgttgccgtatgaatgagatctgtcttcaccacggggctgaaaggatcgacgtgcctcattgnggagggggg

SEQ ID NO: 4575 - DNA, 348 bp, A.fumigatus
gattcgtattcgagtccggcttcagcgcctcatgctccgtccttgccatggtcgctgccccacgaagaccgctcgccccagccgcagacaggatcagcacgctgtcctccgacacatgcaccccttcaccgaccccgatatcctgatccagccaatcctccccctcgagtgcaggaagaatccgctcccggccaggcgtctgcacattcccctttggcacccgctcaatcgcaaaccccccttccaccgcatacaaccgctccaaattcctgccctggatccgatgaatccgaacatgccagtccggccaccgatccgtcggcggaaccagcgtcgtccggaccgtaa

SEQ ID NO: 4576 - DNA, 504 bp, A.fumigatus
atccgaacatgccagtccggccaccgatccgtcggcggaaccagcgtcgtccggaccgtaatctccccatccacccacggcctccactcgacctccgccacggggactctgtccttctggcccggtacgaccgcagtcccgaacctcaccggcgcgcacttccacttcacagcccaagtcgcgcacccatcccggctcagcgcaagggtgctgtccggcgcgagctgctggatcagcgggcccgtcggcacgctaaacgcaaacgccgacgagtacgcgaacttgcagtactttgccggcgaggccttcatcggccaggcgacgaattgggccgggttgaggaggaagtggtggccgccggacgggtggttgcagaggagctgctgcggcgccgacaccacctccactgggggttgggccgatggagagggtgcttcgggggtggcccagaagggatgcgagtccggtaggaggagcacgacgagggatttgaggctccagtag

SEQ ID NO: 4577 - DNA, 1125 bp, A.fumigatus
gcgcttcgcttggatccttcggcccgctgtggtgaagaccggctacctgtatccgtacgtctccctcccccctcccccctacaactccccattgccgctaacaaatgcagcaacatgtacatggccgaagactacaactccccgcaatcggtctactggagcctcaaatccctcgtcgtgctcctcctaccggactcgcatcccttctgggccacccccgaagcaccctctccatcggcccaacccccagtggaggtggtgtcggcgccgcagcagctcctctgcaaccacccgtccggcggccaccacttcctcctcaacccggcccaattcgtcgcctggccgatgaaggcctcgccggcaaagtactgcaagttcgcgtactcgtcggcgtttgcgtttagcgtgccgacgggcccgctgatccagcagctcgcgccggacagcacccttgcgctgagccgggatgggtgcgcgacttgggctgtgaagtggaagtgcgcgccggtgaggttcgggactgcggtcgtaccgggccagaaggacagagtccccgtggcggaggtcgagtggaggccgtgggtggatggggagattacggtccggacgacgctggttccgccgacggatcggtggccggactggcatgttcggattcatcggatccagggcaggaatttggagcggttgtatgcggtggaaggggggtttgcgattgagcgggtgccaaaggggaatgtgcagacgcctggccgggagcggattcttcctgcactcgagggggaggattggctggatcaggatatcggggtcggtgaaggggtgcatgtgtcggaggacagcgtgctgatcctgtctgcggctggggcgagcggtcttcgtggggcagcgaccatggcaaggacggagcatgaggcgctgaagccggactcgaatacgaatctcatggcgcagcggacgctgattcctgtcgtgagacacgggctgttggacggtgaccgtcaggaggcggtcctagtgacggctgtctttgctgttgcgagtccacaagaccagagtcggaggagtctccgggcgagatggatggattatccacgggaggccagtagtatcctgctggagtag

SEQ ID NO: 4578 - DNA, 624 bp, A.fumigatus
gaagacaacgaaaagaagcaatctaaagcgcagcgcgcagccgaggccgcacaggcggaagccgaagcccgcagagcagagaagctgcgcgagacagaagcgaaccttgcagacctttcgaaactcgtcacggagcccatcaagaagcgcaagagccgaaaacagaagtcagcacgggacgccgaagactccgactttggtgatgaggatgctcttaccgccaaggaggccgaagaaaaagccaggcagaaacgctcgctgcgtttctacacctcccaacttgcacagaaggccaacaagcgcaatgcagctggccgagatgctggtggtgatgcggatctgccttatcgcgaacggttgaaggatcgtcaggctcgcttgaacgccgaagccgagaaacgtggtaagcaaagaccagacaagatggagcagcttggcggcgacagtgatgaggaagaccatcggctggccaaggagatcaggggcgaaggggccggaaccgacgatgacgaatattacgatatggtcgcggcccgctccaagcagaagaaggacgaaaagaaggcgcgcgcagaggcttatgcggccgcagcccgcgaaggtggacgcgtggagatccaatag

SEQ ID NO: 4579 - DNA, 240 bp, A.fumigatus
  unsure (13): Identity of nucleotide sequences at the above locations are unknown.
gaggttgggccanacggcaaacgtgccatcacctaccagatcgagaagaataagggtcttgcgccgaagcgcaataaggattctcgcaacccccgtgtcaagaagaggaagaagttcgaagagaagaagaagaagctcggcagtatccgccagctttataagggaggtgaaggtcctggtggctacggtggtgaacttactggtatcaagaagaacctggtcaagagtgtcaagctatag

SEQ ID NO: 4580 - DNA, 684 bp, A.fumigatus
  unsure (255): Identity of nucleotide sequences at the above locations are unknown.
acgccgaagccgagaaacgtggtaagcaaagaccagacaagatggagcagcttggcggcgacagtgatgaggaagaccatcggctggccaaggagatcaggggcgaaggggccggaaccgacgatgacgaatattacgatatggtcgcggcccgctccaagcagaagaaggacgaaaagaaggcgcgcgcagaggcttatgcggccgcagcccgcgaaggtggacgcgtggagatccaataggaggttgggccanacggcaaacgtgccatcacctaccagatcgagaagaataagggtcttgcgccgaagcgcaataaggattctcgcaacccccgtgtcaagaagaggaagaagttcgaagagaagaagaagaagctcggcagtatccgccagctttataagggaggtgaaggtcctggtggctacggtggtgaacttactggtatcaagaagaacctggtcaagagtgtcaagctatagaccacgttcacttctctttggatacatgcactatgggcgttcattgtgttctctaaattatgggcttgcgtgtacatatatattttctctgatgatatacacctttcagtttctcacattctactttcctcctgcacctccatcctttccacgctatcatcagatactcaataagatactcggcattcgcaagcaaaagtaa

SEQ ID NO: 4581 - DNA, 441 bp, A.fumigatus
cagtcgttcatctccccagaaggcgagatcgtgcatcaccgccgcaagctcaagcccacgcatgtggagcggagtatctggggcgactcacagaccgactcgctgaagacggtcgtcgacagcccctttggcaagatcggcggcttgaactgctgggaacatcttcagcccctgttgcggtactatgagtacgaacagggtgtgcagatccacgtcgcgtcttggccggccatgttccccatgaccaagagtgtgccatggggattctgtgctaccggcgacggttcaaagttggcgagtcagttcatggctatcgagggacagacctttgtgcttgcatgtacgcagatcctcaccaaggaaaatctagccaagcagaatctggtagaggagggaattatccaggtggtacgtacctcatatccaatttccgatatctga

SEQ ID NO: 4582 - DNA, 198 bp, A.fumigatus
tcttcggacccgacggtagtgccgctggtagaagcgccccctcccggcgtggagtgcatcctccaggcggatatcgacttgcaaaacattgattatgccaaggcgatggctgatccggtaggtcattactcacgaccggatctgcttcaattgagggtcaacaaaaccgctgccaagtgcgttgttgacatggagtaa

SEQ ID NO: 4583 - DNA, 672 bp, A.fumigatus
  unsure (635): Identity of nucleotide sequences at the above locations are unknown.
tgtaatccaactgatgagaacagcacccccctcgtctcaatgactccagctgcagcgccagccccagcttaccagggccagggcccagagtatgcaccggtcatcaacccaatggccatgccccctcctccacccccctatctccaacccttcatccccatcttcaccgaccaactgccgagcatcccccactcaccatccctggcccactctttctgcgacactctcgccttcgccatgctccccacataccctattcctccgctacaccttcctcaccccgaccactccttcaccaacaccaacggcaacaacagcaacaccaacccccgaccaagaaccaccttccacccacgcaaaccctcaagcagcgaccaaacccaacaaaatcctcgcttcagcccccgccgcacaatcttcatccaaaaccttagcccaacaaccaccccgcacgaccttgacctcttcctccaagatgccggcacaatcgagcagtgcgagaatgccttaaacccggacacaggtcgctgcaagggcttcgcgcgcgttactttccgctcggctgacgaagcaaagcgcgccatcgcgctcttaaaaaacggggttttttcttggcgccgaaaatcagggctaanaatgatcggagtgggttatttccctccgggtcagggc

SEQ ID NO: 4584 - DNA, 468 bp, A.fumigatus
ctccagctgcagcgccagccccagcttaccagggccagggcccagagtatgcaccggtcatcaacccaatggccatgccccctcctccacccccctatctccaacccttcatccccatcttcaccgaccaactgccgagcatcccccactcaccatccctggcccactctttctgcgacactctcgccttcgccatgctccccacataccctattcctccgctacaccttcctcaccccgaccactccttcaccaacaccaacggcaacaacagcaacaccaacccccgaccaagaaccaccttccacccacgcaaaccctcaagcagcgaccaaacccaacaaaatcctcgcttcagcccccgccgcacaatcttcatccaaaaccttagcccaacaaccaccccgcacgaccttgacctcttcctccaagatgccggcacaatcgagcagtgcgagaatgccttaa

SEQ ID NO: 4585 - DNA, 288 bp, A.fumigatus
gttttccggaggacttaccaggaatatctatccttggctccgtatctcaagcacgttatccaaatcttctacttggacacttctcagccattcagcatcctttatatggcattgtctatcgatcttcctcagctatcatctaccatcatactgagtctaaatgaccagcaacatcaaacacgacagtactctacttctccggcctcactcaccatcattctgtatcatcctcactcattgggactctgtataacctcatcctgcgtctcacaggaggcgacgatctga

SEQ ID NO: 4586 - DNA, 603 bp, A.fumigatus
cttcaaaatagccgaaaggagcagagaagggaggaagtgttgaagaatctagatgagaagaaggcagccaaggcaaagagagctgctacaaaacaggtctccgcagacggcgtgcaagacatgccaggctctgagttctttgcgggtgacgataaacaaacggattccacccagacatcacgccgagcctcaattgcaatccaaccacaaaacgccatggggatcactcccgctacatccgaggatcttctaccttctgatctgcctgctacgcagcttctaccacttccagaagtgccctcatcgtaccccttgtttgcccatctacacgcggagggctattatctgtcaccaggtctccgattcggctgccagtaccttgcatatcctggtgatcctctgcgattccattctcactttttggttgtgtccgccgaatgggatgaggagattgatctgatggatatcatcgtcggtgggcgactagggactggtgtcaagaagggctttctgttaggaggagctgaggaaaaggatggagactcgagcaacgaagcagggagtaacgtgcggaccttcagcattgaatgggcgggaatgtga

SEQ ID NO: 4587 - DNA, 417 bp, A.fumigatus
  unsure (20),(53): Identity of nucleotide sequences at the above locations are unknown.
aatggcacttcgttggatcngacactccaagaccttcataattcagtgctccntagggcagaggaattcccgagccatacgatgcacgggcatagcttctcccaccattccataccttcaggcctatcgcatcacggtttgcctgccatgccgatccctcagtatcaagcgatttacgataataatattgaaaatcacttgccagagcatgtgctggacgacaatgagaactcggagactggtgcaaagaagaagaaaggttccaattcatccctagcgaacgacaatgaattgcgaaagttgctccgtcagtacgaaggctattccctcaagcaaatggcggcagaggttctgaaacatgaaggggctgggggcaaggccgagaaagttaagcaggtctttgccatgatctggtaa

SEQ ID NO: 4588 - DNA, 423 bp, A.fumigatus
tctggtaagcggacgcgcgtttctcattgttatcggcaggaaatctggtacttatggatgcttaggttgaaagagaattgccggaagagcagcggttccgtccggcgagaccgtgtttactgttgctatgcagagaaatgtggcaccgagcgtgtctcagtcttgaatccagcttcttttggtaaactcgtgcgcattatatttccgaatgtgcaaacgagacgccttggtgttcgtggagaatccaagtaccactatgtggatttaacagtcatcgaggaaaaacagcagaagccgccgccgttgaatccgcaggtctcgtcgattaccaatggccaaattggtggaaccatagaaaacaaatttgacggaaccatgcagaagaggttttgtcaatacatacttgatagcccaggaagatga

SEQ ID NO: 4589 - DNA, 216 bp, A.fumigatus
aaatcaggcagcaaatatcttgccgatctagtcataactgcaggacagactagtacagagagagtaaaagacgtgtttactggtcggaaattctccggctctcctgttttccttatcagcgcaaattttcactctccggccatttcggccagctccgccgctgtcaccttgggcgattatattgacctgcttgacagccggctaccgagtgtttga

SEQ ID NO: 4590 - DNA, 192 bp, A.fumigatus
cgtaatgtaggaaacaccatcttccttggcctcggcgcctcagggcaaccaagcagcaaaccctggggctggctcaagtcgctgacttctatcgtctcattcttcatcggtgcgctgatcttctcgaatgtgacgcgtcgcactggcgcccgccgccgcggcacccttttcacctccttcatggtgcagacc

SEQ ID NO: 4591 - DNA, 1083 bp, A.fumigatus
ctactgagcgctctttcagcccccggtgaagacttcatactgcttgagatcagtcacgttttgacggatgctgtctccatcgacatcatttggagggacttgcagcttgcctatgaaggcgccttgactacttcgaaagccccccgctacagcagattcgtctcgtatcttcaaggcacatcgcagaaggaccatatggcgtattggctcaagtttttgaaagatgcggagccttgtttctttccccatctcggaacgggcaaccaaaaaggcgcaacacgggctgtgtccgtcacaatttccagagcaatgactgatcacattcggcagttctgtgcatctctccagattacggttgccaacctcattcaagtgatgtggtccatggttttgcgctcgtacactggaatggacgatgtcagttttggttacatcacatctggacgggatcttcctttggacggtatcgacgatttggtgggcccgttgatcagcatgatgatatctcgcgtgcgttatacgccgtcaatgaaagtggccgacgtgatcaaacaagtagggcaggataccgtagccagtatggcccaccaacactgttcgctggcagccatccaccgagaagttgggctaaagtccaggtccctgttcaataccgttctcaccgttgtccggccgcattccacgcagtcgatagacagttccttgcaattaacacaaattgcgagttcggctgggactagcgaatttgacgttgtcctggaagtgagtgactctggagtcgaactggatactaccctcgcatactccgagtcagctcttcgttcggaggacgcgaccaatctgtctcatgcgatagtgtgcgcgttgaattggatcattgcacatccagaatctttggttgaccatctcagcctgtgctcacctgatctcatatcccaaatgactgccatgaacaacgcgagcccaggagtgggagttgcggcagtgtctgcacgaacttatctccttgcgtgcacatcggcaaccggattctccagccctgtggaccggacagggaacaatgacctactcggaactagatag

SEQ ID NO: 4592 - DNA, 396 bp, A.fumigatus
acaacgcgagcccaggagtgggagttgcggcagtgtctgcacgaacttatctccttgcgtgcacatcggcaaccggattctccagccctgtggaccggacagggaacaatgacctactcggaactagatagcaaatcaacgatgttggcccgtcagcttatctctcttggtgtcaggcccggctctctggttcccatatgtctatcaaagtctacagtggccgtcctcgctatgcttgctattatgaaagccgggggggcatttgttcctttggaccctctacatcccactcagcgtttggcggatctcgtccagcggacgggggcaaagttgatactctcgtcagccaacacgaggaactcagcagagttcgctggccccagagtggttgtcttc

SEQ ID NO: 4593 - DNA, 1068 bp, A.fumigatus
  unsure (46): Identity of nucleotide sequences at the above locations are unknown.
gaagcaagttcagttagtatttccaaaggatctgggggctttgtancagacgttacgatcgtatgcggtttgtacgggttcaacatcggaaaccagcagttcacgatgcgcaatctgcacatttcagacgctgtggttggtatctcccaaatttggaactggggctggacataccaaggactcactctgacaaactgcaccacggctttttcaatcgccaatggcggtcctggagctcagctggttggatctgccattgtacttgacagtacgattgaggactgtcctgtgttcgttgagacagcctggcagagctcgagccagagcaatggtagcttgattctggagaacgtggccctcaacaacgtccccgtggctgtcaagggcccaagtggaacagtccttgccgggtcagggggagccatgaccatcagtgcgtggggccagggacacaagtatactccttctgggccgaccaactttcagggtgcaattactgcgcccacaaggcccagcgctctactgtctggtggaagatattacaccaagtcaaagccgcagtatgaaacatctccgacttcttcattcctgagcgtacgaagtgccggagccaagggcgatggctctactgatgacactgccgcgattcaatccgctcttaccacagcagtgggttcaggacgaattgtctacttcgatcagggtgtgtacaaggtgactggcacactctacatcccccctggctcgcggattgtaggagaagcatatccggtcatcatggcaagcggaagtcagtggtccaacatcaaccagcctgtgccggtgatccaagttggtaaggcaggagagtctggaagcatcgaatggtcagatatgatcgtcagcacgcaaggctcgacacccggtgcggtgcttattgagtggaatttggcggcaagtcaaggctcaggcatgtgggatgttcacacacgaatcgggggatttgcgggctcaaacctacaagccgtacagtgcccgacctcggcagccgtctcggtctacacgccggggctggaaggtatcgcgctg

SEQ ID NO: 4594 - DNA, 270 bp, A.fumigatus
gcgccacacgcattacctcgctttacaggtctgtccccctgtcagccagtattaggcctgactgacatgcgtagcttcgtctctgtgataacaggaaccattctcggagcaatcgtcatttatgtgagacgcctcaagccatttattgtcgcgggtaccttggtcttcatggcagcctttggtatcctcatccgattccgcggaggcgcagacggcaccaatcatgcaggaatcatcgggggtcagatccttcttggttttggtaagtga

SEQ ID NO: 4595 - DNA, 387 bp, A.fumigatus
  unsure (230),(309): Identity of nucleotide sequences at the above locations are unknown.
cttgtccagctggtggtttgttcccttaccccgctcaagccagcgttcaggtcgcctccaagcataagtgtaagtctggcgcccccaggagcgttcgcaatgctaaccaccacagaccttgccgtcatcaccggcatctacctcgcaacgtacaacgtcggcagcgccctcggaaacaccatctccggcgccatctggactcaggttctgcccggcgagctggaaaatcngcttggcaacgcgacactggccgcagaaagtctatgccaatccccttcgccttcaccccaagtaaaccccgtctgcacnccgggacggggacgccggtcattttggccctacaccatgcgcaaaaaatggtggttgtacacggggtatcttgcctga

SEQ ID NO: 4596 - DNA, 1149 bp, A.fumigatus
acagatggctcatccgaccctcgaagcgcagccttctcgacatttacgcgagctgctcttaaggcgtggaaaactgacccggttttccagccttactttcacgaaactggctttatcatatcggggcacacacctgctctgattgaccacatacgaaaagacgaggtagaaccgtcagaaacaaacttcgtcaagctggagacagccgaggacttccgccggaccatgccgccaggtgtactgacaggcgacttccctggctggaaaggctggttgcacaagtctggtgctgggtggattcatgccaaaaaggctatgatctctgctttcaatgaagctaagcgcttgggagtcagatttgtcactggctctccggaagggaatgttgtatcgttggtatacgaggacggagacgtcgttggagccagaactgccgatggtcgcgtgcacaaagcccatcgcactattctttcggcaggtgctggcagtgacagtctcctagacttcaagaagcagcttcggcctaccgcgtggactctctgtcatattcagatgggccctgaagaggtcaagcaatatcggaaccttcctgtgttgttcaacatcgccaaagggttcttcatggagcctgatgaggataaactcgagctcaagatttgtgacgagcatccagggtactgcaactttctccctgacccaaacagaccgggccaggagaagagtgtccccttcgcaaagcatcagatcccgctcgaggccgaagcccgcgcacgagactttctccatgatacaatgccgcatctggctgacaggccactgtctttcgcgcgtatttgctgggatgctgataccccagaccgtgctttcttgatcgatagacatcctgaacacccctcactgctagtcgctgttggaggttccggcaatggcgccatgcaaatgcctacaattggcggttttatcgcagatgctctagagagtaaactacagaaggaggtgaaggatatcgttcgatggaggccagagacggctgtcgatcgagattggagagcgactcagaatcgctttggcgggcctgacaggatcatggattttcagcaggtcggagaggatcagtggaccaagattggagagagcagaggtccgtaa

SEQ ID NO: 4597 - DNA, 501 bp, A.fumigatus
aaatgttgtaacttactgctcagtaaaggcatatcccaagccgcgatgcgagcatattcacgaatctcgcggtgcaattcgacctccgcgtgcgccatggaggtgatttcgtcgtcatggaaatcgtcatctgcgtcctcgacaagaccgaattcatcgtcttcttcctcagcccagaagccccgggatctgtccggcacatcctcaaatcgcagccctacttccttctctatgtctctcacactcttctcgatctccgcaaatttggccgctcgcacttgcgggtcattgaattcttcgatcatgcgacgttgctccgcatcaaaggcctcccgttcctccggggatagcatttcatacattgaccgctcctccttgctaaggagatctggcgagtattccggcacgtcaggcaattcatcctccggcgaaggtcctttggcaattggcggatcttccggcacgaatttaaagggtgtgacagagaacgggcgagattga

SEQ ID NO: 4598 - DNA, 225 bp, A.fumigatus
gttatgattcatgatatacttttcttttgtcattcgttagtctacatctacctgtttcctttgttggatatccacgagtgcgtacggctggtgtctatcatttctatacctatatcccgttcgattcgctgtcgtcagaggagtacggattacaattcaattgatattatcacgcctcaatgggaaaacgtccagacaaaaacaaggagcaggatcggaaaataa

SEQ ID NO: 4599 - DNA, 1206 bp, A.fumigatus
  unsure (253): Identity of nucleotide sequences at the above locations are unknown.
aaccctgattctctacaaacggctcaccagatcttccaacctcgagctggctgccaaaggctctcgctgaatcccaaacctttggtcgagccattcgaatgttttctgcgccgagtatccaaacgcaccaatcttggcctggagccctccgtacgcgacatccgtagcaatccatttctccttatccacgccatcttggagactcgtcaagcagtcgtagatcttgtcggtcgtggtggcggggtcgaagtanaagcttgccccggctcccgtcaccagggtcgggcacttcacatcagccaagtattccgtgccgtctgccttctgcagagtgtaggcgccaaagctacgcatgacatccgcatccgtcgtggagccggtggcccacctcaagtggttaaactcccaccgggcctgaaacgcaagtttcttgagaacgccgaggatcccgttgaacatccagtcggagagccagccgctcatgaagccgttgaagagcgggcccggcatccggccgcccacaaagctcgacaggctgtagaatccatccacgctcacgcatgccttgatccgggggtcggcagccgcgcggagggcaaagtagccccccatcgaggcacccgtcacggcaatgtggtccaggtccagctccagttcgggatggcgcgtagccaggtcgaagaggtgatccagaacgggacccgtgacggattcccagtccgggcgcattggcagcttgtcgcgacggaggacgattccttggccgggcccctcaaacgtcaggactgcgtagcccaagtccggcccgtacgccggattgacaaagtagatctcttcctgggtcgaatcgcccccgcccgagttgagcaggatcgggatcttgcgaccagggatgcgccgggcggcaggcggcaagtacagatatccaggcagcgttttgccgccctcgtatgggatctccaggaagatcgtcttgccatcacgatactggacgccctttcggaaattggcaatggctcgttccaaggtgggaaggactctttcgtcatgtccgatggggccttcgttgagcatgaactgcgcggcccggaggtagttggaggagcgcaggtacgcgcgccgtgcaccgacacgatctccagaggcctcggcttgctttgcgatggcttctgccttgccacctattacgaccgggtgaaaatacgc

SEQ ID NO: 4600 - DNA, 1194 bp, A.fumigatus
  unsure (954): Identity of nucleotide sequences at the above locations are unknown.
gcgtattttcacccggtcgtaataggtggcaaggcagaagccatcgcaaagcaagccgaggcctctggagatcgtgtcggtgcacggcgcgcgtacctgcgctcctccaactacctccgggccgcgcagttcatgctcaacgaaggccccatcggacatgacgaaagagtccttcccaccttggaacgagccattgccaatttccgaaagggcgtccagtatcgtgatggcaagacgatcttcctggagatcccatacgagggcggcaaaacgctgcctggatatctgtacttgccgcctgccgcccggcgcatccctggtcgcaagatcccgatcctgctcaactcgggcgggggcgattcgacccaggaagagatctactttgtcaatccggcgtacgggccggacttgggctacgcagtcctgacgtttgaggggcccggccaaggaatcgtcctccgtcgcgacaagctgccaatgcgcccggactgggaatccgtcacgggtcccgttctggatcacctcttcgacctggctacgcgccatcccgaactggagctggacctggaccacattgccgtgacgggtgcctcgatggggggctactttgccctccgcgcggctgccgacccccggatcaaggcatgcgtgagcgtggatggattctacagcctgtcgagctttgtgggcggccggatgccgggcccgctcttcaacggcttcatgagcggctggctctccgactggatgttcaacgggatcctcggcgttctcaagaaacttgcgtttcaggcccggtgggagtttaaccacttgaggtgggccaccggctccacgacggatgcggatgtcatgcgtagctttggcgcctacactctgcagaaggcagacggcacggaatacttggctgatgtgaagtgcccgaccctggtgacgggagccggggcaagcttntacttcgaccccgccaccacgaccgacaagatctacgactgcttgacgagtctccaagatggcgtggataaggagaaatggattgctacggatgtcgcgtacggagggctccaggccaagattggtgcgtttggatactcggcgcagaaaacattcgaatggctcgaccaaaggtttgggattcagcgagagcctttggcagccagctcgaggttggaagatctggtgagccgtttgtag

SEQ ID NO: 4601 - DNA, 1089 bp, A.fumigatus
ttcgctagcagcgtcttctcgactgcaaccgcggtgacggctaaggaataccatgtatcaactgaggttatgactttggctaccagcctggtcgtgttcggattcgctcttggtcccatcgtgtgggctcccatgtctgagctctatggacgcaggctgccgctgttcttgggctacgccatcttcgtaatcttccagattccggtagcagtggcacagaatgttcagaccatcatgatctgccgcttcctcatcggtgttttcggttgctctcctctagcggttgttggaggcgcaatggcagacttctgggatcccatcgaccgtgctgtggctattgccttgttctcggctgccactttcgttggtcctacacttggtccaatcatcggtggatttatcaccgagtcgtacctcggctggcgctggactgcatggatcacgatgattccgtctgcagctttcggcactttagcctttttcattgttcctgagacctatggtcctgtcatccttcagagacgcgcggctcgccttcgccgtgagacaggcaattgggcactgcacagccttctcgacgaaagtcgccctaccgcttccgagatcgtcaacaaatacctgctgcgccctattcaaatgcttttcctcgagcccatccttttgctgatcacgatatacctggcactggtgtacggaatcctgtaccttttcttcgaagcataccccgtttcgttcatggaggttcgcggctggaccaacggaggcattgccggtcttccgttcatcggcatcttgctcggagtggtctgtggtgtggcattgatcatctggcagacgaagacccggtttgcacgtaagttggcgaaacaccgccgcgttgttcctgatgagcgtttgggtccccatgattgttgcatccgtgcttctggccggtggtcttttttgggtcggctggacccccaccccccatatgttgtgggttgctcaagttcctgcaggttttccccttcggcattggggatcttgggtcatcctccatgccagggttctccacctacttcctcccaaagttgttttttttccacctcc

SEQ ID NO: 4602 - DNA, 252 bp, A.fumigatus
tccgatctttggaatgtgatattggcaaagggactattagctgataccccccacaacagggctgagaagaatcccgccgacctcaaggctgtctgtgttaccaatggcgatgatgtacagaaaaagatcgcgaacacttgtggtgatagtgagcaggcagccctgtcgtggtttgctgatacctgcgacgctgcaggctacaaagttggtatgttctccagggcgtaccgaggcgcatcgcggggttcctga

SEQ ID NO: 4603 - DNA, 279 bp, A.fumigatus
ttggccgcatcattaatgacatatttcttagatatcaaatcctctaccactacctctgagtccgctaccggaacttccactaagggctcggcatctaacaccggtttcgttactgctactgcgactggctcttctagctctggggagaacaagtccggaacttctagctccagtgctacgtcgacttcccagacagtctcagctggctcgtctgatcgacaggtctccgcagcagcctttgcggctgtcgtcttcttcggctttgctgcaaccctgtag

SEQ ID NO: 4604 - DNA, 771 bp, A.fumigatus
agactgcaccctctcatccagcctccctccaaaaccaagccagctgctgaatggagttcgagtagtcaaacacttatataccctgtggctcagttcactccgctattgaagcctgatacttctactgagttccccgcagtcacagctatcttacgccttctttctacttcctctgttttctccggtgcccgctggctcttcaccgctggttacttcaacatacaccccgttctttcttctctcctcattgcaagcacgtccacctctcacaccgcctcgactacccgaggtactgtgcttaccgcttcaccatgggccaatggattttatggctctccgggagtttctggcatgttgcctgccgcctatacacatctttcggccaagtttctggaccgagtctcagaggcacagcgcacaaacgccatccagctaaaagaatggcgtcgcggaaccgtaggggaaccaggaggttggacttatcacgccaaggggttgtggataactctgcccaaggaagaacaccccagcatgacatttgttggaagcagcaattacacaaagcgcagctacaccctggacttggaagttggcgcgctggtcgtgaccaatgaccaggaattaaaacagaaattgggggctgagaccgactggttgcaaaaagattcacaagccatctcgcgcgaggatctacggcggaccgagagacgagtctcatggaaggtacgattggcaatgtggatcgttgagaaggttgggggtgctctatga

SEQ ID NO: 4605 - DNA, 189 bp, A.fumigatus
ttcaatgaggtcatggacgacttccttgctgggtgggatgataagacaagcgcccaggcgaagcgtaagggcgccaaggccaagagaggcaaaaacggcaacgaggccatcggaatcaagatgttggacgagatccgacagggtctcgggcccgctagagtgccaggaaaggtttctggccgggcatga

SEQ ID NO: 4606 - DNA, 525 bp, A.fumigatus
agactgaacttcggccagatgggatttgttttcatcgaagccaacgtcaaaaaatggggcctggctcccatgacgggcagcctggctcctccgccgccatatggaagcgagcagggcagtatcctccttgaatccggtcgcgagagcgctgctcagatctctcagcgggtctatcaggatgcaaggacaagctcgaccgtcagaatcccgccctctcgtagccccggaccggtccgatcaccaacggatatttccctcgcaccacttgcacatattccctctcacgaagacgttggtgaaggatcaagtcatgctaacaccattgctgacgaacaaactgccttattgaacccaaccgatcttgatcaggttccgcctcccgaatactcgagcccggacggcagtcgaagaggtagtgacatcacaggagacctgccaaatcagagctcacctccgataccgagttacgatgctgctgtgggcaaccaagccgacaataccttgatgccggacggcgatcactga

SEQ ID NO: 4607 - DNA, 249 bp, A.fumigatus
  unsure (217),(222),(238): Identity of nucleotide sequences at the above locations are unknown.
ggagaatcaaaacctccaggtctccagcttttcagtctgctccctcccgatacaatcacgctctctcatgaggttaagcctgagttcgcgggcctcttcaatagtgagaggatatggttcaagttaatccagcaccatatcctgcagctctcctgggagcccctttcgagccagaacatctcgttggatattgaggccatcccacccgcccccctgntggtnttcaccgacggaccgnggacacccacc

SEQ ID NO: 4608 - DNA, 807 bp, A.fumigatus
aacgcattcgcggtccttcatgcccgttgtgaagactgctttgacgtagtttgtcccgactgcttctccggatggaaacaagtttttgatggtcacgtcgaacctacgaatacaataaaatgccaggtttgtgacggttggatccctatctcgtattcgaccatcactgtcgaaggacttgaggagtacttgacggagcacgaacaagcaaagcagagccgaaggcaacccaaaacccttggcgagtacgaaggaccacacacgaagaccaaggcgcttttggctcatctctccgaatctgcagaggagagcaagagactaaacgctgagcccccaatcaagagcgtggtattctcggcctggacctctcatcttgacttgatcgagattgcattgaaagatcgtggcatgacgggattcacacgcttagacgggactatgtcgctcgcagctcgtaacaaagctctagaggatttccataccaacgacaacaccactatcttgctagccacgatcggtgctggcggtgtcggattgaacttgacttctgcttcgaaagtgtatatcatggaacctcagtataatcctgcagctgtggcccaggcgatcgatcgggtgcaccgactgggtcaaacgcgcgaggtgaccacagttcagtttatcatgaaggggagtatagaggagaagatcttcgagcttgccaagaagaagcaacagttggcagacatgagcatgaaccgtggcaaactcgacaagaaagaaattcaggagcagcggatgagagaatatagaagtctcttcaaatga

SEQ ID NO: 4609 - DNA, 192 bp, A.fumigatus
ccggcgcaaaatgtatggaatgtatgtgtttcaacttctccccctcccccccacagtccatcgtttggctttgccactaagtcgaacgagcatctcactcctttgtgcggacgccatacgtaccattcgcttacgattgacgtccattgtgtgaacgcttcttcagaaactagtcgaaagtacagactatga

SEQ ID NO: 4610 - DNA, 225 bp, A.fumigatus
  unsure (26),(27): Identity of nucleotide sequences at the above locations are unknown.
cacagaattgatagttcgaacaattnncagttgggtggtactacggtgctacatagtgcctggctttcatgttttggtcggcgaaaatcgctcaaggcaatctggacggtgaacacgatcaagtttgaccctttcaaccttttaacggccgccgcatccgtaatgcatccaattatctggacgttggagaagattctttgggcttctaagccccgtgtgtcaaaa

SEQ ID NO: 4611 - DNA, 255 bp, A.fumigatus
gcacattgtggagttgctggctcagccacggactggctaatgctatggacgatcaaacagatccagggtcaaattagcgcaatcactgacttggagggaattaccgccgaggagcatatcattagcactccatcgtcgatcgccgtcgaccatgttctgagaagcttctatcatttcgacgtcggaaagctttcccagcaagacctgttctccttctgtctgtactgctcaaaaatactcgatggctccacataa

SEQ ID NO: 4612 - DNA, 453 bp, A.fumigatus
gaagcttctatcatttcgacgtcggaaagctttcccagcaagacctgttctccttctgtctgtactgctcaaaaatactcgatggctccacataaggttgtggaaggctcacccacacaacagatcatatccgaccacgtttggaagcgcaagcgacccgaaaccgactatgaacgatggcagcgggagcaagacgagagctacgaacccggcggacgaccacaatacggaccgccaaacgaattccggaaagatgactatgtggcagacggaactgaggagttgctccatggacagcactattctgtagagcaccgggccccatcgcacggttattttgtgtcctcaacagccccggcaaaacccatcacaagcgagggtagcttcatatcttactgccaggaacgcttgtattcagcctccggagcgaaggcaagaaccgaacttatggtc

SEQ ID NO: 4613 - DNA, 777 bp, A.fumigatus
ctgtggctttccagaggctatgcgtcgataacagccggtgcttgttctactatagtgactaatccaatctgggtcattaaaacgcggcttatgtcacagagcctcaagtccaacagtgaaggctacacggctccatggcagtactcaagcacttgggatgcagcccgcaaaatgtacaggatcgaagggattaggtcattttattctgggctgacccccgcgttactcggcttaacgcacgtcgctattcaattcccgctatacgaatacttgaagatggcctttacagggtacgggataggggaacatcctgataacggtggctctcactggattggcatatcctgtgcgacattcctaagcaaagtttgtgccagcactttaacctacccgcatgaagtgctacggacaagacttcagacacagcaaagaacatctccagcgccttctccagaaggtatctcatttcgtggagggctagatcacccacaagaccgcgggcggcctccaggagcggcttcatcggacggcatgcccaaccgccctcggtatacgggcgtgatccgtacatgtcagaccatcctgagggaggaaggctggcgcgcattctactccggcatcggggtgaatctattccgggctgtgccggctgccatgaccacaatgcttacatacgagtatctccgtaagctgatcggtcacttgcaacatgagggagagttgaagttgcgcatggcaaatgatagagaattagctttgttgcagcaggatgagtaa

SEQ ID NO: 4614 - DNA, 213 bp, A.fumigatus
tctctcaatgctccgatagctgcctttaccatggcaatcattctatgctcctactgcatcagttccatcaactccgctcgccgcgaggctcaatcatccccagtcaccgcgactacaagggctcagaagttctccgtggaaaaatctgaccaatcgtgggtacagcaggcattagaaaccagagatgcagagcagcaaaatcggtcgaggtag

SEQ ID NO: 4615 - DNA, 1446 bp, A.fumigatus
  unsure (1413): Identity of nucleotide sequences at the above locations are unknown.
agattccactctcgtgcttgtcaacaagtacgagagtggaacgctgcgctaccagagagacctgatagatgcgcacatgagataattgaacaacaggttctgagccaccctacctcgcctgcaatctgctcatgggacggagaatttacttacgaacaactcgaccgtctatcaaccaaattggcaaagcatcttgtttgcctgggtgtcaagcccgaaatcttcgttggattgtgctttgagaagtccgcttgggcagtcatcgcacaagttgcggtcctgaaagccggaggggcatttgcatctctggatcccagtcacccggacgcaagacttaggggcttggtcgacgatattggcgctcatatctttctttgctctgccaaatatctcgacaaggctcgccagatatcccgcgccgcctatatcgtgagtgaagaaacactcgctgaactgccagacgtatcgtctactgcgtcgatgactcggcccagcatccacaacgcagcctacgctatttttacctccggaacaacaggcaagccaaaagtgactgttcttgagcacattgctctcagcgtgtcttcaccagctttcgctcgtagcatgggaatggacacgactactcgtgctctgcagttctccagttatacttttgatgtgagcataaaggagattatcattgtcctcatgacgggaggttgtgtttgcgttcccagtgatgaagagcgcatgaacgacctgtccggtgccatcaggagactgaacgccaacttcatcagttgtcctccgtcagtttcaaacacgatccaacccgagagtgtcccatcagttaaaactgttgtgatgggaggcgaaaagatgactgcgagccatatcgaccgttggggcgataggtttgtcatcaacgcgtacgggccctcggagtcgacagttatggcaacgatgagcgtcaaagtggatgaagcaggagtacgcgtcaacaacgattgcaactccatcggtgctgcgatttgcggccgcacttgggtggttgaccctaacaactatcagcgtcttctgcctatcggggctgtgggtgagctggtgcttgagggctgcaacgttgcccgtggttacctcaacaatgaccagaagacaaaagagtcatttatcagcgaccctgcatggacgaaggccccaggtttgaaggaactattcaagaggaaggagcgcatgtaccggactggtgatcttgtccgctataaccccgacggcacaatttgcttcatctcgcgcaaggacacccagatcaagttcaacggtcagcgaattgaactggaagaaatcgaacaacaatgcatcagttttctttctggaggcactcaggtggccgtcgaggttgtggagcccgaatcgaagccattgcaagtnttctccaagggagcccagatccgcccagtggtt

SEQ ID NO: 4616 - DNA, 240 bp, A.fumigatus
  unsure (104): Identity of nucleotide sequences at the above locations are unknown.
ttacccgcacctttgaacccgttttctttgggtattggacggcatttttcgcccgccgggttaggatgtcctttctgggattgggttgaacatgtgggcggcanatgctccggtcggaacgacttggttaatgcgaacacaggcaagttgaacccccggcacatgtacggtgcgaccaatcaggatgtcttcccggtggccaactgtgcaatggggcgtggaacggcaattgttgggtag

SEQ ID NO: 4617 - DNA, 1191 bp, A.fumigatus
acccccggcacatgtacggtgcgaccaatcaggatgtcttcccggtggccaactgtgcaatggggcgtggaacggcaattgttgggtagttatatcacaacattgctctttccgggcatccttcttttgctctggggtgaggagcaggccttctatgtgctggatgccactgctactaattatatttacggtcgtcaggccatgtcgcctgcaactgcctggagagaccatggctgcttcagtctgaactcctcgcagtactacaaatggccgattcaagctggccgggaaggttgccacgatgatacagtcgcctatgatcatcgggacccttctcacccagtgcgcaacatcctcaagcacatgtatcagttgcgtgagcaatttcccgttcttaatgacggttacaccctcaacaacttgtccaagtcgacctttcccgtgcagtacccgggttctaacggaaccgagaccgagaccggaatgtggtctgtcagtcgcgaagccaacctggaagtgcaggatttcggatccgatgacctgaattcgcctgtatggatggtctaccagaatgataaccatacggtggattacaagttcgattgcaacagcgagaccgatgctttgattgctccctaccctgccgacaccgtcgtcaagaacttgttttacccctgggatgagttcaccttgaccgccggcccaaccaaacggacctttggaaatgcgacattgcctgctggctgctatggcaatctgaccctcaaagcatttgagttccgggcctacgtgccaaagaagttacatcggaagcctcgcccgatgatcaccaaattcagcccgggccacgacgttcccattgcttccacggttgcgcctgatgcttccgagaatgtgcccattgagctgcatttctccgaggagatggattgcgatggggtcaccaagtcgatttccctgacctcctccaccgagtcactcaaaatcccatccatcgacgctggctctgtacattgcgagcgtattaccaacttcaacacctcgtggactgctcagattcctagcatgtggaagtggcaggctactttgacgaatgtctacaacggtatccaccagatcactgtgaaggaacccaagactagcagtggcaacgcctccaccaactccaccgatcacttccttttccgcatt

SEQ ID NO: 4618 - DNA, 567 bp, A.fumigatus
ttgaaacatgagcgctttttccagccccgtggtgaagacggcaatccatgtgttttcgtgcgtgcttctgacttgggggtaccaggaaatctggcgccagataagatcgatgcgcatcctactctactctcacagttggattcgatccgtcggcaagctggggtgaagatgggactggctggaacaacaaaagaagtgcctgggagtgttcccaagatctgcctcgtttcatctccgtcagatgcttatacatcgggaatgatgcagacgccaaaggatgtcgatctggtggttcgcgctctctcagtcggccagccgcataaagccgttcccatcaccgtcgctttggctcttgcgacggccgctagggtgtccggcactgttgtggccgacgtggtaagcgacaaaccagtagatcctgctggcattactctaggccatgccagtggcaaactgctagtcggcgcagactttgaccctaccggtcatgtaagctgtgcgacggtctatcgaactgcgcgccggattatggaggggcgtgtcttttggaaaggtgtttctacttga

SEQ ID NO: 4619 - DNA, 561 bp, A.fumigatus
gtactctattccttcgagcggcgtcgtgtagtacatatgccaatcggttggttctggttcggctggacgtcctacccctccattccatggattgtcccaacgatagcagttggatgcgctaccatgggcatcttctcggtctacctagccacctttaattatttagccgacacctatcaccggtacgccagttcggcgattgcggcacagtcttgctgtaggttctccattctgctcttttgttcttcactattgacgcgacgatcaggtcgaaatctcctcggtggtgtctttccgttggtaaccaacgccttgtttacgaaccttggatatcctgccgcttccagtctactcgggggaattgtgagtttctgtgtctatgaaagaggagtcgaggctaaccttttgacagggagccttgctgtgtatcgtcccatgggtccttctgctgtttggacccaagattcgcgccaggagcaaatttgcaagtgtaagtgtccacaatacattcggctgggcccaactaattgtaccaggaacttgcacactagttcattataa

SEQ ID NO: 4620 - DNA, 432 bp, A.fumigatus
attcgcctccccgcattcccccagactggttccccaaagtatagtcccagggatttaaacagggagaccgcacctcacctcacctcaaacaaatcaatcatccatggccaacacatactaaatgcacaatgctccgaactctcatccgcacagcacaaacaaccacgagaccccccgtctacctctacacacccgtcctcactcgctccctccatccccggcccaatccggacgagctcgaccgccaaaccctccaccctgaacgagccgaaaacacccagtctgggaccgacgacgctgtcgcacggcacacctcctcctatgacccctcgaccaccactccagagaccgaatcggaggcgctcgaggccgaatgcaagctcctcggcgaggtggatcccttgttcttcagcgcagcgcaccgcgaggtga

SEQ ID NO: 4621 - DNA, 1110 bp, A.fumigatus
tctgatagctgggctatcattcaagcactgtggtggatcctcatcatgcctgaccgccgcctgtcgcaactgctcaaatcgaagcttctgcgccgatcatcgaccacggctacgacctctccgaaacagaaccagaaacccgttaacgctcagaaaaaggcggccgtcggggcggatccgcttgtcgaccccaactcaacctccgacctttcctgttctctgcctcctcatcttttgacctctaacgaaggagagggtgatgccaaatcccgtgcctacagcataatttcctccatacccctcgaccatcccagttcccccgacgagattcctggtcctgctactggttcctcagcaggctgcgaacagtacttcacccacttcgaccgatcgggcgcaaactcacgtcaagaaggatcgcagaacggttcaattcagcagtctccgacattcacgaggacccttcggcacaagcaactgaccgaggaaaaaggcaaggggaagttacaatcgcgggagggggatcaaagaggcgaatacggataccaacgtatccggaatgactccaacgactccgatcctcagtacagcttgaccacagaacttgccaataagccctctacaccacagactcccgctggcgacgactcgctacattcaccgtcggcgacccctcttcccctttcgccttctctgccaggacccactggcgcaagctcgcttcaagcagcatatcgaccagtccgagaaaattccagcgtgccactagtcgaatctcaattgactccgtccttgggtgctgtcgccgaggactcttctggagaatctgcatttcatttcgtgggcccttcgtcgtcgtccccgtttccgaagcggccccccttggggttccgccgtcagtcgctttttccagcctcacatcaacacttgatcagtggtcttatgggtttcgggccttatcagaacctcggccagggcagcggtcacccttccacagtcaacgctgatatgattcctcgaaaagtatgggtcaaacggccagggggctcggccaccctggtaccgaccatggaagattcgcttgtagacgagctgcgcgatccagggatc

SEQ ID NO: 4622 - DNA, 189 bp, A.fumigatus
gaaaaaaaggtccacggggaccataagattatccacctaaaacatcctatactctgctccactgaatattggacctcgcacatcggacacccagcaatctatacttctatgacctccgccgtctccaccaacgaattatatacatacatacgatgggcgagctccgcaccaaactcaagcgaatactga

SEQ ID NO: 4623 - DNA, 480 bp, A.fumigatus
tgtcgaggattgttgtcaggttgttatagtttgccgaagatcttaacccgctctttaatgggcttctgggtcttctcgcctgattcgcccgcccggctaccgaagacgagttgcgcgatgaggcgccactccgaggggatgtcccattggttggcgaacggggccgtcgatgaagggggtgtaacgttggacgttccgcccctcttccctaccgtgtttctatcggtctcgccaacctggcttccccatttcgattcttatctttttctcctagaccgatctgtctgcgcagactggcgatctatcagcaccagcgagcacctcggccctagctgcactatcgactgcctacttataccttgtatcggtaacgttcctatcgaatggcttacgtatgcgttgtattcagaagagtactgctactctactacgcgcagcttcaccaatcctatcgtcgactctgatcgtagtactgtctga

SEQ ID NO: 4624 - DNA, 234 bp, A.fumigatus
gaatcgaaatggggaagccaggttggcgagaccgatagaaacacggtagggaagaggggcggaacgtccaacgttacacccccttcatcgacggccccgttcgccaaccaatgggacatcccctcggagtggcgcctcatcgcgcaactcgtcttcggtagccgggcgggcgaatcaggcgagaagacccagaagcccattaaagagcgggttaagatcttcggcaaactataa

SEQ ID NO: 4625 - DNA, 393 bp, A.fumigatus
ctggagtattcagactcgatcctatggcccctccttcattaccaccccggcgagatcgttttcgacgaaggcgcttgggatgcctaccgtgaggccaaccttttattcgccaaaacaattgtaaaggaggcgcaagacggcgacctgatttgggtacaagactatcatctcatgcttcttccagaattgctccgcgcggagttacgggcggcgggcaaaaaagataacaaaatcggcttcttcctgcatacaccttttcccagcagtgaaatatacagaatcctaccggtgcgaggccagcttctgcgtggtgtgttgcactgtgacttgatcggcttccacacatatgactatgcacgtcacttcttgagcagctgctcacatctactgtag

SEQ ID NO: 4626 - DNA, 450 bp, A.fumigatus
ttgcgcccgcttcgtccttccagccccgtggttaagacatatgagttctccatgtcatcgggtggtctggtaactggtttgagtggtctgtcgaaaacaaccactttccagtggtacggctggccaggtctggaagttccagaggatgaacttggatcggtgaaaaagagattgaaggatgagttcaatgcgactccggttttcatggacgacaagttggctgatcgtcattacaatgggttttctagtaagtggccaccaccaacaacctatcacagtccgcgcctggcggtgtgcgagcgacaacatcaacaatccattgctgactggagtattcagactcgatcctatggcccctccttcattaccaccccggcgagatcgttttcgacgaaggcgcttgggatgcctaccgtgaggccaaccttttattcgccaaaacaattgtaa

SEQ ID NO: 4627 - DNA, 423 bp, A.fumigatus
ttgctaatggcgctctatagaggcttggtcacgactccgagcagtgtcaaatatgaaggcagatccgttgccgtaggcgctttccctatcggaattgatccggataagttcaccgacggtctgaagagccccaaagtgcaaaatcgcatcgcaagtctcgagaacaagttccaaggcaccaaactaatggtcagcgttgaccgcttggactacatcaagggtatcccgcagaagttacatgctttggaggtgtttcttcagaaccacccggagtgggtgggcaaggtcgtccttgttcaagttgccgttcccagtcgacaggatgtagaagagtaccagaacctcagagcggtggtgaacgagctcgtgggacgtatcaatggcaaatttggtaagagagacccccttgctcaagtgcgctga

SEQ ID NO: 4628 - DNA, 351 bp, A.fumigatus
tgtcacatcgctgataccctcacccaaacaggtactgtggactacatgcctattcactttatgcacaagtcggttagttttgatgagctcatcgccctgtacgctgcctccgatgcctgcgttgtctcctgtacccgagacgggatgaacctggtatcattcgaatacattgcaacccagcagaagcgcaagggtgttttgatcctttccgaatttgcaggagccgctcaaagtctcaacggcagcctcgttgtcaacccttggaacaccgaagagctcgctagagcgtatcatgaggctgtttcgatgagtgatgaacagcctcatgatacgctctcagcgaggtcttaa

SEQ ID NO: 4629 - DNA, 1368 bp, A.fumigatus
gagggtggaagagtgaagtttttcccaggtttggaacgagggaattggaagaacttgagaggaaaggcccctaatggtcccgaattagcgcctttcattaaaagagttggcccggaacatgaaagggaagattggcgtatgaggccctttgggaaacatgcagaggagacaggcgaagcggatgacgacttgggtctcgataaggtcttcgatgaagagctggacaatatgctcagggaagagtttgaaggcatggcaatggaggaagaaaattggctgtcagaagtgggggaggaaggctctacagaagcaccagtgccgagacagccctacgaagtgaccttgaacgacgcagaatctcatccttacgtcgacaagctaaatgagtgtctcagacgattgaatagtgacccttctgatgaacgcgctaaacaatacctgtggaagtggtatcgccgctgtcgacaagttattcccaacttcctccaatcgattcctgaagaggcattgaccatgatgtgggagtctcaggcgaatggagatttgacacgggcttcccgcgcgactcgattacaagctctggctgaagacgccatttccgctggaagatctcttgctacgtcccgtacccttgtatacatacagtcgcttcaggaaagtggcaaaacaaacctggcacttgaccaatgggaggcgtgtcagacatccctttcccagagtaaggaagaccttgaagcatactggaaacttggtgtacagctcttcgcggccgcagatgacccgcagcgagctcaagatattgccttagcgttcctggccaatgataaatcacgcgagcctcgcatccttcttccggtcatcacagcctggggaagacaacccgggagagaagccgaagtcaaggcatgggctttatacttgcagctcaaggcattgctagagtccaaaatgaagatggaagactatgacttcgttagcattggactactcaaggcgggcaaactcgaccttgccattgccgttttcaaggacatgatggtaaccgctcaagatccagcaaacgactctgctgctctttataaggctgctctgggtctagtaggtaatctgcagatgtccagcattcgggaacaggacgtcaacaagatatcgctttcgactctgactgttttacctcggcggtttcaaaacagatttttttacgcaagctggataaagaagcttatcggaatgggcgaggtcgactccgctgcgatggtgattgagctgatgtatgaacggggtgtcaagccagactctaagcacttgaatggattactcgctgcagtcttcaccacggggctggaaggatccagcgctctcagttag

SEQ ID NO: 4630 - DNA, 420 bp, A.fumigatus
ctaaccgtacgcggaccttcggctcccttggtgaagatcaaggggagtttgcattctattcttgtcaacaccgtatcatccgaagccgaggtcgagcaggcgaagaagattatcgagactgctcgggaatacattcttgccatgtctatcgaacttgaacgccgctccctatcaacggatacccccgagaacctcaagaggagtctcgagctctctgcctacttcaccatcccaaagctagaggtcgctcatcgtcagcttgcactgatggctgcaatgaagcttgcgtttgccaacaagaacttttcgtctgccctgagctttgccaaccgtatgttggccaacggtggctcggctaagcttcttgatcaggtaagccttttgcgcttttgcaaatcgctgtgttctatacgatactaa

SEQ ID NO: 4631 - DNA, 252 bp, A.fumigatus
gccaagaaaatcaaggcacagtgcgagcgtagcccgcaagacaagatcgatatcgagtttgaccagttcgccgaatttgacatctgcgccgcctcattcactcctatctacggcggttctcctagcgtgtcggatcctttcaccggtgccaagtatcatgaacagtacaagggtaccgtgtgtcggatatctgaagtgacggagattggagcaccggctagcggcctacgtctattcgttcccagccagtag

SEQ ID NO: 4632 - DNA, 264 bp, A.fumigatus
tgggaacaatcaaccggctcctggaattctgctcatattcgtcctatgctggacttgagacatggcggcctcaggccatataccctgaagagtagtcccttcccaaagaaacatcccatcatggtcttaggcagctcctattatcaatggctgctagatagcagtttatttgcagttaaccacttcaaaaaagcaagccctgacctgagagaaacaatgcattacatctgtctagtgaccattcacagagacatcaccatatga

SEQ ID NO: 4633 - DNA, 183 bp, A.fumigatus
  unsure (13),(175): Identity of nucleotide sequences at the above locations are unknown.
tggccgttatttntagaacattccaataagatgcacttcccggtatttgactttctgaccttaggcaccaccaatttcgatcaagtgaccaaggccaaccaatgcttgggtatcattaatcttcattggaagggtgagggagattatgaccggaggtttagcgttggactgctantgccatga

SEQ ID NO: 4634 - DNA, 345 bp, A.fumigatus
cttccgggccctgctttcgccacatttctgcacctgtctcctcgtctggccctctttctctctcccctcttacttgcgttcggtctcatcgtcggcgtccccccctctctcgctcctctctcagtctcaccctggcgctccctccctcggctctttccaccccccccttcgggcatctttgctttctctctctctcgcaacctccttttccccccccttctctcttaccccttcatttctcttcttgctttcgcaccgtccccctctccccttgcctgcctctcccctctcgtccctcctctgcccctccttcatctcggtcctctattttcccgctcctactag

SEQ ID NO: 4635 - DNA, 582 bp, A.fumigatus
  unsure (34),(35),(36),(37),(38),(39),(40),(42),(43),(44),(45),(46),(47),(51),(52),(53),(55),(56),(58),(60),(61),(63),(64),(65),(66),(68),(70),(72),(73),(74),(75),(76),(78),(85),(86),(89),(96),(99): Identity of nucleotide sequences at the above locations are unknown.
acaccgatattgtataacaatacaggtggttgcnnnnnnngnnnnnnggtnnnanncncnncnnnncnancnnnnngngttgganntcnggaccgnccnccccccacacccccagcagccaaccgaccggccacaccggtccagccccagcatcacccccccccggcgagccccggtcaaaccccgcgcctactctcactgactgtatctgacttccgggccctgctttcgccacatttctgcacctgtctcctcgtctggccctctttctctctcccctcttacttgcgttcggtctcatcgtcggcgtccccccctctctcgctcctctctcagtctcaccctggcgctccctccctcggctctttccaccccccccttcgggcatctttgctttctctctctctcgcaacctccttttccccccccttctctcttaccccttcatttctcttcttgctttcgcaccgtccccctctccccttgcctgcctctcccctctcgtccctcctctgcccctccttcatctcggtcctctattttcccgctcctactagcatggttctccccatctctctttga

SEQ ID NO: 4636 - DNA, 702 bp, A.fumigatus
ttggagaaacctggagtcttgtttgccttcagtcatgtatggtgtcgttctcggagggtaagccattcggtttccataccaagaagtttggaagcatcttgtaccgactattttagggttgtctccatctccactctctgcccatcgcttgggtggccacctccctacctcttcacatcggccgacctcggtctattcacccttagcagctttatcggcatcatcattgccttccccatcgctggccctctcaccgactacgtctcgcaatggctacgtcgccgcaacaataacatccacaaaccggagcaccgcttcccagccctcctcgtcccctttctcctctgcccccccggcctaatcatattcggctactccttcgcccaccagcgacactatatcggccccgccgcaggtgcagctctgtccgccgcgtctctcactctcgtcccctcggtcatgctctcatatgtcgtggactcgtacccgcgcacgagcggagaggcgctggttctggtcaacgcgtccaaaaacgtggttgcctttgggctggccaagggatcgtactcgtggatggcgctcgtgggtgttgacaagatgttttacgagtttgcgggtatccagtgggcagtgattgcattggcgcttcccttgtactatgccggtccttggattcgggccaaaacaacgaactttgtgtaa

SEQ ID NO: 4637 - DNA, 1173 bp, A.fumigatus
agatttccaagggggcgtaatggcgcagacaaaaggtatttccgcccggagaatttcgggtatccacggggtacaggtcactgggcgtctggtaatcaaatagtcgatctttgggatgccaaagccgtgatctcgacgattgaactcgaggagaacgaggccgcgttcagcatggcagcggtacctttctcgagtcaggaggatgaggcatttttggtggtgggaacggctaaggatatgattgtcaaccttccctcgtcagcgggaggtttcatccacatttacaggtttcaagaagatgggaaggagctggagttcattcacaagacgaaggtggaagagccacctcttgctctcctcggattccagggacgtcttcttgccggcatcggctctacccttcggatctatgacttgggaatgaaacagctgctccggaaatgtcaggctcaggtggtgtcgaagacgattgttgggctccagacacaaggtagccggattgttgtcagcgacgttcgcgaaagcgtgacgtatgtcgtatacaagtaccaggataacatcttgattcctttcgttgatgattccgtttctcgctggacgacgagtaccaccatggtagactacgagactgttgccggtggtgacaaatttggtaacctctggctcgtgcgctgtcccaagaaggcctcggaggaggcggatgaggatggatcgggagcccatctgattcatgagcgcggttatctgcatggcgcaccgaatcgcctggatctgatgatccacacctacacacaagatatcccgactagcttgcacaagacacaactcgtagcaggtggacgggatatccttgtgtggaccgggtttcagggtacaattggcatgcttgtgcctttcgtgagccgcgaggatgtggactttttccagaacctagagatgcaactagcatcacagtgcccacccctcgccggacgggatcatctcatctatcgcagctattatgcaccagtcaaaggtgttattgatggagatttgtgcgaaatgtatttcttactgcctaatgacacgaagatgatgattgcagcggaactggatcgttccgtcagggagattgagcggaagatctcggtaagtcagccatttcccactttatttctgaaattgtgccactaa

SEQ ID NO: 4638 - DNA, 1005 bp, A.fumigatus
  unsure (955),(958),(969): Identity of nucleotide sequences at the above locations are unknown.
tcagcattttctgcggcacaaacgcaggtggaatttcctcctgccagtcaattactagagatggatcctacgcgttccgggtcctttgtgccaccacttccagaaccggctgcagagtacgacaagaagggttctctatcccactctcagcatcttagctcatcatgttcatcgtcactatctttacagccgcccgagaacgtccactccggtcaagaatgcatacttgatccgccactctccagcgctcttcgaccgtctccaatgaatacacctcgtgggctgaaaacttcgctttctggccgtcgcgaactaggcttcattcccataacaggccccgctccgccgaagttcacaacagactcgccagctaagaggaccccatgtaccacatattcatgcaactcatcttcatcttcggcaatgccacaatctgccctattcacgacctttcccagcgccaacaatggaaaacagtcatccaaggagaagagacaattggctgaatcttgcaatgacaacttcgctgattttcctgaaccatcttttgcatcgaagcctctgaagaggaccctcatggatgctgccccattgaaagagcgaacgatcaagaagcagaaacgcgaagacgtcgatgttacgcgacttccgaaccctgaggagatgtcccccattgaagacgatggcacaaagcctccttacagctatgcgaccttgataggaatgtctattttacgtgcgcctaaccgacggttgactttggctcagatttacaaatggatctcagatactttttcttattacaaacacagtgatcctgggtggcagaatagcattcgtcataatctcagtctgaacaaagcttttatcaagcaggaacggccgaaagatgaccctggcaaggggaattactgggccattgaaccaggaatggaagctcgacctcttagggctntcnttgagtgtctngacaagccgagatcgaagagtacggtttggagggaa

SEQ ID NO: 4639 - DNA, 258 bp, A.fumigatus
  unsure (87),(95),(125): Identity of nucleotide sequences at the above locations are unknown.
agcgttggtctataccatgcttggtgttgccgtggtcgtgaccagcgcaggcgttgtatactaccttcggactcggcccggactccnccagcacntgctcccccagaaaagaagaagagccaganccagcgacgcaaggagaagaagaaggcggaggaggaaaagaaggcaaagaacgccaccgttcaagagggtatgctaaatccaaccgcgttctgcgcaccctctaaacgcagtatcgagctgataacggcctag

SEQ ID NO: 4640 - DNA, 480 bp, A.fumigatus
ccggttttaggcaataaggatgctgcagccgacgattttgagctcgccatcacccacaacaaggacgaccctgatatctattaccaccgtgcccaactccacttcattcttggagaattcgccgaagccgccaaggactatcagaagtcgattgacctcgaccgcacctttatcttctcgcatattcaattgggtgtgacacagtacaagatgggctctgttgcctcagccatggccacattccgtcggtccgtgaagaatttcgaggacgtaccggatgtctacaactactatggtgaactccttctagaccagcagaatttctccgaggccattgagaagttcgataaggcagttgagatggagaagcagagcaagccaatgggaatcaatgtcctacccctgatcaacaaggctcttgcgctgttccagcggaagcatgacgtgttcaccaaaagcagccggaaggatccgacataa

SEQ ID NO: 4641 - DNA, 858 bp, A.fumigatus
tcgcatccttcctgcttctcctggcgtccgctgctcgaatgctcacaattgttattgcagacccggaaagcttacgctgccaagctcaaggctgctggaaacaaagcttatggctccaaggattacaacagagccatcgacctctacggaaaggcgatcatttgtaaacccgatcctgtcttttactcgaaccgcgctgcctgctacaatgtcctttcggagtgggaaaaggtcgttgaggacacgacagctgcactggcaatggatagcgagtacgtcaaggccttgaacaggagagctattgcatacgaacacctcgagaagtacagcgaggcccttctcgatttcaccgccagctgcatcattgacggattctccaatgatgtcagccgcaacgcgctggaaaggcttctcaagaaggtcgcagagaggaaagccaaggctatcttggaagccaagggtcgcaaacttcctagccccaccttcgtgtccaactacctccagagcttccggccccagtctctccccgaaggccttgaagagtccgcagatctcagtgaggagtctggcaaaggtcagcttcgcaagggtctggtcgcaatgagcaagaagaccggtgacggctacgaggaagctgctgctgctttcgagaaggccttggaactcggtgatctgggtgaatacgaagcgttggccctcaacatgagagccacctttacatacctcgagggcaacgctcagtcggccctggctgatcttaacaagagtattgagttgcagccatcactggtgcagagttatatcaagcgcgccagcttacacctcgagcttggtaagtacatgccgtctttattgtga

SEQ ID NO: 4642 - DNA, 285 bp, A.fumigatus
aggccatttaaaaccttcccatggactttgggggtcgatttacaaaatcaagaaaatttggttaaatcaaaagtaaaattgatcttagtcagtaaacaattgattgatggaactgcaagcaaactataccaagttaggccactaaagaagtcttacccaagttatcttagcctccgtggatctgtttgttatgtcttagatttggcagacgctaacatacaaacagcctgttctagtcctccatctcttctaattaatattactacaaatatgatactatcatga

SEQ ID NO: 4643 - DNA, 213 bp, A.fumigatus
atagaaaaaacatcaatcacaactaaccgactccgaaccattatgacctgggatctcaacattcaacaaccgaaaaaacaaggtagtgtaccagactatcttagcttccgtgatgtgtacctgacccagaagcaaactccggttcgttccatgaattttaactttctggacgggatcgctgctcagtgctgccggaactactccatatcttaa

SEQ ID NO: 4644 - DNA, 855 bp, A.fumigatus
taccgctacagttctggttccgctcagaagacaagattcagagatcttatcactggcggccgcacccaacatttccgccgtatgctcatcggctcctcttcccagatcttccagcagctcggcggttgcaacgctgtgatttactatcttcctgtcttgttgaaggagtctctgcaccagagcaacgacatggccttgctgatcggaggcattaacatgattgtgtactccctcttcgccaccttctcatggttctccatcgagaagattggtcgtcgcaagcttttccttggaggctcattccttcagactatctcgatggttatcacatttgcttgcttgattcctggcgatgaacagacttccaagggtgctgttttcggtcttttcctgtacatggccgccttcggtgctgcgtggctgcctctgccctggctgtatccggccgaattgtctcccatcaagactagagccaaagccaacgctgtctctacttgcagcaactggctctttaactttactgttgtcatgatcactcctgtcatggttgcgcacattggctggggtacctacctgttatttgctgcgctgaacgcctcgttcattcccgtcatctggctcttctacccagagaccgccaatcgcagtctggaggagatagatttgatcttcaccaagggctacgtggagaacattagctatgtgaaggctgcgagagagcttcccaagcttatcgacgatgaaattgaggccaaggcggcagagtatgctttcgcctccggtgactctcttgacgagatcgagaaggctcacgctgagcataatgctgcccagcgattggagacgacccagtga

SEQ ID NO: 4645 - DNA, 552 bp, A.fumigatus
tttgcaggtggcatggtgggtgctattttcgccatttttttcggtgatcgcactggccgtcgctggatgatcttctcaggcgctatcgttatgattgtcggtgtcatcatccaggttacttcatttgttggacacatcccccttctgcagttctttattggccgtgtcatcaccggtatcggaaacggaatgaacacttctaccattcctacataccaagccgagtgctccaagacaagtaaccgtggtctcttgatctgtatcgagggtggtgtgatcgccattggtaccgccattgcatactggattgatttcggcgctcactatggccccgatgaccttgtctggcgtttccccattgcgttccagatcttctttggtctaattattatcatcggaatgttcttcctgcccgactcccctcgctaccttatctccaaggatcgcatccaagagggagagtacgtccttgctgcgctggcaggccgcgaggtccacgatcatgaaacccagattcagaaacaatcggtcattgagtccatcagagcgtga

SEQ ID NO: 4646 - DNA, 762 bp, A.fumigatus
aagcaggtgcagagttgttggtggagaccagaatggggggattctgccgtgagtatggctctacgaagcggacaggaagctatcgcgacatttcttgcagaccacggtgctctcctgcttcgtggacaggctgggcgtcgcgcctccattattgcctcccggagaggattacagcgcttagtgcgccgtctaacggtgtattatgaagccattgctgggaggcctttgcatcggcagtcgtcgaggattgtgagcggactacctgagatccctgaaataccgtgggaacgaccatcttatttccatacagaaagtggggaaagagatgaggtctcgttcgcagaactcatggagcaatatgatatccagactggctttcatcagcgataccacatgatggagcaaatcgggaaagggcatttcgccactgtgaatctctgctccaacagagtgaccggcgtattatttgcggtcaagatgttccaaagtcataggcctccctcatcctcggattttgagagcttgcattatgagattcagttgcttcgcgaactccagaagcattctcatccaaacctcatgaggatggctgatctatttgcagacttcgagaagaataggatctgcctcgtcatggacctcgggaaggaaggggatctctttgaccttattgttgcgaagggaaagtttaccgagactgagacacgagtcctcttcactcagttgttatccgctatcaaattcctcgtgggtcctttatag

SEQ ID NO: 4647 - DNA, 450 bp, A.fumigatus
atgtggcgccggagggtcctccagacgtctcgcagccgttcatacggttttggagtggacgtgtggtcctccggcgttgtcttatacatctgtttgtctgggtttcccccattttctgacgagttgtacactgaagagaacccgtatactctcgcacaacagatcaagatgggtcaatatcattatccatcgccgtactgggattccgttggagatcctgctctggatctcattgatgcaatgctgactgtagatgtggacaaacgtgcgacggccgaagaatgcctcgcccatccatggatgtgcaaagaatctatatcaccagatggtgccacagatgctagtatggccctccctctggacattcggatggtgcagctaatgccgaaacaggtcctagatagcgaagggagtgcgcttacaactggattacagccaggcaccatttaa

SEQ ID NO: 4648 - DNA, 456 bp, A.fumigatus
cacgaccgtggatgggtccaccgagacgtcaagcccgagaatatccttgttatggacaagaaccttacgatccagctaagcgactttgggctggcaaaaaagctccctaccgactcaggatccgaagagttggcatcgactttgtgtggaactccaagctgtatgttatctacttcgtgtcacttattcgcaattgctgacccatctagatgtggcgccggagggtcctccagacgtctcgcagccgttcatacggttttggagtggacgtgtggtcctccggcgttgtcttatacatctgtttgtctgggtttcccccattttctgacgagttgtacactgaagagaacccgtatactctcgcacaacagatcaagatgggtcaatatcattatccatcgccgtactgggattccgttggagatcctgctctggatctcattgatgcaatgctga

SEQ ID NO: 4649 - DNA, 561 bp, A.fumigatus
tcgataacccccaagggcaatgtattcaagatcgactcccagggtgaaaagggcatcaacatgctcctcttctcgaacaacaagtgcgatggcaagccaagtgggcaggccaccgagatcttctccaaggcgtcttcccaggatctgctcggcttccaggtcgtcgctctttccaccgagccgacggcaaccgccacgactgggaaatctgtcagccgagttgcgacgacgttcccggctagtgagacggcgtcaacaggcgccagcgatgacggctcgatgacgattcaacccacggataaaatgacgattcagccagcgggtgagatgacgatccagccgacggatgagatgagcacgactgcggctgcgactgcgactgcgactgccaccacaacttcaactccagaaagctccagcacagcgtcgtcgacgacttcgagtgctgcgagcggaactacctccaatgctgctggccagctggtcgctttgaacggggatacggtcaaggggatcattggtactgtcttcggattggggctggtacaatggattatctga

SEQ ID NO: 4650 - DNA, 585 bp, A.fumigatus
aggcctcacgctcaaggatgtcaatcccaaacgccctcccttctaccgggattggaccctcctccaactcaacacccttttgctgtgtgccctcctcacgcaaatcgcctcgggatacgacagcagcatgctcaacggcatgcaggccctcccgcaatggaacaagtactttggcaaaccaaccggcacccgtttcggcgccatgacgtttggcccaaccggtggcatcctgatctccgtgctggtctcctcccagctgtgcgagcgcttcggccgccggtaccccatctgcggcggctcgctcatcatcatcctgggctcgatcatccaggccgccgccgtcaactacggcatgttcgtggtctcgcgcttcttggtcggcctggggctgggcatcgtcgctaccgccgccccgcctctcctgaccgaggtcgcctacccgtcccagcgaggcaagctcgtctccttctatctcaccacctggtcgctgggctccctcatcgccgcctggatcacctacggcaccttcaagatgaccgatcgccgctgtcttacacgacggggctggaaggtagcgcgtcccgc

SEQ ID NO: 4651 - DNA, 708 bp, A.fumigatus
gcccatacagctcttgcggacctgtcgaccagcaatccaccagcagaatcggccgtccgccagaccgacacgatgacttctcaccacgatcgacaggagagaccagacgaggacaactttgaaggcctcacgctcaaggatgtcaatcccaaacgccctcccttctaccgggattggaccctcctccaactcaacacccttttgctgtgtgccctcctcacgcaaatcgcctcgggatacgacagcagcatgctcaacggcatgcaggccctcccgcaatggaacaagtactttggcaaaccaaccggcacccgtttcggcgccatgacgtttggcccaaccggtggcatcctgatctccgtgctggtctcctcccagctgtgcgagcgcttcggccgccggtaccccatctgcggcggctcgctcatcatcatcctgggctcgatcatccaggccgccgccgtcaactacggcatgttcgtggtctcgcgcttcttggtcggcctggggctgggcatcgtcgctaccgccgccccgcctctcctgaccgaggtcgcctacccgtcccagcgaggcaagctcgtctccttctatctcaccacctggtcgctgggctccctcatcgccgcctggatcacctacggcaccttcaagatgaccgatcgccgctgtcttacacgacggggctggaaggtagcgcgtcccgcc

SEQ ID NO: 4652 - DNA, 855 bp, A.fumigatus
  unsure (852): Identity of nucleotide sequences at the above locations are unknown.
gaccctccaaccgagtatccggagttcgtccctcaaaaaggaccctcgaccgggcgctatgtcctccgcgaatcctccttgtggacctgcggcttcttccccgggctcttgtacgtcctcctcgaacgggccatccaatacccctcggcctttccatacctgggacaccctcacagcctcgatccagccagcctgcgcgaccacctcgtcgccctctgcaccaaatggaccgcccccatctacccgatgtccctgcgaaccgacacccacgacctcggcttcatcctggccccgtcgctccgccgctcctgggaactcaccgccaatcccaacagtcttcgcgctctcctaacaggcgcgcaaagcctcgcctcgcgcttcgtgcccgccaccggcgccatccgcagctgggacgtcctccgccagtccgacgtggacatcacctccctcgagaccgactgcctcgtcatcatcgacagcatgatgaacctcgatcttctctactacgcggcggcgcatctgggtccgcagctggcggcgattgcgaccacgcatgcgaagaccctcctccactcccatctgcgccgggagacgatacccggaacggcgagggcgggttactccaccatccacgtcgtcaattttgaccccgccacgggtgcgatcatggagcgccgcactgcgcaggggtacgcggcggactcgacgtgggcgcgcggccaggcgtgggcgattaccgggtatgcgcagacgtacgcatggacccgggaccggcagttcctggatgttgccattgggctggccgagtacttcctcgcgcgactggagggggcgccgccttgcgtggagcantag

SEQ ID NO: 4653 - DNA, 432 bp, A.fumigatus
  unsure (365),(379): Identity of nucleotide sequences at the above locations are unknown.
acctcgatcttctctactacgcggcggcgcatctgggtccgcagctggcggcgattgcgaccacgcatgcgaagaccctcctccactcccatctgcgccgggagacgatacccggaacggcgagggcgggttactccaccatccacgtcgtcaattttgaccccgccacgggtgcgatcatggagcgccgcactgcgcaggggtacgcggcggactcgacgtgggcgcgcggccaggcgtgggcgattaccgggtatgcgcagacgtacgcatggacccgggaccggcagttcctggatgttgccattgggctggccgagtacttcctcgcgcgactggagggggcgccgccttgcgtggagcantaggtggatggcangagggtcggccggtacgtgccgctgtgggactttgatgcgccggtcgacgaag

SEQ ID NO: 4654 - DNA, 840 bp, A.fumigatus
ggcgggacgcgctaccttccagccccgtcgtgtaagacagcggcgatcggtcatcttgaaggtgccgtaggtgatccaggcggcgatgagggagcccagcgaccaggtggtgagatagaaggagacgagcttgcctcgctgggacgggtaggcgacctcggtcaggagaggcggggcggcggtagcgacgatgcccagccccaggccgaccaagaagcgcgagaccacgaacatgccgtagttgacggcggcggcctggatgatcgagcccaggatgatgatgagcgagccgccgcagatggggtaccggcggccgaagcgctcgcacagctgggaggagaccagcacggagatcaggatgccaccggttgggccaaacgtcatggcgccgaaacgggtgccggttggtttgccaaagtacttgttccattgcgggagggcctgcatgccgttgagcatgctgctgtcgtatcccgaggcgatttgcgtgaggagggcacacagcaaaagggtgttgagttggaggagggtccaatcccggtagaagggagggcgtttgggattgacatccttgagcgtgaggccttcaaagttgtcctcgtctggtctctcctgtcgatcgtggtgagaagtcatcgtgtcggtctggcggacggccgattctgctggtggattgctggtcgacaggtccgcaagagctgtatgggcttatgtacccaccctgacgcggagaaaacctgggggaacatcgggtcaattccggagtcaatcgtccgctggccgtcgatctttcctgggggttctgatggattcggggcgggcgaatgtgctcgggcgtga

SEQ ID NO: 4655 - DNA, 675 bp, A.fumigatus
acacgaatggtgactgatactggtgtaggaccctccaaccgagtatccggagttcgtccctcaaaaaggaccctcgaccgggcgctatgtcctccgcgaatcctccttgtggacctgcggcttcttccccgggctcttgtacgtcctcctcgaacgggccatccaatacccctcggcctttccatacctgggacaccctcacagcctcgatccagccagcctgcgcgaccacctcgtcgccctctgcaccaaatggaccgcccccatctacccgatgtccctgcgaaccgacacccacgacctcggcttcatcctggccccgtcgctccgccgctcctgggaactcaccgccaatcccaacagtcttcgcgctctcctaacaggcgcgcaaagcctcgcctcgcgcttcgtgcccgccaccggcgccatccgcagctgggacgtcctccgccagtccgacgtggacatcacctccctcgagaccgactgcctcgtcatcatcgacagcatgatgaacctcgatcttctctactacgcggcggcgcatctgggtccgcagctggcggcgattgcgaccacgcatgcgaagaccctcctccactcccatctgcgccgggagacgatacccggaacggcgagggcgggttactccaccatccacgtcgtcaattttga

SEQ ID NO: 4656 - DNA, 483 bp, A.fumigatus
acgttgacgctagttgatccgcttgacagaacaaccgtactagaccccatttcgcgcttctgtgcgtacttccccgatatcaacgagtgcattaagaagcggaaccacaaattgctggactacgacgccatgagagcgaaagtgaagaagttggtggaaaagccagacaaggatgccaccaagctgccccgcgcggagaaggagactgagatggccaagcaagcatacgagcagcttaacgagcagctgttcacggaacttccacagctcatcgatctgcgtgtgccctatttggaccccagtttcgaagccttggtcaaaattcaactccggttttgcgccgaagcgtattcacgcatggctcaggtgcagcaatatctcgacgccgagacaagagatcaatacgcccgcggcgatttggataacagggtagaagaagttctgcaagagattcgggacctgagtatagcggggactgtatga

SEQ ID NO: 4657 - DNA, 555 bp, A.fumigatus
acggaatccgggccgaagttggtccgacagctcagtagctggttatcaacaacacaatctgaggtattagggcgagtggtccgccaaggtgacgtcgcattgcccgcgaacttcggcgattatgcctatggagcgaatgccgaatggcagctccggggggtagatccccgctcgctgaagagtttccgaccgacgctggtgattttgcatgatgaactggaagcgccgctgggcaaggtgagggtgaagaggggcgggcttgagaaggcaagtctgcggggtcaccgtgggttgatcagtgtcatggagagtttgcgcggcaagggcctatatccgccgcggacaggacaggcggcgcaaggagcaaatgctggtctgtccattctgcgtgtaggcgtgggcattggccgtccgtcgacacgaacccgcaatgatgttgcggactatgtcctgactgagatgaatgcctccgaactggctgcagtccgtgcagctgcggtcccagtcttggacattttggcagatgagctctatcgagaatctaacgatgactga

SEQ ID NO: 4658 - DNA, 465 bp, A.fumigatus
tcttggataggacgggtgtgctgtgcatcatcctctgcattgctctcggaatcgcgaacatcttctctttcgctgttttgcgcatcatattcagcgtactatgcctgtatgccagtcctactgagcaacactctggacagtggaactgacgatcttagtatctcgggattgatcctcatcttcattgaagttcctttcttgctgagaatttgcctaccttcttccaagttcgatgcattcattcggcgcttcaccaccaactggatgcgcgctgcgatgtacggcgtcatgagtgtcgttcaatggcttagtcttctccccggctccggagcatccagtttgatcgttgcagccgtcttcttgttgattgcctccatattctatgctttggcgggcctcaaaagccaagaattcgtgggcagcaagactcttggtgggcagggacttgtccagatgatcgtttga

SEQ ID NO: 4659 - DNA, 243 bp, A.fumigatus
actatgcgtagatgcaagcacctctgctgccgagaaggcctcgagaagccacccaaactcactcggaagcagtctactaacggcaatcaggtgaagagtgggcttaaccagctgacactctcagccagcattcctagaacaaaggctgggaggacctcgacgattgaggctcgggataagggtagtggcaagacacccccaaagggacgtggaatccacgggcatcaactcagatatcactga

SEQ ID NO: 4660 - DNA, 183 bp, A.fumigatus
ataagtcagagtcgcgtcagttttaatcgacagaatttgccagagaaaaagacattaaccaataataaggatagtgggaagggcagcacgatcttcaagcaatcatatcgcacaagagcttacctattgcgcaaagtacagcgtgcttattacaccgccggcatggaagaaaactaccctccc

SEQ ID NO: 4661 - DNA, 369 bp, A.fumigatus
tctaagcaacgtgacgtatcacaccttataagccatcatccgaatcaccacgaatttcgcgattatcaccactcgaatctctcttccttcgccatggaaaccactctcacccatcgaccttgggaacctaccacaacagggccgcagaatgctccgacctcttctgcgcaaacactaccctcgatttcaactctcaccgcaagtatggccagcaatataccccttcccgcagagaagtccccagggaatgcctctttgaacacggtagaacgcgactcgggaacctggtcaatgccccaaagcacaagtatgattagttgttctacatctgccatgccagacttcaccaggggctgcgagagcgctcag

SEQ ID NO: 4662 - DNA, 258 bp, A.fumigatus
acaactacgaacagtcatctcatcatcatctccagattgccccaatttgaattccatctctcggtcgctaataccttatacgcaagtgacaaagagaccccccattatcaaccagacgaacagaaattagacgctcgattcttccctacaaaaccaccaggaaatcccgtctccagtagccctgaggctcaatctatcaacaaagcccgacattttcacattaagaccattgcacaggcgaaatcgcagctgatgtaa

SEQ ID NO: 4663 - DNA, 597 bp, A.fumigatus
agacgtgcggctgccatgtctctctccatggccatcctcgcggggaccacctcggtgacggacaacacgggcgcaaccgtcgtcgccgtcatcttcctgtttgtctttcagttcatattcaccgtcggctactcgggcctgaccttcctctacgcgaccgaggtcgcacccttgcagctgcgagcggccatcagcgccgtctccacggccgccgtgtggaccttcaacttcctcctggcgcatgtgacccccgtcggcttcaactccatcgggttacagtactatatcatcttcgcggtgctcaacgctgccatcgagccgacggtctacctcttcttccctgagaccaacggccgcaccctcgaggagatcgacgagatcttcatccggtcaaagagcatcttcgaacccgccccgcgtcgcgcgcaacctgccccggatgcattttgccgaagtggtcgacgtcgggacggaatccggggacgaccacttcaaattaaccaagggctgaattgtcagcgttttgacgattcgcggttagattgggttgatcctgagggatttcgccaagtgtcgggccagcggtccgctggataa

SEQ ID NO: 4664 - DNA, 423 bp, A.fumigatus
tcaaatccccccgtaccaatggtacatccacggctcgcagccaacctctcactacctaagcctctcgcctgcattcaagaacccagcctccaaggtcgatgctcagggcatccggatcaccattgtacctcctccgcctcttcctctatcggtctgccaatgcaaatgcaaatactaacgagagagacaaaggactcctcctcctcctggaacggccaaacgatgatgcgcagcgagatcatcccccagaaagccgcaggcgtcaacctaggccagggacacctgtactatcacttctcggtgtcgacactggcaaccaacgccccggatccgagtctggagcatcagattgctttttttgaggtcccccccctttctcccacagcacccagctgttcttttttgaaagactttctgagctga

SEQ ID NO: 4665 - DNA, 468 bp, A.fumigatus
accagaactaatcctcgtccggcggtcctgtccaccggtatgattctctttttttgctatccctgtgcgcgagccgctactgatttcagcagcgatatcaataccaacaacggaggccaatacaacgccctctactggtacatggtaggtgttcgtctgtttcgggatcgtgcagtcgctaatgcacccagaactccggccacgtccaaacagaagcgaatcgcatggggctgcacggcccatattcgatgtactttagtcgcagcggcactccgggcaccaacattgatacgtctttctttgcgaatcttgatattcaggggtaacgtcccggacagtgcccgaggcaaggtgtctggaaaggcatcgggtgctgattccacgttcaaatgggttgttcactggtatgccgagaacccaatgtcggcactaaacgtcccgatgctaattatccaggtacaacgatga

SEQ ID NO: 4666 - DNA, 516 bp, A.fumigatus
ggatgcacccgtccgactcgcgcatgtccagctggggcccgctcacctacaccgtcggaagctcctcgctgtctgacttccccatggctatcttcaagtcggtcaacagccccgtcacgatcaagttcaccgcgtcgtcctcgcagaccggcgccgccacgctgcgcatcggcacgaccctgtcttttgcgggtggtcgcccccaagtcacggtatgccaccggccagctctcttcgccggacaagaagctaatgagacaggtcaactcgtggaccggaccgattccctccgcccccaaagacctcaactcgcgcggtgttactcgcggtgcgtacagggggctcggtgaggtgtatgatgttgcgattccggccggcacgatcgttgcgggcaccaacacggtacgcggtaattcatttttatcgtctagctaccgagatgacaacaggaatagattaccattagtgtcgtctctggcagctccggagacgcgttcctcagtcctaactttgtaa

SEQ ID NO: 4667 - DNA, 195 bp, A.fumigatus
cgcgggacgttccatccccgtggtgaagacgggatcgatgtgaagttcaccgtcaaccggtcgaactgcgacatcacatcgatcaactactacggcgccgagctgcagtatcaaggcacaggcagtcacattgggtcaggtctcggatctgcatccgtctctgccactcagagcggtgtgttcaggtactgctga

SEQ ID NO: 4668 - DNA, 234 bp, A.fumigatus
ttatccaggtacaacgatgaggcgcagtactggacctatacggcctctgacggcagcttcacctctcccgccatgaagcccggaacctataccatggtgtactaccagggcgaatacaaggttgcctcgacctctgtctccgtgtcggccggctcgacgaccaccaagaacatctccgggtccgtgacgaccggcaagaccatcttcaagatcggcgaatgggacggccagtaa

SEQ ID NO: 4669 - DNA, 288 bp, A.fumigatus
agttcaccgtcaaccggtcgaactgcgacatcacatcgatcaactactacggcgccgagctgcagtatcaaggcacaggcagtcacattgggtcaggtctcggatctgcatccgtctctgccactcagagcggtgtgttcaggtactgctgaagatggcattattgtcctgacctctgtatgcgattatatcaaggttacctgctcgacaagtaccttgactcattacttcgtcgtgcacaacggagaccccatcattcatatggccacctatattactgcgggttag

SEQ ID NO: 4670 - DNA, 393 bp, A.fumigatus
caacataggcccaccggcttccgcaacgctgcaaaccagctaaggatgcacccgtccgactcgcgcatgtccagctggggcccgctcacctacaccgtcggaagctcctcgctgtctgacttccccatggctatcttcaagtcggtcaacagccccgtcacgatcaagttcaccgcgtcgtcctcgcagaccggcgccgccacgctgcgcatcggcacgaccctgtcttttgcgggtggtcgcccccaagtcacggtatgccaccggccagctctcttcgccggacaagaagctaatgagacaggtcaactcgtggaccggaccgattccctccgcccccaaagacctcaactcgcgcggtgttactcgcggtgcgtacagggggctcggtga

SEQ ID NO: 4671 - DNA, 666 bp, A.fumigatus
  unsure (296): Identity of nucleotide sequences at the above locations are unknown.
tatatagaaatctggtttgaaagcttaaactcaatcacaatgtctgcaccgtcagaagctcccgctgcaactgtttcagtcatcgactctcatgccaattcggctccatcaaactccattaaggatcaaacctctgctgcgactacagtgcaatccaaggctcaggttccgccttctaatactagtgcgagggatgagaaagataatgaattggaccttccaacttccgctgcagatggcctcgttcagaagccatttcctcgccctcttgacacatcaaaggcagcggctcctgntgagctaacccctgatcagcaatcgaaatatgaggcagtcctgaaggcagtttccgaatggaccactcttccgacaacatcggcaaaaaatgcacccacggccccaattacagatgatgagcgcatgtttttgacccgcgaatgtcttctgcggtacttacgcgctacgaaatggaatgtcaccgaagctatcaatcgacttcagcgcactctcacttggcgccgcgaatatggcctggaaaagctgactccggcctacatctcgattgaaaacgagacaggaaaacaggtcatcctcggatacgacatccatgcacgaccctgtctctacctcttgccctccaaccagaacacggaaacaagtgaccgt

SEQ ID NO: 4672 - DNA, 1254 bp, A.fumigatus
catgcatggttcaaccattcatcgaccataccgatatatcgtacagaactcctgctgtttgatgatgaaataatggtactcggtattagtcctccttcagatcccaaaagagcccaggcatggtggacggaagttttcctatcccatccgcctcgcgaggtggtttatgcaccggagttccctcccaggccggacgagtttcaagagatcgactgggccccaaatgtgggatcaaaagatgcgaagctagcacacatcttgtgggatcgtcccactcaaaagctccgagaatacttggacagcctaggccagcatcctttccctcggcctgatgatgacgacgatacaagggcaatgaaccacacggaggggctcgccttcgaggtgtacgagcttctcctgcgggagcatatgtaccccattgcagagtccgaatggcaagataaatggacacagatggggatggatcaggcgaaatggggtatcgacgatatcttgcaagactggggacatgcgcccaaccctggtcccatccttattcgaggcaacgatgtaatgacttcccgccaattgacagtggcaagattgaagcaggagcttagggaccgaaaccaacctgaaaccgggacatcgcaagtcttacgccagcgtctttgtgactatgagcgaaagtctctcacgctcttttccagaagcgaccttggacattggggaatatcctcagggaagccgcggggacgaagaatccacccgggcgataagttagacacgttggacatgtacacctgggccattaaactcagcccatacaacccgacatactggatcagccgtgcctattgtcactatcaacaggccttttttgaccttgcgatcggagatgcctaccgggcccagcttctctgcgaggtgcttgtcgatgctcggtgcagaaaccgccaacccgggctttacccccgaatctggcacgccatctctcagcatatcatggcagggatgcacactgatacgggagacgtaccgccagaggtggaaaaaatgcgccaacctaacgggattaactacttcatcccaacccttcgaaaggcacttcataacatcatcggccttagtcttgctgcacttcaagccagagaggatggcaaagccatggagaaataccttcctcaaagggtcatcatgccggaccgcgatagacgacctttcgagcgacgtcgcgaggtcttcaccgcacgggcccgaaaacaagcatgg

SEQ ID NO: 4673 - DNA, 531 bp, A.fumigatus
agcgtcggtccttccagccgcgtggtgaagatgggcccgacccgctggggccgcagacacagcatcatcgccggcggcatcggcctcagcaccaccatgttcctcatcggcgccctctacgccgccgacgccgtccacccgtcctccggccccggccgctggctcgtcatcgtcgccatctacctcttcgccgtcatcttctccctcacctgggccatctgcatcaaagtctacgccgcggagatccagccccagcgcacccgcgcctcggccaccagtctcgcgcacggcagcaactgggtcactaacttcctagtcgcgctgaccacccccatcctcctggccaagagtagtttcggcgcgtactttctcttcggcgggtgtacgctgctgacggcgttggtttgcgctctcttcatgccggagactaaggggaagtcgcttgatgagatcgaggaggcgttcaagtccaagtcgctgggctcgcatttggcaaaagccatcaggcccatcacccggtcgtcgaattga

SEQ ID NO: 4674 - DNA, 855 bp, A.fumigatus
acgcgtagcgcggatccttcgacccccgtggtgaagaccaatctgtacgtccagaatgaagcaacagctgccctcttgtctcgtacagtcaaggcgaacgaggaggtcttgtcagggctcaaggtttctcgggcgcatcccgctttcggctcagctgtgaaacctagcacgagcctggcagagcttgctactcttggcattaacgatcccgctgtggcctggcctgtctttgaggcgctgtgggctgaacttactgcaacttctgcgtctcccggctacgatatggccttcaagactcgccctcccattcttgctactgtggatggcctggcacactggatgaagaacactgagtaccgaagtgctgactttgagcccattcatgctcatgatctcgtcttcgtaagacacttcctttcgctgttgaagcccggtgccggtcagcctacccttccgaacgggggcatgctgctctatgccacttccgcctccaacaatcctactgtctacagcttcgaagttgctctcaagcaggtagcagcgcgccaggctggccttaatccttctgctcccgaattccctcaggccgacccgtacagtaaggttgacaagcgcgttcttgatgcgttcgactctcctaaaccctcctccgctaaggaaggtgctctggagcttcagactattggcggccttacaagggatgaggctcgaggcttcatggaatacttcgcacgcagtggacttctccgggaaaacatcaatgacgagtgggttggggagaagtggagcttggccggaggtggcattgttggtgaattagagaagttgggtagacgcctcagagtgatggcctaa

SEQ ID NO: 4675 - DNA, 873 bp, A.fumigatus
cgcggtgtcgtgaaggctattcgacgcaagatggaggcggacctcaacaaaaagaggcaccacgcccccagagcccatcgcacgcgcaaagctccccctggaaccgtcctggctctgaagcctagtcaagcccttcagattaagccaaacactaccgtcgcagaagccgcacaaatgatggccgcgaagagagaagactgcgttcttgtcacagacgatgatgatcgcatcgctggtattttcacagcgaaggatcttgcgttccgtgtggtcggaaacggccaaaaggctcgcgaaattaccgttgccgagatcatgacgaagaaccccctgtgtgcgagaaccgacaccagcgcgacagacgcactggatctcatggttagaaagggctttagacatctgccggtaatggatgagaaccaggacatctctggtatcctcgacattacaaagtgcttctacgatgcgatggagaagctggagcgtgcgtacagctcttcccgaaaactgtacgatgccttggaaggtgtgcagacagaactaggctccacgcagcctcagcaaatcatccaatacgtggaagcgctgcgctcaaaaatgtccggcccgaccctcgagagtgtcctggatggcctgcctccgacgacagtatccgtgcgcacttctgtcagggatgccgcaacgctgatgaaggagcatcacactactgccctgctcgtgcaggaccagggctccatcaccggtatcttcaccagcaaggatatcgtcttgcgtgtgattgccccaggactggaccctgccacttgtagtgtcgtccgtgtgatgaccccacatcctgattttgctcctgctgatatgagcatccaagctgct

SEQ ID NO: 4676 - DNA, 702 bp, A.fumigatus
  unsure (646): Identity of nucleotide sequences at the above locations are unknown.
gatggaatctttatatactgcagatcttctctactcgagcacgagcatggactaggcccatcggggttggaccgcatccgccaaccaccttcacgaactctgaatctccctaacagatctgcctcatcgcttgttcccctatcgccccaaagcaacactccttctcgtcgatccagcacggcctcgaaacccagcctcatgcgcatatcctcaaatgacagcatcagcacgttggaagaccttcatcgcttccccctggagtcgttacattcattttcctttgcccagcaatccgacgaattactcaacagtcgtcataacattctgaaacgatccatagattttatgcgtgaccgtttcggctggtccgctggcaattccgccattgccaacgcgcaggctcgcatggctggcgatgcggaggcccaaagtatggtagagctcatgtccaaaacaagtattgcggggaaggacgacagacacaattatgctggcttatcgcgtggcccgttgacgagccccgcagatgtggacagcggcaatctttttgatcaagctttcactgggcctggaggctctgcgattgagagcaaagcgacacgacaaggacatgatgcgagtggagggaatctattatccactgganacatacctcaccaaagaagggagatgaagtctgctccttcctccaggcggccgtag

SEQ ID NO: 4677 - DNA, 195 bp, A.fumigatus
gccagcataattgtgtctgtcgtccttccccgcaatacttgttttggacatgagctctaccatactttgggcctccgcatcgccagccatgcgagcctgcgcgttggcaatggcggaattgccagcggaccagccgaaacggtcacgcataaaatctatggatcgtttcagaatgttatgacgactgttgagtaa

SEQ ID NO: 4678 - DNA, 441 bp, A.fumigatus
cagtggtgcggcccagtattaaacagtaggccctggccacattggcaagcatcgacatccctttccactgcgtctattcgaacagacactgctaccatggctgacattgccgaccaattaatcgaaaagctccagacgttggagacgagcatctttgagggccaggatgccacgcgacagaagctggctctggcggcccgcaaactcttccacacgctggaaacgaaagaagaaaagaccatgcggctcgctatcgaggaaccagtcatgttctccgtgctccaagctctcatcgacaccggtctgttcgaaggctgggctgcggccggcggcggcgagagagatgtgaccgagttggccaagctcagcaagagagacgtggaacccgagctattacgtaggtttctctctgctgagagtgccatcccacgtggatgctga

SEQ ID NO: 4679 - DNA, 222 bp, A.fumigatus
tttttctcgcgacttgacttttccattttcaaacgtctcataatcatcgccatgtctgctcctactacaccaactttcaagctcgtccttgtgggtgacagtggtactggtaaagcaagtaaaatcactctcatattgccttttactcttgaaatgcagtatcttgctctgcttgcattctacaagggtcgaacctttttgaactacttgccttggctttaa

SEQ ID NO: 4680 - DNA, 549 bp, A.fumigatus
agcatagtccgcacgacacgagcacggataattcacctgcgaaccgaccacaaagaagtaatgaaacatctcgagaaaggtctccatgagcatttcgccagttttcaacgtgcacaagccgctgttgctgctagcggtatgaacgggacttcagttcaacgaagcaatttgggtgagaacagtttatcaaatgctgaaatgatcgggacgccatttgccaaggtgaacagcgtggtgcccgatagccctgcggatcaggctgggttgaaggccggggacatcatacgaagcttcggaaacgtgaactggatcaatcatgaacgtctatccaaggtagcacaaacagtgcaacagaacgaaggagtaagtgtccgcatctttgttctcaaggtacattgggcggacttaacgcagggaacaatcgtggtcaagatcgtaagagaggacggacctgcgtccaataacactactgagctgagtttagaactcataccacgccgtgattggggaggtcgtggtttgttaggttgtcactttgttccactgtga

SEQ ID NO: 4681 - DNA, 213 bp, A.fumigatus
agactgtggttgatcgatcaaaatttagctgtgctggttttgggacgcattctctccaaggctattgatccctgggagccaactcttaccacaaaagccggtatccaagccaacagagaagcagctattgtcactattaaagcaagcagaaagcgaatatggccccacggactcgtcgataacctgtcgagtatccatagtgataggcaatga

SEQ ID NO: 4682 - DNA, 183 bp, A.fumigatus
agatgcaccatttctaactctccttttcttcacgacaatgcagatttcaatgctggaataggcgtagtggtaatgctgggccagtcaaactacctggctattgttggtggaggaagaaatcccaaatttcctcaaaacaaggtgcgcagctttcaattttggacggcttgcatacttcggtga

SEQ ID NO: 4683 - DNA, 195 bp, A.fumigatus
gactctttgcagttggtgatttgggacgatgcgaaacaaaaagcagtcataacactcgagttccgtacgtccgtccttggtgtccgtttgtcgaaatcgcgaatcgttgtcgctttattgaatagtatacacattttcgcgttttccagtcttcacgccggggctggaaggataccgcgcttcgaaggaaacgcg

SEQ ID NO: 4684 - DNA, 192 bp, A.fumigatus
  unsure (4): Identity of nucleotide sequences at the above locations are unknown.
cgcnggaccttcggcccctgtggtagaagaatcgcccccagcgtctccgtcattgctgtcaccacctgcgtccccaccgtcacttacgtcaccgtccctgtctctactcctagcggcgctgccggtgttcactcctccgtccccgtcatcccctctgttcctgctggcacccctgctcctagcgctacgtaa

SEQ ID NO: 4685 - DNA, 1098 bp, A.fumigatus
  unsure (1079): Identity of nucleotide sequences at the above locations are unknown.
tattggtcttcccatttgcagtggactggtttcgacgaaggacctatgagacctttctcgtccttcatattctcttctctgttgtcgctcttgtcggttgtttctagtaagtggatcttccttcaagccatcgtctctaacaggggtagtcacgtcatcatatttgaggatcacgaatattggttctatctctggccggccgttgtgatctgggtatctgatcgagtcttgcgcctgattcgcatagtttactgcaacctgcacgtccaactcggttcccgcagccgtttccaatgcaccgaatgcgttgcagcgtatgacaaggatgctgatatcattcacctggagctaacccccggctcaggtctgcagccagctccaggacaatactactttctttacaaacccttccggctcacgggatgggaaagtcacccgttcacgctgggttcgtggtcatataacgatggcgcaccttcaactcaatgccgtagtctgaaacgtgacacgaccactgatgtctcggaaatccctctactacctgacactcccagttcgggctcagactatggttcaatcgatacctcaaccgacccacccgagcgcaaactcgcactgcgtttctggatccgaccttatgacggatggactcgccatctccgcgatcaatgcctgcaatcaccaactcggataatccagccaaacatcctccttgaaggaccatacggcgagcagtgtccgctctggaagtacgaatccgtcctattgatcgcaggcgggaccgggatcgccgccgcggtaccttacatccaagatcacatcctccgctcgtcaaccggccagacctcgacgcagagcatccatctcgtctggacggctcggcaacccgcgctcctgcgcgatattgcgggcagagagttgaagcaggctcttagcaggaaggacttccgtgtctcgttttatgttacttcagagtctgcgtctcagggtgcgattatggacggggtggaatttgcgtgtggacgccccgacctgcaggcgataattacagctcatgcggaagaagcaaggcttggtanttcgtctgtgttggtgtgg

SEQ ID NO: 4686 - DNA, 717 bp, A.fumigatus
gtcttatcgagtgagccagaatggcatagcctggaagctgatcatatcccgcaactagtcgtaaagaaacatcctgaccccgttacggcgtatgacgacggacctctcgcggcgtacgttcttcgcctctatgacagcgcggaatttcacgactgccggatcctattgaagtctggcaaagacaacttcccaccgatcaccatccgcacgcacaaggtgttgatcgcccgtagtcctcttctcgcctcgattatgaagtcacctgcagcaaagcaggatatacccgaaatagtagcaatggctggagagaacttcctgttggtcaaggcgtttgggattgcgcttcagagtttatacgggttggccctcttaaaccagaaacggctcagatccatgacactcttcagtctgggatataccgaagagagtatcaaatcgtctccatacccgatcaatacggcactggcggattttgccctgtgctacgccagctctggggctttccttcaacggcgggacattgtcgaaacgggtatcaagctgattgtggaagtcataaattgggacaacatcgagctgatcttctactttggcttctgcatgtctaagtttctcatcacggcgcctcagatggcagagcttgagaaatcctcagccgatcaaccagccaccgctgaccaggtcttcacctcgggactggccggccgaactcatgca

SEQ ID NO: 4687 - DNA, 948 bp, A.fumigatus
gcatgggagttcaaacacccggaattcagagcgaacagcaaggagtcgcttgataacattcgacgaaaggcgccggcgcctcgaaagcagactcagaacaccgacgactccgttccgacacaacagatcgatcttctgaaccagcagatcgtagcgcagcagcagcagatccagcacctttcggatagatacgcgcagttgacggttgatcatcagctcatgttgcaggaactgatgagagttcagaagacggttctgaaccatgaaaatgttattcaccaggtgatgaattatttgctgtcagtagatgctcgccagaggcgcgatagcaaagcagcagcagccttccaagctcaagggcaaggcggttcgaacgtgaatgggggacaggtagacgatatgccttcctctcccttgcagcatgcgtcgaagctactgagtaacatgaacgccgaggttcaattcaatttgaccggagtggagtcggtaggcgaatcttcgaaatccgctcctgttgtttccacccctgcactagaggctgggccgcgcaatggggtagtgcgcccgcctacggcggcaggtgcaaatcccaccaaccttctatatccaaagatgaacggcgagattgagcccgttgtctaccctgttggtgctaccaatggaattgatccaatgtacagtgagcatgtgaacaatttgccgtatcctatgcctccaaaacaggaagtggacgacactcgccgacaagttcccgacagtcgaaagaagagcacaaatgtcgatcccgggtgggtgcgcagcccgcacattctactggtggaagatgatgcaacatgtcgccaaattggtggtaaattcctctattctttctcttgtgttattgacacagcggtcggttctcctctgttcccgtatggacgcaaagcaactgacagtcttgcagtttga

SEQ ID NO: 4688 - DNA, 435 bp, A.fumigatus
  unsure (47): Identity of nucleotide sequences at the above locations are unknown.
agggatagttttgtagttctcgaggtcgggtgcttctccgccctgtnccgtcgaagtgtccgttgtcgaactttcaagctgaccgtgttgccttatcgcagtgcgagaaattcacaaaagaccatccttccgaaacacttcaaacacagcaattttgccagttttgtgcggcagttgaataagtacgacttccataaggtccgacaaaccaacgaagaaaatggacaatctccttatggacaaaacgtaaggcttcgttgctcaactcaagccgaacgaaatctgacaacgtataggcatgggagttcaaacacccggaattcagagcgaacagcaaggagtcgcttgataacattcgacgaaaggcgccggcgcctcgaaagcagactcagaacaccgacgactccgttccgacacaacagatcgatcttctga

SEQ ID NO: 4689 - DNA, 450 bp, A.fumigatus
acaatttgccgtatcctatgcctccaaaacaggaagtggacgacactcgccgacaagttcccgacagtcgaaagaagagcacaaatgtcgatcccgggtgggtgcgcagcccgcacattctactggtggaagatgatgcaacatgtcgccaaattggtggtaaattcctctattctttctcttgtgttattgacacagcggtcggttctcctctgttcccgtatggacgcaaagcaactgacagtcttgcagtttgacggactggaagcggtgaataagattcaggatggatcgaaatacgacctgattctgatggatatcatcatgccaaatctcgatggggtttctgcatgtcaccttattcgccaatttgaccgaactcctatcatcgctatgacctccaacattagaagcgatgatattcaactatacttccagcatggtacgtag

SEQ ID NO: 4690 - DNA, 351 bp, A.fumigatus
  unsure (249): Identity of nucleotide sequences at the above locations are unknown.
accagcatgaccggaaaaaagatcctcatcatcctcaccgacgccaaatccttccccttgaagaaaacctccggccccgacgccggcaaaacagtcgaacagccatctggcttcttcctcatggagctcgccaagcctctcgagaaaatcctggctgcaggctatgaggtaaccttcgcctcacctaagggcctcgaacccactccggacccgctcagcgaatccctcgccgccttcgcaggcaacttntacgaacgccggcgtgagaacgaccttatcgaccgcatgaagcgcgagaacgggtttagtcgccccagaccgctcggcaccagttttcaccacgggaggtag

SEQ ID NO: 4691 - DNA, 498 bp, A.fumigatus
ggatgtggtggtgcggctttgcaagaaaaagggcttttcaacttcaataccctcacctattctgcggaaggcaataccttctttatcaaatataacaatgtcactatggaggaagcccacgcacaggtgttcttccgtcagaagagtatcgaacgcaacgccaccttccggattcctgaggtctaccacgcttttatagtgagcgagggcgggtgcactggcaggggatgcacctacatagtcatggagcatattgaaatcgattttgagagaactgtgtcagatgaacagagagcacaagccatctccgagttgatcagtatcccaccgccacctggtgtctttgggagccttagtggaggccgctacaggcatcatttctttcgagacagccagcctcctgttccgttttcgtccgccacagaacttgaatataacatcaatcgagtaagtcttgctctatgtccgatcggggagcgaatactttggttgaactaa

SEQ ID NO: 4692 - DNA, 1566 bp, A.fumigatus
cgcgtgtccttccagccccggggcgtgaagacaaagcggacacactcaatgtctatcctcgataccacaaaagacctctcggccctgtttaccaagcaggtccgtgcgacccccgatgcccctgcactagaagatgattccaccacatacacctatgccgaactagataccgaagtggatgctctggcccagcgtctgcgaagctatggggtcggacgagacagcctggttggcgtgcttctccctcggagcgcgcattatgtgatcgcctgcctggccgctctgcgtgcaggaggagcattccttgttctcgagctggcttatcctcctgatctcctggcagacgtcctggaagacgcgaagccggtggtcgtggtgactcaccgcgccgaagcaaagaaggtcaaagccgatgtgccgttgatcgctctggacgagcccgcgacccatgccaacggacacaccaaggaaccatcgactcctctgccagctgaggacgaccttgatcgactcgcctttgtctcgtattcctcaggaactacgggcaaacccaagggaattgccaacccgcatcgagcgcctgtgctttcgtataatctccgattcggcgtgcaggatctgcagcccggtgatcgcgtggcctgcaatgtcttctttatctgggagattctgcgccctctgttgcgcggtgccactgttgtggcagtgccagacgatgtgagctacgacccggcagccctggttgatctcctggccgccaaacgcatcaccgaaactctcatgacgccaacgttgctggccaccgtactcgcgcgtcaccacgatctcggtgctcagttgccccatctccgcacattgtggttgaacggtgaggtggtcacgaccgatctcgctcgacgggccatcaaggccctgccgtccacccggctactgaattgctacagcgcctgcgaaacacatgagattgcgtgcggcgatattcgagaaatgctcgatgacaatgccccatattgtcccgtgggccccccgctggatccgaagcacacctatattctgggtgaagatggcaaggccgttcccgagggcgagagcggcgagctttttgttggcgggccccttcttgcccgcggatacctcaatcttcccgacactactgccaaagctttcacagcggatccgttcgacgccacccccggtgcgcgcctgtaccgcaccggcgaccgtgctcgcattctgccttccgggctgctggaaatcaccggtcgtgtaggtgcaatgatcaagctgcgtggctattcggtggttcctgggaaggtcgaaaacgagatcgtcaaacacttggcggtcagccattgtgccgtgatcgcccacggcgaaggattggatcggaagctggtggcgtacattgtccgagaccaggacagcaccgacgatcgtccggttgtccagatcaacctctccggtcacagcccggcggcgcggcagactttggcgccctacctggctcattacatgatccccgccctgtgggtggaaatggatgagctgccgacccacgcgggtctg

SEQ ID NO: 4693 - DNA, 426 bp, A.fumigatus
gcggcttcggcaagatcctcaagaacgagggtatcggtgctttctactctggtttcggtcctatcctcttcaagcagtaagtcgatcactctcaaccaatggagtcgcctggtgatttctaaactggtaaacttcaggatcccctacaccatggccaagttcgtcgtctacgagaaggttgtcgaggctgtttaccgcaaggtcgacaagaacaccatttccgatggtgctaagactggtatcaaccttggctctggtctcattgccggtttcgctgccgcccttgtttctcaacccgccgacaccatgctcagtgtgatcaacaagactcagggcgctcctggtgagagcactgtctcccgtcttgtcaagatcgccaaggaccttggtatccgtggcagctacgctggtatcggtacccggtaa

SEQ ID NO: 4694 - DNA, 501 bp, A.fumigatus
cattgcggcgattgcggctctttccggcccttggtaaagactcaactgggtactgatgtatctctttctcaatgcagcgtcaagaccagaatccagcttgaccctgtcacctacaaccgtggtatgattggtggcttcagacaggtcattgccaacgagggtgctggcgctctcctcaccggtttcggtcctactgctgccggttacttccttcagggtgctttcaagttcggcggttatgagttcttcaagcagcagtttatcaaccagctcggttacgagactgcttccaacaacagaaccgctgtctacctcgcttcctccgctgccgccgaattcttcgctgatatcgccctgtgccctcttgaggcgactcgtattcgtctcgtctctgagcctaccttcgctagcggtctcatgagcggcttcggcaagatcctcaagaacgagggtatcggtgctttctactctggtttcggtcctatcctcttcaagcagtaa

SEQ ID NO: 4695 - DNA, 678 bp, A.fumigatus
gagttcatcctccgcgtgcagcgggaaggcaagcctgacatctttgtggccaggcgatatggagaattcgcaaaactttataggagactgcgtacagagtttccgggtagaacattagcacctctcccgagaaaaaataagtcatcaacaagtactagcttttttggctcggctgacgatgaggcgtcctctatttcctccgtgtcaactcaagatactagcgaggggtacattggtcgaactctggctccgggacctcatcacagccgttcattgtcacgttcctccatgaaatcatcaaagtctgggagactttcaagtgagggcccgagagagtgtgtgctttaccgggaggagcagcgcgtctctcttcgagcatttctacgcactttgctgcagaacaagcgagtttccgagtcaaaggcgatggaggagtttctcacagcaaaccctgtcaccttgaatgaagaggaattaaccgatgtagaaagaagaaaagcagcggacgccatcaggatcgaggagcagaagcaattctacgaaattgcacggcagcgtgcggcggagctggatgtatacatggagcaattccgccgggatattgtggagagcagtaagcaacgagtcacaaatgacccagagccggctttactaacatttcgaactcagatggtctaa

SEQ ID NO: 4696 - DNA, 1098 bp, A.fumigatus
ttgccgcgatctcctgagaattgtccgtctcgactgactataactagggttgcggcaactctctatcacgtattcctggctgaggacaactctccagaaatgtttgcgcagttcaagaggatacattctcttgtcccgtatactctactaaagaatgtcatccgcatcgccaatcctgcagctgtgatgagtggtgtcctagatcttttcctcgcccagccatttgggtcacggtctctactacagcgcatcttttccatggctctaaacgacggcattaagcaatttcaaaagtccattgactcgctggcagccaaggttgatgatcccgttctgactggaaagctaaaagagttcacgcatgcagatgagaatatcaagaatgaaattaggacagaggctgcgactgaagatgtggatttgatcgttgccattcttcgatcggacctcatagcacctgagctcactccggaacaggttggaaaagtgttcaatgcctatgtagcgtggaatcatgcggtggacaacgtggatcttgagatgcaagaaggagctcaatggtttgcaaacatgaagcaattgctgaagctctacacccgacaacgcgacaaggcaatgatactcagcatcatcgaggagcctgtcacccttcagttgttccgcgatctcttcaccattttctacgagcccctagtgcgcgtctacaaatctgcgaatgtgtacagtagcattactgactttgcgcaatttgccgatgacgccatcgctgtgattgagaaatgtcacaggcaggatgtatcggcggaccctaaccaaaccgtccaggccttcatcgatctatgtgaaagacaccaagacaacttctacaagttcattcacgaagtacaccttcacgataatggcctgtttacatccctcatgggttggattgaagatatccttgaattcctgcgccacggacctcaagggggtaagcttgacatgaacgccctgttccacggagccaaagatgtcgggcagattgatgaggccaaggccatcgaggagattaatgctttgatcaagtggcacgaggatcgcaaacgtggcagcgaataa

SEQ ID NO: 4697 - DNA, 216 bp, A.fumigatus
agtggatttacacatggagaagctctgggatcgaaacatcagtttgtgacactgcatactcataatcaaccattctctcctactaatagggctcttctaggtattcatatgtcgatgtgtaatgcgacttcaactcgccacttgcagaatcttgtgaagaagggtgaattagatattagctcactagtgactcatcgtaagtttaagagtgaatag

SEQ ID NO: 4698 - DNA, 951 bp, A.fumigatus
gtgaaactgcttttctcaacaaacctcactgtattttaccatccatttcttcccatatccaaaagtctatttcattcacctttcaacatcatgaaggccgttgtttacacacaaaatgagactgttgaagttttagaccgccctaagccaacggtacaacagcctactgacgcagtcgtgcgaatgctacatgcatctatctgtggcacagatcttcatatcctcaaaggtgatgtaccaactgcgaaaccgggtcttatcttgggccatgagggtgtcgggatcatcgaagcattgggatccgccgttcagggatttcaggtgggcgaccgggtcattgtttcctgtatgacctcttgcggctcgtgtcggttttgccagcgatctattcaatcacactgtcagcaaggagggtggactctaggccaccaggtcgatggaacacaggcggaatttgtccgtgttcctcacgccacgctatcgctccatcccttggactcctctgttgatacatgtgctgcagtttcgctttcagacgccctgccaacaggttttgagtgcggtgtgtgtaatgccggaatcagtccgacaggttcagtggttattgtgggagcaggccctgtgggcatggcagccctcctcatgacctgtctcataaaacctgccttcattgttatggtcgacctggatgatgcgcgcttagagacagcacgcaccatgggcgcacaccatacagttaactctgcagctccagacgcaatacaacagctgctggatctgactgagaataaaggatacgactctgtcatcgaggcggtaggcattccagctacgtttgaaatgtgtcaggaattggttgccgttggcggacagattgcaaacatgggagtacatggcgttaaagtggatttacacatggagaagctctgggatcgaaacatcagtttgtga

SEQ ID NO: 4699 - DNA, 207 bp, A.fumigatus
ttgaatagatcgctggcaaaaccgacacgagccgcaagaggtcatacaggaaacaatgacccggtcgcccacctgaaatccctgaacggcggatcccaatgcttcgatgatcccgacaccctcatggcccaagataagacccggtttcgcagttggtacatcacctttgaggatatgaagatctgtgccacagatagatgcatgtag

SEQ ID NO: 4700 - DNA, 609 bp, A.fumigatus
gcatcatcacagctgattgccatgtggctgttcagaggggctcaatcggccgtcttctactatgccagctgtacgccctgtgctatgtcctttgaccgtcgcaagcgaaaaaaggaagccgttcgatcgcaacgagagaaggagaaggttgacgccgtcatcaccgaccaaccaaaaccatttgctcagccaacaccgttcagtaccaacccaggatgggcggaagagattgctctaggtccgggtcctcctgcaagaagaagcggtcatcggaacaaccatcgactgaccgacagttggaatactgatccattgtcacctatggagtccatccacgacgagggagaggcgtcaaagcgaaaggataagagcagagaaaagcatccgcaaggcgaccggaggaaccgtaagcgtaacctacgggaggaagaacatcagaggggggaggaagaggaggagaagggctcatcggaaggaatctccgtccggggcaaagcggacaccaccgaacccagcaagtattacatcgcccgcgtacccccagtcaacgatcttcatccaccgattgtaagcggacccaagagccgggcggaaacaagatggatgtag

SEQ ID NO: 4701 - DNA, 225 bp, A.fumigatus
cagatcgctggtcgatctccgcgtgctctttcctcagaattccgcaataggacagagaacgcccttcatgttgtcgttagcgccacagcaaacattgagatcaaactacaagtgcctccgggccaaatagatactcagacccttttttataccagtgcattcgccggactcgtctacatcaagcgttgctactctcatccggatcttaggcatcatcacagctga

SEQ ID NO: 4702 - DNA, 525 bp, A.fumigatus
gccatgttgggagaactggtgcaaggccccggagaacgggtatgggctgggacgggacaagctgcccaaggctgtcgcccgccccatgtaccactgtgcgcagctgtatgtctttcgttgttgtatcgtgatggtatattgctgatacccttgttcaggctggacatccctccattcatgtcctatgctgccgcttattcgctcttcaactaccatcttgcggatccatccaagggcttggtttacgacaacctccgcctggtgagagcttttgagcgcggcctcgaccccaagagctccgaggcaggctttatccttacccatatcgacatggtcaaggagtccaatggtctgatcagtggtgccctcaaagtggtcgatacccttgagcagggtggccctcgctccgaggtcaacgacggcttccgagagattctcgcctcaatggaaaagattgaagcctgcatggagggtaagctacttcaccgtcattcatccgcactcacgaactcaactcccggctaa

SEQ ID NO: 4703 - DNA, 570 bp, A.fumigatus
acacatagacatactctcttcttgtcaacttctaccatgactcaaaacaaagtccctccaacctctaccacaactctgaagaggttccctcatatccatgatgaccctgctacccttcccaggtccttggaccccttcaccatcaccacttccactggctttctaccctactgcacgtctcctactacgctgcccgatgccttcaagcccttgatggacctgctggaccgtatgcctgtcgtcaggcaggatggcagtcccggtctgctagccaagtacgaactgggccctgctgtcgagactgaacttcctgacctgactgacgaggttgacaaactcgtcactgctgacggctcccgggacctctacatggtcactgcagtgttccgagactactctttccttgcttcggcctatctccttgagccatgttgggagaactggtgcaaggccccggagaacgggtatgggctgggacgggacaagctgcccaaggctgtcgcccgccccatgtaccactgtgcgcagctgtatgtctttcgttgttgtatcgtgatggtatattgctga

SEQ ID NO: 4704 - DNA, 405 bp, A.fumigatus
acccctctacttccgaggagaaagtggcgccaacgacagcatggtacgctccctaactggcctccctttttatctgcaatcccaattaacatctatctacctcagatccccctgctcgaccacctcctccaaatccccatgccctccacccccctcaccaagatcctacacgaattccgcgcctacagaccactcccccaccgtgaattcctcgcctacatcgactccaaggccgccgaagtcggcgtccgcaacttcgcagtccaagacacggagactaccgtcctgcttctcaagacgctgaaccacgttcgcagcttccgctggcgccattggctgtttgccagggagtatatcatcaagcggacgccgtcttcacgcccaggggctggaaggtaccgcgct

SEQ ID NO: 4705 - DNA, 480 bp, A.fumigatus
gctacttcaccgtcattcatccgcactcacgaactcaactcccggctaacaacatcagacatgtgggccaactccaagccggccgaatacctctccttccgcgtcttcatcttcggcatcacctctcaatccatgttccccaacggcgtcatctacgacggcgtcttagacaataaacccctctacttccgaggagaaagtggcgccaacgacagcatggtacgctccctaactggcctccctttttatctgcaatcccaattaacatctatctacctcagatccccctgctcgaccacctcctccaaatccccatgccctccacccccctcaccaagatcctacacgaattccgcgcctacagaccactcccccaccgtgaattcctcgcctacatcgactccaaggccgccgaagtcggcgtccgcaacttcgcagtccaagacacggagactaccgtcctgcttctcaagacgctga

SEQ ID NO: 4706 - DNA, 339 bp, A.fumigatus
  unsure (224),(225): Identity of nucleotide sequences at the above locations are unknown.
atcgctcgcaatcataaaatctatgggatgtggttcgatttcgcccagcggcctccccttcagatcccccaggctcatcgagatatcttcaaccatatagccaacgtcaaggccgccaagttcaacgataagatgacgcggagcagaaatgacacgaacaccatcaccgggaccgactcaaccctccatgttgaaaaaaggcggcttctaaatgctgtcctcanngggaagtcgtttcattccatggagcccttgctggttaagctagtaacacactggtgtaagctgctcatcaacgggccctgtacggcttggtccactccccggggaaatgtctga

SEQ ID NO: 4707 - DNA, 462 bp, A.fumigatus
gaggtattgtcggcattatcttggcaacgatcaacatatactgactgctccgcagactcctcccccatccggtatatgtctagctccagtccaactcgagctcagaatcgccagtcccggcgttccgacattcccagcagcagcagcggattattcgtctcgtccagacccagcatcgagagcaaccgtgccgtgtcccgccgtagcgaccttcattctggtggttttctttctagcccgaaccgtcgccgcagagtttttgtcgatgctaatggtatgcctgcgaccgatggcgatccacgttccgatgccaccttctcgaatatccacccagacacctctgaggccgaggccttgggcggtagctcaacccgtgtgatttggggtaccaacatctccatccaggattccatgtccgcattagtcttctaccacggggctggaaggtcccgcgattgcggt

SEQ ID NO: 4708 - DNA, 1551 bp, A.fumigatus
  unsure (909),(1540): Identity of nucleotide sequences at the above locations are unknown.
agctctggctccctgttgttgcaggtcaaaatgacaaagaaaagcgtctttgatcttcatgattcgaatatggcctatcgcctgtctggccagctccgcggcccaacaacgcctgtgtgcgctcccagtacagcgccttctcagacgaccaccaccacctcgttttctcctgcagattatgcccagcctttttgtgactttatgactgcacatcctacaatcttccaagccgtcgacggtttcacaaaggagctcgaaagcaaaggttacaagcgcctacccgagcgtgaggcctggacgtcgaagctacaacgtggtgggaagtactattgcacccggaacggtagtgcgtttattgcattctctgtggggaagaattaccagagtggaaatggcttggctattgtggctggccacatcgatgccttgaccgccagattgaagcctgtctctaagcttcctaccaaggcgggattcgttcagctgggtgttgcgccctatgcgggcggcctcaacgagacgtggtgggatcgcgatctgtcaatcggtggccgtgtcttggtccgggatcccacttccgggaaggtagaatcgaaattggtcaagctggactggccaattgctcggattcctactctggctcctcattttggcgctccttcgcaagggccctttaacaaggagacgcagatggtccctatagttgggatcgacaactctgatctcttccagcagcaagtgtcacctacggcccactcgagcagtggtatcaagcccgggtcgtttgcggcaactcaaccagagagattggtcaagatcatttccaaggagctggggatcacagattatgatacaatcctgagctgggagctggagctctatgacagtcaaccagctcgccttggtggnttagagaaggacctaatcttcgccgttcgcatcgatgacaaattgtgctgctatgctgctcagcaggcgctgctagcttcttcagatgacacatcgactgggtcgatcaaaatggtcggcatgtttgacgatgaggagattggcagcctgttgcgccagggtgccagatccaactttatgagcagcgtcattgaacgcatcaccgaagcctttgcatcgtctaactacggacccaatcttctctcccagacagtggccaacagcttcttcgtttcctcagatgtcattcacgccgtgaaccctaactttctgaacgtgtacttggagaaccatgccccgcgcctcaatgtcggcgtggccgtctccgccgatccgaatggccacatgacgactgatagtgtgagttacagcttcatcaagcgggttgccgaccgatgcggctcgactttgcaggtgttccagatccgcaacgattctcgcagcggaggaaccatcggacctatgaccagcgctcgcatcggcatgagggctattgatgtgggcatcccgcagctgagtatgcatagcattcgggccacaacgggtagcttggatcctggcctgggcgttaaactgttcacgggcttttgtntactcgcctaa

SEQ ID NO: 4709 - DNA, 402 bp, A.fumigatus
actgatccgtccgcgaagctatattccattatctgtactaaggtcctgtggttcaatcaggcgcacaagtctcgcaagatccgcacttccaccaccttccaccgtcccaagacccttcagctctctcggtcgcccaagtacccccgcaagtcgatccctcatgagccccgtctcgacgcccacaaggttgtcctttaccctctcaacaccgagagtgccatgaataatattgaggagcacaacactctggttttcattgtggacgtcaaggcgaacaagagacagatcaagctggccctcaagaagctgtacgatgttgacaccgtcaaggtcaacactctcgtcaggtatgaaacactagttttcgtggttttaatgattctaccggaaacagtattctaa

SEQ ID NO: 4710 - DNA, 183 bp, A.fumigatus
ttcggtgtctgggcagcggttcaccatctcgccgatgtctgttggaagaaatgcatcactggaaagatttcttctggccgtctgggccagggagaggagagctgcgcacagaactgtgtcgaacgatggatggacacaaacttcgccgtcctcaagcacctggaaactcttcgagggcaatga

SEQ ID NO: 4711 - DNA, 372 bp, A.fumigatus
  unsure (208): Identity of nucleotide sequences at the above locations are unknown.
aaattgattctggtcttagtcgtaatgggcgagtacacccaccacaaagcaacccagggtgtcgaaaccatcgtcgtcccctgcagcgacatgagcggcgtggtcattcaggtaggcgagggcgtaactgcctggaaagctggcgatcgcgtcctgtcgaccttcctcccggatcaccagactggacaagtgaccgaaaaagaattancacgcggtctgggcttgccactggatggtgtgttggcgacacatcgtgtgttccccgagtacgctctggttcgggcttcctgtttatttgacgcacgaagaaggctattacacttcccattggcaagtgttgacggggttggaagtctaatcatgggcattccg

SEQ ID NO: 4712 - DNA, 192 bp, A.fumigatus
agcatcgacctgagccatcccatcgagagctgtgcgttcgccaggtgcttgagaataacggagcgaaactcattccagccacctcctaacacctatgcgccattctgtcaaaaggcagacgccagatgcatgtgcttattcgaccacgctattcccggagagagtatatatgctcttttcgtggacgagtag

SEQ ID NO: 4713 - DNA, 975 bp, A.fumigatus
aaactacgccgcggccagggcatcaccccactgtccgtaattccgccggtctattttgaggatgactttcatcttgaaaatcctcggactttcgacgtggtatctgagaagtcagaagttgtgagaccgcaaaagctaccaggaaaggacggccaagggaccaatgaatcggccgctgaaaccgccatcaccgggagaaaggcgcttgccacaaatgcaatcctccaagaaaaactctcgtggtacatggacactgtcgaggtccatctcatatcctccatctcgagtgcgtctaaatccttttttaccgctctgggctccctgcgagagctacattcagaggcagccgattcggtcaaaaggatacaaattctacgaaaagatcttcagaagattgaccgtgagatggcgttgggtggcttgaaaattgtcaatctgcgacgtcgcagggagaatgtgcgaatgcttgcagacgcggtgtcccagctgcgagatgcggttcagtcagttgcgcgatgcgaggaattagttgagaacgggcaaatcgaggaagccgcagacagtcttgaagaagtagaacgattgatggctggggagcaatccaccaatagcgacgaggatggtgcatctcgagaccgatctaggaagccggtcgacttgcggagactcaaggcccttgaaggcgcttcggatgaccttgcgcagctgaggtaccggataggcatgggatacgaaaaccggttcttgaacgatctacttggggacttgcgcaagcacgttgagaatgtgccttcggatgtgacactacaacgctggggctcctcattccaacgacaacgcggagcgcagcgctcgggtgcctctgcatctccagcttatatgaaatttgacgatgacatgagatcccggctccatacgaatctgattggactcgcccgtgcgcaatacacgacaccagcagcgacgtcgttctag

SEQ ID NO: 4714 - DNA, 213 bp, A.fumigatus
acagcagtcctccgggagatgaaggggctaatccgcaaacatatgcctagctccagcgacgatgacaatgagtcggtggtgtcagtctctacgcaccggtcccaacaacgttgccaacaagagaaatcatcgatactagcgcgcaacctgcgcgctctatacgcggaggatgcctactatatgcttactcgagtctataccggcatcagctag

SEQ ID NO: 4715 - DNA, 228 bp, A.fumigatus
atcgttcaagaaccggttttcgtatcccatgcctatccggtacctcagctgcgcaaggtcatccgaagcgccttcaagggccttgagtctccgcaagtcgaccggcttcctagatcggtctcgagatgcaccatcctcgtcgctattggtggattgctccccagccatcaatcgttctacttcttcaagactgtctgcggcttcctcgatttgcccgttctcaactaa

SEQ ID NO: 4716 - DNA, 1662 bp, A.fumigatus
gcggatccttccagccccgtggtgaagacgctgcgggccagattttccaatgtcgacaacaatctccagcaacgtataaccgatgagagcgagggggcgtgttgcgtaaagtggcatactctagaagcgatggacccttcttacatatccacagcattggaccgctgcgaaaggaggatcgacattttccaaggcccaatttgcgcggtggagatattcgactttccacacgagcagatcttcttcatcgcagcgcaccatcttgtcatagattttgtctcccaacaaatcctactgaaagacttggactctctgctggccggcgaagagctgtccacgccacgaccattgagttttcaggcctggtctctcaagcagatagagtatggttccaacttggcgttgtctccgcaagcagtccttcctcatcacgaaaacgttccccttgcgaacctgaattactggggtatcgctgcgatggacagctgttacgccgacagcgctgtgcgcgtcctggaattcgactcgaccgtaacctcttctctcgttggagatgcaaacagggccttcaactccgagccgattgagttattcattgcctccttactacattcattcgccaacacattcacggaccgatctgcgccagccatcttcaaggaagggcacggtcgccagacccgggaaccccggttggacccttcttccacggtgggctggttcacgaccatcactcctatcgccctagcggtatccccccagctctcgaccttcgaggacacattgcgacgagtcaaggatatctgtcgtgctatccccgccaatgggttcgattatttcacttctcgatttctcaacgccagcggatcgtctgcgttccagtcccatggccctatgatggagattgtcctcaactatgcaggggtactcaacaatgtccaacagggtgggacattgttctgtcccattgccactgaggaacagcgacagatgaggtaccatgatatcaacccgcagttgcgacgctttgccgtctttgacatctatgcacaagttgctggtggtaaattatcgtttacgttcgcctacagcccctctttgaattatcaggaccgtatctccgcctggattgaaagcctccgtcgtctcctggaagctatcagtgtggatctcccagcgaagcaaccgcagaaaaccctggcagactacccccgtgcgcgtctggactatacagcattggagcggctgcacaaggatattataccatccttgtatcctgccaaactcgacgatgtgtgggaatgctcgcccactcagaccgtgatgctacgcgcacgatcctatcaacctctcttcttctcgccccactttatctggaagattgctggtacaagggcttcggagggcaaccgggagcgactgacaaaagcatggaaacggatagtggcccggcactctgtcctccggtccgttttcacaagccagttgactgccacttaccaccaaatcgttctggccaacccgccgttcttcattacttgggccgatatggccggcaaagaaagtccatccgaggccctgcgtcgtcttccccctcttccgtccgatgaattgcacttggctttccggctgacagcgtcggaagatgacgaaggtgacttg

SEQ ID NO: 4717 - DNA, 483 bp, A.fumigatus
gtctctccaactacggctattcccgtatggtctgtcgcagtcaccaccgtggtggcggtcctgttggcgttgatccccattgggtccgctgtcgccttcaacgacctctgtgccatgtccattaccggcttgttcctctcctacatcatggtcgccgtccttctcctctggagacgtacgactggcgccatctcactgactgctggtgctgacgagactgtgaacacgatcggggccaaactagtctggggtcccttccgcatccctggtgtctggggaatcgtgatcaacgtctttgctattatctactgtgtcatcgctatcttcttcagcatgtggcccacctacagcgaagtgacagtgcagacgatgaacttcagctcggttggtaccgtcagtgtgattctcctgagcgtcatctactatgtcctccgcgcacgtcatgtttatgaaggcccgattgtggagaccgtccctcggtag

SEQ ID NO: 4718 - DNA, 390 bp, A.fumigatus
cagtcggacggagaagagaccatgtccaacccccccgttgccgctgccgatgaggtcgaggtttccgctgatgccggcgccggcggtcagatgtccgtcctcgatgctctgaagggtgtcctccgcattgctctgatccacgacggtcttgcccgtggtctccgcgaggccgccaaggccctcgaccgccgccaggctcacatgtgtgtcctcaacgagggctgcgaggaggaggcctacaagaagctcgtcattgctctgtgctctgagcacaagatccccctcatcaaggtccccgatggaaagatgctgggcgagtgggtcggtctctgtatgtattccccttatccctttttgtggcgggaaacatccgacgtgccctgggactaa

SEQ ID NO: 4719 - DNA, 276 bp, A.fumigatus
gtctcatggttccccgcgtgcaagtcatcatcgaccgtgttcagattgcggtcacaggccacgctgaaaatgatgcccatgaagcaagccgagcgaatcaaaggcatcctcaaatcgatctccctggacaatatctatctcccatccgaccccggcggcgcgattgatctcacagtggatgcaggcgagtaccaagcccgcgtagccaatgcaattgcagagattgccaagggccgatataccaaggcgattccgtccaggaaagttccgttggat

SEQ ID NO: 4720 - DNA, 402 bp, A.fumigatus
actcgagtgtttggaccgcagctacgctttccagagattagtctggcgttgaggcggcaagatgctcagatcatcagctatgcctcggcgtttttggctcagacgggacctgcgcactgggagaccctactccgggctcgagccattgagacacaatgctatattatcgcagcggcacaagctggacaacataacaagggaagagcgagttacggccatgcaatgattgtaaatccttggggcgaggtggtggctaaacttggagaggagcccaaagaacctcaaattgcaactgcggagattgactttgatttcttctcaagagtcaggacgaagatgaggttgtctagaggggtccatggatccccagtcaaaattataacatttctaccacatagttag

SEQ ID NO: 4721 - DNA, 618 bp, A.fumigatus
cgcacctccatcagccctttcttcagattccggctccctccattcttcaagctgaactcagttccctcgccgctcgacacgccctcaagtatggcccgcttcggacagcagatcatcctccctggagctgaatttccgctggagaccgcagtggcactcttggactactacagcaaagccgattattacgtctatgagcgcgatgatatctggtacctcgggctcggtgctcatgcatccctagtcgtcgatccaaaggggcaaaccgcgacagaaatcgacagtgagggccggaaagagtcgagtaccatactcaacttgctcaccggccaagttcgacagtttgtctccaaatattccatccatgggaaaatctttggcaggtcgggttcaactactcggcgcgctgctccggggcaggcctatgccccaagtcagtggccgatgttgagtctcatggttccccgcgtgcaagtcatcatcgaccgtgttcagattgcggtcacaggccacgctgaaaatgatgcccatgaagcaagccgagcgaatcaaaggcatcctcaaatcgatctccctggacaatatctatctcccatccgaccccggcggcgcgattga

SEQ ID NO: 4722 - DNA, 969 bp, A.fumigatus
ctgcagtggatacatcgactgcagtttggacatcttccacccactgcatctgtgacgcctacggcacccacgccgtcctccacattggttgtctcccagaatcccactgctgatcagtacgccaatgtcagccaggctatcgcagctctgcgtaatgatggccaggcatacaccatctacatcaaggctggaacctataccgagcagatctccatcacgcgcgcaggcaaggttacccttcgtggtgaaacctcctttaagaatgattacacgcagaacctggttactatccagttttcctacggcgtcctaaccagtgcaggtcaggatgaaaacacgccggttatatatgcaaagaagacagatggctctggtctggcgctgtacaacatcgactttgtgaacacgtatccgcagaccaagaacaccgctgccctggctgcagacttttatggttcgaacatggcagcatatggttgttccttcatcgggtaccaagacaccctcttggctaacatgggtgtgcaagtgttttcgaattgctacatcgaaggatcggtcgatttcatttggggtttctcgactgcctactttcatcagtgctatattgcatcgaatactgcaggcgcgtacatcgcagcccagagtcgatcctcttccactgccgctggtgggtacgtgtttgacagttgctatgtgacctacaccaacacctacggtaccacttttggtcaaacgtacctcggcagaccttactctcagtacagtatagccgtttacatgaactcctacctggataagcacatcaacagcgccggatggagtatctggtctaccagtgcaccccaaactgaccatgtcacctttggagagtacaacaactcgggtcctggagcatggtcgtccagccgtgcgtcacttgcgacgtcttcatcacagggctgccaggcgccgcgctatatgtatcag

SEQ ID NO: 4723 - DNA, 720 bp, A.fumigatus
gtggttggcgaacgccattctgaggcttatgaaggtaccagcgtgactgtagatgagatggaagtgtttcgcaattgggctcaagaaatcagccgctcggacgaggagtacatccagtgggagcaagatctgcagcaagatgtcgcagaggcctggatggcccttctcctgccgctggtgaggaacgtccagcagctgcggttggtatatcccaaggagaacaagtatctcgaccgcatgatgcagcgggccgtccagcgagagaagccgttcgacacacagcctgccttccgtgctctgcgccaagtctccttgggtcacctggacgacacgcttgacagcaagggcacctacgccccgtctcaggtacttccatttttccagctaccatcaatgcgcgccgtcgcagtcgattcggtggttgaatcgacctctgcggatgagcagccgcaaccagagcaagagcaagagcaagagcaagagcaagagccatcgcccacctcgtcggtatctgaaatcgtcttaaactccagcagcggcgccaacggcatgacgagcattgtcgccgcttgctccgccattcggtcgttcaaataccaacactcagacgaccatctgctcgccgaaggctaccagcccgctgccttctaccgctcgctgtctgccagcaaacacaccctgcacacactctggctggacagctgcgggggtgcatctccc

SEQ ID NO: 4724 - DNA, 201 bp, A.fumigatus
ggcatcagaagccacatgaacgggtgggtccgcgcgcatcaggtcggcttagtaaagaatttgcggctggcgtctaactggccaatcatcaaatgcgatgacgcatctgctcatgtttcctgtattaactatttggctgcctgtggcagctttatgactagactacatgctagcatcgcaatgttgactacttctatttaa

SEQ ID NO: 4725 - DNA, 477 bp, A.fumigatus
  unsure (26): Identity of nucleotide sequences at the above locations are unknown.
acacatttaaagtcccaatacttttntagggatcagtgctatctttggcgttcttattcccaacatgattacagtctttcggaggtatgttactttctcagaacaaaggggcgtgagcttcctctaaagttactcaagatactctggaccttttctatatggctagaatctaccgctattcttccacagctttttatgctccagcgcaccggagaagcagatactatcaccacgcattacctctttgccctgggactctaccgcgctctttatatacctaattggatttaccgttacttcgcagagaaccgctttcagccgatacccgtcgttgcaggtatagtccagacgctcctgtattcggactttttctacatctattatacaaagtgggtcaattgcacacgcatcatttttaatgataggctaatgaagaacagggtaatgaaagggaaaaaattttccctcccggtataa

SEQ ID NO: 4726 - DNA, 1686 bp, A.fumigatus
  unsure (1646): Identity of nucleotide sequences at the above locations are unknown.
aacgccaccgcggatccttccagccccgtggtgaagactcacaaagagctttgcaggggactaggactctgcaaaggtcggaagtttgatagtgaaccgagcgaaaagagcactcgcaccccaagcgagcatgtcaatgcgtcggaaggagaaaagtctgaacgtgtcaatgcgcctcacaggaagcggaaaaaggaagtcaaagaaagtcaagatgccaaacgaaatcaagcaagtgcacagcagcgggtagcacggcaggaaaaagagcgaagacggcttgaacacaagatgaagctaatgggtgtgagcaataccgatcctactcgtcaagcagtgagctttggagacccaaccatctacttgaacccgcatattggtcaacgcgtaaagccgcatcaactaaatggcattcagtttatgtggcgagagctgatacaggacgagaagcaacaaggctgtctactggcccatacgatggggctgggaaagacaatgcaggttatctcgctgctcgatactatctctgctgcggctgcttccaatgatccaaagatcagcgagcaggtccccgagtgcttccaccgatcacaaacgttgatactttgtccttcgtcactgatcgataactggtacgaggagttcctaatgtggactcctgaagagtcacgcattgggcctctgagaaaagttacggcttcgatgatagcagtttctgagaggctgcgagaagtgtctgattgggataaagaaggtggaattctgatcatgagctacgacatattccgcaaatggatccacaataaagagacgaaaaagatggacaaacctctacgagatgatgaacatgcaaatgtgaagaaatggcttctggagggtccaaacattattgtcgccgacgaagctcataaaatgaagaattctagttcgggaatatctcgagcggccgtgcaatttcgttctaagagtcgcatcgccctgactggttccccccttgctaacaacttgactgactacttcaccatggtggactggattgctaaaggctatcttggggaatttcctgaattcaaggcaaactatgtggagcccatcgaagaaggtctttacgtggacagcacacattatgagaggaggaaatcgctgaagaagctccaggttctcaaggagattcttgagccgaaagttaaccgtgccgctatcaccgtgctagagggtgatatgccgccaaaggtcgaatttgtcatcactgttcccttaactgaactgcaacgggcagcgtatgattcatacgttgactctgtagttcaggggaagactgaagttggaactgcaaagctttggacgtggatggccatcctcgggctgtgcaataatcatccagcttgcttcagggacaagcttctcagtcgcgctaatgaggcgcaaagcgcagggtcaagcttggatgagatgctaccaggtgatgaacctataacccaagcaggcattcctgattcggagaagctggtttctgagcaagagcggctattcgccaatgttcctgacatgaacgcgctgaatctgtcgtatcgggcacagcttctcgacaggatcatcagcgaatcaattaagggcggtgacaaggtgttggttttctctcatantataccgactctcaattatgttgaacacgtcctcaagaac

SEQ ID NO: 4727 - DNA, 333 bp, A.fumigatus
cagatcacaaggggcaagtggtacaaggacggtgacaaggacgccgaaatcacaagtgaagatgtccagcaaaagacggcacccccaggcggttccgtgaacgtcaactcttgcggtcgcagcgacgcttcgagtggaacgacgggaggttttgatttgtatgacggcaataccaagattggaagagtccactgggactgtccatggggttctaaaaccaacgatttcgatgttggagagagaaacaaaaattactgggtcgaaattggaacgtggaacaagtatggtggtgccattggcactgttgacgttgaagttggaaggaagcgctga

SEQ ID NO: 4728 - DNA, 831 bp, A.fumigatus
gatgtacccaaagaacccagaagctcaattgcagcaacaacattacctgccggggtgccagagccaacacctttcttcccagcttcagaacaaggcccagaacccgtgacgacgaatctaccatccagtacagaacccgccgatgcagtgtcgctatcatcctttgttgtcgtcgctccttcagatgtccataaagcctccctcccaactacttcctctctctcagactctccaccaaaccatgaaagcaacacggacattcgcaaatctgtcccatctcctacctcttataatcagacatctggcctctcgtcgattgatggtctttcatcgactgagctgtcgactacaccgtggagctcagaagtcgcgacgactcctacggtagagaccgggtttctggtcgagacccccacatcgaacaccgttaccgcagcatttccttccgcaacgaacccttcgcagaacttttcggaccacgattctgaggacgtgcgcaaccgtcatacacttcgtacgattttgggcagcatcttcggtactgtgggcttgatcgccgtcatactcctcatgtgctttctgatttatcgttataggcggcgaaaaccgcgggacggtcgaagtatcggcggcagcgagaaactgctgcgcgacggtcggcactctgcagactcctgggcaagctcgcagcatgcctttttatccaggacgtcatctctttcggatgctccttctgccccggaccatcatgtgccggcactgaacatggcttatgctcatgtcagaccgggatcctctcatcatctgcccgccgggctgaaagtaaggcag

SEQ ID NO: 4729 - DNA, 378 bp, A.fumigatus
ctgattaggcaacgtgccaacaacgtcgatccatatttgcgtgaaacccggctgaagtcctttctggaacctatcaggaaagcctggcaagaagaagaatttcggaccacaagctcctcattcgaaggcttctgtgacatgcttgggctgcaaaatgttgggccatatatgcagaagaaccaagcgcagaagctggaagactggtccgcggttccgctggataatgaagggaaacagattccggaaactatgacgagggagtttcaggtattgagcctacgccccactttgggggacctaactttgtcactaattcgcgctccagcaactaccctgaagggaactaagataagctcgcagtctcctacgagatattga

SEQ ID NO: 4730 - DNA, 189 bp, A.fumigatus
gttgcatttcagcgcctctgggatacgtattttctaacaagaaactggaagacgttctacgatctgcttgagccgaaaattaaagaaatcaccatggccaaccgggtggacgacaaactccacatggagcacacctcaatcctcctaattatcatgtatggacacctccaatcctcttctgccctgtag

SEQ ID NO: 4731 - DNA, 426 bp, A.fumigatus
gagtcccgacgtcggcgacttcgctgcatagcgatgatgatggcgcagccatttcctgcccatcaaggcatgccgcaacatcctggcctaccgccaggtcatccaatggccccgggacaacatcccaatgcccatcctggtgccgggatggtgcaagcggtgcacccggccgtgtcggcgccaggagggcctcaagtcactcaaggaggaccgatgatgggaatgcccccaggcgctggaacaactggccctggtggtcctgtccaggctcatgctctttctcatttggggcctgcgcaggcacatctgttccaacaaccgcagtttgctcaaacatgtacgtctctgtccctttgtaccacattgtcaatttggagggggggtggagtcttcaccacggggctggaaggtccgagcgtgctcatt

SEQ ID NO: 4732 - DNA, 501 bp, A.fumigatus
aggcctcagagcttatgctcttacttcgtacgtatcctttgcttaaacgaagccctcgtcggtttctcgaggctaacacggaaacaaagcgcgttcgaggattctcgtttcactccgatcccacagtcgcttctaccatcattatcatgttctctgactctgctcggctcctttgagccctgcaccaatgctctggactggatacttggtgtgcatggtatccgtatatctttcattcaccgcggccggcgctatggcgccacttatttgcccgatatagccgtagagcaaggttggacgaaagaggaaaccctggaaagcctgatgcggaaagctggctgggacggagtgaccacggggggtgttgcacggcgactcctaagaggcagcagcggcggcggccactctggctccagcaagccatgggagcaggtctcagactttcgcgtagtgaaatatcagggtctcaaggctagtgccagctatgcggaatggcaataa

SEQ ID NO: 4733 - DNA, 699 bp, A.fumigatus
agccagtgggttgcttttgcagaagtgagggttgaacaccgtttccattgctttggacatcgcaagatggcaagtccagcccattgcatctactgctttgagtgccttgctgcctcttataaacgccatgagcccatcgatcttgcagctgttgaggagctgtgggaacgatacgagcagtccaaaaagcctgcatctcttcaggacattaataaccctgtttctcaaagggatagtgccgaccttggacgggaggtcgtagtggaggaggaggaggaggaggatgacgatgatgccgacgaggaactcgacacgacgcagcgcggctccatgaagtcgaagagtagccgtccacactctatcaagctgcccagtgtcagtcgccttcaaagccagttgtcttcggactcctcgagcgtctccactactccgtcagtcatgtccaccagttcatctcgctcgatcttatccggttccacggccgccacgaccccgatttcagaatctacgcaacctgagatggcagagacgcggcagcaaaggttacatgaccaacgttatccattgtttgtgacgtggaataccctgtcgaagaacggccacaagtccctccgtggatgcattggtacgttcgatgcgcacgagctcgctgaaggcctcagagcttatgctcttacttcgtacgtatcctttgcttaa

SEQ ID NO: 4734 - DNA, 216 bp, A.fumigatus
tccctttttaaaatgtcatcttttatgttcacatgtaaaagtagattaagcgacccagtgcatagcggatataaatcgatgctgtggttgttcagctacgaaaacttcggcccgttactgagtagtcatctcatggatatcatttttatgtaccgctctatatccttccctcccccagaagatatatatacatcaatcgtcaggcatgacatttaa

SEQ ID NO: 4735 - DNA, 186 bp, A.fumigatus
tacaggatcttgcgactatgtaggttctacaaaaattcagaatgcatccatactgaccagctggtcagctaccagaatcaacgtgaagtcgcgcagggtatcaagagagccttccaggacatccccggcctcaagcgtgaggatctcttcatcgtacgtcgagctcaatcaccgaaattgccttaa

SEQ ID NO: 4736 - DNA, 321 bp, A.fumigatus
caattgcagacatccaagctatggaacagccagcatcaccccgacgatgttgagaaggctcttgatgactgccttgctgagctcgaactcgactacctagacctctatttggtacactggccgagctcattcaagcgcggcgacgagtacttccctctcgtcaaggacagccctatccccgagggtgatgtcgaaatcgatgacagcatttccattgttgacacctggaaggccatgatcaagctccccaagagcaaggcccgcgccgttggtgtttcgaaccacaccattgagcatgtaagtcaccggcaccacaattga

SEQ ID NO: 4737 - DNA, 363 bp, A.fumigatus
tttttgcaggcctttggtaacaacatgctcggtctccctcttctgatcgccagcgacgagttcaaggcggttgctgccgacgttcccaagagactcggccaggaagtctcccccgctcaggtcatcctcgcctggtctcaggtcggtggccacagtgtcattccgaagagcgtgaccccagaacgcatcagatccaacttccaagagatcgagcttactcccgaggaagtcgagagggtgtctgctctcggcaagcagccccgccgcttcaacatcccttacattgccaacaagcctcgctgggatatcaacatcttcggcgaggaggaggagaagcccgccacccacaaggttattatttaa

SEQ ID NO: 4738 - DNA, 693 bp, A.fumigatus
  unsure (672): Identity of nucleotide sequences at the above locations are unknown.
gctctctatagcgtacgcagggcgccacgtctctggcagagagatatttcgaaagcacttgaagagataggtttacagagaatcgacactgactcatgtctttacacagatgataagactgtcgtcctggtgtttatggatgacatactattcctttaccatcataaaagcaagaagcatgctgacaatctgatttggaaactacaaaaacaatacaaattccaagacctaggcgagggagatagcttcctgaacatcaagatcaccagagatcaaatgaaacgaaagctatggcttagccaacgggcatacattgagaagatcgttgcaagatatcatttggatttaaccaatcagaaggcacgaacgcctgcaacgacagatcgcctacgcccttacaatggaaaggctacggtaaacaagatacaccactaccaatccaaaatcagatcaattctctacgccgcagtgaccactcacttagatatcgctaagataacatccgatctatcaaggtatctattgaatccaggaccggcccattttgacgcagccaatcgaatcattctatatctctcttcgacgaaagattatgcattggaatatggaagtgacttgacagggaatatcttcatcattactagtaacgccgcctacgtcttcacaacaggnttcaggggcgttccatctata

SEQ ID NO: 4739 - DNA, 291 bp, A.fumigatus
tggtatggtactgctctaacgacatccgggaaactcactgccggcgaagtcctgagaacattctgggcctgcttgacggcggctcagtcgatcgagctagccttaccgcaagtaatagtgatggagaaaggcaaggttgccgcgataatgttaaaggatcttctgaacgaccgaagagtgaaaaagcgccctgaggagttggaaggagcttcatacccccgatattgtgaaggtgatatcgaagtgtgcgatgtaagtttcccggctaacaattcctgcccagttttctaa

SEQ ID NO: 4740 - DNA, 1185 bp, A.fumigatus
tcttctcagcccgacaggcccatattaagttcagttagcttcttctttcctgcaggtgaaacgacttttgtaattggagaaagcggatctggaaagagtacgctcggacaattacttgcgcgattgtatatgcccacctcaggcgaaatactaattgatggcaacgcaattcaagctctcagcctcaactggatcaggaacaacatcacacttgtcgaccaacagagcgtgcttttcaacgagtccgtcttgactaacattgccttcggccgtcgggcacacgagacagtgacgaagggagacttgcgcgaatgcatagatttggcaatgctcagggacactattgacagcttgccaaatggtctcgacacatgcgttgggcctgggggaagcttcttgagtggaggtcaaaggcagagagtggcgattgcacgagccaggctacgggacactcccattctcatcatggacgaaccaacgagcgccctggatggaataaaccgtatagcagtaatgaaagcgatacgagaatggcgcagagggaagacgacgatcattataacacacgatatgtcacaaatcgtggatcaggattacgtttacgtcctcgagcatggatcagttgtgcaatcaggataccggcatgagctcgaaaatagcccagcgaaagagaaatactttcgtttcagtgaaaggcaaatcttatcgaaaagtcatccgaagccagaagtcccctacgtcaatggcgagacgcaggagataatcgattttccgaatactatctgtgtaagcaactttggcttcaaagagacaccagttctgtcaaggagaattccttcgcaacctaagaacactcaactgttcgaccgcagaatggaagaaacgcagcttgctgcaggactgagaaatgtggttaaggcagcgtcccaagccgagatctccatacctgacggagttgctataccgatgtgtgaactaagtatggcgcagtcacgcaggtcattaatctccgctcatcgactccgattacatcgcgcttctctacctcctcctgtccctgcaataaatgattcgcggcctatcaagcggccacaatacgccggaggggacactccactttcagggccgcatcgtctctccatgaaaccagatcatgcggacttaattgcccagccttcaccctga

SEQ ID NO: 4741 - DNA, 879 bp, A.fumigatus
gaagacgccagcagccggtttgaagggctgccgcgcgaggatggtcggattgccagtgggtctggaccgaagggtgtgtggttcgatctgttcgggagcgcctttgttgtcttcgagctccacacgctgtttgcgctgtcggtgacgctgctggtcgtggcgccgctcgttctgctggtgacgagcatcgcgctggctcgcgcggacaagatgtatctgttccgatcgtcggcatcgccggaggacagcgacggcagcgaggtggtgcccttgcacggtgttcggggcttctttcggtttccctttctgctggtgatacccacggcggtgacggtgggtctggcgtacctggtcaccaagttcaacccgtatatcatccacagcagcgagtatgcggtctggagtatgatgatatccgcctgggtctttctggcgtggttcgtctcgcgcgtggcggactttgcgcggccatcggcgttccatcgcgtgtacacgttgacctggctgtttcttgtggagtgggtgtttctggtcatttccacggtctacgagaaccagtacggtctggccgggggctattttgtgctttttgtatttgcgggcacgttccttgcgacttggatctcgtatctggagctgtttgctctaccacgcaagtccgactacgcgacgcagcttgcgctgccctcccggcggaccagtagccacggcagccggctgggcacggcctcgggcgaggatgtcgaagacggcgaggacgaggatgacgacggcaccacggcggaggcgacggagacaacctctttgctgcgcggacagcgcaccacctttgccaactacgtccggtcttcaccacaggggccgaagcatccgcgctaa

SEQ ID NO: 4742 - DNA, 465 bp, A.fumigatus
  unsure (104),(177): Identity of nucleotide sequences at the above locations are unknown.
atattcttacccgagccgcaaccagagacaacagcatgcacgatcgaaactgccaccactgatccgccgtctggtggactaaccacgtcacaaccttcggctgntaccatttcttcatcctcggtcgacgactacaccagtggaatgtctcaaagtgcttctcatccaagtatcccntcggtcatttccggtgcatcatctttttccggtgatgggtccctcaaggacaaggagtgtgaccagggggtcgcagtcccttccatccttcgcacgggtgaaacggtcaaggctagactcctgcggccccagcggtcgcacgaggacgatgagtcgcggtactactgtgatgacgaaactgattcggaggacgactctgaagatgaggttctcgtcattggcagaaagaagccgagccctcagaagccagcgatgtgtggggctcaggctttcaagcccaagtcgtga

SEQ ID NO: 4743 - DNA, 1548 bp, A.fumigatus
  unsure (1090),(1111),(1437): Identity of nucleotide sequences at the above locations are unknown.
gaagaccaagtcgctgaaaccgacgcgactgaactcgatgatgctcgagagttatccaaaactgttggcacaccggccttctacgcaccagaggtgtgctacactggcgatgactttgaagagacaattggctcggtgcccaagattaccggcgcgatcgatgtttggtctcttggcgtgaccctttatggaatgatcttcgggcgtctgcctttcgtgtccgatgatgaatacagcatgtttcagactattgtcaagaaggatgttttcattccacgcaagcgtttgcagcctgtcgaggtagaccctgagtccatcagccaatggccccgatactcgaacaacaacaagcgcatggaggaagagcttgtgtatgaggagatcgacgatgaactttacgacctactgaagcgattgttgaccaaggatcccgtcaagcgcattacggtcaaggagattaagcaccacccttgggttctccatggcctgccgaatccccgggcatggattgaggaaacggatccaggctatcagagcaagggcaagaagatcgaagtctccaacgaggaagtcactacggccgtcagcaaggtgccgttcattcaaagggtacggtccaatgttgccaaactgtcaaactacctcactggaaggtcgaaagacaaggataaggaaagtcgcaaacgaacgtctagtaccacaccatcgatcgattcgtctgcttcaagcaatgctagtttggggaaatatatcctggacggtcgtcgaggcagtctcagggaggaggatttgtaccgtcctgccaggctggcgacaagggacgctgaacatccgctgtcgcacagcgtgacggcgagccccgtcggtcgggataatcagacctcatactttgacgacttaagaactgatgccacgcttgatcgtacgcctcgcccagatccccctcatcgcgcgacgtcaaccttgtctactgccggatctgcaaagactatccggccagactggacagtcacaccgtgtgcaagccagcgggtcagtgcgccttcgaagattgagaaccacggcactactcatgtcggtggtctcttangcggggcaggccgtcggctancacgtggcctacaaaccagaaagtggcgctcggataggtccatttccggagataccgcagactccgtctccctggatggtgatcgtcactcagaacccagcctggcattgagcgtcgcttccgcagttggtcacgttcaaggctcaaacttcttgcaggacgaagactcccactatttccatgcagggagcttgagtgcagcggaatcaggacatcggcgcaatagatctcaccaccttacgaccaagtcatcgcatgagccatttcaattcgcgaaagacgtactgctgaagaagcgacggagtgacatttaccaggcccctgtngacgaccaagtgccaccggaaatcaagagcaagtccacagactcgctaaatattcttacccgagccgcaaccagagacaacagcatgcacgatcgaaactgccaccactga

SEQ ID NO: 4744 - DNA, 222 bp, A.fumigatus
attttccacagtcttacggaggattacaacctcgagttacaataccgcaagccgttcctggatatttggcgtgatgaaaaggatgatccggagctgggtcccttgagcgagcgcatgggtgtccgtgaccgagtcactggcaaactactcatgacggaggaggaaaaggaagcggccagtgagtctctctattgtggccaggtcgttctgtggcatgactga

SEQ ID NO: 4745 - DNA, 414 bp, A.fumigatus
cgtggtagcatccaatgttcactatccattaacgcctttgaaagtgaagaaaaagcgaggcagatgctgcgcaatgttgcaggctgtctgaagaagggaggccgattcctcggcgtttgcccgaactcggacgtgatcagcgcgcgagtatcagaaatcaatgcgaagaagaaggcgcggcaggcacaagccaagaaggagaagtctgacgaggctcctgaggacggggaggtggaagaggatgacggcaaggtggaatgggggaaccagatctaccgggtccgatttcctatcacgcctcctgaggatggtgttttccgtcctccttttgggtggaagtacagctacttcatggaagaggccgttgaagaggtcccggaatacgttgttccctgggaggcgtttcgagcgtga

SEQ ID NO: 4746 - DNA, 285 bp, A.fumigatus
  unsure (243),(256): Identity of nucleotide sequences at the above locations are unknown.
cgagacgcaggcgccaactccccggccggcatcggccgcgccagcgcccaccagtacgcccacaacggcgcaaaagccgtctacctatgcgacttcacagacacgcacttggaaacgcacaagcgtgagatcgagtccctgtatcccggtgtggacgtgcagatccgcgtgtttgacgcggcggaggaagacgccgtcaaggcggtcgtggccgatgcgcttgcgttgtttacttggccgatntggcccacaggtngaaggaccgcgtcccacacggccgcgccc

SEQ ID NO: 4747 - DNA, 456 bp, A.fumigatus
tgtgacagtctggtgctcttcatcaatcccccttcgggaatcctcttcatcttcatcctggggacgctgaccctgctgattggcatggccctcgcctgggcctggggtgttatcaccatgaaagctgcgctggctgcgcgtcctcaaacagaaacgctggcccgtctgcagatgcttggacaggaggcggccagacaggcgaatgcaaccggccagagtgccgccagcgtgcagtcgcagctcgtatatgacgggttcatgctggatgcgcgagtatcggtcatttactttgctatgacgtgtgtatttatctactttctggtacgttatatcctcgttttgcatttttatcaggtgactgacatgagaaaaaaaaaaaggcccggctgcgcgccgcgaatcccaagttcacgctcgtccagatcttcgggaccatcattgccgatctgttcctga

SEQ ID NO: 4748 - DNA, 912 bp, A.fumigatus
agtagctccaaccgtccggcggctcctgtgctgccgaagcgcgccaaccctcatttattgaatctcaaaccagagcctgagacccctcgactgtctccacgagccatgactgttctgggagtctcagcgctcaccatcagcacctattgcggctatctctacgcttcctataggcgggaagtaagtaatgcgaagtcacttgatgttccccaggatgtatcagaccggtacaaccgcaccgcacccaactttgacgctgaagtcgaaatgtcagagaaggtgatgcgtatgggcaagaaacgacaagaccttgtccggaaggcgcgcgggaatgtcttagaggtgagctgcggtacaggtcgtaacctggagtattacgacctgggggaaagacgcggttttgatgaagacggaaaagcagtgatccggggctgtcgctccgtcacctttgtcgatcttagcccgcaaatgatagaagtcgcacgcagcaagttcgagaagctccatccgaacttcaaaaatgtgacgttccgtgcgcaggatgcgaaggacgtcgttcccccctcggcgggagagaagccagcatactacgataccatcgtgcagaccatggggttatgttcgatgccggatcctgtaggcaccctgcgccatttgggatcgatcacagaaccgaacaaagggcagatatttctgcttgagcatggtcggtcatactacgactggctaaacaatatcttggacaatttggcccctgcgcatgcggaccggcatgggtgctggtggaatcgggatattggcgagattgttcggcagagtgggttggaaatcgtggaggagaaacggtggcactttgggacaacctggaagtatgtcctgaggccagtacgtgaaagtcaggatgctaaatga

SEQ ID NO: 4749 - DNA, 735 bp, A.fumigatus
gctgacagtcacgtaggttgcggccatacaaagggcaaatctgttgtctctcggggtgaagcgtacgcccgtgttcaagccgcttgtgatgcgcgcaatgaaggccaggatatcttcatcctcgcccggaccgacgcactcatccatggctgggacgaagcgattactcgtgcgaaggagttcaagcggattggtgtggatgcagtctttgtggaggcgttgccagaccgggaggccatgaagcgttgctctgaggagattggtatcccagtctttgcaaatatcattgaaggggggaagacagagaatctctctgcgctggagctggcgcagttgggattctgtgcagttgcatacccttggacgcttgtagctgctaagctcaagagtatcagagaaactctggatgacttgaaaaagagcatgaccattggtgcaccacctatgatattgggatactcagaggtgtgtgagggtgtaggtttcaaccgatattgggtatgttatatactttctaacctgtcttttcgaaaaacttatcacatgctgactatggccaggctcgtgaaacaagatatgagtatgatgagaacgggctggtcaataattttgaagacggagctaggcagagctagaaaagtgccatatatcatgacggtacgtagagaaagattatttagaaggtgctgcatatcctttcctgtcatatacggttgttgttggtcttcaagatga

SEQ ID NO: 4750 - DNA, 312 bp, A.fumigatus
atcgtcttacggattcggcacaacctcatggtttacagaagtggcagtatcgcctttgaaaaagtgctctctaactacgccatcctgaaaaccgtgactcctgctgaggacgtaagaggagatacgctctgggcgtctggatatgaggcctacaatcaacattctccagcctggaagaaattcgcggagggtttgacagccacccattaccaatccacgttcaataatgtcatcagaaaccaggatatggaacttatcacagagaatcgcggcaatctggggaacagtggtgtgatatccaaagcctcctag

SEQ ID NO: 4751 - DNA, 402 bp, A.fumigatus
tgtttcgaaagttcaacaaggaaccccaaacaaaattcattcgcccaagccctccagttaaggacgaactctccttcgcggttaattcgaaggagccagggttccccaaaatctttcctccctgggaaaccccatgccaagtggctttgggctaaccagatacggggatatattccaatggagaacatgtgcaggaagattcaagagttagtgcgtgtgactgcatccccagtcatggcggatggagataccggttacggaagcccgatgaatgtcaagcggactgtcgaatgctttgccgcggatggtgcggctggtattatgattgaggatcagacgtggccgaagcgtaggtttccattttcaccaggggaccattttaccctgtcatggctaagctga

SEQ ID NO: 4752 - DNA, 339 bp, A.fumigatus
ggtagaagagataagtatgagataccaagccaacttatgctgatagttatatcacaacaaaatagtattcatcagatcggtatggtagaaaagggcttgtttcttgtgactttgcgaaactggcagattctaggtacctcttttcatcttgaagaccaacaacaaccgtatatgacaggaaaggatatgcagcaccttctaaataatctttctctacgtaccgtcatgatatatggcacttttctagctctgcctagctccgtcttcaaaattattgaccagcccgttctcatcatactcatatcttgtttcacgagcctggccatagtcagcatgtga

SEQ ID NO: 4753 - DNA, 237 bp, A.fumigatus
aaacatctcgtcccttttttccttttatcctattttacttttattgatttttatttttactttatttttagttttttgtcttcaaagatttttttttcgaagatctctaatctttatctacaggatgggaatccgaacaccatttaccccttcaaatatttcctccggaccagtgtcgctagagctagaaacgcaaaaggccaagctggtccagaagaggcggttaacggcacttga

SEQ ID NO: 4754 - DNA, 201 bp, A.fumigatus
tccggtactcagaggctccaaatctcccactatcaatcgtcgtttgccctccaggttatcatcatcgtcgtccaagaacccatccatgtcatcatccccttcatcacttccttcctcctcctcctcggaatccagatcttcgccctcttccggctcctcccactcggcctcggaatcatagtcgtagttgatatcgggtag

SEQ ID NO: 4755 - DNA, 1098 bp, A.fumigatus
gcacaaacgaaactgaatgcatttttcgtcaaacctaaacctccagcacagccaactgacgatactgcttccgactcacccaagataccgatcgccgatggtgtctcaaagtcaacctcccagaaccccactccgcctcaatctgactatcaacgagaatttccggacttcttcttacagtctcacacaagaatcgccccgccgcaccagttcgaacgtgatccacaggctctttctcacgtgcgagaaagggtcgatgcttgcctacaatcctatcgaaatgggtccgcggagcctctttcattccggccctctgaacttttccgactcatgccgtataaccggcggcgtggaagacaggctgcctccgtcaaagagattctgcttagaatgcagagtctcgagcagtccgaccctgattctgcgcgccgggctcaagaattgctcagacgcatcaaaatgaaatctctaaagtttggtgaagatgttcgacctccttaccagggcacttttaccaagacgcttccggaatctgctgctattaaactcatgcgcaatcccttccaccgtggtctacccgatatcaactacgactatgattccgaggccgagtgggaggagccggaagagggcgaagatctggattccgaggaggaggaggaaggaagtgatgaaggggatgatgacatggatgggttcttggacgacgatgatgataacctggagggcaaacgacgattgatagtgggagatttggagcctctgagtaccggactacgttggcaaggcgaaggcggagaccacgagcttgaaatgtacaggatccagacgaccatggattcggttaccttccctattgacccattctccacggcatattggcaaaaaccaaagccaacagagcaactcccaacaggtgggtgtgggccgttgcactctccattcattcatggtccgttccttccagcactcaattcccaaacttgctggcccctgtttcctgccgccggtaatcccactccccctgttgaacccgaagggggtccgggccaaatcagcaccattgacaacccaaagccaattggccccccattttaa

SEQ ID NO: 4756 - DNA, 774 bp, A.fumigatus
aaccgccgcgacaggtgcgaaacgcgtgactggccgtcccctctggaaagatacctttcctctctcccctctctcgtttggacgaccggccctgttcaatgttcacttgaccaagacgcctttccgaaattcaactgtcttatcgctgcccctgttgtattcgaatattcgccgccgcgttctccggcacacgcgggcatcatgacgggggctccgccttacaatcctcagtctccgacgcagcaacctcgttttcccgtctattctcctccgaataagaatcgttcatactatcccaacaacgatcagtaccagcagcacgctccgctgacaccgccggctttcgctccacaggcgtcactgtctcggagtccccattactcacatgcgccttcgcccttaccagctacgctacctccattaaacggtggtgctcctccgccagggcatcatccggagccttcttcgcagtatcagacacattcgtcggcagggacgccgcagttttcattagcaaagccatattctgcatcaaggatgtccagcaagggcgcatcctcctacaaccactccactgcttcgcacgccgttccatctgctcgcatggaaagtctatcgcaatcgcctccaaagaaagagacggaaccactgtacccaatcggaggaaatggtgctcctggatactcatcgtcaatgatgcgagagccccggccggcttctccccctagagaaacggtacgtcctcactacgagcattatggtaaacgaatgtga

SEQ ID NO: 4757 - DNA, 561 bp, A.fumigatus
  unsure (548),(551): Identity of nucleotide sequences at the above locations are unknown.
aaacatgctcgcgctgccgaccccatgtcgttcgccagcattctttcgggcccgactgaagagacctctcctataaagcagccttcccttccagaagccctgccgggcccggcaaccacaatcacacccgcaccaccaacccttgccccagtgccagcaaggagaagactcacaccacctccagtgacgcacgctcttccgcctacctcccaacttaaagttaaggagccggagcccatctcccccgcagccttgccccgacttgagaagaaaccgagcgccgaaaaacgtcgtcggaatgtggaacaagagcccaaatccgccgaagcgcttccagttgcatctactcacggtgctttcgaaccgacaaaagccgctcgggtctccaaccgcaagacattaacagagcgagatgctgaagccatcaacaagatcattgccgagattgacaatgccgacaagagcgatgtcgagtcgcctggctttgaagtggagtatgggcgctacatggtgaaaaggtcttcacacggggctggaaggatccaagnggngctcatttaa

SEQ ID NO: 4758 - DNA, 300 bp, A.fumigatus
gcagtgggaatacctttattaacttcgccgatctgctcgaggagaagaatggagggttgcgccccgatatgggagctcaagcatgacgccacactgaagcagttttcgaggggacagttgaagcaacctctggacgcaagcggtcttttcaaccagtcggatgtccgcgagaccgtcaagcgatgggacgaagaatacgagctggaggcagtgctgggtaggattgacaatgacccgaactcgattactgctcgatggaacgagagtcgtcgttcacatcagaaagaggcgggtttatga

SEQ ID NO: 4759 - DNA, 924 bp, A.fumigatus
ctgaattccctccgcaccatggctacaactccgatcaacggccatgccacaaagtctccctccttagatgcggccgaagcccgccgactcaaacacaaccatgccgatgttgtgattataggtgcaggagttttgggctgcgcgctggcagtcgcattagggcgacaggggcggagtgtcattctcctggaagcctcgctgaaagagccagatcgcatcgtgggtgaattgttacagcctggcggtgtacaagctttggagaagcttggtctccgcgattgtctggagggcatagactcgattcccgtaaagggctattatgtttcgtatttcaatgaccctgtgccaattccctacccgaagcctacgcccgcgtcccccccgccggagggccgctgctttcaccacggccggtttgtgatgaagctgcgcgaggccgccatggcatgccccaacgtcagtgttgttgagaccaaggcgacggacctggtcacttgctcgcacacccagcaggttcttggtgtcgagtgcacatccaaagataacgtccgcgcgtgctattttggccacctcaccgtggttgctgacggctacgcctccaaattccgcaagcaacatcacccgcatacccccaaggtcagctcgaggttctggggtctcgagctgatcgatacgaaactccccatgccttactatgggcatgtgttactgagcgataatgcaccgatcctcctgtaccagatcggcacgcatgagacacgcatcctcgttgacattcccgaaaacctcccgtcagcgtccgtcaagaatggtggtgtgaagagccacatgcggaacgtcgtcctcccttcactccctgaatccgtgcagccagccttcattgccgccttggaacaaggccagctgcgatctatgccgaattcc

SEQ ID NO: 4760 - DNA, 396 bp, A.fumigatus
agctcgagtgcaagatcgagtccaacttcaaaggcgttggaaagaagaagtcgaaatgctgaaatggaacggaagattatcgagttacgaaagcagattgccagcgtgcaagccaaccctgctgccatgacccctcagcaaacatgcgcttctcttcactccgcacatgtcactccaaaacaagagtcgagccatgtcagccctgcgggtgtatatcacacaccgtccgccatctcatccgatcagtacatgggctctcacgaggctgttgcatctctacttgacttgcgctccggctttgaaggctctaactacatgagaaatgggaatctgttcaagcggattgaagacgtggtggttgcgccggagaaagtgaccgagctatttgacctgtaa

SEQ ID NO: 4761 - DNA, 900 bp, A.fumigatus
ggttttttgcatcggtcttaccaaaacaggtttttcatgttttatcatccctttcttccattccttgaccgacaacgtgcgccagatgattactacagcgtatcaccattactgttctggactatcatcagcgttggagctcggcgctatcagacagatacccatctgctcaactcgctggctggccctgtcacacgactggtatggagtacgttggcggatattccccagagttaccatgttgtaaaggcgctctgtctgctctgttcatggccattccctaccagcagtacctcgacggatcctacattcatgttatgcggtatgatgatgcaagttgccatgcagctgggcttgcaccgaccgtctcatacccaggactttagcaagttccgagtagaacttatcgaggaggagctcagagacaaggtgaggacgtgggccatctgtaatgttgtcgcacagcggtatgttcgtatccttctactttcatggacctcggcgctcacggactctagtgttgcaacgggatatggccagccaccatctactctgtacgactggacgctatcagcgagcgggtcggtggatccgaatttcaagttgcccgaggatattagacgcagactcgatgttgaaatcttctgcgacaaggtcacgaagacgctctacactaatcggcgggaccctgttggcctgtgcagtgaccaagagagatctacgctgatttcttttctgtcgcgggattttgatgacctcgaggaccaagtcaagtcaaggactgacggtaagcactcccagctggtgccgacatgtgacacgccactaatgtggatcagctataaccgacctctttctgcgtgctgccaatctccatctgcacctgtcggcattctttga

SEQ ID NO: 4762 - DNA, 1023 bp, A.fumigatus
  unsure (129),(138),(175),(178): Identity of nucleotide sequences at the above locations are unknown.
cagaatgcgatttttaaccaatgccgtttaaccggggcggcctccccagtttggtgtcttataaggatgccccttgttcggaatgggagcagttcaaggggggctgggcagaaatgggtggaggggaantacgacggnttgttccgccagtgcctgcaaggaacccataccttgnttntggacgacttcttcgccgaccaggacatcgagccgtaccaatggcacgatcaattcaccgggtccgcgaccaagcgcattgtgcgcatcgaggccctagcggcacggatgctggcgaccgtgatgcgtggctccagcattctcgaggccggagatgtgtcggccctcgagagtcgatttctggcgttccgtgatggctttagcaggttggtctccgaagctattgaagaccccgcagtggtggggttcaaatcggtcatctgttaccgcaccgggttgaacgtccagccaaccgatgaagacgcaggcgttttgttgcaatcgtttgctcgtaccatccgcacctcagaggctggatatcgggtcgaggacaagcccctgaacgactggcttgtgcgccagactctcgacctgctccaagcctccaaatctagcagcaaggattgtaaaaacaagccgttgcagctgcataccggtcttggagacaacgacatcagcctggtgctggccaacccggcctacttgcaaccgctgattgcgcgttatccccaggtcgactttgtgctgttgcactcttcctatccgtacacgcgcgaggccggttatctggcctgtgtctatcccaatgtctatctcgatctcggggaggtcttccccatggtcagtcgggatgcagaggagtctatcattcgggacagtctggacattgtcccgaccaagcgacttctctggagtacggacggccactttttcccggaaacattctacctaggcaataagcagttccgcgatgtattagaaaaggcatgtcccgtcgtttgctttcatgatgtacccgcattctga

SEQ ID NO: 4763 - DNA, 1062 bp, A.fumigatus
  unsure (231),(381),(691),(788),(805),(807),(808),(810),(820),(826),(829),(830),(832),(833),(834): Identity of nucleotide sequences at the above locations are unknown.
ttgtcacaggtttttgtggactacgtccgtcaaggagactggacggtcacacaagcaaaggaagcagcggcggatatccttttccacaacgccaaccgtctctacgacctgaacgagcagccgtcgttcgaccaaatatccaagccaatcaccatctcctccacccacactctggaaacgttcatgcggtgtaatcccgacgtcaaatacgtgtggatgcaatgggtcgantacaccgcaacgacccgcctacggattttccccatactcgaattcgccaagatcgtgcgcaagcagcgtcgcatcggaatcagtctctgcgtcttctggatgttgcaggacgactccatgacccccgaaggcacaaccaccggccaattntacatggaacccgacctgaccagcctcagccccaacgtcggcctcggctccaaaagcgccaccgtcatgaccttctggcgatccgaggagaacaaacccctggagggctgtcctcggaccgcactccaaaacatcgtcgataaactacatacggaccatggcatcgccgtcacctgcggcttcgaaatcgaagttatcttcctccgtcccgatactgacccctccaccggtgaaacccggtacctccccgcggtaaccaatcactcctggtcccaaatgaccagcgacacgcgccgcatgctgcccctcntcgaagagatcgccgacaccctgacggccatcggcatcccgctcgagcaattggagtcggggtgggccgggggccgattggaattcgtcctcccgcncaatagccccttacccncnntngacaccgtcnggaaanccnnannngtcgtcgcgaacgtcgccgagcgccacggcctccgcgcaacccttcacccgcgacccctccccaacttcgcaggtaccgcctcccacgcacacgtctccatctccccatccacaaacgaggactccttcctcgccggcgtgctggcacacttccccgccctgctggcctgcaccctcgcccaagaaaccagctacggtcgtcacgacggggctggaaggaaacgcgat

SEQ ID NO: 4764 - DNA, 219 bp, A.fumigatus
ccggcttgttgcgactgcgggcgggtttgtacggagtggctgacggacatccattaccagatcacatctaccaaagtcttcaaccaggttgtcttcaaggagtacgcaactgcttctataggacgcaagttcacctccctattccctgggctgggctacgctgctggatacaaggtgagtacagatacgaacttgcggggccctgagtcaatgtgctga

SEQ ID NO: 4765 - DNA, 201 bp, A.fumigatus
tattcgaaggttctgcaaagaatctataagtacggtggtcagccttttgttcgggactatctcgccaagcaccatggctccgacttcgatcgtgctttcggaaaggggactggcaaggccatcatgcacgctaccgctggaaggtctgcgatctatcggaacttagggactatatgtgcagctttcgctgacctacaatag

SEQ ID NO: 4766 - DNA, 237 bp, A.fumigatus
ggactatatgtgcagctttcgctgacctacaatagtttgatcggtatcggagaaatcatccttctgccccttgatgttctgaagattaaacgtcagacaaatcccgacgccttccgtggacgtggcctcttcaagatcatctccgacgagggtatgggactctaccgtggcgctggctggaccgcagctcgtaacgcccccggatctttcgcggtatgttcctcacagctgggctag

SEQ ID NO: 4767 - DNA, 357 bp, A.fumigatus
aagactgaccgcagcatacagctcttcggtggttccgcttttgcaaaggagtacatttatggcctgaaagactacaacaaggccacatggggtcagaactttgtggcgtccatctgtggtgccagtgcgtctctggtcgtgtctgctcctttggacgtcatcaagactcgtatccagaaccgcaactttgagaatcccgagtcgggcttccgaattgtgtccaacatgatgaagaacgagggtttcaccagctttttcaagggcctgactcctaagctactgatgaccgggccaaagctcgtcttcagcttctggctggcccagaccttgatccctgcattcggacaggttgtctaa

SEQ ID NO: 4768 - DNA, 837 bp, A.fumigatus
cctttcagacaggacccagcacagacagaaaacttcgactcctctgtatctattctcagtgtgtgcatcacgcattacaatcaaactgacagaatgagttaccaacctgccatcatgagcgcttcactcggccgcgcctggttgcacgatctagcctacaagatcgaccaggccgccgaagcaggcttcaaaggcctagaaattttctatgaggatctggagtacgaagcacgcaagctgtccggcacggataacccaaccgctacccatctgcttgcagcagcagcgcacatccacggcatgtgcagcacccatggcatcaccattatcggcctccaaccgttcctcttctacgagggcctcaaggaccggacacaacacgcacaactcctggagaagatgaagctgtggcttcagcttgccaaaagcctccacacaaacaccatccagatccccgccaacttcctccccgcggagcaactcatcgacgaccgggatctcattgcgtctgatctgagactgctggccgacctaggtgccgccgaaacacctgccatccgattcgcatacgagcctctctgctggagcacgcatatcgacaccatcgagaaagcctgggacgtcgtgcgccgggtcgaccgccccaactttggggtttgcctggatacgttcaacattgcgggccgggtgtggggggatccggctgcgccgacagggcggacggagaacgcggatcagcagctacagataacactggagtggatggtgaaggaggttgacgtggaaacggtgttctgtcttctccacggggaccggaaggatccagatttgcggaag

SEQ ID NO: 4769 - DNA, 1047 bp, A.fumigatus
aggccaggtcccggtccaaccatgctcttcaaccgtggccgggccatcgtggtacaaggcccgggttcattatggggtgggccaattatctctaccctcacctgccttgtcaaagactaccacggcatgcttgtatgtcgcctcttgcttgggatcgtcgaggccccgttctacccgggggccctcttcatgatcagtctgttctataaccgcaaagaagccaccacccgcatggccatcctatacacaggaaatatgctggcaagttcattctccggactcatcgccgcgggcatctttgccggactagacggcgtccacggcctggccggctggagatggctgtttctcgtccaaggcataaccacgttcgccgtggccattgccgcgttcttcctgcttcccaactcgccgctgaagacccggtggctgagcccagaggagcgccaaatggcatacgaccggattgcccgcgacaccacgcagaaagagaaccgcacgagcccttggaagggtctccgcgaagcatgcatcgactaccgcacctggctgtttgccctccagtgcaatctccacctgtccgccaacggcttcaagaacttcatgccaacggtcgtcaaaactctcgggttcaactccaccatcaccctcgtccttacctgccctccgtacctcgtggccacattcgcctccgtcatcgtctcctggtcctccggccacttcaacgaacgcacctggcacatcaccatctccaagctactcgcgattattgggttcgccgtcgcctgcagcaccctcaacatcgcagcccgctacttcgccatgattctcttcgtgggggcaacctacggcgtcaacaatatcaacctcgcctggaccgcagccacgctagggcaaaccgacgagaagaaggccgtggccatcgccatcaccaataccttgggggaatctggcgagcgtgtacacgccctatctgtggccggatgcggatgcgccccgtttctccaaagccatgttctgcacccttgggttcccaccgggtgttga

SEQ ID NO: 4770 - DNA, 1110 bp, A.fumigatus
  unsure (24): Identity of nucleotide sequences at the above locations are unknown.
ccagacggcccccgatttaacagntcatcaacatcccccagagaggagaaagacaggcccggtgataatgatgtccctgctccccacacagctgctagtgtagctggccagcacgaatgggctgaatttcatcaccttccggggcggaagttcgaagactttgcgttggtgaagcaggagattgaagccgaaacagctcgaattgctgggaataataaaggcataaataggcagcccatcaatctcaagattttctcgccccatgtgctcaatcttaccatggtcgatttaccagggttgactaaggtgcctatcggagaccaaccttccgatattgagaagcaaacccgaacgttgattcttgaatacatagccaaaccgaatagcattatactcgcagtctccccggcgaacgtcgaccttgtgaactccgaagcgctaaagcttgcaagacaagtagatccaatgggccggagaacaattggtgtcttgacgaagttggatttgatggatcatggaaccaatgcaatggatattctttctggccgcgtttatccattgaaactcggcttcatcggcgttgtcaatcgttctcagcaagatatacagtcagggaagtcgctatccgaggccttgcaggctgaagcggagttcttcaggcaccaccctgcttatcgaaacatggcgaatagatgcggaactcagtttcttgcaaaaaccttgaatacgacgttgatggctcatatacgagatcgtctgcctgatatcaaagctcgcctcaacacgctcatgggccaaacgcaacaagagcttgccagctatggcaacaaacaatttagtggggaagaacatcgtggatcgttgatactgcagctaatgacacgttttgcctcttcctttatctcttcaattgacggtacctcctctgagatatctaccaaggagctgtgcgggggtgcccagatatactatatattcaactctgtgttcggcaactcccttgaaaccattgatcccacccataatttgactgtgtccgatataagaaccgttatcaaaaactcaactggccccccgccaagtctctttggttccagaacttgcgtttga

SEQ ID NO: 4771 - DNA, 987 bp, A.fumigatus
agtgcgcgcccttccaccccgggtgaagaccttgtcggatttggtctaaccatggaaggtcaagagggtaacgagatcatgtacgacttgctcctggatcaagcctggtctcggcagccgattgatacggaccattacttccataactgggccaagactcgatactcttctggagtgagaggttcagccgtacctgaagaattgtatcaagcatgggatattctgagaataacggcctacaacaacaccaacctgacatcaacggcggtgtctaaatccatctttgaactgcaaccaagcatctcaggattgcttaaccgtacaagtcatcatcctaccacggtcagctacgatccggccgcacttgtccaggcatggcggttgatggactccgccgcatccaaggccccttctttgtggtctcaacccgcttttctctatgacatggtcgacattacccgtcaagtaatgtcgaacgcatttatccctgtctataccaatttggtgtccacttatcaagctggaggctccgtttccacggatggaagcaatctaattcagctgctgcgggatctggactctgtactttctaccaacgacaatttccgcctgtcaacttggatccagtcagcacgatcatgggtgagaaacgacacagaggctgacttctacgagtacaacgccagaaaccaggtcaccctctggggccccaagggtgagatcaacgactatgcctcaaagcagtggggcgggttggtctcgtcatactacattcctcgctggcagaagttcctgaattacttggaaaacactcaggcaagcaagtataatgcgacacaaatagaggcacaattgtttgatttcgagctcaaatggcaggaagagacgagtaaaccgacacgagctaaaactcatgatcttcgatccgtgctcgcgaaagtgcgccgaaggtggccatcagtctttggagaccagaatagtccttga

SEQ ID NO: 4772 - DNA, 1320 bp, A.fumigatus
  unsure (133): Identity of nucleotide sequences at the above locations are unknown.
ctagcgccgtatgggacgaagggcacaagcacatggcgagtgtcctgcaagaccggcgatgtcttccacgttcgatacctcctgacagcattggggctgctgacgaaggccaattaccctgatcttcccggtntgcagaccttccgcggcgagatacggcacacttccgcttgggacacggatctagatcttaagggtaagcgagttggtcttgtcggcgtggtttcctcgggcgtgcaactcgtgcccgccgttgaggacaccgtccagtccctgcacgtcttcattagtcgtccgcaattgtgcgttcccagcggtgaccgtgcgctgaccgcggaagagcgcgaggcgatttttagggacttcccccaaatctggtccgaggctcgcacctcgcgggtcgccatcgggttccccgagctctcgcgagaggccatggcgttgtgccccgcagaccgcgaagccgctttcgagcgcctgtgggaagcaggaagtgggctgcagttcctgtttggtgggttcacggatttgctcacggacccagttgccaacgaggaggcctgcaagttcatccggaggaagatcaaggcgatcgtgaaggatccacagaagcggaaggtgcttacgccagacgaaccgtatgcacgtcgtccgctgtgtgccaacggcttctatgagcagttcaaccgagacaacgtctttgcggtggatatccgggcccatcccattgtgaagatcgaagcagaggggatccgcaccgccgatggcaagttgcatgagttagacgtcatcattttcgcaacgggctacgacgcaatggatggagcgtatgttcgcgtggacattcaaggccgcaaatcaggcgaaacccttcgagatttttggaaggcgaaaggcccagcgacttatctgggaattttcgtcccaggttttcctaatctcatgatgatcaacgggccgcagacgccgtttgccaatatccctcccgtatcggaagagaatgtgaactttattgtggatcttataaagcgggctgaagagatcagtcagcggatgaatcgcccctgtttggttgaagcaactgaagaagcacaacgcaaatggggcgagcactgcgacgagatcgccaacagcaccctcctaaagcaggtgcctcaatggctcttcggcaataatgttcccggcaagaaagtttccaccttattctattttggtggagtcgggcggttcagggctttaattgcggacatcaaggccacgggctttacaggattcaaggagcctctgagtaggaagtctgagccgcggccgcttctataa

SEQ ID NO: 4773 - DNA, 225 bp, A.fumigatus
aggtacatgggtaagaagcatgtcctcttcacggacattgaaattgtccaaaatgaactgagcgagttgcaagtcgtccaaagcctgcctcttcttgttacaatgattatcagatctccagtctatcaggccaagaagctccgaaaagatcacgccgctttcgacaccatcgaagaaggcactggcgctgcgaaatacctcgtcaaactgctgcttggaagatga

SEQ ID NO: 4774 - DNA, 1680 bp, A.fumigatus
gacataaccagccctagcagacgttcaggtgtcttagcttacctgaaccgatatttgcctaagttaggcattacggatcgcagaccgagtaagggtgatgggagcaactttgaggacatgccacatgatatgcgcgtggcggtggactccgttatcatgcctgagccgggtttgcttattaggtgttttgcctccggtctggtggacgaacaaattctcgtgcagcgaaattttcttgacttgcttgtgactcaccttccactcagctcgcctatactgcagtcgcggatcacagatgatgacctgcagagattaatgatcgcagctgttggtgtggttgcccgacgagacatgagcctaaacaggagactgtgggcgtggttcctagggcccgaggctgcaagtgatcagccatctttcgaaggtgaaggaacaaccggatcctacgctgttgatgacgaacagttatcgcagtcagagtatttcagtcaatttggtctaaaagctcttgtaaaaagtctgcttcggttgaatgagcaagacgcaagaactccctcggaaagggcaaagccatttcgaatctcactttccttgatggacagatgggaagttggcggtcatatcgttcctgcagtattcctgccccttatgcgcaatatccaagccttcggaaaatcatcttccaagcagcagtttgacgaggtatttcgcagcgccagtgccttcttcgatggtgtcgaaagcggcgtgatcttttcggagcttcttggcctgatagactggagatctgataatcattgtaacaagaagaggcaggctttggacgacttgcaactcgctcagttcattttggacaatttcaatgtccgtgaagaggacatgcttcttacccatgtacctctactggtgcttactatcctagtaaaattgagcgaactttcatcaaacacaaggaatttcgaaattgcccctgacgaacttcttgaattatcgaacgggcttatgagagttatgaactccttgacaacgctactcacagagagagcgtttgcaagaaaatctgaatcggccaaggtgatagcggacaattcgctcatggacatcagcgacatggacattatgaaaagaattcataacttctatgatcaaagcagaagcagtttggatctaccaccacttccttttcttcccagacagttgggtgatctcataacacggaaagctcacgatcttgccgcatcggccctcgaaaagagcaatggtagtatacctattcaagagatcctgactcttctggttgcgctgctgaagcgactacccaaatcgtttgtgttccatgacaggcgcttctatctggctatttgcagtcgattgaagattgaccaggcagaacaatctacaccgtctttctcgactatttcttccattgtctccgcagtgaccagcttgtatttcatacaggcccctgggtactatatcagctacgaggatgttgcaggactgataccaaccctcgtccgacatctttggcaatttctctcgcccgcaagccccaaattccacgtagaggctgtccgctgtctctggcatctacactcggtttcttggtcagatcatattgttgaggcgtccataacatctctcatgggtcttcaccaggggcagaagggccgatccagg

SEQ ID NO: 4775 - DNA, 354 bp, A.fumigatus
tcttataatggatactacggggataataatgatactgagtccacagacctcccctcggcgggtactctcagtctcccaacggtagagggcgagcctcaaaagttcacggagctgggtttatcggataagacattgaaggccatcaatgatatgggctttgagactatgactgagattcaaaggcgaactattcctccgcttctcgccggtcgggatgtcctgggtgccgcaaagaccggttcagggaaaactttgtcttttttgattccggctgtcgagatgctgagcgcattacggttcaagcctataaacggtaaggatattcttcctctttgcgtgagagcggcttgctga

SEQ ID NO: 4776 - DNA, 735 bp, A.fumigatus
  unsure (340): Identity of nucleotide sequences at the above locations are unknown.
tctacagcaaccggcttcggtatccggcagttgctgacttgtactcatagctctcatacatacggtatagtcatcggaggtgcgaatcggagagccgaggcggagaagctcatgaagggtgtcaaccttctcatcgcaacccccggacgtatgctggatcacctgcagaacactcaaggtttcgtcttcaagaatctgaagacactcgtcattgatgaggcggaccggattctagaagtgggtttcgaagatgaaatgcgccagattgtcaagatctggccctccgaagagagacagacgatgctgttctctgccacgcagactacaaaggtcgaggacntggcacgtatctcccttcggcccggtcctctctatatcaacgtcgaccatcgaaaggaacacagtacggtcgaaggtttggaacaaggctacgtcatttgtgaggcggataagcgtttcctgcttctcttttctttcctgaagcgcaacctcaagaaaaagattattgtcttcttctcaagttgcaactgcgtcaagtatcacgccgagcttctgaactacattgatctgccggtgctcgagctgcacggcaagcagaaacagcagaagcgcaccaacacctttttcgaattttgcaacgccaagcagggtaccctgatttgcactgacgtggctgctagaggcttggatgtgagccactcctccacaacgcatcgtctgtctgctttatgctaa

SEQ ID NO: 4777 - DNA, 291 bp, A.fumigatus
ccatcgtttcagatccccgctgtggactggattattcagtttgaccctcccgatgacccgagggactacattcaccgtgtcggtcgtaccgctcgtggtaccaatgccaagggccgcagtttgatgttcctgcagccgtccgaagtcggattcttgaagcatctgaaggaagcacgcgtgcccgtggttgagttcgagttcccagcgaacaagatcgtcaacgttcaatctcaactcgagaagctcatcggccaaaatgtcttcacgccgggctgcaaggaaacgcgatca

SEQ ID NO: 4778 - DNA, 222 bp, A.fumigatus
atatttataattaccctagaagatcttaaagctactctaaagattagaaaagctcagaaggaagatcctactaacctattatctaataaatttaaagactatactaatattttcttctctaagaaggctaagcgcctgctactatactacctttataactataatattaagttattagagggaaagacccccctatttagctctctatatactatattctaa

SEQ ID NO: 4779 - DNA, 240 bp, A.fumigatus
  unsure (26): Identity of nucleotide sequences at the above locations are unknown.
ttcggttgcgttgttttgcagagttntgcgtcaccgtgcgactttcttgttcctatcatgattgctgactgtgatcgcttgtttagcgacagctttatgctcctcaaggcgcgccgtaccagggcggtcctggagggccaccaggagccccaggacaagctggatatggctacccaggcggcgctcctcctccagcacgtgccactgagcagcagatcggtgcctacaaacagctgttga

SEQ ID NO: 4780 - DNA, 438 bp, A.fumigatus
ctcgctgaccatttccagtgcgccaaattgatgcttggtgctattgattcatcgtacgataccaaggacgaaaaggcttcagggcgtcccagtggtcccggcggtcccggcggtcctccccctcctgggcctcctggccagtacggaggttacaacccaggccaaaactatggtcagcagcccggctactataaccaaccccctccctctggatacaatcagccaggagcctatggccagggacaaggttacaaccaagcgcgttatgctcaaagccagggtggacccccacagcctggctatggacagacgtacggcggatatggagcccctccctctgacccgtacggacgtcctccctctggacctcctcccggtggctatcccccgcagcagagaccaccttacggacagcctcctccacccccacggtactga

SEQ ID NO: 4781 - DNA, 912 bp, A.fumigatus
cgacagctttatgctcctcaaggcgcgccgtaccagggcggtcctggagggccaccaggagccccaggacaagctggatatggctacccaggcggcgctcctcctccagcacgtgccactgagcagcagatcggtgcctacaaacagctgttgattggcaccattcaagagaagaatctgcaaaccttctaccctcctgataaactggatagacttgttcagtcgttggccaatgaagcccccgcaaagattgataggcttgtccatgagtggtccgtgccccaggaagtggcaatggacgtcatgaaactcgctctgtttgacgtgatcctttatgtcgatgatagtggttccatggagttcgaggagaagggaatgagaaaagagcagctgagacagatcctcggcatcgtcgcgaccggagcgtcgacgttcgatcaagatggcatctccgtgcgcttcatgaactcgaatgaagttggcgatggtatccgcagtgtcgatgatgtcaatatgcttgtctcacgtgttcgcttcgccggcttgacgccgttgggtacgagcctgaggcacaaggtcattgagccgatggttgttggtccagctcgtgccggtcgtctgcagaagcctgtcctgatcatcaccatcactgatggtcagcctgccggtgagccacacgatactgtcgctaacaccattcgatatgccagcgaagaggtatccagaacccagtacggaagaggtgctgtttcgttccagttttcgcaggtaggaaccgacaccaaggcccgcgagttccttgccagtctggatgaggatccccagatcggaggtttgatcgactgtacatccagtaagtattggcgcgcatgcaactcgtccctagcacagtgcactaggctaacagaatga

SEQ ID NO: 4782 - DNA, 189 bp, A.fumigatus
tgcatctcatacgttgtacgcgttgttactacacgagtacgtctactaataatgtgttgtactgtcgaatatgtatctcgtggtgactacaccactccggctggcgtcctaaccgcgcgaaccgccgcaactgctagttggaccaccgcggatccttccagccccgtggtgaagacggagcagaattag

SEQ ID NO: 4783 - DNA, 345 bp, A.fumigatus
ctaatggttcgcacagggctgacaatggctgcggtaccggctccgaagacctcaatcagtcttccttcttcagaagcttcggcgacctcagacatcctaattttgcgctcagacacggtccagcccttggggacgagtctctcgcgtgccagtgccaagacagagtctctggtgacgccctcgaggatggttccatctaaaggagcggtcactagctccttctgtccggtctccttgttcttcaaggcgatgaaaaggttcatagtgccaacttctgtcacatactcctcatcaccaaatagccacagattctgctggaagccgcgggaagcggccttcagctga

SEQ ID NO: 4784 - DNA, 726 bp, A.fumigatus
  unsure (46): Identity of nucleotide sequences at the above locations are unknown.
cggccatcgctgacttctgatagtgcccgtggctactcctctattntgcgacccacaatgatcggcacccaaaacacccttggtgttggaccaccaggctctgccttcctcttcgtcattgccagccctgttggcccttactaccctactggcttcaaggccatttcgctagaggctactgactatgccgtccgtgcctggcctggcggagttggagataagaaacttggagcaaactatgctccatgtattgtacctcagctgaaggccgcttcccgcggcttccagcagaatctgtggctatttggtgatgaggagtatgtgacagaagttggcactatgaaccttttcatcgccttgaagaacaaggagaccggacagaaggagctagtgaccgctcctttagatggaaccatcctcgagggcgtcaccagagactctgtcttggcactggcacgcgagagactcgtccccaagggctggaccgtgtctgagcgcaaaattaggatgtctgaggtcgccgaagcttctgaagaaggaagactgattgaggtcttcggagccggtaccgcagccattgtcagccctgtgcgaaccattagctacagagggaagatggttgattgcggtttaaagaaaaacgaggaggccggcgaggttgctctacagatgaagaactggattgaaggcattcagtacggtgatgaggaacacccatggaggtaa

SEQ ID NO: 4785 - DNA, 1584 bp, A.fumigatus
aaatatccaaagttggacggacgcgatatcggaaattcaccgacgaggcatgtatgtcgttttcgacaacacaatcgctacgtaagtaatgtcctcactccttgcgcagtaagtgctgggactgaccagtgcctctcgcgtagcatgggtgacttgattggtttcgaaggatacttgaataccactacccctttttccgtcaaggaacacaaggcactttggaagaccgaccgccactatgtcgatttccactttggaaatgattacaacgagacttgtgactacccgcggttttggaatgaaactggctggccagtcgaccaatccgtcagggaccaattaaatgggtgctacgacagtgacttcgaccaatatggcgaccgagaggcttttggtgtctatccagactggcaacgtcaactggcaaaatttgcttccgttcaagatcgtttgcgcgagtggaatcccagtgtcagacaaagattgactcgtcactcttgcatgattattgaagcccttgatattgacggctttcggtacgacaaggccacgcaagccactgtggatgccctgggggagatgtcactcgcttatagggagtgtgctcgtaaagttggcaagaataacttcttcatttccggtgagatcactggaggaaacacctttggctccatttaccttgggcgtggtaggcagcccaaccaatatctaaagtctgccatcgatgctatgaacatgaccaatttatcagaccaccagtatttcttgcgcgagcatggtcatgaggctatcgacgcagcagccttccactactcgatatatcgttccctgactcgatttctgggcctagatggtaacctggcagctggctatgatactccagttgactggactgatgcctggaacctaatggtcatatccaatgatatgatcaatgccaatactgggaagttcgatcctcgacacatgtatggcgccacaaatcaggatgttttccgttggccggccattgagtacggtgtagagcgccagctcctcgctctcttcatcacaaccctgcatcttcccggcatcccacttcttttgtggggtgaagaacaggctttctacattttggatgctacagcctctaactatatctatggacgtcaagcaatgtcgcccgccacagcatggaagactcatggctgttttcaactaacaccatcgcagtactacaactggcctatccaaaagggtcgtcagggttgccatgacgagacggccacatacgaccaccgtgatccttcccatcctgtccggaacattatcaaacatatgtaccaaatgagagagaattaccttgtcttgaacgacggatggtggttacagaaactatctaagcagactcgtgaaatttatctccctggttcaaacagcactcctaccgaaacgggcatgtggtcaatcctaagaggcgtgactccaggtatccagagcctcggctcagacaaggatgaccaaccggtgtggcttgtataccagaatgagaaccatactgttgactatagtgctacacgcccggggctagaaggtatcgcgtac

SEQ ID NO: 4786 - DNA, 828 bp, A.fumigatus
ggacgctgtccttccagccccgtggtgaagactttgcggatctacgcggccatgttcgccggacagtcgagggtagccttggacactgccgtggagctggaggcctccattcccgaagaacttttacggatcgagtcgccgccgatggcagactggctcgaggggttcctcgcagtgaaagtgcacgtgcttgtccgattcgggcgctgggaggatatccttgctctggagctgccacaggaccaagatctctactgcgtgactacggcaatgatccactacgccaaaggcgtagcatctgctgcgctcggacgagtagacgaggcagaccaggagcggacagaattccacaaagccttcgaccgtgtccctcccagccggacgctattcaacaacacctgccgggatattctggccattgcggaagccatgctcgatggggagatcgaataccgccgcgggaatatcgacgcggccttcaagcacctgcgacagtccatcgcgctggacgatggccttccctacgacgagccgtggggctggatgcagcccacccggcatgcgtatggtgctctcctgctcgagcagggccaagtagagaaggctgcggaagtgtacggtgccgatctggggatggacgataccctcccgcgggccctgcagcatccgaacaacgtgtggtcgttacatgggtatcatgagtgtttgacgaggcttgggcggttggcagaagcccggatcatccagcagcaattgaaactcgcggccgcgacagcagacgtgccgattcggtcttcgtgcttttgccgactggagtgctgcacatag

SEQ ID NO: 4787 - DNA, 633 bp, A.fumigatus
tacgctatttcgcggtccttgccgcctcgtggtgaaaacgagatcgccaagttgctcggcatcacagtccccgagctcgaggccaagttcctttccgcatttccagtccaggcagagcgcttcttactccgtcagcgggccctgcactgcttcaaagaagcccggcgcgtgcttgacttcaaggcctgcctggccaaggcccacactctggatgagaggcgcatccactacctgggccagctgctgaacgagtcccaggaatcttgtcgcgcagactatgactgcagtgccccggaagtcgatgagatctgcgccattgcccgccgcgccgggacctggggaagtcgccttacgggtgctggctggggtggttgcacagtccacatgctgccgcagtccaaggtcgaggccgtcaccaaggccttgaaggaagagtattatctgaaaaggcttccggatatcagtgaggagaagctggcacaggccatggttatcagcaagccttccaacggatccttcgtgtatgtgtacccttgtctggatgatgtcttcatagttccaaccgagaatgccgagtcactgactgcttttgctaggattacgggagccgccattaccgctgtcaagatctag

SEQ ID NO: 4788 - DNA, 675 bp, A.fumigatus
ggctgttcgacgagctgggttatatcgagcaaagctcttattcatcatatgaaagggtatacagaaaatgatggacagaaaagaatagaagcatacctctttgggagtccagtcacccttgcggacgtcgtttccatctttcaggaactgaagcactttggcaacggtggcctcctcctcacgcagcttcttcatctcaagagactgtccgccgcgccttgtctgcttgctcaagctctcgagtgccttctcgacaaactcgatatccttgatccgcaactcctcgctgatgatggtcagatcacggacgggatcgacatcaccttcgacatggataatctcagcatcgtcgaagcatcggacgacctggaagatggcatcgacagcacggatgtgggaaaggaaagcatttcccagaccagcaccagtagaggcacctcgggtcagaccggcgatatcatacacggtcaagttggcgggaacctgagacttgggcttgtagtgttcgcagagccagtcgaatcgctcatcagggacgatgacacgagcctcttcgggatcgatagtggcataggggaagttcgccgggttacccagagacgacttggtgatggcctggaagagtgtcgacttgccgacgttggccagtccgacctaattaatagccattgttag

SEQ ID NO: 4789 - DNA, 687 bp, A.fumigatus
gtcggactggccaacgtcggcaagtcgacactcttccaggccatcaccaagtcgtctctgggtaacccggcgaacttcccctatgccactatcgatcccgaagaggctcgtgtcatcgtccctgatgagcgattcgactggctctgcgaacactacaagcccaagtctcaggttcccgccaacttgaccgtgtatgatatcgccggtctgacccgaggtgcctctactggtgctggtctgggaaatgctttcctttcccacatccgtgctgtcgatgccatcttccaggtcgtccgatgcttcgacgatgctgagattatccatgtcgaaggtgatgtcgatcccgtccgtgatctgaccatcatcagcgaggagttgcggatcaaggatatcgagtttgtcgagaaggcactcgagagcttgagcaagcagacaaggcgcggcggacagtctcttgagatgaagaagctgcgtgaggaggaggccaccgttgccaaagtgcttcagttcctgaaagatggaaacgacgtccgcaagggtgactggactcccaaagaggtatgcttctattcttttctgtccatcattttctgtataccctttcatatgatgaataagagctttgctcgatataacccagctcgtcgaacagcctcatctttaattacaacgcagaggctgtcatga

SEQ ID NO: 4790 - DNA, 363 bp, A.fumigatus
gctatctccccctcaattgacccctcccgctcccttcttctcttctttcccagtctttcttctgcccactgttggtgggcgcttttcatcacgtctcccgcaccgcccgccgtctttctcttcctttctctacccctccgtttagaacgatccgcagctggttctgcttttgcctcgcgtctccatcagtccttgcccttcttctccccggtttcttccccttatttttctgccttctcccgccgaagctactccagcaagaagaagaaaaagatgcctcccaagaaggccgtcgtccaggagaaggtcctgttgggccgtccaggaaacaacctgaagagtggtatcgtatgtgagcattga

SEQ ID NO: 4791 - DNA, 324 bp, A.fumigatus
  unsure (172): Identity of nucleotide sequences at the above locations are unknown.
gtgcattgcgaagaaagggtatattacggcatctgtcaatccggggaaagaagacgaggccgggagatcatgcgctgtctcgcggagaatgtctcgaaggatctttatgtgcatatcatgggacagtaccaccctgacgcacatgttggcaagaagaagcggaccacgaganatgcaagtcaggaagacaggactgagttccgctatgcagatatcaaccgggctgttcgcgatgaagaactgggttcggtcaaggatgctgcagtagcggctggtttatggcgattctgtgaggtcaacgaacatggggggtttcatctatga

SEQ ID NO: 4792 - DNA, 252 bp, A.fumigatus
cagagcactacagctgccaaccatcttaaaatgaaacccatcatcgccgtccccgctgttctggcgctcgcccaccgcgcctggtcacgcaagaccctcactccattaggcatcatcaccgcagtcctgaccgcgatcgcgcacgtcctgcatccatggtccacgccctttgcgctcctcgcggtgttttatctgggtggctcgaaggtcacgaaggtatgttatatgccgccgtttctcgtcggcatttga

SEQ ID NO: 4793 - DNA, 387 bp, A.fumigatus
  unsure (106),(276),(315): Identity of nucleotide sequences at the above locations are unknown.
ttttggtgtatttattgcaaagaacgaaaggtatccccactaatgaaggtgggagacatgtgcattaaaagtgagcacgatcttaactggccagcgcgggacttancactggacatctaccgcttggatactatcgatattggttattatgtttctaaaggtcctcttgacgaacggaagccatatggtattttggttaaactgatgttgttccggcctagtatcaacatgggccgatcttacctccgggttcaaaggggtctaacccccaatgcntgttccgtattggactccctgaaccggtttgtccttatnaaggtttcccttgaacaaattgtttttgcgagcctaattatatctccaaattggggattggtgttaacttaa

SEQ ID NO: 4794 - DNA, 357 bp, A.fumigatus
tgctgctcgcggcgcccaaggaggaagtctaccggatcaaggggaccatgcgctgtcctgcgtcgcaaccgcctgccgactccggggaccaaccccggcgagaagaaacccgcgccgcctccgacttccggcaatgcagctgtccgacactacatcctcaactgggcctttggtcgctggacttttacgccctccgaaatggtggcggagagtgcagaccccgttgtcgttgcccgtctaacgcttatcctggctcggtatgagtcgggcaagtggaagaagaaactagaagctgggggattgattcagcttggtgaaggtgccgagggcgagtcagtggtcgaacgcctggtataa

SEQ ID NO: 4795 - DNA, 216 bp, A.fumigatus
caaaatctagtctatcaagcaacaaagcaaaccaaactgtatgggatccccgccttccacattatctatcccattacaaaccgaattacagacaagcagatgaatcaagtccagacttcgacaaattcaggaacattctctaatactccaggagcgcagtcgcaccggcttcgctcgagatgtaaatcacctcgtggttgtccgagaagccgttga

SEQ ID NO: 4796 - DNA, 924 bp, A.fumigatus
gggcaggcctgcaagaccagttcctatttgcgctatgccgccaaggtgggggtcaagcaaatgaccttggataatgccgacgagctgtacaagatcaaggcctgctacccggacgcggagctttacctgcggatcctgaccgacgactccaccagtctgtgccggctgagcatgaaattcggtgcctccctggacatcgcccgtcagctgctggaactggctcacgagctcgagctcaaggttgtcggagtgagcttccacgtgggctccggtgccgaggatccccgcgcgttcctgaaggctgtgcaggatgctcgtctggtctttgaccaggccgcggaggtgggccacgagctccacaccctggatgttgggggtgggttctgccaggacacctttgaaaaatttgccggcatcctgagtgaggcgcttgacacgtacttcccgcctcacattcgtgtcattgccgagccgggccgctactacgtcgccagcgccttcaccctggccgccaatgtcattgcgcgccgcgacgtccgtgaccccaaggacccggccaacgatacctacatgctgtacctgaacgatggcgtctacggcaatttctccaacatcatcttcgaccaccagcatcccgtggccaagatcttgacctgctctggtgagacccagccgtccgctctgaatgctgcgacttcagagggcatcgcctattccatctggggtccgacctgtgatggtatcgacgtcatcacccagcgcattgtgctgcctggtctgttggacgtcggcgactggctgtactttgaggagatgggcgcttataccaagtgcagcgccacccggttcaacggcttctcggacaaccacgaggtgatttacatctcgagcgaagccggtgcgactgcgctcctggagtattag

SEQ ID NO: 4797 - DNA, 222 bp, A.fumigatus
cgctcgctccatgtggtggtggtggcttctaccctcttctcctctttctccgtctcctcaaaactgtctgtccatcctgccgtttccattttctcatcgggttctctgtttctgagttatcttcttccgttatctcctgtccctatagcctttccgtcaaattcctgcccttacatccgctttgtgattatcctcgatgagccccggctctatcccccttga

SEQ ID NO: 4798 - DNA, 183 bp, A.fumigatus
ggcctttttcgacctactctctattgctctcttgcgcttccggatcgttcttctcgttgtcttttgtggactttctgttctaagccttcgatcgcctccactacccaaggcactaactacaccactactactattaccactgactgcatctatctactacatatctacaactatttgcagtaa

SEQ ID NO: 4799 - DNA, 468 bp, A.fumigatus
  unsure (459),(460),(461): Identity of nucleotide sequences at the above locations are unknown.
ggaaaatacctagacgctgaaggcgttaccgactttgtccccataagcttcctacaaagaatacctgcgctgacaagctggaccactgcagaacgtcgttcggaaactcatcgtcagttcagagctgcccatgagggtcaccgtccccacgccggtctcgatgcttcccgtgcgtcgacgggtgtcgtctggtgtacagaacgtgcaatagaacacggatacgcagaggatccttcgggatgggcgaatctgggtcagggcgcccccgaagccgacgatgagatcgagggaagctttccccgacctactagtattcccatcacatcagctgcccgcgaatacggtcctaccgctggtataaagccgctgcgcgcggcagttgccaggctatacaatgagcattaccgtcaaggaaaagaaagcgtcttcaccacggggctggaaggagccgcgccatannntaatcct

SEQ ID NO: 4800 - DNA, 639 bp, A.fumigatus
gcgcggtcctggcagctccgtggtgaagacccccgcccccccccctcctcctctctctctctcttgcactgtcgggcccctccgccccctcacctcaacctccatcgtttatatttgttgaaggctcctcttctcaagaaaatccatgctattgtgatcagttctgcatttattttatccaccacgtctaccttgtggctcaagttctcggcttcaaagctgggggcccggtgtcttccgtcgacctgcagatcaagcactctcgtccctcgatcctgctccaccgtacctcgaagcttggctgcactgccaagtaaagtctattcaagcttactgctttcgaataaaactcactctcgcttcttttcgaccccttcacgacctctgtacgacgccatgaacaccaacaccactccttcgcctagtcccggccctgcggcgaaaatttccgccagtcccaagcccaatgcctcggcagcagcaggtaccaagagaaagcgaagcgcaccggggaaattttatgcggtcaaggcgggctatcagcctggcatctactatgaatggagcgactgcttgactcaagtgacgggatacaagggggcggtgtgtaagtgccgagagattcgtctgcctagctaa

SEQ ID NO: 4801 - DNA, 660 bp, A.fumigatus
tacccatcgtattcaatagtccaagcattcccaacctacgaggaagcaaatgctttccttacagggacgcagcttccaagtgcccgtggtgccactccttcgagttcggagccaacaagattctacggcatccagcgaggacgcgtccccggtgtatacacagattgggccagggcgcaggaacaaatcaaagggtttgcacgccctcgatacaagaaattctccacgcgagaagaggcggaggaattcgtcagaatggagcagggagcgggagctacctttgccggaggtactgctacgtcacagacacagacattggccggaccaccaggtctcacggatgaaataccaaaggacgagcagggaaacattttggaaccgggcactggtccgttaccgccaggcgcggaggatggatttgatcccaatgtgcttttggacccggccacagggaaggtggtttacaaaaccaaggagcaaaaatccgcaaccaagacgaggccgattggtcctccagggatgttgcgtatctacaccgacggcagtgcgctgaagaacggtagggacacggcagcggcaggcgttggggtcttctttgggcccggagatacaaggtttgtcctcagcattctctgtcgtctctatgcgagattgcaatga

SEQ ID NO: 4802 - DNA, 1119 bp, A.fumigatus
gatactacaccttcgtgcaagtctcgtacgtccccgattcctctttctgagaaacccggttgtacgctgactttggataccagtgactatgcagagacaaaaagaagctccgaagttctcgacgtcctcatatcaatgctatcggaatgcgacaatgtccctggtgctgaacacaagtttgaaaacttccacaccaaaacgagcaaacaaaacaagaagctcctctcagtgaactcgcacaagaaacaggcacagaatgcctggctggctatacttcaaaacgacctctctcacactcagcgcaaaacgctactgcgcaacatggtctacaccatagagccgtggttcaaccgtcccgaactgctcatggacttcctgacagattcatacaacgtcggcggcgcgacatccctcctcgccctctctggactcttctatttgatccgggagaagaacctggactatccccaattctaccacaaactatactccctcctcgatgccgatctcctgcattcaaaacaccgctctcgcttcttccggctgatgaacaccttcctctcctccacccaccttcccgctacgcttattgccagctttatcaagcgtctctctcgtctcgcgcttaatgcacctcccactgctatcgtggtcatcgttccctttatctacaatctactcaagaatcatccgacgtgcaccttcatgctccaccgcgtcgtccgcgacgagcaaacaaaggctactctcgaagccgagggcatggatgacccgttcgatgtgaacgagggtgacccaactcgcacgatggccattgaaagcagcctatgggagatcgagacgctacagtcccattaccaccccaatgtcgctgcgattgcccggattatctcggaacagtttacaaaacaggcgtacaatcttgaagatttcctggactatacctaccaaggcatgctgcaggcagagctcggaacagaagacaagccgttcaagagaatccctgtcgtggaataccatatccccaagcgaatattcaccgaccgattactcgaggaagacggaggtcaggacacagcacctggtaacttcatgagaggcttatggaatttcgcatga

SEQ ID NO: 4803 - DNA, 291 bp, A.fumigatus
acaggcctgtatgctcctagtcttgcagtagctgttgtctgtcctccatctcaattcctggttgcgacagtttgtttctgtgtcgggctgctcctgtaccccgccgccgcattttatctcccgtccattgtgggcacactcggaagctgcgaatcagccgccatcaccatggcgcgcgtctatgccgatgttaacgagcatatgcctcggtcctattgggactacgatagtgtgaacatatcttggggggttttggagaactatgaagtggtccgcaagattggtaagtga

SEQ ID NO: 4804 - DNA, 249 bp, A.fumigatus
gtctcgctcgtctcctttaactttttatcagtgttgaccttcctgcgctttctaggaacggcttacagcccaggaggccatggctcatccctacttcgccccggttcgcgcagcggagtcgcaggccgctcggaacaatgcgacgtcccaatcgtgaagccaggcgttgctgatctgactataacttcatacattcagggatctaccgaacctaactcagcacctgctgtgattcaattgcgttcttga

SEQ ID NO: 4805 - DNA, 561 bp, A.fumigatus
acatatcttggggggttttggagaactatgaagtggtccgcaagattggtaagtgagcagatccagtctcttcacctaacgggagctttaccattatcatggatgacctgtgccacactgaatagttgcatttcaaagctgacgattgtcaatacaggccggggaaagtactccgaagtgttcgagggcatcaatgttgtcaactaccagaagtgtgtcatcaaggtcctcaaaccggtcaagaagaagaagatcaagcgtgagatcaaaatcctccagaatctggcgggtggtccgaacgtggtagccctgttggatgtggttcgtgacagtcagagcaagacaccgagtttgattttcgaatacgtcaacaacactgacttccggaccctgtaccctcggttcaccgactacgatgtgcgcttttatgtgtatgagcttctgaaggctctggatttctgccacagcaaaggcatcatgcaccgggatgtcaagccccacaacgtcatgattgatcatgagaagcgcaaggtgagttctattgtggatgtcccatcatag

SEQ ID NO: 4806 - DNA, 444 bp, A.fumigatus
ctgcggctcatcgattggggtcttgccgagttctaccacaaaggcactgaatataacgtccgagtcgcctcacgctatttcaagggccctgagctgcttgttgatttccaggaatacgattactccctggacatgtggtcactgggtgcgatgtttgcctccatgatcttccgcaaggagccctttttccacggacagaataactcagatcaacttgtgaagatcgccaaggtactgggaaccgaggagctttttgagtacttggataagtacgacatcgagctcgaccctcagtatgatgaaatactttctcgctacccgagaaagccctggcactcttttattaatgccgacaaccaacgcttcatcagcgacgaagcgatcgatttccttgacaaactccttcgatatgatcatgctgtaagtctcgctcgtctcctttaa

SEQ ID NO: 4807 - DNA, 1179 bp, A.fumigatus
  unsure (180): Identity of nucleotide sequences at the above locations are unknown.
ctcaacttcttgccggtaggagcaataggtcccaccaggccaacagagctgatgtgctcgttagaagattcaggaaccttccgcataccaatgcacctttggaacattcaaacctttcgaggtactgggcattgtacattgtacactccgtgttccttcaacccattgacagtcaatagntttgtacctctcgtgccagagaaacatacttcgtttgcgagtcggatatccatgactcaagacaacacgatggaccttttcaagtacttgaacgccgatccatctttcattacgaacttgcttggaagaccagactattgggcgccgcaaacacgctggacatccgatagcaatagcaacatattggcctgtggtccgatacatctgttgcccttgatcagtcgacatgggctgacatccacagacttttactgtcaacacccccgctggaacttacattttcaaggggcacctttatcggtatatctgcgctacgatgcggcgttgcgtctcacaagctacatcatatcccacaaggaaggggactcgaatatccaagcgctgcagaatatattcaacctcgccatcaaaacggcaccggcagagcaaggaacacgcatcctgctcgacgatccgtttgacctcgccgtcatcctgtccaccttaaacttcgaggcctcgaaatatcacgcgcaacgattccggcgatacatgtggacccagatcaacaaggtcgacgaccatctcgcggggctcgaaaccaacgaccgccgcaaactcggggaactgacaaaggagctgcaaatcatctcccaaaacgcggactcgcatctgggcaatgcggacgtcgccatcatcacagcaactggcatccgcacggcgcatgctcgcttgcatgaagccatgggcagcccggctcgggtgtttgagcgcgcgtctgactcgatcacatacgttatcgagtccatgcagaagcagaagatatggtttctcaactacaagaaccgtaaagacagcacgatggcgttggtgtataaccttgtgacgcaacaggatgctgccagtaacatacaattggcggctagtatgaaacgagatagtaccagcatgaacgcgattgctgcgttgacgatggtctttctgcccgggacattcatcgcggtgagtaacctcaggtag

SEQ ID NO: 4808 - DNA, 996 bp, A.fumigatus
tcgcttatccttccagccccgcgtgaagacagcggcggcactctctgcattgcgccctcggagcgcttgttaaacaacctggcagaggttatcaacgagatgaacgtcaaccatgttttcctcactcccactgtggctcgactgctgaatcccaaggatgttcccaacctggagtccatgactgtcggcggtgaacagctgacccgtgacgtggtgacaacatgggcatcgcgagtgacacttcgcaatggctacgggcctaccgaggcttctgtgctggtgacaatgaaggacgttgatactgacacaactggaggcaatatcggcaggccccttgcctctgtgggtgccatcgtcctcgaagcagatggagtccgtcctgttccttacggcgctgtcggagagctgtgcttcttcgggccgcagcttgcgcaggggtatttcaagaagcctgatattaccagtgccgctttcatcgagagtgaagtgctcaacggccgacgcctataccgcagtggtgacttggcccgctatctcccgaacggagacattgagtgcttgggccgcaaggacgaccaggttaagatcaacggtcatcgaattgaactgggagagatagaacaggccttcttgcggactggtgagattaaggactgtgtgttaacagtctggaagcacaacagcactgctcatctcgttgcggtcgcggtttttgatggtgcttcttccgaaaagccgggtgaggtgcttcccctggatggttttgccgagaacgtgcagcgtgtccggtccaagctcactggccttactccatacatgattcctaaggcaatcgtccccctttcgtcactcccaagacttcccttccggcaaggccaatcgcaagaagctcaaggcgatggtacagtcgctgagtcagggcgaactgaccaagttctcattcgacaaggtcggcgctgcgcagtcaaagggtgcggttatccctctggcgtctga

SEQ ID NO: 4809 - DNA, 891 bp, A.fumigatus
ttcctaaggcaatcgtccccctttcgtcactcccaagacttcccttccggcaaggccaatcgcaagaagctcaaggcgatggtacagtcgctgagtcagggcgaactgaccaagttctcattcgacaaggtcggcgctgcgcagtcaaagggtgcggttatccctctggcgtctgagacgcaaaaggtgctgcagcaaggatggatcgaaacactgcagcttgccgacgatgactttggtttggaagccgacttcctcagcctcggcggcgattccattgccgccatcaatctcgtcagctggctcagacgcaagcaactcaagatctccgtgcgagatgtactcaaatacactagcctcggtgcaatggccgaccagctgaagggcgagtcgggcgatgcacatcagattcaaaagaagactttcacgcctccctcggagatcgatgctgctatctctgccgctggtttgcaagcgactgagtatgaatacatctatccctgcccgccagggcaggccgagttcctgacccagggcgctcatcccgaggccttgtggagtctgatgacagtccggaaggtcggcagtgactttgcaccgagacaatggattgacctcgttcgacagctaacaacgaccaacgagattctacgcacaacctttactcgctgtcacggaaattggtatggtgttgtcctccgcgacgcaactcccgtggtcgagatctatgaagatgtcagcaacgagcagagacaacaaatcatcaagtctcttgacgactaccgttttgtgtttgggaagccctttattcgctatgccattctccatttgtcgacaggcgagaccgaaattgtcagtcttcacacacgggcctggaaggtccgcaatgcg

SEQ ID NO: 4810 - DNA, 960 bp, A.fumigatus
tccgacttgcacgttaagttgccgctcccggaccccgcttttcgtctactgaccaataatttttgcagattactagagactggcagtacgcctttcatcagaaacactgctgcccagcaactggcagatgtgcagaagcagcatccagacgaattattcaatcttctcggacgtattctaccatatcttcgatccaaatcatgggacaccagagctgctgcagccaaggcaatcggtctcattgtcgccaatgcagacacctttgatcctaaccaggatgacggccaggagatcaagaaggccgagaatgacgatctcgacgttgacatcaaatcggaagaggagctgttgtccccgatggacgactcgctcctccaactggagcgtctcgatctcccttctatcctgaagtatggaaagagacttctcggcagcgcaggtaaggaatatgagtattcactggccgctatggatcctgcttccagactgcagcatcaaaagaaaaccctgacctctcgcttgggtctcgccggggagtacatcgaagaggacctaatcaatgacaacgacctggtttcgaaaccggttgtgaaggaagagccatctttcgttgcatcccgcgagcacagcattcagggcacttcccagcctctggcgtcgccgattgaacccgccaatggagaggagtcgggcttgagcaaacggcagctcaatcaactaaagcgaaagaataagcaaagcgccagaatgggagcgaataaagtgcgtgtagtcgacctgtcctcgcggagagcgtcggagaacgtgacaacgccttcggtggccacgccttatcccatcaaatcagagaatggagaagagcgcaacggcgattccaagccagattatttctcgttagaccgatccgccggcgatgatgagtcgaagagtcctcaccacgaggcgccaggaccgccctag

SEQ ID NO: 4811 - DNA, 723 bp, A.fumigatus
atctcatccatagcttccctcggacagacagacaaatggctgaaagacgttttcttcccttcactttcacccacgccctccatggcgagtatcccccaaccgaagttctccatcatcttccctactcctgacgagatccgccgatctctgaacggctatggatccggcggatcgatccacatgaaactgcaaagcgtcacacagcagaaacaacttcaatatatgcggccgtatctgcgccactgggcgggagacagtgacagcagtagctcgacaagcaccccccaacgggaagcaggccgctgccgcgcggcaccacatatcaaaacgtacattcgcttctcggacgcagagaagatggacacgattgactgggcgatggtgacgtccgccaacctgtctactcaggcgtggggagcggccgtcaacaacgcgggggaagtcaggatcagcagctgggagattggagtgatagtctggccgcagctttttgttcacgaagataataccaccgagcgacaccagcaagcggttatggtcccgtgcttcaaacgtgacattccgctgcagctcccggaggatatgccaagatgcgatgttctcgtcgggctccggatgccatacgatctccctctgaccccctacaaggcgaacgaagtcccatggtgcgctacaattgcccacaccgaaccagactggctgggacagacctggggagggtga

SEQ ID NO: 4812 - DNA, 426 bp, A.fumigatus
cggcacccatcaggcagggatcatcaactgactttgcagatcttctctgtcaacatggttctacccataataaatattgtctattggaaccattcgaactggaccgagtcaaatgcagtccgacacgactacgaggtggctctgagtatagtcactttaggcggtgttctgcttggccagatcgcctttggcttcgctgcggatgtctggggacgaagcaaggtgtacggcatggagttggttattctgatcttccccactctggggctcgcattatcgtcttctggggccgagaattccatgtctgctatctcccttttcttgttttggcgtggactgctcgggattggtttgggaggggattatcctgtcggcagttatctgttcagagtaagatcccatccggaatggcgtaatcgccgctga

SEQ ID NO: 4813 - DNA, 615 bp, A.fumigatus
gatcccatccggaatggcgtaatcgccgctgataatctcaggtttgcgccgagccgactacgggggcgactacttgcaacggtcttcttttgtcagtccctcggacagctcgccgcacagttgattgctctcattgctatggcgggcttccaacaccatatccccaccaaccctgatacgatcacatgtacagaaacctgtgtccgaagtcttgacactatctggcgtcttctggtcggactaggagctgtgcctgcctttattgcattgtggttccggctgacgatcatcgagtcccctcgctatacagcagaagtcaccaaagatagtctccaggccgtcaatgacgtatcacagttctaccaacgtgttagtatcgacagtgcatcagtcaacagcgtagaaccaccctcgccggagtcaggttcattccgactatcagcaacccaatcagtcgaccaccagccagatcggcctgcctctgctgccccctttgcggaacaagatgccgcctctccattggccatcttgaacgacttcaagcacttcttcgggcagaaggataacttcagaaaactggctggccacaaccctttggcggggtcttggctcgaa

SEQ ID NO: 4814 - DNA, 744 bp, A.fumigatus
gcgcggacccttgccgcctccgtgagtgaagacgcctggcgtggaaagtacctcaatgttgtgcgagaatgtggtggtgtcgacattagccagaaagtgacggacgttcctcatacactagatgatccccggttcctagacaacgtcaatgccgcctacacctatgccaatgcgtctttgctgaacctccttctcacgaaaaactcgctcacgacacgattccggtctctcaagcactacttctttctggatcgctctgattttttctcatactttcttgagcttggctcgtcagagctgcgtaaaccagccaaaaacgtcaatgagaacaagcttcaatcgcttcttgatttagttctacgtcaacccggcagtattgcagcttctgatcccttcaaggaggacgtcaaagtgcggatgaacaagattgggctaacaaaatggctgatgcaagtggtgagcgtatccggaatcgaccaagacaaccccgaggctgtcctcgagagataccaggctcctcaaacacaaggcggagaggacgacaaggatatcgttggtttcgatgcactggaactcgattactccgtccccttcccactgtcactcgtcataagccgcaagaatgtccttcgatatcaactgatattcagacaccttctctcgctgcggcaactcgagacccctgctaactacatcttggttagatcagaacagggttgttggctggcggcacaattcttctga

SEQ ID NO: 4815 - DNA, 426 bp, A.fumigatus
ccaggctctgctgggcgcggggatcggtcgtcgcgatccgcaacgtcatcctcatccccgctcccttcacctagcagttcgcgatccagatcgtcaaggccttcgccgtcgagatcggcgtcatcatcggccagacgaatggaaggaggcagcggcgagagttcctggtcttgtgagggaacgtcgagatcatccttgccagccacatcggaagaagccgctccagcaacgcgactagggcgacttcggctgctcttggagcgagcggatgaggcagtttgccccttggaggcctcgccggccgtagcaccagaagcaccagcctctgcttcggcgagcttgcgtctcgcattgcgcgcggcgcgggctctgctacgagcggacatcgaggctcgcccactcaggtcaagggcatccatggcatag

SEQ ID NO: 4816 - DNA, 198 bp, A.fumigatus
gttttcgtccacatcgactccaccatctccgtcgtcgagatcctcctcgtcgtcaacttcatcgtcggatgtcaacgcttccgcgtcgtcatctgcatcaccaccaatgaaactatcctcgtaaccaggctctgctgggcgcggggatcggtcgtcgcgatccgcaacgtcatcctcatccccgctcccttcacctag

SEQ ID NO: 4817 - DNA, 1146 bp, A.fumigatus
  unsure (25): Identity of nucleotide sequences at the above locations are unknown.
gatggagcagaccccccgacgcgtnctcgccgggcgcctccaggttcaggtcatccgattctgaatagattcgtgaccgaatccacaatcggtcagcctccctcagctcgccgccctcgaccacttacacagcaccagctggctgtcgaacagaatcggcgccagcgtatcgattatcttctggcaaagcgtaaaaacgaggcttaccgaattttacgagcgaagagagaaagcgaaatcccgttcgcacgctacggtcgcttgttgcaatctcttccggaaggttacgacactgaggacgaggaggtctcacggggaaagggtggcttgatccctcaccacgaggaagaagaagactttggagaatccgcgggctacttcttgtctgtgatccgtaaggccgccagaaggcttgaccgctgggactatgaaaacgcgaatggtccgaagagagaccgcaagaaagagagagaggagcgccagaaagccaggcagaacggctatgccatggatgcccttgacctgagtgggcgagcctcgatgtccgctcgtagcagagcccgcgccgcgcgcaatgcgagacgcaagctcgccgaagcagaggctggtgcttctggtgctacggccggcgaggcctccaaggggcaaactgcctcatccgctcgctccaagagcagccgaagtcgccctagtcgcgttgctggagcggcttcttccgatgtggctggcaaggatgatctcgacgttccctcacaagaccaggaactctcgccgctgcctccttccattcgtctggccgatgatgacgccgatctcgacggcgaaggccttgacgatctggatcgcgaactgctaggtgaagggagcggggatgaggatgacgttgcggatcgcgacgaccgatccccgcgcccagcagagcctggttacgaggatagtttcattggtggtgatgcagatgacgacgcggaagcgttgacatccgacgatgaagttgacgacgaggaggatctcgacgacggagatggtggagtcgatgtggacgaaaactcatcgactttcgatggcggaaatggatacgctgccagcgagacctcttctgttgcaggtgatactactgctgtcctagacgatggcaaagtctag

SEQ ID NO: 4818 - DNA, 408 bp, A.fumigatus
  unsure (369): Identity of nucleotide sequences at the above locations are unknown.
aagaggacgagccattacccaggccgccaaagcgtccacgaaagggtaattcagaccagctcccttggcgacctcccttggatgggggcccaggagaaggtcctgcgtgtaagttcagtgcaatgctccagcacgtggtgtcatgtgttaaccaaggttatctatgatatagacgacgcgtattatggaaccaatcctatgcggccgccttccaagcgtccagcggatccagatgaaggctatctgacgcctactcaatcatcgcgttctgagtccaaacgacccaagcgggagtcgtctcttaaccgctcggtcggtcagcagcgactgattttgaagactaagatggagcagaccccccgacgcgtnctcgccgggcgcctccaggttcaggtcatccgattctga

SEQ ID NO: 4819 - DNA, 987 bp, A.fumigatus
cacaatcatttgagaagttcaccatcacgactgatctgtaatatgattccccggaccgaagttctcattatcggggccggacccactggcctcgtgctggccctgtggctcacccgccagaacgtcaaagtgcgcattatcgacaggcaagaagccaaaccatccacttctcgggcgttggtggtccacgctcgtccactcgagctatatcgccagctcggccttgccgacgacgtgttcgccaacggccacaaaatcgaagctaccaatatttgggttgaggcaacccaccgcgcccatgtacccatcggtgatgtcggcaaggggttgaccccatacccgtttattcatgtatatcctcaggatcgccacgagaggttactggaagaccgcttgaacgcgatgggggtaacggtgcaacggaactggaaattggtcgactttgaggagcacgacgagtacatcttagctcaactgaaatacacatccgagcagccaagttcaacagagaaaacagagttctgtgaagcaaggtacatcgtgggctgcgacggcgcccactccgccgtccgtcatctttgcaacattgccttcgaaggtgcaacgtatccccagctcttttatgtaaccgacatcgagggcagcgggccaacgatgaacggcgaggcgcacgtttcgctcaatggatccgaattcatgctatctctcgcatacgacacaaaccgacgagcccgtctcgcgggcgccgtgaacgaagaacacgtaaccaaagacatttccgaactgacgctcgacgacatcctgcccaccacgatcaagaaaatgggactgcaaatcgacaaagtgaactggttcaccacctaccgcgtgcaccatcgcctcgcagccagcttccgcaagggccgcgcgttcctcgcaggcgacgcagcgcacatccacagtcccgtcggcggatcttcacgacggggctgcaaggacacgcgagca

SEQ ID NO: 4820 - DNA, 231 bp, A.fumigatus
tcaagttgcagtcccaggcctacccccgccccagcgcagaagcccactgccaaaccaactactcagccgaccgtggttacgcactggagcgccatccaagaagagaaggctcgcgcccttttcgccaagtatgggctgacgcttgagtctggagagtggagatcgtcgagcgacatgaccgtccgtcttcacctacgggaactggacgaatccgcgcttgatgtttggaag

SEQ ID NO: 4821 - DNA, 393 bp, A.fumigatus
cagctggtttttgcccactgtgacctcctctgtgccaacgttatcatcctgccgtcacagtgtcctgccactgccgcaacctctgacaaagaagcactaaaggtgcagttcatcgactatgagtacgcgaccccatctccagccgcctttgacatcgccaaccactttgccgaatggggcggatacaactgcgactacagcatgatgccgacgcgttccgttcgccgacaattcctgaccgagtatgtcaagagctacagccaatatcgggggattcccgaatgtgcccagcaggagattgtcgaccgattatatgaggatgtcgatcgattccgtggcattcccggactatactggtatgtccctggtcactgcaggtggactttaatctga

SEQ ID NO: 4822 - DNA, 186 bp, A.fumigatus
tctgacaagtacaggggcgtgtgggcactcatccaagcccagatctcacagatcgactttgactatgcttcgtacgcggagacccggctgggagaatactacgcctggcggcgagaagtggatggctcgcgggttcaggcgagcgaagagatgcccctccgagaacgtcgctgggctgaagcttag

SEQ ID NO: 4823 - DNA, 303 bp, A.fumigatus
tgtaacggcaatgacgcatccaacgcatctgacgaagcagacgtggatgctctcaacttcagcacctccaccaacctcctccacgccctccacccccgtgccgcatgcttctccggcgtggcagggtccggatccgccaacgtcctcgaaaacaactccagcgacacccacccctcaaacccaagctcaaagaacgcccgcgccacatccaggaccgggaggtatccgccgcggtcctcttcaaacgggaacagcctcgcattccgcgaccagctcatgcgcggtggctgcccggggacatga

SEQ ID NO: 4824 - DNA, 405 bp, A.fumigatus
gtggcacacattacaaacgatgatgtaacggcaatgacgcatccaacgcatctgacgaagcagacgtggatgctctcaacttcagcacctccaccaacctcctccacgccctccacccccgtgccgcatgcttctccggcgtggcagggtccggatccgccaacgtcctcgaaaacaactccagcgacacccacccctcaaacccaagctcaaagaacgcccgcgccacatccaggaccgggaggtatccgccgcggtcctcttcaaacgggaacagcctcgcattccgcgaccagctcatgcgcggtggctgcccggggacatgaaacgggtggttctcgtcgagcggggcggagaggcgctccccgtcgacgatctggatgtagaagaatttttggacgtcga

SEQ ID NO: 4825 - DNA, 396 bp, A.fumigatus
atcgacgtccaaaaattcttctacatccagatcgtcgacggggagcgcctctccgccccgctcgacgagaaccacccgtttcatgtccccgggcagccaccgcgcatgagctggtcgcggaatgcgaggctgttcccgtttgaagaggaccgcggcggatacctcccggtcctggatgtggcgcgggcgttctttgagcttgggtttgaggggtgggtgtcgctggagttgttttcgaggacgttggcggatccggaccctgccacgccggagaagcatgcggcacgggggtggagggcgtggaggaggttggtggaggtgctgaagttgagagcatccacgtctgcttcgtcagatgcgttggatgcgtcattgccgttacatcatcgtttgtaa

SEQ ID NO: 4826 - DNA, 228 bp, A.fumigatus
catcctcgcgataggcttatattgtgtgcaccacggtttctcacacttgcagaacaaaatttcggggtcgatcttgaggctagagctcgagctgatcggaagagagttccaattcttgtgacaactctactaacgtatttggataatcgtaggccaacggtatccctctcctgcccaagtgcatttgagctaaccaatcttctcaggctatcccgaactcgaaggtga

SEQ ID NO: 4827 - DNA, 873 bp, A.fumigatus
actaccaggtccgtatccagagatggtggaggcgttgcagttcatcgacctaatttctttccagattcccttgtttcttcgcaagtatatgagattgtcaagactatttattcaactaccgctcatgaaacgacggaagacggacgaatcaaagttttgcaaagcacccttggtcagcttcgtctcaacaacatcgcaacacttgacgccatcatgacccatttcacgcgacttatagacctaacatctgccgatgaggcatatatctccgcattggcgcaaacactggctccctgcatcctccgtcctcgtgttgagaacagccttacgatgaatgaacgtcacactaccgtcttatacgtgacctcttcgctcacaaggatgctatcttcggcgagcctgaaacgtcaatcgagcgtccttggattaggctcaacatccaatcgcccgcgtgccattagcacagatgagagcaaccgccgtgctgcaatggaggcgaggaaccgtgctatcgtagaccgcagtcgtgccaatagccccgctcctccccgcaagcatcggcgagaccgctctagtggtgcttcggaggctggacggtttccaatccacgtcaccagcccgaccgaaaggaaagcagccacgaggagcagtttggaagtcccggccagcgctgaagctcccacaacaggagagcaattcacaaccgtgaacatccaggccaacgatagcgccactaatggcacatccagcgactctccagcctctgccgtcgccggggagaatacctcctcagaatcatctagtcctccgcctgcaggtaactccgacggctctccgacgcctactcccacgcccggctatgtgacagctccg

SEQ ID NO: 4828 - DNA, 408 bp, A.fumigatus
ccaatcttctcaggctatcccgaactcgaaggtgatgaggcacgccgtgcgatctggttatatgatgttcctttggccgcaacgcaccaccttcgcaatgcattgaataacagcaaagcggattacaacgaaatccttcagaaatacgatatacccattgtcgcgagcgtgttgaagttgtaccttcttgaactaccaggtccgtatccagagatggtggaggcgttgcagttcatcgacctaatttctttccagattcccttgtttcttcgcaagtatatgagattgtcaagactatttattcaactaccgctcatgaaacgacggaagacggacgaatcaaagttttgcaaagcacccttggtcagcttcgtctcaacaacatcgcaacacttgacgccatcatga

SEQ ID NO: 4829 - DNA, 420 bp, A.fumigatus
  unsure (151): Identity of nucleotide sequences at the above locations are unknown.
cgcgggttgggttcctttcaaccaacccacaaccgaacaagactccccgttgataagttccgaggaagggcacgcgaagcccatgacgggtacaaagccgctgtgcggaaactggatcagatcagatgtaagctcaaagaagaaattgtgnagaatctccgctttatggagcagtgtgagttggatcgtctcaaagcgattaaggcggtcgttctcgacttctcaggtgccatcagcaacgtcattccaaacttgcaaagcaccgtcgatcacatgatgctctatcaagagacaattcagccgctgggagatctacgttatctgctggaaaattatcgtacaggtggttttgtgccgcgggtccaggcctatgagaattattacgggtccgttgaaggtatgttaacatcctcgcgatag

SEQ ID NO: 4830 - DNA, 1149 bp, A.fumigatus
cactccgggctaggcatacagttctgttctgacgttctcagggccgggttcttcccaggagcagtctatctatgcacgttctggtacatgccaaaagacctttccacccgtatcgccgtgttctactgtgccagtgccctgtctggtgctttctccggcctcttggcagccggtattgcgcagatggacggcgtgggtggccaggaaggctggcggtggatcttcctgctcgagggacttgtcacggtcatcctgggagtgatgtgcttcttctttctgatcgactcgccacgacgatctgggaggtggcttgatcccgaggagattcggtacctggagctgcagcatttcatcaaagatggtggccgcttcaaggacgagagaaagagagcctcgtggagcgatatcaaagccgtgctgctgaactggagaatgtacatgctggcatacatcttactctgccagtccgcctgctcatacggtcagtcccgatcactcaactctgcttcagcctcccagctcactcgtacaggaaccaaattcaccatgccgaccatcaccaaagcaatgggcttcaccaacacccacgcccaactcatgaccgtcccgccatacgtcgccggcgccctctccgccatcttcttctccaaactctccgaccgcttctactggcgcatgcccttcgtcgccatccctctggccctcgtgaccatcgcctactccattatcatctctttccacggccacctcaaagagcacgtcggcccggccttcttcgcagtcatcctcacctgcatggggatttaccccatccacccggcgaccacgtcctggacagccaacaacctcgcctcctccagcagccgagccattgggctggcgttcaacatctgcattggcaatatcggcggtattatcgggagctacatgtatatcgacagtgagagcccggagtactacacaggtttcggcctgtcattggcatttggcggatcagggctccttgtggcgcttctgctggagctgtcgtatatctatgggaacaggaagaaggcgaggattccggaggcggagatcagagagcggtataccgacgatcaattgctggctatgggtaccaagtcgcctcttttcaaatataccttgtaa

SEQ ID NO: 4831 - DNA, 204 bp, A.fumigatus
actcggacagaggtccccagcaatatgctcctgaagagcttctccagaccgtctgtttacattggcattctgatcacctgctgggggattatcatgaccttaactggaatggtgcggacctttgcgggcttgatggtcacccgcgttctccttgggatcttcgagtatgtgacactccgggctaggcatacagttctgttctga

SEQ ID NO: 4832 - DNA, 468 bp, A.fumigatus
caggccgaaacctgtgtagtactccgggctctcactgtcgatatacatgtagctcccgataataccgccgatattgccaatgcagatgttgaacgccagcccaatggctcggctgctggaggaggcgaggttgttggctgtccaggacgtggtcgccgggtggatggggtaaatccccatgcaggtgaggatgactgcgaagaaggccgggccgacgtgctctttgaggtggccgtggaaagagatgataatggagtaggcgatggtcacgagggccagagggatggcgacgaagggcatgcgccagtagaagcggtcggagagtttggagaagaagatggcggagagggcgccggcgacgtatggcgggacggtcatgagttgggcgtgggtgttggtgaagcccattgctttggtgatggtcggcatggtgaatttggttcctgtacgagtgagctgggaggctga

SEQ ID NO: 4833 - DNA, 216 bp, A.fumigatus
ctttttttcttttttttcaagtatatgtcctgtgaccttcggacagagccagataagggctatgcccgagcattcgagtcagtttcgaagcactgttctgggggatgctcaacatcaaaagactctacattgttctctataaaaaaactagtccttggctacaactgcgagcctgtgtacctatttgggaagggaaatgttgatagtgctctgtag

SEQ ID NO: 4834 - DNA, 258 bp, A.fumigatus
cactttccagctctgaataagaaacagcggaaacgctacgagaagaaaatggctgcgagagcggcgacgctgccgcctcagatccctgttcatcatcatgctacggatatcacgcctgcggattataaccgtgaacggacggaagatgttcttaccctggcggctgagagcattgagaagcggacggagattacgaagagtgcgagagatgcccggagaaaggcgattagggaggcgaacttcctgcgggggctgtga

SEQ ID NO: 4835 - DNA, 267 bp, A.fumigatus
aaagagaattgctcgagcgtcctggatgcatatgtacagatgtcccacggcagattacttaacccggaggcaacctcggattgccaggtgtgtccagtggcagatacggatacttttctggcacaagtgagcatcagttactcagatcgctggcgcaatgtggggctgttgttcgtgtacattgtgttcaacatctttgccgccatctttctgtattggctcattcgggtgcctaagaaaagatctcgcaagatcaaggaggagtaa

SEQ ID NO: 4836 - DNA, 945 bp, A.fumigatus
atccttgcgcggtcgtcggctcctgtggtgaagacctcccgatgtgtggtgctgtcgcatattctcgatgcagtgcccaagactatgcagatcgagaagtaccaattcaaactcttcgcgatgatgttctcgtctttcgaagagatcctcttcttggacgcggacgccttcccgttagagaagccagacatcctcttcacgaacgagcccttccggtcgaagaatatggtcacctggccggatttctgggccgacaccatctcgtcctactactacgacatagcatcgaagccgatgccctcaaagaccattcgccagtcgaccgaatccggcgagctactcctctccaagaagacgcactcgaaaacgctcctcctgagcgcgtactacaatttctggggcccagattactactgggccctgctgtcacagggcgcagccggagagggcgacaaagagaccttcgtcgcagccgctctgacaatggacgaaccgtactaccaagtcagagagcccatcgtggctctcggtcaccgcacccaatctggcctggccggctccgcaatggctcaattcgaccctgtcgaggactacgccctgacacagaagggagagtggcgcgtgcacggctccaaagctcccgcgccccgcgctttcttcatccacgcgaacttccccaagttcaaccccgccacggtcttcgacgagcaagccgtcaagccgacctttgaagatgacggcagctacacgcgcgcctggacgatccccgaagaggtaattgggaagttccgcacggatgtggagaagcagttttggagggagatcttgtggacggcgtgcgagctcgaaaccaagttccggtcctgggaggggcgtgagggtatatgccagcgagtcaaagactactggaacgcgatgttccccacgcagtcggtcaagacgtga

SEQ ID NO: 4837 - DNA, 438 bp, A.fumigatus
acggagcttttttcccgaaaagcatcgcccatcatggtcggttctctctctctcttctccgtcaatgccgtcctgctcatgtcggctgatgatggatctcgcatcttcgccaaatactactccccgcctcatcccccagctggtgctgcccccaatgcaacagattacccaggcgccaatccctacccaacgctgaaggatcaaaaggcgttcgagcagggtcttcttgagaagaccaacaagcagaccagtgatgtgatcctgtatgacaaccgggtggtcgtcttcaagatggagagcgacgttatgatctatgtggtcggaggcgccgatgagaacgaggttttgctgtacaatgttgtcctatcgttgcgagatgccctgggaattttgttcaagtacgatttcggctgttttggcagctacatgctcaattga

SEQ ID NO: 4838 - DNA, 291 bp, A.fumigatus
  unsure (288): Identity of nucleotide sequences at the above locations are unknown.
gcaatcaacgagaaattcaagcagcttgacttccaggactgtaaagtccgtgtcttgaacgtcgattctcaggcatcgtttgacaacatcctgatttccgtcattggtgaaatttccaacaaatccgagccgtcccggaagtttgtgcagactttcgtgctcgctgagcagcccaacggctactatgttctcaatgatatcttccggtacttggtcgacgaggaggaggaggaggagataataaagtcttcaccacggggctggaagtatcgacggtgtcatttttantaa

SEQ ID NO: 4839 - DNA, 540 bp, A.fumigatus
atttcttcctctttctgcacttattgtcgcctttcgtcgcatagaagctttctgccattgtccatatacttttggcctcccaagaccttttctccaactcatctcccaccacagcttcttacaatgtccgacacgacccagcctcctatgaacggcaactaccccgcgcaacatgcgtatcctgactcctacaaccacgcccatactgccgtgaccagtgtgtccaacttccagccagcgcagtcatctacccccaccaatgcccctcctaatgaccagaaaaatggaatctccaaggatgaagttgggtggtactttgttgagcagtactacaccaacatgagccgtagcccagagaagctacacctcttctactcccggcggtcccagctcgtctttggtaccgaggcagagtcggttcctgtcgcagtcggccagaaggtgagttggatgcgcctcgaactggttgcgccccagagagcattgctaactcgactacccatccgcttaggcaatcaacgagaaattcaagcagcttga

SEQ ID NO: 4840 - DNA, 510 bp, A.fumigatus
  unsure (385): Identity of nucleotide sequences at the above locations are unknown.
acgtgtgcgtcaatatgtgccttcttaacccgtttgcatgatactatcgcggcaacgctatcctctagtgggtccaactttcgtcatttactgacagagattgcgcttggaacccggagtcacctcctcgaacactttaagcgatatgccgtcaacggggccgggggtcttatggtcactaaggacatgacacagtatgcagatctgttgaagtcttgggacatcgacgaacacgtcaaaggaccaggtggtctactagacgttctgctagaagtaggcagtctattcgtcattgggccagaagctttactggagagaattcgtgcaggagccagctctgatgcaagcagacggccaggggctagtcgcactgatactgaacggngacaggagctactagagactggccacatcgagccaggccttagtgtacaggagatcagagcttatgtgtctcgcagggaggattccagcactacagcaatgcaaaatgtgctcaacctcctgtga

SEQ ID NO: 4841 - DNA, 270 bp, A.fumigatus
tcttcgtggattgttctatggttcgctaccatgattaatccatggctactgatcacaagcttcctggcactagccatcctatcactggtttattgcgcgaagaagttagaaccagaaatcacttcctcgtctttcgacaatgagcccttctcattgttctatttcgaggaacccgaaaccatgcttattgaacaccgaaaatggaactttttcccctcgtttcatgggggtaaggccggggaactggttgatggccacatgccaaattaa

SEQ ID NO: 4842 - DNA, 360 bp, A.fumigatus
tttctggtcctggaacagcgtgtatccagcatacaagaacagttgcagcttgaccgggccaacaatgacaagatcgatccatccttcaacatttcctacgatgtgttgccctttgagagcggtggaggacccctacaattatcgtatggcaactatctcggcgcctacgcccgtacctggcagaagagcaggaggaatacattagcagattcgacattgataatcgcagtgtccttgtcgaaggtatccgtacacccttgcaggaaaaggactgcagatgggttatcctcgcccacgacttttctccctcgagtcaagaagtatggaggcggcttcccgctcacagcgtcttcgtcttaa

SEQ ID NO: 4843 - DNA, 498 bp, A.fumigatus
acgcatggaggcaccacaaaatcaaatcctctatgccagcaccacagcaacaacctactatgccagggccattgcctacgcagccacaggagatatcccctctgcgaaaaccaacagtctctcttccatgatgcatgggcgcgggtccctgagacccgacgcgcctacaatggcaagatgatcgacgtcctcaaagtcgcagatgcaatgctagaaggagaaatcgagtaccgctgcacaaactatgataaagcctttgccgcgctccgtcgcgcaattgacctggaagataagttgccgtacagcgagccttggtcatggatgcagccggttcgccatgcgtatgctgctcttatgatggagcagggttaccttgaggaagcattgcaggtttatcgtgcggacctaggattagacacttcaattattcggccgcgcagacacccgaataatgtctggtccctgcaggggtatcatgaatgcttggttcgattgggg

SEQ ID NO: 4844 - DNA, 1305 bp, A.fumigatus
ttcattatctccaagatattcaaatctttcattatgtcttcccttctagccatgagcccagtactagccagcaacgaatactatgacctcggctcctttggccgcaccatcaccaccaccagcactgatgctcaaatttggttcaaccgaggcctgacttgggtatactcctttaatcatgcagaaggagcttattgcttccaacaagccctcgcacatgatcctgaatgcgcaatggcatactggggtcttgcctacgcagtcggccccaactacaacaaaccgtgggaaaagttcgaccagggcgaccttcacacctccgttcaacgcgggtacaatgcagcgcgagaggcaaggaaacacgccgctgtgagagcaacaccccttgagcgagccttagttgatgcaattcaatctcgattcccgaccggtgaacctgctgaggactacccagccgtcaatagggattatgctgctgccatgaaaacggtttacgaaacctacggacgggatctaaatgttgcgacgctgtacgctgatgcattgatgaatatgacaccatgggcgctgtgggatctgtttacgggtaaaccgaatccaaaggcgccaacgatggaggtgaaagccgtactcgaacgcgccctggcacaggaggaggatggcgcactccttaacccgggacttcttcatctttacattcatttcgttgaaatgtcacccacccctgagctgggcatcaacgctgcagatcatttgagggaccttgtccccgatgctggccatatccaccacatgccaacacatctagacatccttattggtgactggcggcggtccatatcctcaaactacaagtcgaccttggcagatgataaatatttccggaaatcaggcgccaaaaacttctatacattttaccgtctgcatgactatcattccttgatatatgcggcgatgttcgccggcaaatcaaaggtcgcatttgacgccgtcacacgcatggaatccacagtaccagaagaagtcctccaaatccggtccccacctatggcagactggctagaacagttcctacccattcgcctgcacataatggtccgcttcgggatgtggaaggaacttaaacgcatggaggcaccacaaaatcaaatcctctatgccagcaccacagcaacaacctactatgccagggccattgcctacgcagccacaggagatatcccctctgcgaaaaccaacagtctctcttccatgatgcatgggcgcgggtccctgagacccgacgcgcctacaatggcaagatga

SEQ ID NO: 4845 - DNA, 1203 bp, A.fumigatus
  unsure (10): Identity of nucleotide sequences at the above locations are unknown.
ctgacggctnttgaaacccgcggtgaagacgatttgccctataccattctcaacgccattacgtccaatatagttctgtacttcatgaccaacttgaggagagaacccggggctttcttcttctttgtcttcacttcgttcatcctgactctgaccatgtccatgttcttccggtctatggcatcgctatccagatcccttgtccaagttctgcccttctccgccgtgctacttctcggtctcagcatgtacactgggttcgctatcccgactggatatatgctgggctgggctcgctggattgcgtacatcaatcccatcagctatggctttgagtcactgatgatcaatgagttccacaaccgcgatttcccgtgcatggactatgtcccatcgggtcctggctatacggatgtcgggctcaacaaccgtgtttgctccaccgtcagatcagtgcctggacaagcctttgtcaatggcaatgcttacattgagtcagcatatagctataccgcttctcacaaatggagaaacatcggtgtcatattcgcttacatgttcctgcttggggcggtctatctcgttgcttctgacttcatcaccgagaagaagccgaagggcgagatcctggtatttcctcgcggacacaaggctctgaagaaaggcaagtcagatgaggatcttgaagggggtggtggccgcagcgccacagtcgagaagatcggctcagatggccttgccatgattgaacgccaaaccgcaatcttccagtggaaggatgtctgcttcgatatcaagattggaaaggagaattgcaggattcttgaccatgttgacggatgggtcaaaccgggaatcttgacggcgcttatgggtgtttcgggtgctggaaagaccacgctcttggatgtccttgctacgcgcaccacgatggggattatcagtggagaaatgctcgtcgatggtcaaccgcgtgatgagtcctttcaacgtaagaccggctatgctcagcaacaagatctgcatttgagtactgctaccgtgcgcgaggcacttgagttctctgctcttctacgtcaatctgctcacgttcctcgtcaagagaagattgactacgtgacagaagtgatcaagcttcttgacatgacggagtatgcgtcttcaccacggggctggaaagagccgctctatttgcaattctac

SEQ ID NO: 4846 - DNA, 1275 bp, A.fumigatus
ctccggtggaagacttgttcgagtttcacgagctgttatatcaccatggcgtctgacggaatgcctccagccaaaaggctgaagagctctaaccttccaccacacctgcgcgatgcgaagcgcaaagacatcgacaactgggaaaccaaccggatgctcacgtctggagtcgcgcagagacgcgattttgaaggcgactttctgccagaagatgaagatggtactcgagtccatctcctggtccacgatctgcgaccgccgttcctggacgggcgcacgatttttaccaagcaactggagcctatctcagccgtccgcgatccgcagagcgatatggcggtgttcagccgtaaagggagcaaggtagtccgagagcggcgtcagcaacgagagcgtcaaaaacaagcgcaagaggcaacaacaatggcaggcacggcgctgggcaatatcatgggtgtcaaggaagatgagggcgacagcgctgttgccatgccggtagaggatacttatagaagtgggaacaagtttgcccagcacctgaaaaaggatgaaggcggacaaagctctttcagcaagagcaagacgcttcgcgaacaaagggaatatctgcctgcattcgccgtacgagaggaattattacgagtcatacgagacaatcaagtgattgtggtggttggtgagacaggatctgggaaaacgacccaactgacacaatttcttcatgaggatgggtactcaaaatacggcataattggctgtacgcaacctagacgagtggctgctatgagcgttgcgaaacgtgtgagcgaagagatggaagtggatcttggcgccgaagttggttatgccattcgatttgaggattgcaccagcaaggatacagtcatcaagtatatgactgacggtgtccttctgcgagaatcgctggttcagccggatctggacaagtattcttgcatcatcatggatgaagcacacgaaagagctttaaataccgatgttctgatgggccttttgaagaaggtattggcgcgtcgaagggatctgaagctgatcgtcacctcagccaccatgaattcagaacgcttttctcgattctttggtggtgcccccgagtttatcatccctggacgaacgttcccggtggacctccacttctcccgtactccgtgcgaggactacgtcgacagtgcggtcaagcaggtcttggcaattcatgtctcgcaggggccgggggtcttcaccacggggctggaaggatcaacgggagctcaa

SEQ ID NO: 4847 - DNA, 183 bp, A.fumigatus
  unsure (81): Identity of nucleotide sequences at the above locations are unknown.
gcggcagaaaggatacttgcggcatatgggagttgctgttccccccgccctcttaccccgcagaagaccatcaactggtcntacaccaccacgcatcaacaacctagagataccaatatccaacactatgagatttctcccttggcatactcgaataaccggattgtttcaaatatgagataa

SEQ ID NO: 4848 - DNA, 231 bp, A.fumigatus
catattgtactaattttgcgtcaattccgcagttccttaattcaagatgagtacgtgcacattcgacattacaccgagcgccgatggcctttttcgtcgaaagattctagcagactgacaacgactacagcgaagggtacctccagcttcggcaagcgccacaacaagtctcacaccctttgccggcgttgtggtcagtatttcacctttcgagatttttctggtggatga

SEQ ID NO: 4849 - DNA, 300 bp, A.fumigatus
tatgacggcaaagagaagacccgtcccaacaccaactccatgggaaagcatcattttcgccttgcattgaaaccggtcacttcaaatgccaggccattcataccagccctctccagcctccgagaacgagaacgcgacgccgaatttgatttagtggatctcgggaccacgggcgcccttgggagtgccgacctggaagccgttcttgaagcgacggtggacatccttgaggtggctcattctgccggtgccggtggtctttcttctcttggccttctcgctccagttgtctgttgttaa

SEQ ID NO: 4850 - DNA, 618 bp, A.fumigatus
agtggcccctcgcagccccgtggtgaagacagtcctgtaccgcaacgagctccctccgccgatgaggatgatcttcttgctgctttcgacgcctctgcgccggtagatgcttcgacgaacttcccgatcccgagcccgagcccctcgccgcagatcgcgcagagcgcgtctaccgcggcggctcagcagcagcaccagaccgctggaatgtcgttcagcgaagtcgacgatgatccttttggtctcaatcagctaaagccgaagccaacagcaaccccggagcccgctcagaccgacgacgatgatttcctcggcttgctgggaaagccagtttcggaggtctctcgcccggcacccgagccgtcgccgaaaccctcatctccggccatccatgagcatcatgcgccttcccccaagccgtctagtggtgccgatcgagcgattgcagagcttgtagacatgggctttcccgcagacaaggccagccaggcactgcgggcgacggagtctgggactgacgtccaagccgctgtgagtttgcttctgacacaggcgcatgaagaagcccgtcagaaatcgaaaagtaggacaccagccgtcgatcgtgagttcgaccat

SEQ ID NO: 4851 - DNA, 681 bp, A.fumigatus
actatgtctgttggccgtgcagtgcggggtgttgatctcgggatatatcaccccgatgttatatacctcttcttccctcgactttctgaaccatcatacgaacttatccgaacaaacaagcaaatcgaagcagacaaaaaggaagacatgaagaaatacgctctcattggcaccggcggccgcgccatgttcttctacacggccattgtgcgcgactttcccaccaccgcgcagctggtcgccttttgcgataccaacaccacccggatggcatacgccaacagtctgctagaggcactcggccatgcgccagtcccaacctacgtcgccagcgacttcgacaagatgatcgcagacaccaaaccggacgagatcatcgtgacgaccattgaccgcacgcaccaccagtacatcatccgcgctctggagctcgggtgcaacgtcatcaccgagaagcccatgacgattgacgcgccgcgctgccgggccatcatcgacgccgtggagcgcacacagcgccaggtccgagtgaccttcaactaccggtatgcgccgcacaacagcaagatcgccgcgctgctggcctcggacgcaatcggggatgtccactccgtgcactttgagtggatgctcaacacgtcgcatggcgctgactatttccggcgctgggcacgccaataa

SEQ ID NO: 4852 - DNA, 516 bp, A.fumigatus
ggcgcaacgcgggctggaatgcaacatgggcaatcacccaaccaagaacacgaacaagagatgacacaggaagaccatatcacgcccgttcaaaaccctcgcaatgatcccatcaaggagaaagcggctcagttcctggctactgtaaacgaagaccgaacctttacagtagaggaggagaaagccctcctgagacggatcgaccggcgcatcctccctttgctgttgggagcatactttttccagcagctggacaaatcgtccccctcgtatgtgtccatttccggcattgtcgaagatgcaaacctccacggccagcaatactcctggctggggtccatcttgtacctggcgcatctggtcatgcacccgatcgccgccctgctgctctccaaattacctacagggaaactgaatcgggtcggcggtacttctccgggggcagctcactcccctatcatggggggccgcaccaaattttccccattctggcctgggttacgaatcccctcctaa

SEQ ID NO: 4853 - DNA, 603 bp, A.fumigatus
gttggaccaacatggaggcgtaatttggcaaccccgtgggaaacggctttttcggtggatagatcactcgctgcaaacaattcagaagactgttggactgggtgttccattggatgctgggtaagtggaggttcagacatactattgacagggcggaatgaccgacgcatatggatccttgaaacagcccgaagcgctcttacgggctgtttttcttcggctaacctagccagaggcttgttacagactggcacagaagtcatcttgtatcgtggccatgatttacctgatcttatgtcaatctcgggcaaggactcactgtggcaccatgcacagtatcctccagcgtacctccattcccagtggccgatccgctcgagtgttgtctcacaagacggacgatacatagccattgcaggtagacggggactggcgcattacagcgtcaatagtggtcgctggaaagtctttgaagatccgaagacagaaaattcattcgccgttcgcggcggcatgtgctggtatgggcacattttgattgccgccgtcgaaagcgatggctcctacgaggttcgtcctttgagtaccactaaactgttttaa

SEQ ID NO: 4854 - DNA, 195 bp, A.fumigatus
aattcgctatacgggtatgatcttccctttttcaccttacacatgccatccatgttgccatatgtactgatgttgagaagacccatttattcctaccatatgtcctacaacatgatcttgtccgtggagacctcgcggcagcgctcacactatgccaacgtttctcccacctctcatatttccctcatgccttag

SEQ ID NO: 4855 - DNA, 690 bp, A.fumigatus
tcttccctttttcaccttacacatgccatccatgttgccatatgtactgatgttgagaagacccatttattcctaccatatgtcctacaacatgatcttgtccgtggagacctcgcggcagcgctcacactatgccaacgtttctcccacctctcatatttccctcatgccttagaaatgcttttgcaccacgtcctggatgacgatgttgataacgagaggaaagagagcaagacagatgatccctcacgaagacacgagccactattgccatccgtcatttcattccttcaagcatcactgccgatcaaagtatttttggacatcgttgtccagtgcacaaggaagaccgagcttcgctcatggcgcaccctgttcaaccacctgccccctccaaaggatcttttcgaacaggccctgaggctcaactcccttaagacggcagtggggtatctgctcgtcttacaagccatggaggacgaaggcgagggtggtcacgaggctccaattgaagactatgttgtccgcctcattggtcttgcatcacaaaatagtgattgggagctctgtggtgaactggcacggttcctaattgctcttgatgcatctggggatatgcttcgacgcgctatctcgcgggtcgggctgagagtcttcaccacggggctggaaggagccgcgccatcattg

SEQ ID NO: 4856 - DNA, 231 bp, A.fumigatus
tatatactagtttataacttcctcctatctattagttttaaatatatatatactaattattctgtttttattaaacatagtattactatactactctatataaataatattcttatatttttaaatttaaataatcttattaataacttccttaagcagctaggaaaattatttaaatatattaataatagcaaggtttctgtctacctagggattgatatactatattaa

SEQ ID NO: 4857 - DNA, 189 bp, A.fumigatus
cttatactagaaacctatctagatattacttttactatatctaagcttacttactttactaggaatcctagccctaattactttattatagtaaagtatatattttactatctagcagagatgcttttactcttattattttatccttctatacttagtaatcttaatagttttattaatactaattag

SEQ ID NO: 4858 - DNA, 951 bp, A.fumigatus
ccgttagattttcctctttggcacatgggtatctctgggtatgaggccactattatcgcctacatgtcacctctccttctagcaatcccaactctgaagactgcggtggccaagtacccacgacttttccactttctgtcactttctggactgctcgcctacaaggtacagaatcctaccaacagactcttcgtcactactttcagtgttgcctgcaatgctcttacatggtccggtattttccacgcggagaagacccagagctcccgcttggagtctcggatccttgcctggggcattggtttgatcatgtctagcgtcgccaaatttgcatgcagcaccaacaatcctgtctggcccactatgcatgcggagaacggtggatggaacaaaatgggtctacttcttggtattttggctgttctccgatctcacaggaagcctgtaccgagtggaggagactatttcccgtctactggcaagaagggcccttctctgttagccgcattcggtatgggtggtcttctgttcgccatgcactctcttctgtctgattccagcaccatgatttcatgggtctgggagggatatccggtgagaggaccgatcgctgtgcctcatggtgtgcttacaatcttcgcgatgggggccggtcttgtatatggtctcttctgcccacgcatcgctggaagctggactgcttttggtatcggttccctcggcgctgcgctacttacatgttacagccactggactggattctatggccgccggtccctgcgttttatgtcatggccggttgcccccgtcccgggctttttgggttgctcggccatttcttcccgcaccaacgttccgggctcggaggccctggctaccgcttcttggacccctttccaactaggggttggtgctttatccatttgtgtccccggcgggtccctttgttaa

SEQ ID NO: 4859 - DNA, 579 bp, A.fumigatus
aggatcacggagtatttcaatgtggccttaccggttgggggtgtttttgccaccccgttcatcggtttgttcttggatcatctgagtgttccaaacatgttggccatcattgtcatcctgacaacgctcattgaagccctgaacttcggtgcaagcagcttgggcggtttacaccaccgtgacgttgttcgtcctgctgcgcccgttgtactattcagccatgtcgtaagtgcttctctgtctcctgttcattttcgtgggctgacttcggctagggactacgccaccaaggtgttcggctttgcaacatttgggcgcgtgtatgggactattatttgcgtatccggcttggtgaacttcagtcagtacgcgctggacgcattgacacacggacccttcgacggcaacccaatccctgtcaatatcttcctggcagctgctgggttcgtggtaggtacggtactcgtcttgtatgtgcagattgctggtaagcacttgaaagagaagagattggccttggagagggatgaagagcaagagcgagaacgattgattccgattcaagaggaggacgcttga

SEQ ID NO: 4860 - DNA, 1161 bp, A.fumigatus
aaccagtccgactccaaattcttagaagccctacgcatgagagatcccaagcgacgtttcgaccatatctggagactctctaaggatgtgttgatctgcgaagcggaccctccaccggacgaggacgagcctttttcgaaagagagctccaagccactccggaggcatggtggttgcggtaacgcccagcccacgattcgtaaagagggtatcactttggttggaacatggaagcccaacaagagcatgatggatgaggatgagatgcagcagccagaaaagaaagtcattactcctcagatggccttgaatgtcttccgcaacatttcccatgaagatgttcggataatgggcttaagtaatgactacgctcgtcctgaatggatgatcatcactgttctgcctgtcccccctcctcctgtccgtcctagtgttctcgtcggtggtagcaccagcggccagcgcggtgaggatgatctgacttacaagttggctgagattatccgagcgaatcagaatgtccagcgatgcgaacaggaaggcgctcctgaacacgtcgtacgcgagtttgagtcgcttttgcagtaccacgttgccacctacatggacaatgatatcgctggtcagccgaaggctatgcagaaatcgaaccgaccggtcaaggctatccgaagccgtttgaagggtaaggagggtcgtcttagacagaacttgatgggcaagcgtgtcgatttctccgctcgtactgtcattactggcgatccgaacctgtctctagacgaggtcggtgttccaaggagtatcgctcggactctgacctaccccgaagttgttactccgtacaacatcgagaagctgcagcagcttgttgccaatggcccaaacgaacatcctggagctaggtatatcgtgcgggacaacggggagcgtattgacttacgccatgcccgaagagctggaggccaacaactgctgtatggctggaaagtcgagcggcatcttatggatggcgatatcattctgttcaatcgtcaaccttccctgcacaaggagtctatgatgggtcatcgtgtccgtgttatgccgtattcgactttccgactgaacctgtctgtcaccaccgtcttcaccacggggctggacggatccgagcttacgtaa

SEQ ID NO: 4861 - DNA, 378 bp, A.fumigatus
  unsure (199): Identity of nucleotide sequences at the above locations are unknown.
tcgacgcggatcttccagccctttggcgaatatctcggcactcagttcaccggtgtcaacgtgatcggctactatcaaacaattatgtatgaatcgctcggtatcacagggaacagagccacgctagttgccggtatttacaactgcgttggtcctctcgcgaacttaatcttcatcatcttcattctggacagggtangacgacgcaggcccatgatgtttggtgccatcggaatttccattgccttgatctgtgaagcagcattgaactcgcagaatgaggatggtagccgccatggctacagtatcggtggggttgtattcctcttctgcgtgaccatcatcttttccctgtcctttggcccttgcagttggtaa

SEQ ID NO: 4862 - DNA, 219 bp, A.fumigatus
ttgcaatcaagggtctatatgtctgaggtcatgcccatgcagattcgtggtaaaggcaacgcctttgcgacaggtatcggtaactgggccgtggctactctctgggcccaagtctctcctattgctctgggcaagcttggatggaagttctactttgtctttgtagcatggagtaagtttgcgccccaaagaaggtgtgatcgtcgtgaaacaggctaa

SEQ ID NO: 4863 - DNA, 243 bp, A.fumigatus
catggagtaagtttgcgccccaaagaaggtgtgatcgtcgtgaaacaggctaatgtgtcttgtctagacatctgcattaccctgccggtcatctatttctgcttcaaggaaaccaagcagaagtccctggaagagattgatttgctctttggtggtcgcgccctgggcactctgcccgagaatatggccgataagggcgaggaaaccggtatctctgtgacaaacgtggagcacagtgtttga

SEQ ID NO: 4864 - DNA, 885 bp, A.fumigatus
  unsure (813): Identity of nucleotide sequences at the above locations are unknown.
tatgagtgctctttccagccccgtggtgaagaccctgcagtggagtcatacgtgacaaccaaagacggagtatcactcccttaccggctcgagggcagcacggaccccaccgccccggtcattggcctgagcaactccatcctggtcgactggagcatctgggacggttttgtggatgccttcctatccaacccccaaaaccaaaactaccggatcctacgctacctcacacgcggccgccgccgcgactgcggtgagacacccatcaccgtcgacgtcctggcctcggacatcatcgcgctgctggacgcgctccgcatcccgcaggcgacgctcatcggggtcagcctcggcggcgtaacggtgctgaacacggcactgctgtaccccgcgcgtgtgacgcggttcatcgcctgcgacaccaacagctccgcgccggaatcgaaccgccaggcatggacggaccggcacgcaatggccgccagcgaaggggccgtgtcgcctgacacgcaggaacccatcattggcgagaagctggcggaggcgaccacgcggcggtggttcgtgcccgcaacgtacgagacgcagccggaggtcgcggcgcgggtcaaggaggtggtgcgcgccaacagcctcgagggattccacaagggcatgcaggcgctgtgtgcgtacgatgtgcgggagcggatggcggatgcgcgcgtgccgggcctgtttgtggcgggcgaaggcgacggattgctaccgcaaacaatgcagaagatggcgagtgacctcaacgggggcgcggagctgaagatcatcccccangcgggtcatctgccgatggtggagcagccacaggcttttacggaggtggtcaatagtttcttgcatccgtag

SEQ ID NO: 4865 - DNA, 540 bp, A.fumigatus
tcacaatgtcttaaattcaagggaatactgcagccatacagcgacacaccaattatgagagatcgtctgattataactgccatgtccactatggcttttgcatcagctcaagcatgcgacatcgtccctgcagtcacacatacattctatggattccccgacaatgatcccccgggtcctgcaatcgcctatgattgtggtcgtggcctcacagccgggggtatcggcacgttcgacgatcctctgaccttcgcgtcggcccctggcgagttcacgcagtgcgaagtcatcttctccccgtatctgcacaagtacattcggtttgaggatctttgctcccaatgtgtagaggagtggaccagttctggaatacgccacatcgatatctggacgggcagtaacaccaccgacggcggccaggaccagatcaactgcgaaatgaggctgaccccggcgggcgacttgtccgtcgtgcgtaatcccagcatggacctggatgttgatggtatgttgccactgcacttacatttgccatcttga

SEQ ID NO: 4866 - DNA, 417 bp, A.fumigatus
tctgttcacatggcgtccaccgactctgttccaggcagatttaatggtctgcacagaagagtcctcggcgaactgggtcttctgacactatggcattcatcgttggacgtcaaggttctctgtgcacagcgcttcatccgactcttcgcctatggaggctcaactctgatattagcttcatacctgtctgccttgggtatctcagatgaccgcattggcttatttatgaccttgactctggtcggcgatgtcgcaatcagctttttccttactctcttcgcagacggaataggccgcagagcagtcctggctttgggttctgcgctcatggcctgcagtggtgtcgtctttggtctatttgataattactggattctcttgaccgctgcagtgctcggtgtcatcagtcctagctga

SEQ ID NO: 4867 - DNA, 1383 bp, A.fumigatus
cagcgcgtgtccttccagccccgtggtgaagactatcttgttacctgctctaaggataaactcatcaagatctggaatcgacaagaacttacaccactagacaaagattatcccagcgttcataaaggagtaggagttacgtatccgtcttatattattgacaccagcgaaatcccatctcccgttttagaagcagagcttgctaaaaaccacatcagaagcttgaggccttactctcttttgatgacgttggatggacacggggcagcggttaatgcgatacagatgaacgacgatgagatcgtttctgcgtcgggggatcgtctcatcaagatttgggatatccacagcggtgcatgcaagaagactttgccggggcacgaaaaaggcattgcgtgtgtgcaattcgacaatcgacgtattatcagcggaagcaatgacgatacggtccgaatttttgaccatgcctctggtgcagaggtcgcttgtttacatggacatgctaacttggtaaggaccgtccaggctggcttcggtgatccaccgggagccgaggaagccatgagacttgaggctctggcaatcgagaatgaattctgggacgctcaacgctctggtgaaggggtggacttgggtcatagtgccatcagacgcgccggctatcatcaaaacactgcgggctcgcgaaaccctcgggatatcaaggccctgggtgccaaaatacctccaggcggaggtggcagtcaatggggtcggatcgtctcggggtcatacgacgaatcaatgataatctggaaaaaagacaaagagggccgatgggtcataagccagcgattacggcaggcagacgccgtcgtcaacgcttcacaggcgcagccgtcctcttcgcggacaatggttcctcccccgcgagttccgcagaatcagggtccggctttgcctcaggggcaagctgctgtgcctccccctggacaagcaccttccacacagcatctctctcccatcaaccaaatccctcatcaggctcctatcattcatccggcgcctggtcaacaaaatgctctctggaattcctggaacacggccaacgccaacgctcaagtagggcatgctgcgaatccggcactgttgatccaggcccagcatcatatgcagaacgcgcagcccatgccaaaccccttaccgccgcaccaccaccaccatgtccgcatgaaccgagctctgaacccgcaaggtggccacccaacgtcgaggatcttcaaactgcagttcgacgctcgcaagatcatctgcgccagccaggatcccaggatcgtgggatgggactttgttggcgatgacgaagaactcaatgaagcgtgccaattctttaccggtctataa

SEQ ID NO: 4868 - DNA, 750 bp, A.fumigatus
gcaccttcagcagcccagacaatccgcaaggaaataatggagaccgccattcgctggtcccgttcctccaacacagcggagcagcgctttctcttggtggacgtgacagggaaaaccttccgagtctgcagagtcactggattcgacggcaagaatctggaacatgaagtactgttgacgcacaccaaggtgcccgcctttcgcgccttcgattggtctcctgtggatgagtccctagttgctgtcggccaatcctctggtgacgcgactgtcttgcgtttgagcagcgagaatgcggagtctatttcattccccattcgccatcagcggtattgtaatgctgtctcgttcagcagacatggcctgctggctgctgggctggaccgagttcgcaatgacttttgtttgaatatttgggatgtcaatcagcgtatgatcaacaaaagtgccaagggatatgtcgagcctctcagaaaattggctagctcggagccgatcacgagtgtcaaattctttagagaccaaccggatgtgctggtcaccggggtgaagggccagtatgtgagaatatatgatcttcgaggtaagtgttgccactctttgcagaggtgttgtgcactgtcgtcttccttcttctggctggagtgcgcgactaattccctacagaaggccctggccatccatctctacaatttcccacgcgatgcgtccacaatcttgcgatcgactcgcttgatgagaactatatag

SEQ ID NO: 4869 - DNA, 201 bp, A.fumigatus
accttcgaccccctcgtggtgaagacagccgcacagcggatcgttggtgactgcagcttttgcaatggacactactgctcgaaacacagaatgctggaggctcactcctgtacggggttagaggactgcaaaaaggagtctcacgcccgaaatgccgacaagctcaacagcgagcgtacccaagtcatcaagggcgtataa

SEQ ID NO: 4870 - DNA, 378 bp, A.fumigatus
  unsure (258),(259): Identity of nucleotide sequences at the above locations are unknown.
cccccaaagggggttcccaatcccggattaaaaagctttgttgcaaaaaagccctttaatttgtgctttaaaggggccaaaagggctgtccttggttttagttttagcagggcagaacccccctattttgagcaaacccaaaagccattaattgggggatgtctggcggtgggttcccaccccttcatttcgaaggttcttaaacaggttcatctttggccgccagtttgcctccccccggccaagaagggccaaagnnccaaggagtcccttttccagaagctgtcttgggcctcaattcttaagttgaaacaggacaaaatttctttggaaacctttcgttaccatttgctccatcaatatcccttcaaaaagtag

SEQ ID NO: 4871 - DNA, 1509 bp, A.fumigatus
cgcggatcgccgctctctgtggtgaagatcagcgacgcactttaccccgttaatgatgcatttttggaaaatgtcgcagccgaggtggtctacaatgtccgtcgagtaaaccaccacccatccctagctctgtgggccggcggtaatgagatcgagagcttgatgcttccaatggccaggagagcggatcccacgggatattccaagtacattggggagtacgaaaagttatacatcagcctgatcttgcccctcgtgtacgagaacacacggtcgatcacatacagccccagcagcacaactgaagggtacttgtatgtcaatctctctgcgcctgtgccgatggcagaaaggtactcgaatactaccccgggctcatactatggcgacacggactattacaactacgacacgagcgtctccttcgactataatcactatcccgtcggccggtttgcgaatgaattcggtttccacagtatgcctagtttgcagacctggcagcaagctgttgaccccgaagactttcaattcaacagcagcgtggtggtgctccgcaatcatcactacactgcaggaggcttgttcactgacaacttcaagaattcgtccaaaggaatgggtgaaatgacgatgggcgtggaagcatactatccaatacccagcaaatccgactctgttgccaacttcagcgcctggtgccacgcaacgcaactcttccaagccgatctgtacaagtcccagattcagttctaccgccgaggcagcggaatgccagagcgtcagctagggtcgctgtactggcagttagaggacatctggcaagccccgacttgggcgggaatcgagtacgatggccggtggaaggttcttcactatgtggccagagacatctaccaacctataattgtgtcgcccttttggaactacactaccggtcgcttggaagtgtatgtgacatccgacttgtgggagcccgcgcagggcacggtgaacctgacctgggttgatctctcaggcaagtctattgctaacaatgccggcacccccgaaactgtcagcttcactgttggtgccctcaacacgaccaacatttacactaccaatatctctgagctttcgctgcctgatttgaaagactccattctcatcctttctctttctggggagggacgtcttccgaacgccagtagtaaaaaggcatttgtccaccagaaccatttcacgccggtctttcccaaagacctctctttgaaggatccaaagctcgaagtctcgtacagcccggaaagtaggaaatttacggtccaggctaccggaggggtttccctttacacttggctcgactacccggcaggtgcagtaggatactttgaggcgaatgcgtttgtactgcttccgggggttccaaaggaggtttcctttgtagcccaggaagggaatgtcacagatgactggctgcagagggtgacagtgcagagtctctgggatcagaaggtgagggactag

SEQ ID NO: 4872 - DNA, 192 bp, A.fumigatus
ggggggaagcccaaatttaaggcatattttgcgaaaagcaaccgcacagctttccagcagatatctgaatggatggcagctgggaaagtcaggactgttattgactctgtgtttgagtttgacgacatgcctagggcgattgagcggatcaagtctgggaaaacatgtgggaaaataatagttcacgtatag

SEQ ID NO: 4873 - DNA, 315 bp, A.fumigatus
ggacccattccccagatgggtcggtttggatccaacgattttgtcaaacgagtaccctcaatgcgacaagtcggtgggcccatgatttacacccactgcgaactgggtggaatcgctgccacgggcaatggtaggggcttcggcgacaagtttcccctggtgctggcggcgtatagcagctctcctcccaagacgattccaggggactggaagacatggacgatctggcagaattcggacaagtataagcatggaggagactcggacaaattcaatggcccgatgacccagttgaggaagttagccagtggttaa

SEQ ID NO: 4874 - DNA, 207 bp, A.fumigatus
cggggacctctacgcgttaccggcgctcggcgtgaagacacagtgtctgatattgcattctttgatctgctgcaggacctcgggccatacgttcgcatggcattctttgtaggcctcgacggcggagggcttcagatggacgatctgcgcgatgcggcggactggtgccatttttcgacgggttatgggctggttaggttgagatga

SEQ ID NO: 4875 - DNA, 324 bp, A.fumigatus
cgtcctgctggtggattcattgcagacatgctgtacaagtacacaggggccgtatggtcgaagaaagttcttctgtctttcctcggtgttgtcatgggtgctttccaactggccattggcctcgccgaccctcgatctgaagcaaccatgttcggtctcactgccggactggcatttttcctggaagcatgcaatggcaccaactttgccgtcgtacctcatgttcatcctttcgcgaatggtaagatccctgctttctgtccgttccctgcagccccacttgctaacgatctgtctctgcaggtgccgtctccggtgccgtag

SEQ ID NO: 4876 - DNA, 201 bp, A.fumigatus
cgatctgtctctgcaggtgccgtctccggtgccgtaggcggcatgggaaaccttggcggaatcatcttcgccatcatcttccgatacaatgagactcactacagccggtccctctggatcatcggcgtgatctccatcgccgccaacctggctgtttcgtggattcggccagtaccgaaatcccagatgatgcggcaatga

SEQ ID NO: 4877 - DNA, 273 bp, A.fumigatus
cccaagcaattgcactcaaagaccaacataagcgatagtgtcagcagaacaaaaagcggtgagtcctcacagttcccaggcactgttaccaagctgagtaccagcctggccaatatggatatggcaaacctagaataccacgacaagatacgtcagaactccatgtatatgaagaagctcgtgatcgacattctggacgttgacaggggacaggccatcccaggttcggggcgaacgtgcgggggagaagggtgcatacctcgcctcgcatga

SEQ ID NO: 4878 - DNA, 219 bp, A.fumigatus
  unsure (131): Identity of nucleotide sequences at the above locations are unknown.
agaagaagacagtctgaaaggcggtcggtagatagttcaggaaggtgcgctgatggtttgtgcctacccgttgcgggtggaccgtcaacaatcaacaacaccaccagtggccaatcagcgcttgccttcgntactagctggtttacgcacggttcctaccaggcccacagcttggtttgtttattgggttacaaatgcctgagcatacgcaccccatag

SEQ ID NO: 4879 - DNA, 216 bp, A.fumigatus
acttgcttgtcatacaggtacctcctagagcatggtctcaaggctgatggtcgtctcgatccggaggtgcctgaatcacacaacaacggaggctcctttgaaaccttcttcaccgagacgaacagcggcaaatacgtacctcgctccatcttcgttgaccttgatccatcggtgcgccacaactcggatctgagtccaggatcgaatggaagatga

SEQ ID NO: 4880 - DNA, 342 bp, A.fumigatus
actgttccctatgcagaccctcgtcctccctatcaccgcaaacaggctttcgactttggcgacggaggtggtggtaacatggctaacaacctttctattggctgtgactgcctgggggtcatcaaatactttgatgccatcgttacaggacccgacggtagtgcgaagaagttgcctaatgccatctgcctgcacgaacaggacaatggcatcggttggaagcactccaactggcggacaggccgtgctgtggtcacccgcaaccgcgaactagtcgtgcaattcatcattacgctggcaaactacgagtacatattcgcctacaagttcgatcagtctggc

SEQ ID NO: 4881 - DNA, 450 bp, A.fumigatus
tggcttcaacttcgctgctgcattctcaatgcttcatctttcaatcaatgtgcttatcatcattcaacacctcccgacatggctcctcaccctctagcaatcctctccgaagaggagactaaccttgcgcgcgacgtcgtcattgcagagcatcccaacacggtcattagtttccgtgagatctacctgttggaacctcccaaggaccagctgcgcgaattcttagctcttgagcacgctggtcgcctcagcccaaccacgcctcgacctcctcgactcgctacttgccaatacgatgtgattggagccgaccacatcccctccttccatgaatccgttgtcgacgtggtcgcgcgcaagcgtgtcaagcaccacattgtcggaaagcagcatcatgctccgcttactatgtgcgttgaaaaacatgtctcacaaaggcatacgtgctaa

SEQ ID NO: 4882 - DNA, 633 bp, A.fumigatus
tggcgatattgcagaagcgagttcgagaaccttgttgagcgatgttttagctcacccttgttcaagaaagccctggaagattttgacctgcctccaggatttgaggtcacaatcgagccatggccctatggtggcttggacaacactgaagagaatcggcggtacttccagggtctttgttttgctaccgacaagagcaagaataacccggatgcgaacttctactcctaccccctgccattgatccctgtcatggacgctcttacccaaaagatcattcgagtggatcgtccggcgactggcggcaagggagatggtttgaccgagcaaaccttcaagcgcgacattatcggacattgcaaggcctccgactacgtcccagagcttctgccagacggcactcggcgggatctgaagcccctgaatgtcgtacaacctgagggcccttcttttcgcatcacaaacgagtccttggtcgagtggcagaagtggagtttccgtgttggttttaatcctcgcgagggtgcgactatacacgatgtctggtacgatggtcgtagcgtgatgcaccgactgtctatcagcgagatggtagagttattcccagaggaatcacttggacaatttgattga

SEQ ID NO: 4883 - DNA, 264 bp, A.fumigatus
ataatgcgactttcacacgtactcctaggaactgcagctgcagctggcgttctggctagtcccaccccgaacgactatgtcgtgcatgaacgtcgtgctgtcctccctcgctcctggacggaggagaagagacttgataaggcctctatcttgcctatgaggattggtctcactcagtctaacctagatcgcggtcatgacttgttgatggagatgtatgtgacttgtctgaacctgggtgtattcgtcgttgatgagaggtag

SEQ ID NO: 4884 - DNA, 192 bp, A.fumigatus
ctgcatgcatctttaatcacagccgtgcctgttgtctcaaagaatgaaaggacgggctatgataagcttcagctagcctcctatggtctatcagaacacaaagataaaaaggtgcctagaacttccatttctagtatagtagaagtgatagtgcatatttcctccatcccccgctgtggtacaacgccatga

SEQ ID NO: 4885 - DNA, 300 bp, A.fumigatus
ggatctaggggatgtttacagtcaagaggatctcaacctgttcttttcaacatttgcacagtatgtcagctcctgctgtgtcctgtcatgactaacccgtccaggcaaattccccagggcactcatcccatcctgaaggccgtcgacggcgctcaagccccaaccagcgtgaccaatgcagggcccgaatccgacctggactttcaaatctcgtatccgatcatctggccgcagaactccattctctttcaaacagatgatccgtcttacaccgacggggctagcaggatacgcggtgaa

SEQ ID NO: 4886 - DNA, 270 bp, A.fumigatus
gtgggctgtgttagtttttacggcttcccgagccactattacaaggagaagttccccaacgtcgggagcaaggaaattgcgaacaaggtgcttagtgcgttgaaggaggcgggcatcaaagcggagggagtcaaaagaggtttagatcatggggtctgggccagctttaaatgcggtaagtgcaagtgcctcaacatgtccgttgcaccaataggtgggcaaatagtaatgattgggatgcagcatttgacccagactccaaccccttga

SEQ ID NO: 4887 - DNA, 525 bp, A.fumigatus
gtgcaagtgcctcaacatgtccgttgcaccaataggtgggcaaatagtaatgattgggatgcagcatttgacccagactccaaccccttgaacgttccgatagtgcaggtgtcattgttcaacaccgaggatcctgcccagcactaccgactcggacaagcggtgtccaagctgcgcgatgataatatcctgatcattgtatcgggtatggcagtccacaacctgcgtgatctgcagttcacttggggcaaccccaagccaatgccgtacactacaagctttgacgaggctctgaaggacgctgtcacgaagccgcctgcggaaagagagcaggctatgagtgacctcctcaaacgacccgatgcccgtcaagcacatccttcctttgatcatctgctgccaattcatattggagctggcgctgcgggggatgatcttggaaaaagactctggacgctgaaggagggaagcatgagctgggcgcagtatagatttggtgatgtaggcaataatagcgcgctgtag

SEQ ID NO: 4888 - DNA, 183 bp, A.fumigatus
ctctatgacttcgcgaatcacaggtctttcttgcagcgcgggtacccgactatgaagaagcacaacccccagactcccattctgatccgggaggcagcaggcactttgcatagagtatatgctcgatacggtacgacagatagtcacaatcgaacaagtcaatggaagagcaatgggtgctaa

SEQ ID NO: 4889 - DNA, 432 bp, A.fumigatus
cttgtgcgaacaggtggcgggtccaaaacctggactatcatgtatgacactcgtctcctcaaggaggacagcgacgattccacttcgacctcgctgacggtcaacccgacccttgtggccaccatcacgaaggacagcgccaatcccacagccaccatcccagctgaaatcctgacagcaccctcggccaccttcacgaagcaccctggcgtcgcgcaggacatgccctccgtcaatgtgtcctcgtctgctgctgctgctgcgtcaaagtcggcaggcacttcttctgcctctgcatcggcctcatccagcacgccgtcagcgtcaccctccggtagcgctgggtcgggtgcaagtttgagtcgctcggtgggggccgctgggccaattataggggcggttttcattccattggttatgtcttggttctaa

SEQ ID NO: 4890 - DNA, 1884 bp, A.fumigatus
aacagaaatggtccaagaatgctgaccgcgaaccggcatgcctggcttcagaccactggtaagatccattacgaaccggactctgtattttccttgctggcgcagcgctcaggcagcgagcctttggataaggatgcattcctcgcgccgctacttaatgtgaaagatttagcgcaaggagacgtccttccacatttattaaaaacgcggtcaactatacatccgaagagctttttacacgtggattctcgatttgtttggcttggatactggtccggagctctcgcgcgaatcaaaatcgaggggagaatatcattttatttcggcccaggagaagaaaatcccaaatacgggatacaatttgaaccagataccctcaagcagcggccgggactactaaatccaaccatcggcttatatcaactcagggcgcagaaaagcgtatacaaattccttgtttcttgtgcttctagggtttcgcagcctctaatgctcggcgatcatccaagcgacagcactgatggtggcacctcactttcgcttctgagcaggtctgcacgtatggactataggagaccggactgcatagattggtcatacttacaaagcgtattagaagcatccgctgatgaagcactggacgatttatggcggcttcgcactgatgcggaattctggcttctgcgcatgatggagatgcggaaaaatacatcgaccttgttggattgtgccttcaaccggatcgatacatttgtctgcttaagcgaacgaatcaaggaaattcggctgaacagtgggcggattgagccgtccattccctgcgataacatcgacctgaagaacgtgatatctctggaccgtgtcttccgctccattcttaacagggcccttgaatcggtgcaaaacatggcgcggtcctcagagtggacgttgaatgggaccaagacattttgctatctctttgacatgataaaagaaaatgacccaacgctacgtgtgatcggcgtacgtacggtcttgaggaccatcgaacgtgagatgtcaaaagccaatattggtgatctgatgccatttcccatcgcgcaagccctcaatgatatgtcagtcgtggctgtttgcatgcaggagacttccaatcattaccagtacatacgcagcctccccaccgagtatgcctcagttgcaaatgatgcagaaactgagtggaacgaacgtgagcgcccatggatattgcttgttgagagtacactacaaaatctgggccgcaaagtgaacaaactcaacatctccatttctgatgaagcaaaatcgttggaggaacggcaccgcaacttttggaacactattgataagtgcatgcgtaataatgtgacgcccagtcacctcgttgctattatccagcgtgaggctccgattccagcagcgcctacctttggatccgatgcttcttctattgcatggagcacacaacggactgacttagaagtgactgaaacccagaagaaaagggcaagaggacgtaaagttcaatctcatacatcaagatccctgcgcagagccgtcacggcatcaaccgtagttgagccgcccagcttacccctggttcgtatccaaaaagaagaggataaagatttctggaaccgtcttttaaatgataaaggccagacaacattccgcagctggaaatcctttctactgagtataggattctctttgacgcctcaactggggtctggccgtcgcttcgaatggaagacccatgagggaagatgtcatgcaattgtctttcacgagccgcacgggcataacggagtcgatctccccctttatcgggggcgcgaattgtgggctcgtcttcaccacggggctggaagggccgcgcat

SEQ ID NO: 4891 - DNA, 285 bp, A.fumigatus
ggcctgtatagccacgagacattttgtgtatggcacaccgttatccggcagctctggggggaaggaaggtatagagatatggcaggtctctgtcaaagactgtgctggcgtcttgcgctactcggagatgaatacgattatagtcagcaactacaactgaacttcgatgcttcgctgaccttttatttgctcggacaggcacaggtggcgcagggaaacctgcgtgatgctaggacagcctttgaggggtcagtcatgttgcgaaagtcggcttgtccccagtga

SEQ ID NO: 4892 - DNA, 1149 bp, A.fumigatus
  unsure (10): Identity of nucleotide sequences at the above locations are unknown.
tttctgacanatgcttcccttagattccgtaaggacatcttgaaaatgaacccttcgagatttgagatcggtcccgtgtataacacaaacccgcgggaccggaaaacactacgaggcggtcagatgaaaccaatctccaaagagctagtattcgatatcgatttgacagattatgacgacattcggtcttgctgcaccaaagcaaatatttgtcgaaaatgctggactttcgtgactatggcgatgaaagtggtggatactgcgttgcgtgaagactttggcttcgagcacatcctttgggtgtactcaggtcgtcgtggtgctcacgcatgggtgtgcgatgcccgtgctcgttgtctccccgatgaccggcgcagggccattgccggctatctcgacgttgtgagaggaggatcccaaagcgggaagcgcgtgaatataaagcggccgttacatccgcatatgtcccgtagtcttgaaattctcaaacccttcttcgcccaaactacacttatcgaccaggatacattcgcaagctcagaacaagcagagcgcctcctctcattgctgccggacaagacactgaatgatgcactgcgcaagaaatgggattcgtcgcctggccggtccagtacgaacaaatgggcggacatcgacgcgcttgcaaagactggcaagagcagcactcttaatcctactactctgagagacgcgaaacaggatatcgtactcgaatatacatacccgcgactcgacgctgaagtcagcaagaaaatgatccatttactcaagagcccttttgtcatccatcccggtactgggcgtgtttgtgttcccattgacgccaaaaaagcggacggattcgatcctctttccgtcccaacagtcactcaattactggcggagatagatgcctgggatgctgagcactctagcggtaatgcaggcgccgaagctggtcaagatgaaagccacacacctagcgactcccagggaagtcgcaaattgcaagattacgagaagaccagccttaagccatatattgactacttccgttcgttcatcgcttctctaaacaaagaggaacgcgtcggcaaacgaggaaatgaagatccggatgaggtaaaatcggaaagcatggaattttaa

SEQ ID NO: 4893 - DNA, 474 bp, A.fumigatus
  unsure (119),(171),(222): Identity of nucleotide sequences at the above locations are unknown.
tccagaccgttgttcgggatgttctgttccagatcgaggaggtgttcatatttttttaagcctgacttcgcccacgcacaaactgccgagcaagattggaccagacagagcttttacgntgttcttcctttcgagaaccttgacggagacctgcagactttcttcgaacgntacttcgaagagagaggcatcaacgctgagctcgccaacatgatccccgantacattcaggtcaaggagcagaaggaatacgtccgctggctcgagagtaagtttaatcactgtcattacgccttcgctcgtgtagctaacattgctggtcgcagacgtcaagaacttcgtcgccgcttaaataccgaaatcttttcggcgaaaaagtgctctgaagtccttactaggtcttctcgtgcattgtaccaaaatccattgaaaaatcataactacttatccgctattcccccattgtatcattag

SEQ ID NO: 4894 - DNA, 954 bp, A.fumigatus
agacgcaagtatggcagcgccaatgtgtggcggtattgttgcgaggtgtttgattacctggcgctgggcgcacttgtgcttggggccagctcggaattggaaccgaccggctcaactatgaacgacaccacccagtccacgatgccgattgatggcgcggaactggagacggaagtacttaactcaagaggggaggtcacaatgagcacttacagacggcggcaacgatcttcttcggacgcgtcgactgattccagaaacctctccccaccacgggatatctccgctgtgcctggccaggctcccgccagatctggcgccccgggtactggggcttcgggcaacggagccggtagcaacaccagccggaccggtgctgtgctctgcgtgcacggcggcctttcgccgctgatagatacagtggataaaattcgcctcattgacaggaaacaagaagtcccacatgagggcgccatgtgcgacttgctctggtcagacccggacgaaatcgaagggtggggattgagtccgcgtggtgcaggcttcttgtttggtggagacatcgtgaagcagtttaattacaagaacgacctgtccttggtcgctagagctcaccagctcgtcatggagggctacaaggagatgtttgacggcgggatcgtcactgtctggtcagcccctaactactgctaccgatgtggcaacgtagccgcaatactggagctcggcgaggatacaagtaacgggggcacagttgctagaagcaacggtgattatggacggagtaatggggtctcaggcgtagacagcggtggttcacgggtcgtcagtcccggtagaaggtacagagtgtttgaggccgccgcgcaggacacgaggggcatgcctgcgaagaaacccgttgctgattatttcctggtgaggttttccccctttccctttgagacacgctga

SEQ ID NO: 4895 - DNA, 243 bp, A.fumigatus
gcgaagatgggttcccttcccgagccggcttatctttacaaaaatgttgtccacgacccgacagtcccatatgttcagtcggccgagggaatgtacattcaccttgacaatgggcagagaattctcgacgctacctgcggcgcggctgtttctgctatcggacacgatgtagaccgtgtgaaacaagcgataatctcacagctggatcaagtcgaatactcccaccctggattctttcctaat

SEQ ID NO: 4896 - DNA, 240 bp, A.fumigatus
aatttacttagaccatgtttatgcatcccagcctgcccaccatcagtcaatcaatatattctccaaaactcaatcacttttttttcggctcgtggataccttcatgatagtctacttatattagatcagctgctcctcccacatctctccgatattttcgagatcttcactctgcaagttcctgacttgcttccacctggaaaaattacctcccctttgccttccccgcctcagttttga

SEQ ID NO: 4897 - DNA, 768 bp, A.fumigatus
tctatggaatctgttgaacggaagtcagaatcgagctacttgggtatgcgcaacatgcagcccgagcagcgtctttctttggatcctccccgcttgaggtcaacaccccaggatgagcttcatgatcttctgtgtgttgggtttggacccgcttccctggccattgccattgctttgcatgacgctctggaccctcgattgaacaagtccgcttccaatatccatgcacagcctaagatctgcttcctggagcgccagaagcaatttgcgtggcactcgggtatgctggtccccggttccaagatgcagatctccttcatcaaggatctcgcaactctccgggacccccgcagcagttttacttttctcaactacctccaccagaagggccgtctgattcacttcactaacctcagcaccttcctgccggctcggctggagttcgaggactacatgcgttggtgtgcgcaacaattttcggatgtagtggcttacggggaagaggtggtcgaagtgattcccgggaagtctgatcccagcagctcggtggttgacttcttcactgttcggtcgcgcaacgttgagacgggcgagatcagtgccaggaggacccgcaaggtcgttattgcaatcggaggcactgcaaagatgccatccggactgccccaggatccccggattatacactcgtccaagtactgcacaacgctgccggccctgttgaaggacaagtcgaagccttacaacattgccgttttgggcagctga

SEQ ID NO: 4898 - DNA, 669 bp, A.fumigatus
tcagctgcccaaaacggcaatgttgtaaggcttcgacttgtccttcaacagggccggcagcgttgtgcagtacttggacgagtgtataatccggggatcctggggcagtccggatggcatctttgcagtgcctccgattgcaataacgaccttgcgggtcctcctggcactgatctcgcccgtctcaacgttgcgcgaccgaacagtgaagaagtcaaccaccgagctgctgggatcagacttcccgggaatcacttcgaccacctcttccccgtaagccactacatccgaaaattgttgcgcacaccaacgcatgtagtcctcgaactccagccgagccggcaggaaggtgctgaggttagtgaagtgaatcagacggcccttctggtggaggtagttgagaaaagtaaaactgctgcgggggtcccggagagttgcgagatccttgatgaaggagatctgcatcttggaaccggggaccagcatacccgagtgccacgcaaattgcttctggcgctccaggaagcagatcttaggctgtgcatggatattggaagcggacttgttcaatcgagggtccagagcgtcatgcaaagcaatggcaatggccagggaagcgggtccaaacccaacacacagaagatcatgaagctcatcctggggtgttga

SEQ ID NO: 4899 - DNA, 651 bp, A.fumigatus
cctctctccacggttaactcacagtccgcccagtccgctgccactcatgccttccttaaatcccaaccctcctcaagcagcctgtcttccgctgcggcagcggcagctctgcgaagtctcacacctaccccgacgcccgtcgaaaatgtccagacaaagagaatgattcaaaggcgggcctccgtaacatcgcagaccagcatgacaggtagcctccgtccagccagcagggcagcccttcgccgcagcaatagctcaagctccatgagcaacagaacgttccgagaacaatctccgcgccgaccggctaccagtaacggccaagtggatgtcgtgccgcccctgccctctatgcctccaggattcggaggccggaaaaatcctggtcggcgctccgtcagcctggaaccaagcgtacggttcaattcctcgcctacaaataaggcgctgggtcgcggtgtgagtgtcgacagatcgttgcgatcgccatctagccagtcgcccgtccaatccaaaccattgtctaccgttcctgagcttgaacgcaccagcagtcggaactcgatcaatttctcatatccgatgaatggtcgaccaatctccccaactgtctcgcgttcgtttcccacacaacatgagcccttgggctaa

SEQ ID NO: 4900 - DNA, 183 bp, A.fumigatus
atacatcggggattaaggcagacacaagtgttcattggtagccttattttcaaggtgccgaccagctgtaagttgacggatgcaacctcaggcatcgacacacccacacccgcatacatcatcgatgccttacagaagacgatcaaccctgtagcaactctgcagtatgtaagaagagcctaa

SEQ ID NO: 4901 - DNA, 462 bp, A.fumigatus
caaggtgtaggggttccaacccttttaaccccctccctaccaattttgaccagcagcttcctactaccactacaaggaagaccacacggtcgactcttgagaacaccccgcagcccaccacgggctcttactaccacatcgactaccacttttgaagcccccacaactctgacaactgcctcctccacaagtgagggcccaacaaccaaccacaagcataccaccacccgtacaccctacacgtcaacctacaagagtaccactactctgcccaatggcgagcggagcaccgtcacagccgtgacggtcgtctaccccacggcggacagctccagcccagccgccacaacgaccggtccagcccccggcctgcaaaccggcggtgccgcatccatcaccgggctccagaaggagctactcgtcatgcttggaggcgcagccgctgtagccatggctctctag

SEQ ID NO: 4902 - DNA, 888 bp, A.fumigatus
cctggcccttcacccttcccagcttgtcagcctttatgggtaggctgtgaagggcggaaccgtgagagatgctttatttccaaacaaaatggagggtattataactccgttcaatgctggcgcgggattcagcctgcgtacaaccctctccgtcctcgtcagtcgcgttgcagaagcatcatggaagtgaactccaacaacagtgagtatatctacacagcagtctggacggattggtcgcatggtcgtattcatggagcgaccatcaccctcagcgcccaaaacgccgggtttttgacggcttttctcgccttgtttgtgagcgtctcagccggccatttgtggcggatcatcagcttcgtcgtgcatcagtttcactcttctcaaaaacccagagatgccctccatcaccaacagcaagtcatcttcaagaacactacttcgcctgtcgcgcttatttgggaatttgcccttctctcatgggcatggcgccggaaggcccagcaccctcttcttcgcaatctccttttcattgtcctggcaatcatctggctagcgctgaccggtagcgccgccattctctcggcgcgaataaccaagccagcaggctctcactgcctgatcatgagccctcattgcggactctatttggccgctggcgcaggattcaacgccagtgacccctatcaactagacgtatttgacaccacccagctactcgagactaacaccgcgacttcctacgcaaggacctgctacgtgcctggtgcagagagactcccacagtgcaacatctacgctcagactcgcctcgccttgcatactaccaccaatgcctcctgtccgttccagagcggcatgtgtctggaaggagacagcgcagcattt

SEQ ID NO: 4903 - DNA, 402 bp, A.fumigatus
caagtggaaattcccgaccttggaaacgagctcatgggccccgtcaccccgtgtgctttgcctgaacccgaggtcgagcgcattgccgctgctctgctaggcgccaaacggccgttgatcatcacaggctacatgggtcggaatccacggacgccgccgctcctggcagaattatgcgacaagctcccgattagcgttattgaaacggtcgggtcggacgtgagcctccgcagtgatcacgaggcatatcttggtgtgacggtcagcacgcatccggctgtttgtgaggcagatgtcatcctggtgatggactgtgatgttccttgggttccgacggcgggcaagcctgcagatggtatgctcttctacaacttttttccccccagacaatggctcacatag

SEQ ID NO: 4904 - DNA, 285 bp, A.fumigatus
  unsure (123),(181): Identity of nucleotide sequences at the above locations are unknown.
gctctccttttcagccgagtggctctccacatactaatggatgtagatatgaacctgtcgttcgagccgtcgccggattaccctggtattgcggcggcggctggcaacccgtggggggcgacngtcaccaagacggaccaatttgattccacgctcaataacgccgtggagactgtccaanggggtccgtgtgccgttgttgaaattcggttagttttctccctgtgttcccaagcaaagctaaatctaggcaacgtttccctccaatgtggggtaaagaaatga

SEQ ID NO: 4905 - DNA, 228 bp, A.fumigatus
gctgacacatgtagcgtcggcgacggcacctacctcttctcgcagatggaatccgtgtattggatcgcccggcgatacgacgttcctttcctcctggttgtgctgaataatagcggctggaacgcacccaaggtgtcgacattgcttgtccacagtgacggtctggcgtccaagtcgaacagagggggtaggctctccttttcagccgagtggctctccacatactaa

SEQ ID NO: 4906 - DNA, 231 bp, A.fumigatus
  unsure (216): Identity of nucleotide sequences at the above locations are unknown.
atgcaatcagtgtcgagtccttgcatccgacagggatcttacgacttgcagggctgtcactaccactgtccgatatctgcattgcgagccgggatccgagggctgtggcgtatctcaagtaagccccttgcttatgattctatctggttgtctgacaagctatccggattcgatgccgaatttggatgggagaagcttaagagcacggcccacagnctcgtccgtggataa

SEQ ID NO: 4907 - DNA, 237 bp, A.fumigatus
atttcgatcgtcatgtcacatcaactaacaaacgggctgcaagacaaaaagggaaaccaagtcgaccatcacatcctcactcagggagctgagatctgccacgaggttgagattctagacgagcgaaaggattcattcaatcattatccttacgatcaggcagacataagttacttaatcatcgtagttcaaatcatcggacactcttctcttccagaggagcctcatccagactag

SEQ ID NO: 4908 - DNA, 384 bp, A.fumigatus
catagctcggatccttcgacccctgtggtgaagacatcgccgcagatagtgcgtttcatctccttctcgctccctcttccctgcactgaatcgcaactgacctctcccccaacagatcaatacctccgggccctccaacgtggctgcttccgttacttccaactgggactcgtcgacggccccgcaggcctcctcggcggcctcatccaaaaaccttccgtcctcttcgtccatttcttctccgtcgccctcctctccctctgggtccttcttcgcgaataccctccctacctcttccccgtcgccctcttcaaatgcatcatgaccttctggacagcctgcgtcgtcatcttcccatacatgctaattgaagccttctgctga

SEQ ID NO: 4909 - DNA, 189 bp, A.fumigatus
attcccgcgcgtccttgctcgtcttatattcccccgtcccatgtcggcgtttacaagggtcagatgcgggctttttggccagtctttaaagactatcccctagatggcttgcgggatttgcaaaattgcaatcgaacatctgcgtctgtttgttgcatttcaatctttggacatgttaacggtttctaa

SEQ ID NO: 4910 - DNA, 231 bp, A.fumigatus
  unsure (2): Identity of nucleotide sequences at the above locations are unknown.
tnctcgacgcgggtcttccacctcggggtgaagacgattgctcatgcgcctcgcaagcccaacggtatcaatgcgtcgactcttgattcagctagcggtcagggaagcaatggatggcagacaactaagaaaaagcagaaaaagaatgccaagccaatggagccccgatctggcttccatgcgggtgcagagcctctacctgcagacgagtcgttgaggaaaggcggatga

SEQ ID NO: 4911 - DNA, 333 bp, A.fumigatus
ccacaggcagtggcatgtttctacgtccgaatccaggacaaacagcagcaggaaccctattaccgcgccgtatacctcaccgagcgcaccgcatccgactttattgaccaactatccaagaaatacaacgtccaaccagaccgtatcctcagtctcgtccatatcaatccgaacagtctacgcgtcgccgtcgacgatgacgtcgtgggagcaatccccgaaggacaagacatgatcgcccaatttaccgaggttcctgctccggttagcagcgacggagagggcgagggagaaggagacagcaccaggtacgaggttcagctacatttctga

SEQ ID NO: 4912 - DNA, 1530 bp, A.fumigatus
tataccaagttgtgtccttccaccgcctgtgaagaacttaccttatttttacagtacaaaagcaagatcaaaaaatatgtccttccggaaggctacagcggtttgaccataggaagattgcagcttgcattcattgagaaatttgcttggaatacgcacaacaacggggttgacctgccggagatctatattcaggacccaatctctggagtgcggcatgaattggaagatttgaatgacgtcaaagacagatcggttcttgtcttaaatgtggatatacttgacgaggtcaagaagcatttcgatgatgagcttggaggtgttcgtcgtctgattgaaggcgttaaaggtactcttgaaggacaagaaaatatcatccagcgcgtgtcagaccgtcagttagaggccgcaaaggagattgctcgcctggccgccgcgcctccagtctcgatcccgacctcccttccagacggatccgctcggaagggccctattactggaagtcgcagccaactggctgagcttcagagtctgaagcgtgatcttgcagtgctacggcagacatactcaaatttctcgtcagatattgctagctccatgaatgcgattcgtgctaaggcaaattttgtgaaatctgcagctgcagatgttgccgtgccgtcctatgaaggagatgctggtcgtgcccgtgtcaacgccggcaaaaaggaactcgcagatgagtcagaacgactcgttgggcgcgtcgacgaccttcaggatttggttgaagatcttcgtaaagacgtggtatcacgtggagtccgacctctcccaagacagctagaaagcgtcagcaaagaaattagcgccgtcaccaaggagttgaaaaaaatgcaagaattcctgaagcgggagaaaccgatttggacgaagatttgggagaaggagctccagcttgtgtgcgaggaacgcgatcaattaaccatgcaggaagatctggccgcggatcttgaagatgatctcgagaaggccgctcagacttttgctctagtcgaacaggctaccaaacagcaggcgttgcagcataatgtcaacggaggcgttgctctgcgaaacacctcgcgcaacgtggttattgacccagcggttgaccccatgaaggcgaaggatgacgttctgggtgaggttcgcgcactccagcctaatcatgagtcgcgattagaagcgatcgagagggcagaaaaggctcgacagaaggaacttgagaatcgtcggatagggcttttccagaaagagcttggtgcgtttgttcaagagggaaagctgaagaagagtggcggcgtggaagaagctgagcgacaacgtcgagtcaaagatgaccgtatccggaaggaggtttgggagagacagcaagcccgagcagccgaaatggagaaggcagaagccgaatcggcagcggcagcggcagcttctacccaactagagcagtcagaccagtccgaacaacctgtcttcaccacggggctggaaggagccgctccacaaaaa

SEQ ID NO: 4913 - DNA, 207 bp, A.fumigatus
ctcggtcttcagagcggtatccttgcatgtctggtgaatctctcacaattcatcatcatagattcggttggccctgtcagcagcactgtcattggacacttgaaaacctgtatcattgtcgggttgggatgggccctgagcgatcggccaatttcgaggggatgcctcgtcggtatcctaatggccctgacaggaatgaccttgtaa

SEQ ID NO: 4914 - DNA, 717 bp, A.fumigatus
gttcggatcctggcacgggccgtgtgtgaagacgccaaggcgctatgtagtatcctatatcatgactcacaccagaacatatatagccacatgtcctgcgtatacccaaagtacactcacatcaatcagagccctaattctccagtcatcatgcccatcctaatcaaccccataacaaacgaaccctacattcccctccccgccccccattcatccatcatcatcaccccggcgcgggccccgaacacccacgactcctccgccctcctctccctcctcaacaacccccagatcttcccgtacctcgaatccaccccggtcccatacctccccgaacacgccaccgaatggttacaggcctcgcacgaacaagccaccgccctcctacaggcagcgcaaaacaaccgcttcgtcgacgggctgccattcacctgcatccgcgaggtcaccaacgacggtagcagcgacatctacatcggcaacgtaggactagtccggtacgccttctacgaattcaaaaagggcacggcagagcgcgaggaggccgtgcgcagaaatgaagcattgggggttggtagtccggagattgtttgggggtttggtggtaagagtcccttcccgttctttccttccgccttggccatatacatatatctgtgtgtgtacgtgtgtgtgtatgttttagatgaagatgagggcgacgaaggtgggtactga

SEQ ID NO: 4915 - DNA, 330 bp, A.fumigatus
  unsure (122): Identity of nucleotide sequences at the above locations are unknown.
atccagtgcgatcccgtccatgaatccgtagcccggctatcaagcaatccctcctcactcgcagattcgactttacttcctgcttcccaaaccaacacaacattggacttcacccctccgcnccgattcagcggcacaaccgcccaatcttccaactcaaactccaaccggaacccattcttctcaaacacccgcatactagccctattatccgcatacaccgacgccttgatcacccgcgcattcatccgcggcaccgcccattcgtcaatcacagctttgatgacagctgtcatgatgcctttgccgtggtatgtcggcgagagataa

SEQ ID NO: 4916 - DNA, 396 bp, A.fumigatus
ccgagtgacgcggagaaatggtggaacgtcatccgcgacacagccaagagcgcccccgcccattcgccagtgtctcccaccagccctatagcaactgggggtgctgtcgctgctaccactgagagtggtggtgctgcttcggctccgccacctactactgctactgccgatgttgccgcagtcgaggcaaagcctccggcctacaaagagcaggaaggcgttgcgccagtcgcgcaggagaagaccactgccggtgaagcagccactcccaccactccagcagccgagactgggctcaaccgctcgaccagcgcggcgacgggccactaccacatgggacctggtgggtcagccgttgcgcctgacgcacctgcttccggtgtcgagaagtcgtga

SEQ ID NO: 4917 - DNA, 483 bp, A.fumigatus
  unsure (442): Identity of nucleotide sequences at the above locations are unknown.
agacgccacgggctcttctacacgaccttccgcgcctccctccctggcaccggcaaggacaagacctccttcaacatccaagacctcctcacgcagccgcatccgggcttcgcaaacgtcgagcaaatgcctttgctcaacttcaccgtgacgattaccaataccggcaaggtcgcctccgactacactgctatgctcttcgcgaacaccaccgcgggacctgctccatacccgaacaagtggctcgtcggcttcgaccggctggcgagcctggaaccgcacaggtcgcagactatgaccatccccgtgactatcgacagcgtggctcgtacggatgaggccggcaatcgggttctctacccgggaaagtacgagttggccctgaacaatgagcggtcggttgtccttcagtttgtgctgacaggccgagaggctgtgattntcaagtggcctgtagagcagcagcagatttcttctgcgtga

SEQ ID NO: 4918 - DNA, 669 bp, A.fumigatus
  unsure (45): Identity of nucleotide sequences at the above locations are unknown.
ttcgagcgcggatcttcgacgcccagtgggtcgaagactccatcnaagagcgcatccgcagcccagtctggtatacgcaatctgccgctcatcctggccattagtcttttgactatcttctcgggcggtctgattacggccacaggtcacttcggatccctgatggtcatcggatcggccttggccaccgttggctccggcctgatctgtaccttggacatccacaccggcagcggaaaatggatcggataccagatcgtcgccggcgtggggcttggtctcgcactccagatcccggtcattttgaatcaggcgctcgttacaccgagcgacctctccagcatctccgccgtcacgttgttcatgcaaactctgggccggccgatctgcgtgtccgcagctcaggccgcatttgtcaatcggttggtgacgaggctgtccgtgctggccccaaatgtggatgccaagcttgtcgttgctacaggcgcatcagagctgcgtcacaccttcaacgatgaggacattggcgggattctggaggcgtacatggatggcttgaagctttccttccttttgtgcactgtcctcgctggagttaccctggtcatctcagcattgcctaagtgggtgaacttgaaaggaaaggtacaagggagcggtgcaacatga

SEQ ID NO: 4919 - DNA, 267 bp, A.fumigatus
ttcatacagtcagaattcctggaagtaatagtttcactaacagttgtggtgataggccatgcctttcgcaagaatgccgccggtgcctttggacctgatctcgccaggaagctgtctcagctagttaagatggagaagaacgtcatgcgtagcatggaaatggttgctcgagagcgtatggaagctgctgtatgttgctggtccttaacacatgccttcacaattgctgactctggcaccctagcaacaactctccatctggggtga

SEQ ID NO: 4920 - DNA, 648 bp, A.fumigatus
gtcgggtctttagatcccaaagaatcctatattaacgtttcaataggcaagcagaagatcaccgatgagatcgccaagctcaagtacaaggaccctaactctcctcgcatcgtcgtcctcgagcaggagctggttcgcgcggaggccgaatccctagttgctgaggcgcaactctccaacatcacccgagagaagctcaaggcagccttccagtaccagttcgatgcgcttcgcgaacactgcgaaaaggtcgctatcatcgccggatacggcaagcatctcttggacctcgttgacgacacccccgtaactccgggcgagactcgccaggcttatgacggctatgaggctagcaaagccatcatccaggactgcgaagaggccctcaccaactgggtccagtccaaggcggccgttaagcccagcctgtcgacgcgatcccgctcgctgtcccagcgagcccgcgagaagaaccgcgagggtctcgacctgtccgagcaggaccagcccatgagaggtgatcgggactcctgggtccccgccggtcagcacccaagctacggggaagacggcgaggaggccgccagcaccgtggacggcgagacccggggtcgagaagagacgacagaggcggtcgctgcggcctaa

SEQ ID NO: 4921 - DNA, 201 bp, A.fumigatus
caacaactctccatctggggtgaaaactgcgatgaagatgtctctgatgtgacagacaagcttggtgtcctcctctacgagattggagagctggaagatctctttgtcgatcgttatgatcagtaccgtgttcccatcaagagcattcgaaacattgaagcttccgttcagcccagccgggatcgtaagtcgggtctttag

SEQ ID NO: 4922 - DNA, 303 bp, A.fumigatus
tctccacccgtggttaagaattggcttccactcgttctaccttgtcaatctctcgttatcaaaaaagtatcatccaccatgcatcgcacgtactctatgcgccagtcgcgcgttcccacggcgtcgcagattgagaacccacctccgccattgtcttctaccaagaccaacagatggcttgggaaaggtggactgggtgcgttgattcatacagtcagaattcctggaagtaatagtttcactaacagttgtggtgataggccatgcctttcgcaagaatgccgccggtgcctttggacctga

SEQ ID NO: 4923 - DNA, 1581 bp, A.fumigatus
  unsure (109): Identity of nucleotide sequences at the above locations are unknown.
gccgttcggcagcgttcggggaggggcatcccttcaagtcggggcctcggagtcccagaaaaaagagcttggaaggagtttcagggacgtcacgctgaccagcttgttnggagccagcggactcgggaccagatcatgaggcaatccgtcatctccgacatgtttaattcgtcgtggaggatggatgctctcgtcgagactcctttggccgaggtcaaaatgcctgcggtcatgttcgtccgggacccagaaaccaaagacctgaagccgtaccatggccctgctcctggaagtgacaagccacttcctgacatcaaggtgctcgtgcgtcaaccctggcctggagctggtgtggagaaactcccgcccacaacacggtgcgacgaggcggtttcttacatcgtgcgcaaccacgatctcagaggcaaattcgatccacaaaaggcgaaagagctgaatgttcgcgccggtcccaactttgcgcgtctgacgaagggcgagaatgtgctgtctgaggacggaaagaccgtcacccccgatatggtcttgggtccaccacggctcggaaagggactggcaatcatcgatttgcctacctctgactacgtggatgatttggttgaccggccggaatggaactcggcctctgtcaccaggggactagaggccttcctgtggatcctaggaccgggtgtaggcgaccatcctcgcctccgcgagtttgtcgctcgcatgtcgcattgcaaacacaccgtctccagcacggattactgtcccaactacttggcactgagtagcgtggcagggtcctccatcaggctagctaggttgcgcggcgagaattatcccgtccctgttcatgacaacaagaccctgccacagccaggtactcctacgagcgaatcagagacaaccaaggaaatgatccgcaactcgccattcgaaccggtcaaacccggcttggttatcgacatggaacccaagtgcgagcttaaccgctcagaggtcgtgccactgttcaaccctgctgagaccgtgcaaaggatccctcgctcaatcgagcagcgggtgactgccatccgtacgcgggtcatgaacccccaatttcaagagaaactggccgagtttcgtaaagatcttcctggggccaatgtggagattgtaactctgggaactggctcatcctcgccgtccaaataccgcaacgtctccagcactctcgtcaatgtgcctggcgtgggatcctatctgcttgattgcggtgagaatacgatcggccagctcaagcgcatgtacgaaccgaagaagttgcaagaggtgctgcagaaccttcggctgatctggatcagccatctccacgctgatcaccatcttggcaccgcttccgtcatcaaggaatggttccgtgcgaactacccaaacggcgtacctggagcaggcgatgtcgagaccgacatgcgcaagatcctcaaagaaaagcgcctgtttgtcgtgtccgaggagatgatgatcggctggctcgaggagtatgccggcgtcgaggactacggctttggaaagctagtgcctctggcagcccat

SEQ ID NO: 4924 - DNA, 531 bp, A.fumigatus
  unsure (8),(9),(10),(28): Identity of nucleotide sequences at the above locations are unknown.
ggtgcagnnnttttgatgacactgagtncactggagcccccggtgaagaccgtcgagatcacgtcgccggtgatctcggaccagatcgtgccaacgatcctggatctcttgatcgaatcctcctcgctgggggacacggccacccgcgcggccaaggacgtgctggccctctacgaaggccagtcgatgattcggcccttgatccccgagcagaacggcaagcaagactggcagttcaccgtgatgaacaccggcggttcctggctggccgagcgctccgccgccaaaccggccttccggctggtcatccccctcatcgacgatctggagtggcggatcacggatctggaaaaggatcccaacgaactccacccgatcaagaactttgacctggtcgacctggcccgcaaacttgaaaaacagtacgggcccgaagtgaccaactgggtccgcgacgcagcccatgttgcctcgtggtgggtgggcgaaaactggcgtcgctaccggtatcatcccgaccccaagcactga

SEQ ID NO: 4925 - DNA, 873 bp, A.fumigatus
tgtgtatcgtgcattaaaccaaaatcgtcattttgtttagaatgccaacacggcagcgacggcgccgaacaccagagcgcaggcggtgaccgagcccttgatggagccggcggcgccctgggagagctcgggggtggcggaggctccggcgctagtggaggagcccgtgctagagctagagccagagccagagccggagccggagccagagccggtgttgctgctgccgctgccgccggtggtagtaggttccgcgctggagctcgagttagagccggagctggttccagacggggtgggagtcgccttggtggaagtggccagggtggaggtggaaggggtcttgctcgaggtagagctggcggagctggcggtgctggtggtggaggaggtcacggaagagctggaggagatatcgacggagccgtcgaacttgatgctctgccaagagccagagttgtccgagtaggtgtaggactcggcggggttggcgttctcgatacggacggacttgacgtacatggtgtacggtcccgcgctgtagtcggtcaagccaccggcccactcgatggtgcccttggggttgctggggtcgccgccggcccagctgccaagtctcaggcgcataggagtctgagggaagcgagtgccacccttggcatcgttgtacgtgagcgtacgcacgaccgcaccgtcaatagaccaggtaacggcatccttggtccagtcgatggtgtaggtgtggaaagtctcctgaggagtggcaacgggcacgtaagtgcctcggtcatatgtggtggtgtctcctttgccaaagtagtttgtctgaacctgagtggtgtcaccgcccaatacttcctgcgctttcgttaa

SEQ ID NO: 4926 - DNA, 429 bp, A.fumigatus
aatgccaacacggcagcgacggcgccgaacaccagagcgcaggcggtgaccgagcccttgatggagccggcggcgccctgggagagctcgggggtggcggaggctccggcgctagtggaggagcccgtgctagagctagagccagagccagagccggagccggagccagagccggtgttgctgctgccgctgccgccggtggtagtaggttccgcgctggagctcgagttagagccggagctggttccagacggggtgggagtcgccttggtggaagtggccagggtggaggtggaaggggtcttgctcgaggtagagctggcggagctggcggtgctggtggtggaggaggtcacggaagagctggaggagatatcgacggagccgtcgaacttgatgctctgccaagagccagagttgtccgagtag

SEQ ID NO: 4927 - DNA, 378 bp, A.fumigatus
  unsure (102): Identity of nucleotide sequences at the above locations are unknown.
gtgttttcatacgaccatatgatatacatcagcttatctaacgattgttttgcagagacctgcccgcccaacaagggtcttgctgcatccacttacaccgcngacttcacctcagcttcagctttggatcaatgggaagtcactgcaggcaaagttcccgttggcccacagggcgccgagttcactgtcgctaagcaaggcgacgcacctaccattgacaccgacttctacttcttcttcggaaaggccgaagtggtgatgaaggccgctcctggcacaggtgttgttagcagcatcgtcctggagtcggatgatctggatgaggttgactgggtaagcctgcttgtctatcatgtgttcgtcttgagccggacttaa

SEQ ID NO: 4928 - DNA, 456 bp, A.fumigatus
cctcctccaccaccagcaccgccagctccgccagctctacctcgagcaagaccccttccacctccaccctggccacttccaccaaggcgactcccaccccgtctggaaccagctccggctctaactcgagctccagcgcggaacctactaccaccggcggcagcggcagcagcaacaccggctctggctccggctccggctctggctctggctctagctctagcacgggctcctccactagcgccggagcctccgccacccccgagctctcccagggcgccgccggctccatcaagggctcggtcaccgcctgcgctctggtgttcggcgccgtcgctgccgtgttggcattctaaacaaaatgacgattttggtttaatgcacgatacacatcatgaaggggacgtcagaactatacatttcggcatcggggtttcgccatcgtttggagtatga

SEQ ID NO: 4929 - DNA, 426 bp, A.fumigatus
cggtgcggtcgtgcgtacgctcacgtacaacgatgccaagggtggcactcgcttccctcagactcctatgcgcctgagacttggcagctgggccggcggcgaccccagcaaccccaagggcaccatcgagtgggccggtggcttgaccgactacagcgcgggaccgtacaccatgtacgtcaagtccgtccgtatcgagaacgccaaccccgccgagtcctacacctactcggacaactctggctcttggcagagcatcaagttcgacggctccgtcgatatctcctccagctcttccgtgacctcctccaccaccagcaccgccagctccgccagctctacctcgagcaagaccccttccacctccaccctggccacttccaccaaggcgactcccaccccgtctggaaccagctccggctctaa

SEQ ID NO: 4930 - DNA, 210 bp, A.fumigatus
tgcacgatacacatcatgaaggggacgtcagaactatacatttcggcatcggggtttcgccatcgtttggagtatgactactccatcgttcttattgatttcattctatgcccatacctatttcttataccccgtacatacaacatgcaacatgttacatatttaatgaaagtacgctattgttctggtcgggggatttgtttgctctga

SEQ ID NO: 4931 - DNA, 882 bp, A.fumigatus
ctgggtaagcctgcttgtctatcatgtgttcgtcttgagccggacttaacgaaagcgcaggaagtattgggcggtgacaccactcaggttcagacaaactactttggcaaaggagacaccaccacatatgaccgaggcacttacgtgcccgttgccactcctcaggagactttccacacctacaccatcgactggaccaaggatgccgttacctggtctattgacggtgcggtcgtgcgtacgctcacgtacaacgatgccaagggtggcactcgcttccctcagactcctatgcgcctgagacttggcagctgggccggcggcgaccccagcaaccccaagggcaccatcgagtgggccggtggcttgaccgactacagcgcgggaccgtacaccatgtacgtcaagtccgtccgtatcgagaacgccaaccccgccgagtcctacacctactcggacaactctggctcttggcagagcatcaagttcgacggctccgtcgatatctcctccagctcttccgtgacctcctccaccaccagcaccgccagctccgccagctctacctcgagcaagaccccttccacctccaccctggccacttccaccaaggcgactcccaccccgtctggaaccagctccggctctaactcgagctccagcgcggaacctactaccaccggcggcagcggcagcagcaacaccggctctggctccggctccggctctggctctggctctagctctagcacgggctcctccactagcgccggagcctccgccacccccgagctctcccagggcgccgccggctccatcaagggctcggtcaccgcctgcgctctggtgttcggcgccgtcgctgccgtgttggcattctaa

SEQ ID NO: 4932 - DNA, 612 bp, A.fumigatus
  unsure (84): Identity of nucleotide sequences at the above locations are unknown.
agttcatggattcattggccttgcggaccaaccaggggcgttcccaacctttttgatgacagcagcatccagaatacccaaggnttttacgtatacgcggatgatgccggggacattaaggcacatccctttttccatggtatcaactggcgtacacatcatctgaccgaaccgccgttcactcccaaagtagatggctgggaagatactcgctatttcgatgacaatgaagactccttggacaacgatgatgtttcaattacgtcggaggacaatcaagggcaaggtgaggtcgatggaggtcatgcacacgaaccaggtctcgaaagggtgcaatcgcaacagaaaggctgtcagccagaccagaaggacagtcctgatcttgcaaagaagaacaaacaccgtaagaaggacaaacacaagcggagacgaccacgagacaagttattgcgtgacccaagagtgggtaagacagtcctcgacattcgcaagcgaggtgcatttctaggctacacataccggcggccaaatgcagttgcattggcactggtgcctgaacgggggcgatcgatgtttaggcggggacaattgccagaattatatggatattga

SEQ ID NO: 4933 - DNA, 225 bp, A.fumigatus
tggacaatccatcgcagtgacctcctcaacactgttgtttatgctgtaggcttgctcgcaacgcttcgctccaagaagttgagcggacaatggattggcgtcatggtcactgcgagccataatcctgccgaggacaatggtgtcaaactggtggacccaatggtgagctcctatggaactttcgatgggggtatgaaaggtgaatttgctgacgtattgatataa

SEQ ID NO: 4934 - DNA, 384 bp, A.fumigatus
  unsure (355),(374),(375),(376),(378): Identity of nucleotide sequences at the above locations are unknown.
gctgaatgggaagcatacgccaccaaactcgcgaatgctccgcttgaaaatatcggtgacgtttacgacgaattggttaaggagatcgatgttagcatggagaaccctgctcgtgttgttttcgctcgggatactcgtgcatccggttcgcgactcattggcgtcctcagtgctgcgctcactgccacggaggccgagttcatcgatatgaaatttatgaccactccccagctgcattacgtcgtccgatgcaagaacactctgggaacgcaatatgagtatggtgagcctactgagcaaggatattacgaaaagcttgccgcagctttcaagagggtcttcacccggggcggcnatggaatgcaggtcaattnnnanctgcac

SEQ ID NO: 4935 - DNA, 1512 bp, A.fumigatus
actctccaattaggcttcactttgagatacccacccagtcttcagcggggacggttgctgtgtgtgcctttcaactccgcccctcctcaccactatcttctgctgcttcaacttcgacatctctcctccattgaagaacttcatctactatcttcccaactggacctcaagttctgtcttccttgctttctaactcctacagaccactttcgtctctgtccttccaccagctctgcccgcaacaaccaagctctccacttcccccgctccaaagttggtcggaactgtaccatctccggccttacagccaacaggatggctgatagctcttctttcccgggtacaaacccgttccttaaggtcagcacgaaagacgacaaatattccccgatccagaagatatccgaggaggaagaatatgaggtgacgtcaccgaccgatcccactttccgcagcgcgcactccggggctacagcacccactgctggaaactcgttcaatggagacaatggctccaacgaaggtggtgagggaatacagttcaataggccctttgatgcaggatttggtcaggggagcgaaggtcaaggcgaacacgtcgagcctcccggaggagctcgcccaacggcagccgccaaccaagggttccctaacaactatgctctcggccgtcgtacctctgtatccgccgagtccctgaaccctacctctgctggctcagatagctggacgcccccatgtcatccgaagaccgaagaacagctttcgcgtttgaaaacggctgtgagcaacaatttcttgttttctcacctggacgacgaccaattcaggactgtacttgacgctttggttgaaaaacccattcctgcgaaagatatcaaggtgatttcgcagggagatgccggtgattacttttacatagtggagaatggccatttcgatgtctacatcaaccccgcgggctcagtccaaccaggccccgatggtattggcaacaaggtcagcaccattggtcctggaggctcctttggtgaactagccttgatgtacaacgcgccccgagccgcgactattgtctcagcagaccccaagagcacgctttgggctttggaccgcatcactttccgccggattctcatggactctgccttccagcgacgccgcatgtatgaggctttcttggaagaggtgccattactttcttctctcaaaccatatgaacgcgccaagattgccgatgctctcgatgcgattaaatacccagcgggctctacaatcatcgaggagggcgctccaggcgatgctttctatctacttgagtctggggaggcggaagctttcaaaaaggacgtggagggccccgtcaagtcgtataggaggggcgactttttcggagagctcgccttgctggacgacaaacctcgtgctgctagcgtgttcgccaagaccgacgtcaaagttgcacgacttggtcgcgatgggtcttcaccacggggctggaaggtccgcgtc

SEQ ID NO: 4936 - DNA, 255 bp, A.fumigatus
aatcaatggattaaaactgccagccagacctctggtgaagacctggtaaactttttcgctttgtctgacgacgacctccgtctttcgctcctcaccctggtttatcgggccgctccgcccacaaaaggatcctccacaacctttagcttaagctgtatcaaagctgccgagaccgctttaaggagacaccatgacgttattgatgtgatacgcaagaatggcagtatctacttcgccaagtatattcattggtaa

SEQ ID NO: 4937 - DNA, 405 bp, A.fumigatus
aacgtgtactcggaaaacgactccgtgctggctctcttatatcgaacaagcagcctccagcttggggttgcaggcttgcagcctgttgaaggtgtctcaggcgttgagaatctggacgttagcgacctgatcagcggccatctccgttatcagtttctcgttggcaggatcttgagcgttgttggacttgagagcattgatgctcgcgaggtcgcactggaggaggccgcattagaagccaaagatcggaggcaggagcaggaaagggctcataacgaacgacaggctggatttatgggcgagggtcggtcaccaagccagcggctggaaagccaggaggatctgcagggcgaagaggacagattacagaaagagatgggaaaagcacgagtgcggcactcttag

SEQ ID NO: 4938 - DNA, 603 bp, A.fumigatus
ctaaaacaggactttagggctattgtcccagtccgctgccaactcgtcgctcttatctcggccttcttctttagaaaccgccaaatttgctctactatgaattcaccaaaggtcgctttgattaccggcgcctctagaggcctcggcgcagcaattgcgcgatgcctggctgaggagggcatgaacatcgtgatcaattacaattccgatcctgctccggcggaacgtttactgcaggagatgagggctttgagtcaggccaaggtgccgggtgcgaatgcccctcgctatgcagcattccaggcgaatctggccaaccaaagctccactcagcagcttgtgcagcaaaccattcagacaatgggccggttagacgtggtggtgtccaacgtcggctggacgagaatgaccaattttatgaatctggaagacgctgataacgagatggactgggatagatgcttctcgatgaatgtcaaaagtcatttccagcttttccgggtttgtcaggagcatttggagcggagtgagggggtattcattgctacagcgagtgttgcgggggtgaagccgagtgggagttcattggtatgggtcatttga

SEQ ID NO: 4939 - DNA, 1266 bp, A.fumigatus
  unsure (1132),(1189),(1224): Identity of nucleotide sequences at the above locations are unknown.
catctctcagagctaacagacttccctctaggtacggtcccaggcctaccaacgtccataatggcttccacagaagaacctgtccctcctcctgcccctgtgcccgctgatgcgcccgcttcggccgaagttgacgctgaaatggcaccccctgctactcccgtcgactctaccatcctgtccggcagcgagggacccgttacaagccccgatgcttcgatcagagacaaggagaatatcaagtcttcgcccgagaagaccactacgacgacaaaccgtccgttgtctggaacggccgctgccaaacgtccaagctctgtttccggggctaccaagaccgcagcgtccaccgcgcgagctgcggccaacggcagtacactcagcaagcccccaactcgtcctaccacttctggtactgtccgtaaaccgctgagcacttcgacaaccgcctcccaccggtctcgcccctcggtgagcagctccgcggatgagaagacgaggtctgtcgcgagctctggtgacgaaaggagaggaatctcgggctcggccaagcgcatgtccttggtcggcactacttcctcgagggctccaccgaagactactacgtccactctggaccgtcgctcaagcattgccggcaccaccacatcacggagccccgctacgcgtcctagtaccgctccctccactaaacctgccacaaaaccaactggcgtgtccagcacctctcgtacgtcgaatagcacgagcacgactgtggcccgacctgcagcccgacccatggccacggctacacgccctactacgacggcctcgaaacgactgagcactgccatcaaggtgtccgacgatgaggcggagaaactgcagtcactgcagaacaagctgtccgaaagtgaggcgactgtcgccagtctcaaggcagagctggagactgtgaacgagaagctttctcagctgtcggtgtctcatgggggagcgtccaaagaaaatgacgacgaagtcgccagcgcccggcggaaggaacacgctgccgaaacggcaaagctggctgctgaacatgccgagcaacttcaagctctgcaggcccaattggacgaagcagagactaagcgcaaggagctggaagatnaagtcctgcaggacctggaatatgccgccaaagcagccgctcatgaacgggacgacnagactactgcggcacttgaagagttgaaacagtcncaccaatctcagcttgagacgctggaaaaaagaacttgctga

SEQ ID NO: 4940 - DNA, 600 bp, A.fumigatus
actgatcttttccggtcgctgttttattcgtttgtgtcgctggccttccagatcccgttcgcccatagtccagcgccggatacgttgcctgcggacgatcccaatgcctatggacatggatctttcgtggtattctggatgctgaattgggttggcatgactgcgcttggattaccctgcgagaacatggggatgatcctcggatttccctacagcgccctttttcttattttttgggtcatcaccaacgtcgccactggcttctatgcgttggatctggcccctggattcttcgcttggggctatgccttccctttgcatcgcagtaagtcttccatccttcgaactgccttgcggctgtctaactcgtgtagttgtcgaggcgctccggactattctcttcggcacgcattcctggattggactcgactttggcattctgtttgcgtggatcggattgtccatcatattatacccatttgccgcatttgtcatgcgctggaagatgaagcgaggattgtaattttcgctcgcgatagaagcatacactctaatcaatttatcatactagatacctctcaacataatctattttcataa

SEQ ID NO: 4941 - DNA, 330 bp, A.fumigatus
  unsure (154): Identity of nucleotide sequences at the above locations are unknown.
cattccattctatcactatcattcgacatggccaccacaaacgatttcctttcatccgacgtcaatagctatgactatgttattgtcggcggcggcacggctggctgtgtcattgctagtcggctggctcagtacttgcccaataagcgtatcntagtcatcgagggtggtcccagcgacttcatggatgacagagtccttaatctgcgggaatggctcaatctcctgggaggcgagctagactatgactatcccaccacagagcagcccatgggtgtgtattcttcgcacattctttgttttatccgcacgtccttgcgggttatttag

SEQ ID NO: 4942 - DNA, 186 bp, A.fumigatus
gtttatgccattcgctccattaatatccctccgtggtcgaccatgaaggacgaagtcgatgaaaattctccgaagctcacgattgatttgtttattgagaaatggagatatcaaatgatcattaagtgggtgctccgtcatattggcgcttgcttggctaaggacgacaacaccccaaaaggtctt

SEQ ID NO: 4943 - DNA, 261 bp, A.fumigatus
acgcgatcatgccgcgcacttcccatacaggactcttactctttgcagctctacctgtccctatatttcttagtctactctgattgtctctttgctctgaaccaattgtcggcccttgctagtacgtctacagtcatatgctgttttattctctacattggaaagtgcttgccgagcggatttaagaaccctgcccatgcaacccttgttgacacctattgtaacaacgaggagaaacgactaggtctttggcatatttaa

SEQ ID NO: 4944 - DNA, 840 bp, A.fumigatus
gtcaagattctccgccaacggagatgtcccttgcctggtcggttgcggtgttgttcctggcccgcattgggtacaccttccgcataccatgcagctcgttgtgctgtatccttaactaatcttgagctgcggaaagtagagctggattcaatggcgtctattttgcgagttttaatgaataatgttcggcgaaggcgactgtcttccagagaatgctctactgttgcgcatattatccatacagaaaccccgattgaggaagaaaccttaccacattacaaagcagagcattactatccagtaagaataggcaatgtgtatcacgccagatacaaagttgcaggaaagcttgggtatagggcatattcaactacctggctctgccgagatctccagtgcgccaatcccagtctaattaatcccagggcagctctgacgagtcatggatatagagccaataactacacagtattgaaggtatcaacctccttgccagattatcccactgcagcagatcgcgaattgagagtctataaacacctagcaaaaatagattcttcgcatccgggtcggtcattgatccgcgagctgtatgattcattcgacctccatggccctgggggcacacatcgatgccttgtactgcagctgatgaatgtgacacttcttaaaatgatgagaatgaatcctcggctgtttgatctacctctactaagaatgacaatcaagcgacttctattagctcttgatttcttgcacacggaggctgaggttattcatactggtagagatttatgctttataaaggttggatttgatactgatgtccaccagacttaa

SEQ ID NO: 4945 - DNA, 1074 bp, A.fumigatus
aataatcatccatatagacctcatacactcaccatcaaaatgagctcaaacaaggccctcgtcttcaagaaagtccccgaaggatacccagtccccggcgagcaccttaccatcgagcctgtcgagtatgacgccaacacccccgcccccgagaatggtgttgtcctacagtccctctacaccagctttgacccctacatgcgtggccgcatgcgccccgctcacgtcaagtcatactctcccgctttcgagcttggcaagcccatcgacagcacaacgattgcgaaggtcctccgctccaacaatgcttctttcaaggaaggcgatctggtcatcggcttcgtccccatccaggagtacatcgttctcgatggctcccaggttgcccgcatccgccctctcgagaaccccctcggcatcgaggacatccgtgtgttcctcggtgctctgggtatgcccggtctgaccgcctactcttccctttacgagatcggtaagcccaagaagggcgagaccatcttcgtctcagctgcgagcggcgctgtcggacagctcgttggtcagttggctaagcacgaaggtctcaaggtcatcggcagtgttggttctgacgagaagctcgagtacatcaccaaggacctgggctttgacggtggtttcaactaccagaaggaaaagcccgctgatgctctggcccgcctggcgccccagggtatcgacatctactacgagaacgtcggtggcgagcacctcgaggcggctctggacgctatgaacaactttggtcgtgtcgttgtctgcggcctgatctcccaatacaacactgctccttaccccatcaagaacatccacaatgtgctgatcaagcgtattgacatgcgtggcttcatcgtcagcgaccctggcatgggtgacaagtacactgaagagcaccagaagaacgtgcagaagtggatcaaggagggctctttcaaggctcttctgcacgagaccaccggtatcgacaatgccgccgagggtctggtgggtatcttctacggtaagaacaagggcaaggctgtcctgaagttctag

SEQ ID NO: 4946 - DNA, 423 bp, A.fumigatus
gctcaaacaaggccctcgtcttcaagaaagtccccgaaggatacccagtccccggcgagcaccttaccatcgagcctgtcgagtatgacgccaacacccccgcccccgagaatggtgttgtcctacagtccctctacaccagctttgacccctacatgcgtggccgcatgcgccccgctcacgtcaagtcatactctcccgctttcgagcttggcaagcccatcgacagcacaacgattgcgaaggtcctccgctccaacaatgcttctttcaaggaaggcgatctggtcatcggcttcgtccccatccaggagtacatcgttctcgatggctcccaggttgcccgcatccgccctctcgagaaccccctcggcatcgaggacatccgtgtgttcctcggtgctctgggtatgcccggtctga

SEQ ID NO: 4947 - DNA, 612 bp, A.fumigatus
cgtgtctatgagatgattttactattaacatgcaggattttttttcaacgctctacctcccatctagaacttcaggacagccttgcccttgttcttaccgtagaagatacccaccagaccctcggcggcattgtcgataccggtggtctcgtgcagaagagccttgaaagagccctccttgatccacttctgcacgttcttctggtgctcttcagtgtacttgtcacccatgccagggtcgctgacgatgaagccacgcatgtcaatacgcttgatcagcacattgtggatgttcttgatggggtaaggagcagtgttgtattgggagatcaggccgcagacaacgacacgaccaaagttgttcatagcgtccagagccgcctcgaggtgctcgccaccgacgttctcgtagtagatgtcgataccctggggcgccaggcgggccagagcatcagcgggcttttccttctggtagttgaaaccaccgtcaaagcccaggtccttggtgatgtactcgagcttctcgtcagaaccaacactgccgatgaccttgagaccttcgtgcttagccaactgaccaacgagctgtccgacagcgccgctcgcagctga

SEQ ID NO: 4948 - DNA, 1422 bp, A.fumigatus
  unsure (993): Identity of nucleotide sequences at the above locations are unknown.
acgcatagcgcggtaccttcggcccgcggggtgaagagctcctcctctttcggtctgataggcgagatccgcgagcgctccccctccgcggccatccccccagctcctaaaccctccactgcatcaacaggcttccctcagcatcgacggcgtgtgaatcagtctgctttcaagcagcgccgagcgaacaggcaacaagaatcgaccccgccgcctgcggcgactccttctaccaccctttccgatgagaagaagagcatcgatgaggagaaccgtcggcaactggcatctatgtcacctgcccagattcaacaggagcgggaggagctgatgtcttcattgaacccgtccttgctcgagagattcctccgtcgcgcacggatcgacgatgacgacagtatcaccccatccgagaagagctcgtcacaaccggagcccccactctcgtctgcatcatcggcgcaagatgcgtcgacggcgaaatccaagaaatcagtatcgttcgacgtcgaagaagattccaagacagcaacagagaagctggagcgatcgcagcgcaagagaactccccccacagtgacatcttccgttctcacgccggaagaccttcctccagctcaaccaccggccgacctccatccagcgtctgaaatgcccagtcatgaggcctttcattttcctacgcctccgcgccaagacaagccaccaaatctcgatcctgcgtctccttctttcctgtctgacctccaagcccattatttccccgaaatatctcatgatccatcagcgctctcctggctacagccgccctcggccgacccggaagatcctgactcgacgtccgcataccacccggcaagtagtgcagaggccgttcatccgtccgctctccgattctccctccttggcaatgtcctctcccccgccacttcgctctccctccccaccactctcggtctgcatcaccacggcaaggatccgcatgctgccggntacaccattcccgaactcgccatcctcagccgttcgacctttcctgctcaacggtgcatcgcctggcaagtgctcggccgtatcctgttccgtctgggcaagggccagttcggggaacgcggcagccccttggtcgagggcttatggtccgtgatcgagcgcgagggcgtcgtcgccggcatgctcgccgaagcagacggtgctccctccggccccactcgttcagcggccgctcaggactcaaccgccgcggatctgaaccacccatctccattgccagcgcagggtactccagtgccaaaaggggcaactgggatcggtcggcatgccagtgcctccgcttgggctgtggagggcgtgtggctctggcagatgggtggaggaggagatcgggggatcctaaaggagaatactatccggtcgcagtag

SEQ ID NO: 4949 - DNA, 225 bp, A.fumigatus
agacccttgagggaccatctatcctctatctcccagaataataatcatcgcataaaactgacatacgtagagtcatacgctcaaatcaagaaaaaaaaaatttgtagtaaccaggacaagtcccagttcacatccttttccttccgcctttatgatatactccccatctgcaccccccaaaccttccaccgcgtttcttcccaaaaactcccgccgcagccataa

SEQ ID NO: 4950 - DNA, 1116 bp, A.fumigatus
ctcggacagtgtgggaaagagcatccccgatgttctcattgcatgaagcggcatatattatgccactatatgccgtcctggaaatattcacgctctacatcgacacagaaccggtcgtcaatgaaaacattaccatctatctctgttttgacttgcgtcgctcagtcgcagagtcagatgagtcccactggtccaaacgatgccaaagacaacctcaacgtccacgatctggagttgatgatgcagtggtgtactaagacatatcgttcattgtctcatagcagcaatgttgagagcatctggcagactgtcattccacgtgaggctatgcggcacccggccctaatgcatggtattctcgcgctgtccgcattgcatctggcttcctcaaccggaggaagcatgtacgaacgatatattaaaacggcggaggcccataaagacctggctctgtcaggcttcagaaagagattcacaaatatcgaccattcaaactgcgatgcagcctttgctttatgcagtctcacgaccatatcctcgctggcctttcctctgattgccggacagggccagacaaacacggcgctggatgatatttgtgaagctttccaagttgcaaggaactccatgaatgttctggtccagatcgccgaccaagttaagagtggcgagttgaagccgttacttgaggaggacgaagggggccccaagatgcccgacacttcgcggctcgcaatcatgtccctatcgatgacgaactcacagctcgtcaaccggaacccgaagcacgaaagggagatgtttgaagcaacaatcagacagttggggcagtctctagaaaagcttgcgcaaggcagggaagcttcaatcgtggcgttccagtggatgcaccacattccgccgaggttcatggacctagtgcatgagcgacatccgttcgccctggtcatcctggctcattatgccgtggtcctccattttatgagaagccgctggtggatgggtgattggggtgcacgaatcatccaacaagttggtcaactgctggactctcaatggcgacaatccattagttgggtattggacgctaccggctgttatattgcaccaacttga

SEQ ID NO: 4951 - DNA, 222 bp, A.fumigatus
cagtataatgcctcgaaagcgggagtggtgcagctggccaaatgcctgtctgtcgagtgggtggatttctgccgggtgaattgcatctcccctggtttcatcgaaactgatatcctggatatccatcccaaggagtggagggagaagtggtatagcatggtccctgcgcagcgttttgcggatgcatacgagttgaaaggggtgagttttcctttcctgtga

SEQ ID NO: 4952 - DNA, 462 bp, A.fumigatus
cgaaagaataaaaaaaaagctcacgatcaggtcgcgttgatctacaactcgtccaaaacggccgacacgaccgccgccgaaatcgcctcggcgaacaacgtcagggccgcagcttaccaagcgaacgtcagcaacaaggctgagatcgagaggaccatccagcagattgcctccgactttggaggactcgacatcatcgtcgtcaactcggggatcacctcgaacgtcgcggcggaggactacaccgccgagcaatggaaggaggtcatgcaggtgaacctggacggcgcattctacaccgcacaggctgcagcgcagatcttcaaagcccagggacgcggcaacgtcatcttcacggcgtctgtgagcgcgacgctggtgaatgttccgcagaagcaagcggcagtatgcggtttctcttgctcagcaactgcagcgagattgctgacggtagcagtataa

SEQ ID NO: 4953 - DNA, 435 bp, A.fumigatus
acagaatatgccatatatacgacaaaatccgcccagcaaccctatcatccggcggggccgctccccttcgccgcgacgaaccagcccccatcccatcaagcaaccactgccgcagcgcaacatactccccccgcgaatgtcgccagatattctccctcgcgacaacaaactgcgcacagcactgcgaccgcaccgcatcgttgcgccccagcgtcgcagcaagatacccctcccggttgtccccaccaaacaacacccctagcgccgccggcagcgccgtatccgacgccgcgcgcgcactccacggctccagcacagactggacccgattctccagactgccctgcggcgcggcggacgcagcgcatgtgctcacgctccagtcgcagcggaggttatggtacccgtgtggttccagcgcagcggggatgttga

SEQ ID NO: 4954 - DNA, 492 bp, A.fumigatus
atgggtttctccccagttggccggcaacttcaaatcctttggcaaggtatacgccccctgacaactccctggacttgtacatcgcagatcacaccgtccgtacaaccgacaataacactcatcggccttggggcacgcctgctcattcaaccgccccaaatccaccccatccccagtccccagtcccgtccccgtccccgtcccagtcccccgatgctccggggcaataaacagaatatgccatatatacgacaaaatccgcccagcaaccctatcatccggcggggccgctccccttcgccgcgacgaaccagcccccatcccatcaagcaaccactgccgcagcgcaacatactccccccgcgaatgtcgccagatattctccctcgcgacaacaaactgcgcacagcactgcgaccgcaccgcatcgttgcgccccagcgtcgcagcaagatacccctcccggttgtccccaccaaacaacacccctag

SEQ ID NO: 4955 - DNA, 1590 bp, A.fumigatus
tctctcacacgcttccaaggtagttctgatcttgcgcaaaaaatgatgtcaacaatgctctcccgacctgcagcaaacattacgccgccagaggttctgctgcaaatattttacttacttaatccgcgagattttgacaatgctcggcgaacatgttctcaatggatgcgtgccagtctcgataagaacttgctggagagcatgctgaagcgggcagggtggtgggacgcctggaaacaggactgccacaattaccgagttgatccttctgcaagcgagcagagtctggtgtggagaatgagcaggagatttgcgactgaatgtaccttgtctggtagcaagtctaatgtggaaagagctggctttttgacaacgggggtcgttgatttctctcgactttctcaggggcagtctctcgcgaagcacggggcttctgcgccccattcagttgctggcagtgtcatgaaccctgattcgagacctctggccacatcgaggttccatgttagcaagtgtgccaactatcttctcgttacctccggccgcatgatatacgtgtaccacctactctaccggaaatctggaagcgatgtttttacaacaatggacgctttaacagatttggatattgctcctgttaccagcatcatttgtcctgtcgaggtaatatcagctagcatcgacaccagcactccgaggattgtgattgcggcattgctgcgtgaccgtttgggatttgtttgtgacttgaatgcatcaagtgaacgttcctctgcgcaatcagaagtcatgcaactcttggatccctcatttatccactattttcgcgatatatgctccccagaagatcctccccggagcgtgtcgatctgtccaggccgtcgatgcgttgcttttggctccggtactagcatcgagctgcattgggttgacgaaaagacaagagagaatcggagaaagcggtttcccatgtcgcaaccatcggaaatactacacttccttcccaatcgcccggaaacacccatggaaatgaggctcatctcatcactggctggacctgggatgccgggctgcgagtgccacaaagtgtcgtacggggaaatgcgtgccccttgtcagcttcaccttctgactgacgtacaatcccttactcgatggactccatcaaacaacgacagtctgagtattgttagggcaacccattgtcaccattatcgagctatcccaatcaacgatggattgcatatcctgttcattgagccccgcacaggtctactctgtatcggctctgacgcgcctatcggtggaccgaccagcttaacacaggcacttgtctgtgtgccaccgtttgggaaggattgcttaaatgtttctaaggatgatctggcccctacagtctttgcttcaggatggaacctggactggggattgcgcgtggtcgctgcgtatggcgaccggattgtactatactcagtacctgtggatgtgtacaacgtcatccgaaaagagcgtgagagacaaggagacggtgtcatgggagatagtgatctgtcttcaccacggggctggaaggagccgctgccatcacaa

SEQ ID NO: 4956 - DNA, 1062 bp, A.fumigatus
agcttgtctttggtgatcatgagctcaaacaccttttcagatattctgtactacactaccgatagtgattatctcgcagctgctcttttcttcgccttcggtatcgtcattttaagtctgtggttggtcaatctgctggttgcagtgatcacgcactcattccaagtcatcagagaggagagcaagcgaagcgccttcgctgtccagaaactcgactcgctcgatacggagaacacatctacccgcaaaactagtagtttcaaacgtttctatgacaggacggaatggctctggatcggcatcatcattctcgatctcgttgtgcaggctatgagaagctcgacgatggaggaggatcgcgcgaatcttatcaatgttgtcgaagtctttgtcacgatcattcttctttttgaaatcatcctacgctttgcatccgattggcgcagattccaccgaagtcgccggaactgggttgatttagggcttgcgctcattacctgcgtcatccagatacctgcgatcaagcattcggggcgtccgtatgatgttctcactctctttcagattctccgagtataccgagtggtactagcgttctcggttaccaggaacctcatcatggttgtctttcgtaacgcgactggtctgttgaacctgatcatgttcgtgtttctgattacgttccttgcgtcaatttttgcgacccagctttttcgcggccagatacccgcagagaacaatggtggtgacgagatcgatatcaactttgctgatatatataattcgttcctcggcatgtatcagattttgtccagcgagaattggactactatgttgtacgacgcaaccgcattcacgtacccgttcaacactgcctggatttccgccatcttcattatcttatggttcatcgtggcgaacttcatcgttctcaacatgttcattgctgtcattcaggagagttttgacgtctctgaagacgagaaacggttgcagcaggtcagggcattcctggagcagaaacagtcttcaccacggggctggacggatccgcgattaggt

SEQ ID NO: 4957 - DNA, 306 bp, A.fumigatus
gttactgacgcaacaacgatggtcttcctcccaccagctacggcgggcgagctcgctccaattccggacaacattcccatcagcgaatttatgctgaatgagaaatatggccgtcaccctgctagccagtcgagagatccgtacacctgcggactcacggggaagtcctactccgttccccaggttactgaacaagtcgatcttttggcgcgtgcgcttgccagagagctgaattgggcaccgaacagcggtaccgaatgggacaagactctggcaattttcagcttgaacactgtaagtacttga

SEQ ID NO: 4958 - DNA, 414 bp, A.fumigatus
attgacacgctgcctttatcctgggctgtccaccagcttggcggtgtcgtgtcaccggccaacgctgcatattcggcggctgaactgaagcatcagctgcttgactccaaggcaaaggcgttgtttacatgcgctcctctgcttcgtacatctctggaagccgccgcaatggtcggcctcccgaaggaccggatttatttgctggaagtaccgccacaggccggaggtggaaaggaagccggactgggcttcaagaccgtgtcgcaattgatagagaaggggaaattgctccccaaagtggaaaggttgaattggagcgcaggcgagggcgctcgtagaaccgctttcctgtgttactcccagtggaacgtcttctaccacgaaggcgacgaagcatccgcgctaagcgatggg

SEQ ID NO: 4959 - DNA, 1575 bp, A.fumigatus
tgtatatcagtccctaccctgctaacaaccgctgctgacccgcacagatatatgtcagaaacacaagcattcttcctgttgtccgtactgtgcgatcgtcttttgccagggtactattcgacaaccatgtacggcaccctgctggatcagaaggtgtttgagtcattggtagagaagaccatgccggtattgtgggaccacctttccaagtccgatgttcagctgtccgtcgtttcccttccttggtttctctcactatacatcaactctatgccactggtttttgcattccgggtgttggatgtctttttcttagagggcccaaaggtactctttcaagtcggtctcgccatcctgcgcataaacggcgaagagctcctggatgttcaggacgatgggtctttcatctcagtcctcaaatcttacttctcacgtttggatgagtcagcacatccaaaatcggagaatccaaagctaagagcgatcacgcgattccaagagttgatggttgttgcgttcaaagaattttcgggtatcacacatagcaccatcaccgaacagcgtgagaagcacaaagacgcggttcttgagaatattgagagttttgcgaaacgcacgtctattcggaaccttggcccagacagcaaacgcctaagcatggatgatctgggcctgatctatgaccgattctacgaagtgctgtatgaccgccagcagaagcaaagacttatcgacgaggaaaagaagcgccaggagaagaaaaggtccgaacgaacttcaatactcggccctcctgtagaccaagaaatgggtcgggtcggccttggacctagccctactcatatggattacgacgctttccgcgacttccttgctattacagcgaaatgggctgttaccgattctcccggcccgtcgcggaaggagtcatcggccgatataaatggaagctttagaggcttcggcaaatggacatccggagcgaaccataagcccgaacctgcagaccacgaattcatgcaaagactgttccgtaaatgggcgacggatccgtccgaaggcctgagcttgcaaaacgtggtaaatggccttgcacggctgaagggcacgcgggatatcatgaatagcattaactacttttttgatttgtatgatgacaatggcgatggaaagatcgaccgggaaggcatactccggatgtcagaagctttgctcttcctttctcgccgaggtttcgacggtaccatcacgccgagtcaatctctggaggatttgaatgaccggaaccacccagaacgggataagttgagcaccgatgaaagattcctcggtagcgtcagctcgttcatccgtcgatgtttcgagtatgctgatcctagcaaacccgaaggcaagacaaccgacactgcgaatgatacaaatgaagcacctgacaagctggattcgtttgctattggagatgatgacgaagaggatcttatcgacatggaagagaacaaaaatcccaagggaagctcctccgtcacaaagcgccgggataacgaccacgatgcgggatgccacccccgagcataa

SEQ ID NO: 4960 - DNA, 420 bp, A.fumigatus
agagctttcgttaagatgtcttgcaatttagaaaatggccggaatgcaaccttagttcggcagccgacctttcataagctgatccgcgtcggtctgccaaatcgtttacgtggagagatatgggaggtgacctcagggtccttgtacctgcggctgaggtctccaaagttatacactgatactttggccaaattctccggccgggagtccttagcgatcgacgaaatcgagaaggacctgaaccggagtctccccgagtaccctggctttcaaagtgaagagggcattggccggcttcgaagggtcctgacagcttacagttggactaatgcggagatcggatattgtcaggctatgaatattgttgtggcggctttgttgatgtatatcagtccctaccctgctaacaaccgctgctga

SEQ ID NO: 4961 - DNA, 429 bp, A.fumigatus
agacttgctctcgtcacgggaggtggttcgggaatcggcctcatgatcatacaggcactggctgtaagcggtgccaaagtatacatcactggtcggacgggagaaaagctcgaccgtgttgcagaattgtactcgcacaatattcccgggcagatcattcccatcaccgccgacgtcactagcaagcaatccatccagaagcttgtcgacgaaatctcctccgaggaaaaagcactgcacattctcgtcaacaacgccggcatctcgggtacgacacaggacaccgacagtcagagcgccgaggaactgcaccagaagctcttcaaggacgagtccaattccgttgaagagtgggacgagatcttccgcaccaacgtaacccagctatatttcaccaccgctgctttcctgcccctgctgaataagtga

SEQ ID NO: 4962 - DNA, 399 bp, A.fumigatus
accgaccttgagcacggctggtccagtaccgttgtcaacatcagctccatttcaggcattctcaagacagctcaacaccacttccattacaatgctagcaaaggcgccgccatccatgtgtcgagaatgctggcgcatgggatcgcctcatccaacctgaagattcgggtcaacaacatcgccccaggggttttccccttggaaatgaccgccaacgacagcgacgagaagcagaagagctctcttcccaaggagaagtacgagggcaaggttcccgctggaagaccgggtaaggataaagacatgggcagcgctattttctccatctgcaaccagtacctgaatgggcagactatcgtggttgacggcggcttcgttcttgctgctggaactgtttaa

SEQ ID NO: 4963 - DNA, 297 bp, A.fumigatus
tcatgccattaccgcattgtccaacagcagaaagctgaattcggttattctaccgaagtagtggccgttgtttttctacgaaaccaggtggatcttgaaaccgaggacggagtgactagtcaaatgctaacaaggtataaattcttccatgctaacaaacacagatcaactaaatgtaaatgctgccacatcaaatgtagtatcaatcttaagtcgtccagtccctccttgcccattgcacccaacctatggttgacttcatatatcgagggtattattcagtatcttcgcgactag

SEQ ID NO: 4964 - DNA, 663 bp, A.fumigatus
ggactgacacagggttttgcacactccttaggcccccagattgcatggcgcactgtcttcattatcgagtacttgggacctcttctcatccatcctctgtttttgttccctctccggccatacatctactacaactttgataagcccttacccgagccttccggcctgcagctactggtctgcgggcttttaactgtgcacttcgtcaaacgagagctcgagactctctttgtccaccgtttcagcaatgccactatgcccgtccgccacatcttcaggaacagcgctcactactgggttctcgccggcttcaatatcgcgtactgggttttccgccccgacgcgggtgctgctactaacgaacccaacccagccctcctctacagtggtcttacgcttttcgtcttcggcgagctggccaacttgaatacccacctggtgcttcgcgatctgcgtcgacccggtactaccgagaggggcatcccaaccgggttcgggttcaaccttgtgacgtgccccaattacttgtttgagatcattgcctggattggcgtctatctggtcagcggaatgagttggagtgtcttgttcttcatcactattggtggttctacaatggctagcgtcttcaccacggggctggaaggatccgcggaggcgtaa

SEQ ID NO: 4965 - DNA, 534 bp, A.fumigatus
ctgtcgttgtgcgatatatcatcgaaaatgcagttcacaagcaagctttccgtcgctcttctggccatcctggctgccggtggtgaggccaaccatcaggctctccatggtcgcaagttctttcaccccagaggtttgaactcgaccactcctgcttccacctcaactgtcgttgtctacccgactccgatcgagtcttcgtccgctgctggtgactcgatctctgcaatcacctcaaccaccatccctctcagcactggtgctcctggatctggtgattccggcgacgacaatggtggccaggacgtcactatcacttacactctgggttctggcagcaccaagtcagtcgtcactactactatccacaagacttcaactgatcttcacactgtcttcgctgtatgttgcattgatcatattacactacttttgtcacattgcagccgattgactgactttctgtatcgtagacttcctctgcggatcttaccaccacaatctcttccacctctaccaccaccgctaccctga

SEQ ID NO: 4966 - DNA, 444 bp, A.fumigatus
ataaaaggtaccagaaccttcgtcatggatatagtgcaatttcttgaggagactagctctaagcagcccatccgctgcatcgacatgcacaccactggagaacccacccgcatcatctactccggcttcccaccactcttcgggactctcctcgagcaacgagaccaagccaaacagcaccacgaccacatccgcaaatgtctgatgctcgaacctcgcggtcacaacgggatgtacggcgccatcatccgccccgagaccgagctggtctcatccggggccgcgcacattggggtcctctttatccacaacgaagggttctcgaccatgtgcggaaacgcaaccatcgcactgggccgcttcctcgtcgacaccacgactactctgtattccctcgccgccaggacctcgtcttcgaggcagacacgcagaccgtcaaattag

SEQ ID NO: 4967 - DNA, 594 bp, A.fumigatus
tgccatcttcaccgcgaagaagccctcaaagtccgacccggccgatgtgattcttacatttcttccgccgttcataacatggagaacgcggcgtatttcggtgagcaagaagaccagatgaacatcttgagccggggtttcagtgaggcggagggcctcgaaggaatgaacatgtccgaattgcgaatctctatcgaagaactaaccaaacgcatgtgtcccttccaacccccgccacctccagttgcctacgatgaggccaaggatgccagcgccaccagagagacctccagcttctcgactgtcctgaccatccacgagtccacgcatccagacggccgcaagacataccaagctcatgcatcccctttcgtccccacgcaggacctggaggctcccggagccggggagaacgatgctatcatcgacattccccacgggtcggataactcatacatcgagcgcctgcgcgataacaacaccatgcatgccatcagcaccaggagacggcgcaagctaaagatgaagaagcacaagttcaagaagctgttgcgtaggacgagaaccctgcgacgcaagctggacaaggcttaa

SEQ ID NO: 4968 - DNA, 690 bp, A.fumigatus
gtccagccattctccaacccccagctcaatgttcgccagtcgttgctgcaagaggatgcacttgcgtggcctgagctagagaacgctgtaacacccgaagttgcatatgatcccctgatccagctgtattaccagacttttcaccgctcgcatccgctcctgatcccaaggaaagcactgcactctcacttagtcgcgaagataccacaatacatcctctcaatcatgcgcttcattggcgctcaccagcaccatgatccgtccctcaaagagctctttcgccaatctgcctattccgtgttgtccgccttgacgcctcgcgacggattcatggttcagggaatggtccttctcgccattgtggagcatgcgcgtggcgccgaagacagtgcaacccgtattatgcaggctgccgttaacctggccttggaactgggtatgaacaaagccgcattcgcggccgaacactctggcggaaattctattctcgaggagagttggcgccgaacttactgggagctgtactttgtggacggattcttggcggcaatgcgtgatcagagcgcgttccaactgttccatagccctgcagacgtgaggctgccttgtgacgaagagctttataactccggggacgtggtacgtcgttctaagtgtccttctgggcgcgccccgctgattacctgctag

SEQ ID NO: 4969 - DNA, 759 bp, A.fumigatus
gtgataccgagcaatctgacgttcaaagatctgaccaacaagtggcacttcgacgaggaaaggcggttcccatcatccgcatacagaatccaggccgtgcgcgtcctgggcatggtcatggaattgaaccgatcgctggatatcgacctagatactcagatcgaaaccatcgacgctgtgctggccgccttattgatgcaactgccatcatcccagcgggatgcgtatggcagccattgcggcctagatgaaatgacctttcaagctcaaatgacgagctacctgtgcgtgcatcacctatacaagcctctttccgtgcccactaacaaactgagcctgcccagtgccctgatctacctccaccaccctcgatcaaacatgcggtacgcctccatccatgcctatacctcctgcacccgcctcccaacaatccgcgagaccactcccccctccgcctccctggaccttcattcgcagaaactcctgcgagcagcagatctgctgtgcaacctagccactctgccgaatccggtcaaatatcgcaccccgttcttcacctgcgcgcttgccatgtgtgtggtagtgcacacagttgcgtgcttggttgtctccatcccagagaagcaggagtcgattaaggcgagaatccagcttggggtgggcgcgctgcatgtgctagggaagttgtggccactggcgaagacggttagacagcggttgatctccatgtatcaggagcttgggttgcgatgcagataa

SEQ ID NO: 4970 - DNA, 381 bp, A.fumigatus
ccaactatgtattttaatccgattaatcatggatgccattatttcggttccctacgaaggaaccgacggttgtctgtagtttgtggctactgtatccacttccacccaccacccacgatcatcgattcgcttggatccgcctctttcccaacccctgttcttgactttttgactgcttctatggattcgtttgagaacattcacgcctctaagaatcttgagcattctaaagatgggttactgactaacgctcttacaggtggtcgtgcagaattcccagtggtgtgtcaggattctccatgcggttcatttgcaaatttgacattcgttgatatcgattctcaagtcctatttgggcacctaggcaagtatgtgtattag

SEQ ID NO: 4971 - DNA, 663 bp, A.fumigatus
ggaatctcatctcagcaggtgatgaccatcctctcctcttcatcatgcatccggtccagcatgatgcggctcgttcctgcgtttcacgacgcggaaagcaaactccggttcaagattgatttcttcattctcaccttctgctgtatcacctatttctttaactatctcgatcgcgcaaatctcagtaatgcgtacgtatcaggcatgaaggaagagctcgcctttcatggcaaccagctcaatgtcatcaataccatcttcacggtgggctacatcctcggccaggtccccagcaacctggctctgacgtactttcgcccacgcatcttcttccccgccatgatcttcctgtggggcgggctgacgatgattacggccgcggtgcacagtccacaggggattatggctatccgcttttttctcggactagccgagtcaagcacgtttgtagggacgcactatatccttggatcatggtacacggaggaggagctgggtaaacgtagcggtatttttacggcttctggtttggcagggacgatgtttggcgggttcatccagacgggtattcattcatcgctggatggggtcagaggactctccggatggcgatggttattcattgtaagatttctgctttcccaaaatgtgatccgctgctaa

SEQ ID NO: 4972 - DNA, 246 bp, A.fumigatus
attgatggactgatcacccttcccattgccatttatggcctgtttcttttccctgacacaccagccaccactcgcgctccatatctgacggagtcggagcgtgcgttagccatctccagattgcccgtgaccaatgccgagcgtgcccccttgaatcgggctttcatcaaacgcttgttcaccacctggtactggtgggcgtttgtcatcctctgggtgatcgccggcgagaccgagtccttctca

SEQ ID NO: 4973 - DNA, 1149 bp, A.fumigatus
acgatggagctctactccggccttagacggctcctgagccggaagacgctcacaggaagccgaggattgttaacggcgacggaaaacgtatttgacggtcagcgacaagaggcagagaagttgtacaggcgtaatttcctggaaaattattccgataccgaaacagcacagtttagcttcttcaccaccaagctggactcggtgatccatgcatccagcatcaactctttggcatcgatctatggacctctccacacgctacttgacagtggagagcatgatggaatctggtggcttgacgtcacggatccctccgatggagatattgagcttctttcccgactgtttgatattcatccattgacgacggaggatatcaagatccgcgagacccgggaaaagatcgaactctttggcccatattatttcctctcactgcggccgccccagcaggctgaggacgtccctggctcgcggacgtcagggtgcaacgtctatgctattatattccgagagggagttctcagcttcaccttcggcaacaaccctcataccagtcatgtccgcagtcggatcaaggaccatcaaagccatctctttctgacaagtgactggatatcgtacgctttgatgtatggcaaccttctctcctatgtcgaatatatcctaactgacgaatgcagcgatgacatcgtggacggcttcgcaccactcatcaaccgcgtcgaagccagcgtggagacgatggaagacagtgtctccatcacccgaccagatgacatcgggctcgcgctgaagcagatttacacatcgcgcaggcaagtcctccagatccgccaactcctcaacgacaaaaccgacgtcatccggtgttttgcccgccactgtgaggcattgggttccacgcgcgaagtcgtctcctacctcagcgatattcaggaccatgtcttgaccatggtgtccaacctggcacactcggagcagaagctgtcccggtcacaggacaagtacctaggtcagctatccttcgactcgacccggatgcgcaatcagatagtggctacactgagccggctgacggtgattgcgtcctgtatcgtgcctatgcaaatcattaccggtttgttccggatgaatgttatgggtaca

SEQ ID NO: 4974 - DNA, 294 bp, A.fumigatus
agacgcgattcagagcaggcctcttcgcagtcattgccgccatcacagcagtcaaacttcggcatcttgggggactcggtcgattcgaagaacaagcgcaggcgaggaaatcttcccaagccagtcactgatattctaagggcttggttccatgaacatctggaccacccctatccgagcgaggaagataagcagatgtttatgactcgcaccgggcttacgattagccaggttagttttccagcgccatttttctcgaccccattcactgatgacttgcgcactgcagattag

SEQ ID NO: 4975 - DNA, 456 bp, A.fumigatus
cacttttgcccagctgaggataacatgaacgtccagctcaaggatatcacagtcactgctcgtgatggtcgcgtgtcgcacctggaccaggtctacattcgcggaagccacgtcaagttcttcatcgtgccggatatgctgaggtattacatctatactgttaatgtggtttacgtactgacgtctgcagaaacgcacccatgttccgttcgcgcggccagcgcggtagaggtgttggccttgctcgtggtaaggcgacagtgcagagggcccggggacaacggaggggttgatctactgaatttttttttttcgttggcgtttctttcatgtggttttcgtcattcatcgttcctaatggtaccttacttgtgtgggattgaaaaatgtgattccttgaagactgggttcggggcgatgaccgtccgatattcttcatccacagggacgaccgac

SEQ ID NO: 4976 - DNA, 210 bp, A.fumigatus
ttcaactgcagtcacacatatgctctcttagtactattctctttgccgtattccacaggcttgactatttaccagacggctcacaccaacagcaaatcaatcgagcacttctatctcattaagatgttgacttgtccgatattagccctgagagttcagctgcagaggtttaccagggagactaacatccactgcctgcatgtgaagtag

SEQ ID NO: 4977 - DNA, 216 bp, A.fumigatus
ctagacaccactaagctaaatgatttgataggacaattcaaattccccgagctcatcggaaaaaaggatctggtctctatggctaaggaaattgaagatgacgacggaatgccccagtttgtagactttatttctagaatgctgcgctggaggcctgaggaccggactacggcagaggacctgctttcccatgcgtggcttctggcgtcactataa

SEQ ID NO: 4978 - DNA, 360 bp, A.fumigatus
gatccgctaatagacgaacaagatcttaagtccgataacatcttactggccctacgcaacccgtctatcctggactcggtcgcgcaagatgaaatgaacaatccctctccacgaaaacaactggacgatcgggacatatacttatcccgaaattactggggactgtcacccgccgaactgggcagatcggtaataactgactttggacttgccgtacgtggtgacggcgccccgaacagccaccccatccagccagaggagtatcgggccccagaagtttgtctcggggctgattggagctacagtgctgacatttggaatttgggagttatggtaaagacctctttatcattatattga

SEQ ID NO: 4979 - DNA, 192 bp, A.fumigatus
ctccgagactctgttgccggttgtctctttggggaaaggtacatcgctgcagggacgtctagaatcttggttgaaatgctaacgtaccattccagcatcctttgggacatcaactgcctccgtaacatccacactgtcgacgagctctacatccgcagcatcaccaacgcatacatcgactcaaccccctga

SEQ ID NO: 4980 - DNA, 348 bp, A.fumigatus
agaatatggctgggtgtgggatctgcttctttccagcttatgacgtggcttataccaaatgtcatcggggatgcggtttccgtggctattgtgggattgctgctaggtcccgtctacccctgtgccacggcagtcttcagcaagttgcttcccaaaaatattcagatttctagcttgagctttatcagtgctatgggaagtagcggtggcgctgttgcgccgttcttcacgggcttgctggcgcacagtgtgggaacctatgttcttcacccaatctgcattgggctatatggtgtgatgcttgtgggctgggccttgatgcctaaggtctcgaacagatctgaatga

SEQ ID NO: 4981 - DNA, 1638 bp, A.fumigatus
  unsure (153): Identity of nucleotide sequences at the above locations are unknown.
aaagaagccaagttgaccgagcagtttcccctcatcatcgtttgcgaccgtttcactttcatccacgatttggttctctacttataccagaaccaacaatataagtcaatcgaggtctatgtgcagcgtgtcaacccttctcgcactccggcngtcgttggaggcttgctggatgttgattgtgatgaagctatcatcaagaaccttctgtcgaccgttgagccctctgttattcccattgatgagctcgtctccgaggttgaaacaagaaacagattgaagttgctcttacctttcctcgaggccactctggcgactggcaatcagcaacaggccgtctacaatgctcttgccaagatttacatcgacagcaacaacaaccccgagaagttccttaaggagaacgacatgtatgacacgttgaccgtcggtaaatactgcgagaagcgtgatccgaacctggcctacattgcatacaggaaaggacaaaatgacctggagcttatcaacattaccaatgagaatgccatgtaccgggcccaagctcgttaccttgttgagcgtgccgatcctgagatttggtcgttcgtcttgagcgagaataatttgcaccgccgtccccttgtcgatcaggtcatcgcaacagcagtccctgaatcgactgaacctgacaaagtctcagttgccgtcaaggcgttcctcgatgcagatcttcctggcgagcttattgagctcctggaaaagatcattctcgagccctcgcccttcagcgacaatggtagcttgcaaaaccttctgatgctgacggcagctaaggccgacaagggacgtctgatggagtacattcatcagctcaatgagttcagcgctgatgagattgccgaaatgtgtatctccgtcgggctgtacgaagaagcgttcgagatctataagaaggtcaacaactacatcgctgccgtcaatgttcttgttgagaacattgtcagcattgaccgtgctcaagaatttgccgagcgcgtggagttgccagatgtgtggagcaaagttgcaaaggcacagcttgatggtctccgcgtgtctgactcgatcgaatcgtacatccgcgccaatgatccctcgaattacctcgaggtcatcgagattgccactcacgccggcaaggacgaggagcttgtcaaatatctcaagatggctcgcaagacattgcgggagccagccattgacaccgcccttgctttttgctatgctcgccttgaccaactaccggagctcgaggacttcctacgtaccaccaacgtggccgacgtcgaaacgtctggtgacaaggcctatgctgaaggctaccaccaggcagccaagatcttctatacgagcatctccaactgggccaagcttgctaccaccctggtgcacttggaagactatcaggctgcagtcgaatgtgcacggaaggccaacagtgtcaaggtttggaaggaagtcaaccaggcctgtgtggacaagaaggagttccgtctcgcgcagatttgcggtctcaacctcattgtgcatgccgaggagctgcaggatcttgtgcgccaatacgagcgcaacgggtacttcgacgagttgatcagtggtctcgaagctggtctggga

SEQ ID NO: 4982 - DNA, 450 bp, A.fumigatus
cgttgcaatgtagcactaactggcgagcgctgcgtcaacaccatcggccctacgcttgggggagggttggggcccctctacggcattcgtggcccgcaggtagattctcttgtgtccgctcgcttggtaacagcttccggggatgtgataactgtctccaggagcgagaatcgagatctcttctgggctatcaggggtgctggtgcgaactttggtatcgtcacgtcggccacctacaggatctacgaccagaccaatggtggaatggctgtgtccgcccagtttgccttcgcgcctgccgtcaatcgctcggtattcgatctgatggaatccatgaatgatgagtatcccctggggatgtctggggggatgatactcagctataatcatacaaccaacgaggtaactatccttctgggctcccctttgagcttctcttcgtgtccttga

SEQ ID NO: 4983 - DNA, 366 bp, A.fumigatus
ccctcggtccaatggaatctcttgttcatggggtccaatgaagatgcccagccgtggctcgacaagatccaggccctgggtccgatcgactcgagtatccgcaacgtcccgtggcatcgcagggatgaacccgaagtgccatattgtgagagaggacaacactatatcctttacaacctgaacctcagaagaacagatgcagccactttgcagtcctacttcgatagcttcgtcgacttctcctccaaaaacccctggttcgattgcgatctcatgtatgaacggcaggcgaccgacgccgcgctggcagtgcctcttagcgagaggggagtagggccatggcgggacagtaaaatcaatgcgtaa

SEQ ID NO: 4984 - DNA, 387 bp, A.fumigatus
tgctacattgcaacgttagtgagctgtatctgcttatacatggaactcaagctgagtgctgggcaaaaagatgtaagagtttgtaccggtctctttccccacggaggacagaaggtcataaagctgggcattttccaccccgggtccgatggtgaccacctcattgtcaaggtccagatcgatgaagtcaagcaggctcaattcgatatttatggcattttgcacattgccaaagttcaactttacgccgtgtccgccaccagttgcgaaaaaagttatattgtgcgaggcagcagtggaaacctgatattctctctgagcatcaccggcgccgcatctcttgcttctttggtagatgtgctcacaattgcttggattatcttatag

SEQ ID NO: 4985 - DNA, 183 bp, A.fumigatus
ccggtctacctcgaaggctattttttcaagatgtgctcgcaatacttctacaagtacgactgcggctgcaccctcccggagggtgatgttgtctactgcgccaagcgaggcacctcttgcaccggcgtcagacagcagatccgacgccgagagggatacaactgccctgcccatggtggatag

SEQ ID NO: 4986 - DNA, 210 bp, A.fumigatus
ctgcggcaagctggtggcaggtcgaaccggaaactccgcatcctgttttctttcaaggcactcaacagcgagcttggcgcaaagaaaatgcgccacaaattgatcgttttctttgacggagaaacgcaatcgcccctccccccacgcctcgtcaagttgatgtacgattttgagattcgttcctctactgctcacagactgctgatctag

SEQ ID NO: 4987 - DNA, 510 bp, A.fumigatus
atctcaaacgcgctccttacctttgcgcgcagtgcagtgcaaagatcaagttacgcgtcgctataccgcccacatgtccagccactggcgcaattgaacagccagcgccgtcaccagagccagacgatacgggccgatcgtccgtttcgcgttgccattgtagggtcaggacctgctggattctatgcagcctataggctgctctcaaaggtcgaggatgccatggtagatatgtatgagaaactgccggtcccctttggcctggcacgatatggagttgcgccggatcatccggaagtcaaggtacgctcaatgcctttaagcacgccttcggaaaccatgttgattccattttggcaaatagaactgcgaggaaaagtttaccgaagtggcagcatctccgaggttcaactttatcggcaacatcgaactcggcacaaatctccctctcaaagcgctgaaaccacattacgacgccattctattcgcatacggggcgccgaaagataa

SEQ ID NO: 4988 - DNA, 483 bp, A.fumigatus
aactgcgaggaaaagtttaccgaagtggcagcatctccgaggttcaactttatcggcaacatcgaactcggcacaaatctccctctcaaagcgctgaaaccacattacgacgccattctattcgcatacggggcgccgaaagataagaagttgggtatacctggtgaggatgcacttcggaacgtgtactcggcgcgagagtttgtggggtggtacaatggcctcccggagcatcgtgatctcgcgccggatcttacagccggtgaggatgctgtgattgttggccagggaaatgttgccctagatgttgcaaggatactgttgtcggatatcaatactctacgaagcacagatatcgcagagtacgcggtggaagagttggtcaggagcaagatcaagcgcgttcgggttgtcggccgtcgcgggccgttgcaagtacgttggacaagttttccacggtatgcaatgctaatctgctcttag

SEQ ID NO: 4989 - DNA, 306 bp, A.fumigatus
gccgcctttacaattaaagagctcagggagcttcttcagctgccttctgtgtcgtttgatcccgttcctcgagacctctttccaccagacgaggttatatccacgcttcctcgggcacagaaaagattaatgcaactgctggcaaagggttcgcccaatgatcccaataccgcgagcaagtcatggtctttagatttccttctttcctccggaatgcctgaattggtcacctgtctatcctttccgcctctcgtccgtcaggttctcccgcatagaactggatccgagcaatcctcacacacctag

SEQ ID NO: 4990 - DNA, 411 bp, A.fumigatus
atttccttctttcctccggaatgcctgaattggtcacctgtctatcctttccgcctctcgtccgtcaggttctcccgcatagaactggatccgagcaatcctcacacacctagtgccaagattacaccaaagtacctctcaagcgggaagcgggcgcaagtcgacatacctgccaacactttcttccgcagtgtgggctacaaatctctccctctgcctgggttggaagatctaggcatccagttcgattctgatcgcggggtgctgcccaacgacggttttggtagaattaccgtcccgaccacttcagggggtaatgagcgattgcccgacggttcgctgatctcccatctgcctgggctccactgtgcaggttggtgtcttaacgccggggatggaagtattcgctca

SEQ ID NO: 4991 - DNA, 186 bp, A.fumigatus
ttgcggaagggcagagtgaagcgatcgctcactcaagcatacattaatgacatctttgccagtctcttgcctagcatcggcgatttgctgtcgcaccagactaacaattcgctctatgacaggatcaaagatggagcgcaggtcggcactaacacgagtcagcagcacattgatcgacgtcagtaa

SEQ ID NO: 4992 - DNA, 312 bp, A.fumigatus
acttcaggaggcaagtgcggatcgactgcggtcgaccgcaatttctacaagctgatgtcagaccgtttcggcgatgcgttcgaccgtttacctcgaaaacggaaaagtcctggcagtgaatttatgaggaagtttgagatcatcaagagagactttggaaattctgacgaagataccactttcgagttgcctctgaatatgaccgtggataatccagatccagagttcttcgatgaagaggagcgattagtccttatttccaggttaggaacccttactgacgtcgatcaatgtgctgctgactcgtgttag

SEQ ID NO: 4993 - DNA, 708 bp, A.fumigatus
aatgtgagtttgagctttccccttggcacggtcccagcggctaatgctgacgataatagtgtgctgaccactcctacccacgccgtccagttcttccgcaactcgcaccgtcacaccaaagcagtgaacaatgattccggctggttgtttggagaggtccttggcgtctgtgtcggcttactcagtggcaccgactggaaacgagtccggcagcaggtcgaagacggcttttcacgcccaactgcggctcggtatacgggtgacctggtctttctggcccgcgaatatctccaaaataccctgctcgcctcatctgagcagagcctcgaaaacaaaggaattatccacgttgagccagctaagactctacagttctatccctttctgtcggtggcgcagatcttgttcggacgcttgagcccgatgcaacgcacccagctgaccacgctcgctccgttgcgagaagagttattcaaggaggtcattcgggggggcatcaatcgcctctccatcgcgccttggttcaagtcacggggagtgcgcctcttgaacgaattccaaacgcagtgggaacagtttgtcgaagacgcctaccatgcagccgtcaagcgcaaccaatcccctaggccactggtcatcggtctttgggaggcctaccaggcggggaccatcagcaaacgcgaagtaagtgcttgtcccgacacatga

SEQ ID NO: 4994 - DNA, 249 bp, A.fumigatus
tcaacgttgggctgtgttgacaaatccttcatcctgcagatctccatcctcctttgtatgtctgatgagtactccgtaccctggggtggccaattcgagttgttccccctcgagcatgatactgccagcagacctacctacttgttctcctcccctgaaccattcctagagtcgaatacgtatgcttcaagatcttcctggcgttgcatcctgggtgggggtgggtcaattaacggccgtccttatgcc

SEQ ID NO: 4995 - DNA, 600 bp, A.fumigatus
atctggtatcgaataatgcgcggatcggaactgattttgattcccgtagggcttccaacctcgatactgggagttcttctctacatatgccttaatgcctcgtacacggtggcggtttttacggatcccgggtcgccgctgacgactggggccggtcggcatcaatacagtgctctgccggtctctgagttgcctgagtatacggcgtacacggtgagctcgactgggggatcgcggtattgcaaaaaatgtcagtgtccgaagccggaccgggcacatcactgctcgacgtgtaagcggtgcgtgctgaagatggaccatcactgtccgtggcttgcgacttgtgtcgggttgtacaactacaaggcgtttctgctgtttttgatctatacgtcgctattctgctgggtggattttgcggtgtcggcgacgtggatctggacggaggtcttcaacgatgctccgtatctagagacgatgctgccggtgaatgtggtgttgttggctatcttgggtgggattattggactggtgctgacggggttcacggcttggcatatcagtgctcgtcctcaccacgtggaagaagcacgccgctag

SEQ ID NO: 4996 - DNA, 210 bp, A.fumigatus
caaagtcagtgctcgaatctttttttgaacctcagtatccggagcagagccacaacgaattgtgagatcattatggaatatctcgtcgctattgcaagtgtgcctgagtgttgtcaggaaatcaagtacatggatattaacaagagcgctgctaccacgtgtatatcgcttaaaatctcggttttggacttggagacatcaagcagataa

SEQ ID NO: 4997 - DNA, 2364 bp, A.fumigatus
  unsure (698),(709): Identity of nucleotide sequences at the above locations are unknown.
aatgaggtgtttacactttccgtttggtttctggcttccggggttatgaaggaatacccccccacgggtgccccagcaacggttaatactcgtgccatcctgtcaggaaatatccctggccgtgggtcatcgcataagcagatagaccgcggtcaaggatgctgcgttctgatcgcggcctgttctgggccggcttgtgagccatcttccattatgtcgcgcacatcggcaggctttgcggacttctttcccactgccccgtcggtccttcaacaaaaaagagtcagagcgccgcgagatcgaccttgccccaaggatcggcccgaggatcaacttcatgtccaggatgacaatggacaatcgtcctgctctcctggagcaagcgcagccaacgtttctacgaatggcagcccacctagcgtatcagtatcggaaaccggtacgggtgtagagaactccggatgcaaactcgttggagaaacgaacacggacataacgggtacggatacatctattttaagtgcatcgcttgctcagtgtcgtgcaacgcaggtgaacgaggcacggttcgataatcttaccccggtcaccaatgcagagtcgtctccgcctcgcaagttgagccttcatcaatccaagtccgttgaagtggccgaatacgaatcgaacaagtttgcaaccgatgaatcgaaacttgntgctacacccntacatacaccgccaactccacggtcgcaaacatcgcgcagtggtgtaattaagggttgcaagttggtttacgaccccgatcttgagaaaagatcatcgaaagaaaagagaaggaagccacagtatgtggactttgtggtgaatgaacaagatggctgttcaccagacccacgtctgagtattctgaattacactcgaggtgctggctgtaagcagaagaccaaataccggccagctccttatagactgaaacagtggccctatgacactgcaactactatcggtcccggaccccccgtccaaatagtggtcactggcttcgatcctctgaccccagtggctccgataaacgcgcttttttcaagcttcggtgagatttcagaaataaataatcgcacagacccgattacaggtcgatttcttggagtatgttcagtcaagtacaaagacagcacctcttttcgaggtgccgggccagtaccagcggcgaccgcggccaggcgagcctatgttgaatgcaagaaggagcagcggattgggacacgaaggattcgggttgaactagatcgagatggtgctgtctcagacagaattgttgcaagggccatcgagtctcagcgaatgggacataagaagaacatagtcggagaagaggcaaaagttgagcctcaagcaaaaaagaatgaaccaccgccgacagctcccaaaggcccttcaaggtcttccacacgtccggtagcagctgtacctgaaggtccaagggcgagctttctcaagcccgccataccctctctgatagaggaaacacccatattagcgcaaatcaagcgggatccatatatcttcatcgcgcactgctacgttcctgttttgagcacaacgattccgcatctgaagaaaagactcaagttatttgactggaaagacattcgatgcgataaaactgggtactatatcatcttcgagaattctaggcgtggtgaggaggaaaccgagcgttgtttcaaagtatgccatatgaagcccctttttacttacatcatgaatatggaaagccagccctatggcaatcccaactatgagcgaagtccgagcccagaacgactccaagcagagcgacgggaacgggcagagagagaaaggctgaagaaagaggcggatttggatctcgaggaagagaagaaacagcgagcgattgatttggacccatgcagagaagtcctggctctcatcgtccgcgatttgaaagataaacttcttgaggatgtcaaatcacgcatcgccgccccaacattgtatgactatctcgaccctgacagacatgcagcaaggaggcgggctctgggcattcctgatcctgaggggatcagaaaacatacttttcgactcgatgctgataattttggatccaacaatccccggtctttcctaccaggcgaccgttcgttcagcccatatggccttaacatacttgcgctcccacgtatccgaaaagctcgtcgtttgaaacgtgccaatgctgccttcctagatgagaagcggaagcagcctgttcggagaaaggaaatacgtcctctctatcacagaatgcagcagttgcatgatgtcgacgactctgatgaggaacaacgttctccggtcctccaaggattttga

SEQ ID NO: 4998 - DNA, 276 bp, A.fumigatus
gggaggcccacctgcgccggcagaccgcgcgccgcccgtgcggccatgtgccccagccaactggtcactgcccttcgtcaccaggcggcggcggcgcgcgggtccccgcggccatctcggccggccaactggcgagagtccatggaggtggagatcccgaggggaccggccgtcaccggtgcccccccgcgtctccggagaaaggtgtctgggcccccctccaagcgcccggcgctgccgggcccgttgatgggaggtgtttgccaacaaatctag

SEQ ID NO: 4999 - DNA, 579 bp, A.fumigatus
  unsure (504),(514): Identity of nucleotide sequences at the above locations are unknown.
ggaagggaggtaggtgatagggacgtggtgcacaaggacagcgtactggtgattgatgatgtaggcatgctcgcccttaggcagcttccggagccaggcccttttcattccaggagaggcgcgcccgatctgacgcggaatgggtatacacatcaaggtcgccgctacgaagcacctgggccaccgctacctgcacaccggctaggggaggcccacctgcgccggcagaccgcgcgccgcccgtgcggccatgtgccccagccaactggtcactgcccttcgtcaccaggcggcggcggcgcgcgggtccccgcggccatctcggccggccaactggcgagagtccatggaggtggagatcccgaggggaccggccgtcaccggtgcccccccgcgtctccggagaaaggtgtctgggcccccctccaagcgcccggcgctgccgggcccgttgatgggaggtgtttgccaacaaatctagccaaggatcgggctgacgctcancgactcgtancaacaaggctacttgaccgcttacacgacccgcttggtcacttcagtcgtctgcagaggattcat

SEQ ID NO: 5000 - DNA, 480 bp, A.fumigatus
  unsure (43),(53): Identity of nucleotide sequences at the above locations are unknown.
agtgaccaagcgggtcgtgtaagcggtcaagtagccttgttgntacgagtcgntgagcgtcagcccgatccttggctagatttgttggcaaacacctcccatcaacgggcccggcagcgccgggcgcttggaggggggcccagacacctttctccggagacgcgggggggcaccggtgacggccggtcccctcgggatctccacctccatggactctcgccagttggccggccgagatggccgcggggacccgcgcgccgccgccgcctggtgacgaagggcagtgaccagttggctggggcacatggccgcacgggcggcgcgcggtctgccggcgcaggtgggcctcccctagccggtgtgcaggtagcggtggcccaggtgcttcgtagcggcgaccttgatgtgtatacccattccgcgtcagatcgggcgcgcctctcctggaatgaaaagggcctggctccggaagctgcctaa

SEQ ID NO: 5001 - DNA, 624 bp, A.fumigatus
tgttggcttcaaccatgtcagccgggacaacaacagccgaagccgcttcgttgcatcataacagcccatgatcctaaaagcggcaaagctgtcttcagcaacgccattagtgaacaggtatcattctctggatttcctgttcccccgggcaagccaccggcgacagactatgttctggcctacaatacaaatgaattgcctgtgaaagggctttcgcctccaagttctacaaacccggcctccaaagccgatctcgacatcaagcattatcagtcccatctctcgcagccgtctcctttgcctccagtaaacggtacatcctgcaccattatcgaggtaccaccgggctcggcggtcccgatgcaccgaacaacaactctcgactatgctgttataatagacggcacaacagaattagttcttgattccgacgaaaaaaaagtattgaaaaagggcgatgtaattgttcagcgaggtaccgctcatgcctggcggaatgtgactgaacagagtgacaattctggtgtcctgcgtatcttctttgtgtttctgcccattgagaaggtgcaagtggaaagcggactcattgatatggacttgactctgtctctgaaacagacttga

SEQ ID NO: 5002 - DNA, 231 bp, A.fumigatus
acgcttatcatcgatccccggcgtgtcgataaactagaatgtaccgcattgatctctctttccattgttcgccacggctttctaccgagtacgacgatgtctgaagagaagcccctcaacgcggccaaagaccaggacaaggatgacattgtctacccaaccggtctcaagctcgctctgctgatgacatccattttcattggcatgtttctggtttccctcgtatggtga

SEQ ID NO: 5003 - DNA, 681 bp, A.fumigatus
ccgctgcaggaccgactcatcatctcgcccgcgattccccagatcaccgacgagttccactcagcaggagatattggctggtatgggacggcgtacctcctgaccaactgtgcttttcagctgctgttcggtaaggtatacactgtattcagcatcaaggccaccttcatgacgtccattgtcctgttcgaagtcggttcggctctctgcggcgcggctccaaactcgatcggattcattctcggcagagccattgctggcctgggttctggggggatttttgcgggcgccctgacagttattgtgtatgcgctcccactgcacaagcggcccaagtatcagggggcctttggggctgtgtttggggtcgcctcggtggctggcccactggtcggcggtgcctttaccaccaatgtcacctggagatggtgcttttatatcaatctgcccctaggagcagtagttatcgcgaccacccttctttttttcgaaatacccgaccatcagaacgccccgaagccgctgaaggggaagctgcgtcagctgaacggacttggagtacttaccattatgcctggagtcgtttgtctttgcttggctctgcagtggggtggctcccagtatgcagtacgttctcattcatcactggctttgttcaccactggtattgactgcgtctag

SEQ ID NO: 5004 - DNA, 228 bp, A.fumigatus
tggggagagggccggatcgtcgcgctgctggtgctgaccttcctgtgtctgatcgcgttcgtcttgatccaggtatggaagccagagcaggcaacgctgccaccacgagtcttcctacaacggagcatcgcctccggtttctgggcgagctgctgtttcggcgcacacatgatcgtgttcggtgagtcggctggatttcaacctccactgatgggatccgcctgctaa

SEQ ID NO: 5005 - DNA, 192 bp, A.fumigatus
atccaatgccgatggatcggtatatcggcattgcggccctgttggacgacggccactaggaggaacaaaacaactgacgatatgaacttgacaggcaactccggcgttgtccgtgctcagttccgccacaacctcccccccaagtccttcggtgctaccgtccgcgtcatgctctacccctccaacatctaa

SEQ ID NO: 5006 - DNA, 558 bp, A.fumigatus
atgcgttttccttccagccgggcggttaagacaaactcttgtggcagcatgtcccttctggacttctgggacacattgcgccctcccgtgaagcgcaggaagactacccctaaagagggtcaagagagtcccagaacagtcgcacttcggaaggagggatccagaatcaaggaaaacgaaatcgatagctctgatagtccatcagatacatgggattccctgccctcggctcaagttggcgattttgcggtcgaggacgagagcttggtcccaaacagtcagacagaattagagtcttcgctaccagatattcctacagatcaacaagctatcgcggagtatgaaacttcgcatgtggtaggacaagatgacgagcctaatctgcgccagaggcttcaagacggcaaatggcggaagggaaagacttcaatctatgtggatgcattcaatctggcactggaaactgtgctggacgaagaagcccaccttttcaatgaggcggagttagaggtttttgaacaatggaaagggctatcgtatgagtcccaatacttgtga

SEQ ID NO: 5007 - DNA, 207 bp, A.fumigatus
caggtcggtgattttcaacgattacgaacgcctcaacaagcgggatacaagtgggctcccaaatccttgctcaactttcggactcctcaattgacctgccctgacgaaaagaagactgctcctcttgagaaggacaacggcccggttaggccttccgggttcgttatcggggctattatgggactttgcctattaaaaacctgccct

SEQ ID NO: 5008 - DNA, 684 bp, A.fumigatus
aatgaaggcgtccctgcaggagacaaagaccgcaagcgcaaggcgatccggaatatgcggcacgtctattcaaatgcgaaagcggtcctggtcttggacaagttcatccagaaaatcccatccactgctccagcgttggataaagtcgctcggctgtatctgtccaactggaccaagcgcctctggactcaccaagaagggtttctaccatccttggtatacatacagttctccgatcggccagtcgagttacgcgcgctggcagaagagttcatgacctataatcgtgaacacctggaaaagtcaggaaagtatctaggattcccgttcgcggcgaatctaaggctgctcgacctatactccgcattgaggggtctcatgaagctagtcaaggaaaagtggatgctctatgaacctctcgcgcatcatttgtcaccacggaggagcacacgactcgcggacgaaacagtgtgcatggcaacgattatcgacatcgaccttgacaggatccaggcgatttcatgcgacgatgacgagggagtcgcagaggagcgcatggcggctttcttggaacaattcgggacgtttgacaggtcggtgattttcaacgattacgaacgcctcaacaagcgggatacaagtgggctcccaaatccttgctcaactttcggactcctcaattga

SEQ ID NO: 5009 - DNA, 294 bp, A.fumigatus
tcattggtcccaacgttgtggtcggcgatggcgtgcgtctgcaacgctgtgtgctcttggagaacagcaaggtcaaggaccatgcttggatcaagtcgactattgtcggttggaacagctccgttggcaagtgggctcgcttggagaatgtcacggtcttgggtgacgatgtcaccattgctgacgaggtgtatgtcaatggcggctctattctgccccacaagagcatcaagcagaacatcgatggtatgttaccactcgcgctatacgaacgtcatgaattgcgagaactaa

SEQ ID NO: 5010 - DNA, 708 bp, A.fumigatus
caaaccatcccttttgcattgatcgtttcgtccaaaaagccagttgagtttggtggtaaccgcaattaccgccgggattctacatcctcacccctagtgttctcaagcgcattgagctgcgtcctacctccttcgaacagaggacattcccccgccatctgcagcgacggtcagtcccactcctttgatctcgagggtttctggatggatgttggtcaacccaaaattttcctgacgggcacctgcctctacctcacctcgctcgcgaagcgtaactccaagctgctggcccccaacagcgagccgtacgtctacggcggcaacgtcatggttgatccctcggccaagatcggcaagaactgtcgcattggccctaatgtagtcattggtcccaacgttgtggtcggcgatggcgtgcgtctgcaacgctgtgtgctcttggagaacagcaaggtcaaggaccatgcttggatcaagtcgactattgtcggttggaacagctccgttggcaagtgggctcgcttggagaatgtcacggtcttgggtgacgatgtcaccattgctgacgaggtgtatgtcaatggcggctctattctgccccacaagagcatcaagcagaacatcgatggtatgttaccactcgcgctatacgaacgtcatgaattgcgagaactaacgcattgtatagttcctgccattatcatgtga

SEQ ID NO: 5011 - DNA, 669 bp, A.fumigatus
  unsure (481): Identity of nucleotide sequences at the above locations are unknown.
gtcagggacaaaccctgcgctggggagcgcgctgacctgtatctatcaactggggtgtttcatcgagtaagtcgccttgcaaggtattctggactgtggctgatcctggatagttaccacggtgatcgtggacatccatatccgtcctcggatgacggccttctgggttcatgtacgggtatgttgagttgcaccgcagtcagctcgtgcaagaatgtcggagaactactgccgctggcagtcgagattgtcagattgactatccacctcgggctctgtgtcatgagagtccgagagatggtggactcgacggagtcatcctccggcagctggtcaatcctcgtctcggagatcaacgaggcagatgccaccagcctgattggcgattttgtcaagaagcgagtaagtacagtgtacgaccattggaagaagaatattgacaataccagggaattcccccctcgtcgcaaccgtacatcancgcggttggatcgaaaggtctcaccatcagtgcaccacccgaaattctcgacaactttatcgaagaaggtcttccgaaggagtacaaacacttcaaggctcctggagtcagtggtccgtaccacgcgccccatctgtacaatgaccgagaaattcgcaatatcctcagcttctgctccgaggacgtga

SEQ ID NO: 5012 - DNA, 420 bp, A.fumigatus
gttgcacttaaagactcctcttttcaaagtgggctgttgttttcttctgctttataccaaaaaaccccatgtgcggcggtccaggataatcactactccttgcagtcacggccgcgcaaaccactcgccatggaggatctccatcgcctctatctctttggagatcagacaatcagctgtgacgaaggcctccgcaacctcttgcaggcgaagaaccatactatcgtcgcctcgttcatcgaaagatgcttccatgcactgcgtcaggaaatcaccaggctgccgccttctcagcgcacgctcttcccgcggtttaccagcatcgccgacttgcttgctcagcatcgtgagtcagggacaaaccctgcgctggggagcgcgctgacctgtatctatcaactggggtgtttcatcgagtaa

SEQ ID NO: 5013 - DNA, 1188 bp, A.fumigatus
  unsure (41): Identity of nucleotide sequences at the above locations are unknown.
caataccagggaattcccccctcgtcgcaaccgtacatcancgcggttggatcgaaaggtctcaccatcagtgcaccacccgaaattctcgacaactttatcgaagaaggtcttccgaaggagtacaaacacttcaaggctcctggagtcagtggtccgtaccacgcgccccatctgtacaatgaccgagaaattcgcaatatcctcagcttctgctccgaggacgtgattctgcgccacacaccacgggttccactggtctcgagcaacacagggaagctggtccaggtaaagagcatgcgtgatctgctaaaggtggctctggaggaaatcctcttgcgcaagatctgctgggacaaagtcaccgagtcatgcctttccatcgttcaggctaccaacgacaagccctggaggattctccctatcgccagcaacgccacgcaaggcttggttactgcactccagcgtatgggaaactgccagatcgaggtagacaccggggttggcgctcctcaaatggacccggccgctcccaatgcaacgggcaatgcttcacggtctaagatcgccatcatcggaatgtctgggcggttccctgaggcagatggtatcgaggccttttgggacttgttgtataaaggtctggatgttcacaaaaaggtcccacctgagcgatgggatgtggacgcgcacgtggacttgaccggcacaaagagaaacaccagcaaggtcccatacggttgctggatcaacgagcccggcctgttcgatgcccgtttcttcaacatgtctcctcgggaagcactccaggcagaccctgcgcagcgactggcgctgctgtcggcttacgaggccctggaaatggcaggcttcgttccgaacagcagtccatcgactcagagagaccgcgtcggcatcttcatgggtatgaccagcgacgactaccgtgagatcaacagcggtcaggatatcgacacatacttcattcctggagggaaccgagcattcacgcctggtcgtatcaactactacttcaagttcagtgggcctagtgtcagtgtcgacaccgcctgctcgtccagtcttgctgccatccacttggcctgcaacgccatctggaggaatgactgcgataccgccatcagtggtggtcttcaccacggggctggaaggtccacagtggtcata

SEQ ID NO: 5014 - DNA, 591 bp, A.fumigatus
aaaggagagattaccgaccctcccactgctgaaacgaatcctgctgtttacggtcctggaggcacagacgttccttttgagtcggttgattttacaggatccggcctcttctgtgctcagtgtgttcgcaaccagcatctcttcacaagtgcgcttgcctcttattttccgtcgccggaggatccaaattatagcgcctacgagcgggaatatcccagttttcgcaggaacctggaggaacgatacccgcaagtatgcgcaaactgcgaacctcgggtgaaggaacggatacgtcaagctggatatgaggcgaaatcggaccaccttcgacggatgatggacaggagcaaagcgggaagggcagcgagacacgcgcggcgttggaattggagaaatctactggtgtcagcgggtgctatgggttactggggcagcgttgctggtcaactgtcctgggatactctgggcgctctgagtgccgatcatcatctccgcgatatgtacaatgacttatcaccgccgtccattgcgttctgcgcccgtgccgacattacagaaaccgccaactaccaagttttatgcctgggttga

SEQ ID NO: 5015 - DNA, 438 bp, A.fumigatus
acggcagcaccgaaagcgacagcctcatcggggttgatacccttggaggccttcttgccgccaaagaactcttcgaggagagcctggaccttgggaatacgagtggaaccaccgaccagaacaatgtcgttgacatcagacttcttgaccttggcgtccttgagcacctgctcgaccggcttcagagtcttcttgaacagatccatgttgagttcttcgaacttggcgcgagtgagagtctccgagaagtcctcgccgttgtggaaggattcgatttcaatgcgagtggacatctgggaagacagagtacgcttggccttctcgacttcgcgcttgagcttacccatggccttgatgtccttggagacatcaacgttgtgcttcttgttgtactgcttgacgatgtattccataacgcggtggtcaaagtcctcacca

SEQ ID NO: 5016 - DNA, 687 bp, A.fumigatus
ggtatcatgtattgggcctctaatcatacatcgaggcgactctggcgtatttccaaaggaaagtccataatgaatcaattaacatatcaaaactccgtaaatccctctaaagtaattttacagttcgtcatgtccgctgggctcatcctcctcatccgctggtgcagagccatacagcttgctagtgatggggtaggccacattggacagttgctccttctgctcctcaaagtcctcggtggtggcagtggcggcgttgtcctccagccagtcggtcacctccttgacagcatccaagatggtctgcttgtcatcctcatcgatctggccaccaagcccgttctcgtcgttgacctggttcttcaggctgaaggcatagttctcgagagagttgcgagcctcaatcttggccttgatggccttgtcctcctcggcgaattcctcggcctccgcgaccatgcggtcgatctcctcctgggacagacgacccttgtcgtttgtaatggtgatggactcggccttgccggtacccttgtcgctggcgctaaccttcaggataccgttggcatccaggtcgaaggagacctcaatctgaggcacgccacgaggagcgggagggatacccgtcaactcgaactttccgaggagattgttgtccttggtcagagaacgttctccctcatctga

SEQ ID NO: 5017 - DNA, 780 bp, A.fumigatus
  unsure (190): Identity of nucleotide sequences at the above locations are unknown.
ggcacgccacgaggagcgggagggatacccgtcaactcgaactttccgaggagattgttgtccttggtcagagaacgttctccctcatctgagataagtcagtatatctccatatcttcaatcaagtacaatggcaaaacacttacaaacttggatcaagacggtgggctggttgtcagcggcggtcganaagatttgagacttgcgggtaggaatgacggtgttgcggggaatgagcttggtcatgacaccaccggtggtctcaatacccagggtaagagggttgacgtccatgagaacgacatcgccggtaccttcctcaccagagaggacaccaccctgaacggcagcaccgaaagcgacagcctcatcggggttgatacccttggaggccttcttgccgccaaagaactcttcgaggagagcctggaccttgggaatacgagtggaaccaccgaccagaacaatgtcgttgacatcagacttcttgaccttggcgtccttgagcacctgctcgaccggcttcagagtcttcttgaacagatccatgttgagttcttcgaacttggcgcgagtgagagtctccgagaagtcctcgccgttgtggaaggattcgatttcaatgcgagtggacatctgggaagacagagtacgcttggccttctcgacttcgcgcttgagcttacccatggccttgatgtccttggagacatcaacgttgtgcttcttgttgtactgcttgacgatgtattccataacgcggtggtcaaagtcctcacc

SEQ ID NO: 5018 - DNA, 663 bp, A.fumigatus
  unsure (591): Identity of nucleotide sequences at the above locations are unknown.
ggtgaggactttgaccaccgcgttatggaatacatcgtcaagcagtacaacaagaagcacaacgttgatgtctccaaggacatcaaggccatgggtaagctcaagcgcgaagtcgagaaggccaagcgtactctgtcttcccagatgtccactcgcattgaaatcgaatccttccacaacggcgaggacttctcggagactctcactcgcgccaagttcgaagaactcaacatggatctgttcaagaagactctgaagccggtcgagcaggtgctcaaggacgccaaggtcaagaagtctgatgtcaacgacattgttctggtcggtggttccactcgtattcccaaggtccaggctctcctcgaagagttctttggcggcaagaaggcctccaagggtatcaaccccgatgaggctgtcgctttcggtgctgccgttcagggtggtgtcctctctggtgaggaaggtaccggcgatgtcgttctcatggacgtcaaccctcttaccctgggtattgagaccaccggtggtgtcatgaccaagctcattccccgcaacaccgtcattcctacccgcaagtctcaaatcttntcgaccgccgctgacaaccagcccaccgtcttgatccaagtttgtaagtgttttgccattgtacttgattga

SEQ ID NO: 5019 - DNA, 576 bp, A.fumigatus
cttatctcagatgagggagaacgttctctgaccaaggacaacaatctcctcggaaagttcgagttgacgggtatccctcccgctcctcgtggcgtgcctcagattgaggtctccttcgacctggatgccaacggtatcctgaaggttagcgccagcgacaagggtaccggcaaggccgagtccatcaccattacaaacgacaagggtcgtctgtcccaggaggagatcgaccgcatggtcgcggaggccgaggaattcgccgaggaggacaaggccatcaaggccaagattgaggctcgcaactctctcgagaactatgccttcagcctgaagaaccaggtcaacgacgagaacgggcttggtggccagatcgatgaggatgacaagcagaccatcttggatgctgtcaaggaggtgaccgactggctggaggacaacgccgccactgccaccaccgaggactttgaggagcagaaggagcaactgtccaatgtggcctaccccatcactagcaagctgtatggctctgcaccagcggatgaggaggatgagcccagcggacatgacgaactgtaa

SEQ ID NO: 5020 - DNA, 273 bp, A.fumigatus
  unsure (37): Identity of nucleotide sequences at the above locations are unknown.
gaatccggaaatagtgaggacagaccagagcaacgtntacaggcagttttcagcgaagattactttcagcagatcatccgcttcttaactgcgttggctcgattgccagtttttaaaagcttctcgctcagggattactactcacagccagttcggcatgaatatgtgagtgcagaaaactccgtcaccaataactgggacgatgaaacggacccggtgtatcctttaccagccgcaaactgtgggctgaactcagtcgttgtggatgggtga

SEQ ID NO: 5021 - DNA, 240 bp, A.fumigatus
cttggcctggaatcagtccgactaggattcacgggaaacgtggagaatggaccagagacaacgcctctctgcggaggcctaccccgagtcttccctgtgatcgaagcattgctgttcggccaggcagaagaaaccgctggaccatgccgcctccgagatcgcgacttttcaccagaggacggatcgatcgccgagcgtggttccgcggccggcagaagacgttttcgaccacgccgctag

SEQ ID NO: 5022 - DNA, 537 bp, A.fumigatus
ggaagcactgtaggtgctggggcgctgataaccatgccaccatccacagtcttctcctactggcgacgtgaacatcgtcgcgcgagtgcaccccccgtctcatcgtccggacaggtctcttcaagaggcaaaagcaacggcaaccgtcctcagctcccggttattcagcacacgccgatccttgcgactacggttgaggaatcgtctccatgccccgatacgctgactccccttacttcgagcgaatactctcctgcagatggcgataccgataagggacttggtgtgggctctacagtctcgacagatgcgccgtcatctgctgcgaccaacctggcagtaccgtcctccacttcggacaagcaagcgcgtcctcattccagtccggaagaccgcgaaaagaacttggatctgactgctcagccgaactcgtcacaagtgtccattacggcttctcgtcccgagtatggcgatagtgattcctcgaagccgaactcgccttgtcttacacgaccggggctggaaaaagtacgcgcc

SEQ ID NO: 5023 - DNA, 294 bp, A.fumigatus
ttatcgcactcaagaaccgccatcatgggcaacgagacggtcgtcccgtccgagaacgagctgaagaacttcaaccctggcaaccccgatgtggtcgagctcatccgttatgcgcaggagagtgatgctgctgatcgcttactgaccgtgagacaagctctgtcaaagtacaaaaaggccgtcttctgggccatgttcctctcgaccagtttgattatggaaggatatgacctggtcattgtcagtacttctctcctgacgagggagagagtcataactaaaagtaaagtttga

SEQ ID NO: 5024 - DNA, 333 bp, A.fumigatus
cagatcacctctttctacggccaatcccaattcatcgaacgattcggcgagttctcagacaaagcaggtaaaaaggttatcacagcagcatggcagtcgggattgtcaaactcgtccatggtaggacagctgaccgggttactgctcaacgcttactctcaggaccggttcggctgtcgaccaacaatgatgttcttcatggcctggatggcgcttatgattttcatcccggtttttgcgccgtcgttgccgatcctggcctggggtgaggcgatgtgtggcgtctcgtggggagttttccaggtccgtctttctgctctgttgcatgcatag

SEQ ID NO: 5025 - DNA, 462 bp, A.fumigatus
accctctcgactacgtatgcttccgaagtcgtccccacggtcctacggccgtacgtcacagcctatgtctgcatgtgctggggtgctggtatcctcctgtcgtccggtgtggttcgtgccgtcgctggcatcgacggagatctaggctggcggctaccgtttgttttgcagtgggtctggccgatccccctgtttatcggagcgtacctggctcctgagtcgccttggaatgccgtccgacggggcaaggtcgacctggcgagaaagagcttgagacgcctgcgacaggacacaccggacaaagagcgagaggtcgaggcgacgctggcgtacatccagcataccaccaagctggagcaagcggagacggaaaatgcaagtttcctggaatgcttcaaggggacgaacctgcggcgaacggaaattgtacattctctcattactatgtccaacggcgcctag

SEQ ID NO: 5026 - DNA, 189 bp, A.fumigatus
aattgcgtcgtctgggcggctcaaaccctcagcggcaatgccatcctcgggtactcggtcgtttttctcgaagcggctgggtttacggagctgcaagccttcgatgtcaacatctccctttccgcatgctacatcgtcggcggcgtcatgtcttcaccacggggctggaaggtccgacagtgtcagtag

SEQ ID NO: 5027 - DNA, 396 bp, A.fumigatus
gaaatctccacaggaatcattcgtttatttctactgacacggttaggatgtcttcaccaacacccgcccactctggcacccccccggcgcccgcggcatctttggcggagccgccatcgcccagtccctctcggccgcaatgcgaacggtgccgaccgatttcgccgtccacagcatgcactgctacttcgttctagcgggcgactcggaaatcccgattctataccacgtcgaacgagtccgcgatggccgcagcttcatcacccgcacggtgcaagcgcggcagcgcggccggcccatcttcacaacaacactgagcttcagccgggccaacagcggcggcaagaagcgcctcgagcacgccacgcccaaaccgagtctcgccgaccctgctga

SEQ ID NO: 5028 - DNA, 204 bp, A.fumigatus
gtctgtccgggctccatacttataaagaatgggaaaggggctattaataaaactgagctggctgacaataatacgatgatccgtacagccgaatctactctcaacggaccgattagtgatgccaatcgtcatctaaagtcggcacatccaagcgatggagatgcctcggcatttaccaattcgggagtctcgtgcagcgcgtga

SEQ ID NO: 5029 - DNA, 501 bp, A.fumigatus
gatgtcttcaccaacacccgcccactctggcacccccccggcgcccgcggcatctttggcggagccgccatcgcccagtccctctcggccgcaatgcgaacggtgccgaccgatttcgccgtccacagcatgcactgctacttcgttctagcgggcgactcggaaatcccgattctataccacgtcgaacgagtccgcgatggccgcagcttcatcacccgcacggtgcaagcgcggcagcgcggccggcccatcttcacaacaacactgagcttcagccgggccaacagcggcggcaagaagcgcctcgagcacgccacgcccaaaccgagtctcgccgaccctgctgagggaaccagacgctcgctggaagatatccgggggccgtttgagacacacatggcggggactgtcaaccgtaagcaaaattgcctccactcccctgcccatgagcagctggggctagggacgattcgagaggtgctgagatctgacacttga

SEQ ID NO: 5030 - DNA, 786 bp, A.fumigatus
acgcaggcgattcgcccaatcccgaggacaagcgcgtgcgacggttcgctcgcgcgcggggccgcatctccgaggcagggggccaccaggcgcacctctccccgcctggcctacatcaccgacagctacttcatcgggaccgtggcacgggtgcagaacatcccgcggttctcgtcgccggcggagctgcggcgggcgctgcaggcgctcaagaacccgtcggacctggacgacgaggacatcgcgcgggcgatcaaagagctgaaggaggaggaggcggccgatctgcggcggcggctggagggcgcgctgagccaggcgacaaaccaaccgaaggaggaccggaaggaggtcggcatgatggttagtctggaccattcgatctacttccacaatccgtgggcgttccgcgcggacgagtggatgctgatggagatggagagcccgtgggcgggcgagggccgggggctggcgatccagaagatctggtcgcgggatgggacgctgattgcgacttgcacgcaggaggtacgtttacgcttccactcgctctcgcgaacattacggtttgggctactgcctgcaagaaaacggccgctaacgcttgttcgtgtctttctagggagtggtgcgattaaaacaggacgagcctgctcgtgcgaagatttagcggttactggactagacctgtttccatttcttttttttttttcccttttcgctatttactatattctgatagactcgacggacacattggcctcttttgcttctgtttatagttgt

SEQ ID NO: 5031 - DNA, 846 bp, A.fumigatus
gacacgactggaccggaaacgtcactgcctggcctgccagaattaaccagccgaaatcagaaattacgtggtgcagacatgagttcctctcccgatgaagaaccagccggcgtatctggtttcgaaaatgaatcacctgcggcgcatacgtcgcaggggatgaaaccggaggaaccattggaacccgaagctcaccagcctatacctatccctcctcaacagcctcgttcccctactcctccaacgccgccccccgtacgtgattcttctccaattcgcgttgccgtgccggttggacgaggagaagttgcagacgctcacgatgaacaatactcgccacctcctgtcatgccgacacaaagcctccgacaggcagtaccggatgatgaacggctcgaggatactaccattgatattggtagggaagcgtcaaaatctactgcctttcaccgtcctcaagacgaggcgctgcaggctattgtgcagtatgattatgagaaggcagaggacaatgaaatagacttgaaggagggagagtatgtgtctgacatagagatggttgataaagactggtggcttggttctaattcgcgcggcgagcggggtctctttcccagcaactatgttgagctcgtcaaagacaaccagaagcacctcgcatcagttgctggagctgaagaccccaaggaaatccctccagccgcttctatccacagtcctgggggagggaagggtacctcacagccgaccgcaatggcattgtatgactacgaggctgcggaggacaatgagctcagcttcccggagggtgctcaaatagttaatatcgtaagtgggacatgttga

SEQ ID NO: 5032 - DNA, 192 bp, A.fumigatus
gtgggacatgttgaaattctttttgctttttcgtcttctttctcttttagcttgcttttggccagacaatctagccagacaacggtatcgctaactcgacaccaggaattccccgatgatgattggtggttcggtgagtacaagggtcagaaggggctcttccctgccaactatgtacaactcgaggagtag

SEQ ID NO: 5033 - DNA, 663 bp, A.fumigatus
tcatatgagcctcagatcgcggcagttctctgtttcctggcctggttctaccccgtcggcctctaccgcaacgccgaatacaccgacagcgtccattcccgaagcaccctcgtcttcctcatcatctgggccaccttcctcttcgccagctcctttgcgcatctcctcatcgccggcgtcgagagcgccgagctcgcctccgcgctcgcaaacatcatgggcatcatgatgtacgccttctgcggcatcctcgccggcccgcatgcgctccctggtttctggatcttcatgtatcgggtcaacccgttcacgtacctggtgtcgggactgttgtcggcgagcctgggtgatgctccgatgcactgcgcggctaacgagttcctggcgttttcgcctcctgcgaatcggacttgcggcgagtacatggaggactacatggccttggccggggggtacttgctggattcggccgcgcgcggtgatgagcaatgccagtattgtcgtgttgataacacgagccaatacttgaggaatttcagcattgacttcgcgactcgctggagggatttcgggctgctctgggtgtatgtcgccgttaacaccttcggggcggtcttcctctactggctttgtcgggtcccgaaagggaagaaaagactgtga

SEQ ID NO: 5034 - DNA, 474 bp, A.fumigatus
caacaccgcccagggactacagaaccaggtgtttggtgtctttgtcttcctcttcgtcgtcatccaactcatcttccagatcattccaacatttgtcacccagcgaactttatacgagtctcgcgagcgccagtccaagacctactcctggcaagccttcgttctctccaatatcgccgtggagtttgcatggaacacggtaagtcgttagagggcagatatgcacagacacagacccggactaatcatatgagcctcagatcgcggcagttctctgtttcctggcctggttctaccccgtcggcctctaccgcaacgccgaatacaccgacagcgtccattcccgaagcaccctcgtcttcctcatcatctgggccaccttcctcttcgccagctcctttgcgcatctcctcatcgccggcgtcgagagcgccgagctcgcctccgcgctcgcaaacatcatgggcatcatga

SEQ ID NO: 5035 - DNA, 726 bp, A.fumigatus
tggacgttgtcgtccatcccgccggtgaagactgaccgcctgcatgggcgagactacgccgacgcgattgtcggcgtccccggggaaggcttgaacgtggaacagaggaaacggctcaccatcggagtggagctggctgcccgtcccaagctgctcttgttcctggatgaacccacgtctgggctagacagccagacgtcctggtcgatatgcaacctcatggagacgttgaccagaaacggacaggccatcttatgtacgatccatcaaccgtcggccatgttgttccagcgcttcgaccgactcctgctcctcgccaagggaggaaagaccgtttactttggggaaatcggatcgggggccaggaccctgatggattactttgttcgcaatggtggacccccctgcccgaaaggtgccaacccggcagaacatatgctcgaggtgattggagccgcgccaggagctcatacggatatcgactggccagcggtgtggcgcaatagtccggagtaccagcaggttcgccaggaattgtctcgcgtgagacagctggccagtcagccttcgtcggtgcattcggatgacccatccagctactccgagtttgcggccccgttcccagcccaggtgggccaggtcggtcgtcgagtcttccagcagtactggcggacgccgtcgtatctctattccaaggcgatcctgaccgtcggttcggtaagttaa

SEQ ID NO: 5036 - DNA, 264 bp, A.fumigatus
ccgttacgcaaattgcagtccatcttcataggcttctccttcttcaaaggtgacaacaccgcccagggactacagaaccaggtgtttggtgtctttgtcttcctcttcgtcgtcatccaactcatcttccagatcattccaacatttgtcacccagcgaactttatacgagtctcgcgagcgccagtccaagacctactcctggcaagccttcgttctctccaatatcgccgtggagtttgcatggaacacggtaagtcgttag

SEQ ID NO: 5037 - DNA, 471 bp, A.fumigatus
  unsure (405): Identity of nucleotide sequences at the above locations are unknown.
ccacttttccttccctgcaggggcgagtcgggcgtgggaagatggactgtaattgtcaaagacaccaatgtgaatgagttcaccggagagttcattgattggcgactgaatctctggggagaggctatcgacggcgccaaccaaaagcctcatccctttcccgatgaacatgacgatgatcacagcatcgaggatgctattgtggctaccaccagtgtggaaacaggacctaccaagaccggtgtccccggctccacggacgacaccataaatcgccctgtgaacgcaaagcccgttgaaactcagacaccatcacccgctgaaacgaccgcaaccaaactagctccacccgccgagaccaggccggctgctacggcgacatcttctcccacacctcctggcggngttccgaccagtttcctggccaagcttccatgcccaccttccggggcttcccaaaagaagccataa

SEQ ID NO: 5038 - DNA, 720 bp, A.fumigatus
agacatttcgacggctatacgaatagcatttacagtatcactgtaggtgctattgaccgggaaggaaatcaccccagctattccgagtcttgctccgcacagttagtggtcgcttacagtagtggctcgggcgacgcaatccacaccactgacgttggaactgacaaatgttactcttttcatggtgggacatcggcggcaggacctttggccgcggggacggtagcactggctctcagcgctcgcccggaactgacatggcgcgatgcgcaatatctcatggtggaaacagccgtcccgattcatgaagacgacggtagttggcaggtcaccaaggctggaaggaagttcagtcatgactggggctatggcaaagtcgatgcgtacgccctggttcagaaagccaagacctgggagttggtgaagccgcaagcctggttccactccccttggctccgggtacagcacaaagtccctcaaggcgaccagggtctagccagttcgtacgaggtgactgagcagatgatgaagaacgcgaacattgccaggttggagcatgttacggtgaccatgaatgtcaatcatacacgccgtggtgatcttagcgtcgagctacgcagtcctgaaggcattgtcagccatctaagcaccacaagaaagtcggataatgaaaaagcgggctatgtcgactggactttcatgactgttgctcattggtag

SEQ ID NO: 5039 - DNA, 687 bp, A.fumigatus
cgccatcgtctaatagccatgttgaacgggacatccgtcgccgccgccgaaaaggacggttctcgctttgtgaatttcattcttcccagctacgactactacaatctggcctcgggtcatgctggccacctccccgagttcgtggaggaccatgtcgatgcgggcttcgtccatctcgtgtgcttcccctgtgcgccaggacaaccctgcgagtacgatttgacggatccgcactgcgcctacacggaaccttatttttccctcgttcccgaaatgccaatgaataagcagtacgattacaaatacctgcctgacgtggatggcaattcctttagcggacggtaccgcggattcttactatcaacctcgcttcccatcaaagctaccatctacgatgaatggcatgactcgcggctcattccctgggcccatttcgtccctatggactcgacgtttctagatatctacggcataatggagtattttattggataccgcgggtcggggcatgaccacgccgcgcgaaagattgccctgaatggcaaaaagtgggcggagaaggtgcttcgcccggaagatatgcagatctatatgtatcgattgttgcttgaatacgcaaggatctgtgatgatagacgtgataatttgggttataccgaggatatgttatgggtcagacgtgggtag

SEQ ID NO: 5040 - DNA, 207 bp, A.fumigatus
tctggatctcggctcggccgttcgctcgtgatccttcggctgcagtgtccttggtgcccgtcccagatcattattgtccgcgataccgcggctcattcgtcctctctgaactataacaataacaatagcgcaaccattctcgcggggcagttggcctttttctatctttcggtctttcttctgtctcctacacttcttcaagactaa

SEQ ID NO: 5041 - DNA, 270 bp, A.fumigatus
aggcttatcactactaggttttgcgccgacactcaccagagccccgatgccctgctaagaaaactgaaaccagctgatgtcaagtcatggtttgattggattgaggataacttcagcgggtcaatcaaggctcatgggactctctcgaactactggatgactctcaagaggctttatttcatgaaaaataagaaagatatgtctcgatcaatgatcaatgactgtattaacgtaagatttattctcctaagcgcgagaagtggtctttaa

SEQ ID NO: 5042 - DNA, 630 bp, A.fumigatus
tacatgaacgaagtcagcaagcgaatgcgcctacgcaaacttcctctgcccaaagacacggaaaattcacttgatctgctctcttaccagaccgcccaccttgtccattgtaaagcagtttttcctgatgagaagcagaggctctaccacatggctaccctcaatttgtccagcgttactgcctgtcgagcggtttcgctgttcgatacacgatgtcaggtcgacttacacccggacggcagcccggtcattcctggtaaaatcgaggcaggcagcaatggagcactaaattctccaacccctgagcaaagtggcgaggctcactgtgactctggctatgaatcgagccgcagtggccgcctcaacgtcgatgaagatgatatgctcgacgagatatccagcgacggttcttccgatgacataatgagcgatattggctacgtgtcagactgttctagtgttgttacagatgatggatatcttgctggtgacgatcagacaggcaccattctctggaggcacgttgagttctgcattgcgcggaaccctgaacccgggcgcccaaatatcctctttgccattgtgaccctcatccatactaagggtgaagatcggaagccccgaatgtaa

SEQ ID NO: 5043 - DNA, 255 bp, A.fumigatus
agtgatgcaagtcagctatacaatacgattgaaaacgtgaagttgacggcaaatggacaaagttactccacgggtcctatcgaagctgtccagctggtccactatcgaaacttgactggcgatggagcgtgggtgttcaacgaatcggcagacgcgatattggctgctcgcttggatccgatccccatcgactcgacggagcacgaagcatccgaatttaccgtcactggtgagctcccgcaactccacaactag

SEQ ID NO: 5044 - DNA, 1488 bp, A.fumigatus
  unsure (41),(102): Identity of nucleotide sequences at the above locations are unknown.
aatctagggaaattagaggcgctgacaccccggatcaatanacgatatgagcattacgtccagttgatgcgcgaacgtcaagctcggacttcgcatcagganacaacctcgtcgaagcaggtgcaaccatatgaccccgcgttggcgggagtagtcgaacctttggaggcagggaagaacagagatttggcagtgcagcttgcacggacagagatcagccggagggcaaccgtcaggaaagccttgcgtcaggctggtgtgccacaagaagaggagcaaagccggcgtacggcgggtgtctggaacaactgggaaattgcaacggataaagatggacctgggatggacaatgacctgagccgccggattcaaaatgtgagactcaacatcgaccagcaaactcatgcgaacgctcgtccgcagcaattgaagcctgcagagccatcaactagcacctacagttatccctccgtcccccggacaaaaccgctggagcctttgccatctgcgtcgacgaacgtgtcccgagatgaaaccagctggcgcttggaagttccattgccacccccaaaggagcgatttggatcaagttcatccgtcatttaccgagggagcgacccccgccactattgcccgacaaaggtctcgtcgaccccggccccggctgttccagagaagggacagccgttggcagctggcggaaactcacgtccagacctgaacccctccagcttcacattcaagccgtcggcatatctagagaatgggacaccgctgcgcaccgtgtggctacctcccgatctacgaacgcattttttggccatagcgggccctaacacgcgacgcaacctagagacgtgcggcatcctgtgcggaactttgatttcgaacgcactatttgtctctaggctgcttattccagaacaaacggcgacgtcagacacatgcgaaaccgtaaacgagtctgcgatctttgactactgcgattccgaggatttgatggtgttaggctggatccatacgcaccccacacagacttgttttatgagttcgagggaccttcacacgcattgtggataccaggtgatgctccctgagagcatcgcgattgtttgtgcgccaagtaaatcccctgattggggtgtgttccgactgactgatcccccggggcttaagacggtcctgaactgcacgcagagtgggctatttcatccccatgcggaagctaatatttacaccgatgcgctgcgacctgggcacgtctatgaagccaaagggttggaatttgagactgtggatcttcgtccaaagggatcccgggggttgatgatagatgttggatgttgcgatgtactatgtatgatatggcttgccattaggataccatctccagcgatgtgctgtttgttctccgctttagaatcattgctaagttcagcatacattacatattttacagcaagatgtcactgcttgctcctaccatga

SEQ ID NO: 5045 - DNA, 261 bp, A.fumigatus
tcaagtatgtatgcatgcatgctctctcattccctttatacaaaatcatacattacatacatctttcatccaacctggccagtggtttcgactcatccgctcattcctgcaaaatcctgcttcgagatcgggaccgagaaggagcgcgggagcgcgatcgagagcgccgccgcgcgccagaacatgcgctatactgacgctttcgctcgggggtgggctttcgccgaagtcgcgagcccatacggttccccggaacagtag

SEQ ID NO: 5046 - DNA, 1320 bp, A.fumigatus
ggatatagaacgttgttgagttgcttagtcgttccagagtcgagttcagccctgttctcttctccaactgaggaggggcggaatcattcgcgggtaaaaacaaaaccctcccagcttctccaacgccgctccgttcaacaccccacctgcttctctttcctcattgttatcatagtctctatgcccaaaaagcatcacaaacactccttcgtgaagcctgttagtccagctcatcatactttactcccgtccggccctcgtaaccaaaatgaacggtatcacgcttcgcagccctcgtcctcaagcacatcgacaccatctgtcaacgacctgatcaaccatcttcgtcgcacgcaggtttcccggtcgcctgaagatggcgccggcagcccaacccgggttgtagctcctcggtcggtccatccgtccctacggaacttgctagagctccctgaaaccccaccacctcgtccccgcccggaagcacgccgcgtcggagtcactggacgactgctgaggaggactcccggaccgccgcctccccagagctggctcttggggagtcatgataaggatacatcggatgaagacttgaactccacaaatgctgcgcgagtagagaggattatataccggttggatcggctgccggggacgacgttcccgcgcaagtcggacttgttgcacatggttctgaagtccatggcatcgcaatgggcatggcatattgaatacgatgggcaatttctggctgtgctgcccagtcacgttaagattttgctgctgagctatattgctatttatgcgggagaccaacctctgaaagggctgatgcatgggctgaagcctctgtttgagaaattcagtaccgatgaccatgagagtggtgatgctggagatctaaccgaagatggcgactcagagatcttgcgtctggatttgagcagtgcgttggggcgctggatgactataaagcagctctcacatgaacttttagtctcgaacaagtcaggagcaaatcttgtgcaaggcaatgctaaggagcccgttccgtcatcatgggaagagatcgatgacgaagaagttgatacggcggatgaaagtcctaatatgccgatccccaaggcattaagccagggccttcgctttcaaaatcttcgcttcctctccttagcgcaccccaaacccgcggctgcgaactggaacgcccttgttgaccttctatcgcgtctatcaacaattactcatctttctttggcgcactggccgttaccaacagttaccccgaacgctatgagcgcgcgcatcaagcatcccgcc

SEQ ID NO: 5047 - DNA, 219 bp, A.fumigatus
ctcatctttcattttgccctctcgttgcgggccttcttcaatccatgtctcagcgagaccgtgtttggggtcttcatcggagaggcctctagtccgccttacctccaggacaagatcccggaccttctgggtaacctcctttcgcagttcgatcgcctcttcgtcgtgcagcagttcatcgctgagcaccccgaggggaaggttgcgagactccggtga

SEQ ID NO: 5048 - DNA, 1035 bp, A.fumigatus
tatctgacatgtgtaacactttggcagtttcttgacttcgttctctcgtctattgagacgggtagaccaggttccattcgttcctcttcctcagttcggaacgccgcgccacctgttttggtctcaaatgttggatctcgggcatacaagcctactaatggacttggtagcaatgctaccgggcaggggaatgttgctgcgggagtgaaaaggaaagcagaggatcagttgcgtcgaccgcagaaacctgagtctgaagcatcggccaagccatcggcaggcaaacccgttaatgcttctattacttcaaagtctcgcccagtcgccgcttcgtcttctgccaagtctacgcacggaaatactgcaaccgctgctcagaaaccgcctcagatctcctcgaagccccctcctaaaggatcatatgctgatctcatgatgaaagcgaaggaactacagacgaaagctccagctcaagtgggcatgttcaaacatcaaccggtagccaaggagaagctcagcaaagcggaacgcaaaagacgagctttggaggcgcagataaaagagaaagagtcacggctggccaagaagcccggcactgtttctggcagagcaaccggaacaaaatctggtgatgggaaacttgccagaaaacgggaacacgaggaattaacctacaagggcacagcgagaccgtcgcagaccccaacgcagctggagtaccggggaacagccggcttgccaagtcgacgcagctcacaagaaccgaaagcacagtctcgtgctagcaagcgcgctagaatgaatgagtatctggcaacagatgaagaagacgaaggagacgattacgatgagtactactccgcatcatccgacatggaagctggctacgatgatgtagaggaggaagaagctgctgcattagcagctgcgaagaaagaggacgaggaggaattgcgcgctgagcttgcagccaagcaggaaaagctagaacgacgaaagaaacttgcagcattggctgctaagagtcgatcctga

SEQ ID NO: 5049 - DNA, 285 bp, A.fumigatus
caggggtttcacagattcaaaatgaagcacctcgccgcttacctcctcctcgcccttgctggcaacacctccccgtcctctgaggatgtcaaggccgtcctctcttccgttggcattgatgccgatgaggagcgcctgaacaagctcattgctgagctcgagggcaaggacctccaggaggttagtaactacagctcgaagattacagactgggaattttggactggcgctgacatcgaacgttttctaccacagggctggcaaggatccgcaaacttagcgtct

SEQ ID NO: 5050 - DNA, 276 bp, A.fumigatus
gaagacctacaaaaggccgcggcgttgctgcgcgagagaaatgacgaactcgcccgtctcgaaactttagattccggcaagggctattcagagacaagcacagtcgacatcgtgactggtgcagatgtactggaatactatgccaacctggtaggaggcggtggtcttaacggcgagacgacgcagttaagagaagatgcatgggtctttaccaagaaggctccgctgggagtctgcgttggcatcggcgcatggaactatcctctccagatgtaa

SEQ ID NO: 5051 - DNA, 1020 bp, A.fumigatus
cacagtgctctctggaaatcggcaccatgtcttgcggctggaaataccatggtctacaagcctagtgaatatacgcctctgcatgcgcagatgctggctgaaatctaccgggaagctggacttccccctggcgtatttaatgttgtctatggcgctggggatgtgggtgcttatttgactgctcaccccctggtcgccaaggtcagcttcacaggacaggtgtccacaggaatgaaggtggccggctccgccgcgggacaaatgaagtacgtcacgatggagctaggaggcaagagcccattgctcatcctccctgatgcggaccttgaaaatgcagtaaatggggccatgatggccaatttttttagtacaggccaggtgtgtactaatgggactcgagtgttcgtcccgagaggcatgaagtctgcctttgaaaaggctcttctggacaagatgcaatatatccgtcccgggccgttgtttgacaacgcaacgaacttcggacccttgagttctgctcttcacctcgaaaaggtaacctcgtacattcgtcatggcattgagacggacaaggcaacgctcctctatggcgggctgggaaagccctcccttccaaaggatttggagaatgggttctgggtaaggccgactgtcttcacggactgcaccgactccatgcggattgtccaggaagagatttttggcccggtcatgtcaatcctgtactacgatacagtcgaggaagctgtcagacgcgcaaataacactgagcttggccttgcggctggcgtctttacgcgagacctgaatatggcacatcgtatcatcgaccagctccaagcgggcattacatggatcaattcctggggtgaaagcccggccgagatggctgtgggtggctggaagaagagtggtgttggcgtggagaacgtccgcagaggtatcgaagcctgggtaaggaacaagagtacgctggtggatatgaatggacgggttgctactgtctttgcaaaattgtag

SEQ ID NO: 5052 - DNA, 432 bp, A.fumigatus
catgaccgggccaaaaatctcttcctggacaatccgcatggagtcggtgcagtccgtgaagacagtcggccttacccagaacccattctccaaatcctttggaagggagggctttcccagcccgccatagaggagcgttgccttgtccgtctcaatgccatgacgaatgtacgaggttaccttttcgaggtgaagagcagaactcaagggtccgaagttcgttgcgttgtcaaacaacggcccgggacggatatattgcatcttgtccagaagagccttttcaaaggcagacttcatgcctctcgggacgaacactcgagtcccattagtacacacctggcctgtactaaaaaaattggccatcatggccccatttactgcattttcaaggtccgcatcagggaggatgagcaatgggctcttgcctcctag

SEQ ID NO: 5053 - DNA, 339 bp, A.fumigatus
agagcagaactcaagggtccgaagttcgttgcgttgtcaaacaacggcccgggacggatatattgcatcttgtccagaagagccttttcaaaggcagacttcatgcctctcgggacgaacactcgagtcccattagtacacacctggcctgtactaaaaaaattggccatcatggccccatttactgcattttcaaggtccgcatcagggaggatgagcaatgggctcttgcctcctagctccatcgtgacgtacttcatttgtcccgcggcggagccggccaccttcattcctgtggacacctgtcctgtgaagctgaccttggcgaccagggggtga

SEQ ID NO: 5054 - DNA, 1395 bp, A.fumigatus
cactgcgggaagacttccgatgcatacgatcccaaggccattgaatccggccggtacgaatggtgggaggagcgtgatcttttcaagcccgagttcggccccgatggcaaagtcaagcccgagggttacttcgtcatcccaattccgccaccgaacgtcacaggttccctacacatgggccacgctcttaccaatgcccttcaggatactatgattcgttgggagcggatgaagggaaagaccactctctggctccctggtatggatcacgccggtatctccactcagagtgttgtcgagaagatgctctggaagaaggaaaagaagacccgccacgatcttggacgtgaggagttcacgaagagagtgtgggcttggaaggacgagtaccatgcgaacatcaagaatgctttgcggagagtcggtggttctttcgattggtcgcgtgaggctttcaccatggatcccaacctgtcggctgccgtcaccgagactttcgtacggctccacgaagaaggcatcatctaccgcgccaaccgccttgtcaactggtgtgtggccctgaatacctctttgtccaatctcgaggtcgagaacaaggaggttgaaggacgtacattgcttgacgtacctggttacgacaagaagatcgaatttggtgtcttgacccacttctgttatgagattgatggcaccaaggagagaatcgagatcgctacgacccgtccagaaaccatgatcggtgacacaggtattgccgtgcaccctgatgacaagcgctaccagcaccttattggcaagttcgcccgtcatcccttcgtcgaccgcttgatgcccatcgttgccgatacggatgtcgatcctgaattcggtactggtgcggtgaagatcacccctgcccacgatttcaacgatttcaaccgtggaaaggcccacaacctcgagttcatatccgttctgaacgatgatggtacctttaacaagaatggtggcccattcgttggcatgaagcgtttcgatgcccgttacaaggtcattgagatgctgaaggagaagggattgtacgtgaaatgggagaataaccccatgaagattcctcgctgtgccaagtcgaatgatgttattgagcctattctgaagccccagtggtggatgaagatgcaagatctcgctgagcctgccatcaaggctgttgagaatggtgagatcgtcatcaaacccgaatccgctgagaagaactacttccggtggatgagaagtatcaatgactggtgtctttcaagacagctctggtggggtcaccaggctcctgcttacttcgttaagatcgaaggcgaagaccgggatgacagtgacggtaacctgtggggttaccgggcgttccgaaaaaattaa

SEQ ID NO: 5055 - DNA, 1110 bp, A.fumigatus
aagacaccagtcattgatacttctcatccaccggaagtagttcttctcagcggattcgggtttgatgacgatctcaccattctcaacagccttgatggcaggctcagcgagatcttgcatcttcatccaccactggggcttcagaataggctcaataacatcattcgacttggcacagcgaggaatcttcatggggttattctcccatttcacgtacaatcccttctccttcagcatctcaatgaccttgtaacgggcatcgaaacgcttcatgccaacgaatgggccaccattcttgttaaaggtaccatcatcgttcagaacggatatgaactcgaggttgtgggcctttccacggttgaaatcgttgaaatcgtgggcaggggtgatcttcaccgcaccagtaccgaattcaggatcgacatccgtatcggcaacgatgggcatcaagcggtcgacgaagggatgacgggcgaacttgccaataaggtgctggtagcgcttgtcatcagggtgcacggcaatacctgtgtcaccgatcatggtttctggacgggtcgtagcgatctcgattctctccttggtgccatcaatctcataacagaagtgggtcaagacaccaaattcgatcttcttgtcgtaaccaggtacgtcaagcaatgtacgtccttcaacctccttgttctcgacctcgagattggacaaagaggtattcagggccacacaccagttgacaaggcggttggcgcggtagatgatgccttcttcgtggagccgtacgaaagtctcggtgacggcagccgacaggttgggatccatggtgaaagcctcacgcgaccaatcgaaagaaccaccgactctccgcaaagcattcttgatgttcgcatggtactcgtccttccaagcccacactctcttcgtgaactcctcacgtccaagatcgtggcgggtcttcttttccttcttccagagcatcttctcgacaacactctgagtggagataccggcgtgatccataccagggagccagagagtggtctttcccttcatccgctcccaacgaatcatagtatcctgaagggcattggtaagagcgtggcccatgtgtag

SEQ ID NO: 5056 - DNA, 279 bp, A.fumigatus
cacccactaccttccagccctgccgttaagacagtcctgattgagaacatgcgggaatggaataatcaggagatcgactacgggtacaccgtgaccggcgtcgacgtggacagccagctggcggcagatccgcaggcgtatcctgtcaaggtaactgctgagaaaaactggaagactgagatgtttgaagctaagtatgcgcttgtatgtcattcccaatcactgattcttgtgatcaggctgtctctgacgtctctaggcctgcgatggtgctcatag

SEQ ID NO: 5057 - DNA, 207 bp, A.fumigatus
atcggtgactatctctgctcaacagagggccctattcagacattccgccccaagggaggtgatattgacagtcttattgagcccattctggtggctcatggcaaccgccatgccgtagaattggaacagattcctgagtgtttctaccctgtgacggggaagcatcaaatcagaggcgggtctccgaatctcaaaaattcttcatga

SEQ ID NO: 5058 - DNA, 927 bp, A.fumigatus
  unsure (410): Identity of nucleotide sequences at the above locations are unknown.
gcctgcgatggtgctcatagtaccgttcggaaagcactcggctacaacatgattggggatagcactgatgctgtctggggtgtcatggatatgatccctcgcaccaatttccccgacatccgcaagaaaaccactatccgctcaaaggcaggaaaccttttgatcatccctcgggaaagtggtagtctggctcgcttttacattgagctgcctgccggcacgaagcccaaggaagtcaagcttgagaatctccaacagacagcaaagagtattctcagccagtacgcaatcgagttcgtcgaaaccgtctggtggtctgcgtactccattggccaacggcatgcagacttcttccacaaggattatcgcgtcttccttgccggtgatgcttgtcatacgcactcccccanagccggtcagggcatgaacgtcaacttgcaggacgggtataacataggctggaagttagccactgttctaaagggactggcatcgccatcgctgttggagacatatgtcctggagcgacagaaggtggcgattgatctgatcaacttcgaccggtatttctccaagctcttctcctcggggggccagacgtctcccgctgagttccaggagggattcatcaaggcgggcaaatatactgctggaatgacggcgcggtatgaccagtcacccattactttccacgtgaacgaatcagacaagctctcgacaaacgttgtcgttggtatgaggctgcccagtgcccaagtggttcgcttcagtgactcgaagcccatgcaattagcccagtcgctcaaatcggacggccgttggcgagtgatggtatttattggagatatcagctcggccgagactaagacaaagttgaaagctgtaggtggcgctcgccttagtgatgccttggatgagtcttgctga

SEQ ID NO: 5059 - DNA, 717 bp, A.fumigatus
atatggattggcgcggctccttccagccccgtggtgaagacctatatgcttttgcagagtgacaagaccctcccaccgccccttgcagacagaccagattttgagaagttgttccatcaggccagagcgaacgcgaaaccaaatgaatggtttgctataccagaacagacattatccatcggttttgacgatactgacgaacaatctttgcctgatgtgtcttttggatgggacaatgagaagcctcagcgaacgatcacagttcgtgctttcgaagcacaggctcatgctataacaaacggcgaatatgccaaatatctgcaagcgactcgtcagcgccggcggccagagtcgtgggttctaactcattcggatgagaattatccaatctccaagggggtgactctggagagcagccaagccacaaaggatttcatggacaacttcgctgtccgcaccgtctttggacctgttccgcttgaattcgcgcaggattggcctgttatggcttcctatgacgaactggccctatacgccgaatgggtgggctgcagacttcccacttatgaggaggtcaagagtatctacaactactccgctcagctgaaggagacaagacaacatgagccatcagatcacgagaggttcgtaaattcccctcggtctttaagtttagctatgtctgacagaaggcagcaacggtgtgaagggcattaa

SEQ ID NO: 5060 - DNA, 366 bp, A.fumigatus
ctatgtctgacagaaggcagcaacggtgtgaagggcattaaccgtgatatggtgacgaacgggcactcgaaggttcaccaggataagccccggaccccagaacgtcagccaatccaacctccttcccaaagcacaatgccagtatttgttgacctccacggttgcaacgttgggttcaagcactggcaccctaccccggtcatccagaacggcgatcgactcgccggtcacggtgagctgggaggagtctgggaatggaccagcacgccactgacgccacatgatggcttcaaggccatggatatttatccaggttatacaggtaagctgttgacctacttggtggatttctataaacccaactaa

SEQ ID NO: 5061 - DNA, 195 bp, A.fumigatus
tcgtccttgacaaagtccctccatccgttcgcgatcgtttccaactcctccttcgtcgcatatccctcctccacagccatcttcgaaaacccactcgatctcatcctcgcttccattgatccaccccagtatttcctttcctcgggactactgaagcaccatgccccagcacttttcttgattcttgtcccttga

SEQ ID NO: 5062 - DNA, 660 bp, A.fumigatus
ttacgtagcgaaattgcgcgggtcctgccccaaggccatgtcacggcgatcgagtacgttgccgacccgctagacgcagcccgatccctcgcctccgcacatggactcacaaacatcgactttcgcgtcggggacatccactctcttgactttccggacgacacctttgacatcgtccatgttcaccaggtgttgcagcacatcgcagacccagtgcgtgcactacgggaaatgcgccgggtggcgaagattgacggtgggattgttgcggccagggagtcggcatcgatgacctggtaccctgacaactcgggaatcgccggatggaaagaggttacagatcgtatgtgtaaagcgaaggggagcaatccgcatcccggccggtatatacatgtttgggctgaggaagccgggtttcaagggacaagaatcaagaaaagtgctggggcatggtgcttcagtagtcccgaggaaaggaaatactggggtggatcaatggaagcgaggatgagatcgagtgggttttcgaagatggctgtggaggagggatatgcgacgaaggaggagttggaaacgatcgcgaacggatggagggactttgtcaaggacgatcaagcttggtttgggctgctccatggggaaattctatgctggaaataa

SEQ ID NO: 5063 - DNA, 831 bp, A.fumigatus
acctgcgattcgagcggcttttgtcttcgaagcaacagaataaggcaactgtcccattccttcaaaatgatcaaaccctctatcctcggggcactggccctgctcagctgcgccctccccagcaacgccacacagatcttccgcaacaccggcaccctggcgggctgggactcggtcaaccacgaacactccggtactgtacagcaggtcagcaacgtcgtgtacgagggctccaccgctctcaagatgacccaggtctacgacgcgagctacacaggccgctaccactccgaggtcgtcaagaacaacgtgtacaagcgcggcgacacggggttctacggcttcgcgttccgcctacaggaggactggcagttctccccagcgcagtcgtacaacatcgcgcagttcatcgcggatttctccgacacgggctgcgacgactacatgccctcgagcatggtgtggctggtcggaaaccagctctactcgcgcgtcaagcaggggagcgtctgcgcgcagaagaccaagacgtttagtaaccttgccacggttaccgcgggcgtgtggcacaaggtgattatccaggcgagttggaagtcggatggcacgggattctataagatgtggtttgatggggtcaaggtgctggatcaacatgatatcgcgacgacggtggatgacaaccgcccgttccagttccgggttgggctgtatgcgaatggatggcatgatgacaagggcatgaaggggacgcaggggacaagacaaatctggtatgatgagatagcagcagggacgacttttgccgatgcggatcccgcgcagtggtag

SEQ ID NO: 5064 - DNA, 315 bp, A.fumigatus
ttatttagtcaaagtatattctggaaaattctcatcatggtcagcaacacgacagacccctcggactactgtacgctggatacttgtcccttgagtctcgccaatttcaactatgttcccaacctggcaggtaaccttctgtacctggcgcttttcgggacgatgttggtggccaatctgggactcgggatctattaccgtacttggggatatctagttggtatgatcggtggcctcgctcttgaagtcatcggttatgtcggaagaatccagcttcactacaacccatttccgttcagtccattccttcagtga

SEQ ID NO: 5065 - DNA, 1152 bp, A.fumigatus
acccgactgactttttctccgtttttccaggcgatccatgcagacattgcttttaccttggccaagtacctttactcgagcatcatgcctaattccactgacgcaccggccatcaatgtgaagaatatgcaagtccagcacggcctggtcgcgcgaaaagatcgctcccggccccagctcatccagatccgcggcatcgcagacgtcacacggggcctggtcagcttgtcgtggcaccttgtagacgagcaaggccgtcgcgttgaagaaagcttcgctacggcagtggcggaattcggaaaccatgaagcttggctagaggaatggtctcccatgacacacttggtcgtcagtcggatcgacgttctccagcgcctcgccgacgagggcacggccaaccggttgtctcgcgacatggtgtacatgctctttaacaatctggtggattacgcggagaagtatcgcgggatgcaaatggtcgtcctgcacggcttggaagccatggctaatgtgactctcgctgcccccgagcaatcgggtggcaaatggaccgtagcaccacattatatcgacagcgtggtacacctcgccggcttcatcctcaatggcggaaatggtctcgatccccgacggaacttttatgtcaccccaggctggaaatcgatgcgcttcgcccgcccgttggtccatggggtgcggtaccagtcctatgtgaagatgatgcctattcgagaacagtcgggcttctacgccggcgacgtttacatcctccatgaaggccagatcgtcggccttgttggaggcattactttccgcacgttccctcggtcgttgataaacacattctttagccctcctgatacaatgacccatggtgggagtcaagcaggaagcgtccaccaaccagcatgtagtgaaagaacgctcccggtggccccagcacgtcaagattccgcagccagggagacactatgtcaaggtcatggtttatctcgcacagtcatggatagctccgacagtagtcctgccaccactctcactccaccgacccttccgtccgttgctgcaagcacggagagtccgattgtccaccgggcgatggccttgatcgcggcggaaacagcgtcttcagccggggcaaggggactcatc

SEQ ID NO: 5066 - DNA, 1050 bp, A.fumigatus
agacagtgtactcgcgcgcctcatgcaatgttggcggtgtgcgcgactgtggagcagatccgcaatgtgttggctggacagccgtatgaagtggcttgcataaacggctccagtgacataaccctcaggtgctcagtcgctgacatcatcaatctgcagctagccatcgagcaacatggatacaagtgtactcggctggatgtcccatatgccttccattcagcccagatggatcctctccttggcccgttcgagcacatcgcccgcggtgtcaccttcaaagcccccaacatacccgtgatgtccccgtcactcggcgattgcgtttttgatggcaagaccatcaatgcatcctacatgtgcaatgttactcgcaatccggtaaagtttgtcgatgctcttgagacagcgcgcggcatggacctggtagacgcaaagaccgtctgggtggagattggcccgcatgcgtcgtacagccgctttgtgggcagcgcgatgccgccagggaccgcgactattgcaagtttgaaccggaatgaggataattggagcacctttgcgcgtagtatggctcaactgcataaccttggggtggatctaaactggcatgagtggcatgcacctttcgaaagcgaattgcgcctcctgacagatcttcctgcataccagtggaacatgaagaactactggattcaatacaatggcgactggatgctacggaaggacggcaaatcctcagcagcagcagcagcaagtcatccgcatcaagcgattccaccagcattgcgcacctcgctcgtgcatcgtctcgtgtgcgaatcagttcaagaaactagagtcgaggtcattgtcgagtccgacatcctacacccagactttttcgaggcgatgaatggccataggatgaatggatgtgcagtagccaccacggtaatccaaacagagagccctttcttgaacccgactgactttttctccgtttttccaggcgatccatgcagacattgcttttaccttggccaagtacctttactcgagcatcatgcctaa

SEQ ID NO: 5067 - DNA, 1341 bp, A.fumigatus
cttcctcttgccaatgcaaccgcacttgctaactcgatcatttctcttcaggaattgcccctgtttgttcctcctcaggttcctctgacaacctccacctcatcgatctctcctcaacgtcgctcagtcggccaagaaggggcgatctcgccattcgctcggcccaaccaacgtccttacaatcaacaacagccgctaccatctccacaaagctatggccacactgagcagacatatacaatgagttccgctcagaacccgatgtacgccactccggcgatgcctgaccatggtcatcgtctgcgcgaccgcgcgaccgcacagtcgtctggacagcacaacaacgccgccggccggtataatggtccaggtgtccttccaactcctgatcccaccattgctagctgcatatccgatgaggatgtggcaatgcagctgatccggctgggagacgcttcgaatttctctcatggtcgaacatcggcatctacattagacgatgccttcagcggtgctgctgacgctgcttcctccaccggcgccaccagcgatggtgaagactacagtgaggatgacgatgatttgccggcacggtctagacagaagctcgattcgagcccaatgcttccccctggcaccactaaacgcactcacaagcgccttgacgatatcctgcccagtttcgacagctccgacggcagctacgacggtatggacgaggactaccaacatgaagagcttaatgacagtctactcaagagcgagctggacgaatattcactttacagagagtctacacctaagccgaagaaggctaagactcggccgactagtacagcgtcgaccaaaccgcgtgtgtccaagacagaccccccacgccaaggcaagagtggaaaagcttcttcgaccgcggtggctcgtaaggtcaagtcgacgaccactgtggtgagtcagaacgctgcaccgctgtcgcagatcgttactcctacccctgcccgcaaggcctctacatcctccgtcaacggtcaaactcagcttgctgcggacgaagaggacctttcaaccaagccacgctgtcagcgatgccgcaagagcaaaaagggctgtgatcgccagcgaccttgtggtcggtgcaaggatgccggtattggcctcgaaggctgcattagtgaagacgaaggaaacggtcgcaaaggtcgttatggtcgccatatgggcgtaccagttaagaaagcccttgacgcaacctcccccgcgagcaatgagtctcaattgatcagcaccatgcctatgccttcctcatcagctatagccgacaagaacaaaaagcgcaagcgttag

SEQ ID NO: 5068 - DNA, 1155 bp, A.fumigatus
aatcaagggggaccgggcatattgcagagatcccgggcacggcatcggtatatcatgcagttgtgccgtgcgctgatgcgatatggtgcgcatacgcaccgattagaggaatacatgaccatgacggcgcgggtcctggaggtcgagggacagtttctgtatcttcctggttgtatgatcatgtccttcgatgaccctgttactcggacggcggaagtcaagctcgttcgttcgacgcagggggtcgatctgggacgattggcggaaacgcacaacgtttacaaaaatgtcgtccatgacctgatcggagtcgaagaagcgatccaggaacttgacgaaatcatgaagcgcaaaccgcgttttaataaatggatcctggttccggtgtacggtctggctggcgccgcggtcggcccctttgccttcgacgcccggccaattgacatgcctatcatcttcattcttgggtcgcttgtcggtctgatgcagcacgtcatatctccccgatccaccctctattctaatgtgttcgaagtgacagcagcagtgctgacctcgttcctggcacgcgcattcggctcgatccgtataactgtggacggtcaaaaacagtccctcttctgcttctccgctctggcacagtcctccatcgccctgattctaccgggtttcatggttctgtgcagcagtctcgaactccaatcccaccagatgattgcaggttctatccgcatggtcttcgctataatctattccctcttccttggctacggcatcacggtcggcaccaccgtctacggcctcatcgacggcaacgccacctccgaaaccacctgccgtgacctctccatctacggcagcaagtacatacaacacttcatctttgtccccatcttcgtcatctgcctcgccgtcatcaaccaagccaaatggaaacaagttcccgtcatgatcttcatcgccacctgcggctacattaccaactacttcagcacaaccaagctcggctcccggtccgaggtcgccaatactgtcggtgcattcacgctcggtaccctgggtaatctctacagccgcctatggcacggccacgcggctaccgccattcgaccgggtactatcggccctcagttcccagggccaaaaggtcctcga

SEQ ID NO: 5069 - DNA, 183 bp, A.fumigatus
  unsure (173): Identity of nucleotide sequences at the above locations are unknown.
atggcagtaacaccaaagcgagtccacactaaccacacacaccttttcgctgacgtcgggtggggactgtgctgcatacctactattcaacccaggcacctctctgaaccctgtacttccccgatcactacgaaccaggtcttcacctcggaggtgcctgagacgagcaattntaaccacccc

SEQ ID NO: 5070 - DNA, 240 bp, A.fumigatus
agaatcgatatcctcctcgccactcaattcatcatcctcgccaatcttcaccccaccttcaacgtccgacatgacgtcttcatctcgctccacatggagatcactttcttcttgctggagggcatgctcaacttcctcgtcaccttccgctgtttccttggtcttagtcgcttcgaattgcaacccacgggaacagccaggggctatctccaagagaccaccctcagctccaaaaattga

SEQ ID NO: 5071 - DNA, 432 bp, A.fumigatus
  unsure (392): Identity of nucleotide sequences at the above locations are unknown.
cccagaatggctcaaccgccttcaaaagtttgtgttgacaacctacgcctggcttgtgttatcactaacgatcttcgcaggcgatgggatgtcccggttaactacaccgacctctatgagattgctcccactcaaacgcggactattgttcgtttcacccgggaaggtctggagggtcgagtcactggttatcacgaagtcactgtccccgctgcggcggcccacgccaaaaactcgacgtctctgctgcgcaggcctgcaggtcgtgctgactttgtgagaggcgcggcaggattcttcccatttgcgccgggcggactcgacggtgttgaggctattgctgaaatggaatctgaagcacaggctgcggaacgctcaaaaaccggtggcanacagtccggcctcgaccgcattatcaatttttggagctga

SEQ ID NO: 5072 - DNA, 684 bp, A.fumigatus
  unsure (112): Identity of nucleotide sequences at the above locations are unknown.
gaggcgcggcaggattcttcccatttgcgccgggcggactcgacggtgttgaggctattgctgaaatggaatctgaagcacaggctgcggaacgctcaaaaaccggtggcanacagtccggcctcgaccgcattatcaatttttggagctgagggtggtctcttggagatagcccctggctgttcccgtgggttgcaattcgaagcgactaagaccaaggaaacagcggaaggtgacgaggaagttgagcatgccctccagcaagaagaaagtgatctccatgtggagcgagatgaagacgtcatgtcggacgttgaaggtggggtgaagattggcgaggatgatgaattgagtggcgaggaggatatcgattctttactccctgtcgagttcccagccttggagccccgagcgccgttactcagtggtgtcaagcaaaggcagggtggcaaagaatgggctcacgtcgtcgacgtcaataaacacatctctaacttccatgaactcgtacctgacatggctcgggagtggccgttcgaactggataccttccagaaggaggctgtgtatcacctcgaaaatggcgattcagtctttgtcgcggcttatacctcagccggtaagactgtcgttgcagaatacgctatcgcactggcctcgaaacatctgaccacggcgatcaca

SEQ ID NO: 5073 - DNA, 504 bp, A.fumigatus
gtcggtggactgtctcagtctacgatttatattattctcctgttaggtggtggctctaacggatgtaccaagactatctgggcaggagtttcagagctcctcgaagaaggctccggatatcgaattgccatcgtaattcgtaattcgacatacctactggagtgtctcggtcataaattggaagagcctgcgtcaggagatgcgatcgaacttagccgggagatcatctcgcaattccagaattacagcgccaagtacgatgaaaaattcatcggggctggcttgccagagtcccttgttctcaaatgcccagggctttgctcacagctttggttcaagcttgatattgtcccgctggtgctgagacatgtagctcgtgcgcgaaccgcccatgatcggggtgaggtggccacgttccggggctgggaaagaaaagcactagatgagcaggcagattccatggcgcgaaagtgcatacggtatctaggtgcagttggaggataa

SEQ ID NO: 5074 - DNA, 183 bp, A.fumigatus
  unsure (33),(87),(132): Identity of nucleotide sequences at the above locations are unknown.
tcctggcattctcttgcacccactttaaatctntatttcttcgtcaaaggaaagatacccgagggatttgtccaacccttcgagganatctctcatcttctgaacgatactgattatccctggacgtggctntgcgacatacctgttaggttagcaacatgtccaaaactctcatactcataa

SEQ ID NO: 5075 - DNA, 510 bp, A.fumigatus
catatcgttaggcttctcccctcagctatcgaagacgggacggatctggatcccaagatgaagcgcaacgcccgcgaagtcgagggtgataccccgaaagccaaagcaaaggatggctccaatgagactcagcctaagccaaatccgacctccaagcgtatcagcatcaaccgcgaggagattgcgaaggttatgatggctcagtcccaggcagctcgacaggccacactcgggctgcctttccaggctcgcaacgaaattggcaagaacgtcccagggcccaaggaatctccgagcgtgagtgctcagagtcattgcccgtccagcatcgctcacatttctgccagaccaatcacaagcagccagtgtatgacggagccacaaagggacgccctgctctctcggacgaggctatcgcagccatcctcagatacaccaagccggagtgtaacaaggcccagacctgggttcatgcccatgatttccacaaagccattcaagacagaatga

SEQ ID NO: 5076 - DNA, 342 bp, A.fumigatus
cacaacgcaatcatcatgaccgactacaccgatgccaccgataccacctatggtaccacgggctatggcaccaggggctacggcaccaccgttggcacatatggcaccacctacgacaacggctacggcaccaccgcctacgatcccaccactggagcgtacgaccagcacatggactatcgtaccgatggcacgacgaggcatcaccgtgaaagagtgaatcctagcgggacatatcgacaccgcgatgtcgaccgccgcgatgacggcaccgtccgtgtccatagagaatatgacaaccctaataccgggaccagctaccaccgggactatgagcggtag

SEQ ID NO: 5077 - DNA, 387 bp, A.fumigatus
gccgttccttccactacagtcaccgcgtcttgcgatttgaccagtcccgcactcgaaatagattgcacgccgtacctgctccagctgggccttacaaagtctcggacttcgcttgtgtggattgctggccccttgtctgggttgatcattcagcctttgatcggtgtcattgcggatcgttcacgctcgaagtggggaaggcgcaggccatttatggtcgttggttcgggtattgtcgcagtgtgtttgctagtgctggggtggacgacggaaattgtcagcctattcgtgaaagatgcagagaaggtgtgtctattctgttcagggccgggttttggcatctgtgactctgccgctcactttaccaggcaaaaaatgtcaccatag

SEQ ID NO: 5078 - DNA, 204 bp, A.fumigatus
cgaccctcagcaacaagaatgtccgcaattggccagctgattagctatgttattggctcaatcgatacggtcagcctctttggcgccattatcggggatacgcaattcaaacagatgacagtaattgctgcactctcgctgatcggggctgtttccgtcacctcttattcggtgaaggatataatcctgattactgccaggtga

SEQ ID NO: 5079 - DNA, 888 bp, A.fumigatus
ctcgatttaggctggttccccttccttttctacagtactacttgggtcggtgagacgtacttccgatacaaagtccccaaagacgctccacagtcaagcgactttctcggcgaaattggacgcgtcggcagtctgtctctggtcgttttctcttccatcactttcatcagctctgtgcttctaccgttctgtgtgcagcctccggacagcaaacggtccagattcacacctcgcccgccacctgggatagctgcgcttcttaagaggatcacagcgatacgaccagacctgcagacatcatggatgatatctcatgtgatgtttgctgcgaccatgatctttgcacctctggcccggtctcgggcatttgccacatgcctcgtggccctgtgtggtatcccgtgggcgatcagcagctgggcgcctttcgcattcatgggagtggaaatcaacaagctggcgatgggacctgcagccgcagcgcgctcttctggcgtgaccatgattacttcttctactatccgttccagcaattttgacacggacacggagatggacgtcctacgactcaaccaccatgatacggacagtgacagcgattccgatgacgacgcaaatattccttccactggcgaactggctggtatctacctcggcgtgttgaatgtatacactacgctcccgcaatttgtcggcacattcatcagttggatagtcttcagcctcctcgaacctggtagtacgaaacgggacgattccgcacaggactcgcaatggatacgccgagataaagagggtcctaatgctatatccatctgcctgtttgtgggtgccttgtgtgcacttgtagccgctgaagctactcgacgactacgctatgctcgctga

SEQ ID NO: 5080 - DNA, 183 bp, A.fumigatus
acaccgtccctctgggaaagaagtcatcattattatcgttcttgctccgctgcacctcatttgacgctcgcagcagctaaatctctcagttcgctggctgattgcaaccagaaggctcttcatgaaaatgatgtctcgtcttccttcctttccctttcctttcatacatttaactgctgctaa

SEQ ID NO: 5081 - DNA, 309 bp, A.fumigatus
aagaaaagcacacaaccgcttgcgttctggttcaagattggcaggcttctcaagaaccgtggcacgtcacctgtgaacaagtcaccgccaagtatcttttacgtgtctgtatgcggtaagtataccaccctggtacttccggacaactgtcttcggaacacgcccgacctctccctgtcaacaacccacactcgtcacggaattgttgcacggatttgggtagttttagcatttggaatgaaaattattggaagccgaaatgatatgaagattttagaattcatcgttaccacgaagtacagaaggtag

SEQ ID NO: 5082 - DNA, 183 bp, A.fumigatus
  unsure (86): Identity of nucleotide sequences at the above locations are unknown.
agtctgcctcggatcagtccactgctacagaacaggatcattcaattgggctattatatcctgctctcccttttagctcagattgnggattttgtggaaggtggggcacctacccttgtttattatttactagaaagtctatggaccctgaccagggttctgaagggctggtttgaatttgga

SEQ ID NO: 5083 - DNA, 828 bp, A.fumigatus
  unsure (797): Identity of nucleotide sequences at the above locations are unknown.
ccgctgatgacaacgacagccttctatctcagaccaaatagccaacaaaaacacctgtggactatttatatctgccagcacggcgacgaccccgagcccgcctacaccctgcgttaccctgatcccgcctccccctcctccaagaaccgctatgccgtcgcgctctgtgatcctttcgtacccgatgtcgtctacggcgaggtcttgatcatcccggaatggacacaacccagtctatccgccgaggcgatccgcctgaacggcggggtcacacctccgccagaagccattctcccctcgcagttcatcgtccagctgtacaacccggaccagcaggtgacgatccgctacaagcacaagacgtggaatacaccggcaacatgggaattcgagatgccgcagcataccttccgacaaccatcggcctcgacgctcgaccgcacgcagactgacccggccctggctgacacgaccccgaaactccggttcagctggcgcaaggatagcaagttgtccaaggaccttacgtgtctgctccttggaaagacgtcgacactgcccgaggggaggacgaagagcaaggagccggatatcacggtgtcgatcttcaaggctctacgggagttgacgctgtacgagccgaacatgtaccgggttgagatggaggatttcaaggggctggagattgtactcttgctgggagcggtgaccattcgtgatgtctacttcaccccgatgaaggacgcgtttcgaatcgtacgggatgaggtgggaaggaagcctggggctgatccttnttcatcaggacgagccgggatccgttcatga

SEQ ID NO: 5084 - DNA, 1560 bp, A.fumigatus
  unsure (91): Identity of nucleotide sequences at the above locations are unknown.
caaggtgattctaggatcgaaagaccagcctcttcatctgcatcctgtgaggaattcgcccattatcccgtcttcaacccacgcaaccttngacacaaccatgcagcgtctgcatctttgtgcctgcaaagtgattactgtcgatctcgagcatctagagcacaaagttcagttacctggatgcaggatttgccaaggaggtcactccgcaaagcgcgatcgggtctgctagcccttcgttctggaatgcaaagacgacccattccaggcggccacgctcggagaagtgatatacatagtatttggtcctcgagagactctagagagggctcatctgatcattttccgtcgtcagtgtcggatgcgagtacagaagacgatcacgagttcggcaccggtctctatcgaacagctcgaaaccagtcatcctcaagcgaagctctgaaagatcacagccatagctctatacctcccacatcgccgttgccttgtaccgtccgtgagggcccagaggacattgggttgaggaaatccctagctgcacaggaaaagagaggagtcaatggtacgtcaggagcaggggtggatagtgcgttggagacagcgacgacggtgggggcacctcgagagcacgtcaccgagcctgagcaccactgttacatcccgggagaatcaagtacagtcgtccaaacctcgactcatgccatttcaacttcgccatctgccagtctcattgagcttggcggaattaaagcgacaacggaaaacacagcaccatcagaaacatcgaaggcagcaaccccgaaggagcccatgaatttgcagacaagtgaggagtgtataaaagatatatgctcgcagacccatgattcaaagtctgttataacccattcaccagttattgaccctgaaaagccgagagcgccagagagtcctgaagagttggtcaatccaaatgttcgaaaacacaatgaatcaattcgaggccacgggaatgctccaccacccatcgcttctggttccactgactcaatggcttgtttatatgtctcgagccgttccccgtctccgacatcctctgtctgctctcgtgaatcaatgtttcggcagataccagccgtccaattgatgatgggaacgcttgaattggttgcgtcgtcaagagactgcagcagcggtggtcagaccttatgttgcagcgatgttgcagaaaacgatctcgtatcacgggcatttcaccatgctccagccgatcataccgaggatggaagtgcaccaaccgagacagagcctcagcagtctagagccgcgaacgtaggagagacgcagataactcaagctggtgcatctttcacggttagtatcaactttgatgatactctcagggcactgacgaaatcgcaggaaccctcagaaatgagatccagcgagcaagaagaggaatctgcgagctgcctgttgcccggtctggacgacaccgattcctttggaatccaaaataattttgatccgtgcgtggctcgaagaccaccctctccaagacagactgaagatgcccca

SEQ ID NO: 5085 - DNA, 1338 bp, A.fumigatus
attcgcgaatttaatgaactctggcacctctttgaacgcagaattaatatgtcctatccttttgctagtcgctatgtggaccaattccccaaagataagacggtgcaggtcgcaggtttcgtggcgtttgtgtcgggtgcactggcgtctgtgttggctctggcatcgatcgtggacccagaactgttcttgggattcgaaatcacacatgaccgaacagttctcttctaccttggcgtgtttgggtctgtctgggctgttgccagaggcctcgttccggaagagacaactgtcttcgacccggaatatgctttgctcgaagtgatcaactatacacattacgctccgagccactggaaagggcgattgcatagtgacgaagtccggagggagttcacggaactttaccagatgaaaattgtgatcttcctggaggagatcctgagcatgatattcacgccttttattctctggtttaatttacccaaatgcagcgaccgtcttatcgacttctttcgggagttcactgttcacgtggatggaatggggtacctttgttcatttgctgtgttcgattttaagaagggaaccaatgtgataaaccaaggagatcgacgagacccggcaaggcaagatctccgagccgattatttctctacaaaagatggcaaaatgttggcatcttactacggattcttggacaactacggtgccaatcaccgtggcagccatcctgctactagacgacaattttatccgccccccgcctttcctactcttgggtcaccaccagcgggcgagatgggaacgatcggcgaccggctcgatcagacccagactcggcacggtctggcaggccctttcatgggacagcaatcagtgtttgggccgtctcgctacggtctgacaggtctaggtgaccatgcatcaccggctccttcaatactcctagatccgcatcaccagccatcaacttcgggattccgaggaacgagccgcgcagcaggggttcaacggtacagatcatcgcgagcgcatcctcctatatcagggacaatagcggatggcgatgagtcaccggtagccacgggacgcagcgacccgtcaagaccagctgctaatgctgctggagcatcaagtgcgggtggtgtaggcactagcgacagcaacctaggggactcatggcggatgaatttggtggaagacggggatgatgacaacacagagggcggagagaacgtcgatgctattgctgggggtgccggcgttttgggcttgattcaacaatttcaaagggtaaacaaggacagtcgaggacgcacagcggttggtttatag

SEQ ID NO: 5086 - DNA, 294 bp, A.fumigatus
catgtctctttcacggcggcactccagctaactgcaactcacagataccaagtcgtgatcatgtccaaccagaagaggatcagcctgcagaaagatctgaagggcggccgagccgattcgaagagcttgactaatttcaaggaaagggtgacaggcgtgatgcgccagatagacatccccatcagcgtctatgccgccacagcagacgacgagaatagaaaaccgcgaacgggaatgtggaaggagtttgtggaagtcttcaccacgggggtcgaaggatccgagctaagcgtt

SEQ ID NO: 5087 - DNA, 396 bp, A.fumigatus
gcgtaccgtaaacccggactggtcaatgtccgtgtaggtgccagtcaggatctgcagggcgcagaactgcagcgactgaacaagatgctcaatggtggcatgttctacacccaggtcgttggccctgtttccgaggctgattttggcgcacctgcttcaccggtcgccgaccaagatgcgcacatgtcagggacggatgagaagtcgtccgtccgcccgcactactatgattacgagaatcaaccctggaaattggaatttagggatatacccgaggcagcgacccggtcggccgtcacaacccggctgatggccagtgctagtctccctaaaggcgatgttacagtcccaatgaatgcctggggttacaagtcagtcgttatctccttgttttag

SEQ ID NO: 5088 - DNA, 324 bp, A.fumigatus
ctccgatacagctttgtcactgagtatgcagtggagggcgatatcttcatccataacgacattgtcatctttttacatcgcgtcctacactaccccactgaatcgcaagagcctcggcgccaattgccagccctaaatgaaatgacaccgcttgacaggagtggaggctacgtcttacaggccgccatcacagtccaggatggcagcaatcaagagactatgaagattgcctctcagcatctctttgggctaagggagcaattgaaatctgctgttcgcctggaacaagcagatcggctgtccttggatactcgagcaaagtga

SEQ ID NO: 5089 - DNA, 255 bp, A.fumigatus
gattccactttggtcgtgacagcttccggcaacacctttccccgggattcttcagattggaagtggttctctcccaatgtaccgaccaaactccaggatctgaatgctgacgggcgggtagcatgtctctttcacggcggcactccagctaactgcaactcacagataccaagtcgtgatcatgtccaaccagaagaggatcagcctgcagaaagatctgaagggcggccgagccgattcgaagagcttgactaa

SEQ ID NO: 5090 - DNA, 639 bp, A.fumigatus
actttgccgtcctcagggtacacctcccaagagatgtacgagctagagcggcgcgcgatcttctcccgcaagtggctgctgaccacccacaaactacgtcttcccaaccctggggactggctccgctacgaagtctccggctttcaatttgttcttgtcaaggaccgcgacggaaacatcaacgccttccacaatgtctgccgccaccgtgcattccccgttgtcactgaagaaaagggaacctcccgcatcttcgcctgcaagtaccacggatggtcgtatggactgaacggcaagctggccaaggcgccgggctatcaggagctcgatggtttcgacaagagcaagaacggtcttttgccaatccacgtgcacatcgacgccaacggcttcatctgggtcaatctggacgcaggcgagaaacccgaggtcgcctgggaggatgacttcaagggaatggaccggctgccccgctatgaacacgtcaagtgggacgacttcgcctttgaccacacttgggagcaggagggcgagtataactggaagattctggcggacaactacaacgagtgctatcactgcccgacaacacaccctgacattccgtccattgctgatctgagcgcctactccctctaa

SEQ ID NO: 5091 - DNA, 432 bp, A.fumigatus
agcccccacttcttcttcatgcagcgcttcgtccctctctcgcccactcgatccattatgaagtacgaagtctaccgcaacacgaagtcctcggatgaagactttgagaaaatcaaccagatctacaagcgcattatgtccgaggacaagtacctctgcgacctgacgcagaagaatctgaatgccggcgtcttcgtcaacggcgagctgcacccggagatggaaaagggaccgctgtacttccagaagacggtccgggatctcgtggtggagcactacgaacgcgagcaaaaggccaaacaggagatctggcccgcgaggcagaacctgccgaagactgcgaccgtcagcgagaaggatatttcgttctgctctagtttgagctgccagacaacggagtgtgtgcagccgcctgcgactattgcgtggtga

SEQ ID NO: 5092 - DNA, 1029 bp, A.fumigatus
ctgatcccacgtgtagactgggaatccgcccaaacacccgataccagctcgctcgtcttcggcctcgccgccgagaatatcaccttccaacagttcggggcgcgcaacgagctggtcatcgatcctcgcggctacagcgccatcatcaacggcgaggccgccacattcctcgctagcgagaatggcgagccgagcatggatcctcgcgtccggctgcagacacaggtcacgcagattgagtactccgacaaaggcgccacgatccgcaaccgcgacggtagctgcgtggaagccgcgtacgcgatctgcacattctcccttggtgttctgcagaacgacgcagtcatattccgtccggcactccccgggtggaaacaaaccgccatctacaagtacaccatgggcacatatactaagatcttcatgcagttcgaggagatgttctggccgaacgacacgcagttcttcttgtacgcgtcgccgacggcaagagggtactttcccgtgttccagtctctgtcgatggaggggtttcttccggggtcgaatatcctgtttgtaactgtcgtggatgcggaagcctatcgggtggagcggcaatccgacccggaaacgcaagctgagatcctccatgtcctccggcaaatgttccctgacaagcacattcccgaaccgaaagcgttcttctacccgcgctggtcggaagagccctgggcgtatgggagctactccaactggccggtgggtacgacgctggagacccatcagaatctgcgagcgaatgtacagcggctgtggtttgccggcgaggcgacgtcatcggcgtattttggatttgcgcatggggcgtggtacgaggggaaagaagtcggagagcatgtggccgcgctgctgcaggggaagtgtgttacgttgcaggggcagaaggcttgtggagagaggaggcactacgaggtgctccacgggacgacgccgttggaggcatataacgccatcaatgggtggcccatgagtagcgttgatctgtag

SEQ ID NO: 5093 - DNA, 546 bp, A.fumigatus
actgggaatccgcccaaacacccgataccagctcgctcgtcttcggcctcgccgccgagaatatcaccttccaacagttcggggcgcgcaacgagctggtcatcgatcctcgcggctacagcgccatcatcaacggcgaggccgccacattcctcgctagcgagaatggcgagccgagcatggatcctcgcgtccggctgcagacacaggtcacgcagattgagtactccgacaaaggcgccacgatccgcaaccgcgacggtagctgcgtggaagccgcgtacgcgatctgcacattctcccttggtgttctgcagaacgacgcagtcatattccgtccggcactccccgggtggaaacaaaccgccatctacaagtacaccatgggcacatatactaagatcttcatgcagttcgaggagatgttctggccgaacgacacgcagttcttcttgtacgcgtcgccgacggcaagagggtactttcccgtgttccagtctctgtcgatggaggggtttcttccggggtcgaatatcctgtttgtaa

SEQ ID NO: 5094 - DNA, 1233 bp, A.fumigatus
cgtcgcctcgccggcaaaccacagccgctgtacattcgctcgcagattctgatgggtctccagcgtcgtacccaccggccagttggagtagctcccatacgcccagggctcttccgaccagcgcgggtagaagaacgctttcggttcgggaatgtgcttgtcagggaacatttgccggaggacatggaggatctcagcttgcgtttccgggtcggattgccgctccacccgataggcttccgcatccacgacagttacaaacaggatattcgaccccggaagaaacccctccatcgacagagactggaacacgggaaagtaccctcttgccgtcggcgacgcgtacaagaagaactgcgtgtcgttcggccagaacatctcctcgaactgcatgaagatcttagtatatgtgcccatggtgtacttgtagatggcggtttgtttccacccggggagtgccggacggaatatgactgcgtcgttctgcagaacaccaagggagaatgtgcagatcgcgtacgcggcttccacgcagctaccgtcgcggttgcggatcgtggcgcctttgtcggagtactcaatctgcgtgacctgtgtctgcagccggacgcgaggatccatgctcggctcgccattctcgctagcgaggaatgtggcggcctcgccgttgatgatggcgctgtagccgcgaggatcgatgaccagctcgttgcgcgccccgaactgttggaaggtgatattctcggcggcgaggccgaagacgagcgagctggtatcgggtgtttgggcggattcccagtctacacgtgggatcagttatgtcgatctcgaagtcgatctcgaagtggcgggagacgtaccccaattccaccattccactgcttgtgctgccgaatcatctttccgtggccgccagccggccagcgcgaggccagtccgcgcggtctggtcctgcagattctcggtcatgatgcgtcctgcttctctagaggcgatgcggtaggcctcggcatactcgcgctggagatgtcggtagtcggtgtatccggtctcgttgtaggtgcgtatcgagctgtagttggaacatgtcactgtcaagttgtgttttcttgcctggggctggtcaatatttgccgtggatcggaggagagacgcaccagctgccaaatagggttctctgtgcatgtcagcatgagtcttcacacggggctggaaggaccgacggtggcgtaa

SEQ ID NO: 5095 - DNA, 504 bp, A.fumigatus
tgtcttggccggaattatgatagccacctttctgatatcactggatgtttctattatcgctaccgtaagctcgtcaaacgcctgtcggtttacttgactaactcaagctatttctccaaggccattgctgccatatcgacccacttccatgctacgacagatatcgggtggtgcggagctacctatccgctcacaatgtgcgctcttcaaccgatcagtggcaagctctcttcattgctgtcgctgcgatggacatgcctcgcgttctactgcgtattccttctaggatctctgatttgcggtgtggcaaacagttccaaaatgtgcataatcggaagagcagtcgccggtgctggaggctccggggtagtgtcaggcggtctctcagtcatcgcattgataacaaccccccagcagcgtcccgttgttcactggccttgtaaacctctctttatgccctgggacctgtcggtcgcccccaattatcgggggcgctttggctga

SEQ ID NO: 5096 - DNA, 759 bp, A.fumigatus
  unsure (114): Identity of nucleotide sequences at the above locations are unknown.
cattgctcttatttttccatccgcctcgaaaccccattcgcagtggagtcatggctcctgccttcggtctgcactcaggttttttggatcccttgtctctggcatcctaggtanacgccggtcctcagtatctacggaagttgcttctggcgctgtattatagccaaacacctcagagactataatccgtggctcttccttggttctgcctttctctgcattgcgaatgggcttgacaccacttttaccgtgtcctcaacgtccgcatcatggatcggctatcagatcctccagggcctgggttgtggacttgccgcccaaattcctttacttacaattcagctggtactgaaggacgaacctcgctccattccagtcgggatagcgactgtcctcttcacacaatactttggaagtgcggtgatgcaaagcataggaggcgctatctttcagaacgcactgcgaaggcagctgcatcaggcatcactggttgacaagcagatcgagatgcttcttaatgctggaacttcacgggtgcgggaagttgctgtacaggcatttccggaccgtttggccgatattattgttgcatacaataacgccatcacacctgtctttatgagtcaatcttttcaaatttctcacctacaccttaagcggaccttgctgaccctgctagtatcttccagtagctggcagtgctctagcatttcttctatcggcaggaatttcacgggtcaatacaacccaggaagataa

SEQ ID NO: 5097 - DNA, 1251 bp, A.fumigatus
  unsure (1202): Identity of nucleotide sequences at the above locations are unknown.
aggaggtgccccgatgagaatgcactcaaagaccaagtcaacggcctacccaacctttcaggtccggatggttcttcgaaaggtgctggcccgatggcacgtatggcgactgggggtgctttgaatagcgagtcccgccccttgccgctagacttgaggcagtcaagggctgctcaaaagcctcctcttcgtcagttgatcctcgacggtgactactaccttgctaccgttctctcctcgacgttaacgaaacttgtaatgcgccactcggaggtctcgcaggacgtcgctcggacgaacgcactacgcgctgaagcgatgttgatcatgatctctattatccgcgtcggacagtctcagtttgtcaaggctcccattgacgaagattctattgatcgtatcatgtgctgcgtgcgctctctcagtgagttctctcaaagaaaggagttggagactaccttcctggaagacacacgtaaagcattccgtgatatggtacaggtggaagataagaagcgtgcggccaaggaagctgttgagaaggccaagactgctgttcaggttgacgatgcgattcccatccggcagttcaccaagaagtctggtcttgagggtgcagaggaaatggaacttgacctggccaaggctactggcggcgattcgacagtggagactgtggcctcgaagttgagccgagttgtgcaacttaccggcttctcggacccagtctacgccgaggcttatgtcaccgttcatcagtttgacattgttctcgatgtgctccttgtcaaccagactctcgagaccctgcagaacctgtctgttgagtttgccactcttggtgatctgaaggtagttgagcgtcccaccacacacaacctgggacctcgtgactttttgaacgtacaggctacagtcaaggtgtcatccacagatacgggtgtcatcttcggcaacattgtatatgatggagcgagctcgactgaaacccatgttgtcattcttaatgatatccatgcagatatcatggattacatccagcccgctcactgcaccgagactcaattccggactatgtggaccgagttcgagtgggagaacaaggtcaacatcaactccaacgcgaaaagccttcgcgagttcctcaagcaactcatggagagcaccaacatggcttgcttgactccagaagcctcactcanagggagattgccggttcttgagcgccaatctgtatgccccgaagcctaa

SEQ ID NO: 5098 - DNA, 201 bp, A.fumigatus
ccgcgtcgcagcacccctcttctgcaagactggctaggtgatgaccagcccaagcgtcaccgccgcgaggttcacttcccgacaggccggttcggcgaggccatcgagcaggcgcatgcggtcgtgttccttgccagcgacgagagcagtttcgtcaatggaagcgattttgtcgtagatggaggcatgaccaaggtatga

SEQ ID NO: 5099 - DNA, 558 bp, A.fumigatus
tggatttcccgcagtggcatcggtctcgaaaccagtatcctcttcgctcgcgaaggtgccaacgtcctgatggccgatatctccgctcccgctctcgagaaagccctggctaaagtcaaggaagtcgtccccaacgcgccccgagtcgaaacaatcaagtgcgatgtctccaaggaatctgaagtgcaggccatggtcgagtcccaggatagctggggtggaacggacgtgatgttcaacaacgcggggatcatgcacgctgacgacgccgatgcggtcgatacaccagagaagatctgggatctgacacagaacattaacgtcaagggtgtctggtttggctgcaagcatgccgtgctgagtctgcgtcgtcacaagaagaccaggggtagcattatcaacacggcgagtgtggttgccctggtgggaagcgcaacgcctcagctggcctacacagccagcaaaggtgctgttctcgccttgactcgggagttggctattgtccatgctcgtgaaggtttcaggttcaatgctctctgccctgctccgctcaagtaa

SEQ ID NO: 5100 - DNA, 321 bp, A.fumigatus
  unsure (133): Identity of nucleotide sequences at the above locations are unknown.
aagcccgctgccttgctcgataccccagtttcgatgaacatctggtctgatgtctccactcctgccatgctcgagggcatgccagtgggcgagattgattcaaatgctgctttcgaaggtgtcccaggtatanatgccattatgacttctaacagcatgctggagaaccagcagtatcattttgaaccaaatgcgttcgatctcatgaatcaggtgcagaacgattacaacaagactgccctctaccagcaactcagccttcccgagggtcagatcggagagaactttgagttcactgattttatctctgattgcttctag

SEQ ID NO: 5101 - DNA, 468 bp, A.fumigatus
agtgacgcaatgcgcggggtcttctggctccctgtggtgaagacgggttcgcatgcgggaagtctcgacgaagacgcatgggccatcaggcacttcatgaactgcaagcccgaattggagttctgtgttgcgcagtcgttctcgaagaatttcggtctctatgggcagcgcactggcgcactgcatgtggtcacgagttcgagctcggggactttgccgcaggttgtgttggccaatctttctcatctcgttcgtggagagtattccatggctccccgaggcgggtccgagattgtacggaccgtcctcagcgatgaggggttgagacagcaatggtatgaagatttgaagcacatgagcgggcggatcaagcagatgcgccaggcattatatgacgagttgatccgactgggcacaccaggcacatggaaccacgttctggaacaggtaggccttatttcggcctga

SEQ ID NO: 5102 - DNA, 237 bp, A.fumigatus
  unsure (33): Identity of nucleotide sequences at the above locations are unknown.
aaacgatgggactacaccaagggtctcgtgcanaagctgcagggattcgaggagttcctccaggagaacccggaactggcgaagaaggttgtcttgattcaagtggcagttcccagccgcgaggacgtcaaggagtatcaggaactcgagaccgagatttccaccctcgtcgggaagatctgtgggacttatggtaagttgttgtccgtctgtctggtggccacttttctttgctga

SEQ ID NO: 5103 - DNA, 495 bp, A.fumigatus
ttcaagtggcagttcccagccgcgaggacgtcaaggagtatcaggaactcgagaccgagatttccaccctcgtcgggaagatctgtgggacttatggtaagttgttgtccgtctgtctggtggccacttttctttgctgactatccagccacccccgagggcgtaccactgatctacatccaccgctccgtttctttccccgagctgacagcgctgtactgcgtcgccaaagcctgtctcatcaccccgcgacgggacggtatgaaccttgtggcctcggagtatgtcgcgtgtcaggagaaccgatacggcgtgctggttctttcggaactggctggcgcggcttctttcctgggccatggcagtgtcaccttccatccctccagcactcgcgagctcgccaatgccatccaccaggcggttacgatggacgacggggagaagaagcggcgtcaccaggagctacgcgagtttgtcacgactcatacgaggtag

SEQ ID NO: 5104 - DNA, 306 bp, A.fumigatus
ggactgaccagcagcattgaaccagcgcttcaactttgcaacttttccttccgcagacatctcaacctcgattccctgatcctcgatatccttcatatactgttgcgcttgttcttccatttcatgcatgtacattcgcgcctgttctttgatttcattcatacattcattggccgtattgcgtacttcggaattaccatcgtcgacctgttcacggaattcggcctcgttcattttgtgctcgtcgtagatctgatcacgacactcgctgacagctctatcgacaatctcgttgagaacgtgtga

SEQ ID NO: 5105 - DNA, 759 bp, A.fumigatus
tatctagatccctggtcaatgtcacccaacaatgacagacgaaaaagactgctccttccatcccctcaactgataggctctcccaccgaagagaatacgccgagtactttctccccgtcaccgcccgcgattctcccaactgagtttacgcatgcttcctctgctggccgcacagagcgtaacagacttagacgtcttgcaaatgaactccgtggtctttccgatgacctgattcgcgaactcttaatacaatcaggacaccaacatctgctggccacgccaccagacgtagaccgtgacatagagaaaatgcgttttgccgagatcgagacgattgagcgtcgcctcaaacattatgtcgatgagatgattgagcgccgcctcaaatcacacgttctcaacgagattgtcgatagagctgtcagcgagtgtcgtgatcagatctacgacgagcacaaaatgaacgaggccgaattccgtgaacaggtcgacgatggtaattccgaagtacgcaatacggccaatgaatgtatgaatgaaatcaaagaacaggcgcgaatgtacatgcatgaaatggaagaacaagcgcaacagtatatgaaggatatcgaggatcagggaatcgaggttgagatgtctgcggaaggaaaagttgcaaagttgaagcgctggttcaatgctgctggtcagtccttacttagcagcaactccagccctagccacgagccgggtgccaatgccaggcgccgctccgtttaa

SEQ ID NO: 5106 - DNA, 186 bp, A.fumigatus
cacccggccggcgacgtctcctctggaactcactggcaccatcccccaattttccctacagagtacctgttcgctatctcaatcttctttcccatctccggacttcactttgtcttcttccgatgctcctcgctctatcacaacagcttcgacaaccgatcacaacttctccaacccatcgtataa

SEQ ID NO: 5107 - DNA, 1395 bp, A.fumigatus
ttgtcatccgcactcccacaaatcccaaagtttcccgaatcaagccggtcagctatggagactaatgcgcagccgtcattcgaagactcctggaagccaaggagcttttacgagcagggcgtacaggacgatgctctcagtccagtcatcgatttggatgcagctctaggacccttcaacacacctgatatgcgtgccgatagggttgtcgggagtggattctcggctgtatcccgacgtatgtacagtggtggacgacggggtgaattcgtcggacctgaaatgcgctatcatcgacgggcggaaagtgctccggagatgcctccttttgatcgtagttttctcaacaatcgccttatcaattcctccagcttggaaaatcctgatgttttttatgaggaagaggaggacgcctttttggcggctactagtgaatctccgaaggacaatcagacagcctccgaatctaatgtcgtcccacaaccagatacttcggaccagataacggtacatagcaaggccacgtccgacacgctgactcgaaggtcggcggatgccgcatccagcacagaaagagctggcctcggcatccagaacaacgagggaacagacccggaggctcccgcccctgctcctgcgagccaggagacctttggggattccggactatctgcacatgagagggctgttgaccggctccacaatgctaggaatcctttcacaagccatccaaacagcccggtggaaatcatcaaacacgagaattggcagccgaacaaaccgccagtgccacccagtcctgaaatttcaccaaggtttttgcctgctgacacccggccggcgacgtctcctctggaactcactggcaccatcccccaattttccctacagagtacctgttcgctatctcaatcttctttcccatctccggacttcactttgtcttcttccgatgctcctcgctctatcacaacagcttcgacaaccgatcacaacttctccaacccatcgtataatccatctgtggactatcatcagtcttcagtagacgatgtgccgtcattgaccagcagtgtgtcgaccacaacaaatccgttgaatcgggtctcaggcaccttcttccatggttgtcgaatttccactgaccgctcggtttctatctctgcccccggcactcgccgcagcagtcaagctcacagccagaagaggtcaagcttggctagtttatccaaacttgttggtggtcctcatggcgagagaagcaaactgagctacgaggaaaagcctccgagtgatgtatctgagaagtcaaagaagaagagccgtcgtatcagccgtctcgtgcatttttggaggacgaaagataaggacaagctgaacagggaggctgtttaa

SEQ ID NO: 5108 - DNA, 414 bp, A.fumigatus
ctcactcacgttgctagatcttgtcttcaggagcttcaaacgtcaaagtcacacctggacgcgcttttgtctgacacatcgtccacgctcgacctccttcgtagcctctccgaatccttcaaggccgtggaagctcaaacatcgaatttccggaagcaatgcgagggcatcctatctgcccaaaaacgtgacacagagctagcagagaaaatacaagagaacatccaatactatgagttcctggaccccgcttcaaggcgactcaacgctcctggggctggaaatgctgttcgtagccaagatttctcagatatgctcaggcggctggacgagtgcctggattacatggagacgcatgtgagtattgcagtcgtgccctggattgacgagtcgactaactctttcccagcctga

SEQ ID NO: 5109 - DNA, 648 bp, A.fumigatus
tgggccgatttttcaccgtcagtctggctgcttttgcagctactgggtcgtttctctttggtacgttcagcattgatacttgttaaagcgtttctgtgtgaaatcccaggtttcagacgccttcgtctcttctcagttgtaaaaaacaacacactttcatatccaccgcctctgaagttctggctaagtcgcttattcaaaggatatgattccggtgtgatgaccgatgttattgcgagtcctaatttcctcgccttcttcaacaccaacaagacttccgccattatcggggccattaacagtacattcaatggaggcggtatgtattccctttcctactgcaattctgctcattcactgacaaagactgcgatagccgccattggggcccttcagggaggcctgacgatggatcggttcgggcgtaaatttaccatccagatgggtgctcttatctgtctcgtcggcgctattcttcaggcttcggcgatgaacctggccatgattctggtcggccgtatcctcgcaggatgggctgtcggtctcatgtccatgtccgtgcccgtctatcaggccgagtgcgcgcatcctcgctctcgcggcttgatcgttggactggtcttcaccacggggtggaagaaagcgtcc

SEQ ID NO: 5110 - DNA, 1380 bp, A.fumigatus
ttatgcttagcgcggagccgccgctcccctgtggtagaagacgctcagatcttcgtgtacaacaatatcttctactcttttggcgctgatggagtgggaaccttcgtgtcagagggtggagacgaagccgcccgcgtggccgttggcaaggacgtcttgggaatcatggcagtcaaccagcttgacatcaacggccttttcacgccaggaaccgttgtcgttgactacctcggcaagcgcatcgtcggccatagcattgtgccggggatcttcaagcagcgcgagcccggtgagcaccaaattgattacggtggtgttgagggcaaagacgtcgtcgcgacacatcccgacttcgtctccgtctttgaaaagatgtccaaagcgctccgcatcaagaagcaccctgtatgggacaaggaaggcaagcgccacgatcttgaaggcagcgtcgaaaccaagggtcttttgggcaccgatggccgcaaatatgtccttgatctctaccgtgtgacgcctcttgatgttgtgtggcaggaagaacccggcagcgaggactatcctcaccgcatgtcagtcctccgattggagctggttgaagcgtactggaggtcgaagatgagccagtatgtcaaggctgaagttgagcgccgccgtgccgccaaagcccaagaggacgctgccaacaaggagcagccctccgaaactaccgaatcgaaggaaggggaatccgaggagaaggccgaagaggctcttgatcaagagcgggtggatatctccggattccagctcgcgctcaaccccgatgtctgcagcggccaagttccccagacagaggaggagaagaagcaatgggctgaggacgaaaaggaggtccgcgatgcttgcgagttcctgcgttcaaaggtcattcccgagctgattcaggacttgcacgatggtgacgttggcttccccatggacggacgatccctcagccagctcttgcacaagcgtggtattaacatccgctatctcggcaagctggctcagctctccaaggagaagggctctcgcctggaagctctgaccactttgctggttcaggagatgattgctcgtgccttcaagcacatcgccaaccggtatcttcgcaatgtgcctgcgccttttgtcgcgtcctgcgtcgcccatctgctgaactgtctcttgggtgcggacgtgaacccgaaacctagcgcggagattgatgcttccctccgcgagatctatcccgagggtgacttttcgtttgagaaggttacgccagagactctgcgcgccgaggttgagaagcaggttactgtgagataccgctacactttggagactgagtgttctcttccgtcttcaccacgcggttga

SEQ ID NO: 5111 - DNA, 474 bp, A.fumigatus
aagacgctcagatcttcgtgtacaacaatatcttctactcttttggcgctgatggagtgggaaccttcgtgtcagagggtggagacgaagccgcccgcgtggccgttggcaaggacgtcttgggaatcatggcagtcaaccagcttgacatcaacggccttttcacgccaggaaccgttgtcgttgactacctcggcaagcgcatcgtcggccatagcattgtgccggggatcttcaagcagcgcgagcccggtgagcaccaaattgattacggtggtgttgagggcaaagacgtcgtcgcgacacatcccgacttcgtctccgtctttgaaaagatgtccaaagcgctccgcatcaagaagcaccctgtatgggacaaggaaggcaagcgccacgatcttgaaggcagcgtcgaaaccaagggtcttttgggcaccgatggccgcaaatatgtccttgatctctaccgtgtga

SEQ ID NO: 5112 - DNA, 810 bp, A.fumigatus
gcagctactcgtcttactggagttgccatacaagcactcgtcgtctatacaggtaggatgaaattcttcccaaatggcaccctttctcacggcgctctaggttatctcatcccgccatggaagatgcacccgtggttcaaatggctgatctggataaatcccgttcaatatgcatttgaagctatcatggctaatgagttctacaacctcgacattcagtgcgtaaggccaaatattgtaccggacggtcccaatgcacagcccggtcaccaaagctgtgcggtccagggcagcactccgaatcagctggttgtccaagggtcgagttacatcaagactgctttcacatacagtcgttctcatctatggcgaaactttggcatcatcatcgcgtggttcatttttttcgttgccttgacgatgctcggtacggagttgcagcaacccaacaaaggcggcagctcagttacaacatttaagaggaacgaagcgccaaagaatgttgaggaggccgtgaaaaataaagaacttcctgaggatgtagaatcaggacagaaagagaatgccgtcaatgctgattccgagaagacccaacccggagagactggtgatgaagtcaaagacatcgctcagagcacgtctatcttcacttggcaagatgtcaactacaccatcccgtatgagggcgggcaaaggaagcttcttcaggacgtccacggatacgtcaaaccccgccgccttactgccttgatgggagcttctggagcagggtcagtcatgcccaccatcattttgaaaccaagtagctaa

SEQ ID NO: 5113 - DNA, 465 bp, A.fumigatus
cctgtacagagaaacgaggtcaagaggtctacgacaaggatagagaataccgtgcatcaacatcagcagcagcagcagcaaaggtcatcaagttccccaccgcctcatgatggtgctcctccttcatctcctgttcaaccggcagcgccgccgtcctctcctcctaaaccctctcctccagtggcagcagcgccagatgatgaatggcagaataacgatgcgcaaccaccgacgcaggaatctcagggaggagcagaaggacaatatgacccatgggcagcgagtgatgcagcacaagcgcagaactctcaaggtccaactgagggcggatggaaagccaatgacgctttcgctccaacacagcacactcagggacagtcgccagggaataggaaagttggcgacggtacaactacgaagacgactgaggaagcaaagccagccgaaccagaggttacctggtag

SEQ ID NO: 5114 - DNA, 276 bp, A.fumigatus
gatctagaagtccgacgacgatactccgagttcgcttccttgcgacagacgctggtcaaccttcatcccacgctcgtcatccccccgatcccggagaagcatacaatggccgattatgctgccaagcctacaaaagccaaggaagactctgctattatcgatttgcgcaagcggatgcttgccgtcttcttgaacaggtgtcgccggatgaaggaggttcgggaagatggagtatggtggagattcctcgatccgaacgttagctgggtatgttga

SEQ ID NO: 5115 - DNA, 204 bp, A.fumigatus
  unsure (204): Identity of nucleotide sequences at the above locations are unknown.
aatgaggttcttcattcccaccctgcatcgtccgtgccaaagaataacctgaaggcccctcccctcgaccccgctaaccctacggctgctcactcctggcttccggttccctcaagctccgcaaagcttaaatcagcatcgagcggtgcgacttctggcactacggatgccgcgggccaccgtgccttggacctgatgtgttan

SEQ ID NO: 5116 - DNA, 309 bp, A.fumigatus
tcgtcacactctttgtcttgtttggtctggactcgttcgcttcaggtttggcctcattgtgcgtattggtggcaccctaagatgacagcacacattaaactgaccgtacttcacagatcctggatgacatatttcttcaagcgcaagttctctctgcccgatggagagctcggctcgatcttttttaccaccagcctaatctctgccgcatccatgttggttgcatcctccatagccaaacgcattggtaatgtcaaggttcgctcttcgccttcaattgcattcttccgtcgccgtgtgggtttctga

SEQ ID NO: 5117 - DNA, 486 bp, A.fumigatus
gttgaggaatctactctggctcatctcaccgccaaagagcatcgcagcgatatcttcgtctggtactcctggatcggcaccgcaggcaccgccctcggaatgatggtgtgcggatggagcatcaacctgttgaaaaccactagagattggcaatatctcaatgcatgccggattgtcttcttcgcatatgccggaatcggtgcagtcaagtttcttctttccatctgcctaagtcacgaggttgaagccgccaagaaggacaagaacggtgctactgcctctcgacagccacgagcagctgatggtccggaaacccaacctctcctgggtgaaagagccaacaacgaggacaatcagaagaagtcactgttctcttttctcggcagtagcgatctcgtgtctttagtcgtcacactctttgtcttgtttggtctggactcgttcgcttcaggtttggcctcattgtgcgtattggtggcaccctaa

SEQ ID NO: 5118 - DNA, 453 bp, A.fumigatus
tgtcaaggttcgctcttcgccttcaattgcattcttccgtcgccgtgtgggtttctgactatgcggcagaccatggtcttcacccatttgccgtctgccatttgtctggctctcatcccagttccatccgccctgccggcagccttaaccttcttgatcctccgtgcctgttcacagagcatggatgtcgccccacgcagtgccttcttggccgctgctcttccgcccgaaaagcgcactgcaatcatgggcgccatcaacgtcgtcaagacttgcagtcagagcttaggcccgttcatcactggtgtcctggccgatcataatttttttggtgcttcctttacgcttgcgggtgtcctgaaagcaatctatgatatcggcatgctgataaactttgcggggagagagtgtgcgcaaaggatggcttcggatcggcccggagagagcgcttag

SEQ ID NO: 5119 - DNA, 528 bp, A.fumigatus
aacagtatctctcttagttatacctctaaagtccttgaaagaatgaagttcaccttttccttcatcgccctcggtttcgcgagctttgcccaatctacttctgtctctggctctagctctctgcttccaggaaataccaatactgcaagtgcagcctggctaacccatttcgaccaattccgccagcaacatgagcccttgaaccccgctcaatccgctgtcatcgatacggccacagacctcgcaaagcaaggacaggacttcgaccccaaagccatggacgatctgaagaacgatgctatttccgccttcggattcaaggacgccaagtcccttcttgcgacaatgggcaataagtcattgcagacccgggatgatgcaaaggaggacatcgagtgtggctgctccacgcaatctgactggtgtgattctggttatcattgtgctggaggcggctgtacacagaccggttcgggctgcggaactctctataaatacgcttgtgatgggctgtgtcgtctttcctag

SEQ ID NO: 5120 - DNA, 219 bp, A.fumigatus
cgcaaggccccaggcttacgcaaaagaaaaagatcggctacaaaaaaggacaaagcccgtttacttttttttccacgggggcttcgggttcccccaaggagaaatccaagcagccgatcagtttccggtgtggtcaaggtcaacctcgaccccgatatgcagtacgctacatgttctggtgcccgtgactacattctcaccaggaaggctacctcatga

SEQ ID NO: 5121 - DNA, 246 bp, A.fumigatus
tctgacaatacctgcgtgagctcgaatgagtgcattcaaaaagaaatggaggtctccacggaggagttcaagccttccggcttctcccttcgttgtctcttgcctactgccgaatacgagaatgacggtctaaaggcagatcgacagattgacggttcttctgctcttgttacatgccaagggaggtttactacgtcagtggcgagtcaggagctcgcaatccagcgtccatgcggaagtccctaa

SEQ ID NO: 5122 - DNA, 189 bp, A.fumigatus
tttggatttggcgtggttaagcgaaccgatttttcacccctgcgattcaagttctcccacaagattatgatgtatatttcggttttcccccatggccatttccatgcgaagaccaatgtctacgaggagaggaacctcggcatttatgcgggtggggaggacgaagacgaaccgcaggacccctcctag

SEQ ID NO: 5123 - DNA, 672 bp, A.fumigatus
tgtatatttcggttttcccccatggccatttccatgcgaagaccaatgtctacgaggagaggaacctcggcatttatgcgggtggggaggacgaagacgaaccgcaggacccctcctagttacatcgggttccatttaagaaggcagctgagttttgatctgtggtatgtcttcctcgggctgttcataattgccatcgtggagggcaaccgcctacagtcagaggacgagtatgctttccagatgtgggcagtgctcttcgaaattgtctccgcctatggtaccgttggcctgtcattcggatatccgggggtcaacacgtctttcagtggccagttcaaagttttgtcaaagctcattatcattgcaatgcaaatccgtgggcgacatcgtggtctcccatatgcgcttgaccgtgcaatcttgcttccgtcggaatctctcaaggacaaggatctgcaggatgcagagagacgaatgcgtcggcgtgtctcgaacctcagcaccatgtctgggatgggccgaacttattcgcaagcgcggacagagaacggtgtcgcaacaggcgccgaggataaggacaggggtgcaacggcatggacaaacggggacaatgtcatccgccggcactcgacaatgcggtcgcaacaatcccaaaaatcccagcggtag

SEQ ID NO: 5124 - DNA, 192 bp, A.fumigatus
atagatcctaatattaaaccaagaaatatagctataatcactagagtggtcctgggttgggtttgggtcaacccatggcataaaaaacccgccctacaacccatgtgggttagccagtctaacaatcactggctatctcctacaggaagaatcattagtggcatagatattaaccaggaactacgaggagtg

SEQ ID NO: 5125 - DNA, 255 bp, A.fumigatus
ccgagtgacactcccagatgtcagaaggatcatcagattcctctatcatccaaaatgggctcaatcggaactcatgaaaaactgtctggcttcgacctgatccagacgcactataaacagatcagggaccacgccatccgtgccgactttatcatccccaagtctacattcactggcaagcgcccagtaatcgtccgctttcatggaggaggcctggtaggatctacatcacgtccattcatggactcgcactaa

SEQ ID NO: 5126 - DNA, 1119 bp, A.fumigatus
  unsure (590): Identity of nucleotide sequences at the above locations are unknown.
agactgcaaggcttcaaccatcgggctaagatcaaactgcgcaccggtggaagcagtgggaagatcccgcgtggctggtgtcatatcgaggggaacaactcatattacgatctgactaatgaagacttccgtcgaagcattcgacttcctgtgaaacatcgttatcgctcccccgtcgtatttgagctgcacacgcagggcaaacatggagctgcgggttattcaatcctgtggctgcaacacctcgtcgacaacgaggagaccgaaatcgacctacctatttggtcgacaaagaacggcagccgactcacccagaactacatcaccgaggaaaactggaaggcgaaggaagtacctgggttggaagacctccacgaaatcggtcgtctacagcttcggggcctcttcactcccgggatcgatgactcccacgagcaatacgtggtagacagcaattcccgcgagacctttgagacctgggaagcctgcatggctgaaggcgtgcggccgcacagagtcacggccgagatccctgcgaacattgagaaacttcacgagcagtccctcagagccgttcgcgacgtcttganacaaagccaccccagagagcgcaagcgctggatcgacaagcagggaaacaactggagcggcgcgtttggcgacgacccggccgcctacttcgactccaagggccgcaagatcgccgagccaggtcgcgaccagcccccgcaagacccagtcaaccctccgcccaaggaaatcgagcccactggggccgcgcaccccagtgattacgaggaggactcatcagaatcgtcgtcagaagaggacgcccagcaggagcagcaggagcagcagcagcagcagcagcgacaaccctccgaacctcaaaccatcacgacgaagcccagcgaagctagctcaagcaacggcccatcgaaacgggcagccaagcgcagtgagcagcgccagcagcgcggtctgatgcagtggaagccagcgcgcaatgcggtgttcgcacgggatgaagccaagtatgcaatgcgcaaagtgaaacacaagttcactggcaacctgagcggacgagagccggatattgagaccgagacgggacagtag

SEQ ID NO: 5127 - DNA, 723 bp, A.fumigatus
gggtccggtcctgaagctgaattggaggattatgatgtcaccgatgatctgcgggaaatgtgtatccagtttggatatctggctctgttctcacccgtgtggccacttgttcccgtctccttcttgatcaacaactgggtcgagctgcggtctgatttcttcaagatctgcgtcgagtgcaagagaccctggcctcagcgtgcggataccattggaccatggatggacagcctcggattcttgtcctgggtgggaagtatcaccagctcagcccttgtctatatgttcagtaacgggcatgagggccctaatggcgagccaacaacaatccggtgctgggcgttgttactgacaattttcttctccgagcatctctacctgatcgtgcgctacgccgtacgaagtgccctggctaagctggagcctccgaacacacgtcgcgaacggatagagcgcttcatgatgcggaagagatacctcgacactgtgctcagtgcagagagcgacgacgatgccgatgaggtcaagggtgtcgtatcttccatcccaccttccgagatcactcgcgagtccttggaacaggacgctagagactggtccaagcaggggactgatccaaccgagcgcttctggataagacagagaggctggaaggagtctgccgaggttggtttgagcctcatcacaaaggccaagggcgacgaaaccaagaagcagcagtag

SEQ ID NO: 5128 - DNA, 315 bp, A.fumigatus
ctcttcctaggggcccttattcttatgtacactgcttttgaattagcatatagggacatcatctactttgtattgtctattattgaatattgcctttttattaaagtactagctatccacccattgcagtgggattctttttgtgggaggattttgcgtagtgcggaagtcatggctgtgcttaattttgaatttgaatctgttcctcatgtctctagtagcgtgaatcatgactctgaggtcaggactcacgcgcgaacgcacccaatatgcctagtggtctttatgggtgactattatagatcaacagcttaa

SEQ ID NO: 5129 - DNA, 240 bp, A.fumigatus
agcaaattacacagcgcaatacactacctgattcgccctatcatcatgtctgccacctctccaacgctatctactaaccagcccattaagactagcactgctcctccacctccaccacctccactaagtactaatagggcttccactctcgcgacagtaccccatccgctgactgtcacctctcacggtccccccagagctttcctagttaagctgttgatctataatagtcacccataa

SEQ ID NO: 5130 - DNA, 525 bp, A.fumigatus
gtatcccccttcccttccctccatttacattactcacacaagtacaggtcaggtaatcacccgcctccctgccgacgcaaccaagcacataaagaccttgatcctctcctaacagctcaacccagcaacttctccaatatcgcctccctcctctggcacgcctacgccgccctcccatccccctcctcctccgtaaactgggctggcttctacatccgccaggataaattccccgcgctcggttcccagaacacacgaagcaacagcaccaataacctcctgctgctaggcccattccagggccgccctgcttgccaggagatccgcttcgggcgcggcgtgtgtggcaccgcagcggagaagcgcgagacggtgattgtgccggatgtgttgagtttcccgggacatattgcctgtgacgcgagtagtcggagtgagattgtggtgccgattcttgttggcggggaggtgagtttgctttctttggtggaagctgtgttgcgttgtgttgctgatgcgcggtag

SEQ ID NO: 5131 - DNA, 561 bp, A.fumigatus
acaatatctctccatacactgacgatgtcatgtgcaacccaatttccaatctttcagtcggacgtagagcatatttgtataagatatacgggacgtctaaccaagcatcataccatcatattatatatacacacttaccaatcacaacactccgccaaaagcgacgcaagctcctccaaccacttcttatcctcctcgtcgaacccagccggctccgtacaatcaacgtcgatgatcgcaaccgtctaccgcgcatcagcaacacaacgcaacacagcttccaccaaagaaagcaaactcacctccccgccaacaagaatcggcaccacaatctcactccgactactcgcgtcacaggcaatatgtcccgggaaactcaacacatccggcacaatcaccgtctcgcgcttctccgctgcggtgccacacacgccgcgcccgaagcggatctcctggcaagcagggcggccctggaatgggcctagcagcaggaggttattggtgctgttgcttcgtgtgttctgggaaccgagcgcggggaatttatcctggcggatgtag

SEQ ID NO: 5132 - DNA, 618 bp, A.fumigatus
caacagctgcatatggcatcagcccgttcagacactcagtccgaccagagccagatgaacataacatttgatcgcttcaacccgcagccgtacctcacatacacgccagctcccagacctcctgatatgtctggctccgctcagtttggaattacaagggatctacctttccaacagctgcatatgacatcagcctcttcggacactcaatccgaccagagccagatgaacgtaacatttgatcgcttcaacccgcagccatacctcacatacacgccagcttcaaggcctcctgatgtgtctgatcccactcattttggaattacaagggatctacctttccaacagctgcatatgacatcagcctcttcggacactcaatgcggccagagccagatgaacataacatttgatcgtttcaacccgcagccatacctcacatacattccagctgctcagccttctgcactatccaatcaccaaaagccggcaggcgaaagcggggcgtacatggtacttcatcggcagttagaggatatccacgatgggcaggctgagcgtaacggataccagaacgaggtccaacattgccctgaagaccaaattcgagtttggtga

SEQ ID NO: 5133 - DNA, 504 bp, A.fumigatus
tgtgccttgtcttttgacatgtcgctcctgtcctacatcgcctcgggcatcagctcgtttgtcgtcgtgacgctttcccttttcgcgctcggccaaaaagtccctcgcgcggcctttttcgctcggtgtctggcggcctatggctctctcttgttatgcgcatgctatggcgtgattgcatccattcttcttcggctcgtaggctacggccgggtctcgcaatgggccaccgcacgcagtttcaaatgggttatgcggtatacaaccggcgtacagttcgacattatccagggcgccgagcacctctctacccggcctgcggtcttcattggcaaccatcagtccgagctcgacgtgctcatgctgggccatatcttccctccctactgcagtgttcccgcgaaaaagtcttggaaacatatcccccttcctgggttggttcatggcgctgttcccggacggtcttccttgaacgggccaacccgcaaaaccacaatgaaaggc

SEQ ID NO: 5134 - DNA, 198 bp, A.fumigatus
ccattggcgaattcaacagcggcaagtcccacgttctgttccaaaagaagaggtttactgacagtgcctccaacagccatcaatattgtcacggactttgttttcgccactctgccggttttcatgttccataatatccaggtcaacaagcgcactcgagcgtccctaatgggcattctcagtcttgggtacttgtga

SEQ ID NO: 5135 - DNA, 270 bp, A.fumigatus
ctttcccaagtctttctcatactgttcacgatcgcctgcattctaaccctgatactccaatgcatacctgttagtgcggtgtgggattataccctaaaggctacagcaacgtgttattcaagccaaacctacctagccattggcgaattcaacagcggcaagtcccacgttctgttccaaaagaagaggtttactgacagtgcctccaacagccatcaatattgtcacggactttgttttcgccactctgccggttttcatgttccataa

SEQ ID NO: 5136 - DNA, 186 bp, A.fumigatus
agtaatcctttctatcctggaccgggcagaggatatagagacttcgggggcggacatggcgagaatgtcactatcccaaagagacacaaactctacagtgcggttttggatattctctctggactaggcatatcaaactacagaagtccagattacaacattgttcaacctccatggtgcggctga

SEQ ID NO: 5137 - DNA, 219 bp, A.fumigatus
gccgccgtaggcgcatccgtccccattgcaagcctcgcccctccatccacaaactcgctatacgcaaaagccctctggcagcgctcaccgatcaactccggccacgcacggaacaaaaccggatccgagtggaccggctgcactgacgcgattatccccaactcccccaaccgtcttgcgtcctcgggggcagtcagctccagatgctcgatgcggtga

SEQ ID NO: 5138 - DNA, 951 bp, A.fumigatus
  unsure (58): Identity of nucleotide sequences at the above locations are unknown.
accggcctcgtcgacatggccatggacgaaaccacgtgggacgtcctccagttttacngacaacgtcacgatccccccctgcacatcgcagcatactggctcgtccccttttcccagaacgaagaaaccaattttagccatgttgaccgcgcgatccagatacacgccgagttccaccccaccaaatcacccaacttgtgcatcatgggcataaagctcatctgcgacggtgtcgtcgacggctgcacagcggcgctcagccagccatacggcagccttacggacccagtcgagcccatctggcccgcggagatgctgaaagccgtcgtccagcgcgcagaccaagccggcctgcaatgcgccatccacgccatcggtgacaaagccgtgacgcaagccatcgatgtcctcgcggaggtgggcacccccggccgccgtcaccgcatcgagcatctggagctgactgcccccgaggacgcaagacggttgggggagttggggataatcgcgtcagtgcagccggtccactcggatccggttttgttccgtgcgtggccggagttgatcggtgagcgctgccagagggcttttgcgtatagcgagtttgtggatggaggggcgaggcttgcaatggggacggatgcgcctacggcggctcatttgccgttgccgaatctgtataatgcgacgacgaggcgttcggcattggaaccaggcgagccagccgctacgaatccgcgtttcggattagggctggcggaggctgtcacggctgcgacggaaggggcggcgtatgcgagatttgcagaggggtggacggggtgcttaagggaaggccgtagcgcggattttgtggtgttagatatgcagtgggaagcggaagagttgttggagggtaaggtgtgcgagacttggttcggagggaagagggtatacagtgtagaaagatga

SEQ ID NO: 5139 - DNA, 1380 bp, A.fumigatus
  unsure (1046),(1204): Identity of nucleotide sequences at the above locations are unknown.
atgtttttggcggatctcataccacgtgagcaggatcaggacggcccgccacgggatgacgacgcactggcggaagatcttgcggcagaggcaccatttgtaccgattcgtaacaacagacgtcctggcaatgatgtgcagcaaaatcagggcattggtgcggatgcaggaattgatcccaacgacctggatgctgttgaagaaggtgacgatctagaaggaatcctcgaacttatcggcatgcaaggtcccatatttggcttgcttcagaacggagtgttcagcgctcttttgatttcatttacagtggctattggggtctggcttccctatttgtgggggaagatcgcactcgtcctcctcgcaaaccccattcaactcatcttcggtgtacctgtgactgcagtatcggttattgcagatgtcacactcgacactcttattggcagtcttggctatctcatgtatgcggtcagccttgtttgcaaagtgctgcttggccccttgagcgcctttgtcccgctaggcgactggattccccaaactaagttcatcacgaacgcatcattgtcgcttatcgatgcaagcagtcaccggttgaagactgtggtcagcgcgttctttgtcttccacgaatctgacgttccagtgttctctgttctgtctcaccaggcactgaagatccatcaagcgcgcatctctggtctttgtcagtccattgctacatttgtcaagttcatagtacaagatctgcccctccaaattactacaaatggactccaaggcgctttatcctttggtcgtcaaggcatcgacttgagcagtcttttggctcaggctcgacagcagttgtacagctttgctgaacgcccttttttcccagggaaaggcgtgaagtggctcgatgccactgtgaaagggacggcttccaccagtttggccattgatcccgaattggcggtttgggataccaaagatcgtattattgccattatcatgggttatgtgctcgcgtcgattttgggactcctctaccttcgtattantagcctgttcacaggggcaactcgtggacagagggtcgagggcctcgtcgcagacatactccaccaagctggtggagtgatgaaagtcattttgatcattgggattgaaatgattgtctttccactgtactgtggtaccctgcttgacctcgccttgntacctctctttgagaacgctacgatagcctcccggcttgagtttacctcatcctccccacttacatcactctttgtgcactggttcataggcacttgttatatgttccattttgctctatttgtttcgatgtgccgaaaaatcatgaggagtggtgttctctgtaagtgctcttaa

SEQ ID NO: 5140 - DNA, 981 bp, A.fumigatus
gaactcgtcgcgagaatggcttttgcgactcttcgtagcattccctcaccgactcgtttgatgcgtcctaccatggctatttctcagcaccagagccgccagatctcattctcttcctacctcgtgtcacccagagaactccatgaagctttgaagaagaacccgaccacgaagatctccacttctccacgtgtaatccctttatgtgccgcgtggttcatgcccaatgaccccgagggccgcaaaggcattgatgcttttcgaaagcatcgaatccctcaggcacgatttttcgatctagacgcgatcaaggactctgaatctccctacccgcatatgcttcctactgtggaaacgtttgctgaggcgatgagcgagcttggtattcgacgcgacgacgaggttgtggtttacgatacagaagagcttggcatcttcagcgcccctcgtgttggctggaccttacgagtatttgggcatccaagggttcatgtcctcaacaactacaggttgtgggttcgtgacggctatccaacggagactggggagccagcgcctgtggagaaaaccagctaccccctcccacagttcgactctaagctggtgattccgtaccgagagttgaaggagattgccaaggaacaccgaaaagaaggatcaaaggaggtcgagatcctagatgctagatcttacgggcgatgggcgggtactgatcccgaaccgcgcccgggcttgtcttcggggcatatccctggctccaagagcttgccatttcaagaacttcttgaccctgaaacaaagacctatcttgctcctgaagagctacgcaaggtctttcagaagcacgaagtcgatgaaaccaagtccatcatcagcacatgcggaaccggcgtgacggccagtgtcattgagactgctttgaatgtggcagattatggaaatcccagtcttcggagggtttatgacgggagctggacgtaa

SEQ ID NO: 5141 - DNA, 435 bp, A.fumigatus
cgccaacacatccacaaccacaacagactcagacagcggcaaccgaggcctcccctactacgaaaaactccgccgcgacctccgcgacgccctgcaaaagaaacgccttatggacaaaagcatggtatgccttcgcctctccccctatatcccttcccagtccgccataacctggcaactaaccacagcggacaggcccaactcgaagaccaaatctaccgttttgagcaatcctacctcgaagaaaccaccgccggaaacatcatcaagggtttcgacaactatatcaaggggtccgggtcaagcacggggcttggcgcaagcgggatcgcgctggcagggggcatgggcggcgcggcacgtcgcaagtcgcaggtgacagatgcagatagggtgttttcgaggagttcggcgagtttcatgcgggtgcgttag

SEQ ID NO: 5142 - DNA, 243 bp, A.fumigatus
caaaacagagacagattgacgttgaaagttgatgcattcatcaaggacgaaacgtatgcttatgcatacaagacaaacagaatctataagatcctccctttggcttcacatttactgaatacgggagtccagtcctccaaccggtctcaaactgaccgccctgcctcagacgatagtccaagcatcacgaacaacgcgtcccctctcaacctgttatcaaggaatactcagcatattaattga

SEQ ID NO: 5143 - DNA, 570 bp, A.fumigatus
gcaattcaacctttgtcagcccttgctgcacagcacaagatggcagacaccgtcccagctcaggctccagccgcaacaggcagaccaacaggtgcagcaaccgcaacagcaccagcaacagcaggcgcatcaggcacaacaacaggcacacaaccctccggcaccaacaacccaaccaccggcaacgctaacgccaacacatccacaaccacaacagactcagacagcggcaaccgaggcctcccctactacgaaaaactccgccgcgacctccgcgacgccctgcaaaagaaacgccttatggacaaaagcatggtatgccttcgcctctccccctatatcccttcccagtccgccataacctggcaactaaccacagcggacaggcccaactcgaagaccaaatctaccgttttgagcaatcctacctcgaagaaaccaccgccggaaacatcatcaagggtttcgacaactatatcaaggggtccgggtcaagcacggggcttggcgcaagcgggatcgcgctggcagggggcatgggcggcgcggcacgtcgcaagtcgcaggtga

SEQ ID NO: 5144 - DNA, 486 bp, A.fumigatus
atacgggagtccagtcctccaaccggtctcaaactgaccgccctgcctcagacgatagtccaagcatcacgaacaacgcgtcccctctcaacctgttatcaaggaatactcagcatattaattgagcaattcaacctttgtcagcccttgctgcacagcacaagatggcagacaccgtcccagctcaggctccagccgcaacaggcagaccaacaggtgcagcaaccgcaacagcaccagcaacagcaggcgcatcaggcacaacaacaggcacacaaccctccggcaccaacaacccaaccaccggcaacgctaacgccaacacatccacaaccacaacagactcagacagcggcaaccgaggcctcccctactacgaaaaactccgccgcgacctccgcgacgccctgcaaaagaaacgccttatggacaaaagcatggtatgccttcgcctctccccctatatcccttcccagtccgccataa

SEQ ID NO: 5145 - DNA, 234 bp, A.fumigatus
cacaatcagatgctattcacctggtccaccaaggacctttgcatcgtcttcagccagtggcatatcactggccccttctccctcctcatgtccctgattgtcatagtgctcttgacagcaggttacgagggtgtccggcaagccacccgaaaatacgaagctgcccaagcgcagcgtctgaacgttttctcgacaacaacagctacgatcggtaagtacttcggtcttttctga

SEQ ID NO: 5146 - DNA, 318 bp, A.fumigatus
  unsure (11),(66): Identity of nucleotide sequences at the above locations are unknown.
tccagtagttntaatccttcccataagtattctccaaccgttcgtaggcggcttatcccttctttngtggccctcatcatccttatcttggtccttgttaccgggccccgttccgctttcttcttatttttcgacgacgaagacgaagaccctttcacactggcggcagcagaagacgtcccctcgccattcggcttcccattcgacccgttgtatgtcgacgtcggcgtcggcgcatgcgaaggcgtagtctgcacggatgatggcgcgggagaatcctatgactggttagaccaccgcctttattcagagctttaa

SEQ ID NO: 5147 - DNA, 297 bp, A.fumigatus
aatgtactcccgctttctatgtctgctttggccatagctcgactgaagccttcattgacgaacggtgtgcaaggcaatgagttcgccgacgagtccgccaccaccaacgttccctcaagtcaaacccccaacgagagctcaccgctggttgcaggtagggacaacagacgggccgtggagcaaagacgcaagatcatccttgcagctttgtatgccgtgcaagtgttctatagcttcttcatcaagttaattatttcccccattctgcctgttttttctatcaattcagatgcctaa

SEQ ID NO: 5148 - DNA, 897 bp, A.fumigatus
acgctcgctcggtccttcgccgctgtggtgaagactgttttggaagcttttgacaccaacattcaataccggggagctaacagcaagatgaaccttgtttttggtggctcggaacccgctgtggctcttgcttcgctcatgcagctcgcgtcgtcgagccaggagaacttctactctcgtccagacctcggagcgtccctcatcttcgaattgtttagcctcgaagctggagcagctccgacatacccggaccagtcccagctctacgtgcgatttctcctgcgtaacggaacaggcacctccgccgaattccggtcctacccattttttgggcatggtccaagtaatgatgcgatcccatactccgagttccgcgcgcagatggaaaagtttgctcttggttccactcagcagtggtgcctcgaatgcggatcgtcggctgtgttctgttccggagcgatgggcaaggctaaaaaaacatcgacctccggcaacaggttaagtcccgctattgctggcgtgattggagctgtggttacaatcgtcgctctagcactggctgctatactcattttcctagtgcgggggttccgtatgagacgcatgcgcagatcaagtgctggagggttcaagggtaatagcaagatggcaagcgatgctgaccttactgccaaagattctacgcgtgaggacgttaagccagcagagagcccagatagtgagccatttagggctggaggagcagttgtctgtggtcatgagcggactggaagctgggaaatgaggccgactcctgctcagaatcggacgactgcatctcctttcgaagtcgaacatgacgatacctggaatactcacagcgcccttaagccagtccaggctcgggaacatgtttga

SEQ ID NO: 5149 - DNA, 213 bp, A.fumigatus
ttgctccactgcggatccttccagccccgtggtgaagaccgtcagagcttctctgaaccacatcccgcaacacctgataccattgcacctcaaacccacaccaagcttaatcgcaacatgtcggagcttgattatgcgacagatgaggatgtggaggatggcaatgccttttcttttcggcctccggtaagtcattattctacattccattga

SEQ ID NO: 5150 - DNA, 252 bp, A.fumigatus
  unsure (10),(34),(53),(62),(98),(101): Identity of nucleotide sequences at the above locations are unknown.
ttgggggaanaaagaagtggtgtcattggcgaancgaaagggaagtcaatgangccatgcanatgcaatgccaagtcaattacaaatcctgcaaccanaanccgtctccatctatttcattcaaggagacgtggcaagacgactaatccattatttacctttgcaattaaacctgatttcgatactcgtcctctgcagggtgtcaatcatctctctccctttatctcatgttatgtacctcagattatatag

SEQ ID NO: 5151 - DNA, 249 bp, A.fumigatus
catgcacctcactttgatgaacggcacactgcgtacggcggccctcagtggccggtttgccctggcctctccctcccctttgcccaccgccacgccgttattccaatgctgccagaagatgtcactcagaacacaggctcggccagtcagcacatcaaccacacgcatccttttaaagccatcgcctcgtcctcagacaagctttatgtgcctgtctcccattttccgcaaaactgcttttcgccttaa

SEQ ID NO: 5152 - DNA, 336 bp, A.fumigatus
  unsure (60): Identity of nucleotide sequences at the above locations are unknown.
ttcgaccgccgcaaacgcatcccgcgccgaagtcccccaaactggattgaaattcattcnttcaaactgcgcgcatctcgccgcagatacacccttgccttcgtcgataattgcctcgatggccagtacaattatcggagtacaaattcctttcggagcaagatctcgagtccctcgggggcgcaggtgatgggcttggaccctttcgttgtcctgggattggcgaccgctacctgcggtgcggtgggctggctcgcgggtccctttttgggcaatgccatctggaggctggtctatcgcaaatataagccagctttcttaatggtgagttcttga

SEQ ID NO: 5153 - DNA, 216 bp, A.fumigatus
gactcttgccggttttgctcggtgctaacaaatggacagagagagaaggagttctatgacagaatcaagcggttccgtgtcgatccctcgtctaactcgattgccaatccagtgccggattactatggtgagaagattggtagtgttcaaggttaccggcagtggttgaaggatcagagggcctacaaccgcaagagacgcagtttcatcatctaa

SEQ ID NO: 5154 - DNA, 1011 bp, A.fumigatus
  unsure (899): Identity of nucleotide sequences at the above locations are unknown.
gcctggaatcactccacgtctccacttccgtttccctctctcttgttctctctctccctctcctactctcctcatccctcagcccccttctgtcccatcccatcctcctcggtagatttgaggaatctctctgttgtctctcgtttgaaaagtatttctatatatcatttagggacatttcgtcatctcagtcccacccatgcgagtcgtcccagcagcctctcttgttccagggtgcacgtccctctaaagcgagttttctgggcatcttcaaccaaccaacagctctgtaccgccaacgttgtccccgcggtttccagtccgttgcaggccgccctcgccctcccacacggctcgcccttcgtctatcctcctgtgccgcatttcatcttcctcgcttactcggacaaatccttggatctcctcgctttttcgatagtaaggtacagtagacgttcggtggtatcttcaatctctctatccaccggcatgacgcagcttttcgcttctagtccgtccggtgtgacgaatgagaaacgtggaaactttcccggtctatccctggcttccaaaaaacacaatgagtcgagccatctcccgacaaggataaagaatttcttccgtatcaatagttctagcagcaatgtcactcctcatacaggcagcgatcgagaacgagaccgagacgccagcccctccaccggcgccaaggcagaggcgaagtcgacattcagacaatcccgtttcatacctactatcggtcgcaatcgctcaaccaccgtcgcgagtgaaggcaatccgctcgatgaaggtgtctctcctacggctactgccaatccatatttcgttcaccaaggtcagccttccctgcagcatcgcaacgacggttcgttcccctnttcccctcccgacacccctgaactgcaggtggatggtgtctctgctgctgagcaggcgacgaccgccaacagggaggaatcttcaccacggggctggaaggacacgcgctct

SEQ ID NO: 5155 - DNA, 198 bp, A.fumigatus
ctcgctcagagtatcaatgtcgccgggggcgaagaatattcccatcgcttcaagatccccgagatggattctctctaccgctactggcacatgttcttcgagataccccataagaaccttccgtttgctcatccgaagtcggaaatctatcaaataccaggtacaaacatttcccccctttcgagtgtatctaactga

SEQ ID NO: 5156 - DNA, 252 bp, A.fumigatus
ttgaacacgctctatacccgcgagaacaatactatacctatctggatcttcaccacgctcttgctgaactgtgtctttggtctgccggggggcaagtctagcgagagcgacattaccctcggcagtctcgacagcttgataaatcttgcgcgggtgatcgaatctggcccggcaatggatctcgtcgatcaggcatccacagtggaggagaaatggaagagttacatcgagggagaatctcaccgcaggtaa

SEQ ID NO: 5157 - DNA, 228 bp, A.fumigatus
aaaattggatctgagaagccctactacagcatcagtgtgagtaattccagtaggaaaacacaggatcgacacaatgtccaaggatatgataccggacacttacctccgagtgctgtctccatcatcgtcgctctcatcactcaagtcactactatcatcctcttcggcttctctttgtttctgttgttcgctgtctttcaccacagggggtcggcggatccgcgctaa

SEQ ID NO: 5158 - DNA, 1794 bp, A.fumigatus
tgctgtagtagggcttctcagatccaattttctaaaatgccaatccgcacacgagctggatcttcgccaatccgttcgtctgatcgtcatgaaggcccggaagtcatggtcacatctccctcacacccagcaacaggagcgcattttcgcactggatcattggggacggcagtgaatgtgaatgagggacgaccgcgacgagatactactaccagtagcgacctgtctacagataacgagaccaacgaaatggacccttcattcaagaggcgacaaatacaattttctaccacggacaaaatcatagaatatcaggacccgcctcgcagcactagtaacaggaatgttgacactatgacgttgggagggctcagcgaggccgcggaggactctggcgctgagtctgtaggatctgtactctcgtccgagttcgacgcaacggctggatccggctcgctgttggaagacgtcgggatcactggcggtttagactcatcctcgcctgtcgcgttgatgcataagctgcagaacggagctggatcccagactgcatccccaaggaaacccagaactccagcacccgagttgcaaaatctgccaccgccacgccccatcagcaggctgcaacctaccagtttactgacgcaagcgcttaaagcacgcatgaaggcacccacaaatcctgtcgaaaaatttgctgttctttccggtaaagggttagcggacgccctaaatatcaagctttatcttccattctcctctgatcccgaagaacctctcgaccttcagttggccagggaatctaagcttgcggatcagccggcgccggtcactgttgcggaggctattgggttggctctttggaggtactccgaagaaggtcgcgagccagccatcgagcgtaacaaactcaatgtgaatcgatggacactacggatggttgaggatggagaggttgaatacgattttccgcctctgagccgtgcatcacacatagcagacttcacttcgaacaataacaatagggcgaccggagtgaggggccggtcgaggggaaagcaatatgatgaattcgctttggtggaggcttctgaggaggaattcgaagagaatgagcggctgttcccgcaatacagtcaggaagccacctctgaggaaaacgtgatgacgcctacagcgccaacagtgccgctcctccagcctactccgcagagtaaggccccagcagctcgcgtgaatcccattctgggacagccgttctcgtctgccctcaacgacaataccttgactccagctgaccggcccgcggtgcccacatcccatgctactcctcgaatgggcgtctccaaaacgctgaagatccgatttatgaacctggatgctgccactcacgttacaaccctgaacacctccaccgacagctatatagcagaaatcttggactcggtctgcaagagatgggctctcgacaagggcaattacattctcaaggtggctgggtccaacacgatcgcgccgcttgatcggacagtggaggctttgggtaatattaccgacctcgaccttgtacggcgtcgattcggggcagggcctctatcattaactggttccccaggaagctcatcccccaatgcgccgttactcatcgataacaaacagaacactacaagcaagaagaacaagaagagcggaccaagcatgctacatccactcacccaaactcaggagcttatgggtggttactaccggcgctatcatgtcttcaaccacgggggctggaaggaaccgcgctaa

SEQ ID NO: 5159 - DNA, 594 bp, A.fumigatus
ccaagcgcgacctgcgctcctttgactgctggccacaatccgtccatcccgacgaatacgaccgcctcgcgaccgcctaccacgacgcctcccgtgcccagcagcccctctgcatccagtaccgcacccgcgacgatgactgtccctgacggctactcacccctcggcccgatgggcttcgacgagcgcgccctcttcggcctcaccagcgccggcggcgccatctacactatcgccgacatcacccaggaaaagaccgccgagctttcccagcggcaaatcgccgaggaagttcagcagcgcaagacccagcaggagcggttcatcgacatgatcagccacgaagtacggaacccgctctccgccatcctgcactgcaccgaggacattctcaacgcggtgcaccggatccgggacggggcagagcacgccggaggagacgcatgcgacgattgtcagtcggcggctgtgtcatcagcacgggggcgagatcgggatgagttccaaggaagacgagggcagcacgtttgggttcgtctttgccgtccggaaaagcgaaggcgtggagaggcgtcttaccagcccgacggctga

SEQ ID NO: 5160 - DNA, 240 bp, A.fumigatus
caagtggcggacatgctgcctactggcgtcgccatccgcaaccaccgcgacgaagccatcttcgccaaccaccgcttccgcaacctcatgaccaagcgcgacctgcgctcctttgactgctggccacaatccgtccatcccgacgaatacgaccgcctcgcgaccgcctaccacgacgcctcccgtgcccagcagcccctctgcatccagtaccgcacccgcgacgatgactgtccctga

SEQ ID NO: 5161 - DNA, 216 bp, A.fumigatus
aagggggtccaaagtattatgtgcgacgcgttacaagagacagagttatatgacggctgtgaaattatgtattacgccttagctggaaaatcgagaatctatctaacgtgcgcttcatcagaatctatttccgaagaaccgatgtttatattcctacaagcatacgattataagatcttttacgaagctacctgtaccattatgaatatgctttga

SEQ ID NO: 5162 - DNA, 1383 bp, A.fumigatus
tgtaacgccaccgcggatccttccagccccgtggtgaagacaaacacagcaacccagctggtcgactttcctcccgaggttattctggacataggagaccatctcgggctgaaagacctcaattcatttgtccagacggcaaagctgttcaacactttgttgtcttcccgactttatgcgctcggagccaaacacgtgggcgaaacaacatcgccgctaatccacgcggtccagtattgcccgatctcagctgttagaaagttgcttgacaatggagcagacccttcagtctttgccggcaagaccaacgccttcctggcagcaataacgcgctatagacctaaggtcctaaaaatcctcgttgagcctggcgttagcgcatccacaccgataaccaagctcaagtcacccctgtcaatagcggcgactcgttggcgactagcgccactacgtatcttattgaatgctgctcctggacattatcctgatgaagacggagcatggatgggggcgttgggccgtgcgctagtgaagaaccgcgtgcgtgcagcccgcctcctgttggcagcggctgcgaagacgatctcctcacctctgcaaggtttatctgtggacaagatttatagcgttctctaccgagcaaattgtgagattatccggctgctggtcgagtttggctgggatcccctcgcccagttagggatgggaggcctgcccttgcatattgctgcgcaaacgggcagagcagaccttgttcggctgctactttcgtacggcgccgatgtgaacgcgaggaatggccagcatgctacgccgctccatctagcctgcgccaacggccagttgggcgccgtggagcttcttctgaaccgcggcgctgatgccaacgctgccaccttatttcgcgaaactcccttgcatcagtgtatgcgttttggctctctcccccttcttgagcttctgctcactgctggagccaataccagtgctcgcgatgaaaccggggtctcaccgttgcacattggcatcagcctcaggaagcctctggagatgattgtgcgactcatccaagcgggcgccgatatcaacgcactcgacctgcattcccgaacatcgttatttctggccgctaagtacggaaatgcccgactggtgcaagccctagttgatgcaggagtcgacatggcgattgacgaacgagcaggttcgacagggccgttgcatgtagctgctactgaagacaactttagagtcatccagccgctaatcgacgctggactggatattgaggctcccgactccttgggaagaacgcccttgcatttagcaacaattcataactgccttatattccatgagggagctcattcgtcaaggagctga

SEQ ID NO: 5163 - DNA, 534 bp, A.fumigatus
caacaattcataactgccttatattccatgagggagctcattcgtcaaggagctgatccaaaccgcgtcaaccatccgggaaaatcagcagcctacggggcaatcgcctacaatcgcaccgaggccctcaagtttctccttgaatctggagccgatgtgtcccgcctgaggcaagatggcatctcgcttctgcatgacgccgccacacacagcgccatgcccagactgattacgtgcctcctggactacggagcagaccccctggctattacgtctgacggtaagactgcgctgcactatgccgcgactaacgacaggtataagtcaatcccaccgcttttggaggcgggaacgccgatcgaggcgagagacaatcatggcgacaccgcacttcttattgctgcccgcagcagttgtgagggtacccgtgacctgctcaaacgaggtgccaatctgaatgcatgtgaccgacgcgggaggacaccgctacaccattgttcttcccacacagattcagagatatgcaccatgctg

SEQ ID NO: 5164 - DNA, 1656 bp, A.fumigatus
cagtcattcaaggtcttggcggagtgcccaattatcgtcgtgtccatcttccagacgcatcggaattcagtctcggccaacgtgaaactgttcgtgcctttgataaagagtattcttctccttcaagccaaacctcaggagcgcgcgcatgcggaggcggcagcacaaggcacaatctttacaggcgtatgtagggaaatcaaaaatcgggccgcctttggcgaattcatcacagcacaagtgaagacgatgagcttcctcgcatatctgctccgtatgtatgcgcaccagctccaggattttctccctacgcttccgtccgttgtggttcgactcctgcaagattgccccagggagaaatccagcgccagaaaggaacttcttgtggcgatccggcacatcatcaactttaattaccggaagatcttcctggagaagattgacgaacttcttgacgagagaaccctcatcggcgatggattaactgtgtacgagacgatgcgcccactcgcctacagcatgcttgcggatcttattcaccatgtccgagatcacctcactcgcgatcaaattcggcgaacagtcgaagtctacacaaagaatcttcacgatgatttccctggaacaagctttcaaactatgagtgctaagttgcttttgaacatggccgaaaggattgcgaaactagacgacaagcgtgaggcccgttattttctgatcatgatcctagatgctattggtgataaatttgcttggatcaaccaccaatttgataatgccgtcaaggtgtcgaaggcgtacaaggcgggcaagaaagatattgagctttcttccgaaagatatcttgcggacaaggaaaaccccccggattgggatgagattgatatattctccgcatcgcccatcaagacctcaaatcttcgcgatcgcggaggagaccctgtctcggacaatatcttcctcttcaaaaacctcatcaacggactgaagaacatcttccatcagctcaaaaactgcaacccagagcatattcagatcgaccccaacaacgtgccgattaattggcctgaagtctcttacgggtataatgcagaggaagtccgggtgatcaagaagttgtttcatgagggagcgcgtgttttcaaatattatggcgtcgatcagcctgcgccagaagtgacatatagttcccccttcgatttccttgccagtcagtatacggcgcctatgtcgcgggaagagaaggagcttttggagagctttgggacagtcttccactgcattgacacggccaccttccatgaggtgtttcactccgagattccttatctccatgagctcatgtttgagcatggggctttgcttcacctgccacagttcttcctcgccagcgaagccacttctcctgcattctccgggatggtgctccagtacctcatggatcgtatccacgaagtgggaaccgcagacatgaccaaagcgaaaattctcctcaggatgttcaagctttctttcatggccgtgaccctcttctctgtccagaatgagcaggtactgcaccctcatgtgaccaagattgtcacgaaatgtatcgagctatcagtcaccgctgaagagcccagtcttcaccgcgggcgaaagaggggtactgactgg

SEQ ID NO: 5165 - DNA, 1017 bp, A.fumigatus
  unsure (96),(127): Identity of nucleotide sequences at the above locations are unknown.
cccattgagctctttctcgtcgccaacaccaattcaatctgcaacatggcctctactcttcgctcgtcgggatgtcataggcatcgcagagacccnaagcgggaagacattggcttttcgatgccgngtattaagaaaaatcttgattcagggaaggttaagcgaaacatgcaagactgccggagtcatattttggcaaccagggaacttgcaatgcagatatatgatcagctatcgaagtttggggcctctgtggacatcagagtaacatgtatctatgggggtgtgaagaaagatgaacagcgcgaggcactgaagactgcagctatcgttgttgccacccctggtagactgaaagatcttaaagacgatggctccgtggatcttggaaaggtcaaatacctagtcttggacgaagcggatcgcatgctggacaagggttttgaacaggatataaaagacattatccgctccacgccagattcaacacgccaaacagtcatgttcacagcaacctggcctccaagcgtcagagacctggcggcttctttcatgacttcagctgtgactgtcaccatcggtggtgatccgtccgccgatccgcgtgctaataccaggattaaacaggtggtcgaggttgttaagcctcaagaaaaggaggctaggcttgttcagttgctcagtcgctctcagcgaggcgcagcagttggcgataaggttcttgtcttttgcttgtacaaaaaagaagcggttcgtgtcgagagacttttacgaagcaagaacttcaaagtcgcagggatacatggagatttgaaccagcacgaacgatttaaaagtctagaggcattcaaaaccgggtcggctactgtacttgttgccaccgacgtggcagcccgtggccttgacataccgtcagtcaaattggttatcaatgtcacatttcctctaacagccgaggactatgtacatcgaattggccggttagtaacgatgctctctctcggctggaagtattaa

SEQ ID NO: 5166 - DNA, 192 bp, A.fumigatus
tctgctaatgtggccatcttcctaatatgtcacaggttgataaacgttctgagagcagccaaacaagatgtaccggacgctctgctcaagtttggaacaaccgtgaagaagaagcagcatggtgcgtacggcgcattcttcaaggacgtggataccagcaagtcagcgacaaagattgttttcgatgaatga

SEQ ID NO: 5167 - DNA, 354 bp, A.fumigatus
  unsure (49),(51),(182),(213): Identity of nucleotide sequences at the above locations are unknown.
agtgacccgattcttcgggaagcgccaccgctgcgccccattatgtcgntntctcacctccctagcagcttcagcaagatctatgacccattgagctctttctcgtcgccaacaccaattcaatctgcaacatggcctctactcttcgctcgtcgggatgtcataggcatcgcagagacccnaagcgggaagacattggcttttcgatgccgngtattaagaaaaatcttgattcagggaaggttaagcgaaacatgcaagactgccggagtcatattttggcaaccagggaacttgcaatgcagatatatgatcagctatcgaagtttggggcctctgtggacatcagagtaa

SEQ ID NO: 5168 - DNA, 210 bp, A.fumigatus
aagtctctcgacacgaaccgcttcttttttgtacaagcaaaagacaagaaccttatcgccaactgctgcgcctcgctgagagcgactgagcaactgaacaagcctagcctccttttcttgaggcttaacaacctcgaccacctgtttaatcctggtattagcacgcggatcggcggacggatcaccaccgatggtgacagtcacagctga

SEQ ID NO: 5169 - DNA, 435 bp, A.fumigatus
ctaatgaaactcgagttcgttgaggaacaagctattgatcgagtccatcggcttaaccagacggtcgacgtcaagatttacaagatgattatcaaggaaaccgttgaagagcggatcttggaattgcaagaccgcaagcgcgagttggccaatctcacaattgaaggcaagagcgcagctggcaagcttactatgaacgatatgatggctctctttggtcgcgatgccgaagctcgcttctctggcgaccggggaaacattgacgttatcaaatccggagcatcattgacagaagccagcgcctctagttccaagaataacggaaacgaaggaagcactcggccgtggggccggcccagttcgcaaggccggaatcgccatgcggagaagcgggctcctaggactgaggattctgtatatggacgacgctggtga

SEQ ID NO: 5170 - DNA, 822 bp, A.fumigatus
gccaaagaagaagtaaagaacagttccagcaggtgtggagagtgcgagcccgatctaaaggctacgcttggtggtttcgattcaggaaagaaaaagagctctcacaaaccgagagtagagatggatctcaccgactcaccatcgaataaattctccgaaatgcagaaggctcgagctcggagaaacaggaagattgttattgacagcgacgacgaggacgaggacgatggggagtggatagtcccggagggccaacgcggtttgcctaatcttggaaaagctggtggaactgatgacgaaaatgctgaaggaggaggcgaatggctgagttccgaggactctgagaccgatgaggatggccctgaatctccaacacggaagcctgccattgtttccaatttgagaagaagccagggttcggagtcggacaccgatgaggatatctatctgaatcctggtgacaatgagactcaagtcctgccatctaccaagatccgacatttgatgaagatcctcagacgtgaagctgccgactacaagttcattgttttttcggtcttcacttcgatgcttgacaagatcgaaccgttcttgaagcatgctggcattggctttgcaagatacgatgggagtatgcgaaacgaccttcgagaagctagtctagataaattgaggcacaacagtgcgactcgggtgctactctgcagtctgcgcgccggcgccctgggactcaaccttacggctgcaagtcgggtcgtgattttggaaccattttggaatcctgtaagtgaccatggtgaactggtgattacagttgactaa

SEQ ID NO: 5171 - DNA, 1443 bp, A.fumigatus
tttctctgcgggtttccgctgacagaaggatgcctgacatcagtcgcgttgacgcgattcaggaggaccttgatatatgcccgccttgaggtgcgaaggctcacccatacgcttcatatgcccccggccctttctgaaatatatggcggcccgcgaccagaatggctgagggacattctcgagtttctaccctgcctccaatctctgattgtatctagattacctttctttgaccataatgctatgatggcattgaagggacccgccaagtacgaaccgcctgatgcagcggccttcaagacatatagcgtccgattgctgatggcggaaagagaaccaaatgcaacgtcacagggtctcgcagagacgttgctgcgattccaagaactggtgtacttggacctgtcatatacgactcctgctcgagatcttatggtgttttcttccctgtctcagctgaaccggctccaggtgctcaaactccgaggcatcggtttgagagacagagaagctgagttcttagccaacgctattgggatcagggtccgtttcttggatctgcgtaataatctgctgaccgatatggctgtgcgatctctgctgcaagcctcatttgtccctaatggaccccccaccaatgaagctgagtggagaggaggatcatttatatttcacgacagattactcaggcgcgcgagtttagatgctctgtttgtcaaggctttgacgcagcccttaacaggccgttcttgggttgaggacctttcgcacgtaggaataacacatctctacatcgcggacaatcagcttacagtcgaaggcgttgcgagcctcttggcttcatcgagactgcatgtcctcgacgttggaacggttgatacagtccaatccttggggagagcacgacaaccgttaatttcatcgcctatgaccgagaaacccgctagattccctggggctgagaaattggtaccagtacttgggtctatcgcgaaagagagcctgacataccttcgagctcaccatgctctctgcacaactgacacctctttcaaagcgcctgactcaacgcgggacttactgcccgagcttccagacgaagccagcagtagcctccaaggcagggcggaaatggacgctgcagatgagattcatgaactatctgcagaagcccatcctgtttttgagctcgaagccactgagattgccggaatttcgagtcctgccggtgatgtagatgagacgcgcctccagtcaagaactcaccgggacgaccctgtacctaaggtgagaaggggttccatatttgctcccgaggtagtcgaaccaaaccagcgcgtgggcagcaatggcaacatggcagccgaccgtagtgaaacagtgaattataacgtttttacggctagcataaggtcttcaccgccgggctggaaggaaaagaag

SEQ ID NO: 5172 - DNA, 279 bp, A.fumigatus
  unsure (8),(9),(11),(12),(14),(18),(20),(25),(27),(29),(33),(34),(35),(37),(38),(39),(41),(45),(46): Identity of nucleotide sequences at the above locations are unknown.
gccctgtnncnngnaagnangtggngntnttgnnnannngnatanngtgttctctgcggtgtcggggctgttggcaatatccttatgatgatgattgccaaccttgttggatttgccttgggactggatgggctcaagggtctcctaaccgagattcttgggtcatactcgggtattggcttccttattgccgcttgtggcgcactgtttgttggagcacaggtcatgtttgagattcgggaagaggagttacgcgctggtatcaagatgaagtgttga

SEQ ID NO: 5173 - DNA, 522 bp, A.fumigatus
tcctcgggggatctggtccttccggtcggtggtgtaagactacaaagagcctcgctcagcaaggtcaccaagccctcccgacgaagtctaactcccgctgctaccccgctcgactcctcgaaaaggaagcaatccaccgtaccaccgtcaagagcctcgacgatcccgccagagaccagcacaaacgcgagccctgacacagacgaagacaagaaacagccggagccagaagcggagaaccctaaccgcctgataaaatccgagtacgacaacgatccccttctaaggtcgtacattccctcggcaccctcagagcgcatcatgcaggcacttctcgccgaaccgccactcacatacaacgcggctcgtgctggtccgcccctaaccgccaaggcaccacggcacttttgctgtatgtgtggatattggggaaagattcggtgcaagaactgtcatgttcggacctgcggactagcttgttacaaggttcatgaggactcgcgatgcggagctttcttttga

SEQ ID NO: 5174 - DNA, 330 bp, A.fumigatus
tatgtagaacacaggttaagagggaagaaatctttactagacaatcatggccactcaacatttcatgacgactggacaaactaccgtgcctggccaatgggtcgtgcgcgtcaagccctatctgacccccgagctggtacaaaaggagcatctgtcgctattggaagaaagaaacagaagatcctgcaactcccttcaatgtggaaattcttcaacggtttgatctgtatgattcacaagggctactctgcaaaattcgacgatgccccccaagaaaagttggagaaaatacctcatgtgagcgggcaatgtgaacatgatggactgtga

SEQ ID NO: 5175 - DNA, 183 bp, A.fumigatus
acaatcatggccactcaacatttcatgacgactggacaaactaccgtgcctggccaatgggtcgtgcgcgtcaagccctatctgacccccgagctggtacaaaaggagcatctgtcgctattggaagaaagaaacagaagatcctgcaactcccttcaatgtggaaattcttcaacggtttga

SEQ ID NO: 5176 - DNA, 645 bp, A.fumigatus
gcgggcaatgtgaacatgatggactgtgagactctaccactcacaatctcgcaggtcgtgtctattgaaccagagcaactataccgccactgcaatatccagccaaattcaccgtggggtatcagccgcgtctcgacgaggaccaaacttggcgcccctccatactcttacacatatcgtgatgatgtcgccggcagcggcaccgtggcatatgtaattgatactggtatcaacaacaaacatgtcgagtttgaggggagagcccaaaagggcccaaagtttgtctctgacaatgtctctaatgacgaggatgtgcacggtcatggtacgcattgcgcgggcaccatagccagtcgcgcctatggtgtcgcgaagaaggcaaatgttgtaggtgtcaaggtctttggtgaccggacagggactgcccagacaagtgatatcatcaaggcgctcgagtgggttatcagtgatatctctgccaaaggcatgggcggccgtgcggtggtgaatctgagtcttgggggacctccaagcgacgctcttgatgctgctgttgcgtcaaccgttcataaaggggtagtggtttgcgttgcagctggaaatgagccggaagcaagtactttcgcgacaactaattataactaa

SEQ ID NO: 5177 - DNA, 333 bp, A.fumigatus
cgaaagctcgatcccatcaaagacagtggatatacgaggacgagggcgtttggtaggctcgtagatagattgtctagtaaacatcgagagaatatcatgttttcgaccacatcttacagctccctagctccagcccttgcatctgcaacacgcatacgaaggaatatcgcaacagcccagtcccacaacttccgcgtgatcacgaacaagggtacctccggctcgttctcgcgggtcaagtgtaactgcagaagaagcgaggacatactgacgaagctggcgactgatacgaccaacaacgatgcggttgtctcacgcttgattgtggcgtga

SEQ ID NO: 5178 - DNA, 186 bp, A.fumigatus
agggcaaagggtctttctatgggtcgtgagaaccatctccattctacatacccacataatagccaatgccacctccgtcactctaaatctcctctctacatcccaatcttgcccaacactcccgataattgctgccgcccagccttcccgtcccatccccggccgtatgtgaagaagctcagctag

SEQ ID NO: 5179 - DNA, 579 bp, A.fumigatus
acacaagagtacaatacaatgtacggagcatcgacgggcccccagacgggcatcaacacgccacgctcctcacagtcactgcggccacttattctgactcatgggtcactcgagttttccttcctcgtgcctacatccctccatttctatgcttcacaattaaaagagacctttacggcatccctcccacaaccgacagatgagcttgctcaggacgatgagccctcttcagtggccgagcttgtagctcggtatatcggtcacgttgctcgcgaagtcgaagagggcgaggacgatgcacagggaacctgtctggaagtcctgaagttagctcttaacgagttcgaaagagccttcatgcgcggaaatgatgtccatgccgtagcagccgctctcccgggtattactgccaagaaaatcttggttgttgaggcatattatgccggaagggccgccgctggacggcccaccaagccttatgaatctggcgctattccgcgccgcctccgaagaaaaagccagtatctactcagtccttcggtggccagggcaacatcgaagagtactttgatgagctga

SEQ ID NO: 5180 - DNA, 186 bp, A.fumigatus
atctggcgctattccgcgccgcctccgaagaaaaagccagtatctactcagtccttcggtggccagggcaacatcgaagagtactttgatgagctgagggaaatctacacgacctacccatcttttgtggaggatttgatttcttcatccgctgtcttcaccacgggggcggaaggatccgcgcta

SEQ ID NO: 5181 - DNA, 555 bp, A.fumigatus
ccgccgagtacatgctgcggctcttcggcctcaaggatggactctgcttctatttcctcgaccgtgaaaaccagggccactacaccgacttctgcagcaatggtacccccggtctcttcctcagcggtttccaaatcgagcgtcccatcagcgagctgctcttcactctgctggcccagcgcagtggcgtcaatgtcttccacggccgccaggtcgacttcaacggcagcaccatccggggcggattccagaacaacagggttgccatcaaccccggaaagttcgacggcaagcctgccacaaccatcgattcctcccttctcgtcgatgccaccggtcgcttccgccagttggcttccaagaaagcctccctccaccgttttgaaggctggaactacgacgccttctggggctacttcacggcccccaaggatgaaagcaacattcccttccgctactacgagggtgaccacaccaaccatctgtgcttccccgagggctgggcctgggtcatccgtctcccctcctgggagggcagccccatccccaacttga

SEQ ID NO: 5182 - DNA, 1383 bp, A.fumigatus
aggtcctgtggaatgagtatgacctctcatcatcccgcagcaaacaacccatctccaacatctcgagttcagtcgtctgttattcagtcaagtttaacatctgtcactaccaaaatgactgtgaccaagcccacccctaagcacacctttgctgagcgtgctgccgccaacaatctcaacgatgcacaaatcctcaactccaacaacccggcaggtgcagacatccctgagaaatccgacgttgttgtcgctggtggtggtatccatggcctcatctacgcgattcacgctgccaagtacaagccaggcaagctcaacatctccctgatcgagaagggcaccaagccaggctacaagattggggagagcacgctccctctcttctccctgtggtgcaagatgcacggcttgaccgccgagtacatgctgcggctcttcggcctcaaggatggactctgcttctatttcctcgaccgtgaaaaccagggccactacaccgacttctgcagcaatggtacccccggtctcttcctcagcggtttccaaatcgagcgtcccatcagcgagctgctcttcactctgctggcccagcgcagtggcgtcaatgtcttccacggccgccaggtcgacttcaacggcagcaccatccggggcggattccagaacaacagggttgccatcaaccccggaaagttcgacggcaagcctgccacaaccatcgattcctcccttctcgtcgatgccaccggtcgcttccgccagttggcttccaagaaagcctccctccaccgttttgaaggctggaactacgacgccttctggggctacttcacggcccccaaggatgaaagcaacattcccttccgctactacgagggtgaccacaccaaccatctgtgcttccccgagggctgggcctgggtcatccgtctcccctcctgggagggcagccccatccccaacttgatggacatgatctcgtacctgctcgactgcgccgaggctggtgtccccggcgaccagatccccagctccgaggagctcgccaagatgtttgaccttaagttccggtgggttaccagcatcgggttcgccgtccgcaacgatgtcaagtacccagaggacatgtccgcgtacggcacccgtgaggcggagcgcaagttcaactactttgttgaaaagtatgacctcatcaagaagttcatgagcaacttcgagctcgttgaggatctctatggaccgggaacgacgtggtacatccgcaagtctcttacctaccaatccccggtcgtctcgggccctggctggcttgctgtcggcgacgcctgtggcttcaccaacccgctgcactgtcttcaccacggggctggaaggagccgcgcc

SEQ ID NO: 5183 - DNA, 1290 bp, A.fumigatus
ggcgcggctccttccagccccgtggtgaagacagtgcagcgggttggtgaagccacaggcgtcgccgacagcaagccagccagggcccgagacgaccggggattggtaggtaagagacttgcggatgtaccacgtcgttcccggtccatagagatcctcaacgagctcgaagttgctcatgaacttcttgatgaggtcatacttttcaacaaagtagttgaacttgcgctccgcctcacgggtgccgtacgcggacatgtcctctgggtacttgacatcgttgcggacggcgaacccgatgctggtaacccaccggaacttaaggtcaaacatcttggcgagctcctcggagctggggatctggtcgccggggacaccagcctcggcgcagtcgagcaggtacgagatcatgtccatcaagttggggatggggctgccctcccaggaggggagacggatgacccaggcccagccctcggggaagcacagatggttggtgtggtcaccctcgtagtagcggaagggaatgttgctttcatccttgggggccgtgaagtagccccagaaggcgtcgtagttccagccttcaaaacggtggagggaggctttcttggaagccaactggcggaagcgaccggtggcatcgacgagaagggaggaatcgatggttgtggcaggcttgccgtcgaactttccggggttgatggcaaccctgttgttctggaatccgccccggatggtgctgccgttgaagtcgacctggcggccgtggaagacattgacgccactgcgctgggccagcagagtgaagagcagctcgctgatgggacgctcgatttggaaaccgctgaggaagagaccgggggtaccattgctgcagaagtcggtgtagtggccctggttttcacggtcgaggaaatagaagcagagtccatccttgaggccgaagagccgcagcatgtactcggcggtcaagccgtgcatcttgcaccacagggagaagagagggagcgtgctctccccaatcttgtagcctggcttggtgcccttctcgatcagggagatgttgagcttgcctggcttgtacttggcagcgtgaatcgcgtagatgaggccatggataccaccaccagcgacaacaacgtcggatttctcagggatgtctgcacctgccgggttgttggagttgaggatttgtgcatcgttgagattgttggcggcagcacgctcagcaaaggtgtgcttaggggtgggcttggtcacagtcattttggtagtgacagatgttaa

SEQ ID NO: 5184 - DNA, 231 bp, A.fumigatus
ccaagagctgtgccgcatctccgattggcttacgtcaccactatgtacaacatgatggccagagaatgtgcagagaatcagcagcattggctacctttacgggaatcaagaccgaaaaatttaggcacctggtttcttgtaaccaaaaagctcatgatctactacttgcactatccaaattgtaagcataaggcagatccgacggcccgcggggatctaccaagcgaataa

SEQ ID NO: 5185 - DNA, 411 bp, A.fumigatus
tccaaaaccagcatgcaggcccttctccgccgcggcacctcgctattcggctcgacgccatccggctcccccaaggagagcgggggtatcgatgaattccgcaaggcgccgtcgcccgatgtgttgttccccaaggttgacccggctgttgacggagaggaatgcctccacgactgtgcgtcgtgtacggtgaagtatccagccaagttcgacgtggactacgaggatgagctctatgggcacgtcaacgggtgggcgacgcatctgctcgtcgcgaccgggaagacagactgggtgagggatgttgcagacgagaagggcagtttgatggaagcgatcgagaagggaggacttgtgccgagcaatggcgacgtcgtcttctcctcagagccgccgatccgcgtagtgggg

SEQ ID NO: 5186 - DNA, 1176 bp, A.fumigatus
  unsure (29): Identity of nucleotide sequences at the above locations are unknown.
ggaaggaaaagctttcttatcccaccggngattggtctaattcttggtcgtgttcttcgaattttgaactttcccttccggcccaacagtatccccttctgccggccagcccttccacatccccatcccccggagtccaatacttccgatgttgatcaggatgacaagatcagggtcttggacgctccagctggcaacccgtccgaggacctgaacgctgaagatcagcgcctcttagataactggtgcaactccacggaacagtccctcgcgcacagcaaaagtaaggaccgcccatggcaggccatcatccggcgcgaggcatcccggcaccctgctttgaggcatagcacgctggccctgtccgccatggaactcgcatcgaccagtgaggctggtacgccgcaacgccagcgtcacttgcaggcggccgaaagtcactacacccaagccacggagcagctcccgaacatcctagactctcgtacagcatccgggcccaacgcagcattctccactgcaagtattcttttcatgtgcgacctcgcgtcctctgcgctggccggagagggctccaagtccgttttcccgtcgcccgacaaccagacccccgcctctcaggagagtcccgacccgtcaccttccgcctgtccttccctgcagaagctcctcgacctcttcgacaccatccgggccttactgccttgtgccgaaaccctaaacaaagtggaaaccggcgccctcaaagaccttttcacccagggagacccctaccaccaactgcccagcacctacaccctcaccatcctctccatgaagaacctgaacgcgctcagcgcgcgaagcgaccccgcgcacgagacggccgtctataacgacaccatcgcacacctggacaactcgctcgaaatgctcaccaagggcggcgatccgacgaccatcgccctgcgctggatgtttcgcatccccagtcgctatctggatctcgtccgggagaaacaacccctggcgctcatcatcttcgcccattactgtgcggtgttgcaccacctgcgcgaccgctggtggatgggcgacttgggggcgcggttgttgaaggagatctgtcggcttcttgggtcggcgcggatgggctcgattctatgggccacggatatcgtaggcatccagacgtaa

SEQ ID NO: 5187 - DNA, 408 bp, A.fumigatus
ctatgtgggttccatttcacaggctcggaggccgttgatgccgcaatgaagctttcccaccagtactttgcagaggaaaatccagacacccgacgaaccaagtttatctcgagacgcggttcttggcatggttgcaccttggggtctctgtccttgggagacttcaagccgaggaaggctcggtttaaatcaattctacatcccaatgtcacccacgtatcagcatgcgacccgtaccatgccctcaaagataatgaagatctggagatgtatgtggctcgacttaagcaggagctcgacgaggaattccaaaggcagggacctgacaccgtctgtgcatttttccttgagccagtggccggaacagtacgcgactctctatgtcttattggacttgacatacattaa

SEQ ID NO: 5188 - DNA, 1116 bp, A.fumigatus
agctttcccaccagtactttgcagaggaaaatccagacacccgacgaaccaagtttatctcgagacgcggttcttggcatggttgcaccttggggtctctgtccttgggagacttcaagccgaggaaggctcggtttaaatcaattctacatcccaatgtcacccacgtatcagcatgcgacccgtaccatgccctcaaagataatgaagatctggagatgtatgtggctcgacttaagcaggagctcgacgaggaattccaaaggcagggacctgacaccgtctgtgcatttttccttgagccagtggccggaacagtacgcgactctctatgtcttattggacttgacatacattaaccgctatgaaatccaggctctaggctgtgttgctgcagtgcctggctacctgaaggccatgcgggaagtttgcgatcgctacggtgcgcttctggtctttgatgagatcatgtgcgggatgggccgcaccggagccatacacgcttggcaagtggacggtgttgtgcctgacatccaacttgtgggcaaaggtctcgcagcgggatacgggaccatatctgccctccttgtcagcgatcgcgttgtttctgggctgaagcagggcggaggatactttgtccatggacagacctaccaatcgcacccgcttggttgtgcggctgcagttgaagttcagcgcattgtcaaggagtataatctagtcgacaactgtcgaaaaatgggtgagtatctcggaatggaactgaaactgcatctcggagatcatccacatgtgggtgatattcgagggagaggcctcttctgggcagttgaattcatggaggataaggatagtaagactccgtttgatagtaaccttaccctcagcaagcgcctacagaccaagggactagaaaagggctacgacatctgtctattcgcagctaccggtgcggtagatgggtggaacggtgaccacttcttgcttgcacctccatacactgttggaaagcaggatgtggacgagatagtgagtcgagttgttaaggttattgatagtgtctttgaggatatctacgctttgaggcagcagcatcctcaccactcaggcttttga

SEQ ID NO: 5189 - DNA, 1257 bp, A.fumigatus
cctaatttgttgcaggacgtgagcctgcatgtaaacgattgtctcgacgggaagcctacggctaactcagctgaaacacactcaaacgctccgaggcaagcactatcgcggtccgatcgggctgccgttccacgaccagctcaacgtgacccattctcgtcgggcggtataaagtcaagatcagccttttcaatgatcatggctggaaacgctgaggacgctgcttgggcaagtgccgcggcaggagaggttgcgtcccgcgggaagcaggcttatcaacggacttgtccgttctacaagatccttcctaatttttccatctgcgtggatgcgtttcgctatggcgccgtggaaggctgtaacgcctattttctcagtcactatcatagtgatcactatatgggtctcacatcgtcctggcgacatggccctatttactgtagcagggctacagctaatctagtgcgccagcaactcaaggttgatccgaaatgggtggtagacctgccatttgagaagaagacagaggtccctggaacgaatggagtgcatgtcacaatgatcgaggccaatcactgccctgggagcgccattttccttttcgagaaacagatgggatccggaccatctgccagagtacaacgaattttgcactgtggagactttcgagcatctcccacacatgtgcaacatgtgcttctgcgtccggaagtagatgaccctactactggtcaacgccgccaacagaaaattgacgtttgttaccttgacacgacatatttgagtcctaagtatgcgttccccagccaggaggatgtcatcgaagcatgcgcgaatttgtgtgtcagtctcgaccagaatccggaacaaggtgtaggtcagagtctgttgcagaaggaaagctctggtgcagggaaggttatgagccggttcttttctgcgatgagcggatcccgtggcaactcagacaaacaggccgcgcaggctcaggggcggttgcttgtcgttatagggacatatagtatcggcaaggagcgaatatgtctcggtattgctcgagcactcaagagcaagatatatgcgacgcccgccaagaagcgagtatgcgagtgcttagaagacccggaattatcctcactactcaccgataatccagctgaggctcaagtgcatatgcagacgctgtttgagattcgtgcagaaactctggccgactacttggactcaatgaagccgcatttctcacgcgttgtaggc

SEQ ID NO: 5190 - DNA, 243 bp, A.fumigatus
ggaaagagggcatcgagaaaaacttctgggccaaagcttgaacaacttcggaggagcccgaaaaccagccctaccttcccggagaagattctctggcgtcagaaggagcaattcagcgacggtgtcggtaacagctggattgacggcctgaaggatcagccggagaagcaaatcacagatgagatgatgaagaaccccaagccggaatggggtaacgatatccctgacaccaaggaagcgtaa

SEQ ID NO: 5191 - DNA, 279 bp, A.fumigatus
caccaaggaagcgtaagtccacctatctcagaagcccaggttggagacataagtctaacaacaactttcaggtactggtaccgcatgatgtttgacgagcacttccccccaacgtgcgcgtccaccgtcgagcgttggacaccgacatggtcgaaacagaccgaccccagtggaaggtacgggccccaactcatatttggtcaacgcttttcccatgctgatacatcaatctccagagctatcgcaatccacgctgccaagtatgagcacattgagtaa

SEQ ID NO: 5192 - DNA, 819 bp, A.fumigatus
atactagcgcggagcgtcgctccctgtggtgaagaatgggtgcaattcttctatcgacataaaccatcggataccgtacctgattcccttttgggcaatgatgtatgtattacgacccaaccgccaccatcaatccaacacaaaaattgtaggaaaggcaactcaaccgtccaaatttgtgaaaacaacaacaaacgcagttatgagcaaccgagaatgccacgagattcgaacaacctccccaccaccaaacgctacatcaccacccacagcaccgagggcgagtcggtgttcatctcccactctcaaatcccagaatacatcccttcgaaaccgatcagcgacgatggggatattgctcttctctacgcaacagtatccaatcctgtttctgtagatgacgaaattgacgtccaggcttacgatgagtaccttcatacctcgcctggactgacgacttcgcttggcacggtcctacaaacgatcgatctgcatccggggaagacgagtcccatgcaccgaacggttagcgttgactacggagtggtcttggaaggcgaagttgatttgatcctggattctgggcaaagtcggacattgcggcggggggatgtgagtatccagcgagggacggcgcattcgtataaaaatcggagtgatacggagtggtgtcggatgttgtttgtcttcttgccgatgcagaagttgaccattaagggtcgagatctagaccaagaagtgtatgacgagcactatgatcatgacactgggagtgagaatgaatcgcaagggggaaatgggaatggaaagggctcttga

SEQ ID NO: 5193 - DNA, 744 bp, A.fumigatus
aaggatttatcttctccgccatcttttccccatggcgaacgttcttcttggaccttgtcatcttctcaatctctaactcggttgtgcatgtggggaaacaccgcataccgacgcgagatgatctcccacaccggccccagcttggagaaatccgactccaagatcgagtcgcatccctcccggccatacggggaagacgtggcgccctatcccaaggaggatgcgctgcagctcaatgttggtggccggggtgccactcagcgccgcctgaagaactaccaggtgacgatgatcgggttctgcgggggtattggcaccggtctgttcgtgggaacgggtgcggcgtatgccaaagctggtccggctggtctgctactggcctatgcagtcgttggtctggtgctgtggtgtgtgatgcagagtatcgccgagttggcgacgctgctgcccaccgccggatcattcccgcactgggcgacacgcttcattgatccctctgttggtttctcgctggccatctcgtacggctactggtacaccattgccatcgcgtccgaagtgtcggcggcggcggtgattgtctcttactggacggacatcacacccgcggtggtcatcaccgtgggcctggtgctgattctggcgatcaatgtcatgaatgtgcgattgtacggtgagacagaagtcctcgccggtagcgtcccagatcctctgcttcttcggatgtgcctaaccgccgggcca

SEQ ID NO: 5194 - DNA, 426 bp, A.fumigatus
  unsure (332): Identity of nucleotide sequences at the above locations are unknown.
gtaggtttcaagggccaggcccgtgtaattcttcccactctatcctcatgcattgaatgccagctagatatgcatgctcctcgacctgctgttcccctttgcaccattgccactatccccagacagcctcagcattgcattgagtgggctcaccaaatcgactggcaagagaagcgcaaggacgaccctttgacagcgatgaactggaacatatcaactgggtttataacgcccctctttgaaagggcaatcaattccacatccaccggtgttacctttcaaatgacccaaggcgtggtccaaaaatatccatcccgctattggcttccaanaaaagccgtcctccgcaacccggaaccaagtctcgaagcacttgaaaattccctacctccccggaaccccttaacttggataacttttttaatt

SEQ ID NO: 5195 - DNA, 366 bp, A.fumigatus
acatgggtaagtgtttctatcaccatacgactttgcgttggtctgactccaaaagatacaattgatatctccaatttgaaccggcagtttctgttccgacaaactgacatcggcaagcctaaggcagaggttgctgcatcattcgtggagaagcgagtcaaaggtgtcaaaatcacgccatatgtcggcaagattcaggataaggacgaggattattacatgcagttcaagatcattgtatgtggcttggatagtatcgaggccagacggtggatcaattccactcttatcgggatggttgatccggaaaatcctgagagtctcaagcctctcattgacgggggaacagaaggtaaagtcatctga

SEQ ID NO: 5196 - DNA, 186 bp, A.fumigatus
cccactaggtacggagtatgtgaggaaatcgcgcaaacatccggcaatccgctttgtattgttttctcgcgctcgactacggagtactatggctcgattctgtcctcttctagaagtgctcagtatcgagctacctacgtccaggtagatttgctggtcacatcgtactatcgaagtccctgttaa

SEQ ID NO: 5197 - DNA, 624 bp, A.fumigatus
  unsure (610): Identity of nucleotide sequences at the above locations are unknown.
agcgaatgtcttctacgggaacgtgatacttcacatcgacgcagccacgtgctcaaaatcgacgattcatccctcccttctggcacagtcaccccccagatccacaagatgacagacgacaaggaaacacctgcagaagaagaggtggtggaatccctcattcagggacgcgcgagacgaagtacagcagggcgtcatctatccgcgcttctgaacgctgaagcagacgacgagctcgcgctactgttcgaggaagtagacgatgacaatgaattttcaattgacgcagaggaagaagcagaagaggatgacatggctttggactcatcttccgatgacgatgaagatcaaggcccaaacgcgcgcagcgatgatttggaaggtgagaaggagatcgaaaaggaagccaaggccgaccgacagaaacgcagagcacgcgaagatctacgcctgaagctggcccggaagaaggtcaagatcgatccctccgccgtctctgccgtctccgcagtacctgcccctcgacccaagaagaaatcagaacgtatctcgtggcttcccacggttgaagatcggcctacgcggtcgttgtgtacacgccggggcgaanagaagagccactgg

SEQ ID NO: 5198 - DNA, 258 bp, A.fumigatus
tctctcaggatgtgcgagcagaaattgcaaccgaggatcatggcttttgcacaactgttcgaaaaaaaactcaacgaccatggttctgacgatctctctctcacaggccttcattcaagatgcagatctttgtcaagacccttaccggttaagactatcaccctcgaggtggagtcttcggacaccattgaaaatgttcagtccaagatccaggggtaccccacccctccaagcatcctggctgcagaagactcctga

SEQ ID NO: 5199 - DNA, 231 bp, A.fumigatus
tctgcagatcggcgggtgcatggtcccactcccacaaagggggcaaaagggtcggaagccgcgggactctatggatttggacagagtgcttcaactgttggcatgaacaaatcgatttgtgcaactgccatgatcatcatctccaatgtccatatcctaagaggagatgtattcatcattctctacagcaggcagcagctcaacaagttgcacctagactctgcaagttga

SEQ ID NO: 5200 - DNA, 900 bp, A.fumigatus
attttgacaagagtcatccaagcaagttcctccaagcgcacgttcattgaattagaagcagagcacaagacccagatgccaccatacctatctatatgcacccaagtcctgcgttctattgcagaagcaagcggtcatcaggccacttcgacaatgacaagtagggaggctttgactgtggcagtcgcatcagttctcttggctcagaatcaaaatgaagcatccaaaaagataatagctattctgctattgcatctggcttgcctcaaacgattatctctgcagcaacgaagaaccgcgagcctcgagataccaaatgaggggatgtacaacaagttcgttagaaagttcagcagggcggcaacgatcatgcttcaaacgaacgaatggaaaggcttaaatataattaaatcctggggagatttgcatgacctgtttgatggcaggctttttaggtcatgtgctgcgtattactcggtggagaaagtagcacacctgagcagccttatcaccgacgattggcatactgtttggacctgtttgaatcatattgaagaactaggtggtccggaagtattcttctctcagaactttccgtacacagcgacattgcagcatgaaggacgaatcttcgatgacgaacatgaagacaaccaagacgatgaggaggacgagggggatgaggaagaaggagacgaagaaggtgaagatgacgaaacagatggagatgaggcaacaaatgaagaggatgaagacatggaaagcaagtatgccttgttgccgttcgaaaacctaacatttgatcaacatctcgccagcgtacgcgtagtcatagaggactcgcagggggaatatccagagcgagccttttcaccacgtagcaagcagatccacgattaa

SEQ ID NO: 5201 - DNA, 390 bp, A.fumigatus
gtacaggaccgcacactattgttactgatggacgacacagagaaccaagggatttctacccaagccgcctcgaatatcgatcgctccaagtatcagttggcgagggagatcatctatcagcatctcaaggtgcacattcaggaccagtaccctgatcttcaagttcaccggtttccctctatgagatctcctgaattccaccagcacgtccaaacatatagtgtctacttcgtcatgtgccacaatggagtactgcagaatagacgtcggctcattgatgatacacttcgtgttatctgtaacatgatgactcttgggctggatgtggcaatcatcaatgagattgagtggcgtgatactaaggttcgtatctttcccctgtcagtgtaa

SEQ ID NO: 5202 - DNA, 312 bp, A.fumigatus
acccccggccctacagtccctggtgctacaggaagtatagactttatgagggaactcagggccatggttgataatatcaacttcctagttatacttatcaccttggggaaccctaagggcaacctgcttgtaactgtttggtggatctctgctgttggtgaatttaatggcttttccatctatgattatctcaggaggggcttctttgcctggtttaataaagaatggcctagactgttttcctggaacagctacctaataaaataccttgtaatggcaattattttggattttggctttgctgtcagttag

SEQ ID NO: 5203 - DNA, 330 bp, A.fumigatus
atattactctccaactacttgagcagacatcagagtgcttttttcagtatgaggtgtttattcctattccttgcagctgccctcatggcacccaccctagccatctctgaacctgcctggatgaaatacctagctggactagatgagccagcagatgcagctgaacaaattaatctcaactatttagctcatctggctgacatagccgattccgttggtgtggccaatccagtcagcctggatgaactggcttacctagctaagcttgcgtatctaactgacagcaaagccaaaatccaaaataattgccattacaaggtattttattag

SEQ ID NO: 5204 - DNA, 744 bp, A.fumigatus
atcagcgctgtagaagccaaggtgccaacgccaccattgtatttgcagatttgcagtagctggtacttgccaactaatataaaggtgtgtagacccgagcggcagttggcctgcaatatcgaacctcaacctttttgtagttccccatcgattcatccaatgttaacaatggccgaggcgtcaaacggccagagacgagacccaagcaaagtgcaggcatggctcgtgggcagtgggatggcttgcctggcagcggctgttcatctcattcgcgagggcaaccttccaggtaaaaacgtccacattctcgatctacatctggggtttggtggcgaaatgggaacctcgggagatgcgcaaaacggctatttcgttcccttcgagtgccatccctattttcatggcgactgtatcaaggatctgctatctattgtaccgagccccggtgagccaggcaaatccatgatggacgatatttactcgcttgaaaagaatgagcggcgaccgccgcaggactcggggatgacgcgggcaatcaagctggggaagctgggacccgaagtcgttcacttcaggggcatccaggtgggattaaagcatcgattggagctgatgaagttcatcatggagagcgagacgagcttaggcgcgaaaagcatcaatcagatcttcgaaccgtccttctttgaaactggattctggacgcgatggtcaacagcgtatgccactcaatggcacccttga

SEQ ID NO: 5205 - DNA, 204 bp, A.fumigatus
aaccacactctttattcctggctgtccacaactttcacgatacccaagggatgggaacatcagaacgtgctgttgaacttcggtgctgtggactatgaggcaaccgtttttgtcaatgggaagcaggctggcttcaatcggggaggatatttttccttttaccctggacatcacgcaatttgtctccttcgacggcacgaatga

SEQ ID NO: 5206 - DNA, 240 bp, A.fumigatus
attgtgagaaacttagcccagtcttatttccaagctgactctatcaggttggtctttgtgcacgatcccactgacagcggtgactatgtcataccaattggcaaacagagactcatcccagcccatatcttctatacgccctgcagcggcatatggcagagtgtctggattgagtctgctccagccaactatatcacggagttggacattagtgctgggatggacggtcaaggtgcgtga

SEQ ID NO: 5207 - DNA, 369 bp, A.fumigatus
agattatttcttaggaaactgacagcaaaagtcaacgtaaccgccgtcagtgccagtggaaaatcgatgccggtggacattacagttttcgatggcagttcagataagaaggttgcattccacaagggtacatctgaccaacccttcagttttaaggttgagtctccgaaattgtggtcgccggattctccgactctgtataacattagcgtcaagatgggagcagatgaggtcaagagttatactggcttccgtactatatcgaaaggaacagtcaatggcatcttgcgaccattgataaacggcgaatttacatttgtgttcggtacgcttgacttaggaaatgacccgaatgtatggactcttaac

SEQ ID NO: 5208 - DNA, 216 bp, A.fumigatus
cgaacgccgccaccgatggatttgcgaaaccagcgagccttctttatgaattcagtggatccgacgatgatgctcccaatcggtgctcccaagccttttgagaagcagagactcacactgtcgaacaggccagcatattctggcaagctgccggctccagaaaccactgcttcccaaagtctcgcgccgtccaaatgcaccttgactccgttctga

SEQ ID NO: 5209 - DNA, 1152 bp, A.fumigatus
  unsure (1111): Identity of nucleotide sequences at the above locations are unknown.
acagcgctcgcattctacgccggcaacttcttgccttccggccacattctcccgctcaaacgttcggagggaatcgagtatttgccatggcgagcacttcagcccgtctcgatgggaccaatggcaggatcagtagttggcagggtgccggcgcagcagaattcgacttgcgaagtgagttctttgcagtgcagtggaagacacgaggaactaatacggaagaacacccaaggcgacacgatgaccaagcctaccccatcgatgctcgaagcaatctgtcagacaaccttgttggacgacgtttttgaagaggatcctgtgacaaatgacctccaagcctacgtcgccgaacggactggccatcagagcgccttactcgtcatgtcggggactatgggcaatcaggttgcgattcggacacatctcgtgcaacctccttactccgttctctgtgatcatcgctctcacattgtgcgctacgaggccggaggcgtcagctctctgacaggggccatggtacaacctatcgtgccgagtaacggtattcaccttactctagaggacattcaaaagcacgcagtgctcgatgaagacgtacattactgcccaacaaagcttatcagcttggagaataccctggatggcatggtgatgcctctggccgaagctcgtcggatcacagaatgggctcatcagaacggagtcaaggtgcatttggacggcgcgagactttgggaagcagtggtttctggagccggcagcttgccagaatatgctggcctgttcgacagtgtgagtctctgcttctcaaaaggcttgggagcaccgattgggagcatcatcgtcggatccactgaattcataaagaaggctcgctggtttcgcaaatccatcggtggcggcgttcgtcaggctggggtaattgctgcggctgcgcgggtggccctcgaggagactttcgggccagatcccaacggtcagaagggtaaacttcgagaaactcacatcaatgccaagagagtcgctgagatgtggacaacccgtggcggcaagttgcaacatccagtacataccaacatggtatggctggaccttgaatcctctggtgtangtcccaatgaccttgctgagatcggaaggagcttggcctca

SEQ ID NO: 5210 - DNA, 966 bp, A.fumigatus
catcaagagctacctcaaactgacagaccccgacgacaagtttcctacactgtcacgcaagagcgattctggcttggtaagtttccagtgaattatcgtgtgcatgggttgtcggtacatgctctttctccacacaatgttccttcctctgatcccgctctcagcccgtggataccatttttctttgtcattttgtatctggtcgactttgctgattattatcctcagctgtctgcaaactcggacgcgttggatctagcaaattcgcgtactcctaacccagagacttggaactcacacagccgccatcgctcctcccatcagagcatgcctcagaacgccctgaacatgttccgtcttgatcagctcggaaactctactagcgagagccacgctcaagcgtccaaccctgctcgtcacattgcgagacactccctggaagcaaccctcttacacagccaggaaggaggccacggaaatataggtccagctgtctcaagtcgtccaacttcgctccagacgtcttactccacgaacgacgtgcccactatccagggagacggattcaaccctgcgattacgcccccccaggcgcatgctgagagttttcagcaacataacaacacgccgggcagaattcccagcccaattccattggcactcagcagaaggacgccgtggcaacatgatgagcccaagcctcagaactctctgactcagcagacgaccttgcaggctagtgctcctccttttggaccacagcttactgctgccgcagtaacccaaaatacggttactccgactgcgatgactgcgttcccagcgcctttctacgggtatggaatccaaacatacatgggaaaccctgtacaggtcaatggccaactccagaacttcagccccaccgccccctacggtgcttatcctccttacggtaactatcgactggcagaaggtcaagcctaa

SEQ ID NO: 5211 - DNA, 222 bp, A.fumigatus
ggcgttgctgctcgcagaagcggtgacggagactctaaccaactgtctcgcttcaccaattttccgctggagcattatcggggcgagctgtacaccctttgcaaagatcagcatggctgtaggtatctgcagagaaagctggaggaacgtaaccctgaacatgttcaactcatattcgacgaaactaatatgcacgttgttgagctaatgactggttcgtaa

SEQ ID NO: 5212 - DNA, 519 bp, A.fumigatus
  unsure (496),(513): Identity of nucleotide sequences at the above locations are unknown.
aacttaccccacttgcatctggagaaacatttgtcttctaacattgtcccaacagatccattcggcaactacctgtgccagaaactgcttgaattctctaatgacgagcagcgaaccgctttaattaataacgctgccaaccaacttgtgaaaatagccttgaaccagcatggcactagagctttgcagaagatgattgaattcatctcaacccccgaacaaatccagacggtcatccaagctctacgtgatcatgttgtggagctggttcaggacctgaatggcaaccatgtcatccagaagtgtctcaaccgtctttctgccgaagacgcacagttcatctatgacgccgttggcgccaattgtgtggttgtcggcacccatcgacacgaatgctgtgtcatgcagcgatgcattgaccacgcctctggcgagcagagagctcgtttgatgtcttcaccacgggggtggaagtaccagcggggtcaaaaaggtnttacaaggctttcatanttccgc

SEQ ID NO: 5213 - DNA, 285 bp, A.fumigatus
ctgactgacttcctctaccccaggattcaccgctattcaatgccctccactggtctaggatcacagattcgtcctaatattgctgcgttcagcaacacctcaggcctggactccttctctgctgcgaagtacttgttccacaacgaggacgacagagccactgtgacagaggaggatcgaattcctacccctgacatcaagagctacctcaaactgacagaccccgacgacaagtttcctacactgtcacgcaagagcgattctggcttggtaagtttccagtga

(The sequence listing continues in the following parts.)

The invention claimed is:

1. An isolated nucleic acid encoding an *A. fumigatus* polypeptide consisting of SEQ ID NO: 42779.

2. A recombinant expression vector comprising the nucleic acid of claim 1 operably linked to a transcription regulatory element.

3. An isolated host cell comprising a recombinant expression vector of claim 2.

4. A method for producing an *A. fumigatus* polypeptide comprising culturing a cell of claim 3 under conditions that permit expression of the polypeptide.

5. An isolated nucleic acid consisting of SEQ ID NO: 20623.

6. A recombinant expression vector comprising the nucleic acid of claim 5 operably linked to a transcription regulatory element.

7. An isolated host cell comprising a recombinant expression vector of claim 6.

8. A method for producing an *A. fumigatus* polypeptide comprising culturing a cell of claim 7 under conditions that permit expression of the polypeptide.

9. An isolated probe comprising a nucleotide sequence consisting of at least forty contiguous nucleotides of a nucleotide sequence consisting of SEQ ID NO: 20623.

* * * * *